United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 106

SEQ ID NO: 3760627 - RNA, 13 nt, Salmonella typhimurium LT2
ggccagacaggcu

SEQ ID NO: 3760628 - RNA, 19 nt, Salmonella typhimurium LT2
ggccagauggcaaacggua

SEQ ID NO: 3760629 - RNA, 11 nt, Salmonella typhimurium LT2
ggccagcacaa

SEQ ID NO: 3760630 - RNA, 12 nt, Salmonella typhimurium LT2
ggccagcagcca

SEQ ID NO: 3760631 - RNA, 23 nt, Salmonella typhimurium LT2
ggccagcgacucgguaaccaucc

SEQ ID NO: 3760632 - RNA, 16 nt, Salmonella typhimurium LT2
ggccagcgcaggcugg

SEQ ID NO: 3760633 - RNA, 13 nt, Salmonella typhimurium LT2
ggccagcgccggc

SEQ ID NO: 3760634 - RNA, 14 nt, Salmonella typhimurium LT2
ggccagcgccggcg

SEQ ID NO: 3760635 - RNA, 20 nt, Salmonella typhimurium LT2
ggccagcguggaugaacuca

SEQ ID NO: 3760636 - RNA, 11 nt, Salmonella typhimurium LT2
ggccagcguua

SEQ ID NO: 3760637 - RNA, 15 nt, Salmonella typhimurium LT2
ggccagcucucgccg

SEQ ID NO: 3760638 - RNA, 16 nt, Salmonella typhimurium LT2
ggccaggcauccggcc

SEQ ID NO: 3760639 - RNA, 20 nt, Salmonella typhimurium LT2
ggccaggucguccguugcca

SEQ ID NO: 3760640 - RNA, 16 nt, Salmonella typhimurium LT2
ggccaguagcgggggc

SEQ ID NO: 3760641 - RNA, 22 nt, Salmonella typhimurium LT2
ggccaguauuggccucggggcg

SEQ ID NO: 3760642 - RNA, 14 nt, Salmonella typhimurium LT2
ggccaguuuccuga

SEQ ID NO: 3760643 - RNA, 12 nt, Salmonella typhimurium LT2
ggccaucaacuu

SEQ ID NO: 3760644 - RNA, 12 nt, Salmonella typhimurium LT2
ggccugcuccgu

SEQ ID NO: 3760645 - RNA, 13 nt, Salmonella typhimurium LT2
ggccugcugcaga

SEQ ID NO: 3760646 - RNA, 16 nt, Salmonella typhimurium LT2
ggccuggagaucagca

SEQ ID NO: 3760647 - RNA, 16 nt, Salmonella typhimurium LT2
ggccuguaccgcuucc

SEQ ID NO: 3760648 - RNA, 17 nt, Salmonella typhimurium LT2
ggccugucuccgcagca

SEQ ID NO: 3760649 - RNA, 22 nt, Salmonella typhimurium LT2
ggccuucuuguuuucuacucuu

SEQ ID NO: 3760650 - RNA, 21 nt, Salmonella typhimurium LT2
ggccuuguagcgcugcccaau

SEQ ID NO: 3760651 - RNA, 12 nt, Salmonella typhimurium LT2
ggcgaaaaacca

SEQ ID NO: 3760652 - RNA, 18 nt, Salmonella typhimurium LT2
ggcgaaaagcuggcugac

SEQ ID NO: 3760653 - RNA, 15 nt, Salmonella typhimurium LT2
ggcgaaaaucggcag

SEQ ID NO: 3760654 - RNA, 14 nt, Salmonella typhimurium LT2
ggcgaaagcacuuc

SEQ ID NO: 3760655 - RNA, 18 nt, Salmonella typhimurium LT2
ggcgaaagcgaccggcac

SEQ ID NO: 3760656 - RNA, 12 nt, Salmonella typhimurium LT2
ggcgaaauagac

SEQ ID NO: 3760657 - RNA, 14 nt, Salmonella typhimurium LT2
ggcgaacagcccca

SEQ ID NO: 3760658 - RNA, 20 nt, Salmonella typhimurium LT2
ggcgaacaggcucagcgcca

SEQ ID NO: 3760659 - RNA, 12 nt, Salmonella typhimurium LT2
ggcgaacauaag

SEQ ID NO: 3760660 - RNA, 19 nt, Salmonella typhimurium LT2
ggcgaacauuccgcccagg

SEQ ID NO: 3760661 - RNA, 18 nt, Salmonella typhimurium LT2
ggcgaaccggcaucggca

SEQ ID NO: 3760662 - RNA, 24 nt, Salmonella typhimurium LT2
ggcgaaccggcaucggcagcguca

SEQ ID NO: 3760663 - RNA, 17 nt, Salmonella typhimurium LT2
ggcgaacgcuggcuggg

SEQ ID NO: 3760664 - RNA, 16 nt, Salmonella typhimurium LT2
ggcgaacucggucagg

SEQ ID NO: 3760665 - RNA, 18 nt, Salmonella typhimurium LT2
ggcgaauaaauucuucau

SEQ ID NO: 3760666 - RNA, 13 nt, Salmonella typhimurium LT2
ggcgaauagcgcc

SEQ ID NO: 3760667 - RNA, 16 nt, Salmonella typhimurium LT2
ggcgaauagucgccgc

SEQ ID NO: 3760668 - RNA, 22 nt, Salmonella typhimurium LT2
ggcgaauagucgccgcggcgca

SEQ ID NO: 3760669 - RNA, 13 nt, Salmonella typhimurium LT2
ggcgaauauagcu

SEQ ID NO: 3760670 - RNA, 23 nt, Salmonella typhimurium LT2
ggcgaauccccaucuccagacga

SEQ ID NO: 3760671 - RNA, 16 nt, Salmonella typhimurium LT2
ggcgaauccuaaacuc

SEQ ID NO: 3760672 - RNA, 13 nt, Salmonella typhimurium LT2
ggcgaaucgccug

SEQ ID NO: 3760673 - RNA, 16 nt, Salmonella typhimurium LT2
ggcgacaagaauaugg

SEQ ID NO: 3760674 - RNA, 20 nt, Salmonella typhimurium LT2
ggcgacaagaauaugggugu

SEQ ID NO: 3760675 - RNA, 16 nt, Salmonella typhimurium LT2
ggcgacaaucucaccg

SEQ ID NO: 3760676 - RNA, 13 nt, Salmonella typhimurium LT2
ggcgacagccgcg

SEQ ID NO: 3760677 - RNA, 14 nt, Salmonella typhimurium LT2
ggcgacagccgcgu

SEQ ID NO: 3760678 - RNA, 17 nt, Salmonella typhimurium LT2
ggcgaccaguuauucgg

SEQ ID NO: 3760679 - RNA, 19 nt, Salmonella typhimurium LT2
ggcgaccaguuuagcuaaa

SEQ ID NO: 3760680 - RNA, 15 nt, Salmonella typhimurium LT2
ggcgaccauccacca

SEQ ID NO: 3760681 - RNA, 23 nt, Salmonella typhimurium LT2
ggcgaccgaacagaacagugagu

SEQ ID NO: 3760682 - RNA, 19 nt, Salmonella typhimurium LT2
ggcgacgauagucagcgca

SEQ ID NO: 3760683 - RNA, 19 nt, Salmonella typhimurium LT2
ggcgacgcgauagcgcagc

SEQ ID NO: 3760684 - RNA, 23 nt, Salmonella typhimurium LT2
ggcgacgcguggcaucuuaucag

SEQ ID NO: 3760685 - RNA, 18 nt, Salmonella typhimurium LT2
ggcgacggcggucgccgc

SEQ ID NO: 3760686 - RNA, 22 nt, Salmonella typhimurium LT2
ggcgacgguacaaaccccaccc

SEQ ID NO: 3760687 - RNA, 18 nt, Salmonella typhimurium LT2
ggcgacgguuuacgauac

SEQ ID NO: 3760688 - RNA, 15 nt, Salmonella typhimurium LT2
ggcgacguuagcgca

SEQ ID NO: 3760689 - RNA, 23 nt, Salmonella typhimurium LT2
ggcgacuaacgucuuauccggcc

SEQ ID NO: 3760690 - RNA, 18 nt, Salmonella typhimurium LT2
ggcgacuagucgcccgcu

SEQ ID NO: 3760691 - RNA, 17 nt, Salmonella typhimurium LT2
ggcgacuaucgccgccc

SEQ ID NO: 3760692 - RNA, 21 nt, Salmonella typhimurium LT2
ggcgacucauuacgccacguu

SEQ ID NO: 3760693 - RNA, 23 nt, Salmonella typhimurium LT2
ggcgacuuucacgaaaccggcga

SEQ ID NO: 3760694 - RNA, 22 nt, Salmonella typhimurium LT2
ggcgagaacucgucuuauccgg

SEQ ID NO: 3760695 - RNA, 15 nt, Salmonella typhimurium LT2
ggcgagcacugccca

SEQ ID NO: 3760696 - RNA, 17 nt, Salmonella typhimurium LT2
ggcgagcagaaaaaguc

SEQ ID NO: 3760697 - RNA, 16 nt, Salmonella typhimurium LT2
ggcgagcgaugcugcu

SEQ ID NO: 3760698 - RNA, 16 nt, Salmonella typhimurium LT2
ggcgagcuucucgccg

SEQ ID NO: 3760699 - RNA, 15 nt, Salmonella typhimurium LT2
ggcgaggcguaaaac

SEQ ID NO: 3760700 - RNA, 17 nt, Salmonella typhimurium LT2
ggcgagggaggcaaucg

SEQ ID NO: 3760701 - RNA, 18 nt, Salmonella typhimurium LT2
ggcgagguuuaccguccg

SEQ ID NO: 3760702 - RNA, 15 nt, Salmonella typhimurium LT2
ggcgaguuaagcgcc

SEQ ID NO: 3760703 - RNA, 20 nt, Salmonella typhimurium LT2
ggcgaguuuggugcccgcgu

SEQ ID NO: 3760704 - RNA, 20 nt, Salmonella typhimurium LT2
ggcgauaaaaauauccgcca

SEQ ID NO: 3760705 - RNA, 17 nt, Salmonella typhimurium LT2
ggcgauaaaccagcccc

SEQ ID NO: 3760706 - RNA, 18 nt, Salmonella typhimurium LT2
ggcgauacuccgacggcg

SEQ ID NO: 3760707 - RNA, 14 nt, Salmonella typhimurium LT2
ggcgauagccccag

SEQ ID NO: 3760708 - RNA, 17 nt, Salmonella typhimurium LT2
ggcgauagccccaguaa

SEQ ID NO: 3760709 - RNA, 17 nt, Salmonella typhimurium LT2
ggcgauagcgccccaaa

SEQ ID NO: 3760710 - RNA, 15 nt, Salmonella typhimurium LT2
ggcgauagcucgccc

SEQ ID NO: 3760711 - RNA, 22 nt, Salmonella typhimurium LT2
ggcgaucaauaaaauuauccag

SEQ ID NO: 3760712 - RNA, 21 nt, Salmonella typhimurium LT2
ggcgaucaccagcaccgccag

SEQ ID NO: 3760713 - RNA, 17 nt, Salmonella typhimurium LT2
ggcgaucagacgcuggu

SEQ ID NO: 3760714 - RNA, 13 nt, Salmonella typhimurium LT2
ggcgaucagcagg

SEQ ID NO: 3760715 - RNA, 12 nt, Salmonella typhimurium LT2
ggcgaucaggca

SEQ ID NO: 3760716 - RNA, 14 nt, Salmonella typhimurium LT2
ggcgaucgcuuucg

SEQ ID NO: 3760717 - RNA, 21 nt, Salmonella typhimurium LT2
ggcgaugcgcgagccguaaac

SEQ ID NO: 3760718 - RNA, 13 nt, Salmonella typhimurium LT2
ggcgauggcgcau

SEQ ID NO: 3760719 - RNA, 20 nt, Salmonella typhimurium LT2
ggcgauggucauuccagcua

SEQ ID NO: 3760720 - RNA, 20 nt, Salmonella typhimurium LT2
ggcgauguaacgccuuugcc

SEQ ID NO: 3760721 - RNA, 15 nt, Salmonella typhimurium LT2
ggcgauguuggcgcc

SEQ ID NO: 3760722 - RNA, 18 nt, Salmonella typhimurium LT2
ggcgauucauaugcgcca

SEQ ID NO: 3760723 - RNA, 19 nt, Salmonella typhimurium LT2
ggcgauucaucgacaaaua

SEQ ID NO: 3760724 - RNA, 16 nt, Salmonella typhimurium LT2
ggcgauuuuguaggcc

SEQ ID NO: 3760725 - RNA, 14 nt, Salmonella typhimurium LT2
ggcgcaaaaaauau

SEQ ID NO: 3760726 - RNA, 19 nt, Salmonella typhimurium LT2
ggcgcaaacaguacgcccg

SEQ ID NO: 3760727 - RNA, 11 nt, Salmonella typhimurium LT2
ggcgcaaaucg

SEQ ID NO: 3760728 - RNA, 19 nt, Salmonella typhimurium LT2
ggcgcaaccauuaccgcca

SEQ ID NO: 3760729 - RNA, 15 nt, Salmonella typhimurium LT2
ggcgcaauaacgaua

SEQ ID NO: 3760730 - RNA, 16 nt, Salmonella typhimurium LT2
ggcgcacacgcccagg

SEQ ID NO: 3760731 - RNA, 13 nt, Salmonella typhimurium LT2
ggcgcacagcgcc

SEQ ID NO: 3760732 - RNA, 14 nt, Salmonella typhimurium LT2
ggcgcacagcgcca

SEQ ID NO: 3760733 - RNA, 12 nt, Salmonella typhimurium LT2
ggcgcacaggcc

SEQ ID NO: 3760734 - RNA, 13 nt, Salmonella typhimurium LT2
ggcgcacaggccu

SEQ ID NO: 3760735 - RNA, 23 nt, Salmonella typhimurium LT2
ggcgcacgcguucacaacggcga

SEQ ID NO: 3760736 - RNA, 20 nt, Salmonella typhimurium LT2
ggcgcacgucgguaaagcgc

SEQ ID NO: 3760737 - RNA, 16 nt, Salmonella typhimurium LT2
ggcgcagcaaacggca

SEQ ID NO: 3760738 - RNA, 22 nt, Salmonella typhimurium LT2
ggcgcagccgccauccggcaca

SEQ ID NO: 3760739 - RNA, 16 nt, Salmonella typhimurium LT2
ggcgcagcgcccagca

SEQ ID NO: 3760740 - RNA, 11 nt, Salmonella typhimurium LT2
ggcgcagcgcg

SEQ ID NO: 3760741 - RNA, 20 nt, Salmonella typhimurium LT2
ggcgcaggcauuaaaaaaac

SEQ ID NO: 3760742 - RNA, 20 nt, Salmonella typhimurium LT2
ggcgcaggggcauuuuccgg

SEQ ID NO: 3760743 - RNA, 18 nt, Salmonella typhimurium LT2
ggcgcaguuuacgcagcg

SEQ ID NO: 3760744 - RNA, 20 nt, Salmonella typhimurium LT2
ggcgcaguuuacgcagcgcc

SEQ ID NO: 3760745 - RNA, 20 nt, Salmonella typhimurium LT2
ggcgcauuuucggcagcgcg

SEQ ID NO: 3760746 - RNA, 16 nt, Salmonella typhimurium LT2
ggcgccaaucaccgcc

SEQ ID NO: 3760747 - RNA, 20 nt, Salmonella typhimurium LT2
ggcgccaaucaccgccagca

SEQ ID NO: 3760748 - RNA, 20 nt, Salmonella typhimurium LT2
ggcgguaaauacgcggcacg

SEQ ID NO: 3760749 - RNA, 17 nt, Salmonella typhimurium LT2
ggcgguaaucgcgcugu

SEQ ID NO: 3760750 - RNA, 22 nt, Salmonella typhimurium LT2
ggcgguacagcgagcuauccgg

SEQ ID NO: 3760751 - RNA, 16 nt, Salmonella typhimurium LT2
ggcgguaccggcauua

SEQ ID NO: 3760752 - RNA, 18 nt, Salmonella typhimurium LT2
ggcgguacuccgccaucc

SEQ ID NO: 3760753 - RNA, 23 nt, Salmonella typhimurium LT2
ggcgguauaacugccuuauccgg

SEQ ID NO: 3760754 - RNA, 15 nt, Salmonella typhimurium LT2
ggcgguauuauccgc

SEQ ID NO: 3760755 - RNA, 22 nt, Salmonella typhimurium LT2
ggcggucagcuuuucagcccag

SEQ ID NO: 3760756 - RNA, 22 nt, Salmonella typhimurium LT2
ggcggugaggggggauugacuc

SEQ ID NO: 3760757 - RNA, 18 nt, Salmonella typhimurium LT2
ggcggugauuuaaggcug

SEQ ID NO: 3760758 - RNA, 15 nt, Salmonella typhimurium LT2
ggcgguucggcugcc

SEQ ID NO: 3760759 - RNA, 13 nt, Salmonella typhimurium LT2
ggcguaaaacugg

SEQ ID NO: 3760760 - RNA, 22 nt, Salmonella typhimurium LT2
ggcguaaacaccuuauccggcc

SEQ ID NO: 3760761 - RNA, 21 nt, Salmonella typhimurium LT2
ggcguaaagauuagaauagcc

SEQ ID NO: 3760762 - RNA, 21 nt, Salmonella typhimurium LT2
ggcguaaaugugcgccagccu

SEQ ID NO: 3760763 - RNA, 14 nt, Salmonella typhimurium LT2
ggcguaagcgacau

SEQ ID NO: 3760764 - RNA, 12 nt, Salmonella typhimurium LT2
ggcguaccagaa

SEQ ID NO: 3760765 - RNA, 14 nt, Salmonella typhimurium LT2
ggcguacgggcaaa

SEQ ID NO: 3760766 - RNA, 20 nt, Salmonella typhimurium LT2
ggcguacuaaauaggcggca

SEQ ID NO: 3760767 - RNA, 13 nt, Salmonella typhimurium LT2
ggcguagacgacc

SEQ ID NO: 3760768 - RNA, 14 nt, Salmonella typhimurium LT2
ggcguagucagcga

SEQ ID NO: 3760769 - RNA, 13 nt, Salmonella typhimurium LT2
ggcguauagccag

SEQ ID NO: 3760770 - RNA, 16 nt, Salmonella typhimurium LT2
ggcguauagccaggca

SEQ ID NO: 3760771 - RNA, 19 nt, Salmonella typhimurium LT2
ggcguauagccaggcagau

SEQ ID NO: 3760772 - RNA, 21 nt, Salmonella typhimurium LT2
ggcguauagccaggcagaucc

SEQ ID NO: 3760773 - RNA, 13 nt, Salmonella typhimurium LT2
ggcguaucggcag

SEQ ID NO: 3760774 - RNA, 13 nt, Salmonella typhimurium LT2
ggcguauuaucgg

SEQ ID NO: 3760775 - RNA, 22 nt, Salmonella typhimurium LT2
ggcgucaaauccaccgccagca

SEQ ID NO: 3760776 - RNA, 13 nt, Salmonella typhimurium LT2
ggcgucacggcga

SEQ ID NO: 3760777 - RNA, 19 nt, Salmonella typhimurium LT2
ggcgucacguucgucgccg

SEQ ID NO: 3760778 - RNA, 17 nt, Salmonella typhimurium LT2
ggcgucagcauggugug

SEQ ID NO: 3760779 - RNA, 22 nt, Salmonella typhimurium LT2
ggcgucagcaugguguguuccc

SEQ ID NO: 3760780 - RNA, 18 nt, Salmonella typhimurium LT2
ggcgucaucauugcgcca

SEQ ID NO: 3760781 - RNA, 18 nt, Salmonella typhimurium LT2
ggcgucccggucggcgca

SEQ ID NO: 3760782 - RNA, 15 nt, Salmonella typhimurium LT2
ggcguccugcccgcc

SEQ ID NO: 3760783 - RNA, 18 nt, Salmonella typhimurium LT2
ggcgucgcauucgauacg

SEQ ID NO: 3760784 - RNA, 11 nt, Salmonella typhimurium LT2
ggcgucgccgc

SEQ ID NO: 3760785 - RNA, 18 nt, Salmonella typhimurium LT2
ggcgucgccuguccggcc

SEQ ID NO: 3760786 - RNA, 14 nt, Salmonella typhimurium LT2
ggcgucgccugugc

SEQ ID NO: 3760787 - RNA, 19 nt, Salmonella typhimurium LT2
ggcgucgccugugccguug

SEQ ID NO: 3760788 - RNA, 22 nt, Salmonella typhimurium LT2
ggcgucgguuauagacgccggu

SEQ ID NO: 3760789 - RNA, 16 nt, Salmonella typhimurium LT2
ggcgucuuaaugcucu

SEQ ID NO: 3760790 - RNA, 15 nt, Salmonella typhimurium LT2
ggcgucuuccagcau

SEQ ID NO: 3760791 - RNA, 22 nt, Salmonella typhimurium LT2
ggcgugaccgccuuauccggcc

SEQ ID NO: 3760792 - RNA, 12 nt, Salmonella typhimurium LT2
ggcgugacggau

SEQ ID NO: 3760793 - RNA, 12 nt, Salmonella typhimurium LT2
ggcguguaacug

SEQ ID NO: 3760794 - RNA, 20 nt, Salmonella typhimurium LT2
ggcguguagccaaucagccc

SEQ ID NO: 3760795 - RNA, 17 nt, Salmonella typhimurium LT2
ggcguguugaaguccuc

SEQ ID NO: 3760796 - RNA, 21 nt, Salmonella typhimurium LT2
ggcguguuguaaaacgcgccc

SEQ ID NO: 3760797 - RNA, 23 nt, Salmonella typhimurium LT2
ggcguuacuggcgaccggcagcc

SEQ ID NO: 3760798 - RNA, 18 nt, Salmonella typhimurium LT2
ggcguuaucuugacauga

SEQ ID NO: 3760799 - RNA, 18 nt, Salmonella typhimurium LT2
ggcguucccgcaggccgg

SEQ ID NO: 3760800 - RNA, 13 nt, Salmonella typhimurium LT2
ggcguuccgcaca

SEQ ID NO: 3760801 - RNA, 21 nt, Salmonella typhimurium LT2
ggcguuccgcacauaaucacc

SEQ ID NO: 3760802 - RNA, 12 nt, Salmonella typhimurium LT2
ggcguucucccg

SEQ ID NO: 3760803 - RNA, 14 nt, Salmonella typhimurium LT2
ggcguugcccaucg

SEQ ID NO: 3760804 - RNA, 19 nt, Salmonella typhimurium LT2
ggcguuuauauaaaaauag

SEQ ID NO: 3760805 - RNA, 21 nt, Salmonella typhimurium LT2
ggcguuucagcuuccaguuau

SEQ ID NO: 3760806 - RNA, 17 nt, Salmonella typhimurium LT2
ggcguuugugcgcgcca

SEQ ID NO: 3760807 - RNA, 22 nt, Salmonella typhimurium LT2
ggcguuuucauuagccgccagc

SEQ ID NO: 3760808 - RNA, 16 nt, Salmonella typhimurium LT2
ggcguuuugcgcgcca

SEQ ID NO: 3760809 - RNA, 13 nt, Salmonella typhimurium LT2
ggcuaacgccggu

SEQ ID NO: 3760810 - RNA, 18 nt, Salmonella typhimurium LT2
ggcuaacgcgccuccggc

SEQ ID NO: 3760811 - RNA, 18 nt, Salmonella typhimurium LT2
ggcuaacguuaaggaaac

SEQ ID NO: 3760812 - RNA, 17 nt, Salmonella typhimurium LT2
ggcuaagccaaaaauaa

SEQ ID NO: 3760813 - RNA, 18 nt, Salmonella typhimurium LT2
ggcuaaguugaccacacc

SEQ ID NO: 3760814 - RNA, 23 nt, Salmonella typhimurium LT2
ggcuaauaugccaggcuuccugc

SEQ ID NO: 3760815 - RNA, 13 nt, Salmonella typhimurium LT2
ggcuacccagaca

SEQ ID NO: 3760816 - RNA, 14 nt, Salmonella typhimurium LT2
ggcuacggcucccu

SEQ ID NO: 3760817 - RNA, 18 nt, Salmonella typhimurium LT2
ggcuagcccgcugcgccg

SEQ ID NO: 3760818 - RNA, 18 nt, Salmonella typhimurium LT2
ggcuagcgccuuauccgg

SEQ ID NO: 3760819 - RNA, 23 nt, Salmonella typhimurium LT2
ggcuauaaccgucgcccguccgc

SEQ ID NO: 3760820 - RNA, 15 nt, Salmonella typhimurium LT2
ggcuauaggccauca

SEQ ID NO: 3760821 - RNA, 21 nt, Salmonella typhimurium LT2
ggcuauguagcgcugaagccc

SEQ ID NO: 3760822 - RNA, 21 nt, Salmonella typhimurium LT2
ggcuauuagcguuuuuaccgg

SEQ ID NO: 3760823 - RNA, 20 nt, Salmonella typhimurium LT2
ggcuauucuucgaucgccug

SEQ ID NO: 3760824 - RNA, 22 nt, Salmonella typhimurium LT2
ggcucaaacggccugcgcugga

SEQ ID NO: 3760825 - RNA, 15 nt, Salmonella typhimurium LT2
ggcucaauaugccag

SEQ ID NO: 3760826 - RNA, 18 nt, Salmonella typhimurium LT2
ggcucaauaugccaggca

SEQ ID NO: 3760827 - RNA, 16 nt, Salmonella typhimurium LT2
ggcucagauugaacgc

SEQ ID NO: 3760828 - RNA, 18 nt, Salmonella typhimurium LT2
ggcucagcauagcgcuga

SEQ ID NO: 3760829 - RNA, 19 nt, Salmonella typhimurium LT2
ggcucaucaaacagcggca

SEQ ID NO: 3760830 - RNA, 22 nt, Salmonella typhimurium LT2
ggcucaucaaacagcggcacuu

SEQ ID NO: 3760831 - RNA, 13 nt, Salmonella typhimurium LT2
ggcucauccagca

SEQ ID NO: 3760832 - RNA, 22 nt, Salmonella typhimurium LT2
ggcucauuuuauccaacagcgc

SEQ ID NO: 3760833 - RNA, 11 nt, Salmonella typhimurium LT2
ggcuccagcgc

SEQ ID NO: 3760834 - RNA, 20 nt, Salmonella typhimurium LT2
ggcuccagcgccagcuccau

SEQ ID NO: 3760835 - RNA, 21 nt, Salmonella typhimurium LT2
ggcuccauagggcagggugcc

SEQ ID NO: 3760836 - RNA, 14 nt, Salmonella typhimurium LT2
ggcucccgcagcca

SEQ ID NO: 3760837 - RNA, 23 nt, Salmonella typhimurium LT2
ggcuccgagacucaaagaaaaca

SEQ ID NO: 3760838 - RNA, 15 nt, Salmonella typhimurium LT2
ggcuccuuuuuugua

SEQ ID NO: 3760839 - RNA, 17 nt, Salmonella typhimurium LT2
ggcucgcagaugcccgc

SEQ ID NO: 3760840 - RNA, 13 nt, Salmonella typhimurium LT2
ggcucguuuuugu

SEQ ID NO: 3760841 - RNA, 13 nt, Salmonella typhimurium LT2
ggcucuaaaaagg

SEQ ID NO: 3760842 - RNA, 19 nt, Salmonella typhimurium LT2
ggcucuaaauuagcucccg

SEQ ID NO: 3760843 - RNA, 18 nt, Salmonella typhimurium LT2
ggcucuguguaaaacgcu

SEQ ID NO: 3760844 - RNA, 16 nt, Salmonella typhimurium LT2
ggcucuuagcagcaua

SEQ ID NO: 3760845 - RNA, 16 nt, Salmonella typhimurium LT2
ggcucuuuggcaaucu

SEQ ID NO: 3760846 - RNA, 22 nt, Salmonella typhimurium LT2
ggcucuuuuuuuauagcaaacu

SEQ ID NO: 3760847 - RNA, 16 nt, Salmonella typhimurium LT2
ggcugaacgccaggcc

SEQ ID NO: 3760848 - RNA, 12 nt, Salmonella typhimurium LT2
ggcugaagcccc

SEQ ID NO: 3760849 - RNA, 11 nt, Salmonella typhimurium LT2
ggcugaagcgg

SEQ ID NO: 3760850 - RNA, 19 nt, Salmonella typhimurium LT2
ggcugaaugaagccuuagc

SEQ ID NO: 3760851 - RNA, 17 nt, Salmonella typhimurium LT2
ggcugaccuucccuucg

SEQ ID NO: 3760852 - RNA, 13 nt, Salmonella typhimurium LT2
gggccgacagacg

SEQ ID NO: 3760853 - RNA, 14 nt, Salmonella typhimurium LT2
gggccgacaggcgg

SEQ ID NO: 3760854 - RNA, 21 nt, Salmonella typhimurium LT2
gggccgccaucuccggcagcg

SEQ ID NO: 3760855 - RNA, 16 nt, Salmonella typhimurium LT2
gggccgcucagcaucg

SEQ ID NO: 3760856 - RNA, 20 nt, Salmonella typhimurium LT2
gggccgugguuucuccccag

SEQ ID NO: 3760857 - RNA, 23 nt, Salmonella typhimurium LT2
gggccuacagguacagaugcugu

SEQ ID NO: 3760858 - RNA, 19 nt, Salmonella typhimurium LT2
gggccugauaagcacaggc

SEQ ID NO: 3760859 - RNA, 14 nt, Salmonella typhimurium LT2
gggccugcugcggu

SEQ ID NO: 3760860 - RNA, 21 nt, Salmonella typhimurium LT2
gggcgaacauuccgcccagga

SEQ ID NO: 3760861 - RNA, 20 nt, Salmonella typhimurium LT2
gggcgauacuggcaguaaaa

SEQ ID NO: 3760862 - RNA, 22 nt, Salmonella typhimurium LT2
gggcgcaaaaucgcaaacgcca

SEQ ID NO: 3760863 - RNA, 19 nt, Salmonella typhimurium LT2
gggcgcgacaauaugacca

SEQ ID NO: 3760864 - RNA, 12 nt, Salmonella typhimurium LT2
gggcgcggcugg

SEQ ID NO: 3760865 - RNA, 13 nt, Salmonella typhimurium LT2
gggcgcuucgcuu

SEQ ID NO: 3760866 - RNA, 17 nt, Salmonella typhimurium LT2
gggcgcuugcgcauggc

SEQ ID NO: 3760867 - RNA, 14 nt, Salmonella typhimurium LT2
gggcggucuuauca

SEQ ID NO: 3760868 - RNA, 16 nt, Salmonella typhimurium LT2
gggcguauagccaggc

SEQ ID NO: 3760869 - RNA, 17 nt, Salmonella typhimurium LT2
gggcguauagccaggca

SEQ ID NO: 3760870 - RNA, 21 nt, Salmonella typhimurium LT2
gggcgucaaaaucccggcugg

SEQ ID NO: 3760871 - RNA, 22 nt, Salmonella typhimurium LT2
gggcucauuuuauccaacagcg

SEQ ID NO: 3760872 - RNA, 19 nt, Salmonella typhimurium LT2
gggcucguuuuuguuuaaa

SEQ ID NO: 3760873 - RNA, 15 nt, Salmonella typhimurium LT2
gggcugccagggcau

SEQ ID NO: 3760874 - RNA, 15 nt, Salmonella typhimurium LT2
gggcugccaucaggc

SEQ ID NO: 3760875 - RNA, 22 nt, Salmonella typhimurium LT2
gggcugcccgccguuaaaucau

SEQ ID NO: 3760876 - RNA, 12 nt, Salmonella typhimurium LT2
gggcuuaaucag

SEQ ID NO: 3760877 - RNA, 22 nt, Salmonella typhimurium LT2
ggggaacggcagacagccgcgg

SEQ ID NO: 3760878 - RNA, 16 nt, Salmonella typhimurium LT2
ggggaucaagcccccg

SEQ ID NO: 3760879 - RNA, 18 nt, Salmonella typhimurium LT2
ggggaugauuuucaggca

SEQ ID NO: 3760880 - RNA, 15 nt, Salmonella typhimurium LT2
ggggcaucagccgcc

SEQ ID NO: 3760881 - RNA, 18 nt, Salmonella typhimurium LT2
ggggccacaggcggcaug

SEQ ID NO: 3760882 - RNA, 13 nt, Salmonella typhimurium LT2
ggggcgaccggcu

SEQ ID NO: 3760883 - RNA, 18 nt, Salmonella typhimurium LT2
ggggguucaagucccccc

SEQ ID NO: 3760884 - RNA, 12 nt, Salmonella typhimurium LT2
ggggugaaacag

SEQ ID NO: 3760885 - RNA, 14 nt, Salmonella typhimurium LT2
ggggugagcgacaa

SEQ ID NO: 3760886 - RNA, 14 nt, Salmonella typhimurium LT2
gggguguuacgcca

SEQ ID NO: 3760887 - RNA, 22 nt, Salmonella typhimurium LT2
gggguucaauagcacaucagcc

SEQ ID NO: 3760888 - RNA, 18 nt, Salmonella typhimurium LT2
gggguucccgagcggcca

SEQ ID NO: 3760889 - RNA, 19 nt, Salmonella typhimurium LT2
ggguaaaaauauggcgggc

SEQ ID NO: 3760890 - RNA, 17 nt, Salmonella typhimurium LT2
ggguaaacgcagcguca

SEQ ID NO: 3760891 - RNA, 21 nt, Salmonella typhimurium LT2
ggguaaauagacuguugaaag

SEQ ID NO: 3760892 - RNA, 14 nt, Salmonella typhimurium LT2
ggguaauggucagc

SEQ ID NO: 3760893 - RNA, 13 nt, Salmonella typhimurium LT2
ggguaauuucuuc

SEQ ID NO: 3760894 - RNA, 21 nt, Salmonella typhimurium LT2
ggguaggugauggugccgccg

SEQ ID NO: 3760895 - RNA, 14 nt, Salmonella typhimurium LT2
ggguaugaauuuuu

SEQ ID NO: 3760896 - RNA, 17 nt, Salmonella typhimurium LT2
ggguaugcgcaaaucaa

SEQ ID NO: 3760897 - RNA, 23 nt, Salmonella typhimurium LT2
ggguaugcgcaaaucaaaaggca

SEQ ID NO: 3760898 - RNA, 18 nt, Salmonella typhimurium LT2
ggguauuuuuuagcgcca

SEQ ID NO: 3760899 - RNA, 14 nt, Salmonella typhimurium LT2
gggucaagaaaauc

SEQ ID NO: 3760900 - RNA, 20 nt, Salmonella typhimurium LT2
gggucaagaaaaucggccag

SEQ ID NO: 3760901 - RNA, 22 nt, Salmonella typhimurium LT2
gggucacauccagacagccgac

SEQ ID NO: 3760902 - RNA, 24 nt, Salmonella typhimurium LT2
gggucacauccagacagccgacgg

SEQ ID NO: 3760903 - RNA, 22 nt, Salmonella typhimurium LT2
gggucaccgggguucagaccag

SEQ ID NO: 3760904 - RNA, 14 nt, Salmonella typhimurium LT2
gggucaggaaacug

SEQ ID NO: 3760905 - RNA, 12 nt, Salmonella typhimurium LT2
gggucaggaacu

SEQ ID NO: 3760906 - RNA, 14 nt, Salmonella typhimurium LT2
ggguccgcccggca

SEQ ID NO: 3760907 - RNA, 18 nt, Salmonella typhimurium LT2
gggucgccgcgcccagca

SEQ ID NO: 3760908 - RNA, 19 nt, Salmonella typhimurium LT2
gggucguacuaaagagcgc

SEQ ID NO: 3760909 - RNA, 11 nt, Salmonella typhimurium LT2
gggucuuccag

SEQ ID NO: 3760910 - RNA, 13 nt, Salmonella typhimurium LT2
gggucuuccagca

SEQ ID NO: 3760911 - RNA, 22 nt, Salmonella typhimurium LT2
gggugcaaacccaucucaggcc

SEQ ID NO: 3760912 - RNA, 18 nt, Salmonella typhimurium LT2
gggugcgccgcagcgccu

SEQ ID NO: 3760913 - RNA, 20 nt, Salmonella typhimurium LT2
gggugguuucccugaccagu

SEQ ID NO: 3760914 - RNA, 14 nt, Salmonella typhimurium LT2
ggguuaauggcagc

SEQ ID NO: 3760915 - RNA, 19 nt, Salmonella typhimurium LT2
ggguucccgagcggccaaa

SEQ ID NO: 3760916 - RNA, 15 nt, Salmonella typhimurium LT2
ggguugagcgaguca

SEQ ID NO: 3760917 - RNA, 20 nt, Salmonella typhimurium LT2
ggguuuaaugcagaaaccgg

SEQ ID NO: 3760918 - RNA, 22 nt, Salmonella typhimurium LT2
ggguuucccccuccauacccua

SEQ ID NO: 3760919 - RNA, 18 nt, Salmonella typhimurium LT2
ggguuugaccgccggaaa

SEQ ID NO: 3760920 - RNA, 19 nt, Salmonella typhimurium LT2
ggguuuguaggccggguaa

SEQ ID NO: 3760921 - RNA, 18 nt, Salmonella typhimurium LT2
ggguuuucaggaaggagc

SEQ ID NO: 3760922 - RNA, 16 nt, Salmonella typhimurium LT2
gguaaaaacagccaua

SEQ ID NO: 3760923 - RNA, 20 nt, Salmonella typhimurium LT2
gguaaaaagcugaugcccag

SEQ ID NO: 3760924 - RNA, 14 nt, Salmonella typhimurium LT2
gguaaaaauaucug

SEQ ID NO: 3760925 - RNA, 13 nt, Salmonella typhimurium LT2
gguaaaacgcugg

SEQ ID NO: 3760926 - RNA, 22 nt, Salmonella typhimurium LT2
gguaaaauggacuuccgcacgc

SEQ ID NO: 3760927 - RNA, 17 nt, Salmonella typhimurium LT2
gguaaacacgacgcugc

SEQ ID NO: 3760928 - RNA, 22 nt, Salmonella typhimurium LT2
gguaaacggugcgauuauccca

SEQ ID NO: 3760929 - RNA, 23 nt, Salmonella typhimurium LT2
gguaaaggcggaaaucagcacaa

SEQ ID NO: 3760930 - RNA, 14 nt, Salmonella typhimurium LT2
gguaaauaccaggc

SEQ ID NO: 3760931 - RNA, 17 nt, Salmonella typhimurium LT2
gguaaauaccaggcacu

SEQ ID NO: 3760932 - RNA, 14 nt, Salmonella typhimurium LT2
gguaaauacgcugc

SEQ ID NO: 3760933 - RNA, 18 nt, Salmonella typhimurium LT2
gguaaauacgcugcggcc

SEQ ID NO: 3760934 - RNA, 11 nt, Salmonella typhimurium LT2
gguaaaucaac

SEQ ID NO: 3760935 - RNA, 13 nt, Salmonella typhimurium LT2
gguaaaucgcauu

SEQ ID NO: 3760936 - RNA, 23 nt, Salmonella typhimurium LT2
gguaaaucgcauuuuuaagcugg

SEQ ID NO: 3760937 - RNA, 14 nt, Salmonella typhimurium LT2
gguaacaggcacca

SEQ ID NO: 3760938 - RNA, 16 nt, Salmonella typhimurium LT2
gguaacauaaaagcga

SEQ ID NO: 3760939 - RNA, 15 nt, Salmonella typhimurium LT2
gguaacgaacgcugu

SEQ ID NO: 3760940 - RNA, 18 nt, Salmonella typhimurium LT2
gguaacgcaacucaucgu

SEQ ID NO: 3760941 - RNA, 17 nt, Salmonella typhimurium LT2
gguaacguaaauaccca

SEQ ID NO: 3760942 - RNA, 13 nt, Salmonella typhimurium LT2
gguaagauguucu

SEQ ID NO: 3760943 - RNA, 15 nt, Salmonella typhimurium LT2
gguaagcagaccggg

SEQ ID NO: 3760944 - RNA, 22 nt, Salmonella typhimurium LT2
gguaagcccauggcaggcagca

SEQ ID NO: 3760945 - RNA, 22 nt, Salmonella typhimurium LT2
gguaagguacggcuuuaacagu

SEQ ID NO: 3760946 - RNA, 17 nt, Salmonella typhimurium LT2
gguaauaauccucgccg

SEQ ID NO: 3760947 - RNA, 21 nt, Salmonella typhimurium LT2
gguaauaauuggcauccagca

SEQ ID NO: 3760948 - RNA, 17 nt, Salmonella typhimurium LT2
gguaaucagaucggcaa

SEQ ID NO: 3760949 - RNA, 22 nt, Salmonella typhimurium LT2
gguaauccgacgcuucaaaucc

SEQ ID NO: 3760950 - RNA, 16 nt, Salmonella typhimurium LT2
gguaaugucauccagc

SEQ ID NO: 3760951 - RNA, 15 nt, Salmonella typhimurium LT2
gguaauuugcgccau

SEQ ID NO: 3760952 - RNA, 15 nt, Salmonella typhimurium LT2
gguacagaugcugua

SEQ ID NO: 3760953 - RNA, 14 nt, Salmonella typhimurium LT2
gguacaggccgccg

SEQ ID NO: 3760954 - RNA, 17 nt, Salmonella typhimurium LT2
gguacaggccgccgccu

SEQ ID NO: 3760955 - RNA, 13 nt, Salmonella typhimurium LT2
gguacgauuucau

SEQ ID NO: 3760956 - RNA, 20 nt, Salmonella typhimurium LT2
ggugaaggcaaaacaccaua

SEQ ID NO: 3760957 - RNA, 15 nt, Salmonella typhimurium LT2
ggugaauaaauccuu

SEQ ID NO: 3760958 - RNA, 16 nt, Salmonella typhimurium LT2
ggugaauaccaaagcc

SEQ ID NO: 3760959 - RNA, 19 nt, Salmonella typhimurium LT2
ggugacaaucucaaugcca

SEQ ID NO: 3760960 - RNA, 14 nt, Salmonella typhimurium LT2
ggugacagaagaga

SEQ ID NO: 3760961 - RNA, 16 nt, Salmonella typhimurium LT2
ggugacggaaaccagc

SEQ ID NO: 3760962 - RNA, 24 nt, Salmonella typhimurium LT2
ggugacuuccugauccgccuuacg

SEQ ID NO: 3760963 - RNA, 16 nt, Salmonella typhimurium LT2
ggugagcaaaggcagc

SEQ ID NO: 3760964 - RNA, 18 nt, Salmonella typhimurium LT2
ggugagcaaaggcagcca

SEQ ID NO: 3760965 - RNA, 12 nt, Salmonella typhimurium LT2
ggugagcucuuu

SEQ ID NO: 3760966 - RNA, 14 nt, Salmonella typhimurium LT2
ggugauagcccguu

SEQ ID NO: 3760967 - RNA, 14 nt, Salmonella typhimurium LT2
ggugauccuccugc

SEQ ID NO: 3760968 - RNA, 16 nt, Salmonella typhimurium LT2
ggugaugcgcaacguu

SEQ ID NO: 3760969 - RNA, 16 nt, Salmonella typhimurium LT2
ggugaugcgccagcca

SEQ ID NO: 3760970 - RNA, 15 nt, Salmonella typhimurium LT2
ggugauggagccuuc

SEQ ID NO: 3760971 - RNA, 18 nt, Salmonella typhimurium LT2
ggugcaagcaccuuaucc

SEQ ID NO: 3760972 - RNA, 20 nt, Salmonella typhimurium LT2
ggugcaagcaccuuauccgg

SEQ ID NO: 3760973 - RNA, 17 nt, Salmonella typhimurium LT2
ggugcacgaacugcugc

SEQ ID NO: 3760974 - RNA, 18 nt, Salmonella typhimurium LT2
ggugcaugcggagauggc

SEQ ID NO: 3760975 - RNA, 23 nt, Salmonella typhimurium LT2
ggugccauaucguucaguuucaa

SEQ ID NO: 3760976 - RNA, 11 nt, Salmonella typhimurium LT2
ggugcccaucg

SEQ ID NO: 3760977 - RNA, 14 nt, Salmonella typhimurium LT2
ggugcccgcgugga

SEQ ID NO: 3760978 - RNA, 14 nt, Salmonella typhimurium LT2
ggugccgccgcaga

SEQ ID NO: 3760979 - RNA, 15 nt, Salmonella typhimurium LT2
ggugcgacaccacgc

SEQ ID NO: 3760980 - RNA, 15 nt, Salmonella typhimurium LT2
ggugcgcagccccag

SEQ ID NO: 3760981 - RNA, 20 nt, Salmonella typhimurium LT2
ggugcgcagccccagcgcca

SEQ ID NO: 3760982 - RNA, 23 nt, Salmonella typhimurium LT2
ggugcgcagccccagcgccagcc

SEQ ID NO: 3760983 - RNA, 16 nt, Salmonella typhimurium LT2
ggugcgccccagcaug

SEQ ID NO: 3760984 - RNA, 21 nt, Salmonella typhimurium LT2
ggugcuauacaguaaaacgcc

SEQ ID NO: 3760985 - RNA, 14 nt, Salmonella typhimurium LT2
ggugcucaauaaaa

SEQ ID NO: 3760986 - RNA, 20 nt, Salmonella typhimurium LT2
ggugcuuccggcacugcgcc

SEQ ID NO: 3760987 - RNA, 16 nt, Salmonella typhimurium LT2
ggugcuugcgccgcca

SEQ ID NO: 3760988 - RNA, 16 nt, Salmonella typhimurium LT2
gguggcgaagcucagc

SEQ ID NO: 3760989 - RNA, 20 nt, Salmonella typhimurium LT2
gguggcgcaguuuacgcagc

SEQ ID NO: 3760990 - RNA, 13 nt, Salmonella typhimurium LT2
gguggcgcugcgc

SEQ ID NO: 3760991 - RNA, 21 nt, Salmonella typhimurium LT2
gguggucacgccauuaucgaa

SEQ ID NO: 3760992 - RNA, 22 nt, Salmonella typhimurium LT2
gguggucaucgcggccagcaug

SEQ ID NO: 3760993 - RNA, 15 nt, Salmonella typhimurium LT2
gguggucuggagccu

SEQ ID NO: 3760994 - RNA, 13 nt, Salmonella typhimurium LT2
gguggugcaggcu

SEQ ID NO: 3760995 - RNA, 11 nt, Salmonella typhimurium LT2
gguggugcucu

SEQ ID NO: 3760996 - RNA, 20 nt, Salmonella typhimurium LT2
gguguaaaccaggcauuuuc

SEQ ID NO: 3760997 - RNA, 16 nt, Salmonella typhimurium LT2
gguguagcucauaacu

SEQ ID NO: 3760998 - RNA, 14 nt, Salmonella typhimurium LT2
ggugucaaagcgcc

SEQ ID NO: 3760999 - RNA, 15 nt, Salmonella typhimurium LT2
gguguccccugcagg

SEQ ID NO: 3761000 - RNA, 13 nt, Salmonella typhimurium LT2
gguguucaccauu

SEQ ID NO: 3761001 - RNA, 23 nt, Salmonella typhimurium LT2
gguguuuacgccgccauccggca

SEQ ID NO: 3761002 - RNA, 21 nt, Salmonella typhimurium LT2
gguuaaacacauccggcggcg

SEQ ID NO: 3761003 - RNA, 23 nt, Salmonella typhimurium LT2
gguuaacccgguuuauccccgcu

SEQ ID NO: 3761004 - RNA, 18 nt, Salmonella typhimurium LT2
gguuaacgucagauuuuc

SEQ ID NO: 3761005 - RNA, 16 nt, Salmonella typhimurium LT2
gguuaauacugaucag

SEQ ID NO: 3761006 - RNA, 20 nt, Salmonella typhimurium LT2
gguuaaugaaaucgucgcca

SEQ ID NO: 3761007 - RNA, 20 nt, Salmonella typhimurium LT2
gguuacaacugcgaggucac

SEQ ID NO: 3761008 - RNA, 22 nt, Salmonella typhimurium LT2
gguuacaugcugaagcagugug

SEQ ID NO: 3761009 - RNA, 14 nt, Salmonella typhimurium LT2
gguuacgcgacgug

SEQ ID NO: 3761010 - RNA, 17 nt, Salmonella typhimurium LT2
gguuacgcgacgugcug

SEQ ID NO: 3761011 - RNA, 17 nt, Salmonella typhimurium LT2
gguuacuauuuuucacc

SEQ ID NO: 3761012 - RNA, 22 nt, Salmonella typhimurium LT2
gguuacuggcuaguauauuaaa

SEQ ID NO: 3761013 - RNA, 22 nt, Salmonella typhimurium LT2
gguuagcagccacacacuguuu

SEQ ID NO: 3761014 - RNA, 14 nt, Salmonella typhimurium LT2
gguuauccagcagc

SEQ ID NO: 3761015 - RNA, 17 nt, Salmonella typhimurium LT2
gguuauucggucagaua

SEQ ID NO: 3761016 - RNA, 16 nt, Salmonella typhimurium LT2
gguucaaggcaggaau

SEQ ID NO: 3761017 - RNA, 21 nt, Salmonella typhimurium LT2
gguucaccaccacccagugcc

SEQ ID NO: 3761018 - RNA, 22 nt, Salmonella typhimurium LT2
gguucagcaacgugaacugcgc

SEQ ID NO: 3761019 - RNA, 13 nt, Salmonella typhimurium LT2
gguucaucgccac

SEQ ID NO: 3761020 - RNA, 16 nt, Salmonella typhimurium LT2
gguucccgagcggcca

SEQ ID NO: 3761021 - RNA, 18 nt, Salmonella typhimurium LT2
gguucccgagcggccaaa

SEQ ID NO: 3761022 - RNA, 18 nt, Salmonella typhimurium LT2
gguucccugcgccaggcc

SEQ ID NO: 3761023 - RNA, 20 nt, Salmonella typhimurium LT2
gguuccgacaauaaaaaugc

SEQ ID NO: 3761024 - RNA, 15 nt, Salmonella typhimurium LT2
gguuccguaagcgcc

SEQ ID NO: 3761025 - RNA, 22 nt, Salmonella typhimurium LT2
gguuccguucccaaugcuuucg

SEQ ID NO: 3761026 - RNA, 21 nt, Salmonella typhimurium LT2
gguucgaacgacagaauaugc

SEQ ID NO: 3761027 - RNA, 20 nt, Salmonella typhimurium LT2
gguucgccgcgcgcauaggc

SEQ ID NO: 3761028 - RNA, 17 nt, Salmonella typhimurium LT2
gguucgccucccucacc

SEQ ID NO: 3761029 - RNA, 15 nt, Salmonella typhimurium LT2
gguucgggcagcgcu

SEQ ID NO: 3761030 - RNA, 18 nt, Salmonella typhimurium LT2
gguucucugccaucaucc

SEQ ID NO: 3761031 - RNA, 19 nt, Salmonella typhimurium LT2
gguucuuucuuuaacaccu

SEQ ID NO: 3761032 - RNA, 22 nt, Salmonella typhimurium LT2
gguugauaccggaggagugcgc

SEQ ID NO: 3761033 - RNA, 15 nt, Salmonella typhimurium LT2
gguugcccgcaggcu

SEQ ID NO: 3761034 - RNA, 17 nt, Salmonella typhimurium LT2
gguugcccgcaggcuuc

SEQ ID NO: 3761035 - RNA, 23 nt, Salmonella typhimurium LT2
gguugcccgguggcgcugcgcuu

SEQ ID NO: 3761036 - RNA, 14 nt, Salmonella typhimurium LT2
gguugccgcaaaug

SEQ ID NO: 3761037 - RNA, 22 nt, Salmonella typhimurium LT2
gguugccugauggcgcugcgcu

SEQ ID NO: 3761038 - RNA, 16 nt, Salmonella typhimurium LT2
gguugcgaaccgcaca

SEQ ID NO: 3761039 - RNA, 20 nt, Salmonella typhimurium LT2
gguugcgcccuuccgucagc

SEQ ID NO: 3761040 - RNA, 17 nt, Salmonella typhimurium LT2
gguugcgcgcuggauca

SEQ ID NO: 3761041 - RNA, 23 nt, Salmonella typhimurium LT2
gguugcggcggggauaaucagca

SEQ ID NO: 3761042 - RNA, 20 nt, Salmonella typhimurium LT2
gguuggaauaauuuucgcaa

SEQ ID NO: 3761043 - RNA, 13 nt, Salmonella typhimurium LT2
gguuggccagcau

SEQ ID NO: 3761044 - RNA, 14 nt, Salmonella typhimurium LT2
gguugugccaguaa

SEQ ID NO: 3761045 - RNA, 19 nt, Salmonella typhimurium LT2
gguuguucuuccagcguca

SEQ ID NO: 3761046 - RNA, 17 nt, Salmonella typhimurium LT2
gguuguuugggcgcaua

SEQ ID NO: 3761047 - RNA, 20 nt, Salmonella typhimurium LT2
gguuuacgauacguuugaaa

SEQ ID NO: 3761048 - RNA, 22 nt, Salmonella typhimurium LT2
gguuucaauauagccguggcug

SEQ ID NO: 3761049 - RNA, 17 nt, Salmonella typhimurium LT2
gguuucacgcucuucgc

SEQ ID NO: 3761050 - RNA, 15 nt, Salmonella typhimurium LT2
gguuucaucgccgau

SEQ ID NO: 3761051 - RNA, 13 nt, Salmonella typhimurium LT2
gguuucccaguca

SEQ ID NO: 3761052 - RNA, 14 nt, Salmonella typhimurium LT2
gguuucgaccagca

SEQ ID NO: 3761053 - RNA, 18 nt, Salmonella typhimurium LT2
gguuucgccuaagcccac

SEQ ID NO: 3761054 - RNA, 16 nt, Salmonella typhimurium LT2
gguuucuaucccuucg

SEQ ID NO: 3761055 - RNA, 11 nt, Salmonella typhimurium LT2
gguuucuuuuu

SEQ ID NO: 3761056 - RNA, 14 nt, Salmonella typhimurium LT2
gguuugcagcagag

SEQ ID NO: 3761057 - RNA, 18 nt, Salmonella typhimurium LT2
gguuuuaugcaucgcggu

SEQ ID NO: 3761058 - RNA, 22 nt, Salmonella typhimurium LT2
gguuuuuaucuuuucucccggc

SEQ ID NO: 3761059 - RNA, 15 nt, Salmonella typhimurium LT2
gguuuuuauggaagg

SEQ ID NO: 3761060 - RNA, 17 nt, Salmonella typhimurium LT2
guaagcgcccguccaug

SEQ ID NO: 3761061 - RNA, 22 nt, Salmonella typhimurium LT2
guaagcgcccguccaugaguag

SEQ ID NO: 3761062 - RNA, 19 nt, Salmonella typhimurium LT2
guaagcggcggaccagcgu

SEQ ID NO: 3761063 - RNA, 23 nt, Salmonella typhimurium LT2
guaagcggguauacuuaacccug

SEQ ID NO: 3761064 - RNA, 14 nt, Salmonella typhimurium LT2
guaagcuauuucug

SEQ ID NO: 3761065 - RNA, 22 nt, Salmonella typhimurium LT2
guaagcuggaaccugaguuccc

SEQ ID NO: 3761066 - RNA, 15 nt, Salmonella typhimurium LT2
guaaggcgugccgcc

SEQ ID NO: 3761067 - RNA, 21 nt, Salmonella typhimurium LT2
guaagggaggugcucucccag

SEQ ID NO: 3761068 - RNA, 22 nt, Salmonella typhimurium LT2
guaagggaggugcucucccagc

SEQ ID NO: 3761069 - RNA, 13 nt, Salmonella typhimurium LT2
guaagguccaggg

SEQ ID NO: 3761070 - RNA, 16 nt, Salmonella typhimurium LT2
guaagguccagggaau

SEQ ID NO: 3761071 - RNA, 17 nt, Salmonella typhimurium LT2
guaaguacggcaaaaau

SEQ ID NO: 3761072 - RNA, 18 nt, Salmonella typhimurium LT2
guaaguuacuaaaaguaa

SEQ ID NO: 3761073 - RNA, 22 nt, Salmonella typhimurium LT2
guaaguuugcguacucagcaga

SEQ ID NO: 3761074 - RNA, 14 nt, Salmonella typhimurium LT2
guaauaaaaaacaa

SEQ ID NO: 3761075 - RNA, 21 nt, Salmonella typhimurium LT2
guaauaaaaaauuccgugaga

SEQ ID NO: 3761076 - RNA, 19 nt, Salmonella typhimurium LT2
guaauaaagaaggguuuug

SEQ ID NO: 3761077 - RNA, 17 nt, Salmonella typhimurium LT2
guaauaaccguggcggc

SEQ ID NO: 3761078 - RNA, 22 nt, Salmonella typhimurium LT2
guaauaacgaacugauggcgcu

SEQ ID NO: 3761079 - RNA, 15 nt, Salmonella typhimurium LT2
guaauaacugacaga

SEQ ID NO: 3761080 - RNA, 16 nt, Salmonella typhimurium LT2
guaauaacugacagac

SEQ ID NO: 3761081 - RNA, 21 nt, Salmonella typhimurium LT2
guaauaaggcggguugcugau

SEQ ID NO: 3761082 - RNA, 13 nt, Salmonella typhimurium LT2
guaauaauuuaaa

SEQ ID NO: 3761083 - RNA, 18 nt, Salmonella typhimurium LT2
guaauagcgucuaaauuu

SEQ ID NO: 3761084 - RNA, 22 nt, Salmonella typhimurium LT2
guaauaugugcgccacgcagcg

SEQ ID NO: 3761085 - RNA, 15 nt, Salmonella typhimurium LT2
guaauauuaaaacca

SEQ ID NO: 3761086 - RNA, 23 nt, Salmonella typhimurium LT2
guaaucaaacauacgccuuuacc

SEQ ID NO: 3761087 - RNA, 20 nt, Salmonella typhimurium LT2
guaaucggccuguuggccuu

SEQ ID NO: 3761088 - RNA, 24 nt, Salmonella typhimurium LT2
guaaugacuggcuuugcgccacuu

SEQ ID NO: 3761089 - RNA, 20 nt, Salmonella typhimurium LT2
guaaugaucagaacucacau

SEQ ID NO: 3761090 - RNA, 22 nt, Salmonella typhimurium LT2
guaaugcucgcccagaauuucc

SEQ ID NO: 3761091 - RNA, 15 nt, Salmonella typhimurium LT2
guaauggcauaacgc

SEQ ID NO: 3761092 - RNA, 17 nt, Salmonella typhimurium LT2
guaauggccaccagcac

SEQ ID NO: 3761093 - RNA, 20 nt, Salmonella typhimurium LT2
guaauggcgggaaaagguuc

SEQ ID NO: 3761094 - RNA, 12 nt, Salmonella typhimurium LT2
guaauggucagc

SEQ ID NO: 3761095 - RNA, 16 nt, Salmonella typhimurium LT2
guaaugguguccacaa

SEQ ID NO: 3761096 - RNA, 16 nt, Salmonella typhimurium LT2
guaauucucacagaau

SEQ ID NO: 3761097 - RNA, 22 nt, Salmonella typhimurium LT2
guaauucucacagaaucaucag

SEQ ID NO: 3761098 - RNA, 14 nt, Salmonella typhimurium LT2
guaauucucccaaa

SEQ ID NO: 3761099 - RNA, 12 nt, Salmonella typhimurium LT2
guaauugacgcg

SEQ ID NO: 3761100 - RNA, 19 nt, Salmonella typhimurium LT2
guaauugccauuacgauaa

SEQ ID NO: 3761101 - RNA, 14 nt, Salmonella typhimurium LT2
guaauuuaaaccgc

SEQ ID NO: 3761102 - RNA, 15 nt, Salmonella typhimurium LT2
guaauuucuugcgcc

SEQ ID NO: 3761103 - RNA, 14 nt, Salmonella typhimurium LT2
guaauuuugauaua

SEQ ID NO: 3761104 - RNA, 14 nt, Salmonella typhimurium LT2
guaauuuuucuccc

SEQ ID NO: 3761105 - RNA, 19 nt, Salmonella typhimurium LT2
guaauuuuuugauauuacg

SEQ ID NO: 3761106 - RNA, 13 nt, Salmonella typhimurium LT2
guacaaacaaaua

SEQ ID NO: 3761107 - RNA, 15 nt, Salmonella typhimurium LT2
guacaaacaaauaaa

SEQ ID NO: 3761108 - RNA, 18 nt, Salmonella typhimurium LT2
guacaagggccgccgcca

SEQ ID NO: 3761109 - RNA, 22 nt, Salmonella typhimurium LT2
guacaaugcaaagaaaaacagg

SEQ ID NO: 3761110 - RNA, 16 nt, Salmonella typhimurium LT2
guacaauggcaggcau

SEQ ID NO: 3761111 - RNA, 16 nt, Salmonella typhimurium LT2
guacaauuuccugcca

SEQ ID NO: 3761112 - RNA, 21 nt, Salmonella typhimurium LT2
guacacaauugccaugguuca

SEQ ID NO: 3761113 - RNA, 13 nt, Salmonella typhimurium LT2
guacaccagacga

SEQ ID NO: 3761114 - RNA, 14 nt, Salmonella typhimurium LT2
guacacuucagcca

SEQ ID NO: 3761115 - RNA, 20 nt, Salmonella typhimurium LT2
guacacuucagccagacgcu

SEQ ID NO: 3761116 - RNA, 19 nt, Salmonella typhimurium LT2
guacagccaaaaauaacgc

SEQ ID NO: 3761117 - RNA, 15 nt, Salmonella typhimurium LT2
guacaggcgcucaac

SEQ ID NO: 3761118 - RNA, 18 nt, Salmonella typhimurium LT2
guacagggcgauuuccgu

SEQ ID NO: 3761119 - RNA, 17 nt, Salmonella typhimurium LT2
guacauaacagcagcag

SEQ ID NO: 3761120 - RNA, 17 nt, Salmonella typhimurium LT2
guacauaacaucucacu

SEQ ID NO: 3761121 - RNA, 11 nt, Salmonella typhimurium LT2
guacauaucca

SEQ ID NO: 3761122 - RNA, 13 nt, Salmonella typhimurium LT2
guacaucuuccau

SEQ ID NO: 3761123 - RNA, 20 nt, Salmonella typhimurium LT2
guacauguccagaucuucac

SEQ ID NO: 3761124 - RNA, 15 nt, Salmonella typhimurium LT2
guaccacgccgcaca

SEQ ID NO: 3761125 - RNA, 21 nt, Salmonella typhimurium LT2
guaccagaacucguugccaga

SEQ ID NO: 3761126 - RNA, 14 nt, Salmonella typhimurium LT2
guaccagcaacgcc

SEQ ID NO: 3761127 - RNA, 17 nt, Salmonella typhimurium LT2
guaccagcagaacggua

SEQ ID NO: 3761128 - RNA, 23 nt, Salmonella typhimurium LT2
guaccauaccggugcgccccagc

SEQ ID NO: 3761129 - RNA, 16 nt, Salmonella typhimurium LT2
guacccuguauuuuuu

SEQ ID NO: 3761130 - RNA, 17 nt, Salmonella typhimurium LT2
guaccgaaaccagaaua

SEQ ID NO: 3761131 - RNA, 20 nt, Salmonella typhimurium LT2
guaccgccuuguccggccua

SEQ ID NO: 3761132 - RNA, 22 nt, Salmonella typhimurium LT2
guaccgcuacgcaggccauuuc

SEQ ID NO: 3761133 - RNA, 19 nt, Salmonella typhimurium LT2
guaccgcuaucgccaaacu

SEQ ID NO: 3761134 - RNA, 18 nt, Salmonella typhimurium LT2
guaccgcuugggccaccu

SEQ ID NO: 3761135 - RNA, 23 nt, Salmonella typhimurium LT2
guaccggcaggacaaucauaaua

SEQ ID NO: 3761136 - RNA, 13 nt, Salmonella typhimurium LT2
guaccgggcagac

SEQ ID NO: 3761137 - RNA, 20 nt, Salmonella typhimurium LT2
guaccuaccguaauacuucc

SEQ ID NO: 3761138 - RNA, 22 nt, Salmonella typhimurium LT2
guaccucgcauacuuccucacc

SEQ ID NO: 3761139 - RNA, 17 nt, Salmonella typhimurium LT2
guaccugaagccauccu

SEQ ID NO: 3761140 - RNA, 15 nt, Salmonella typhimurium LT2
guaccugauaaaacu

SEQ ID NO: 3761141 - RNA, 19 nt, Salmonella typhimurium LT2
guaccugauggacaauccg

SEQ ID NO: 3761142 - RNA, 14 nt, Salmonella typhimurium LT2
guaccuggauaaau

SEQ ID NO: 3761143 - RNA, 20 nt, Salmonella typhimurium LT2
guaccuuuaucuugaccuga

SEQ ID NO: 3761144 - RNA, 14 nt, Salmonella typhimurium LT2
guacgcaagcguaa

SEQ ID NO: 3761145 - RNA, 14 nt, Salmonella typhimurium LT2
guacgcaggaggga

SEQ ID NO: 3761146 - RNA, 16 nt, Salmonella typhimurium LT2
guacgccaaguacgcc

SEQ ID NO: 3761147 - RNA, 12 nt, Salmonella typhimurium LT2
guacgcccagcc

SEQ ID NO: 3761148 - RNA, 15 nt, Salmonella typhimurium LT2
guacgcccggcgggu

SEQ ID NO: 3761149 - RNA, 22 nt, Salmonella typhimurium LT2
guacgccucgcgcaccauaaua

SEQ ID NO: 3761150 - RNA, 18 nt, Salmonella typhimurium LT2
guacgccucuuucagccg

SEQ ID NO: 3761151 - RNA, 16 nt, Salmonella typhimurium LT2
guacgccugucgcaac

SEQ ID NO: 3761152 - RNA, 20 nt, Salmonella typhimurium LT2
guacgcgcaaccgcaucacg

SEQ ID NO: 3761153 - RNA, 15 nt, Salmonella typhimurium LT2
guacgcgcgcggcgu

SEQ ID NO: 3761154 - RNA, 15 nt, Salmonella typhimurium LT2
guacgcuccagggcu

SEQ ID NO: 3761155 - RNA, 18 nt, Salmonella typhimurium LT2
guacgcugacgaagauua

SEQ ID NO: 3761156 - RNA, 13 nt, Salmonella typhimurium LT2
guacggauggcgu

SEQ ID NO: 3761157 - RNA, 14 nt, Salmonella typhimurium LT2
guacggccaccagg

SEQ ID NO: 3761158 - RNA, 18 nt, Salmonella typhimurium LT2
guacggcgagaccaccgu

SEQ ID NO: 3761159 - RNA, 13 nt, Salmonella typhimurium LT2
guacggcgcgaau

SEQ ID NO: 3761160 - RNA, 19 nt, Salmonella typhimurium LT2
guacggcuuucuuucucca

SEQ ID NO: 3761161 - RNA, 15 nt, Salmonella typhimurium LT2
guacguccauccgcc

SEQ ID NO: 3761162 - RNA, 16 nt, Salmonella typhimurium LT2
guacuccaggcgcugc

SEQ ID NO: 3761163 - RNA, 20 nt, Salmonella typhimurium LT2
guacuccccuuuuuucuguu

SEQ ID NO: 3761164 - RNA, 23 nt, Salmonella typhimurium LT2
guaucacuguaaaagggauacgg

SEQ ID NO: 3761165 - RNA, 21 nt, Salmonella typhimurium LT2
guaucagcauuuacaucauuc

SEQ ID NO: 3761166 - RNA, 15 nt, Salmonella typhimurium LT2
guaucaucgauuuua

SEQ ID NO: 3761167 - RNA, 11 nt, Salmonella typhimurium LT2
guaucaucgcu

SEQ ID NO: 3761168 - RNA, 17 nt, Salmonella typhimurium LT2
guauccaccaccuggug

SEQ ID NO: 3761169 - RNA, 14 nt, Salmonella typhimurium LT2
guauccauugccag

SEQ ID NO: 3761170 - RNA, 18 nt, Salmonella typhimurium LT2
guauccccagucuuccug

SEQ ID NO: 3761171 - RNA, 19 nt, Salmonella typhimurium LT2
guauccccagucuuccugc

SEQ ID NO: 3761172 - RNA, 13 nt, Salmonella typhimurium LT2
guaucccgccagc

SEQ ID NO: 3761173 - RNA, 16 nt, Salmonella typhimurium LT2
guaucccgccagcggc

SEQ ID NO: 3761174 - RNA, 17 nt, Salmonella typhimurium LT2
guaucccgccagcggcg

SEQ ID NO: 3761175 - RNA, 17 nt, Salmonella typhimurium LT2
guaucccgccuggcgaa

SEQ ID NO: 3761176 - RNA, 12 nt, Salmonella typhimurium LT2
guauccgccaua

SEQ ID NO: 3761177 - RNA, 16 nt, Salmonella typhimurium LT2
guauccggucaauaca

SEQ ID NO: 3761178 - RNA, 13 nt, Salmonella typhimurium LT2
guaucgauaaguc

SEQ ID NO: 3761179 - RNA, 22 nt, Salmonella typhimurium LT2
guaucgcccaccgacagauagc

SEQ ID NO: 3761180 - RNA, 15 nt, Salmonella typhimurium LT2
guaucgcgccgccaa

SEQ ID NO: 3761181 - RNA, 20 nt, Salmonella typhimurium LT2
guaucgcgcuuacacagacu

SEQ ID NO: 3761182 - RNA, 13 nt, Salmonella typhimurium LT2
guaucgcucugcu

SEQ ID NO: 3761183 - RNA, 16 nt, Salmonella typhimurium LT2
guaucggcaauauccc

SEQ ID NO: 3761184 - RNA, 19 nt, Salmonella typhimurium LT2
guaucguagauguccacga

SEQ ID NO: 3761185 - RNA, 22 nt, Salmonella typhimurium LT2
guaucguuugcccaucauucaa

SEQ ID NO: 3761186 - RNA, 17 nt, Salmonella typhimurium LT2
guaucucgucgccaggg

SEQ ID NO: 3761187 - RNA, 20 nt, Salmonella typhimurium LT2
guaucugcaauucggcggca

SEQ ID NO: 3761188 - RNA, 11 nt, Salmonella typhimurium LT2
guaucuuuuau

SEQ ID NO: 3761189 - RNA, 17 nt, Salmonella typhimurium LT2
guaugacccgccccagg

SEQ ID NO: 3761190 - RNA, 17 nt, Salmonella typhimurium LT2
guaugacguggccagca

SEQ ID NO: 3761191 - RNA, 15 nt, Salmonella typhimurium LT2
guaugcagccaggcc

SEQ ID NO: 3761192 - RNA, 17 nt, Salmonella typhimurium LT2
guaugcagccaggccau

SEQ ID NO: 3761193 - RNA, 16 nt, Salmonella typhimurium LT2
guaugcccccuccagc

SEQ ID NO: 3761194 - RNA, 22 nt, Salmonella typhimurium LT2
guaugcccccuccagccagcgc

SEQ ID NO: 3761195 - RNA, 23 nt, Salmonella typhimurium LT2
guaugcccccuccagccagcgcc

SEQ ID NO: 3761196 - RNA, 19 nt, Salmonella typhimurium LT2
guaugccgcauaaaauuuu

SEQ ID NO: 3761197 - RNA, 17 nt, Salmonella typhimurium LT2
guaugcguugcaaauau

SEQ ID NO: 3761198 - RNA, 13 nt, Salmonella typhimurium LT2
guaugcuccuucc

SEQ ID NO: 3761199 - RNA, 15 nt, Salmonella typhimurium LT2
guauggcgccaauau

SEQ ID NO: 3761200 - RNA, 15 nt, Salmonella typhimurium LT2
guaugguggcggggu

SEQ ID NO: 3761201 - RNA, 19 nt, Salmonella typhimurium LT2
guauguauuuuauccagga

SEQ ID NO: 3761202 - RNA, 12 nt, Salmonella typhimurium LT2
guauuaaauaca

SEQ ID NO: 3761203 - RNA, 18 nt, Salmonella typhimurium LT2
guauuaacagcuucuucu

SEQ ID NO: 3761204 - RNA, 16 nt, Salmonella typhimurium LT2
guauuaacauauauag

SEQ ID NO: 3761205 - RNA, 17 nt, Salmonella typhimurium LT2
guauuaagcauuacccc

SEQ ID NO: 3761206 - RNA, 17 nt, Salmonella typhimurium LT2
guauuaagccuuuuuaa

SEQ ID NO: 3761207 - RNA, 16 nt, Salmonella typhimurium LT2
guauuacuauacccgc

SEQ ID NO: 3761208 - RNA, 14 nt, Salmonella typhimurium LT2
guauuauccauugu

SEQ ID NO: 3761209 - RNA, 18 nt, Salmonella typhimurium LT2
guauucagcccgcuggcu

SEQ ID NO: 3761210 - RNA, 15 nt, Salmonella typhimurium LT2
guauucauaccuuua

SEQ ID NO: 3761211 - RNA, 20 nt, Salmonella typhimurium LT2
guauuccagucgcuccacca

SEQ ID NO: 3761212 - RNA, 21 nt, Salmonella typhimurium LT2
guauucccccugauagcgagc

SEQ ID NO: 3761213 - RNA, 20 nt, Salmonella typhimurium LT2
guauucccguuuuucaucca

SEQ ID NO: 3761214 - RNA, 16 nt, Salmonella typhimurium LT2
guauucggaauaaugu

SEQ ID NO: 3761215 - RNA, 19 nt, Salmonella typhimurium LT2
guauucguuaccagcaucg

SEQ ID NO: 3761216 - RNA, 21 nt, Salmonella typhimurium LT2
guauucugcgccagccagcuc

SEQ ID NO: 3761217 - RNA, 14 nt, Salmonella typhimurium LT2
guauugaagcgaua

SEQ ID NO: 3761218 - RNA, 15 nt, Salmonella typhimurium LT2
guauugcaccuggga

SEQ ID NO: 3761219 - RNA, 16 nt, Salmonella typhimurium LT2
guauugcuuucaauuu

SEQ ID NO: 3761220 - RNA, 22 nt, Salmonella typhimurium LT2
guauugcuuucaauuuccgcac

SEQ ID NO: 3761221 - RNA, 13 nt, Salmonella typhimurium LT2
guauuggcaagaa

SEQ ID NO: 3761222 - RNA, 12 nt, Salmonella typhimurium LT2
guauugugcuua

SEQ ID NO: 3761223 - RNA, 14 nt, Salmonella typhimurium LT2
guauuuauccagca

SEQ ID NO: 3761224 - RNA, 17 nt, Salmonella typhimurium LT2
guauuuccauuuuucag

SEQ ID NO: 3761225 - RNA, 16 nt, Salmonella typhimurium LT2
guauuucccuucccag

SEQ ID NO: 3761226 - RNA, 23 nt, Salmonella typhimurium LT2
guauuucgacuuucuucggauua

SEQ ID NO: 3761227 - RNA, 12 nt, Salmonella typhimurium LT2
guauuugcgccc

SEQ ID NO: 3761228 - RNA, 11 nt, Salmonella typhimurium LT2
gucaaaaauaa

SEQ ID NO: 3761229 - RNA, 22 nt, Salmonella typhimurium LT2
gucaaaacuuauuuuauuuuua

SEQ ID NO: 3761230 - RNA, 14 nt, Salmonella typhimurium LT2
gucaaacccuuccg

SEQ ID NO: 3761231 - RNA, 19 nt, Salmonella typhimurium LT2
gucaaacuuguguucccac

SEQ ID NO: 3761232 - RNA, 18 nt, Salmonella typhimurium LT2
gucaaacuuuuauaaaua

SEQ ID NO: 3761233 - RNA, 22 nt, Salmonella typhimurium LT2
gucaaagcauugugcagccaug

SEQ ID NO: 3761234 - RNA, 23 nt, Salmonella typhimurium LT2
gucaaauuccagcaacgagccgu

SEQ ID NO: 3761235 - RNA, 22 nt, Salmonella typhimurium LT2
gucaaauuguacuuuuuggcca

SEQ ID NO: 3761236 - RNA, 16 nt, Salmonella typhimurium LT2
gucaaauuugcugcca

SEQ ID NO: 3761237 - RNA, 22 nt, Salmonella typhimurium LT2
gucaacgaggugaauaaauccu

SEQ ID NO: 3761238 - RNA, 23 nt, Salmonella typhimurium LT2
gucaacgcacuguaacgcacugg

SEQ ID NO: 3761239 - RNA, 15 nt, Salmonella typhimurium LT2
gucaacgugaaaaau

SEQ ID NO: 3761240 - RNA, 17 nt, Salmonella typhimurium LT2
gucaagaucgcgcagca

SEQ ID NO: 3761241 - RNA, 21 nt, Salmonella typhimurium LT2
gucaagaucgcgcagcaggcc

SEQ ID NO: 3761242 - RNA, 16 nt, Salmonella typhimurium LT2
gucaauacaucacgca

SEQ ID NO: 3761243 - RNA, 12 nt, Salmonella typhimurium LT2
gucaaucaucag

SEQ ID NO: 3761244 - RNA, 22 nt, Salmonella typhimurium LT2
gucacagaauacccuccgccau

SEQ ID NO: 3761245 - RNA, 17 nt, Salmonella typhimurium LT2
gucacagauccagacau

SEQ ID NO: 3761246 - RNA, 23 nt, Salmonella typhimurium LT2
gucacauacuucuguaugcuccu

SEQ ID NO: 3761247 - RNA, 12 nt, Salmonella typhimurium LT2
gucacauccaga

SEQ ID NO: 3761248 - RNA, 21 nt, Salmonella typhimurium LT2
gucacauggcgaauaucacua

SEQ ID NO: 3761249 - RNA, 11 nt, Salmonella typhimurium LT2
gucaccagcag

SEQ ID NO: 3761250 - RNA, 20 nt, Salmonella typhimurium LT2
gucaccagcagcauuucaaa

SEQ ID NO: 3761251 - RNA, 16 nt, Salmonella typhimurium LT2
gucaccaggaugccaa

SEQ ID NO: 3761252 - RNA, 17 nt, Salmonella typhimurium LT2
gucacccgccggcagua

SEQ ID NO: 3761253 - RNA, 17 nt, Salmonella typhimurium LT2
gucacccgcguaucauu

SEQ ID NO: 3761254 - RNA, 18 nt, Salmonella typhimurium LT2
gucaccgaauagcgacaa

SEQ ID NO: 3761255 - RNA, 16 nt, Salmonella typhimurium LT2
gucacgacguauuaaa

SEQ ID NO: 3761256 - RNA, 23 nt, Salmonella typhimurium LT2
gucacgaucuggcaaaccaugua

SEQ ID NO: 3761257 - RNA, 22 nt, Salmonella typhimurium LT2
gucacgcaugucguauccccag

SEQ ID NO: 3761258 - RNA, 16 nt, Salmonella typhimurium LT2
gucacgcgaucguagc

SEQ ID NO: 3761259 - RNA, 18 nt, Salmonella typhimurium LT2
gucacgcgcaaagcugcg

SEQ ID NO: 3761260 - RNA, 24 nt, Salmonella typhimurium LT2
gucacgugacgcagacgauaccag

SEQ ID NO: 3761261 - RNA, 19 nt, Salmonella typhimurium LT2
gucacuccggcugcaccag

SEQ ID NO: 3761262 - RNA, 21 nt, Salmonella typhimurium LT2
gucacuggccauuugcggaau

SEQ ID NO: 3761263 - RNA, 20 nt, Salmonella typhimurium LT2
gucacugguacgugaaauaa

SEQ ID NO: 3761264 - RNA, 19 nt, Salmonella typhimurium LT2
gucagaucguaugcgccug

SEQ ID NO: 3761265 - RNA, 21 nt, Salmonella typhimurium LT2
gucagauuauggcuacaccuu

SEQ ID NO: 3761266 - RNA, 13 nt, Salmonella typhimurium LT2
gucagcaagauua

SEQ ID NO: 3761267 - RNA, 15 nt, Salmonella typhimurium LT2
gucagcaauuaacaa

SEQ ID NO: 3761268 - RNA, 19 nt, Salmonella typhimurium LT2
guccagucgaacuuugcga

SEQ ID NO: 3761269 - RNA, 16 nt, Salmonella typhimurium LT2
guccaguucguucugc

SEQ ID NO: 3761270 - RNA, 13 nt, Salmonella typhimurium LT2
guccauauucagu

SEQ ID NO: 3761271 - RNA, 15 nt, Salmonella typhimurium LT2
guccaucagauucaa

SEQ ID NO: 3761272 - RNA, 21 nt, Salmonella typhimurium LT2
guccaucaggcuuugcgccau

SEQ ID NO: 3761273 - RNA, 14 nt, Salmonella typhimurium LT2
guccaugcaugacg

SEQ ID NO: 3761274 - RNA, 20 nt, Salmonella typhimurium LT2
guccauguuuuauacucaaa

SEQ ID NO: 3761275 - RNA, 21 nt, Salmonella typhimurium LT2
guccauuacucucauguucaa

SEQ ID NO: 3761276 - RNA, 18 nt, Salmonella typhimurium LT2
guccauugcgagaaaaaa

SEQ ID NO: 3761277 - RNA, 18 nt, Salmonella typhimurium LT2
guccauuuauugcaggua

SEQ ID NO: 3761278 - RNA, 24 nt, Salmonella typhimurium LT2
guccauuuauugcagguauugagu

SEQ ID NO: 3761279 - RNA, 14 nt, Salmonella typhimurium LT2
guccauuuuccuau

SEQ ID NO: 3761280 - RNA, 16 nt, Salmonella typhimurium LT2
gucccacaugaacucg

SEQ ID NO: 3761281 - RNA, 16 nt, Salmonella typhimurium LT2
gucccagcgucaacug

SEQ ID NO: 3761282 - RNA, 23 nt, Salmonella typhimurium LT2
gucccaucguaacgccgucgaca

SEQ ID NO: 3761283 - RNA, 13 nt, Salmonella typhimurium LT2
guccccaccaacg

SEQ ID NO: 3761284 - RNA, 14 nt, Salmonella typhimurium LT2
guccccagccgcca

SEQ ID NO: 3761285 - RNA, 21 nt, Salmonella typhimurium LT2
guccccagcgauccagccgca

SEQ ID NO: 3761286 - RNA, 19 nt, Salmonella typhimurium LT2
guccccagcguaccacgcc

SEQ ID NO: 3761287 - RNA, 17 nt, Salmonella typhimurium LT2
gucccccagggaugcgc

SEQ ID NO: 3761288 - RNA, 15 nt, Salmonella typhimurium LT2
guccccugacagagc

SEQ ID NO: 3761289 - RNA, 22 nt, Salmonella typhimurium LT2
guccccuggacgcgagccacag

SEQ ID NO: 3761290 - RNA, 17 nt, Salmonella typhimurium LT2
gucccucuccagggcaa

SEQ ID NO: 3761291 - RNA, 11 nt, Salmonella typhimurium LT2
gucccugcugg

SEQ ID NO: 3761292 - RNA, 15 nt, Salmonella typhimurium LT2
gucccugcuucaccg

SEQ ID NO: 3761293 - RNA, 21 nt, Salmonella typhimurium LT2
gucccuuucccuuccagcgac

SEQ ID NO: 3761294 - RNA, 16 nt, Salmonella typhimurium LT2
guccgcaaagaaccaa

SEQ ID NO: 3761295 - RNA, 20 nt, Salmonella typhimurium LT2
guccgcaaagacaacgacca

SEQ ID NO: 3761296 - RNA, 22 nt, Salmonella typhimurium LT2
guccgccaauuccugccagaga

SEQ ID NO: 3761297 - RNA, 21 nt, Salmonella typhimurium LT2
guccgccuaccagcacaugau

SEQ ID NO: 3761298 - RNA, 16 nt, Salmonella typhimurium LT2
guccgccuuugacgcc

SEQ ID NO: 3761299 - RNA, 18 nt, Salmonella typhimurium LT2
guccgcguuaacuccccu

SEQ ID NO: 3761300 - RNA, 13 nt, Salmonella typhimurium LT2
guccggauggcgu

SEQ ID NO: 3761301 - RNA, 23 nt, Salmonella typhimurium LT2
guccgggcuccauagggcagggu

SEQ ID NO: 3761302 - RNA, 19 nt, Salmonella typhimurium LT2
guccgggcugcacgccauc

SEQ ID NO: 3761303 - RNA, 20 nt, Salmonella typhimurium LT2
guccgggcugcacgccaucg

SEQ ID NO: 3761304 - RNA, 17 nt, Salmonella typhimurium LT2
guccggguucagcgaca

SEQ ID NO: 3761305 - RNA, 18 nt, Salmonella typhimurium LT2
guccgguaacggaugaaa

SEQ ID NO: 3761306 - RNA, 16 nt, Salmonella typhimurium LT2
guccgucagauccgca

SEQ ID NO: 3761307 - RNA, 18 nt, Salmonella typhimurium LT2
guccguuuucgcccccag

SEQ ID NO: 3761308 - RNA, 17 nt, Salmonella typhimurium LT2
guccuaggacgaaaaau

SEQ ID NO: 3761309 - RNA, 18 nt, Salmonella typhimurium LT2
guccuaggacgaaaaaug

SEQ ID NO: 3761310 - RNA, 21 nt, Salmonella typhimurium LT2
guccuaggacgaaaaaugaau

SEQ ID NO: 3761311 - RNA, 17 nt, Salmonella typhimurium LT2
guccuccagcgugcaga

SEQ ID NO: 3761312 - RNA, 19 nt, Salmonella typhimurium LT2
guccuccagcgugcagaug

SEQ ID NO: 3761313 - RNA, 14 nt, Salmonella typhimurium LT2
guccuccauggcuu

SEQ ID NO: 3761314 - RNA, 21 nt, Salmonella typhimurium LT2
guccucggacgaaaaaugaau

SEQ ID NO: 3761315 - RNA, 22 nt, Salmonella typhimurium LT2
guccucggcaacauaccgggua

SEQ ID NO: 3761316 - RNA, 19 nt, Salmonella typhimurium LT2
guccucuuucccuuuuuaa

SEQ ID NO: 3761317 - RNA, 21 nt, Salmonella typhimurium LT2
guccugauagccguaaauaau

SEQ ID NO: 3761318 - RNA, 21 nt, Salmonella typhimurium LT2
guccugcccgccacccuccgg

SEQ ID NO: 3761319 - RNA, 20 nt, Salmonella typhimurium LT2
guccugcgcgacgcccacca

SEQ ID NO: 3761320 - RNA, 16 nt, Salmonella typhimurium LT2
guccugggccgccacg

SEQ ID NO: 3761321 - RNA, 16 nt, Salmonella typhimurium LT2
guccugguacaucgcg

SEQ ID NO: 3761322 - RNA, 18 nt, Salmonella typhimurium LT2
guccugguguguaaauuu

SEQ ID NO: 3761323 - RNA, 23 nt, Salmonella typhimurium LT2
guccuguaacaacuguuuuucac

SEQ ID NO: 3761324 - RNA, 21 nt, Salmonella typhimurium LT2
guccuuuaucugcccuuucuu

SEQ ID NO: 3761325 - RNA, 20 nt, Salmonella typhimurium LT2
gucgaaacacgaauaauucu

SEQ ID NO: 3761326 - RNA, 23 nt, Salmonella typhimurium LT2
gucgaacugaauggucggcugcu

SEQ ID NO: 3761327 - RNA, 18 nt, Salmonella typhimurium LT2
gucgaacuuacggcgcgc

SEQ ID NO: 3761328 - RNA, 19 nt, Salmonella typhimurium LT2
gucgaaggcgcuuugcgag

SEQ ID NO: 3761329 - RNA, 20 nt, Salmonella typhimurium LT2
gucgacaaagccaacgccgc

SEQ ID NO: 3761330 - RNA, 13 nt, Salmonella typhimurium LT2
gucgacaccagcg

SEQ ID NO: 3761331 - RNA, 15 nt, Salmonella typhimurium LT2
gucgacaccagcgau

SEQ ID NO: 3761332 - RNA, 14 nt, Salmonella typhimurium LT2
gucgacaugcgcau

SEQ ID NO: 3761333 - RNA, 17 nt, Salmonella typhimurium LT2
gucgaccauacgcagca

SEQ ID NO: 3761334 - RNA, 15 nt, Salmonella typhimurium LT2
gucgaccgguccacu

SEQ ID NO: 3761335 - RNA, 16 nt, Salmonella typhimurium LT2
gucgacgaccucggaa

SEQ ID NO: 3761336 - RNA, 16 nt, Salmonella typhimurium LT2
gucgacgucuuucuua

SEQ ID NO: 3761337 - RNA, 15 nt, Salmonella typhimurium LT2
gucgacguuuuucag

SEQ ID NO: 3761338 - RNA, 21 nt, Salmonella typhimurium LT2
gucgacguuuuucagccgcgc

SEQ ID NO: 3761339 - RNA, 13 nt, Salmonella typhimurium LT2
gucgagcagcagg

SEQ ID NO: 3761340 - RNA, 15 nt, Salmonella typhimurium LT2
gucgagcagcaggac

SEQ ID NO: 3761341 - RNA, 21 nt, Salmonella typhimurium LT2
gucgagcuuuugcugcgccag

SEQ ID NO: 3761342 - RNA, 23 nt, Salmonella typhimurium LT2
gucgaggaagcugcgcagcacuu

SEQ ID NO: 3761343 - RNA, 20 nt, Salmonella typhimurium LT2
gucgaggacggccugacggu

SEQ ID NO: 3761344 - RNA, 18 nt, Salmonella typhimurium LT2
gucgauaaaugcccgaau

SEQ ID NO: 3761345 - RNA, 21 nt, Salmonella typhimurium LT2
gucgauaaccuggaugacaca

SEQ ID NO: 3761346 - RNA, 23 nt, Salmonella typhimurium LT2
gucgauacucacgacuuucacca

SEQ ID NO: 3761347 - RNA, 16 nt, Salmonella typhimurium LT2
gucgaucacgguggug

SEQ ID NO: 3761348 - RNA, 19 nt, Salmonella typhimurium LT2
gucgaucucaggcuuacca

SEQ ID NO: 3761349 - RNA, 16 nt, Salmonella typhimurium LT2
gucgaugaaacgcuga

SEQ ID NO: 3761350 - RNA, 15 nt, Salmonella typhimurium LT2
gucgaugauuuucaa

SEQ ID NO: 3761351 - RNA, 12 nt, Salmonella typhimurium LT2
gucgauuuccgg

SEQ ID NO: 3761352 - RNA, 17 nt, Salmonella typhimurium LT2
gucgauuuccggcggca

SEQ ID NO: 3761353 - RNA, 16 nt, Salmonella typhimurium LT2
gucgauuuugccuuca

SEQ ID NO: 3761354 - RNA, 14 nt, Salmonella typhimurium LT2
gucgcacuccucug

SEQ ID NO: 3761355 - RNA, 19 nt, Salmonella typhimurium LT2
gucgcagagcccagcgcga

SEQ ID NO: 3761356 - RNA, 13 nt, Salmonella typhimurium LT2
gucgcagcggcgg

SEQ ID NO: 3761357 - RNA, 20 nt, Salmonella typhimurium LT2
gucgcauccggcuacgggcg

SEQ ID NO: 3761358 - RNA, 21 nt, Salmonella typhimurium LT2
gucgccaaagcagcugcuggu

SEQ ID NO: 3761359 - RNA, 12 nt, Salmonella typhimurium LT2
gucgccaccugc

SEQ ID NO: 3761360 - RNA, 18 nt, Salmonella typhimurium LT2
gucgccacgcgacgccag

SEQ ID NO: 3761361 - RNA, 17 nt, Salmonella typhimurium LT2
gucgccagaaggcaggu

SEQ ID NO: 3761362 - RNA, 22 nt, Salmonella typhimurium LT2
gucgccagaauguuauaaccga

SEQ ID NO: 3761363 - RNA, 23 nt, Salmonella typhimurium LT2
gucgccaggcaagguuaacguca

SEQ ID NO: 3761364 - RNA, 19 nt, Salmonella typhimurium LT2
gucgccauauguuccaccg

SEQ ID NO: 3761365 - RNA, 15 nt, Salmonella typhimurium LT2
gucgccauccaccag

SEQ ID NO: 3761366 - RNA, 22 nt, Salmonella typhimurium LT2
gucgccaugaccugggcgccag

SEQ ID NO: 3761367 - RNA, 23 nt, Salmonella typhimurium LT2
gucgcccgcuaagggcaccagca

SEQ ID NO: 3761368 - RNA, 22 nt, Salmonella typhimurium LT2
gucgccgcaggcccggcaggca

SEQ ID NO: 3761369 - RNA, 11 nt, Salmonella typhimurium LT2
gucgccgccgu

SEQ ID NO: 3761370 - RNA, 15 nt, Salmonella typhimurium LT2
gucgccgcgcccagc

SEQ ID NO: 3761371 - RNA, 13 nt, Salmonella typhimurium LT2
gucuuccuuccac

SEQ ID NO: 3761372 - RNA, 16 nt, Salmonella typhimurium LT2
gucuucgaccgccaua

SEQ ID NO: 3761373 - RNA, 15 nt, Salmonella typhimurium LT2
gucuucugccagcag

SEQ ID NO: 3761374 - RNA, 23 nt, Salmonella typhimurium LT2
gucuucuucuucgcgcauuucug

SEQ ID NO: 3761375 - RNA, 21 nt, Salmonella typhimurium LT2
gucuugauagcgaucagcgcc

SEQ ID NO: 3761376 - RNA, 11 nt, Salmonella typhimurium LT2
gucuugccagc

SEQ ID NO: 3761377 - RNA, 14 nt, Salmonella typhimurium LT2
gucuugucaggcuc

SEQ ID NO: 3761378 - RNA, 15 nt, Salmonella typhimurium LT2
gucuuuauccgccag

SEQ ID NO: 3761379 - RNA, 18 nt, Salmonella typhimurium LT2
gucuuuauucaucaucuu

SEQ ID NO: 3761380 - RNA, 15 nt, Salmonella typhimurium LT2
gucuuucuucgcugc

SEQ ID NO: 3761381 - RNA, 16 nt, Salmonella typhimurium LT2
gucuuuguugccuucg

SEQ ID NO: 3761382 - RNA, 15 nt, Salmonella typhimurium LT2
gucuuuuacacugau

SEQ ID NO: 3761383 - RNA, 21 nt, Salmonella typhimurium LT2
gucuuuugaauaguaacuggc

SEQ ID NO: 3761384 - RNA, 13 nt, Salmonella typhimurium LT2
gucuuuuucucaa

SEQ ID NO: 3761385 - RNA, 22 nt, Salmonella typhimurium LT2
gugaaaaaauaucgcugcccag

SEQ ID NO: 3761386 - RNA, 16 nt, Salmonella typhimurium LT2
gugaaaaaucccccau

SEQ ID NO: 3761387 - RNA, 18 nt, Salmonella typhimurium LT2
gugaaaaaugacgccggg

SEQ ID NO: 3761388 - RNA, 17 nt, Salmonella typhimurium LT2
gugaaaaccuaaauaaa

SEQ ID NO: 3761389 - RNA, 20 nt, Salmonella typhimurium LT2
gugaaaagcgggggcgacag

SEQ ID NO: 3761390 - RNA, 21 nt, Salmonella typhimurium LT2
gugaaauaaacguaccgauga

SEQ ID NO: 3761391 - RNA, 11 nt, Salmonella typhimurium LT2
gugaaauaaau

SEQ ID NO: 3761392 - RNA, 21 nt, Salmonella typhimurium LT2
gugaacacacccuucucaggg

SEQ ID NO: 3761393 - RNA, 16 nt, Salmonella typhimurium LT2
gugaacaccacugaaa

SEQ ID NO: 3761394 - RNA, 22 nt, Salmonella typhimurium LT2
gugaacaucacgcccuccuguu

SEQ ID NO: 3761395 - RNA, 20 nt, Salmonella typhimurium LT2
gugaacauggguuucuugcu

SEQ ID NO: 3761396 - RNA, 19 nt, Salmonella typhimurium LT2
gugaacauuacaauguaca

SEQ ID NO: 3761397 - RNA, 22 nt, Salmonella typhimurium LT2
gugaaccaaagcaaaaaaugac

SEQ ID NO: 3761398 - RNA, 16 nt, Salmonella typhimurium LT2
gugaaccggacgcuuc

SEQ ID NO: 3761399 - RNA, 18 nt, Salmonella typhimurium LT2
gugaacgccaaauacguc

SEQ ID NO: 3761400 - RNA, 17 nt, Salmonella typhimurium LT2
gugaacgguugagcuuu

SEQ ID NO: 3761401 - RNA, 12 nt, Salmonella typhimurium LT2
gugaacugcgcc

SEQ ID NO: 3761402 - RNA, 14 nt, Salmonella typhimurium LT2
gugaacugcgccug

SEQ ID NO: 3761403 - RNA, 19 nt, Salmonella typhimurium LT2
gugaagaucagcagagcgg

SEQ ID NO: 3761404 - RNA, 21 nt, Salmonella typhimurium LT2
gugaagaugguaauauuaaaa

SEQ ID NO: 3761405 - RNA, 21 nt, Salmonella typhimurium LT2
gugaaggcaaaacaccauauu

SEQ ID NO: 3761406 - RNA, 17 nt, Salmonella typhimurium LT2
gugaagggggccagagc

SEQ ID NO: 3761407 - RNA, 16 nt, Salmonella typhimurium LT2
gugaauaccaaagccc

SEQ ID NO: 3761408 - RNA, 16 nt, Salmonella typhimurium LT2
gugaauaccagcggca

SEQ ID NO: 3761409 - RNA, 19 nt, Salmonella typhimurium LT2
gugaauaucaccccagguu

SEQ ID NO: 3761410 - RNA, 15 nt, Salmonella typhimurium LT2
gugaauaucgagcgg

SEQ ID NO: 3761411 - RNA, 22 nt, Salmonella typhimurium LT2
gugaauauuugcgcuaguuucu

SEQ ID NO: 3761412 - RNA, 19 nt, Salmonella typhimurium LT2
gugaaugcgcggcugcgga

SEQ ID NO: 3761413 - RNA, 14 nt, Salmonella typhimurium LT2
gugaauguccugcg

SEQ ID NO: 3761414 - RNA, 14 nt, Salmonella typhimurium LT2
gugaccgauaaaaa

SEQ ID NO: 3761415 - RNA, 15 nt, Salmonella typhimurium LT2
gugaccgauaaaaaa

SEQ ID NO: 3761416 - RNA, 21 nt, Salmonella typhimurium LT2
gugaccgguaagcccauggca

SEQ ID NO: 3761417 - RNA, 14 nt, Salmonella typhimurium LT2
gugaccugcugacu

SEQ ID NO: 3761418 - RNA, 21 nt, Salmonella typhimurium LT2
gugacgauacggcccagaccc

SEQ ID NO: 3761419 - RNA, 15 nt, Salmonella typhimurium LT2
gugacgcagacguca

SEQ ID NO: 3761420 - RNA, 19 nt, Salmonella typhimurium LT2
gugacgccgccauccggua

SEQ ID NO: 3761421 - RNA, 14 nt, Salmonella typhimurium LT2
gugacguucaucau

SEQ ID NO: 3761422 - RNA, 17 nt, Salmonella typhimurium LT2
gugacuaauagccaaaa

SEQ ID NO: 3761423 - RNA, 14 nt, Salmonella typhimurium LT2
gugacucauuucaa

SEQ ID NO: 3761424 - RNA, 15 nt, Salmonella typhimurium LT2
gugacucauuucaac

SEQ ID NO: 3761425 - RNA, 22 nt, Salmonella typhimurium LT2
gugacugauaaaagcccuuauc

SEQ ID NO: 3761426 - RNA, 15 nt, Salmonella typhimurium LT2
gugacuuuccaguua

SEQ ID NO: 3761427 - RNA, 16 nt, Salmonella typhimurium LT2
gugacuuuccaguuaa

SEQ ID NO: 3761428 - RNA, 13 nt, Salmonella typhimurium LT2
gugagaaaaguaa

SEQ ID NO: 3761429 - RNA, 20 nt, Salmonella typhimurium LT2
gugagaagggcagaucgagg

SEQ ID NO: 3761430 - RNA, 21 nt, Salmonella typhimurium LT2
gugagacgcagccucucuucu

SEQ ID NO: 3761431 - RNA, 14 nt, Salmonella typhimurium LT2
gugagauauggcac

SEQ ID NO: 3761432 - RNA, 23 nt, Salmonella typhimurium LT2
gugagaucguuauuaaacagaca

SEQ ID NO: 3761433 - RNA, 15 nt, Salmonella typhimurium LT2
gugagauugacagaa

SEQ ID NO: 3761434 - RNA, 15 nt, Salmonella typhimurium LT2
gugagccuaaaacau

SEQ ID NO: 3761435 - RNA, 14 nt, Salmonella typhimurium LT2
gugagcgaaguucu

SEQ ID NO: 3761436 - RNA, 18 nt, Salmonella typhimurium LT2
gugagcuuccgucgccag

SEQ ID NO: 3761437 - RNA, 21 nt, Salmonella typhimurium LT2
gugaggcagauacgcgggcuc

SEQ ID NO: 3761438 - RNA, 15 nt, Salmonella typhimurium LT2
gugaguacgcaggag

SEQ ID NO: 3761439 - RNA, 16 nt, Salmonella typhimurium LT2
gugauaaagcagacca

SEQ ID NO: 3761440 - RNA, 14 nt, Salmonella typhimurium LT2
gugauaaagcccgu

SEQ ID NO: 3761441 - RNA, 16 nt, Salmonella typhimurium LT2
gugauacuggcggcga

SEQ ID NO: 3761442 - RNA, 22 nt, Salmonella typhimurium LT2
gugauacuguagggguuccaag

SEQ ID NO: 3761443 - RNA, 14 nt, Salmonella typhimurium LT2
gugauagcgcgcca

SEQ ID NO: 3761444 - RNA, 16 nt, Salmonella typhimurium LT2
gugaugacuaaaucag

SEQ ID NO: 3761445 - RNA, 18 nt, Salmonella typhimurium LT2
gugaugagcucaaauaug

SEQ ID NO: 3761446 - RNA, 23 nt, Salmonella typhimurium LT2
gugaugauuacucuucauucaug

SEQ ID NO: 3761447 - RNA, 18 nt, Salmonella typhimurium LT2
gugaugcaucagaacaaa

SEQ ID NO: 3761448 - RNA, 15 nt, Salmonella typhimurium LT2
gugaugcgccagcca

SEQ ID NO: 3761449 - RNA, 16 nt, Salmonella typhimurium LT2
gugaugcggacgcuga

SEQ ID NO: 3761450 - RNA, 19 nt, Salmonella typhimurium LT2
gugaugcguugagcguguc

SEQ ID NO: 3761451 - RNA, 15 nt, Salmonella typhimurium LT2
gugaugcuuuuuaca

SEQ ID NO: 3761452 - RNA, 13 nt, Salmonella typhimurium LT2
gugauggugcagc

SEQ ID NO: 3761453 - RNA, 18 nt, Salmonella typhimurium LT2
gugauggugcagccccgg

SEQ ID NO: 3761454 - RNA, 14 nt, Salmonella typhimurium LT2
gugaugugguugug

SEQ ID NO: 3761455 - RNA, 15 nt, Salmonella typhimurium LT2
gugauuaacgcgaaa

SEQ ID NO: 3761456 - RNA, 15 nt, Salmonella typhimurium LT2
gugauuacaaaaugu

SEQ ID NO: 3761457 - RNA, 21 nt, Salmonella typhimurium LT2
gugauuaugaucgucaacgca

SEQ ID NO: 3761458 - RNA, 22 nt, Salmonella typhimurium LT2
gugauuccuuugaaaucgaaca

SEQ ID NO: 3761459 - RNA, 19 nt, Salmonella typhimurium LT2
gugauugaaguucuuccca

SEQ ID NO: 3761460 - RNA, 14 nt, Salmonella typhimurium LT2
gugauuguccaacu

SEQ ID NO: 3761461 - RNA, 21 nt, Salmonella typhimurium LT2
gugcaaacgauaaaagcucug

SEQ ID NO: 3761462 - RNA, 23 nt, Salmonella typhimurium LT2
gugcaaucccggaacagcggagc

SEQ ID NO: 3761463 - RNA, 24 nt, Salmonella typhimurium LT2
gugcaaucccggaacagcggagcg

SEQ ID NO: 3761464 - RNA, 17 nt, Salmonella typhimurium LT2
gugcaccguaucggcag

SEQ ID NO: 3761465 - RNA, 16 nt, Salmonella typhimurium LT2
gugcacgaacugcugc

SEQ ID NO: 3761466 - RNA, 16 nt, Salmonella typhimurium LT2
gugcagcaagcggcug

SEQ ID NO: 3761467 - RNA, 14 nt, Salmonella typhimurium LT2
gugcagccaugucu

SEQ ID NO: 3761468 - RNA, 14 nt, Salmonella typhimurium LT2
gugcagcgugccgg

SEQ ID NO: 3761469 - RNA, 17 nt, Salmonella typhimurium LT2
gugcagcguuuccagcc

SEQ ID NO: 3761470 - RNA, 15 nt, Salmonella typhimurium LT2
gugcaggagcaguga

SEQ ID NO: 3761471 - RNA, 19 nt, Salmonella typhimurium LT2
gugcaguauugcaccagga

SEQ ID NO: 3761472 - RNA, 17 nt, Salmonella typhimurium LT2
gugcagugacagaggaa

SEQ ID NO: 3761473 - RNA, 22 nt, Salmonella typhimurium LT2
gugcauaaagauugguaucugc

SEQ ID NO: 3761474 - RNA, 13 nt, Salmonella typhimurium LT2
gugcauaaagcgg

SEQ ID NO: 3761475 - RNA, 19 nt, Salmonella typhimurium LT2
guggcgcugucgcuuaccg

SEQ ID NO: 3761476 - RNA, 18 nt, Salmonella typhimurium LT2
guggcgcuucgcuuaccg

SEQ ID NO: 3761477 - RNA, 15 nt, Salmonella typhimurium LT2
guggcggaauuggua

SEQ ID NO: 3761478 - RNA, 14 nt, Salmonella typhimurium LT2
guggcggacgggug

SEQ ID NO: 3761479 - RNA, 21 nt, Salmonella typhimurium LT2
guggcgguaucaaugcgacag

SEQ ID NO: 3761480 - RNA, 15 nt, Salmonella typhimurium LT2
guggcguuuucauua

SEQ ID NO: 3761481 - RNA, 19 nt, Salmonella typhimurium LT2
guggcuaacgggcugaccg

SEQ ID NO: 3761482 - RNA, 16 nt, Salmonella typhimurium LT2
guggcuuuauugacua

SEQ ID NO: 3761483 - RNA, 19 nt, Salmonella typhimurium LT2
gugggaucgacucauccag

SEQ ID NO: 3761484 - RNA, 19 nt, Salmonella typhimurium LT2
gugggaugcguaauccggc

SEQ ID NO: 3761485 - RNA, 23 nt, Salmonella typhimurium LT2
gugggauugcagcagaucgacau

SEQ ID NO: 3761486 - RNA, 19 nt, Salmonella typhimurium LT2
gugggcuacggcucccucg

SEQ ID NO: 3761487 - RNA, 22 nt, Salmonella typhimurium LT2
guggggaauguauuucagacuu

SEQ ID NO: 3761488 - RNA, 18 nt, Salmonella typhimurium LT2
guggggccuaaugagcca

SEQ ID NO: 3761489 - RNA, 17 nt, Salmonella typhimurium LT2
guggggcuaagugagca

SEQ ID NO: 3761490 - RNA, 13 nt, Salmonella typhimurium LT2
gugggucugcggc

SEQ ID NO: 3761491 - RNA, 21 nt, Salmonella typhimurium LT2
gugggucugcggcggugccug

SEQ ID NO: 3761492 - RNA, 19 nt, Salmonella typhimurium LT2
gugguaucgcggcagcgcu

SEQ ID NO: 3761493 - RNA, 14 nt, Salmonella typhimurium LT2
gugguauucagccc

SEQ ID NO: 3761494 - RNA, 23 nt, Salmonella typhimurium LT2
guggucaguagcguucucuccag

SEQ ID NO: 3761495 - RNA, 18 nt, Salmonella typhimurium LT2
guggucaucgcggccagc

SEQ ID NO: 3761496 - RNA, 22 nt, Salmonella typhimurium LT2
gugguccgguaacggaugaaag

SEQ ID NO: 3761497 - RNA, 12 nt, Salmonella typhimurium LT2
guggucgacaua

SEQ ID NO: 3761498 - RNA, 22 nt, Salmonella typhimurium LT2
guggucgacauauucaugguuc

SEQ ID NO: 3761499 - RNA, 21 nt, Salmonella typhimurium LT2
guggugauucaaauccuggaa

SEQ ID NO: 3761500 - RNA, 16 nt, Salmonella typhimurium LT2
guggugcggcuuaucg

SEQ ID NO: 3761501 - RNA, 13 nt, Salmonella typhimurium LT2
gugguguuaacga

SEQ ID NO: 3761502 - RNA, 17 nt, Salmonella typhimurium LT2
gugguuaacagcgcagg

SEQ ID NO: 3761503 - RNA, 14 nt, Salmonella typhimurium LT2
guguaaaaauuuuu

SEQ ID NO: 3761504 - RNA, 19 nt, Salmonella typhimurium LT2
guguaauaaccguggcggc

SEQ ID NO: 3761505 - RNA, 21 nt, Salmonella typhimurium LT2
guguaauaaccguggcggcag

SEQ ID NO: 3761506 - RNA, 15 nt, Salmonella typhimurium LT2
guguaauguuuucug

SEQ ID NO: 3761507 - RNA, 21 nt, Salmonella typhimurium LT2
guguacauccaggaggcaaaa

SEQ ID NO: 3761508 - RNA, 19 nt, Salmonella typhimurium LT2
guguaccagcaacgccagc

SEQ ID NO: 3761509 - RNA, 21 nt, Salmonella typhimurium LT2
guguaccauuguuuacuuuuu

SEQ ID NO: 3761510 - RNA, 15 nt, Salmonella typhimurium LT2
guguagccauaaucu

SEQ ID NO: 3761511 - RNA, 19 nt, Salmonella typhimurium LT2
guguaggaaaggcagagaa

SEQ ID NO: 3761512 - RNA, 16 nt, Salmonella typhimurium LT2
guguagguaagauauu

SEQ ID NO: 3761513 - RNA, 18 nt, Salmonella typhimurium LT2
guguaucgcccugccagc

SEQ ID NO: 3761514 - RNA, 11 nt, Salmonella typhimurium LT2
guguauuuuuu

SEQ ID NO: 3761515 - RNA, 11 nt, Salmonella typhimurium LT2
gugucaaagcg

SEQ ID NO: 3761516 - RNA, 14 nt, Salmonella typhimurium LT2
gugucacucaucgg

SEQ ID NO: 3761517 - RNA, 21 nt, Salmonella typhimurium LT2
gugucacucaucggccaccac

SEQ ID NO: 3761518 - RNA, 16 nt, Salmonella typhimurium LT2
gugucagauccuucau

SEQ ID NO: 3761519 - RNA, 19 nt, Salmonella typhimurium LT2
gugucauaacgaccaaaca

SEQ ID NO: 3761520 - RNA, 19 nt, Salmonella typhimurium LT2
gugucaucauuacaggcga

SEQ ID NO: 3761521 - RNA, 18 nt, Salmonella typhimurium LT2
guguccacaagcccgggc

SEQ ID NO: 3761522 - RNA, 22 nt, Salmonella typhimurium LT2
guguccaugcaugacgcaggcg

SEQ ID NO: 3761523 - RNA, 20 nt, Salmonella typhimurium LT2
gugucccuggaugaucgagg

SEQ ID NO: 3761524 - RNA, 18 nt, Salmonella typhimurium LT2
guguccguaagcggcgga

SEQ ID NO: 3761525 - RNA, 22 nt, Salmonella typhimurium LT2
guguccugaauuguccccaucu

SEQ ID NO: 3761526 - RNA, 18 nt, Salmonella typhimurium LT2
gugucgaaccccggucgg

SEQ ID NO: 3761527 - RNA, 15 nt, Salmonella typhimurium LT2
gugucgccauaaauc

SEQ ID NO: 3761528 - RNA, 23 nt, Salmonella typhimurium LT2
gugucgccggggcgcuggcguga

SEQ ID NO: 3761529 - RNA, 22 nt, Salmonella typhimurium LT2
gugucuucccugaccagcgacg

SEQ ID NO: 3761530 - RNA, 21 nt, Salmonella typhimurium LT2
gugugacagcaacaucuauca

SEQ ID NO: 3761531 - RNA, 14 nt, Salmonella typhimurium LT2
gugugcagugacag

SEQ ID NO: 3761532 - RNA, 16 nt, Salmonella typhimurium LT2
gugugcgacaucgaca

SEQ ID NO: 3761533 - RNA, 16 nt, Salmonella typhimurium LT2
gugugggcacucgaag

SEQ ID NO: 3761534 - RNA, 18 nt, Salmonella typhimurium LT2
guguggucgcggcucacc

SEQ ID NO: 3761535 - RNA, 21 nt, Salmonella typhimurium LT2
guguuaccgccaccuuucugc

SEQ ID NO: 3761536 - RNA, 22 nt, Salmonella typhimurium LT2
guguuaucgcuaucaagcugau

SEQ ID NO: 3761537 - RNA, 17 nt, Salmonella typhimurium LT2
guguucaccauuuccgc

SEQ ID NO: 3761538 - RNA, 15 nt, Salmonella typhimurium LT2
guguuccauugcugc

SEQ ID NO: 3761539 - RNA, 21 nt, Salmonella typhimurium LT2
guguuccuuacuguagcgccg

SEQ ID NO: 3761540 - RNA, 21 nt, Salmonella typhimurium LT2
guguugaaauacuuacuguuu

SEQ ID NO: 3761541 - RNA, 20 nt, Salmonella typhimurium LT2
guguuguacagcaauaaaag

SEQ ID NO: 3761542 - RNA, 13 nt, Salmonella typhimurium LT2
guguuugccagac

SEQ ID NO: 3761543 - RNA, 18 nt, Salmonella typhimurium LT2
guguuuucgauuucauuc

SEQ ID NO: 3761544 - RNA, 20 nt, Salmonella typhimurium LT2
guuaaaaaauuuauaacgua

SEQ ID NO: 3761545 - RNA, 21 nt, Salmonella typhimurium LT2
guuaaaaaucgcuauauugcu

SEQ ID NO: 3761546 - RNA, 15 nt, Salmonella typhimurium LT2
guuaaaaccggcugc

SEQ ID NO: 3761547 - RNA, 20 nt, Salmonella typhimurium LT2
guuaaaagguuauuguguua

SEQ ID NO: 3761548 - RNA, 17 nt, Salmonella typhimurium LT2
guuaaagccgguuucau

SEQ ID NO: 3761549 - RNA, 12 nt, Salmonella typhimurium LT2
guuaaauaccag

SEQ ID NO: 3761550 - RNA, 17 nt, Salmonella typhimurium LT2
guuaacaauauugcgcu

SEQ ID NO: 3761551 - RNA, 17 nt, Salmonella typhimurium LT2
guuaacccgguuuaucc

SEQ ID NO: 3761552 - RNA, 22 nt, Salmonella typhimurium LT2
guuaacgacccaucaauaacga

SEQ ID NO: 3761553 - RNA, 23 nt, Salmonella typhimurium LT2
guuaacucaagcgaauccagauc

SEQ ID NO: 3761554 - RNA, 13 nt, Salmonella typhimurium LT2
guuaacugcugcu

SEQ ID NO: 3761555 - RNA, 16 nt, Salmonella typhimurium LT2
guuaagaagucuguga

SEQ ID NO: 3761556 - RNA, 13 nt, Salmonella typhimurium LT2
guuaagacgcuuc

SEQ ID NO: 3761557 - RNA, 14 nt, Salmonella typhimurium LT2
guuaagcauuucgc

SEQ ID NO: 3761558 - RNA, 20 nt, Salmonella typhimurium LT2
guuaagcgcccgcgcgccag

SEQ ID NO: 3761559 - RNA, 21 nt, Salmonella typhimurium LT2
guuaauaaucgaacugacggu

SEQ ID NO: 3761560 - RNA, 12 nt, Salmonella typhimurium LT2
guuaauacgccg

SEQ ID NO: 3761561 - RNA, 20 nt, Salmonella typhimurium LT2
guuaauacugaucaguuugc

SEQ ID NO: 3761562 - RNA, 21 nt, Salmonella typhimurium LT2
guuaauccagagcggauaaau

SEQ ID NO: 3761563 - RNA, 20 nt, Salmonella typhimurium LT2
guuaaugauuccgucucaga

SEQ ID NO: 3761564 - RNA, 21 nt, Salmonella typhimurium LT2
guuaaugguaccaauagccuu

SEQ ID NO: 3761565 - RNA, 20 nt, Salmonella typhimurium LT2
guuaauuggcccuucagacg

SEQ ID NO: 3761566 - RNA, 11 nt, Salmonella typhimurium LT2
guuaauuucuu

SEQ ID NO: 3761567 - RNA, 19 nt, Salmonella typhimurium LT2
guuacaauauugcgcgcua

SEQ ID NO: 3761568 - RNA, 17 nt, Salmonella typhimurium LT2
guuacaggcuccaggua

SEQ ID NO: 3761569 - RNA, 13 nt, Salmonella typhimurium LT2
guuaccagcauca

SEQ ID NO: 3761570 - RNA, 23 nt, Salmonella typhimurium LT2
guuacccaugagcgaaacuccag

SEQ ID NO: 3761571 - RNA, 19 nt, Salmonella typhimurium LT2
guuaccccaucauugacuu

SEQ ID NO: 3761572 - RNA, 18 nt, Salmonella typhimurium LT2
guuaccgggcaaacagca

SEQ ID NO: 3761573 - RNA, 18 nt, Salmonella typhimurium LT2
guuaccguaaucaucgcg

SEQ ID NO: 3761574 - RNA, 16 nt, Salmonella typhimurium LT2
guuaccguuuaacgca

SEQ ID NO: 3761575 - RNA, 19 nt, Salmonella typhimurium LT2
guuaccucguuucacgucc

SEQ ID NO: 3761576 - RNA, 13 nt, Salmonella typhimurium LT2
guuacgcgccacg

SEQ ID NO: 3761577 - RNA, 24 nt, Salmonella typhimurium LT2
guuacgcgcugcaaauacugcuuu

SEQ ID NO: 3761578 - RNA, 17 nt, Salmonella typhimurium LT2
guuacgcggucuuuuaa

SEQ ID NO: 3761579 - RNA, 14 nt, Salmonella typhimurium LT2
guuacggaaaaaau

SEQ ID NO: 3761580 - RNA, 16 nt, Salmonella typhimurium LT2
guuacggaaaaaauac

SEQ ID NO: 3761581 - RNA, 14 nt, Salmonella typhimurium LT2
guuacguccggcau

SEQ ID NO: 3761582 - RNA, 15 nt, Salmonella typhimurium LT2
guuacuauuuuucac

SEQ ID NO: 3761583 - RNA, 22 nt, Salmonella typhimurium LT2
guuagagcacaucacucauaau

SEQ ID NO: 3761584 - RNA, 23 nt, Salmonella typhimurium LT2
guuagcagaauggcgaucaccgc

SEQ ID NO: 3761585 - RNA, 16 nt, Salmonella typhimurium LT2
guuagcauuauuuuua

SEQ ID NO: 3761586 - RNA, 20 nt, Salmonella typhimurium LT2
guuagccggaagauccuguu

SEQ ID NO: 3761587 - RNA, 18 nt, Salmonella typhimurium LT2
guuagcgaacguccagcg

SEQ ID NO: 3761588 - RNA, 23 nt, Salmonella typhimurium LT2
guuagcgagguucccgccgccau

SEQ ID NO: 3761589 - RNA, 15 nt, Salmonella typhimurium LT2
guuagcgcccauaau

SEQ ID NO: 3761590 - RNA, 19 nt, Salmonella typhimurium LT2
guuagcgcucuucgcucca

SEQ ID NO: 3761591 - RNA, 13 nt, Salmonella typhimurium LT2
guuagcuuucugc

SEQ ID NO: 3761592 - RNA, 17 nt, Salmonella typhimurium LT2
guuagggcgcggcuggu

SEQ ID NO: 3761593 - RNA, 23 nt, Salmonella typhimurium LT2
guuauaaccagacgguuuauccc

SEQ ID NO: 3761594 - RNA, 18 nt, Salmonella typhimurium LT2
guuauacgcauucucgcc

SEQ ID NO: 3761595 - RNA, 17 nt, Salmonella typhimurium LT2
guuaucaaaaaaaacca

SEQ ID NO: 3761596 - RNA, 22 nt, Salmonella typhimurium LT2
guuaucaagagaaccguucaga

SEQ ID NO: 3761597 - RNA, 21 nt, Salmonella typhimurium LT2
guuaucaggauaauuucaccc

SEQ ID NO: 3761598 - RNA, 20 nt, Salmonella typhimurium LT2
guuaucaggcaugauuuucu

SEQ ID NO: 3761599 - RNA, 14 nt, Salmonella typhimurium LT2
guuauccagcagcc

SEQ ID NO: 3761600 - RNA, 19 nt, Salmonella typhimurium LT2
guuaucgauucugaauaau

SEQ ID NO: 3761601 - RNA, 15 nt, Salmonella typhimurium LT2
guuaucgccccaggc

SEQ ID NO: 3761602 - RNA, 22 nt, Salmonella typhimurium LT2
guuaucgccgaucacaacguca

SEQ ID NO: 3761603 - RNA, 15 nt, Salmonella typhimurium LT2
guuaucugaccuaca

SEQ ID NO: 3761604 - RNA, 20 nt, Salmonella typhimurium LT2
guuaucuggcgcaaccggcg

SEQ ID NO: 3761605 - RNA, 14 nt, Salmonella typhimurium LT2
guuaucuuauaaau

SEQ ID NO: 3761606 - RNA, 17 nt, Salmonella typhimurium LT2
guuaugcacaaccagcg

SEQ ID NO: 3761607 - RNA, 12 nt, Salmonella typhimurium LT2
guuaugcaucug

SEQ ID NO: 3761608 - RNA, 21 nt, Salmonella typhimurium LT2
guuaugccuuuuucaacagca

SEQ ID NO: 3761609 - RNA, 12 nt, Salmonella typhimurium LT2
guuauguauuua

SEQ ID NO: 3761610 - RNA, 15 nt, Salmonella typhimurium LT2
guuauuaagcagacu

SEQ ID NO: 3761611 - RNA, 14 nt, Salmonella typhimurium LT2
guuauucgaugcgg

SEQ ID NO: 3761612 - RNA, 14 nt, Salmonella typhimurium LT2
guuauucgcuggcc

SEQ ID NO: 3761613 - RNA, 23 nt, Salmonella typhimurium LT2
guuauucuccaggcugaugugcu

SEQ ID NO: 3761614 - RNA, 20 nt, Salmonella typhimurium LT2
guuauugagaaaauuacgcc

SEQ ID NO: 3761615 - RNA, 21 nt, Salmonella typhimurium LT2
guuauugucaugcuaaaacag

SEQ ID NO: 3761616 - RNA, 18 nt, Salmonella typhimurium LT2
guuauuugccucuggcca

SEQ ID NO: 3761617 - RNA, 21 nt, Salmonella typhimurium LT2
guuauuuggcgauggcagacc

SEQ ID NO: 3761618 - RNA, 23 nt, Salmonella typhimurium LT2
guuauuuuuguaucgauaaguca

SEQ ID NO: 3761619 - RNA, 15 nt, Salmonella typhimurium LT2
guucaaacaucagcg

SEQ ID NO: 3761620 - RNA, 20 nt, Salmonella typhimurium LT2
guucaaccugcgcugacggc

SEQ ID NO: 3761621 - RNA, 21 nt, Salmonella typhimurium LT2
guucaacgccgaacaggccau

SEQ ID NO: 3761622 - RNA, 20 nt, Salmonella typhimurium LT2
guucaacgucagcuggaaug

SEQ ID NO: 3761623 - RNA, 23 nt, Salmonella typhimurium LT2
guucaauagagcgcagcaaaacg

SEQ ID NO: 3761624 - RNA, 23 nt, Salmonella typhimurium LT2
guucaauauucgcgccuagcgcg

SEQ ID NO: 3761625 - RNA, 21 nt, Salmonella typhimurium LT2
guucaccaccacccagugcca

SEQ ID NO: 3761626 - RNA, 22 nt, Salmonella typhimurium LT2
guucaccaccacccagugccac

SEQ ID NO: 3761627 - RNA, 21 nt, Salmonella typhimurium LT2
guucacggccaaagcgcgacu

SEQ ID NO: 3761628 - RNA, 15 nt, Salmonella typhimurium LT2
guucacguaaucgcc

SEQ ID NO: 3761629 - RNA, 18 nt, Salmonella typhimurium LT2
guucagauaggcgcgaaa

SEQ ID NO: 3761630 - RNA, 22 nt, Salmonella typhimurium LT2
guucagcgaccugcagcuccac

SEQ ID NO: 3761631 - RNA, 23 nt, Salmonella typhimurium LT2
guucagcugacaaugugccggau

SEQ ID NO: 3761632 - RNA, 19 nt, Salmonella typhimurium LT2
guucaggcacgugcauaaa

SEQ ID NO: 3761633 - RNA, 17 nt, Salmonella typhimurium LT2
guucaggcggcaaaaaa

SEQ ID NO: 3761634 - RNA, 17 nt, Salmonella typhimurium LT2
guucagguaaaugagga

SEQ ID NO: 3761635 - RNA, 18 nt, Salmonella typhimurium LT2
guucaggugcauuccgcg

SEQ ID NO: 3761636 - RNA, 13 nt, Salmonella typhimurium LT2
guucagguuuuuu

SEQ ID NO: 3761637 - RNA, 12 nt, Salmonella typhimurium LT2
guucaguuuuuc

SEQ ID NO: 3761638 - RNA, 17 nt, Salmonella typhimurium LT2
guucaguuuuuccagca

SEQ ID NO: 3761639 - RNA, 13 nt, Salmonella typhimurium LT2
guucauaaaugau

SEQ ID NO: 3761640 - RNA, 18 nt, Salmonella typhimurium LT2
guucauaagucauccaga

SEQ ID NO: 3761641 - RNA, 13 nt, Salmonella typhimurium LT2
guucauagcgcac

SEQ ID NO: 3761642 - RNA, 17 nt, Salmonella typhimurium LT2
guucaucauccugcagg

SEQ ID NO: 3761643 - RNA, 14 nt, Salmonella typhimurium LT2
guucauccagcgcg

SEQ ID NO: 3761644 - RNA, 16 nt, Salmonella typhimurium LT2
guucauccgcgauuuu

SEQ ID NO: 3761645 - RNA, 16 nt, Salmonella typhimurium LT2
guucauccugcgccau

SEQ ID NO: 3761646 - RNA, 22 nt, Salmonella typhimurium LT2
guucaucgacagguuaaaaucu

SEQ ID NO: 3761647 - RNA, 22 nt, Salmonella typhimurium LT2
guucaucgcuggcguacgccau

SEQ ID NO: 3761648 - RNA, 15 nt, Salmonella typhimurium LT2
guucaugcacucgcg

SEQ ID NO: 3761649 - RNA, 19 nt, Salmonella typhimurium LT2
guucaugcacucgcgacau

SEQ ID NO: 3761650 - RNA, 19 nt, Salmonella typhimurium LT2
guucaugcgacugcccaac

SEQ ID NO: 3761651 - RNA, 23 nt, Salmonella typhimurium LT2
guucaugcgaucgggcaauccau

SEQ ID NO: 3761652 - RNA, 21 nt, Salmonella typhimurium LT2
guucauggcaaaagacauucc

SEQ ID NO: 3761653 - RNA, 14 nt, Salmonella typhimurium LT2
guucaugugcucgu

SEQ ID NO: 3761654 - RNA, 16 nt, Salmonella typhimurium LT2
guucauuaacaucugu

SEQ ID NO: 3761655 - RNA, 15 nt, Salmonella typhimurium LT2
guucauugcuuucuu

SEQ ID NO: 3761656 - RNA, 16 nt, Salmonella typhimurium LT2
guucauugcuuucuug

SEQ ID NO: 3761657 - RNA, 22 nt, Salmonella typhimurium LT2
guucauuuaggcguacgacagg

SEQ ID NO: 3761658 - RNA, 18 nt, Salmonella typhimurium LT2
guuccacacguccauccg

SEQ ID NO: 3761659 - RNA, 15 nt, Salmonella typhimurium LT2
guuccagaaugguua

SEQ ID NO: 3761660 - RNA, 21 nt, Salmonella typhimurium LT2
guuccagcagcgcaucauggu

SEQ ID NO: 3761661 - RNA, 21 nt, Salmonella typhimurium LT2
guuccagcagcucaucaauaa

SEQ ID NO: 3761662 - RNA, 17 nt, Salmonella typhimurium LT2
guuccagccgccaggca

SEQ ID NO: 3761663 - RNA, 22 nt, Salmonella typhimurium LT2
guuccaggcgaaccauaauaaa

SEQ ID NO: 3761664 - RNA, 13 nt, Salmonella typhimurium LT2
guuccaggcgcgc

SEQ ID NO: 3761665 - RNA, 16 nt, Salmonella typhimurium LT2
guuccaguaaggucca

SEQ ID NO: 3761666 - RNA, 21 nt, Salmonella typhimurium LT2
guuccauauccagcgcaggca

SEQ ID NO: 3761667 - RNA, 22 nt, Salmonella typhimurium LT2
guuccauuccagaaucuggccg

SEQ ID NO: 3761668 - RNA, 22 nt, Salmonella typhimurium LT2
guuccccaacagcgaccacgcc

SEQ ID NO: 3761669 - RNA, 20 nt, Salmonella typhimurium LT2
guuccccauacugacggcgc

SEQ ID NO: 3761670 - RNA, 20 nt, Salmonella typhimurium LT2
guucccgagcggccaaaggg

SEQ ID NO: 3761671 - RNA, 20 nt, Salmonella typhimurium LT2
guucccgauuccgugucuga

SEQ ID NO: 3761672 - RNA, 12 nt, Salmonella typhimurium LT2
guucccgccacu

SEQ ID NO: 3761673 - RNA, 17 nt, Salmonella typhimurium LT2
guucccgcgccagcguc

SEQ ID NO: 3761674 - RNA, 14 nt, Salmonella typhimurium LT2
guucccugcgccag

SEQ ID NO: 3761675 - RNA, 22 nt, Salmonella typhimurium LT2
guuccgccacggcguccugcgc

SEQ ID NO: 3761676 - RNA, 20 nt, Salmonella typhimurium LT2
guuccgcuauuugcgcauca

SEQ ID NO: 3761677 - RNA, 16 nt, Salmonella typhimurium LT2
guuccggcagacggcu

SEQ ID NO: 3761678 - RNA, 16 nt, Salmonella typhimurium LT2
guuccggcauaaauaa

SEQ ID NO: 3761679 - RNA, 16 nt, Salmonella typhimurium LT2
guuccugagcagacau

SEQ ID NO: 3761680 - RNA, 17 nt, Salmonella typhimurium LT2
guuccugagucacagaa

SEQ ID NO: 3761681 - RNA, 21 nt, Salmonella typhimurium LT2
guuggcauucgaauccuccug

SEQ ID NO: 3761682 - RNA, 22 nt, Salmonella typhimurium LT2
guuggccugauaucggcugcug

SEQ ID NO: 3761683 - RNA, 19 nt, Salmonella typhimurium LT2
guuggcgacauacgcgcuc

SEQ ID NO: 3761684 - RNA, 15 nt, Salmonella typhimurium LT2
guuggcgauuuccag

SEQ ID NO: 3761685 - RNA, 18 nt, Salmonella typhimurium LT2
guuggcguaaaucaggcc

SEQ ID NO: 3761686 - RNA, 17 nt, Salmonella typhimurium LT2
guuggcguaccaucagc

SEQ ID NO: 3761687 - RNA, 18 nt, Salmonella typhimurium LT2
guuggcuauacgcggcgu

SEQ ID NO: 3761688 - RNA, 19 nt, Salmonella typhimurium LT2
guuggcugucgauuuccgg

SEQ ID NO: 3761689 - RNA, 20 nt, Salmonella typhimurium LT2
guuggcuugaucaacgccgc

SEQ ID NO: 3761690 - RNA, 23 nt, Salmonella typhimurium LT2
guugggauaaugucgacgcgcuc

SEQ ID NO: 3761691 - RNA, 18 nt, Salmonella typhimurium LT2
guuggggauaaccagaaa

SEQ ID NO: 3761692 - RNA, 18 nt, Salmonella typhimurium LT2
guugggugcagcgucagg

SEQ ID NO: 3761693 - RNA, 23 nt, Salmonella typhimurium LT2
guugguauugcgaaacggcagcg

SEQ ID NO: 3761694 - RNA, 16 nt, Salmonella typhimurium LT2
guugguugcuaucguc

SEQ ID NO: 3761695 - RNA, 22 nt, Salmonella typhimurium LT2
guuguacggaugggguaucgcc

SEQ ID NO: 3761696 - RNA, 15 nt, Salmonella typhimurium LT2
guuguaguuaucgcc

SEQ ID NO: 3761697 - RNA, 22 nt, Salmonella typhimurium LT2
guugucauuguaaaaccgacua

SEQ ID NO: 3761698 - RNA, 14 nt, Salmonella typhimurium LT2
guuguccagcagca

SEQ ID NO: 3761699 - RNA, 14 nt, Salmonella typhimurium LT2
guugucccaggcca

SEQ ID NO: 3761700 - RNA, 16 nt, Salmonella typhimurium LT2
guugucgagguuauaa

SEQ ID NO: 3761701 - RNA, 16 nt, Salmonella typhimurium LT2
guugugguuaaacaca

SEQ ID NO: 3761702 - RNA, 22 nt, Salmonella typhimurium LT2
guuguucuuauuguuguauuug

SEQ ID NO: 3761703 - RNA, 13 nt, Salmonella typhimurium LT2
guuguuucaccaa

SEQ ID NO: 3761704 - RNA, 18 nt, Salmonella typhimurium LT2
guuguuuggguaacacaa

SEQ ID NO: 3761705 - RNA, 21 nt, Salmonella typhimurium LT2
guuguuuuauuaccuccugca

SEQ ID NO: 3761706 - RNA, 13 nt, Salmonella typhimurium LT2
guuuaaaaauuuu

SEQ ID NO: 3761707 - RNA, 14 nt, Salmonella typhimurium LT2
guuuaaauccagcg

SEQ ID NO: 3761708 - RNA, 20 nt, Salmonella typhimurium LT2
guuuaaaucgcuaagcagaa

SEQ ID NO: 3761709 - RNA, 13 nt, Salmonella typhimurium LT2
guuuaagcggaua

SEQ ID NO: 3761710 - RNA, 16 nt, Salmonella typhimurium LT2
guuuaaucgcccugcg

SEQ ID NO: 3761711 - RNA, 19 nt, Salmonella typhimurium LT2
guuuaccaaacacgaggcu

SEQ ID NO: 3761712 - RNA, 18 nt, Salmonella typhimurium LT2
guuuacccaggaagagua

SEQ ID NO: 3761713 - RNA, 16 nt, Salmonella typhimurium LT2
guuuaccccaggcgau

SEQ ID NO: 3761714 - RNA, 16 nt, Salmonella typhimurium LT2
guuuaccugcaaaaac

SEQ ID NO: 3761715 - RNA, 22 nt, Salmonella typhimurium LT2
guuuacgagccauuaaugcagg

SEQ ID NO: 3761716 - RNA, 22 nt, Salmonella typhimurium LT2
guuuacgauacguuugaaauga

SEQ ID NO: 3761717 - RNA, 15 nt, Salmonella typhimurium LT2
guuuacgccgccauc

SEQ ID NO: 3761718 - RNA, 20 nt, Salmonella typhimurium LT2
guuuacgcgcaaucagcacc

SEQ ID NO: 3761719 - RNA, 13 nt, Salmonella typhimurium LT2
guuuacuccauuc

SEQ ID NO: 3761720 - RNA, 22 nt, Salmonella typhimurium LT2
guuuagacagacagcguaaaua

SEQ ID NO: 3761721 - RNA, 18 nt, Salmonella typhimurium LT2
guuuauccccgucauacu

SEQ ID NO: 3761722 - RNA, 18 nt, Salmonella typhimurium LT2
guuuauccgccagccagc

SEQ ID NO: 3761723 - RNA, 13 nt, Salmonella typhimurium LT2
guuuauccggcac

SEQ ID NO: 3761724 - RNA, 19 nt, Salmonella typhimurium LT2
guuuauccggcacgguaaa

SEQ ID NO: 3761725 - RNA, 22 nt, Salmonella typhimurium LT2
guuuauccggcacgguaaaccu

SEQ ID NO: 3761726 - RNA, 17 nt, Salmonella typhimurium LT2
guuuaucucugcgcaau

SEQ ID NO: 3761727 - RNA, 17 nt, Salmonella typhimurium LT2
guuuaucugaugccuga

SEQ ID NO: 3761728 - RNA, 19 nt, Salmonella typhimurium LT2
guuuaugguaaucacacaa

SEQ ID NO: 3761729 - RNA, 14 nt, Salmonella typhimurium LT2
guuuauucuucucc

SEQ ID NO: 3761730 - RNA, 23 nt, Salmonella typhimurium LT2
guuucaauauagccguggcuggc

SEQ ID NO: 3761731 - RNA, 15 nt, Salmonella typhimurium LT2
guuucaauccaugua

SEQ ID NO: 3761732 - RNA, 17 nt, Salmonella typhimurium LT2
guuucacguccugguua

SEQ ID NO: 3761733 - RNA, 22 nt, Salmonella typhimurium LT2
guuucacuguggugacgggcaa

SEQ ID NO: 3761734 - RNA, 21 nt, Salmonella typhimurium LT2
guuucagcguuucaccuucac

SEQ ID NO: 3761735 - RNA, 17 nt, Salmonella typhimurium LT2
guuucagcuuccaguua

SEQ ID NO: 3761736 - RNA, 15 nt, Salmonella typhimurium LT2
guuucaggccagacu

SEQ ID NO: 3761737 - RNA, 18 nt, Salmonella typhimurium LT2
guuucaucaucgccgauu

SEQ ID NO: 3761738 - RNA, 22 nt, Salmonella typhimurium LT2
guuucauuucgcccaucgcuuu

SEQ ID NO: 3761739 - RNA, 21 nt, Salmonella typhimurium LT2
guuuccacgacaaucucuacg

SEQ ID NO: 3761740 - RNA, 20 nt, Salmonella typhimurium LT2
guuuccacugaguuucaccg

SEQ ID NO: 3761741 - RNA, 23 nt, Salmonella typhimurium LT2
guuuccagauucggaacgcggcg

SEQ ID NO: 3761742 - RNA, 21 nt, Salmonella typhimurium LT2
guuucccaacaaugccacgcc

SEQ ID NO: 3761743 - RNA, 21 nt, Salmonella typhimurium LT2
guuucccccuccauacccuau

SEQ ID NO: 3761744 - RNA, 21 nt, Salmonella typhimurium LT2
guuucccgcgcggaaggcgcc

SEQ ID NO: 3761745 - RNA, 18 nt, Salmonella typhimurium LT2
guuucccucuuaauuuug

SEQ ID NO: 3761746 - RNA, 15 nt, Salmonella typhimurium LT2
guuuccgcguuauca

SEQ ID NO: 3761747 - RNA, 14 nt, Salmonella typhimurium LT2
guuuccggcgggag

SEQ ID NO: 3761748 - RNA, 19 nt, Salmonella typhimurium LT2
guuuccguuuguaacauau

SEQ ID NO: 3761749 - RNA, 22 nt, Salmonella typhimurium LT2
guuuccguuuguaacauauuuu

SEQ ID NO: 3761750 - RNA, 16 nt, Salmonella typhimurium LT2
guuuccugcgccagca

SEQ ID NO: 3761751 - RNA, 22 nt, Salmonella typhimurium LT2
guuucgaaacguucgcauccca

SEQ ID NO: 3761752 - RNA, 13 nt, Salmonella typhimurium LT2
guuucgccagcgc

SEQ ID NO: 3761753 - RNA, 14 nt, Salmonella typhimurium LT2
guuucgccagcgcg

SEQ ID NO: 3761754 - RNA, 17 nt, Salmonella typhimurium LT2
guuucggugauuuccag

SEQ ID NO: 3761755 - RNA, 14 nt, Salmonella typhimurium LT2
guuucguugccaga

SEQ ID NO: 3761756 - RNA, 22 nt, Salmonella typhimurium LT2
guuucuacuuccaccaccuccu

SEQ ID NO: 3761757 - RNA, 18 nt, Salmonella typhimurium LT2
guuucuagaugaugauuu

SEQ ID NO: 3761758 - RNA, 20 nt, Salmonella typhimurium LT2
guuucuauccuguagugaag

SEQ ID NO: 3761759 - RNA, 21 nt, Salmonella typhimurium LT2
guuucucgccgguagccagcc

SEQ ID NO: 3761760 - RNA, 17 nt, Salmonella typhimurium LT2
guuucucuuccgccagc

SEQ ID NO: 3761761 - RNA, 19 nt, Salmonella typhimurium LT2
guuucucuuccgccagcgc

SEQ ID NO: 3761762 - RNA, 19 nt, Salmonella typhimurium LT2
guuucucuugugcuuccag

SEQ ID NO: 3761763 - RNA, 22 nt, Salmonella typhimurium LT2
guuucucuugugcuuccagcuc

SEQ ID NO: 3761764 - RNA, 13 nt, Salmonella typhimurium LT2
guuucuguauuuu

SEQ ID NO: 3761765 - RNA, 14 nt, Salmonella typhimurium LT2
guuucuucuguccc

SEQ ID NO: 3761766 - RNA, 16 nt, Salmonella typhimurium LT2
guuucuuguuaacgca

SEQ ID NO: 3761767 - RNA, 13 nt, Salmonella typhimurium LT2
guuugaacagcag

SEQ ID NO: 3761768 - RNA, 19 nt, Salmonella typhimurium LT2
guuugagaaaaacaucaug

SEQ ID NO: 3761769 - RNA, 22 nt, Salmonella typhimurium LT2
guuugaggaaaccuuucuucuc

SEQ ID NO: 3761770 - RNA, 23 nt, Salmonella typhimurium LT2
guuugaggaaaccuuucuucucu

SEQ ID NO: 3761771 - RNA, 19 nt, Salmonella typhimurium LT2
guuugaggcuugcagcauu

SEQ ID NO: 3761772 - RNA, 15 nt, Salmonella typhimurium LT2
guuugaucauggcuc

SEQ ID NO: 3761773 - RNA, 20 nt, Salmonella typhimurium LT2
guuugccggagagaugccgc

SEQ ID NO: 3761774 - RNA, 18 nt, Salmonella typhimurium LT2
guuugcgcgaggucgagc

SEQ ID NO: 3761775 - RNA, 12 nt, Salmonella typhimurium LT2
guuugcgcgucg

SEQ ID NO: 3761776 - RNA, 15 nt, Salmonella typhimurium LT2
guuugcuccacgcca

SEQ ID NO: 3761777 - RNA, 18 nt, Salmonella typhimurium LT2
guuugcucgccauaaauc

SEQ ID NO: 3761778 - RNA, 22 nt, Salmonella typhimurium LT2
guuuggcaaggguaugaauaaa

SEQ ID NO: 3761779 - RNA, 15 nt, Salmonella typhimurium LT2
guuuggcaaucaaau

SEQ ID NO: 3761780 - RNA, 14 nt, Salmonella typhimurium LT2
guuuguaaaauaca

SEQ ID NO: 3761781 - RNA, 17 nt, Salmonella typhimurium LT2
guuuguagaugaacucg

SEQ ID NO: 3761782 - RNA, 15 nt, Salmonella typhimurium LT2
guuuguaggccggau

SEQ ID NO: 3761783 - RNA, 18 nt, Salmonella typhimurium LT2
guuugucuucugccagca

SEQ ID NO: 3761784 - RNA, 12 nt, Salmonella typhimurium LT2
uaaacagcagcg

SEQ ID NO: 3761785 - RNA, 17 nt, Salmonella typhimurium LT2
uaaacagcguuuucaua

SEQ ID NO: 3761786 - RNA, 23 nt, Salmonella typhimurium LT2
uaaacaguuccgcaaagcccauc

SEQ ID NO: 3761787 - RNA, 21 nt, Salmonella typhimurium LT2
uaaaccacaugaccagcgccg

SEQ ID NO: 3761788 - RNA, 13 nt, Salmonella typhimurium LT2
uaaaccaggccag

SEQ ID NO: 3761789 - RNA, 16 nt, Salmonella typhimurium LT2
uaaaccauuucuccug

SEQ ID NO: 3761790 - RNA, 19 nt, Salmonella typhimurium LT2
uaaacccgauucugccagu

SEQ ID NO: 3761791 - RNA, 21 nt, Salmonella typhimurium LT2
uaaaccgaaaggguauacaaa

SEQ ID NO: 3761792 - RNA, 16 nt, Salmonella typhimurium LT2
uaaaccguguuccagc

SEQ ID NO: 3761793 - RNA, 12 nt, Salmonella typhimurium LT2
uaaaccucuuug

SEQ ID NO: 3761794 - RNA, 20 nt, Salmonella typhimurium LT2
uaaaccucuuuggcgcgaac

SEQ ID NO: 3761795 - RNA, 15 nt, Salmonella typhimurium LT2
uaaacgaucuguuau

SEQ ID NO: 3761796 - RNA, 15 nt, Salmonella typhimurium LT2
uaaacgcaacaccau

SEQ ID NO: 3761797 - RNA, 21 nt, Salmonella typhimurium LT2
uaaacgccagauaaucgccgc

SEQ ID NO: 3761798 - RNA, 20 nt, Salmonella typhimurium LT2
uaaacgccagcccuuccagc

SEQ ID NO: 3761799 - RNA, 14 nt, Salmonella typhimurium LT2
uaaacgccccuucg

SEQ ID NO: 3761800 - RNA, 20 nt, Salmonella typhimurium LT2
uaaacgccgccgcaaggcgg

SEQ ID NO: 3761801 - RNA, 19 nt, Salmonella typhimurium LT2
uaaacgccugaugcugcga

SEQ ID NO: 3761802 - RNA, 23 nt, Salmonella typhimurium LT2
uaaacgcuccggcaggcaaaucu

SEQ ID NO: 3761803 - RNA, 17 nt, Salmonella typhimurium LT2
uaaacgcugugaccagu

SEQ ID NO: 3761804 - RNA, 19 nt, Salmonella typhimurium LT2
uaaacgcuuuuucaaagau

SEQ ID NO: 3761805 - RNA, 19 nt, Salmonella typhimurium LT2
uaaacggcagccgccacca

SEQ ID NO: 3761806 - RNA, 21 nt, Salmonella typhimurium LT2
uaaacggcagccgccaccaca

SEQ ID NO: 3761807 - RNA, 15 nt, Salmonella typhimurium LT2
uaaacgguaagaguu

SEQ ID NO: 3761808 - RNA, 23 nt, Salmonella typhimurium LT2
uaaacgucccgacgaauaacaaa

SEQ ID NO: 3761809 - RNA, 19 nt, Salmonella typhimurium LT2
uaaacuaaguaaggaggaa

SEQ ID NO: 3761810 - RNA, 16 nt, Salmonella typhimurium LT2
uaaacuaaugccuggc

SEQ ID NO: 3761811 - RNA, 23 nt, Salmonella typhimurium LT2
uaaacuacuggcugguuucuccg

SEQ ID NO: 3761812 - RNA, 17 nt, Salmonella typhimurium LT2
uaaacucaaucaggcua

SEQ ID NO: 3761813 - RNA, 13 nt, Salmonella typhimurium LT2
uaaacucagcgcc

SEQ ID NO: 3761814 - RNA, 18 nt, Salmonella typhimurium LT2
uaaacucaucuuuauuca

SEQ ID NO: 3761815 - RNA, 17 nt, Salmonella typhimurium LT2
uaaacuccauuaaauua

SEQ ID NO: 3761816 - RNA, 19 nt, Salmonella typhimurium LT2
uaaacuccauuaaauuacu

SEQ ID NO: 3761817 - RNA, 15 nt, Salmonella typhimurium LT2
uaaacuggcgcacag

SEQ ID NO: 3761818 - RNA, 15 nt, Salmonella typhimurium LT2
uaaacuguuuccagu

SEQ ID NO: 3761819 - RNA, 18 nt, Salmonella typhimurium LT2
uaaagaaugaaaaaaaau

SEQ ID NO: 3761820 - RNA, 14 nt, Salmonella typhimurium LT2
uaaagauaaauaaa

SEQ ID NO: 3761821 - RNA, 21 nt, Salmonella typhimurium LT2
uaaagauaaauaaaaaauuau

SEQ ID NO: 3761822 - RNA, 18 nt, Salmonella typhimurium LT2
uaaagauagccaccggca

SEQ ID NO: 3761823 - RNA, 23 nt, Salmonella typhimurium LT2
uaaagauuagcguuuuuaucuuu

SEQ ID NO: 3761824 - RNA, 19 nt, Salmonella typhimurium LT2
uaaagcagugcaguauugc

SEQ ID NO: 3761825 - RNA, 21 nt, Salmonella typhimurium LT2
uaaagcccgucccuuccgcca

SEQ ID NO: 3761826 - RNA, 21 nt, Salmonella typhimurium LT2
uaaagccgguuucauuggcua

SEQ ID NO: 3761827 - RNA, 18 nt, Salmonella typhimurium LT2
uaaagccuucaugcuucu

SEQ ID NO: 3761828 - RNA, 20 nt, Salmonella typhimurium LT2
uaaagcgaauuguuugaaaa

SEQ ID NO: 3761829 - RNA, 23 nt, Salmonella typhimurium LT2
uaaagcgaauuguuugaaaagga

SEQ ID NO: 3761830 - RNA, 15 nt, Salmonella typhimurium LT2
uaaagcgcaaaauag

SEQ ID NO: 3761831 - RNA, 21 nt, Salmonella typhimurium LT2
uaaagcgcgggccugccuguu

SEQ ID NO: 3761832 - RNA, 22 nt, Salmonella typhimurium LT2
uaaagcgcgggccugccuguuu

SEQ ID NO: 3761833 - RNA, 20 nt, Salmonella typhimurium LT2
uaaaggcggaaaucagcaca

SEQ ID NO: 3761834 - RNA, 21 nt, Salmonella typhimurium LT2
uaaaggcguuuagauagcugu

SEQ ID NO: 3761835 - RNA, 23 nt, Salmonella typhimurium LT2
uaaagggaaggucauuaucaaug

SEQ ID NO: 3761836 - RNA, 22 nt, Salmonella typhimurium LT2
uaaaggugagcucuuucugcgc

SEQ ID NO: 3761837 - RNA, 16 nt, Salmonella typhimurium LT2
uaaaguacuuucuccu

SEQ ID NO: 3761838 - RNA, 19 nt, Salmonella typhimurium LT2
uaaagugaguguuacucuu

SEQ ID NO: 3761839 - RNA, 16 nt, Salmonella typhimurium LT2
uaaauaaaaaccauuu

SEQ ID NO: 3761840 - RNA, 14 nt, Salmonella typhimurium LT2
uaaauaaaauuguu

SEQ ID NO: 3761841 - RNA, 11 nt, Salmonella typhimurium LT2
uaaauaaaugc

SEQ ID NO: 3761842 - RNA, 16 nt, Salmonella typhimurium LT2
uaaauaacaaaugaag

SEQ ID NO: 3761843 - RNA, 13 nt, Salmonella typhimurium LT2
uaaauaacgccag

SEQ ID NO: 3761844 - RNA, 23 nt, Salmonella typhimurium LT2
uaaauaacgggcgcgcgcgcaga

SEQ ID NO: 3761845 - RNA, 14 nt, Salmonella typhimurium LT2
uaaauaagaaaaug

SEQ ID NO: 3761846 - RNA, 17 nt, Salmonella typhimurium LT2
uaaauaagaaaaugccu

SEQ ID NO: 3761847 - RNA, 14 nt, Salmonella typhimurium LT2
uaaauaaucaccac

SEQ ID NO: 3761848 - RNA, 15 nt, Salmonella typhimurium LT2
uaaauaccacaacaa

SEQ ID NO: 3761849 - RNA, 13 nt, Salmonella typhimurium LT2
uaaauaccaggca

SEQ ID NO: 3761850 - RNA, 23 nt, Salmonella typhimurium LT2
uaaauaccaggcacuugagaaau

SEQ ID NO: 3761851 - RNA, 18 nt, Salmonella typhimurium LT2
uaaauacccaggccauca

SEQ ID NO: 3761852 - RNA, 15 nt, Salmonella typhimurium LT2
uaaauaccuuauuca

SEQ ID NO: 3761853 - RNA, 17 nt, Salmonella typhimurium LT2
uaaauacgccgccagca

SEQ ID NO: 3761854 - RNA, 14 nt, Salmonella typhimurium LT2
uaaauagccagcau

SEQ ID NO: 3761855 - RNA, 18 nt, Salmonella typhimurium LT2
uaaauaucgcguuaauuu

SEQ ID NO: 3761856 - RNA, 23 nt, Salmonella typhimurium LT2
uaaauaucgcguuaauuuuuagc

SEQ ID NO: 3761857 - RNA, 16 nt, Salmonella typhimurium LT2
uaaauaugaaagagaa

SEQ ID NO: 3761858 - RNA, 14 nt, Salmonella typhimurium LT2
uaaaucaaacgcac

SEQ ID NO: 3761859 - RNA, 17 nt, Salmonella typhimurium LT2
uaaaucaacaaccggcu

SEQ ID NO: 3761860 - RNA, 13 nt, Salmonella typhimurium LT2
uaaaucaaccugc

SEQ ID NO: 3761861 - RNA, 21 nt, Salmonella typhimurium LT2
uaaaucaacuuuuuuaccauu

SEQ ID NO: 3761862 - RNA, 15 nt, Salmonella typhimurium LT2
uaaaucaauacaggc

SEQ ID NO: 3761863 - RNA, 15 nt, Salmonella typhimurium LT2
uaaaucaauuuuaau

SEQ ID NO: 3761864 - RNA, 10 nt, Salmonella typhimurium LT2
uaaaucagcc

SEQ ID NO: 3761865 - RNA, 20 nt, Salmonella typhimurium LT2
uaaaucagcgcggcaaggau

SEQ ID NO: 3761866 - RNA, 17 nt, Salmonella typhimurium LT2
uaaaucaggccaagcaa

SEQ ID NO: 3761867 - RNA, 12 nt, Salmonella typhimurium LT2
uaaaucaucauc

SEQ ID NO: 3761868 - RNA, 13 nt, Salmonella typhimurium LT2
uaaaucaucaucg

SEQ ID NO: 3761869 - RNA, 21 nt, Salmonella typhimurium LT2
uaaaucauuuguacaaaaaau

SEQ ID NO: 3761870 - RNA, 17 nt, Salmonella typhimurium LT2
uaaauccacauuccaga

SEQ ID NO: 3761871 - RNA, 14 nt, Salmonella typhimurium LT2
uaaauccauauucu

SEQ ID NO: 3761872 - RNA, 13 nt, Salmonella typhimurium LT2
uaaauccggccuc

SEQ ID NO: 3761873 - RNA, 14 nt, Salmonella typhimurium LT2
uaaauccuucgccg

SEQ ID NO: 3761874 - RNA, 19 nt, Salmonella typhimurium LT2
uaaaucgcggcgauuaaua

SEQ ID NO: 3761875 - RNA, 11 nt, Salmonella typhimurium LT2
uaaaucguccg

SEQ ID NO: 3761876 - RNA, 14 nt, Salmonella typhimurium LT2
uaaaucguguggcu

SEQ ID NO: 3761877 - RNA, 13 nt, Salmonella typhimurium LT2
uaaaucugaaaua

SEQ ID NO: 3761878 - RNA, 14 nt, Salmonella typhimurium LT2
uaaaucugccauca

SEQ ID NO: 3761879 - RNA, 21 nt, Salmonella typhimurium LT2
uaaaucugccgucaucgacuu

SEQ ID NO: 3761880 - RNA, 18 nt, Salmonella typhimurium LT2
uaaaugaggacgcacucu

SEQ ID NO: 3761881 - RNA, 19 nt, Salmonella typhimurium LT2
uaaaugcgcgcggcugccg

SEQ ID NO: 3761882 - RNA, 21 nt, Salmonella typhimurium LT2
uaaauuaacucucucuguaau

SEQ ID NO: 3761883 - RNA, 15 nt, Salmonella typhimurium LT2
uaaauuagcgcgaaa

SEQ ID NO: 3761884 - RNA, 18 nt, Salmonella typhimurium LT2
uaaauuccggcucgccuu

SEQ ID NO: 3761885 - RNA, 13 nt, Salmonella typhimurium LT2
uaaauucgcuacg

SEQ ID NO: 3761886 - RNA, 15 nt, Salmonella typhimurium LT2
uaaauugaguggaca

SEQ ID NO: 3761887 - RNA, 17 nt, Salmonella typhimurium LT2
uaaauugcacgcccaua

SEQ ID NO: 3761888 - RNA, 12 nt, Salmonella typhimurium LT2
uaacguuucaug

SEQ ID NO: 3761889 - RNA, 19 nt, Salmonella typhimurium LT2
uaacguuuguagaugaacu

SEQ ID NO: 3761890 - RNA, 17 nt, Salmonella typhimurium LT2
uaacguuuuacgcugcc

SEQ ID NO: 3761891 - RNA, 16 nt, Salmonella typhimurium LT2
uaacuaaaauacucac

SEQ ID NO: 3761892 - RNA, 15 nt, Salmonella typhimurium LT2
uaacuaaacucaucu

SEQ ID NO: 3761893 - RNA, 20 nt, Salmonella typhimurium LT2
uaacuauaauugcuuuuuuc

SEQ ID NO: 3761894 - RNA, 19 nt, Salmonella typhimurium LT2
uaacucaagcgaauccaga

SEQ ID NO: 3761895 - RNA, 14 nt, Salmonella typhimurium LT2
uaacucauugggua

SEQ ID NO: 3761896 - RNA, 23 nt, Salmonella typhimurium LT2
uaacuccuucuaauuccaggaug

SEQ ID NO: 3761897 - RNA, 19 nt, Salmonella typhimurium LT2
uaacucggcagcgcgacau

SEQ ID NO: 3761898 - RNA, 14 nt, Salmonella typhimurium LT2
uaacucguccuguu

SEQ ID NO: 3761899 - RNA, 19 nt, Salmonella typhimurium LT2
uaacucucucuguaauaau

SEQ ID NO: 3761900 - RNA, 12 nt, Salmonella typhimurium LT2
uaacucuucauc

SEQ ID NO: 3761901 - RNA, 19 nt, Salmonella typhimurium LT2
uaacucuuuugcagcaaau

SEQ ID NO: 3761902 - RNA, 20 nt, Salmonella typhimurium LT2
uaacucuuuugcagcaaaua

SEQ ID NO: 3761903 - RNA, 18 nt, Salmonella typhimurium LT2
uaacugaagguuuuuccc

SEQ ID NO: 3761904 - RNA, 12 nt, Salmonella typhimurium LT2
uaacugacagac

SEQ ID NO: 3761905 - RNA, 23 nt, Salmonella typhimurium LT2
uaacugacgaccgggggcuggcc

SEQ ID NO: 3761906 - RNA, 23 nt, Salmonella typhimurium LT2
uaacugcaccuuuuuuuccagcg

SEQ ID NO: 3761907 - RNA, 18 nt, Salmonella typhimurium LT2
uaacugcccguuacgcau

SEQ ID NO: 3761908 - RNA, 21 nt, Salmonella typhimurium LT2
uaacugcccguuacgcauuuc

SEQ ID NO: 3761909 - RNA, 23 nt, Salmonella typhimurium LT2
uaacugccggguuaaaaacgcca

SEQ ID NO: 3761910 - RNA, 19 nt, Salmonella typhimurium LT2
uaacugccuuauccggccu

SEQ ID NO: 3761911 - RNA, 11 nt, Salmonella typhimurium LT2
uaacugcggua

SEQ ID NO: 3761912 - RNA, 12 nt, Salmonella typhimurium LT2
uaacugcugcuc

SEQ ID NO: 3761913 - RNA, 15 nt, Salmonella typhimurium LT2
uaacuggauuccugg

SEQ ID NO: 3761914 - RNA, 15 nt, Salmonella typhimurium LT2
uaacuggcaaucaug

SEQ ID NO: 3761915 - RNA, 16 nt, Salmonella typhimurium LT2
uaacuuaaauaaaaau

SEQ ID NO: 3761916 - RNA, 23 nt, Salmonella typhimurium LT2
uaacuucuugguaccaaacagca

SEQ ID NO: 3761917 - RNA, 18 nt, Salmonella typhimurium LT2
uaacuugccgccugccug

SEQ ID NO: 3761918 - RNA, 21 nt, Salmonella typhimurium LT2
uaagaaacugcuguagcacau

SEQ ID NO: 3761919 - RNA, 13 nt, Salmonella typhimurium LT2
uaagaacuuuauc

SEQ ID NO: 3761920 - RNA, 21 nt, Salmonella typhimurium LT2
uaagaauaucggcgucgacgu

SEQ ID NO: 3761921 - RNA, 21 nt, Salmonella typhimurium LT2
uaagaaucagaugcucaucaa

SEQ ID NO: 3761922 - RNA, 21 nt, Salmonella typhimurium LT2
uaagaaugcgcgucaggccag

SEQ ID NO: 3761923 - RNA, 19 nt, Salmonella typhimurium LT2
uaagacuacauacgcgcau

SEQ ID NO: 3761924 - RNA, 20 nt, Salmonella typhimurium LT2
uaagacuuuuuaauucacaa

SEQ ID NO: 3761925 - RNA, 11 nt, Salmonella typhimurium LT2
uaagagaacaa

SEQ ID NO: 3761926 - RNA, 19 nt, Salmonella typhimurium LT2
uaagagaccgguuauugag

SEQ ID NO: 3761927 - RNA, 14 nt, Salmonella typhimurium LT2
uaagagacugacaa

SEQ ID NO: 3761928 - RNA, 14 nt, Salmonella typhimurium LT2
uaagagagccuuau

SEQ ID NO: 3761929 - RNA, 14 nt, Salmonella typhimurium LT2
uaagagcuggucgg

SEQ ID NO: 3761930 - RNA, 12 nt, Salmonella typhimurium LT2
uaagauguuuua

SEQ ID NO: 3761931 - RNA, 19 nt, Salmonella typhimurium LT2
uaagauuugcgccgccgua

SEQ ID NO: 3761932 - RNA, 21 nt, Salmonella typhimurium LT2
uaagcaacugauuaaucugcc

SEQ ID NO: 3761933 - RNA, 14 nt, Salmonella typhimurium LT2
uaagcaagcgccau

SEQ ID NO: 3761934 - RNA, 13 nt, Salmonella typhimurium LT2
uaagcacaccauu

SEQ ID NO: 3761935 - RNA, 20 nt, Salmonella typhimurium LT2
uaagcagcugcuuaacuucu

SEQ ID NO: 3761936 - RNA, 21 nt, Salmonella typhimurium LT2
uaagcauccaggaaguaaauu

SEQ ID NO: 3761937 - RNA, 16 nt, Salmonella typhimurium LT2
uaagccacugcccaga

SEQ ID NO: 3761938 - RNA, 12 nt, Salmonella typhimurium LT2
uaagccagcccu

SEQ ID NO: 3761939 - RNA, 14 nt, Salmonella typhimurium LT2
uaagccagcgauga

SEQ ID NO: 3761940 - RNA, 20 nt, Salmonella typhimurium LT2
uaagcccauggcaggcagca

SEQ ID NO: 3761941 - RNA, 21 nt, Salmonella typhimurium LT2
uaagcccauggcaggcagcac

SEQ ID NO: 3761942 - RNA, 16 nt, Salmonella typhimurium LT2
uaagccgauugaauaa

SEQ ID NO: 3761943 - RNA, 16 nt, Salmonella typhimurium LT2
uaagccgucauaaaau

SEQ ID NO: 3761944 - RNA, 24 nt, Salmonella typhimurium LT2
uaagccgucauaaaaucaaucugc

SEQ ID NO: 3761945 - RNA, 13 nt, Salmonella typhimurium LT2
uaagccuggcaua

SEQ ID NO: 3761946 - RNA, 12 nt, Salmonella typhimurium LT2
uaagccuuuuua

SEQ ID NO: 3761947 - RNA, 16 nt, Salmonella typhimurium LT2
uaagcgacagcgccau

SEQ ID NO: 3761948 - RNA, 14 nt, Salmonella typhimurium LT2
uaagcgcagcgcca

SEQ ID NO: 3761949 - RNA, 20 nt, Salmonella typhimurium LT2
uaagcgcagcgccauugagc

SEQ ID NO: 3761950 - RNA, 16 nt, Salmonella typhimurium LT2
uaagcgcgaaauuuau

SEQ ID NO: 3761951 - RNA, 19 nt, Salmonella typhimurium LT2
uaagcggcggaccagcgug

SEQ ID NO: 3761952 - RNA, 19 nt, Salmonella typhimurium LT2
uaagcggcgucauccggag

SEQ ID NO: 3761953 - RNA, 13 nt, Salmonella typhimurium LT2
uaagcguagcgcc

SEQ ID NO: 3761954 - RNA, 17 nt, Salmonella typhimurium LT2
uaagcguuacggaaaaa

SEQ ID NO: 3761955 - RNA, 14 nt, Salmonella typhimurium LT2
uaagcguucaucag

SEQ ID NO: 3761956 - RNA, 19 nt, Salmonella typhimurium LT2
uaagcuauuucuguauaau

SEQ ID NO: 3761957 - RNA, 18 nt, Salmonella typhimurium LT2
uaagcugcgaagccaccg

SEQ ID NO: 3761958 - RNA, 13 nt, Salmonella typhimurium LT2
uaagcuuauaaac

SEQ ID NO: 3761959 - RNA, 20 nt, Salmonella typhimurium LT2
uaagcuuccgccaugguugg

SEQ ID NO: 3761960 - RNA, 18 nt, Salmonella typhimurium LT2
uaaggaaacgaaagcuca

SEQ ID NO: 3761961 - RNA, 23 nt, Salmonella typhimurium LT2
uaaggaucggaagacuggcgcag

SEQ ID NO: 3761962 - RNA, 18 nt, Salmonella typhimurium LT2
uaaggcauaaugccacga

SEQ ID NO: 3761963 - RNA, 19 nt, Salmonella typhimurium LT2
uaaggccugccguccugau

SEQ ID NO: 3761964 - RNA, 18 nt, Salmonella typhimurium LT2
uaaggcgauucaacagga

SEQ ID NO: 3761965 - RNA, 22 nt, Salmonella typhimurium LT2
uaaggcgugccgccgcgaaccu

SEQ ID NO: 3761966 - RNA, 12 nt, Salmonella typhimurium LT2
uaaggcguucac

SEQ ID NO: 3761967 - RNA, 21 nt, Salmonella typhimurium LT2
uaagguaacgcgaaaaaaaga

SEQ ID NO: 3761968 - RNA, 21 nt, Salmonella typhimurium LT2
uaagguccagggaauaaaaua

SEQ ID NO: 3761969 - RNA, 18 nt, Salmonella typhimurium LT2
uaagguucgcuuaaucuc

SEQ ID NO: 3761970 - RNA, 16 nt, Salmonella typhimurium LT2
uaaguaaggaggaauc

SEQ ID NO: 3761971 - RNA, 21 nt, Salmonella typhimurium LT2
uaaguacaagggccgccgcca

SEQ ID NO: 3761972 - RNA, 15 nt, Salmonella typhimurium LT2
uaaguacggcaaaaa

SEQ ID NO: 3761973 - RNA, 21 nt, Salmonella typhimurium LT2
uaaguacggcaaaaauauuga

SEQ ID NO: 3761974 - RNA, 13 nt, Salmonella typhimurium LT2
uaagucaugagcu

SEQ ID NO: 3761975 - RNA, 13 nt, Salmonella typhimurium LT2
uaagugauacaua

SEQ ID NO: 3761976 - RNA, 16 nt, Salmonella typhimurium LT2
uaaguucaaacucauu

SEQ ID NO: 3761977 - RNA, 21 nt, Salmonella typhimurium LT2
uaaguucgcaacaugaauuaa

SEQ ID NO: 3761978 - RNA, 17 nt, Salmonella typhimurium LT2
uaaguuuguaaaauaca

SEQ ID NO: 3761979 - RNA, 14 nt, Salmonella typhimurium LT2
uaauaaaauauuau

SEQ ID NO: 3761980 - RNA, 16 nt, Salmonella typhimurium LT2
uaauaagcagaacgua

SEQ ID NO: 3761981 - RNA, 17 nt, Salmonella typhimurium LT2
uaauaaugccaaaaugg

SEQ ID NO: 3761982 - RNA, 21 nt, Salmonella typhimurium LT2
uaauaauugcgguggcgcaaa

SEQ ID NO: 3761983 - RNA, 11 nt, Salmonella typhimurium LT2
uaauaauuuaa

SEQ ID NO: 3761984 - RNA, 15 nt, Salmonella typhimurium LT2
uaauaauuuaaaauu

SEQ ID NO: 3761985 - RNA, 18 nt, Salmonella typhimurium LT2
uaauacacgcgacaaugc

SEQ ID NO: 3761986 - RNA, 16 nt, Salmonella typhimurium LT2
uaauacaggccagcau

SEQ ID NO: 3761987 - RNA, 20 nt, Salmonella typhimurium LT2
uaauacaggcguguggcaua

SEQ ID NO: 3761988 - RNA, 15 nt, Salmonella typhimurium LT2
uaauacauugccgca

SEQ ID NO: 3761989 - RNA, 21 nt, Salmonella typhimurium LT2
uaauacccgaugagacaaaac

SEQ ID NO: 3761990 - RNA, 16 nt, Salmonella typhimurium LT2
uaauaccgaaauccgc

SEQ ID NO: 3761991 - RNA, 22 nt, Salmonella typhimurium LT2
uaauacgcgaugagauaauaaa

SEQ ID NO: 3761992 - RNA, 20 nt, Salmonella typhimurium LT2
uaauuaaaaagagaaaaaau

SEQ ID NO: 3761993 - RNA, 23 nt, Salmonella typhimurium LT2
uaauuaaaaagagaaaaaauuca

SEQ ID NO: 3761994 - RNA, 16 nt, Salmonella typhimurium LT2
uaauuaaauuuucgcu

SEQ ID NO: 3761995 - RNA, 13 nt, Salmonella typhimurium LT2
uaauuaaccgcgc

SEQ ID NO: 3761996 - RNA, 17 nt, Salmonella typhimurium LT2
uaauuacgcccaucgca

SEQ ID NO: 3761997 - RNA, 14 nt, Salmonella typhimurium LT2
uaauuaguuuuacc

SEQ ID NO: 3761998 - RNA, 19 nt, Salmonella typhimurium LT2
uaauuaucuaccagccgau

SEQ ID NO: 3761999 - RNA, 15 nt, Salmonella typhimurium LT2
uaauucacaacugaa

SEQ ID NO: 3762000 - RNA, 14 nt, Salmonella typhimurium LT2
uaauucaugcugua

SEQ ID NO: 3762001 - RNA, 22 nt, Salmonella typhimurium LT2
uaauucauggccaucaacuucu

SEQ ID NO: 3762002 - RNA, 15 nt, Salmonella typhimurium LT2
uaauuccgcaucauu

SEQ ID NO: 3762003 - RNA, 17 nt, Salmonella typhimurium LT2
uaauuccucagaauccg

SEQ ID NO: 3762004 - RNA, 20 nt, Salmonella typhimurium LT2
uaauucgccaguaagggaau

SEQ ID NO: 3762005 - RNA, 18 nt, Salmonella typhimurium LT2
uaauucucacagaaucau

SEQ ID NO: 3762006 - RNA, 20 nt, Salmonella typhimurium LT2
uaauucucacagaaucauca

SEQ ID NO: 3762007 - RNA, 21 nt, Salmonella typhimurium LT2
uaauugccauuacgauaaaug

SEQ ID NO: 3762008 - RNA, 20 nt, Salmonella typhimurium LT2
uaauugcccccuuuuuauuc

SEQ ID NO: 3762009 - RNA, 16 nt, Salmonella typhimurium LT2
uaauugcugaagauaa

SEQ ID NO: 3762010 - RNA, 21 nt, Salmonella typhimurium LT2
uaauugcuuugcaauguucaa

SEQ ID NO: 3762011 - RNA, 14 nt, Salmonella typhimurium LT2
uaauuggccuggcg

SEQ ID NO: 3762012 - RNA, 15 nt, Salmonella typhimurium LT2
uaauuuauagccauu

SEQ ID NO: 3762013 - RNA, 22 nt, Salmonella typhimurium LT2
uaauuuaugauuuuaacaucac

SEQ ID NO: 3762014 - RNA, 14 nt, Salmonella typhimurium LT2
uaauuucaggcugc

SEQ ID NO: 3762015 - RNA, 14 nt, Salmonella typhimurium LT2
uaauuucagugaau

SEQ ID NO: 3762016 - RNA, 23 nt, Salmonella typhimurium LT2
uaauuuccagugccaguuaagca

SEQ ID NO: 3762017 - RNA, 14 nt, Salmonella typhimurium LT2
uaauuucgcuacuc

SEQ ID NO: 3762018 - RNA, 23 nt, Salmonella typhimurium LT2
uaauuucgcuggcggccccucuu

SEQ ID NO: 3762019 - RNA, 14 nt, Salmonella typhimurium LT2
uaauuugaaucgcc

SEQ ID NO: 3762020 - RNA, 16 nt, Salmonella typhimurium LT2
uaauuuuacuuucauu

SEQ ID NO: 3762021 - RNA, 14 nt, Salmonella typhimurium LT2
uaauuuucuguaau

SEQ ID NO: 3762022 - RNA, 22 nt, Salmonella typhimurium LT2
uaauuuuuccagcauuucuuca

SEQ ID NO: 3762023 - RNA, 11 nt, Salmonella typhimurium LT2
uaauuuuuccu

SEQ ID NO: 3762024 - RNA, 12 nt, Salmonella typhimurium LT2
uaauuuuuccuu

SEQ ID NO: 3762025 - RNA, 14 nt, Salmonella typhimurium LT2
uaauuuuuccuuca

SEQ ID NO: 3762026 - RNA, 23 nt, Salmonella typhimurium LT2
uacaaaaaaugugagccauaaca

SEQ ID NO: 3762027 - RNA, 18 nt, Salmonella typhimurium LT2
uacaaaacccauaucccc

SEQ ID NO: 3762028 - RNA, 18 nt, Salmonella typhimurium LT2
uacaaacaaauaaaucca

SEQ ID NO: 3762029 - RNA, 21 nt, Salmonella typhimurium LT2
uacaaacacgucuuugcugcc

SEQ ID NO: 3762030 - RNA, 15 nt, Salmonella typhimurium LT2
uacaaacgcaccgcc

SEQ ID NO: 3762031 - RNA, 24 nt, Salmonella typhimurium LT2
uacaaagcagauagagcauaauaa

SEQ ID NO: 3762032 - RNA, 23 nt, Salmonella typhimurium LT2
uacaaagccaaaauuuucaauac

SEQ ID NO: 3762033 - RNA, 17 nt, Salmonella typhimurium LT2
uacaaaucucagggugu

SEQ ID NO: 3762034 - RNA, 14 nt, Salmonella typhimurium LT2
uacaaauuacacaa

SEQ ID NO: 3762035 - RNA, 16 nt, Salmonella typhimurium LT2
uacaaauuacacaaua

SEQ ID NO: 3762036 - RNA, 20 nt, Salmonella typhimurium LT2
uacaacaauugugaugcauu

SEQ ID NO: 3762037 - RNA, 21 nt, Salmonella typhimurium LT2
uacaaccguggcguuuucauu

SEQ ID NO: 3762038 - RNA, 22 nt, Salmonella typhimurium LT2
uacaaccguggcguuuucauua

SEQ ID NO: 3762039 - RNA, 21 nt, Salmonella typhimurium LT2
uacaacgacuacguucaucag

SEQ ID NO: 3762040 - RNA, 22 nt, Salmonella typhimurium LT2
uacaacgacuacguucaucagg

SEQ ID NO: 3762041 - RNA, 18 nt, Salmonella typhimurium LT2
uacaacucagcguaacug

SEQ ID NO: 3762042 - RNA, 16 nt, Salmonella typhimurium LT2
uacaauauugcgcgcu

SEQ ID NO: 3762043 - RNA, 21 nt, Salmonella typhimurium LT2
uacaaucuaagagccuauccc

SEQ ID NO: 3762044 - RNA, 17 nt, Salmonella typhimurium LT2
uacaaugcaaagaaaaa

SEQ ID NO: 3762045 - RNA, 13 nt, Salmonella typhimurium LT2
uacaauuucuggc

SEQ ID NO: 3762046 - RNA, 14 nt, Salmonella typhimurium LT2
uacacaaucaucga

SEQ ID NO: 3762047 - RNA, 12 nt, Salmonella typhimurium LT2
uacacaccagca

SEQ ID NO: 3762048 - RNA, 15 nt, Salmonella typhimurium LT2
uacacacucggugca

SEQ ID NO: 3762049 - RNA, 14 nt, Salmonella typhimurium LT2
uacacagacugcuu

SEQ ID NO: 3762050 - RNA, 12 nt, Salmonella typhimurium LT2
uacacagcacaa

SEQ ID NO: 3762051 - RNA, 21 nt, Salmonella typhimurium LT2
uacacaguccgaugguuaaau

SEQ ID NO: 3762052 - RNA, 12 nt, Salmonella typhimurium LT2
uacacaucaucu

SEQ ID NO: 3762053 - RNA, 16 nt, Salmonella typhimurium LT2
uacacauucaggcugg

SEQ ID NO: 3762054 - RNA, 20 nt, Salmonella typhimurium LT2
uacacauucaggcuggcaaa

SEQ ID NO: 3762055 - RNA, 16 nt, Salmonella typhimurium LT2
uacacauuuuaaacca

SEQ ID NO: 3762056 - RNA, 13 nt, Salmonella typhimurium LT2
uacaccccacuau

SEQ ID NO: 3762057 - RNA, 12 nt, Salmonella typhimurium LT2
uacaccuuugcc

SEQ ID NO: 3762058 - RNA, 20 nt, Salmonella typhimurium LT2
uacacgauuaaccucacgca

SEQ ID NO: 3762059 - RNA, 16 nt, Salmonella typhimurium LT2
uacacgcgaauagcca

SEQ ID NO: 3762060 - RNA, 16 nt, Salmonella typhimurium LT2
uacacuacuucuucag

SEQ ID NO: 3762061 - RNA, 17 nt, Salmonella typhimurium LT2
uacacucucggguacac

SEQ ID NO: 3762062 - RNA, 16 nt, Salmonella typhimurium LT2
uacacugauaccccag

SEQ ID NO: 3762063 - RNA, 16 nt, Salmonella typhimurium LT2
uacacuucauccuuua

SEQ ID NO: 3762064 - RNA, 14 nt, Salmonella typhimurium LT2
uacagacacggucg

SEQ ID NO: 3762065 - RNA, 15 nt, Salmonella typhimurium LT2
uacagacagcagaug

SEQ ID NO: 3762066 - RNA, 17 nt, Salmonella typhimurium LT2
uacagacgcuuacgggc

SEQ ID NO: 3762067 - RNA, 22 nt, Salmonella typhimurium LT2
uacagaugccuuguaagccgga

SEQ ID NO: 3762068 - RNA, 13 nt, Salmonella typhimurium LT2
uacagaugcugua

SEQ ID NO: 3762069 - RNA, 17 nt, Salmonella typhimurium LT2
uacagcaauaugacugg

SEQ ID NO: 3762070 - RNA, 14 nt, Salmonella typhimurium LT2
uacagcaccugcuc

SEQ ID NO: 3762071 - RNA, 14 nt, Salmonella typhimurium LT2
uacagcacuucccg

SEQ ID NO: 3762072 - RNA, 15 nt, Salmonella typhimurium LT2
uacagcacuucccgc

SEQ ID NO: 3762073 - RNA, 14 nt, Salmonella typhimurium LT2
uacagcauacgccg

SEQ ID NO: 3762074 - RNA, 18 nt, Salmonella typhimurium LT2
uacagccaaaucagcagg

SEQ ID NO: 3762075 - RNA, 13 nt, Salmonella typhimurium LT2
uacagccaccaug

SEQ ID NO: 3762076 - RNA, 14 nt, Salmonella typhimurium LT2
uacagccagcacaa

SEQ ID NO: 3762077 - RNA, 16 nt, Salmonella typhimurium LT2
uacagccgaagccauu

SEQ ID NO: 3762078 - RNA, 22 nt, Salmonella typhimurium LT2
uacagcgagcuauccggcaaca

SEQ ID NO: 3762079 - RNA, 22 nt, Salmonella typhimurium LT2
uacagcgccuuuucaaaagaga

SEQ ID NO: 3762080 - RNA, 21 nt, Salmonella typhimurium LT2
uacaggauauacuucaucagg

SEQ ID NO: 3762081 - RNA, 19 nt, Salmonella typhimurium LT2
uacaggcaaucggccaggu

SEQ ID NO: 3762082 - RNA, 13 nt, Salmonella typhimurium LT2
uacaggcaucuuc

SEQ ID NO: 3762083 - RNA, 16 nt, Salmonella typhimurium LT2
uacaggcaucuuccag

SEQ ID NO: 3762084 - RNA, 20 nt, Salmonella typhimurium LT2
uacaggcccgauaagcgcug

SEQ ID NO: 3762085 - RNA, 21 nt, Salmonella typhimurium LT2
uacaggccgccgggucagaaa

SEQ ID NO: 3762086 - RNA, 17 nt, Salmonella typhimurium LT2
uacaggccggacaggcg

SEQ ID NO: 3762087 - RNA, 18 nt, Salmonella typhimurium LT2
uacaggcgcaguugaaaa

SEQ ID NO: 3762088 - RNA, 19 nt, Salmonella typhimurium LT2
uacaggcgcaguugaaaac

SEQ ID NO: 3762089 - RNA, 17 nt, Salmonella typhimurium LT2
uacaggcguguggcaua

SEQ ID NO: 3762090 - RNA, 18 nt, Salmonella typhimurium LT2
uacaggcguguggcauaa

SEQ ID NO: 3762091 - RNA, 17 nt, Salmonella typhimurium LT2
uacaggcuguccaacca

SEQ ID NO: 3762092 - RNA, 23 nt, Salmonella typhimurium LT2
uacagggcggcaggaugaaugac

SEQ ID NO: 3762093 - RNA, 23 nt, Salmonella typhimurium LT2
uacagggcguuuuauaagccgcu

SEQ ID NO: 3762094 - RNA, 18 nt, Salmonella typhimurium LT2
uacaggggauuguuaacg

SEQ ID NO: 3762095 - RNA, 21 nt, Salmonella typhimurium LT2
uacaggucgacgugaacugcc

SEQ ID NO: 3762096 - RNA, 16 nt, Salmonella typhimurium LT2
uaccgcuaaaauaccc

SEQ ID NO: 3762097 - RNA, 22 nt, Salmonella typhimurium LT2
uaccgcucguuaacccaaaucc

SEQ ID NO: 3762098 - RNA, 20 nt, Salmonella typhimurium LT2
uaccgcuucccacagucggc

SEQ ID NO: 3762099 - RNA, 21 nt, Salmonella typhimurium LT2
uaccgcuucccgcgucgccgg

SEQ ID NO: 3762100 - RNA, 22 nt, Salmonella typhimurium LT2
uaccggacgacuguagauaccu

SEQ ID NO: 3762101 - RNA, 18 nt, Salmonella typhimurium LT2
uaccggcaacgccgggaa

SEQ ID NO: 3762102 - RNA, 14 nt, Salmonella typhimurium LT2
uaccggcaccagca

SEQ ID NO: 3762103 - RNA, 17 nt, Salmonella typhimurium LT2
uaccgggcgcaaucauc

SEQ ID NO: 3762104 - RNA, 19 nt, Salmonella typhimurium LT2
uaccgggcgcaaucaucac

SEQ ID NO: 3762105 - RNA, 17 nt, Salmonella typhimurium LT2
uaccgggcuuacagcgu

SEQ ID NO: 3762106 - RNA, 15 nt, Salmonella typhimurium LT2
uaccgguaaggcagg

SEQ ID NO: 3762107 - RNA, 21 nt, Salmonella typhimurium LT2
uaccgguuaacucgaccagaa

SEQ ID NO: 3762108 - RNA, 19 nt, Salmonella typhimurium LT2
uaccguaagcuuucugaau

SEQ ID NO: 3762109 - RNA, 19 nt, Salmonella typhimurium LT2
uaccguauggucggcgugc

SEQ ID NO: 3762110 - RNA, 14 nt, Salmonella typhimurium LT2
uaccgucacgcggc

SEQ ID NO: 3762111 - RNA, 14 nt, Salmonella typhimurium LT2
uaccgucagcacca

SEQ ID NO: 3762112 - RNA, 19 nt, Salmonella typhimurium LT2
uaccgucagccacuucuuc

SEQ ID NO: 3762113 - RNA, 21 nt, Salmonella typhimurium LT2
uaccguccaaaucaugccgcc

SEQ ID NO: 3762114 - RNA, 21 nt, Salmonella typhimurium LT2
uaccgugcaaaaucacgcggc

SEQ ID NO: 3762115 - RNA, 14 nt, Salmonella typhimurium LT2
uaccguguuuaccu

SEQ ID NO: 3762116 - RNA, 20 nt, Salmonella typhimurium LT2
uaccguuuaccccgccagca

SEQ ID NO: 3762117 - RNA, 22 nt, Salmonella typhimurium LT2
uaccguuucaacugccccuugu

SEQ ID NO: 3762118 - RNA, 20 nt, Salmonella typhimurium LT2
uaccuauuuuaaauucccag

SEQ ID NO: 3762119 - RNA, 22 nt, Salmonella typhimurium LT2
uaccucagguaucauaugugcc

SEQ ID NO: 3762120 - RNA, 13 nt, Salmonella typhimurium LT2
uaccuccucucuu

SEQ ID NO: 3762121 - RNA, 18 nt, Salmonella typhimurium LT2
uaccuccucucuuccucc

SEQ ID NO: 3762122 - RNA, 16 nt, Salmonella typhimurium LT2
uaccucuuauccggcu

SEQ ID NO: 3762123 - RNA, 19 nt, Salmonella typhimurium LT2
uaccucuuucgccgcuuua

SEQ ID NO: 3762124 - RNA, 16 nt, Salmonella typhimurium LT2
uaccugaagccauccu

SEQ ID NO: 3762125 - RNA, 22 nt, Salmonella typhimurium LT2
uaccugagagaacggaccggca

SEQ ID NO: 3762126 - RNA, 17 nt, Salmonella typhimurium LT2
uaccugagccucuaaau

SEQ ID NO: 3762127 - RNA, 19 nt, Salmonella typhimurium LT2
uaccugauccagcucuucu

SEQ ID NO: 3762128 - RNA, 22 nt, Salmonella typhimurium LT2
uaccugauccagcucuucuucg

SEQ ID NO: 3762129 - RNA, 23 nt, Salmonella typhimurium LT2
uaccugauccagcucuucuucgc

SEQ ID NO: 3762130 - RNA, 21 nt, Salmonella typhimurium LT2
uaccugcaaaaacgccagacc

SEQ ID NO: 3762131 - RNA, 22 nt, Salmonella typhimurium LT2
uaccugcacuuuaagcggcagc

SEQ ID NO: 3762132 - RNA, 15 nt, Salmonella typhimurium LT2
uaccugccgaccuca

SEQ ID NO: 3762133 - RNA, 11 nt, Salmonella typhimurium LT2
uaccugccugu

SEQ ID NO: 3762134 - RNA, 19 nt, Salmonella typhimurium LT2
uaccugccugucacgcagg

SEQ ID NO: 3762135 - RNA, 18 nt, Salmonella typhimurium LT2
uaccugcgcaaucaugac

SEQ ID NO: 3762136 - RNA, 23 nt, Salmonella typhimurium LT2
uaccuggaauagcgugggcagac

SEQ ID NO: 3762137 - RNA, 17 nt, Salmonella typhimurium LT2
uaccuggcuugauguag

SEQ ID NO: 3762138 - RNA, 19 nt, Salmonella typhimurium LT2
uaccugguauuauugucuu

SEQ ID NO: 3762139 - RNA, 14 nt, Salmonella typhimurium LT2
uaccuguuuaucug

SEQ ID NO: 3762140 - RNA, 16 nt, Salmonella typhimurium LT2
uaccuuauucagccca

SEQ ID NO: 3762141 - RNA, 19 nt, Salmonella typhimurium LT2
uaccuucccgcgauaaaaa

SEQ ID NO: 3762142 - RNA, 22 nt, Salmonella typhimurium LT2
uaccuuccggcgucccuuuccc

SEQ ID NO: 3762143 - RNA, 23 nt, Salmonella typhimurium LT2
uaccuucuucacuaaaaacaggc

SEQ ID NO: 3762144 - RNA, 13 nt, Salmonella typhimurium LT2
uaccuuuacgcag

SEQ ID NO: 3762145 - RNA, 15 nt, Salmonella typhimurium LT2
uaccuuuaucuugac

SEQ ID NO: 3762146 - RNA, 18 nt, Salmonella typhimurium LT2
uaccuuuuuucaguaauu

SEQ ID NO: 3762147 - RNA, 19 nt, Salmonella typhimurium LT2
uacgaacgcgaaggccagc

SEQ ID NO: 3762148 - RNA, 11 nt, Salmonella typhimurium LT2
uacgaacugcg

SEQ ID NO: 3762149 - RNA, 20 nt, Salmonella typhimurium LT2
uacgaacugcggcuuuuuca

SEQ ID NO: 3762150 - RNA, 21 nt, Salmonella typhimurium LT2
uacgaacugcggcuuuuucac

SEQ ID NO: 3762151 - RNA, 15 nt, Salmonella typhimurium LT2
uacgacagcgcuggc

SEQ ID NO: 3762152 - RNA, 14 nt, Salmonella typhimurium LT2
uacgaccgccgaca

SEQ ID NO: 3762153 - RNA, 16 nt, Salmonella typhimurium LT2
uacgacugcacccauc

SEQ ID NO: 3762154 - RNA, 20 nt, Salmonella typhimurium LT2
uacgacugcacccaucuuua

SEQ ID NO: 3762155 - RNA, 16 nt, Salmonella typhimurium LT2
uacgacuggauacagg

SEQ ID NO: 3762156 - RNA, 18 nt, Salmonella typhimurium LT2
uacgagaaccaacugcca

SEQ ID NO: 3762157 - RNA, 21 nt, Salmonella typhimurium LT2
uacgagauuaacguuuguaga

SEQ ID NO: 3762158 - RNA, 19 nt, Salmonella typhimurium LT2
uacgagugcguucuuccac

SEQ ID NO: 3762159 - RNA, 15 nt, Salmonella typhimurium LT2
uacgauccucgccau

SEQ ID NO: 3762160 - RNA, 17 nt, Salmonella typhimurium LT2
uacgaucgccaccgcau

SEQ ID NO: 3762161 - RNA, 15 nt, Salmonella typhimurium LT2
uacgaucgcgcacau

SEQ ID NO: 3762162 - RNA, 21 nt, Salmonella typhimurium LT2
uacgaucgcgcacaugcugug

SEQ ID NO: 3762163 - RNA, 16 nt, Salmonella typhimurium LT2
uacgauuucucgccau

SEQ ID NO: 3762164 - RNA, 19 nt, Salmonella typhimurium LT2
uacgauuucucgccauugc

SEQ ID NO: 3762165 - RNA, 17 nt, Salmonella typhimurium LT2
uacgcaaaaaaagccau

SEQ ID NO: 3762166 - RNA, 12 nt, Salmonella typhimurium LT2
uacgcaaaucac

SEQ ID NO: 3762167 - RNA, 23 nt, Salmonella typhimurium LT2
uacgcaacgcuucugagaauuug

SEQ ID NO: 3762168 - RNA, 16 nt, Salmonella typhimurium LT2
uacgcacacuugcucc

SEQ ID NO: 3762169 - RNA, 21 nt, Salmonella typhimurium LT2
uacgcacuuuuaucggauagu

SEQ ID NO: 3762170 - RNA, 15 nt, Salmonella typhimurium LT2
uacgcagaaccgccg

SEQ ID NO: 3762171 - RNA, 19 nt, Salmonella typhimurium LT2
uacgcagaaccgccgcgau

SEQ ID NO: 3762172 - RNA, 23 nt, Salmonella typhimurium LT2
uacgcagauaacuuccuuugccu

SEQ ID NO: 3762173 - RNA, 18 nt, Salmonella typhimurium LT2
uacgcagcgccuucgcuu

SEQ ID NO: 3762174 - RNA, 16 nt, Salmonella typhimurium LT2
uacgcaggcuaacgcg

SEQ ID NO: 3762175 - RNA, 17 nt, Salmonella typhimurium LT2
uacgcaguuuaaagcca

SEQ ID NO: 3762176 - RNA, 19 nt, Salmonella typhimurium LT2
uacgcaguuuaaagccaau

SEQ ID NO: 3762177 - RNA, 18 nt, Salmonella typhimurium LT2
uacgcaucugcgcguagc

SEQ ID NO: 3762178 - RNA, 22 nt, Salmonella typhimurium LT2
uacgccaaaaaaggcagccagg

SEQ ID NO: 3762179 - RNA, 14 nt, Salmonella typhimurium LT2
uacgccaagcugca

SEQ ID NO: 3762180 - RNA, 14 nt, Salmonella typhimurium LT2
uacgccacgcucca

SEQ ID NO: 3762181 - RNA, 20 nt, Salmonella typhimurium LT2
uacgccacgguaauuuacaa

SEQ ID NO: 3762182 - RNA, 16 nt, Salmonella typhimurium LT2
uacgccagcagacagg

SEQ ID NO: 3762183 - RNA, 15 nt, Salmonella typhimurium LT2
uacgccagccuaucg

SEQ ID NO: 3762184 - RNA, 20 nt, Salmonella typhimurium LT2
uacgccaggaucgucgguca

SEQ ID NO: 3762185 - RNA, 20 nt, Salmonella typhimurium LT2
uacgccaucagcauuuucac

SEQ ID NO: 3762186 - RNA, 20 nt, Salmonella typhimurium LT2
uacgcccaucaguccgcaaa

SEQ ID NO: 3762187 - RNA, 18 nt, Salmonella typhimurium LT2
uacgcccgugacgccagg

SEQ ID NO: 3762188 - RNA, 15 nt, Salmonella typhimurium LT2
uacgccgauagcggc

SEQ ID NO: 3762189 - RNA, 15 nt, Salmonella typhimurium LT2
uacgccgccgcccag

SEQ ID NO: 3762190 - RNA, 20 nt, Salmonella typhimurium LT2
uacgccgccgcccagauguu

SEQ ID NO: 3762191 - RNA, 11 nt, Salmonella typhimurium LT2
uacgccggaua

SEQ ID NO: 3762192 - RNA, 14 nt, Salmonella typhimurium LT2
uacgccggcaucau

SEQ ID NO: 3762193 - RNA, 15 nt, Salmonella typhimurium LT2
uacgccgucacgcau

SEQ ID NO: 3762194 - RNA, 15 nt, Salmonella typhimurium LT2
uacgccguuccguua

SEQ ID NO: 3762195 - RNA, 14 nt, Salmonella typhimurium LT2
uacgccucuuucag

SEQ ID NO: 3762196 - RNA, 20 nt, Salmonella typhimurium LT2
uacgccuugagcaaaacaca

SEQ ID NO: 3762197 - RNA, 22 nt, Salmonella typhimurium LT2
uacgcgcgccgccugcuccggg

SEQ ID NO: 3762198 - RNA, 23 nt, Salmonella typhimurium LT2
uacgcgcucucauaagccgcguu

SEQ ID NO: 3762199 - RNA, 13 nt, Salmonella typhimurium LT2
uacuuguugcugg

SEQ ID NO: 3762200 - RNA, 19 nt, Salmonella typhimurium LT2
uacuuuauuuuucgccaga

SEQ ID NO: 3762201 - RNA, 12 nt, Salmonella typhimurium LT2
uacuuucaaaau

SEQ ID NO: 3762202 - RNA, 17 nt, Salmonella typhimurium LT2
uacuuucaaaauacugg

SEQ ID NO: 3762203 - RNA, 21 nt, Salmonella typhimurium LT2
uacuuucaccugcauaccgag

SEQ ID NO: 3762204 - RNA, 23 nt, Salmonella typhimurium LT2
uacuuucuacaaauguugucgug

SEQ ID NO: 3762205 - RNA, 12 nt, Salmonella typhimurium LT2
uacuuucuccau

SEQ ID NO: 3762206 - RNA, 20 nt, Salmonella typhimurium LT2
uacuuucuccaugccagaag

SEQ ID NO: 3762207 - RNA, 14 nt, Salmonella typhimurium LT2
uacuuuuagaacua

SEQ ID NO: 3762208 - RNA, 20 nt, Salmonella typhimurium LT2
uagaaaguacaucauuggcc

SEQ ID NO: 3762209 - RNA, 23 nt, Salmonella typhimurium LT2
uagaaagucuuuuguuuuucucu

SEQ ID NO: 3762210 - RNA, 16 nt, Salmonella typhimurium LT2
uagaacggaaguugca

SEQ ID NO: 3762211 - RNA, 17 nt, Salmonella typhimurium LT2
uagaacuaucugaaagu

SEQ ID NO: 3762212 - RNA, 15 nt, Salmonella typhimurium LT2
uagaacuuccaacua

SEQ ID NO: 3762213 - RNA, 16 nt, Salmonella typhimurium LT2
uagaacuuccaacuaa

SEQ ID NO: 3762214 - RNA, 24 nt, Salmonella typhimurium LT2
uagaacuuccaacuaaagcgaauu

SEQ ID NO: 3762215 - RNA, 19 nt, Salmonella typhimurium LT2
uagaagcucaugugcagca

SEQ ID NO: 3762216 - RNA, 21 nt, Salmonella typhimurium LT2
uagaauagcaucaauuucucu

SEQ ID NO: 3762217 - RNA, 13 nt, Salmonella typhimurium LT2
uagaaucuauuau

SEQ ID NO: 3762218 - RNA, 21 nt, Salmonella typhimurium LT2
uagacaauugcugcguaaccg

SEQ ID NO: 3762219 - RNA, 22 nt, Salmonella typhimurium LT2
uagacaguuuuuucguuccaga

SEQ ID NO: 3762220 - RNA, 13 nt, Salmonella typhimurium LT2
uagacaucaaaau

SEQ ID NO: 3762221 - RNA, 20 nt, Salmonella typhimurium LT2
uagacaucaaaauuaccuuu

SEQ ID NO: 3762222 - RNA, 21 nt, Salmonella typhimurium LT2
uagaccacgccaucaacagcg

SEQ ID NO: 3762223 - RNA, 12 nt, Salmonella typhimurium LT2
uagacgagcgaa

SEQ ID NO: 3762224 - RNA, 15 nt, Salmonella typhimurium LT2
uagacggccugcaaa

SEQ ID NO: 3762225 - RNA, 18 nt, Salmonella typhimurium LT2
uagacgucgcguacaauu

SEQ ID NO: 3762226 - RNA, 23 nt, Salmonella typhimurium LT2
uagacgucgcguacaauugcuuc

SEQ ID NO: 3762227 - RNA, 21 nt, Salmonella typhimurium LT2
uagacuguugaaagccccggc

SEQ ID NO: 3762228 - RNA, 12 nt, Salmonella typhimurium LT2
uagagaaaucaa

SEQ ID NO: 3762229 - RNA, 14 nt, Salmonella typhimurium LT2
uagagaaccaacgu

SEQ ID NO: 3762230 - RNA, 16 nt, Salmonella typhimurium LT2
uagagaccgcuuuagc

SEQ ID NO: 3762231 - RNA, 16 nt, Salmonella typhimurium LT2
uagagagaaucggguc

SEQ ID NO: 3762232 - RNA, 19 nt, Salmonella typhimurium LT2
uagagaugcuggccggaua

SEQ ID NO: 3762233 - RNA, 21 nt, Salmonella typhimurium LT2
uagagcaaucuggcaguauaa

SEQ ID NO: 3762234 - RNA, 18 nt, Salmonella typhimurium LT2
uagagcugacggagcaaa

SEQ ID NO: 3762235 - RNA, 14 nt, Salmonella typhimurium LT2
uagauaccuacuuu

SEQ ID NO: 3762236 - RNA, 16 nt, Salmonella typhimurium LT2
uagauaccuacuuuau

SEQ ID NO: 3762237 - RNA, 23 nt, Salmonella typhimurium LT2
uagauaccuacuuuauuuuucgc

SEQ ID NO: 3762238 - RNA, 17 nt, Salmonella typhimurium LT2
uagauaugaaagaagga

SEQ ID NO: 3762239 - RNA, 21 nt, Salmonella typhimurium LT2
uagauauuaaacguuauucau

SEQ ID NO: 3762240 - RNA, 14 nt, Salmonella typhimurium LT2
uagauauuccccac

SEQ ID NO: 3762241 - RNA, 14 nt, Salmonella typhimurium LT2
uagaugaaugacug

SEQ ID NO: 3762242 - RNA, 19 nt, Salmonella typhimurium LT2
uagaugaaugacuguccac

SEQ ID NO: 3762243 - RNA, 21 nt, Salmonella typhimurium LT2
uagaugcugauguccgcagcc

SEQ ID NO: 3762244 - RNA, 19 nt, Salmonella typhimurium LT2
uagauucuaacauaaugaa

SEQ ID NO: 3762245 - RNA, 23 nt, Salmonella typhimurium LT2
uagcaaaggcuaccggacaaaca

SEQ ID NO: 3762246 - RNA, 16 nt, Salmonella typhimurium LT2
uagcaaaucaucgcca

SEQ ID NO: 3762247 - RNA, 18 nt, Salmonella typhimurium LT2
uagcaaaucuucauuuca

SEQ ID NO: 3762248 - RNA, 22 nt, Salmonella typhimurium LT2
uagcaacguccgcagccgacgc

SEQ ID NO: 3762249 - RNA, 14 nt, Salmonella typhimurium LT2
uagcaaugaagcaa

SEQ ID NO: 3762250 - RNA, 12 nt, Salmonella typhimurium LT2
uagcaccagacc

SEQ ID NO: 3762251 - RNA, 17 nt, Salmonella typhimurium LT2
uagcaccagaccgacaa

SEQ ID NO: 3762252 - RNA, 15 nt, Salmonella typhimurium LT2
uagcacccaggaugg

SEQ ID NO: 3762253 - RNA, 15 nt, Salmonella typhimurium LT2
uagcacuuuaaacac

SEQ ID NO: 3762254 - RNA, 13 nt, Salmonella typhimurium LT2
uagcagcaauaau

SEQ ID NO: 3762255 - RNA, 19 nt, Salmonella typhimurium LT2
uagcagcgaugacagcagg

SEQ ID NO: 3762256 - RNA, 13 nt, Salmonella typhimurium LT2
uagcaggccauaa

SEQ ID NO: 3762257 - RNA, 16 nt, Salmonella typhimurium LT2
uagcagugcaaaggcc

SEQ ID NO: 3762258 - RNA, 21 nt, Salmonella typhimurium LT2
uagcauaaaugcgaugaacau

SEQ ID NO: 3762259 - RNA, 17 nt, Salmonella typhimurium LT2
uagcauaacguuuccuu

SEQ ID NO: 3762260 - RNA, 16 nt, Salmonella typhimurium LT2
uagcauaagcacagau

SEQ ID NO: 3762261 - RNA, 15 nt, Salmonella typhimurium LT2
uagcauagacgauca

SEQ ID NO: 3762262 - RNA, 12 nt, Salmonella typhimurium LT2
uagcaucaccag

SEQ ID NO: 3762263 - RNA, 17 nt, Salmonella typhimurium LT2
uagcaucaggacauggu

SEQ ID NO: 3762264 - RNA, 13 nt, Salmonella typhimurium LT2
uagcaucaucaaa

SEQ ID NO: 3762265 - RNA, 14 nt, Salmonella typhimurium LT2
uagcauccagaccc

SEQ ID NO: 3762266 - RNA, 23 nt, Salmonella typhimurium LT2
uagcauuuccgcaucguuaucau

SEQ ID NO: 3762267 - RNA, 20 nt, Salmonella typhimurium LT2
uagccaaaagcgccacgcgu

SEQ ID NO: 3762268 - RNA, 21 nt, Salmonella typhimurium LT2
uagccaaaagcgccacgcguc

SEQ ID NO: 3762269 - RNA, 20 nt, Salmonella typhimurium LT2
uagccaaagcgguaauuaau

SEQ ID NO: 3762270 - RNA, 15 nt, Salmonella typhimurium LT2
uagccaauaacgucu

SEQ ID NO: 3762271 - RNA, 20 nt, Salmonella typhimurium LT2
uagccacagauuaugcagcu

SEQ ID NO: 3762272 - RNA, 15 nt, Salmonella typhimurium LT2
uagccagccaaacag

SEQ ID NO: 3762273 - RNA, 20 nt, Salmonella typhimurium LT2
uagccagcgauccugcggca

SEQ ID NO: 3762274 - RNA, 17 nt, Salmonella typhimurium LT2
uagccaguucgccuucu

SEQ ID NO: 3762275 - RNA, 13 nt, Salmonella typhimurium LT2
uagccaucggcau

SEQ ID NO: 3762276 - RNA, 20 nt, Salmonella typhimurium LT2
uagcccagcgccgcaucgcg

SEQ ID NO: 3762277 - RNA, 14 nt, Salmonella typhimurium LT2
uagcccauccagca

SEQ ID NO: 3762278 - RNA, 21 nt, Salmonella typhimurium LT2
uagccccuuaucaaaggcguc

SEQ ID NO: 3762279 - RNA, 23 nt, Salmonella typhimurium LT2
uagcccgcuuuaccgaaaucggu

SEQ ID NO: 3762280 - RNA, 23 nt, Salmonella typhimurium LT2
uagccgccgugguaaauacgcug

SEQ ID NO: 3762281 - RNA, 12 nt, Salmonella typhimurium LT2
uagccgcgcgcc

SEQ ID NO: 3762282 - RNA, 15 nt, Salmonella typhimurium LT2
uagccgggguaauau

SEQ ID NO: 3762283 - RNA, 21 nt, Salmonella typhimurium LT2
uagccgguaugaacgggaacc

SEQ ID NO: 3762284 - RNA, 20 nt, Salmonella typhimurium LT2
uagccggugccgcaaucggu

SEQ ID NO: 3762285 - RNA, 15 nt, Salmonella typhimurium LT2
uagccguucaugcac

SEQ ID NO: 3762286 - RNA, 18 nt, Salmonella typhimurium LT2
uagccguucaugcacucg

SEQ ID NO: 3762287 - RNA, 22 nt, Salmonella typhimurium LT2
uagccucggucgagcuuuugcu

SEQ ID NO: 3762288 - RNA, 23 nt, Salmonella typhimurium LT2
uagccucggucgagcuuuugcug

SEQ ID NO: 3762289 - RNA, 14 nt, Salmonella typhimurium LT2
uagccugaacgccg

SEQ ID NO: 3762290 - RNA, 18 nt, Salmonella typhimurium LT2
uagccuuccaccgucuug

SEQ ID NO: 3762291 - RNA, 23 nt, Salmonella typhimurium LT2
uagccuuccaccgucuugcugcg

SEQ ID NO: 3762292 - RNA, 22 nt, Salmonella typhimurium LT2
uagccuuccuggggaacagaag

SEQ ID NO: 3762293 - RNA, 19 nt, Salmonella typhimurium LT2
uagcgaaacugccuaaauu

SEQ ID NO: 3762294 - RNA, 20 nt, Salmonella typhimurium LT2
uagcgaaacugccuaaauug

SEQ ID NO: 3762295 - RNA, 23 nt, Salmonella typhimurium LT2
uagcgaaucacauccgccagcgc

SEQ ID NO: 3762296 - RNA, 14 nt, Salmonella typhimurium LT2
uagcgaccuuuuuu

SEQ ID NO: 3762297 - RNA, 17 nt, Salmonella typhimurium LT2
uagcgcaaaagcgcgcc

SEQ ID NO: 3762298 - RNA, 20 nt, Salmonella typhimurium LT2
uagcgcaggggggaaaugag

SEQ ID NO: 3762299 - RNA, 17 nt, Salmonella typhimurium LT2
uagcgcaguacgcgcca

SEQ ID NO: 3762300 - RNA, 21 nt, Salmonella typhimurium LT2
uagcgcauggcggccagaugg

SEQ ID NO: 3762301 - RNA, 14 nt, Salmonella typhimurium LT2
uagcgccgcuucca

SEQ ID NO: 3762302 - RNA, 19 nt, Salmonella typhimurium LT2
uagucgcuccccauaaaaa

SEQ ID NO: 3762303 - RNA, 18 nt, Salmonella typhimurium LT2
uagucgcuuuucauacug

SEQ ID NO: 3762304 - RNA, 12 nt, Salmonella typhimurium LT2
uagucgucauug

SEQ ID NO: 3762305 - RNA, 12 nt, Salmonella typhimurium LT2
uagucuccgcca

SEQ ID NO: 3762306 - RNA, 22 nt, Salmonella typhimurium LT2
uagucuccugccgaugaaauaa

SEQ ID NO: 3762307 - RNA, 18 nt, Salmonella typhimurium LT2
uagugauaccagccaaca

SEQ ID NO: 3762308 - RNA, 20 nt, Salmonella typhimurium LT2
uagugcuucucuucaaacuc

SEQ ID NO: 3762309 - RNA, 15 nt, Salmonella typhimurium LT2
uaguggaucagcaga

SEQ ID NO: 3762310 - RNA, 23 nt, Salmonella typhimurium LT2
uaguggcagaguccagcggcagc

SEQ ID NO: 3762311 - RNA, 22 nt, Salmonella typhimurium LT2
uaguguccacuuaaauuuugau

SEQ ID NO: 3762312 - RNA, 15 nt, Salmonella typhimurium LT2
uagugucuaauuuaa

SEQ ID NO: 3762313 - RNA, 15 nt, Salmonella typhimurium LT2
uagugugcugauugu

SEQ ID NO: 3762314 - RNA, 20 nt, Salmonella typhimurium LT2
uaguuaccguaaucaucgcg

SEQ ID NO: 3762315 - RNA, 20 nt, Salmonella typhimurium LT2
uaguuauacauuuuuuucuu

SEQ ID NO: 3762316 - RNA, 19 nt, Salmonella typhimurium LT2
uaguucuaaaaguaagcua

SEQ ID NO: 3762317 - RNA, 15 nt, Salmonella typhimurium LT2
uaguugauaauauua

SEQ ID NO: 3762318 - RNA, 15 nt, Salmonella typhimurium LT2
uaguuuauucuucuc

SEQ ID NO: 3762319 - RNA, 14 nt, Salmonella typhimurium LT2
uaguuucuauuaaa

SEQ ID NO: 3762320 - RNA, 18 nt, Salmonella typhimurium LT2
uaguuucuauuaaaucag

SEQ ID NO: 3762321 - RNA, 19 nt, Salmonella typhimurium LT2
uaguuucuauuaaaucaga

SEQ ID NO: 3762322 - RNA, 21 nt, Salmonella typhimurium LT2
uaguuucuggccucuuaucag

SEQ ID NO: 3762323 - RNA, 20 nt, Salmonella typhimurium LT2
uauaaaaaaugguuuuauuu

SEQ ID NO: 3762324 - RNA, 18 nt, Salmonella typhimurium LT2
uauaaaaauagcuggcug

SEQ ID NO: 3762325 - RNA, 22 nt, Salmonella typhimurium LT2
uauaaaacgggccacugcuggc

SEQ ID NO: 3762326 - RNA, 15 nt, Salmonella typhimurium LT2
uauaaaacuacaaca

SEQ ID NO: 3762327 - RNA, 13 nt, Salmonella typhimurium LT2
uauaaaauuuaau

SEQ ID NO: 3762328 - RNA, 13 nt, Salmonella typhimurium LT2
uauaaaccugauu

SEQ ID NO: 3762329 - RNA, 19 nt, Salmonella typhimurium LT2
uauaaauaaaguguuauua

SEQ ID NO: 3762330 - RNA, 12 nt, Salmonella typhimurium LT2
uauaaauaucau

SEQ ID NO: 3762331 - RNA, 12 nt, Salmonella typhimurium LT2
uauaaaucaaua

SEQ ID NO: 3762332 - RNA, 17 nt, Salmonella typhimurium LT2
uauaaauuuuuuaacag

SEQ ID NO: 3762333 - RNA, 11 nt, Salmonella typhimurium LT2
uauaacagaau

SEQ ID NO: 3762334 - RNA, 21 nt, Salmonella typhimurium LT2
uauaaccguagauuuucauca

SEQ ID NO: 3762335 - RNA, 22 nt, Salmonella typhimurium LT2
uauaaccgucgcccguccgcua

SEQ ID NO: 3762336 - RNA, 21 nt, Salmonella typhimurium LT2
uauaacgacagccuauuaauc

SEQ ID NO: 3762337 - RNA, 14 nt, Salmonella typhimurium LT2
uauaacgcguucug

SEQ ID NO: 3762338 - RNA, 23 nt, Salmonella typhimurium LT2
uauaacgugacugucauuucuca

SEQ ID NO: 3762339 - RNA, 20 nt, Salmonella typhimurium LT2
uauaacuaaacucaucuuua

SEQ ID NO: 3762340 - RNA, 13 nt, Salmonella typhimurium LT2
uauaauaauaucc

SEQ ID NO: 3762341 - RNA, 20 nt, Salmonella typhimurium LT2
uauaauaucaacccucccug

SEQ ID NO: 3762342 - RNA, 17 nt, Salmonella typhimurium LT2
uauaaucccgcggcgga

SEQ ID NO: 3762343 - RNA, 14 nt, Salmonella typhimurium LT2
uauaaucugaaaga

SEQ ID NO: 3762344 - RNA, 18 nt, Salmonella typhimurium LT2
uauaaucugaaagacaug

SEQ ID NO: 3762345 - RNA, 14 nt, Salmonella typhimurium LT2
uauaauuauuuguu

SEQ ID NO: 3762346 - RNA, 20 nt, Salmonella typhimurium LT2
uauaauugcccgcaaucucu

SEQ ID NO: 3762347 - RNA, 20 nt, Salmonella typhimurium LT2
uauacaaaacccauaucccc

SEQ ID NO: 3762348 - RNA, 21 nt, Salmonella typhimurium LT2
uauacaguaaaacgccaagaa

SEQ ID NO: 3762349 - RNA, 21 nt, Salmonella typhimurium LT2
uauacauauggaugaggaucg

SEQ ID NO: 3762350 - RNA, 15 nt, Salmonella typhimurium LT2
uauacaucgcuuucc

SEQ ID NO: 3762351 - RNA, 20 nt, Salmonella typhimurium LT2
uauacaucugauuaccgguu

SEQ ID NO: 3762352 - RNA, 20 nt, Salmonella typhimurium LT2
uauaccacgucugaagaagu

SEQ ID NO: 3762353 - RNA, 15 nt, Salmonella typhimurium LT2
uauaccacugguuaa

SEQ ID NO: 3762354 - RNA, 21 nt, Salmonella typhimurium LT2
uauaccauaaaugaaaccuca

SEQ ID NO: 3762355 - RNA, 21 nt, Salmonella typhimurium LT2
uauaccaugccgccauuuuau

SEQ ID NO: 3762356 - RNA, 18 nt, Salmonella typhimurium LT2
uauacccgcguuuucuca

SEQ ID NO: 3762357 - RNA, 14 nt, Salmonella typhimurium LT2
uauacgaagcgcca

SEQ ID NO: 3762358 - RNA, 21 nt, Salmonella typhimurium LT2
uauacgcccgccugguccucu

SEQ ID NO: 3762359 - RNA, 17 nt, Salmonella typhimurium LT2
uauacgccuauuuucug

SEQ ID NO: 3762360 - RNA, 12 nt, Salmonella typhimurium LT2
uauacucaaaaa

SEQ ID NO: 3762361 - RNA, 14 nt, Salmonella typhimurium LT2
uauacuggaagcua

SEQ ID NO: 3762362 - RNA, 13 nt, Salmonella typhimurium LT2
uauacugugacga

SEQ ID NO: 3762363 - RNA, 15 nt, Salmonella typhimurium LT2
uauacuuauugaucc

SEQ ID NO: 3762364 - RNA, 13 nt, Salmonella typhimurium LT2
uauacuucaucag

SEQ ID NO: 3762365 - RNA, 14 nt, Salmonella typhimurium LT2
uauagauauuaaac

SEQ ID NO: 3762366 - RNA, 12 nt, Salmonella typhimurium LT2
uauagaucaggc

SEQ ID NO: 3762367 - RNA, 15 nt, Salmonella typhimurium LT2
uauagccauuuuuug

SEQ ID NO: 3762368 - RNA, 14 nt, Salmonella typhimurium LT2
uauagccugcuggg

SEQ ID NO: 3762369 - RNA, 15 nt, Salmonella typhimurium LT2
uauagcgcaaacgcg

SEQ ID NO: 3762370 - RNA, 16 nt, Salmonella typhimurium LT2
uauagcgcaaacgcgc

SEQ ID NO: 3762371 - RNA, 22 nt, Salmonella typhimurium LT2
uauagcggucaaaauauaacuu

SEQ ID NO: 3762372 - RNA, 20 nt, Salmonella typhimurium LT2
uauaggccaucacuggcauu

SEQ ID NO: 3762373 - RNA, 20 nt, Salmonella typhimurium LT2
uauagucaaacccuuccgca

SEQ ID NO: 3762374 - RNA, 19 nt, Salmonella typhimurium LT2
uauaguccacuuucuguaa

SEQ ID NO: 3762375 - RNA, 15 nt, Salmonella typhimurium LT2
uauagugaagauggu

SEQ ID NO: 3762376 - RNA, 16 nt, Salmonella typhimurium LT2
uauaguggauggccca

SEQ ID NO: 3762377 - RNA, 22 nt, Salmonella typhimurium LT2
uauaguucgcauagaauuucag

SEQ ID NO: 3762378 - RNA, 21 nt, Salmonella typhimurium LT2
uauaguuuuuaccauauuuau

SEQ ID NO: 3762379 - RNA, 12 nt, Salmonella typhimurium LT2
uauauaaaaaua

SEQ ID NO: 3762380 - RNA, 18 nt, Salmonella typhimurium LT2
uauauacccaaaauaauu

SEQ ID NO: 3762381 - RNA, 22 nt, Salmonella typhimurium LT2
uauauacucccccuaacucuag

SEQ ID NO: 3762382 - RNA, 20 nt, Salmonella typhimurium LT2
uauauauguucaauauucaa

SEQ ID NO: 3762383 - RNA, 13 nt, Salmonella typhimurium LT2
uauaucaggcaaa

SEQ ID NO: 3762384 - RNA, 16 nt, Salmonella typhimurium LT2
uauaucgacaggcgua

SEQ ID NO: 3762385 - RNA, 21 nt, Salmonella typhimurium LT2
uauaugaaaucgccuguuaau

SEQ ID NO: 3762386 - RNA, 14 nt, Salmonella typhimurium LT2
uauaugagcgggcc

SEQ ID NO: 3762387 - RNA, 23 nt, Salmonella typhimurium LT2
uauaugagcgggccgucaggccc

SEQ ID NO: 3762388 - RNA, 18 nt, Salmonella typhimurium LT2
uauaugcaggcauaaaaa

SEQ ID NO: 3762389 - RNA, 19 nt, Salmonella typhimurium LT2
uauaugcaggcauaaaaaa

SEQ ID NO: 3762390 - RNA, 16 nt, Salmonella typhimurium LT2
uauaugggcaauuaua

SEQ ID NO: 3762391 - RNA, 17 nt, Salmonella typhimurium LT2
uauauguuucuguauuu

SEQ ID NO: 3762392 - RNA, 15 nt, Salmonella typhimurium LT2
uauauucaugauagu

SEQ ID NO: 3762393 - RNA, 15 nt, Salmonella typhimurium LT2
uauauucuucuuaga

SEQ ID NO: 3762394 - RNA, 23 nt, Salmonella typhimurium LT2
uauauugcgaauaaaacugccau

SEQ ID NO: 3762395 - RNA, 13 nt, Salmonella typhimurium LT2
uauauuuuucccu

SEQ ID NO: 3762396 - RNA, 21 nt, Salmonella typhimurium LT2
uaucaaaaugcaccggcguua

SEQ ID NO: 3762397 - RNA, 20 nt, Salmonella typhimurium LT2
uaucaaacagguuguugaug

SEQ ID NO: 3762398 - RNA, 18 nt, Salmonella typhimurium LT2
uaucaaaccaguuuuuca

SEQ ID NO: 3762399 - RNA, 19 nt, Salmonella typhimurium LT2
uaucaaaccaguuuuucau

SEQ ID NO: 3762400 - RNA, 14 nt, Salmonella typhimurium LT2
uaucaaauacgcua

SEQ ID NO: 3762401 - RNA, 17 nt, Salmonella typhimurium LT2
uaucaaauuugcccagc

SEQ ID NO: 3762402 - RNA, 15 nt, Salmonella typhimurium LT2
uaucaacgggaacuu

SEQ ID NO: 3762403 - RNA, 18 nt, Salmonella typhimurium LT2
uaucaacgucuugccaug

SEQ ID NO: 3762404 - RNA, 19 nt, Salmonella typhimurium LT2
uaucaacgucuugccauga

SEQ ID NO: 3762405 - RNA, 20 nt, Salmonella typhimurium LT2
uaucaagaaaacugccagga

SEQ ID NO: 3762406 - RNA, 14 nt, Salmonella typhimurium LT2
uaucggccagcucu

SEQ ID NO: 3762407 - RNA, 17 nt, Salmonella typhimurium LT2
uaucggcucaauacccu

SEQ ID NO: 3762408 - RNA, 19 nt, Salmonella typhimurium LT2
uaucguaagccacugccca

SEQ ID NO: 3762409 - RNA, 15 nt, Salmonella typhimurium LT2
uaucguagugccaca

SEQ ID NO: 3762410 - RNA, 15 nt, Salmonella typhimurium LT2
uaucgucguauuauc

SEQ ID NO: 3762411 - RNA, 20 nt, Salmonella typhimurium LT2
uaucguuaccgcccucaugg

SEQ ID NO: 3762412 - RNA, 14 nt, Salmonella typhimurium LT2
uaucuaucaccgcc

SEQ ID NO: 3762413 - RNA, 17 nt, Salmonella typhimurium LT2
uaucuaugguaauuuaa

SEQ ID NO: 3762414 - RNA, 18 nt, Salmonella typhimurium LT2
uaucucccgguugauaau

SEQ ID NO: 3762415 - RNA, 23 nt, Salmonella typhimurium LT2
uaucugaaaguaagcuauuucug

SEQ ID NO: 3762416 - RNA, 14 nt, Salmonella typhimurium LT2
uaucugaugaacua

SEQ ID NO: 3762417 - RNA, 21 nt, Salmonella typhimurium LT2
uaucugaugccugaaggcgcu

SEQ ID NO: 3762418 - RNA, 17 nt, Salmonella typhimurium LT2
uaucugcauaggcuuua

SEQ ID NO: 3762419 - RNA, 12 nt, Salmonella typhimurium LT2
uaucugcccuuu

SEQ ID NO: 3762420 - RNA, 18 nt, Salmonella typhimurium LT2
uaucugcccuuucuuaug

SEQ ID NO: 3762421 - RNA, 18 nt, Salmonella typhimurium LT2
uaucuggccuacagcauc

SEQ ID NO: 3762422 - RNA, 20 nt, Salmonella typhimurium LT2
uaucugggucaggaacugcu

SEQ ID NO: 3762423 - RNA, 19 nt, Salmonella typhimurium LT2
uaucuguauaaauaaaauu

SEQ ID NO: 3762424 - RNA, 22 nt, Salmonella typhimurium LT2
uaucugucaugcgggagcuugg

SEQ ID NO: 3762425 - RNA, 21 nt, Salmonella typhimurium LT2
uaucuguugauaaaacacucu

SEQ ID NO: 3762426 - RNA, 15 nt, Salmonella typhimurium LT2
uaucuuacggaaaaa

SEQ ID NO: 3762427 - RNA, 20 nt, Salmonella typhimurium LT2
uaucuucaucgguaagcgca

SEQ ID NO: 3762428 - RNA, 18 nt, Salmonella typhimurium LT2
uaucuuccacgguaaaac

SEQ ID NO: 3762429 - RNA, 21 nt, Salmonella typhimurium LT2
uaucuucccgauaacugaagg

SEQ ID NO: 3762430 - RNA, 13 nt, Salmonella typhimurium LT2
uaucuugcuuuau

SEQ ID NO: 3762431 - RNA, 17 nt, Salmonella typhimurium LT2
uaucuuuaugucaguaa

SEQ ID NO: 3762432 - RNA, 24 nt, Salmonella typhimurium LT2
uaucuuucagaccuuuuacuucac

SEQ ID NO: 3762433 - RNA, 22 nt, Salmonella typhimurium LT2
uaucuuugcugccgauugguca

SEQ ID NO: 3762434 - RNA, 20 nt, Salmonella typhimurium LT2
uaugaaauucuugcccgcug

SEQ ID NO: 3762435 - RNA, 19 nt, Salmonella typhimurium LT2
uaugaaggcucaaauuugg

SEQ ID NO: 3762436 - RNA, 13 nt, Salmonella typhimurium LT2
uaugaauaaaaaa

SEQ ID NO: 3762437 - RNA, 17 nt, Salmonella typhimurium LT2
uaugaccgagucuacau

SEQ ID NO: 3762438 - RNA, 18 nt, Salmonella typhimurium LT2
uaugacugcgaauuuccu

SEQ ID NO: 3762439 - RNA, 23 nt, Salmonella typhimurium LT2
uaugauagccguucuccagcguu

SEQ ID NO: 3762440 - RNA, 17 nt, Salmonella typhimurium LT2
uaugaucgaaaaugcgc

SEQ ID NO: 3762441 - RNA, 22 nt, Salmonella typhimurium LT2
uaugaucgguuuuuuuagaacc

SEQ ID NO: 3762442 - RNA, 21 nt, Salmonella typhimurium LT2
uaugaugcuugcucguaccag

SEQ ID NO: 3762443 - RNA, 21 nt, Salmonella typhimurium LT2
uaugcaauuaauauauuuaua

SEQ ID NO: 3762444 - RNA, 13 nt, Salmonella typhimurium LT2
uaugcacuucgcc

SEQ ID NO: 3762445 - RNA, 13 nt, Salmonella typhimurium LT2
uaugcagcggaau

SEQ ID NO: 3762446 - RNA, 13 nt, Salmonella typhimurium LT2
uaugcaugguguu

SEQ ID NO: 3762447 - RNA, 23 nt, Salmonella typhimurium LT2
uaugccacucuuuuaaggcccuc

SEQ ID NO: 3762448 - RNA, 16 nt, Salmonella typhimurium LT2
uaugccaggcuuccug

SEQ ID NO: 3762449 - RNA, 16 nt, Salmonella typhimurium LT2
uaugcccccuccagcc

SEQ ID NO: 3762450 - RNA, 16 nt, Salmonella typhimurium LT2
uaugccgcauaaaauu

SEQ ID NO: 3762451 - RNA, 13 nt, Salmonella typhimurium LT2
uaugccuuccaga

SEQ ID NO: 3762452 - RNA, 21 nt, Salmonella typhimurium LT2
uaugccuuccagaaauaaaau

SEQ ID NO: 3762453 - RNA, 18 nt, Salmonella typhimurium LT2
uaugcgacgguaaaaaua

SEQ ID NO: 3762454 - RNA, 19 nt, Salmonella typhimurium LT2
uaugcgacugaaaaucaaa

SEQ ID NO: 3762455 - RNA, 21 nt, Salmonella typhimurium LT2
uaugcgacugaaaaucaaaaa

SEQ ID NO: 3762456 - RNA, 17 nt, Salmonella typhimurium LT2
uaugcgccaacugcauu

SEQ ID NO: 3762457 - RNA, 19 nt, Salmonella typhimurium LT2
uaugcgccuucuucgcaau

SEQ ID NO: 3762458 - RNA, 18 nt, Salmonella typhimurium LT2
uaugcgcuuccagcauga

SEQ ID NO: 3762459 - RNA, 16 nt, Salmonella typhimurium LT2
uaugcgcuuuuuucag

SEQ ID NO: 3762460 - RNA, 21 nt, Salmonella typhimurium LT2
uaugcggggguguugcaauaa

SEQ ID NO: 3762461 - RNA, 20 nt, Salmonella typhimurium LT2
uaugcuacacgccccuuucu

SEQ ID NO: 3762462 - RNA, 17 nt, Salmonella typhimurium LT2
uaugcucaacuuccaga

SEQ ID NO: 3762463 - RNA, 18 nt, Salmonella typhimurium LT2
uaugcucauugccuuuca

SEQ ID NO: 3762464 - RNA, 20 nt, Salmonella typhimurium LT2
uaugcucccggggauuucuu

SEQ ID NO: 3762465 - RNA, 15 nt, Salmonella typhimurium LT2
uauggaaugguauau

SEQ ID NO: 3762466 - RNA, 14 nt, Salmonella typhimurium LT2
uauggaugaggauc

SEQ ID NO: 3762467 - RNA, 12 nt, Salmonella typhimurium LT2
uauggcaaugcc

SEQ ID NO: 3762468 - RNA, 22 nt, Salmonella typhimurium LT2
uauggcggcauaaucaggaaaa

SEQ ID NO: 3762469 - RNA, 17 nt, Salmonella typhimurium LT2
uauggguguagcucaua

SEQ ID NO: 3762470 - RNA, 21 nt, Salmonella typhimurium LT2
uauggguuuccuccaucagcg

SEQ ID NO: 3762471 - RNA, 17 nt, Salmonella typhimurium LT2
uaugguauucgugcauc

SEQ ID NO: 3762472 - RNA, 14 nt, Salmonella typhimurium LT2
uauguaaauuaucc

SEQ ID NO: 3762473 - RNA, 16 nt, Salmonella typhimurium LT2
uauguaacugaaccca

SEQ ID NO: 3762474 - RNA, 15 nt, Salmonella typhimurium LT2
uauguacaaccucau

SEQ ID NO: 3762475 - RNA, 20 nt, Salmonella typhimurium LT2
uauguagcaacagacuaucc

SEQ ID NO: 3762476 - RNA, 22 nt, Salmonella typhimurium LT2
uauguagcgcugaagcccgcga

SEQ ID NO: 3762477 - RNA, 22 nt, Salmonella typhimurium LT2
uauguaggccugauaagguaaa

SEQ ID NO: 3762478 - RNA, 13 nt, Salmonella typhimurium LT2
uauguauuuaauu

SEQ ID NO: 3762479 - RNA, 19 nt, Salmonella typhimurium LT2
uauguauuuaauuuuuccu

SEQ ID NO: 3762480 - RNA, 17 nt, Salmonella typhimurium LT2
uaugucuaugauuuuaa

SEQ ID NO: 3762481 - RNA, 23 nt, Salmonella typhimurium LT2
uaugugaucuauauauucuucuu

SEQ ID NO: 3762482 - RNA, 19 nt, Salmonella typhimurium LT2
uaugugcaucggcacagcg

SEQ ID NO: 3762483 - RNA, 19 nt, Salmonella typhimurium LT2
uauguuaacgccgauuaau

SEQ ID NO: 3762484 - RNA, 22 nt, Salmonella typhimurium LT2
uauguuaccuguuaaauugugg

SEQ ID NO: 3762485 - RNA, 18 nt, Salmonella typhimurium LT2
uauguuguggcaauauuu

SEQ ID NO: 3762486 - RNA, 13 nt, Salmonella typhimurium LT2
uauuaaaaccauu

SEQ ID NO: 3762487 - RNA, 22 nt, Salmonella typhimurium LT2
uauuaaaaccauugcuaaaaau

SEQ ID NO: 3762488 - RNA, 16 nt, Salmonella typhimurium LT2
uauuaaaauaaauuaa

SEQ ID NO: 3762489 - RNA, 22 nt, Salmonella typhimurium LT2
uauuaaaauuguaauaauuuaa

SEQ ID NO: 3762490 - RNA, 18 nt, Salmonella typhimurium LT2
uauuaacagcuucuucuu

SEQ ID NO: 3762491 - RNA, 18 nt, Salmonella typhimurium LT2
uauuaagccuuuuuaaau

SEQ ID NO: 3762492 - RNA, 21 nt, Salmonella typhimurium LT2
uauuaagccuuuuuaaauauu

SEQ ID NO: 3762493 - RNA, 22 nt, Salmonella typhimurium LT2
uauuaagccuuuuuaaauauua

SEQ ID NO: 3762494 - RNA, 20 nt, Salmonella typhimurium LT2
uauuaauccaaugacaguga

SEQ ID NO: 3762495 - RNA, 15 nt, Salmonella typhimurium LT2
uauuaccaauauuaa

SEQ ID NO: 3762496 - RNA, 16 nt, Salmonella typhimurium LT2
uauuaccaauauuaau

SEQ ID NO: 3762497 - RNA, 19 nt, Salmonella typhimurium LT2
uauuaccaauauuaaugua

SEQ ID NO: 3762498 - RNA, 15 nt, Salmonella typhimurium LT2
uauuaccaaugagcu

SEQ ID NO: 3762499 - RNA, 20 nt, Salmonella typhimurium LT2
uauuagaauucccuauguaa

SEQ ID NO: 3762500 - RNA, 15 nt, Salmonella typhimurium LT2
uauuagccaaagcgg

SEQ ID NO: 3762501 - RNA, 18 nt, Salmonella typhimurium LT2
uauuagccaaagcgguaa

SEQ ID NO: 3762502 - RNA, 21 nt, Salmonella typhimurium LT2
uauuagcgguacucuuuuucc

SEQ ID NO: 3762503 - RNA, 16 nt, Salmonella typhimurium LT2
uauuagcguuuuuacc

SEQ ID NO: 3762504 - RNA, 12 nt, Salmonella typhimurium LT2
uauuauaaaaua

SEQ ID NO: 3762505 - RNA, 12 nt, Salmonella typhimurium LT2
uauuauacuuau

SEQ ID NO: 3762506 - RNA, 15 nt, Salmonella typhimurium LT2
uauuaucaauccugc

SEQ ID NO: 3762507 - RNA, 13 nt, Salmonella typhimurium LT2
uauuauguagcaa

SEQ ID NO: 3762508 - RNA, 13 nt, Salmonella typhimurium LT2
uauuauugucuuu

SEQ ID NO: 3762509 - RNA, 15 nt, Salmonella typhimurium LT2
ucaaaaugacaaauu

SEQ ID NO: 3762510 - RNA, 22 nt, Salmonella typhimurium LT2
ucaaaaugauguccacacugac

SEQ ID NO: 3762511 - RNA, 20 nt, Salmonella typhimurium LT2
ucaaacaaacauugcuggaa

SEQ ID NO: 3762512 - RNA, 13 nt, Salmonella typhimurium LT2
ucaaacaaaucau

SEQ ID NO: 3762513 - RNA, 19 nt, Salmonella typhimurium LT2
ucaaacaaaucaucagcau

SEQ ID NO: 3762514 - RNA, 17 nt, Salmonella typhimurium LT2
ucaaacagauccagcgc

SEQ ID NO: 3762515 - RNA, 19 nt, Salmonella typhimurium LT2
ucaaacaggcgaaaacgua

SEQ ID NO: 3762516 - RNA, 17 nt, Salmonella typhimurium LT2
ucaaaccaguuuuucau

SEQ ID NO: 3762517 - RNA, 20 nt, Salmonella typhimurium LT2
ucaaacccuuccagacagcu

SEQ ID NO: 3762518 - RNA, 15 nt, Salmonella typhimurium LT2
ucaaacccuuccgca

SEQ ID NO: 3762519 - RNA, 14 nt, Salmonella typhimurium LT2
ucaaacgcgccgcu

SEQ ID NO: 3762520 - RNA, 14 nt, Salmonella typhimurium LT2
ucaaacgucacauu

SEQ ID NO: 3762521 - RNA, 20 nt, Salmonella typhimurium LT2
ucaaacuccgcgcuggcaau

SEQ ID NO: 3762522 - RNA, 20 nt, Salmonella typhimurium LT2
ucaaacucgcccagcgccuu

SEQ ID NO: 3762523 - RNA, 19 nt, Salmonella typhimurium LT2
ucaaacucuuccgggcuga

SEQ ID NO: 3762524 - RNA, 13 nt, Salmonella typhimurium LT2
ucaaacuuagcga

SEQ ID NO: 3762525 - RNA, 17 nt, Salmonella typhimurium LT2
ucaaacuuguguuccca

SEQ ID NO: 3762526 - RNA, 19 nt, Salmonella typhimurium LT2
ucaaacuuguguucccacu

SEQ ID NO: 3762527 - RNA, 13 nt, Salmonella typhimurium LT2
ucaaacuuuuaua

SEQ ID NO: 3762528 - RNA, 13 nt, Salmonella typhimurium LT2
ucaaagaaaacau

SEQ ID NO: 3762529 - RNA, 18 nt, Salmonella typhimurium LT2
ucaaagaaaacaucagcc

SEQ ID NO: 3762530 - RNA, 21 nt, Salmonella typhimurium LT2
ucaaagaagcggaaaccccag

SEQ ID NO: 3762531 - RNA, 18 nt, Salmonella typhimurium LT2
ucaaagcguaccgucugg

SEQ ID NO: 3762532 - RNA, 22 nt, Salmonella typhimurium LT2
ucaaaggcgcugaacgcauaca

SEQ ID NO: 3762533 - RNA, 23 nt, Salmonella typhimurium LT2
ucaaauaagacauggaguuccag

SEQ ID NO: 3762534 - RNA, 21 nt, Salmonella typhimurium LT2
ucaaauagguauguaacgugc

SEQ ID NO: 3762535 - RNA, 23 nt, Salmonella typhimurium LT2
ucaaauccaacucaguuuccagc

SEQ ID NO: 3762536 - RNA, 14 nt, Salmonella typhimurium LT2
ucaaauccaccgcc

SEQ ID NO: 3762537 - RNA, 18 nt, Salmonella typhimurium LT2
ucaaauccaccgccagca

SEQ ID NO: 3762538 - RNA, 20 nt, Salmonella typhimurium LT2
ucaaauccaccgccagcaua

SEQ ID NO: 3762539 - RNA, 12 nt, Salmonella typhimurium LT2
ucaaauccugga

SEQ ID NO: 3762540 - RNA, 23 nt, Salmonella typhimurium LT2
ucaaaucgcaggcauucauccgu

SEQ ID NO: 3762541 - RNA, 15 nt, Salmonella typhimurium LT2
ucaaaugaacacaaa

SEQ ID NO: 3762542 - RNA, 19 nt, Salmonella typhimurium LT2
ucaaaugauuuuuauaaaa

SEQ ID NO: 3762543 - RNA, 20 nt, Salmonella typhimurium LT2
ucaaaugauuuuuauaaaau

SEQ ID NO: 3762544 - RNA, 17 nt, Salmonella typhimurium LT2
ucaaaugcguggcguau

SEQ ID NO: 3762545 - RNA, 18 nt, Salmonella typhimurium LT2
ucaaauguuguuugaaaa

SEQ ID NO: 3762546 - RNA, 20 nt, Salmonella typhimurium LT2
ucaaauguuguuugaaaagu

SEQ ID NO: 3762547 - RNA, 22 nt, Salmonella typhimurium LT2
ucaaauguuguuugaaaaguga

SEQ ID NO: 3762548 - RNA, 13 nt, Salmonella typhimurium LT2
ucaaauuugccca

SEQ ID NO: 3762549 - RNA, 19 nt, Salmonella typhimurium LT2
ucaacaaucguuaauucau

SEQ ID NO: 3762550 - RNA, 20 nt, Salmonella typhimurium LT2
ucaacaccgacauccgccau

SEQ ID NO: 3762551 - RNA, 18 nt, Salmonella typhimurium LT2
ucaacaccuccaguucag

SEQ ID NO: 3762552 - RNA, 16 nt, Salmonella typhimurium LT2
ucaacacgcagaccca

SEQ ID NO: 3762553 - RNA, 13 nt, Salmonella typhimurium LT2
ucaacacgcgcac

SEQ ID NO: 3762554 - RNA, 19 nt, Salmonella typhimurium LT2
ucaacagagccaucaccgu

SEQ ID NO: 3762555 - RNA, 15 nt, Salmonella typhimurium LT2
ucaacagcaggcauc

SEQ ID NO: 3762556 - RNA, 17 nt, Salmonella typhimurium LT2
ucaacagcggcggcagu

SEQ ID NO: 3762557 - RNA, 18 nt, Salmonella typhimurium LT2
ucaacagcggcggcagua

SEQ ID NO: 3762558 - RNA, 13 nt, Salmonella typhimurium LT2
ucaacauauccag

SEQ ID NO: 3762559 - RNA, 14 nt, Salmonella typhimurium LT2
ucaacaucagcgcu

SEQ ID NO: 3762560 - RNA, 21 nt, Salmonella typhimurium LT2
ucaacaucagcgcuaccagcg

SEQ ID NO: 3762561 - RNA, 22 nt, Salmonella typhimurium LT2
ucaacaucagcgcuaccagcgc

SEQ ID NO: 3762562 - RNA, 14 nt, Salmonella typhimurium LT2
ucaacaucaucgga

SEQ ID NO: 3762563 - RNA, 13 nt, Salmonella typhimurium LT2
ucaacaucauuaa

SEQ ID NO: 3762564 - RNA, 20 nt, Salmonella typhimurium LT2
ucaaccaccaccgauaaacg

SEQ ID NO: 3762565 - RNA, 21 nt, Salmonella typhimurium LT2
ucaaccagccgaucaucacga

SEQ ID NO: 3762566 - RNA, 21 nt, Salmonella typhimurium LT2
ucaaccagggucaauacgccg

SEQ ID NO: 3762567 - RNA, 20 nt, Salmonella typhimurium LT2
ucaacccgaucgccauccug

SEQ ID NO: 3762568 - RNA, 20 nt, Salmonella typhimurium LT2
ucaacccuauugccacaaua

SEQ ID NO: 3762569 - RNA, 11 nt, Salmonella typhimurium LT2
ucaacccuccc

SEQ ID NO: 3762570 - RNA, 16 nt, Salmonella typhimurium LT2
ucaaccgagccaaacu

SEQ ID NO: 3762571 - RNA, 16 nt, Salmonella typhimurium LT2
ucaaccgcgcggcguu

SEQ ID NO: 3762572 - RNA, 20 nt, Salmonella typhimurium LT2
ucaaccguuucuuuuucgau

SEQ ID NO: 3762573 - RNA, 18 nt, Salmonella typhimurium LT2
ucaacgaaugccugcaua

SEQ ID NO: 3762574 - RNA, 18 nt, Salmonella typhimurium LT2
ucaacgaggugaauaaau

SEQ ID NO: 3762575 - RNA, 18 nt, Salmonella typhimurium LT2
ucaacgcaucaaauaccu

SEQ ID NO: 3762576 - RNA, 21 nt, Salmonella typhimurium LT2
ucaacgccacaccgagacaga

SEQ ID NO: 3762577 - RNA, 16 nt, Salmonella typhimurium LT2
ucaacgccaggcagaa

SEQ ID NO: 3762578 - RNA, 20 nt, Salmonella typhimurium LT2
ucaacgcccgcuuucaccau

SEQ ID NO: 3762579 - RNA, 16 nt, Salmonella typhimurium LT2
ucaacgcccugcuccc

SEQ ID NO: 3762580 - RNA, 18 nt, Salmonella typhimurium LT2
ucaacgcccugcucccac

SEQ ID NO: 3762581 - RNA, 18 nt, Salmonella typhimurium LT2
ucaacgccgaacaggcca

SEQ ID NO: 3762582 - RNA, 23 nt, Salmonella typhimurium LT2
ucaacgccgaacaggccaugacc

SEQ ID NO: 3762583 - RNA, 16 nt, Salmonella typhimurium LT2
ucaacgccgcgcguaa

SEQ ID NO: 3762584 - RNA, 17 nt, Salmonella typhimurium LT2
ucaacgccuccaggcua

SEQ ID NO: 3762585 - RNA, 18 nt, Salmonella typhimurium LT2
ucaacgcggcuaccgaag

SEQ ID NO: 3762586 - RNA, 13 nt, Salmonella typhimurium LT2
ucaacgcguaccg

SEQ ID NO: 3762587 - RNA, 17 nt, Salmonella typhimurium LT2
ucaacgcguucauccag

SEQ ID NO: 3762588 - RNA, 18 nt, Salmonella typhimurium LT2
ucaacgcguucauccagc

SEQ ID NO: 3762589 - RNA, 14 nt, Salmonella typhimurium LT2
ucaacgcguugccu

SEQ ID NO: 3762590 - RNA, 11 nt, Salmonella typhimurium LT2
ucaacgggcga

SEQ ID NO: 3762591 - RNA, 14 nt, Salmonella typhimurium LT2
ucaacgugaccauu

SEQ ID NO: 3762592 - RNA, 17 nt, Salmonella typhimurium LT2
ucaacucucuauaauca

SEQ ID NO: 3762593 - RNA, 20 nt, Salmonella typhimurium LT2
ucaacugcucuaccaacuga

SEQ ID NO: 3762594 - RNA, 21 nt, Salmonella typhimurium LT2
ucaacugcucuaccaacugag

SEQ ID NO: 3762595 - RNA, 22 nt, Salmonella typhimurium LT2
ucaacuggcggcucagggcaaa

SEQ ID NO: 3762596 - RNA, 23 nt, Salmonella typhimurium LT2
ucaacuguaccugauccagcucu

SEQ ID NO: 3762597 - RNA, 16 nt, Salmonella typhimurium LT2
ucaacugucgaucggu

SEQ ID NO: 3762598 - RNA, 20 nt, Salmonella typhimurium LT2
ucaacuuauccauuagcgcc

SEQ ID NO: 3762599 - RNA, 14 nt, Salmonella typhimurium LT2
ucaacuuccgcguu

SEQ ID NO: 3762600 - RNA, 18 nt, Salmonella typhimurium LT2
ucaacuucucgcaggcca

SEQ ID NO: 3762601 - RNA, 17 nt, Salmonella typhimurium LT2
ucaacuuuuuuaccauu

SEQ ID NO: 3762602 - RNA, 21 nt, Salmonella typhimurium LT2
ucaacuuuuuuaccauugauu

SEQ ID NO: 3762603 - RNA, 15 nt, Salmonella typhimurium LT2
ucaagaaccaauaaa

SEQ ID NO: 3762604 - RNA, 21 nt, Salmonella typhimurium LT2
ucaagaaucaauauaucaggc

SEQ ID NO: 3762605 - RNA, 17 nt, Salmonella typhimurium LT2
ucaagagugaacacgua

SEQ ID NO: 3762606 - RNA, 18 nt, Salmonella typhimurium LT2
ucaagauaaaaagacaga

SEQ ID NO: 3762607 - RNA, 20 nt, Salmonella typhimurium LT2
ucaagauaaaaagacagaua

SEQ ID NO: 3762608 - RNA, 21 nt, Salmonella typhimurium LT2
ucaagaucgcgcagcaggcca

SEQ ID NO: 3762609 - RNA, 19 nt, Salmonella typhimurium LT2
ucaagauuuugugaccgcc

SEQ ID NO: 3762610 - RNA, 21 nt, Salmonella typhimurium LT2
ucaagauuuugugaccgccuu

SEQ ID NO: 3762611 - RNA, 14 nt, Salmonella typhimurium LT2
ucaagcaacuguag

SEQ ID NO: 3762612 - RNA, 18 nt, Salmonella typhimurium LT2
ucaccacuguauuccguu

SEQ ID NO: 3762613 - RNA, 17 nt, Salmonella typhimurium LT2
ucaccacuucaaacggu

SEQ ID NO: 3762614 - RNA, 21 nt, Salmonella typhimurium LT2
ucaccacuuugcgguuacguu

SEQ ID NO: 3762615 - RNA, 16 nt, Salmonella typhimurium LT2
ucaccagagcaucaau

SEQ ID NO: 3762616 - RNA, 21 nt, Salmonella typhimurium LT2
ucaccagcccuuccaccaguu

SEQ ID NO: 3762617 - RNA, 22 nt, Salmonella typhimurium LT2
ucaccaggcguaagaucccagg

SEQ ID NO: 3762618 - RNA, 21 nt, Salmonella typhimurium LT2
ucaccaguugaccaaacagca

SEQ ID NO: 3762619 - RNA, 20 nt, Salmonella typhimurium LT2
ucaccaguugcgaagccacu

SEQ ID NO: 3762620 - RNA, 20 nt, Salmonella typhimurium LT2
ucaccauaauuaccggcaca

SEQ ID NO: 3762621 - RNA, 19 nt, Salmonella typhimurium LT2
ucaccaucguugccagcgg

SEQ ID NO: 3762622 - RNA, 15 nt, Salmonella typhimurium LT2
ucaccauuaacauca

SEQ ID NO: 3762623 - RNA, 14 nt, Salmonella typhimurium LT2
ucaccauucauguu

SEQ ID NO: 3762624 - RNA, 14 nt, Salmonella typhimurium LT2
ucaccauucccagc

SEQ ID NO: 3762625 - RNA, 17 nt, Salmonella typhimurium LT2
ucaccauucccagcgcc

SEQ ID NO: 3762626 - RNA, 17 nt, Salmonella typhimurium LT2
ucacccaaaaugccaua

SEQ ID NO: 3762627 - RNA, 22 nt, Salmonella typhimurium LT2
ucacccaaaaugccauauacau

SEQ ID NO: 3762628 - RNA, 18 nt, Salmonella typhimurium LT2
ucacccaacauuuuuagc

SEQ ID NO: 3762629 - RNA, 14 nt, Salmonella typhimurium LT2
ucacccacaucagc

SEQ ID NO: 3762630 - RNA, 15 nt, Salmonella typhimurium LT2
ucacccacuuguagc

SEQ ID NO: 3762631 - RNA, 16 nt, Salmonella typhimurium LT2
ucacccagacugugau

SEQ ID NO: 3762632 - RNA, 12 nt, Salmonella typhimurium LT2
ucacccagacuu

SEQ ID NO: 3762633 - RNA, 19 nt, Salmonella typhimurium LT2
ucaccccagguugaugcaa

SEQ ID NO: 3762634 - RNA, 22 nt, Salmonella typhimurium LT2
ucaccccagguugaugcaaaug

SEQ ID NO: 3762635 - RNA, 21 nt, Salmonella typhimurium LT2
ucacccccagcugacuggcag

SEQ ID NO: 3762636 - RNA, 17 nt, Salmonella typhimurium LT2
ucacccgcgccagcagg

SEQ ID NO: 3762637 - RNA, 18 nt, Salmonella typhimurium LT2
ucacccgcgccagcaggu

SEQ ID NO: 3762638 - RNA, 22 nt, Salmonella typhimurium LT2
ucacccgcguaucauugcgcuc

SEQ ID NO: 3762639 - RNA, 16 nt, Salmonella typhimurium LT2
ucacccggauacgcgg

SEQ ID NO: 3762640 - RNA, 18 nt, Salmonella typhimurium LT2
ucacccggauacgcggca

SEQ ID NO: 3762641 - RNA, 18 nt, Salmonella typhimurium LT2
ucacccugaaauccggcu

SEQ ID NO: 3762642 - RNA, 19 nt, Salmonella typhimurium LT2
ucaccgcaaauucgucgcc

SEQ ID NO: 3762643 - RNA, 13 nt, Salmonella typhimurium LT2
ucaccgccagagc

SEQ ID NO: 3762644 - RNA, 14 nt, Salmonella typhimurium LT2
ucaccgccaguccc

SEQ ID NO: 3762645 - RNA, 19 nt, Salmonella typhimurium LT2
ucaccggauacccagccac

SEQ ID NO: 3762646 - RNA, 15 nt, Salmonella typhimurium LT2
ucaccggaucgccga

SEQ ID NO: 3762647 - RNA, 22 nt, Salmonella typhimurium LT2
ucaccgggcaggauacggcgcu

SEQ ID NO: 3762648 - RNA, 17 nt, Salmonella typhimurium LT2
ucaccguagcaucauca

SEQ ID NO: 3762649 - RNA, 21 nt, Salmonella typhimurium LT2
ucaccguagcaucaucaaacg

SEQ ID NO: 3762650 - RNA, 18 nt, Salmonella typhimurium LT2
ucaccguuuaaaaacauc

SEQ ID NO: 3762651 - RNA, 12 nt, Salmonella typhimurium LT2
ucaccuccagca

SEQ ID NO: 3762652 - RNA, 21 nt, Salmonella typhimurium LT2
ucaccucuucgcuguuaaccu

SEQ ID NO: 3762653 - RNA, 15 nt, Salmonella typhimurium LT2
ucaccucuuuuucaa

SEQ ID NO: 3762654 - RNA, 15 nt, Salmonella typhimurium LT2
ucaccugcucgcccu

SEQ ID NO: 3762655 - RNA, 16 nt, Salmonella typhimurium LT2
ucaccuggaugcugcc

SEQ ID NO: 3762656 - RNA, 18 nt, Salmonella typhimurium LT2
ucaccuggaugcugccug

SEQ ID NO: 3762657 - RNA, 21 nt, Salmonella typhimurium LT2
ucaccugucgcuaacgcuaca

SEQ ID NO: 3762658 - RNA, 20 nt, Salmonella typhimurium LT2
ucaccuucggucccaucgcg

SEQ ID NO: 3762659 - RNA, 20 nt, Salmonella typhimurium LT2
ucaccuucggugaaaucacg

SEQ ID NO: 3762660 - RNA, 21 nt, Salmonella typhimurium LT2
ucaccuugucgagcgcggcau

SEQ ID NO: 3762661 - RNA, 21 nt, Salmonella typhimurium LT2
ucaccuuuacuuaauucugcu

SEQ ID NO: 3762662 - RNA, 21 nt, Salmonella typhimurium LT2
ucaccuuuuuauuuacugccg

SEQ ID NO: 3762663 - RNA, 23 nt, Salmonella typhimurium LT2
ucaccuuuuuauuuacugccguu

SEQ ID NO: 3762664 - RNA, 15 nt, Salmonella typhimurium LT2
ucacgaaaccggcga

SEQ ID NO: 3762665 - RNA, 17 nt, Salmonella typhimurium LT2
ucacgaaauaacgcacu

SEQ ID NO: 3762666 - RNA, 11 nt, Salmonella typhimurium LT2
ucacgaccagc

SEQ ID NO: 3762667 - RNA, 17 nt, Salmonella typhimurium LT2
ucacgaccagccaacag

SEQ ID NO: 3762668 - RNA, 21 nt, Salmonella typhimurium LT2
ucacgacccggcguuuucaga

SEQ ID NO: 3762669 - RNA, 16 nt, Salmonella typhimurium LT2
ucacgauaccagcgug

SEQ ID NO: 3762670 - RNA, 18 nt, Salmonella typhimurium LT2
ucacgauacuguugcagu

SEQ ID NO: 3762671 - RNA, 18 nt, Salmonella typhimurium LT2
ucacgauaguuugccgga

SEQ ID NO: 3762672 - RNA, 16 nt, Salmonella typhimurium LT2
ucacgcaaaugcagcg

SEQ ID NO: 3762673 - RNA, 17 nt, Salmonella typhimurium LT2
ucacgcaacaacaggcc

SEQ ID NO: 3762674 - RNA, 12 nt, Salmonella typhimurium LT2
ucacgccacagu

SEQ ID NO: 3762675 - RNA, 13 nt, Salmonella typhimurium LT2
ucacgccacaguu

SEQ ID NO: 3762676 - RNA, 18 nt, Salmonella typhimurium LT2
ucacgccauuccagcugg

SEQ ID NO: 3762677 - RNA, 14 nt, Salmonella typhimurium LT2
ucacgccgacgaca

SEQ ID NO: 3762678 - RNA, 15 nt, Salmonella typhimurium LT2
ucacgcgaagcgccg

SEQ ID NO: 3762679 - RNA, 17 nt, Salmonella typhimurium LT2
ucacgcgccgccugcac

SEQ ID NO: 3762680 - RNA, 14 nt, Salmonella typhimurium LT2
ucacgcgcgcgaaa

SEQ ID NO: 3762681 - RNA, 18 nt, Salmonella typhimurium LT2
ucacgcggauugccgccc

SEQ ID NO: 3762682 - RNA, 12 nt, Salmonella typhimurium LT2
ucacgcggcgcg

SEQ ID NO: 3762683 - RNA, 17 nt, Salmonella typhimurium LT2
ucacggagaaaagcgaa

SEQ ID NO: 3762684 - RNA, 22 nt, Salmonella typhimurium LT2
ucacggagaaaagcgaaaauaa

SEQ ID NO: 3762685 - RNA, 15 nt, Salmonella typhimurium LT2
ucacggcaacgccuu

SEQ ID NO: 3762686 - RNA, 18 nt, Salmonella typhimurium LT2
ucacggcacgcccuucgu

SEQ ID NO: 3762687 - RNA, 18 nt, Salmonella typhimurium LT2
ucacggcguuaccuucau

SEQ ID NO: 3762688 - RNA, 22 nt, Salmonella typhimurium LT2
ucacgguacgcaucaccaggca

SEQ ID NO: 3762689 - RNA, 16 nt, Salmonella typhimurium LT2
ucacgguucgcaauca

SEQ ID NO: 3762690 - RNA, 14 nt, Salmonella typhimurium LT2
ucacguaagcauuc

SEQ ID NO: 3762691 - RNA, 16 nt, Salmonella typhimurium LT2
ucacguacaaacgcuu

SEQ ID NO: 3762692 - RNA, 19 nt, Salmonella typhimurium LT2
ucacguaccauauucaacu

SEQ ID NO: 3762693 - RNA, 17 nt, Salmonella typhimurium LT2
ucacgucgcccaccgca

SEQ ID NO: 3762694 - RNA, 23 nt, Salmonella typhimurium LT2
ucacgucggugaaaaugaaaaau

SEQ ID NO: 3762695 - RNA, 14 nt, Salmonella typhimurium LT2
ucacguucagcgcg

SEQ ID NO: 3762696 - RNA, 16 nt, Salmonella typhimurium LT2
ucacguucagcgcggu

SEQ ID NO: 3762697 - RNA, 14 nt, Salmonella typhimurium LT2
ucacguucgguacg

SEQ ID NO: 3762698 - RNA, 22 nt, Salmonella typhimurium LT2
ucacguuuuuuacgucagcaau

SEQ ID NO: 3762699 - RNA, 22 nt, Salmonella typhimurium LT2
ucacuaaaccagcuauccagcu

SEQ ID NO: 3762700 - RNA, 23 nt, Salmonella typhimurium LT2
ucacuaaacuaaugccuggcagu

SEQ ID NO: 3762701 - RNA, 18 nt, Salmonella typhimurium LT2
ucacuaauccccauuuuu

SEQ ID NO: 3762702 - RNA, 12 nt, Salmonella typhimurium LT2
ucacuaauuuga

SEQ ID NO: 3762703 - RNA, 15 nt, Salmonella typhimurium LT2
ucacuaccgccgcga

SEQ ID NO: 3762704 - RNA, 20 nt, Salmonella typhimurium LT2
ucacuacuaaauccuugagu

SEQ ID NO: 3762705 - RNA, 15 nt, Salmonella typhimurium LT2
ucacuaucacacuga

SEQ ID NO: 3762706 - RNA, 19 nt, Salmonella typhimurium LT2
ucacuauucuuaucauuua

SEQ ID NO: 3762707 - RNA, 22 nt, Salmonella typhimurium LT2
ucacuccaggcguuuaugagau

SEQ ID NO: 3762708 - RNA, 18 nt, Salmonella typhimurium LT2
ucacuccuuagauuaauc

SEQ ID NO: 3762709 - RNA, 20 nt, Salmonella typhimurium LT2
ucacuccuuagauuaaucac

SEQ ID NO: 3762710 - RNA, 13 nt, Salmonella typhimurium LT2
ucacucugaaaaa

SEQ ID NO: 3762711 - RNA, 14 nt, Salmonella typhimurium LT2
ucacucugaaaaau

SEQ ID NO: 3762712 - RNA, 17 nt, Salmonella typhimurium LT2
ucacuggagggcauuaa

SEQ ID NO: 3762713 - RNA, 17 nt, Salmonella typhimurium LT2
ucacuggcggcaagcug

SEQ ID NO: 3762714 - RNA, 19 nt, Salmonella typhimurium LT2
ucacuggcggcaagcugcu

SEQ ID NO: 3762715 - RNA, 14 nt, Salmonella typhimurium LT2
ucacuguaaaaggg

SEQ ID NO: 3762716 - RNA, 18 nt, Salmonella typhimurium LT2
ucagcgcccccaguuccu

SEQ ID NO: 3762717 - RNA, 13 nt, Salmonella typhimurium LT2
ucagcgcgccaau

SEQ ID NO: 3762718 - RNA, 17 nt, Salmonella typhimurium LT2
ucagcgcgccaauggcc

SEQ ID NO: 3762719 - RNA, 18 nt, Salmonella typhimurium LT2
ucagcgcgccgcgcagca

SEQ ID NO: 3762720 - RNA, 19 nt, Salmonella typhimurium LT2
ucagcgcgccgcgcagcau

SEQ ID NO: 3762721 - RNA, 12 nt, Salmonella typhimurium LT2
ucagcgcgcgcu

SEQ ID NO: 3762722 - RNA, 17 nt, Salmonella typhimurium LT2
ucagcgcgcuccagacc

SEQ ID NO: 3762723 - RNA, 19 nt, Salmonella typhimurium LT2
ucagcgcggcaaggauaac

SEQ ID NO: 3762724 - RNA, 17 nt, Salmonella typhimurium LT2
ucagcgcggcagccgga

SEQ ID NO: 3762725 - RNA, 20 nt, Salmonella typhimurium LT2
ucagcgcguuuuccaucauc

SEQ ID NO: 3762726 - RNA, 14 nt, Salmonella typhimurium LT2
ucagcgcugucgcc

SEQ ID NO: 3762727 - RNA, 16 nt, Salmonella typhimurium LT2
ucagcggcagcucgug

SEQ ID NO: 3762728 - RNA, 14 nt, Salmonella typhimurium LT2
ucagcggccagggc

SEQ ID NO: 3762729 - RNA, 15 nt, Salmonella typhimurium LT2
ucagcggccagggca

SEQ ID NO: 3762730 - RNA, 18 nt, Salmonella typhimurium LT2
ucagcggcgcaggggcau

SEQ ID NO: 3762731 - RNA, 15 nt, Salmonella typhimurium LT2
ucagcggcgccgcaa

SEQ ID NO: 3762732 - RNA, 23 nt, Salmonella typhimurium LT2
ucagcggcgcgccgcucgacaug

SEQ ID NO: 3762733 - RNA, 19 nt, Salmonella typhimurium LT2
ucagcguaauuaagccggg

SEQ ID NO: 3762734 - RNA, 18 nt, Salmonella typhimurium LT2
ucagcgucagcaccagua

SEQ ID NO: 3762735 - RNA, 20 nt, Salmonella typhimurium LT2
ucagcgucagcaccaguaca

SEQ ID NO: 3762736 - RNA, 18 nt, Salmonella typhimurium LT2
ucagcgucaucacagguu

SEQ ID NO: 3762737 - RNA, 16 nt, Salmonella typhimurium LT2
ucagcgucauucaccg

SEQ ID NO: 3762738 - RNA, 20 nt, Salmonella typhimurium LT2
ucagcgugacguucaucauu

SEQ ID NO: 3762739 - RNA, 13 nt, Salmonella typhimurium LT2
ucagcgugccggu

SEQ ID NO: 3762740 - RNA, 17 nt, Salmonella typhimurium LT2
ucagcguggcgacgaua

SEQ ID NO: 3762741 - RNA, 17 nt, Salmonella typhimurium LT2
ucagcguguaaucgccg

SEQ ID NO: 3762742 - RNA, 24 nt, Salmonella typhimurium LT2
ucagcguguuucaucucaucaaug

SEQ ID NO: 3762743 - RNA, 18 nt, Salmonella typhimurium LT2
ucagcguugucccgccuu

SEQ ID NO: 3762744 - RNA, 15 nt, Salmonella typhimurium LT2
ucagcguuucaccuu

SEQ ID NO: 3762745 - RNA, 20 nt, Salmonella typhimurium LT2
ucagcguuucgccguaaaac

SEQ ID NO: 3762746 - RNA, 15 nt, Salmonella typhimurium LT2
ucagcucagcaacaa

SEQ ID NO: 3762747 - RNA, 20 nt, Salmonella typhimurium LT2
ucagcugaacagucccacca

SEQ ID NO: 3762748 - RNA, 18 nt, Salmonella typhimurium LT2
ucagcugacaaugugccg

SEQ ID NO: 3762749 - RNA, 23 nt, Salmonella typhimurium LT2
ucagcugauugggauaaacacag

SEQ ID NO: 3762750 - RNA, 22 nt, Salmonella typhimurium LT2
ucagcugcugcgcuuuccaggc

SEQ ID NO: 3762751 - RNA, 14 nt, Salmonella typhimurium LT2
ucagcuuaauuguu

SEQ ID NO: 3762752 - RNA, 21 nt, Salmonella typhimurium LT2
ucaggaaacgcgccggaaggc

SEQ ID NO: 3762753 - RNA, 13 nt, Salmonella typhimurium LT2
ucaggaaacuggc

SEQ ID NO: 3762754 - RNA, 16 nt, Salmonella typhimurium LT2
ucaggaaaucuuccag

SEQ ID NO: 3762755 - RNA, 23 nt, Salmonella typhimurium LT2
ucaggaacgcggcgccgaagcag

SEQ ID NO: 3762756 - RNA, 23 nt, Salmonella typhimurium LT2
ucaggaauaacaucguaaaucaa

SEQ ID NO: 3762757 - RNA, 22 nt, Salmonella typhimurium LT2
ucaggaauuuaucaacaaauuc

SEQ ID NO: 3762758 - RNA, 13 nt, Salmonella typhimurium LT2
ucaggacaucaaa

SEQ ID NO: 3762759 - RNA, 23 nt, Salmonella typhimurium LT2
ucaggagauugccccccagccau

SEQ ID NO: 3762760 - RNA, 13 nt, Salmonella typhimurium LT2
ucaggaggccuga

SEQ ID NO: 3762761 - RNA, 15 nt, Salmonella typhimurium LT2
ucaggaggccugaau

SEQ ID NO: 3762762 - RNA, 16 nt, Salmonella typhimurium LT2
ucaggaggccugaaua

SEQ ID NO: 3762763 - RNA, 19 nt, Salmonella typhimurium LT2
ucaggaguaaauaacaaaa

SEQ ID NO: 3762764 - RNA, 21 nt, Salmonella typhimurium LT2
ucaggaguaaauaacaaaagc

SEQ ID NO: 3762765 - RNA, 13 nt, Salmonella typhimurium LT2
ucaggaucaauuc

SEQ ID NO: 3762766 - RNA, 16 nt, Salmonella typhimurium LT2
ucaggaucaauucgga

SEQ ID NO: 3762767 - RNA, 13 nt, Salmonella typhimurium LT2
ucaggaucgccgg

SEQ ID NO: 3762768 - RNA, 13 nt, Salmonella typhimurium LT2
ucaggauucgacg

SEQ ID NO: 3762769 - RNA, 22 nt, Salmonella typhimurium LT2
ucaggcaauaaaaaaggcagag

SEQ ID NO: 3762770 - RNA, 23 nt, Salmonella typhimurium LT2
ucaggcaauaaacaucagccauu

SEQ ID NO: 3762771 - RNA, 20 nt, Salmonella typhimurium LT2
ucaggcaauacgcugccgga

SEQ ID NO: 3762772 - RNA, 23 nt, Salmonella typhimurium LT2
ucaggcaaucuuuaacgcuggca

SEQ ID NO: 3762773 - RNA, 13 nt, Salmonella typhimurium LT2
ucaggcaaugucu

SEQ ID NO: 3762774 - RNA, 15 nt, Salmonella typhimurium LT2
ucaggcacuggcuua

SEQ ID NO: 3762775 - RNA, 20 nt, Salmonella typhimurium LT2
ucaggcacuggcuuacucgc

SEQ ID NO: 3762776 - RNA, 19 nt, Salmonella typhimurium LT2
ucaggcacuguauaugcua

SEQ ID NO: 3762777 - RNA, 15 nt, Salmonella typhimurium LT2
ucaggcagaaauaac

SEQ ID NO: 3762778 - RNA, 22 nt, Salmonella typhimurium LT2
ucaggcagcaggauauccugcg

SEQ ID NO: 3762779 - RNA, 17 nt, Salmonella typhimurium LT2
ucaggcaggucugauaa

SEQ ID NO: 3762780 - RNA, 23 nt, Salmonella typhimurium LT2
ucaggcaucgcugauaaaaacuc

SEQ ID NO: 3762781 - RNA, 19 nt, Salmonella typhimurium LT2
ucaggcaugaccugccgga

SEQ ID NO: 3762782 - RNA, 15 nt, Salmonella typhimurium LT2
ucaggccagacugag

SEQ ID NO: 3762783 - RNA, 18 nt, Salmonella typhimurium LT2
ucaggccgccgcacaggc

SEQ ID NO: 3762784 - RNA, 20 nt, Salmonella typhimurium LT2
ucaggccuacgacagcgcug

SEQ ID NO: 3762785 - RNA, 23 nt, Salmonella typhimurium LT2
ucaggccuacgguuuuacaguua

SEQ ID NO: 3762786 - RNA, 17 nt, Salmonella typhimurium LT2
ucaggcgaccaauaucc

SEQ ID NO: 3762787 - RNA, 23 nt, Salmonella typhimurium LT2
ucaggcgaccauccaccagaacc

SEQ ID NO: 3762788 - RNA, 17 nt, Salmonella typhimurium LT2
ucaggcgcacgaccuga

SEQ ID NO: 3762789 - RNA, 16 nt, Salmonella typhimurium LT2
ucaggcgcauaucgcc

SEQ ID NO: 3762790 - RNA, 14 nt, Salmonella typhimurium LT2
ucaggcgcaucuga

SEQ ID NO: 3762791 - RNA, 14 nt, Salmonella typhimurium LT2
ucaggcuaaauggc

SEQ ID NO: 3762792 - RNA, 15 nt, Salmonella typhimurium LT2
ucaggcuaaggcguc

SEQ ID NO: 3762793 - RNA, 15 nt, Salmonella typhimurium LT2
ucaggcugcggauga

SEQ ID NO: 3762794 - RNA, 22 nt, Salmonella typhimurium LT2
ucaggcuggcaaagcaggugag

SEQ ID NO: 3762795 - RNA, 21 nt, Salmonella typhimurium LT2
ucaggcugguauaaaaacugc

SEQ ID NO: 3762796 - RNA, 22 nt, Salmonella typhimurium LT2
ucagggcgaaaaugaucacuuc

SEQ ID NO: 3762797 - RNA, 15 nt, Salmonella typhimurium LT2
ucagggcuaacgccg

SEQ ID NO: 3762798 - RNA, 19 nt, Salmonella typhimurium LT2
ucagggcuaacgccgguag

SEQ ID NO: 3762799 - RNA, 21 nt, Salmonella typhimurium LT2
ucagggcuuacucccugguga

SEQ ID NO: 3762800 - RNA, 17 nt, Salmonella typhimurium LT2
ucaggggcgaacccauc

SEQ ID NO: 3762801 - RNA, 17 nt, Salmonella typhimurium LT2
ucaggggcggguuuuuu

SEQ ID NO: 3762802 - RNA, 20 nt, Salmonella typhimurium LT2
ucagggucuuauuucuccug

SEQ ID NO: 3762803 - RNA, 14 nt, Salmonella typhimurium LT2
ucagggugacagaa

SEQ ID NO: 3762804 - RNA, 21 nt, Salmonella typhimurium LT2
ucaggguuauuuccgcuggcc

SEQ ID NO: 3762805 - RNA, 16 nt, Salmonella typhimurium LT2
ucaggguuuucaggaa

SEQ ID NO: 3762806 - RNA, 17 nt, Salmonella typhimurium LT2
ucaggguuuucaggaag

SEQ ID NO: 3762807 - RNA, 21 nt, Salmonella typhimurium LT2
ucaggguuuucuaccgcagcc

SEQ ID NO: 3762808 - RNA, 17 nt, Salmonella typhimurium LT2
ucagguaaguguaaguu

SEQ ID NO: 3762809 - RNA, 19 nt, Salmonella typhimurium LT2
ucagguaucccgccagcgg

SEQ ID NO: 3762810 - RNA, 21 nt, Salmonella typhimurium LT2
ucagguuacgcacuacaucau

SEQ ID NO: 3762811 - RNA, 16 nt, Salmonella typhimurium LT2
ucagguuguccagcag

SEQ ID NO: 3762812 - RNA, 22 nt, Salmonella typhimurium LT2
ucagguuucguccgccgcuacg

SEQ ID NO: 3762813 - RNA, 20 nt, Salmonella typhimurium LT2
ucagguuuuuaagcugccca

SEQ ID NO: 3762814 - RNA, 15 nt, Salmonella typhimurium LT2
ucagguuuuuuucau

SEQ ID NO: 3762815 - RNA, 14 nt, Salmonella typhimurium LT2
ucaguaaccagggc

SEQ ID NO: 3762816 - RNA, 18 nt, Salmonella typhimurium LT2
ucaguacagccaaaaaua

SEQ ID NO: 3762817 - RNA, 16 nt, Salmonella typhimurium LT2
ucaguaccgccuucag

SEQ ID NO: 3762818 - RNA, 19 nt, Salmonella typhimurium LT2
ucaguaccucgcauacuuc

SEQ ID NO: 3762819 - RNA, 19 nt, Salmonella typhimurium LT2
ucaucgacuucaaugggaa

SEQ ID NO: 3762820 - RNA, 17 nt, Salmonella typhimurium LT2
ucaucgcaaauucugua

SEQ ID NO: 3762821 - RNA, 20 nt, Salmonella typhimurium LT2
ucaucgcaggcggucagcac

SEQ ID NO: 3762822 - RNA, 15 nt, Salmonella typhimurium LT2
ucaucgccuucaucc

SEQ ID NO: 3762823 - RNA, 14 nt, Salmonella typhimurium LT2
ucaucgcgccuccc

SEQ ID NO: 3762824 - RNA, 23 nt, Salmonella typhimurium LT2
ucaucgcuuaacggcccaggcau

SEQ ID NO: 3762825 - RNA, 13 nt, Salmonella typhimurium LT2
ucaucggcggcaa

SEQ ID NO: 3762826 - RNA, 15 nt, Salmonella typhimurium LT2
ucaucggcucgacuu

SEQ ID NO: 3762827 - RNA, 16 nt, Salmonella typhimurium LT2
ucaucgguguucacaa

SEQ ID NO: 3762828 - RNA, 14 nt, Salmonella typhimurium LT2
ucaucguaccaaua

SEQ ID NO: 3762829 - RNA, 13 nt, Salmonella typhimurium LT2
ucaucgucgcgcc

SEQ ID NO: 3762830 - RNA, 21 nt, Salmonella typhimurium LT2
ucaucgucugcgucuucuucc

SEQ ID NO: 3762831 - RNA, 22 nt, Salmonella typhimurium LT2
ucaucguuugggccgguacuuu

SEQ ID NO: 3762832 - RNA, 14 nt, Salmonella typhimurium LT2
ucaucuaucugcuu

SEQ ID NO: 3762833 - RNA, 15 nt, Salmonella typhimurium LT2
ucaucuaucugcuuc

SEQ ID NO: 3762834 - RNA, 17 nt, Salmonella typhimurium LT2
ucaucuaucugcuucug

SEQ ID NO: 3762835 - RNA, 15 nt, Salmonella typhimurium LT2
ucaucucccaggccg

SEQ ID NO: 3762836 - RNA, 16 nt, Salmonella typhimurium LT2
ucaucugaugauuaau

SEQ ID NO: 3762837 - RNA, 17 nt, Salmonella typhimurium LT2
ucaucuucaccuuucca

SEQ ID NO: 3762838 - RNA, 18 nt, Salmonella typhimurium LT2
ucaucuucaccuuuccag

SEQ ID NO: 3762839 - RNA, 15 nt, Salmonella typhimurium LT2
ucaucuucacuucac

SEQ ID NO: 3762840 - RNA, 17 nt, Salmonella typhimurium LT2
ucaucuucacuucacaa

SEQ ID NO: 3762841 - RNA, 23 nt, Salmonella typhimurium LT2
ucaucuucuuccggcugccagcc

SEQ ID NO: 3762842 - RNA, 17 nt, Salmonella typhimurium LT2
ucaucuuguccucauca

SEQ ID NO: 3762843 - RNA, 16 nt, Salmonella typhimurium LT2
ucaucuuuauccauaa

SEQ ID NO: 3762844 - RNA, 17 nt, Salmonella typhimurium LT2
ucaucuuuuacaggccg

SEQ ID NO: 3762845 - RNA, 12 nt, Salmonella typhimurium LT2
ucaugaaacucg

SEQ ID NO: 3762846 - RNA, 14 nt, Salmonella typhimurium LT2
ucaugaagcucaac

SEQ ID NO: 3762847 - RNA, 22 nt, Salmonella typhimurium LT2
ucaugaaucgcgcgcgccaguc

SEQ ID NO: 3762848 - RNA, 21 nt, Salmonella typhimurium LT2
ucaugacuuuuuucaaccuca

SEQ ID NO: 3762849 - RNA, 15 nt, Salmonella typhimurium LT2
ucaugagcuauuuca

SEQ ID NO: 3762850 - RNA, 16 nt, Salmonella typhimurium LT2
ucaugauaucgccugc

SEQ ID NO: 3762851 - RNA, 23 nt, Salmonella typhimurium LT2
ucaugcagcccgcacucgcgcuu

SEQ ID NO: 3762852 - RNA, 16 nt, Salmonella typhimurium LT2
ucaugcaggccggaac

SEQ ID NO: 3762853 - RNA, 18 nt, Salmonella typhimurium LT2
ucaugccacgccaucaga

SEQ ID NO: 3762854 - RNA, 15 nt, Salmonella typhimurium LT2
ucaugcccggcaaac

SEQ ID NO: 3762855 - RNA, 19 nt, Salmonella typhimurium LT2
ucaugccgaccagggcguc

SEQ ID NO: 3762856 - RNA, 17 nt, Salmonella typhimurium LT2
ucaugcgccuucugcug

SEQ ID NO: 3762857 - RNA, 23 nt, Salmonella typhimurium LT2
ucaugcgcgucccggcagugcau

SEQ ID NO: 3762858 - RNA, 16 nt, Salmonella typhimurium LT2
ucaugcggucuucacu

SEQ ID NO: 3762859 - RNA, 16 nt, Salmonella typhimurium LT2
ucaugcggugcaugaa

SEQ ID NO: 3762860 - RNA, 20 nt, Salmonella typhimurium LT2
ucaugcguagcaugaucggc

SEQ ID NO: 3762861 - RNA, 14 nt, Salmonella typhimurium LT2
ucaugcuaaaacag

SEQ ID NO: 3762862 - RNA, 13 nt, Salmonella typhimurium LT2
ucaugcuaaaagc

SEQ ID NO: 3762863 - RNA, 15 nt, Salmonella typhimurium LT2
ucaugcugcaccgca

SEQ ID NO: 3762864 - RNA, 23 nt, Salmonella typhimurium LT2
ucaugcugcaccgcaucaaacuc

SEQ ID NO: 3762865 - RNA, 20 nt, Salmonella typhimurium LT2
ucaugcugcguacaaucgcg

SEQ ID NO: 3762866 - RNA, 16 nt, Salmonella typhimurium LT2
ucaugcuggucagcaa

SEQ ID NO: 3762867 - RNA, 14 nt, Salmonella typhimurium LT2
ucaugcuuaucgcc

SEQ ID NO: 3762868 - RNA, 21 nt, Salmonella typhimurium LT2
ucaugcuuaucgccaaaccag

SEQ ID NO: 3762869 - RNA, 19 nt, Salmonella typhimurium LT2
ucauggaacuuauccacaa

SEQ ID NO: 3762870 - RNA, 15 nt, Salmonella typhimurium LT2
ucauggcuaaucgcg

SEQ ID NO: 3762871 - RNA, 13 nt, Salmonella typhimurium LT2
ucauggggaacag

SEQ ID NO: 3762872 - RNA, 22 nt, Salmonella typhimurium LT2
ucauguacccguuucuguaaau

SEQ ID NO: 3762873 - RNA, 15 nt, Salmonella typhimurium LT2
ucauguacgaaagcg

SEQ ID NO: 3762874 - RNA, 14 nt, Salmonella typhimurium LT2
ucauguacgccgcu

SEQ ID NO: 3762875 - RNA, 13 nt, Salmonella typhimurium LT2
ucauguauuguua

SEQ ID NO: 3762876 - RNA, 12 nt, Salmonella typhimurium LT2
ucaugucgucau

SEQ ID NO: 3762877 - RNA, 19 nt, Salmonella typhimurium LT2
ucaugugcagcauccagcu

SEQ ID NO: 3762878 - RNA, 13 nt, Salmonella typhimurium LT2
ucaugugccgcga

SEQ ID NO: 3762879 - RNA, 23 nt, Salmonella typhimurium LT2
ucauguugccggauagcucgcug

SEQ ID NO: 3762880 - RNA, 21 nt, Salmonella typhimurium LT2
ucauguugcggguuucugaau

SEQ ID NO: 3762881 - RNA, 12 nt, Salmonella typhimurium LT2
ucauuacaggcg

SEQ ID NO: 3762882 - RNA, 16 nt, Salmonella typhimurium LT2
ucauuaccaacguaaa

SEQ ID NO: 3762883 - RNA, 22 nt, Salmonella typhimurium LT2
ucauuaccuacgcgauaaaaaa

SEQ ID NO: 3762884 - RNA, 13 nt, Salmonella typhimurium LT2
ucauuaccuuuuc

SEQ ID NO: 3762885 - RNA, 22 nt, Salmonella typhimurium LT2
ucauuacgccugucgcgccaug

SEQ ID NO: 3762886 - RNA, 13 nt, Salmonella typhimurium LT2
ucauuacgcgcau

SEQ ID NO: 3762887 - RNA, 21 nt, Salmonella typhimurium LT2
ucauuacgcgcaugcaaacgu

SEQ ID NO: 3762888 - RNA, 16 nt, Salmonella typhimurium LT2
ucauuacgcuuccugc

SEQ ID NO: 3762889 - RNA, 20 nt, Salmonella typhimurium LT2
ucauuacgcuuccugccgug

SEQ ID NO: 3762890 - RNA, 13 nt, Salmonella typhimurium LT2
ucauuagcgcggu

SEQ ID NO: 3762891 - RNA, 12 nt, Salmonella typhimurium LT2
ucauuauaaaac

SEQ ID NO: 3762892 - RNA, 14 nt, Salmonella typhimurium LT2
ucauuaucaauggc

SEQ ID NO: 3762893 - RNA, 14 nt, Salmonella typhimurium LT2
ucauuauucaggcc

SEQ ID NO: 3762894 - RNA, 20 nt, Salmonella typhimurium LT2
ucauucauccagaccugagc

SEQ ID NO: 3762895 - RNA, 15 nt, Salmonella typhimurium LT2
ucauucccgccaaua

SEQ ID NO: 3762896 - RNA, 13 nt, Salmonella typhimurium LT2
ucauucgaccaca

SEQ ID NO: 3762897 - RNA, 18 nt, Salmonella typhimurium LT2
ucauucgcgaauagugca

SEQ ID NO: 3762898 - RNA, 21 nt, Salmonella typhimurium LT2
ucauucuccgggauagcaauc

SEQ ID NO: 3762899 - RNA, 20 nt, Salmonella typhimurium LT2
ucauucugcuuaccagaccg

SEQ ID NO: 3762900 - RNA, 19 nt, Salmonella typhimurium LT2
ucauugacgguggccgcca

SEQ ID NO: 3762901 - RNA, 21 nt, Salmonella typhimurium LT2
ucauugccguuaacugcugcu

SEQ ID NO: 3762902 - RNA, 16 nt, Salmonella typhimurium LT2
ucauugccuuucaaua

SEQ ID NO: 3762903 - RNA, 16 nt, Salmonella typhimurium LT2
ucauugcguucaggcg

SEQ ID NO: 3762904 - RNA, 18 nt, Salmonella typhimurium LT2
ucauugggagcaaagcuc

SEQ ID NO: 3762905 - RNA, 18 nt, Salmonella typhimurium LT2
ucauugguuaauucaaaa

SEQ ID NO: 3762906 - RNA, 14 nt, Salmonella typhimurium LT2
ucauuguaaaaccg

SEQ ID NO: 3762907 - RNA, 17 nt, Salmonella typhimurium LT2
ucauugucguaccggca

SEQ ID NO: 3762908 - RNA, 15 nt, Salmonella typhimurium LT2
ucauuuguacaaaaa

SEQ ID NO: 3762909 - RNA, 21 nt, Salmonella typhimurium LT2
ucauuuguacaaaaaauguga

SEQ ID NO: 3762910 - RNA, 13 nt, Salmonella typhimurium LT2
ucauuuguuccuc

SEQ ID NO: 3762911 - RNA, 24 nt, Salmonella typhimurium LT2
ucauuuuacugcguaaucuuuuca

SEQ ID NO: 3762912 - RNA, 21 nt, Salmonella typhimurium LT2
ucauuuucaugauauucuguc

SEQ ID NO: 3762913 - RNA, 13 nt, Salmonella typhimurium LT2
ucauuuuccacaa

SEQ ID NO: 3762914 - RNA, 13 nt, Salmonella typhimurium LT2
ucauuuucccacu

SEQ ID NO: 3762915 - RNA, 20 nt, Salmonella typhimurium LT2
ucauuuuguugcuccagcau

SEQ ID NO: 3762916 - RNA, 15 nt, Salmonella typhimurium LT2
ucauuuuuguuaauu

SEQ ID NO: 3762917 - RNA, 17 nt, Salmonella typhimurium LT2
ucauuuuuuaauaucaa

SEQ ID NO: 3762918 - RNA, 22 nt, Salmonella typhimurium LT2
ucauuuuuuaauaucaauucca

SEQ ID NO: 3762919 - RNA, 23 nt, Salmonella typhimurium LT2
uccaaagauaaacgacagcgcca

SEQ ID NO: 3762920 - RNA, 22 nt, Salmonella typhimurium LT2
uccaaauggcguacuaaauagg

SEQ ID NO: 3762921 - RNA, 13 nt, Salmonella typhimurium LT2
uccaacaauuaua

SEQ ID NO: 3762922 - RNA, 18 nt, Salmonella typhimurium LT2
uccaacauagcuaaauua

SEQ ID NO: 3762923 - RNA, 23 nt, Salmonella typhimurium LT2
uccagccgcccgcgauaaaaauc

SEQ ID NO: 3762924 - RNA, 17 nt, Salmonella typhimurium LT2
uccagccgguguuaacc

SEQ ID NO: 3762925 - RNA, 16 nt, Salmonella typhimurium LT2
uccagccuugcugaga

SEQ ID NO: 3762926 - RNA, 15 nt, Salmonella typhimurium LT2
uccagcgaauaauga

SEQ ID NO: 3762927 - RNA, 22 nt, Salmonella typhimurium LT2
uccagcgaauccgugcgcagaa

SEQ ID NO: 3762928 - RNA, 16 nt, Salmonella typhimurium LT2
uccagcgagccuucca

SEQ ID NO: 3762929 - RNA, 17 nt, Salmonella typhimurium LT2
uccagcgagccuuccau

SEQ ID NO: 3762930 - RNA, 14 nt, Salmonella typhimurium LT2
uccagcgcaaaggg

SEQ ID NO: 3762931 - RNA, 16 nt, Salmonella typhimurium LT2
uccagcgccagcucca

SEQ ID NO: 3762932 - RNA, 24 nt, Salmonella typhimurium LT2
uccagcgccaggauaucuuccacu

SEQ ID NO: 3762933 - RNA, 19 nt, Salmonella typhimurium LT2
uccagcgccauaagacuac

SEQ ID NO: 3762934 - RNA, 16 nt, Salmonella typhimurium LT2
uccagcgcguccuuau

SEQ ID NO: 3762935 - RNA, 16 nt, Salmonella typhimurium LT2
uccagcggaacucauc

SEQ ID NO: 3762936 - RNA, 21 nt, Salmonella typhimurium LT2
uccagcggaacucaucaucaa

SEQ ID NO: 3762937 - RNA, 13 nt, Salmonella typhimurium LT2
uccagcggcagga

SEQ ID NO: 3762938 - RNA, 13 nt, Salmonella typhimurium LT2
uccagcggcaggc

SEQ ID NO: 3762939 - RNA, 17 nt, Salmonella typhimurium LT2
uccagcgguagcggcac

SEQ ID NO: 3762940 - RNA, 20 nt, Salmonella typhimurium LT2
uccagcgguugcgcuucggc

SEQ ID NO: 3762941 - RNA, 18 nt, Salmonella typhimurium LT2
uccagcguuacgcgcugc

SEQ ID NO: 3762942 - RNA, 14 nt, Salmonella typhimurium LT2
uccagcguuucucu

SEQ ID NO: 3762943 - RNA, 20 nt, Salmonella typhimurium LT2
uccagcuaaguuuguaaaau

SEQ ID NO: 3762944 - RNA, 17 nt, Salmonella typhimurium LT2
uccagcuauagacgaca

SEQ ID NO: 3762945 - RNA, 15 nt, Salmonella typhimurium LT2
uccagcucagggucc

SEQ ID NO: 3762946 - RNA, 16 nt, Salmonella typhimurium LT2
uccagcucauuuuuac

SEQ ID NO: 3762947 - RNA, 13 nt, Salmonella typhimurium LT2
uccagcuccagcc

SEQ ID NO: 3762948 - RNA, 14 nt, Salmonella typhimurium LT2
uccagcuccaucca

SEQ ID NO: 3762949 - RNA, 14 nt, Salmonella typhimurium LT2
uccagcucuucuuc

SEQ ID NO: 3762950 - RNA, 12 nt, Salmonella typhimurium LT2
uccagcuggcug

SEQ ID NO: 3762951 - RNA, 17 nt, Salmonella typhimurium LT2
uccagcuguaccaucac

SEQ ID NO: 3762952 - RNA, 19 nt, Salmonella typhimurium LT2
uccagcuguuuaagcgccu

SEQ ID NO: 3762953 - RNA, 20 nt, Salmonella typhimurium LT2
uccagcuguuuaagcgccuc

SEQ ID NO: 3762954 - RNA, 15 nt, Salmonella typhimurium LT2
uccagcuucaucauc

SEQ ID NO: 3762955 - RNA, 17 nt, Salmonella typhimurium LT2
uccagcuucaucaucag

SEQ ID NO: 3762956 - RNA, 23 nt, Salmonella typhimurium LT2
uccagcuugccgucgcaggcggc

SEQ ID NO: 3762957 - RNA, 22 nt, Salmonella typhimurium LT2
uccagcuuugacgucacuguca

SEQ ID NO: 3762958 - RNA, 18 nt, Salmonella typhimurium LT2
uccaggaaacgcugcgcc

SEQ ID NO: 3762959 - RNA, 22 nt, Salmonella typhimurium LT2
uccaggaaguaaauuauuccuu

SEQ ID NO: 3762960 - RNA, 17 nt, Salmonella typhimurium LT2
uccaggacguccugcaa

SEQ ID NO: 3762961 - RNA, 19 nt, Salmonella typhimurium LT2
uccaggaggcaaaaugcca

SEQ ID NO: 3762962 - RNA, 22 nt, Salmonella typhimurium LT2
uccaggaggcaaaaugccagcc

SEQ ID NO: 3762963 - RNA, 22 nt, Salmonella typhimurium LT2
uccaggaugaccaguuaagcaa

SEQ ID NO: 3762964 - RNA, 23 nt, Salmonella typhimurium LT2
uccaggccaagcgccuguucaac

SEQ ID NO: 3762965 - RNA, 19 nt, Salmonella typhimurium LT2
uccaggccagauauugccg

SEQ ID NO: 3762966 - RNA, 16 nt, Salmonella typhimurium LT2
uccaggccgccagcgu

SEQ ID NO: 3762967 - RNA, 21 nt, Salmonella typhimurium LT2
uccaggccgucggcgccagcc

SEQ ID NO: 3762968 - RNA, 15 nt, Salmonella typhimurium LT2
uccaggcgaaauaga

SEQ ID NO: 3762969 - RNA, 16 nt, Salmonella typhimurium LT2
uccaggcgaaauagac

SEQ ID NO: 3762970 - RNA, 18 nt, Salmonella typhimurium LT2
uccaggcgcugcuggcag

SEQ ID NO: 3762971 - RNA, 18 nt, Salmonella typhimurium LT2
uccaggcgggcaucgccu

SEQ ID NO: 3762972 - RNA, 19 nt, Salmonella typhimurium LT2
uccagggaaaccauguuga

SEQ ID NO: 3762973 - RNA, 21 nt, Salmonella typhimurium LT2
uccagggcugcuggccuucca

SEQ ID NO: 3762974 - RNA, 16 nt, Salmonella typhimurium LT2
uccagguaacauacaa

SEQ ID NO: 3762975 - RNA, 23 nt, Salmonella typhimurium LT2
uccagguaguguuuaagcgucag

SEQ ID NO: 3762976 - RNA, 13 nt, Salmonella typhimurium LT2
uccagguauugau

SEQ ID NO: 3762977 - RNA, 23 nt, Salmonella typhimurium LT2
uccagguugugguuaaacacauc

SEQ ID NO: 3762978 - RNA, 18 nt, Salmonella typhimurium LT2
uccagguuuuaguuucac

SEQ ID NO: 3762979 - RNA, 20 nt, Salmonella typhimurium LT2
uccaguaaaaucgggccucc

SEQ ID NO: 3762980 - RNA, 14 nt, Salmonella typhimurium LT2
uccaguaacgcguc

SEQ ID NO: 3762981 - RNA, 18 nt, Salmonella typhimurium LT2
uccaguaauucccggcag

SEQ ID NO: 3762982 - RNA, 14 nt, Salmonella typhimurium LT2
uccaguaauuucag

SEQ ID NO: 3762983 - RNA, 21 nt, Salmonella typhimurium LT2
uccaguaccugacuuuuccau

SEQ ID NO: 3762984 - RNA, 16 nt, Salmonella typhimurium LT2
uccaguacuuucuuuu

SEQ ID NO: 3762985 - RNA, 17 nt, Salmonella typhimurium LT2
uccaguaguuccuggag

SEQ ID NO: 3762986 - RNA, 16 nt, Salmonella typhimurium LT2
uccagucagcaauuaa

SEQ ID NO: 3762987 - RNA, 22 nt, Salmonella typhimurium LT2
uccagucaggcucaauaugggc

SEQ ID NO: 3762988 - RNA, 17 nt, Salmonella typhimurium LT2
uccaguccucgcccacu

SEQ ID NO: 3762989 - RNA, 13 nt, Salmonella typhimurium LT2
uccaguccugccc

SEQ ID NO: 3762990 - RNA, 13 nt, Salmonella typhimurium LT2
uccagucgccagg

SEQ ID NO: 3762991 - RNA, 14 nt, Salmonella typhimurium LT2
uccagucgcuccac

SEQ ID NO: 3762992 - RNA, 16 nt, Salmonella typhimurium LT2
uccagucgcuccacca

SEQ ID NO: 3762993 - RNA, 16 nt, Salmonella typhimurium LT2
uccaguguuguucucu

SEQ ID NO: 3762994 - RNA, 13 nt, Salmonella typhimurium LT2
uccaguucgagcc

SEQ ID NO: 3762995 - RNA, 16 nt, Salmonella typhimurium LT2
uccaguucgagccgga

SEQ ID NO: 3762996 - RNA, 20 nt, Salmonella typhimurium LT2
uccaguucgcgauaggccuc

SEQ ID NO: 3762997 - RNA, 17 nt, Salmonella typhimurium LT2
uccaguucguucugcgu

SEQ ID NO: 3762998 - RNA, 22 nt, Salmonella typhimurium LT2
uccaguugaaaaccacaaucac

SEQ ID NO: 3762999 - RNA, 14 nt, Salmonella typhimurium LT2
uccaguugcauaca

SEQ ID NO: 3763000 - RNA, 16 nt, Salmonella typhimurium LT2
uccaguugcauacaua

SEQ ID NO: 3763001 - RNA, 19 nt, Salmonella typhimurium LT2
uccaguugcggcaucagau

SEQ ID NO: 3763002 - RNA, 16 nt, Salmonella typhimurium LT2
uccaguugcuuaccuu

SEQ ID NO: 3763003 - RNA, 17 nt, Salmonella typhimurium LT2
uccaguuguuccagcag

SEQ ID NO: 3763004 - RNA, 20 nt, Salmonella typhimurium LT2
uccauacacugcauaaauau

SEQ ID NO: 3763005 - RNA, 21 nt, Salmonella typhimurium LT2
uccauaccggacuccaggcaa

SEQ ID NO: 3763006 - RNA, 23 nt, Salmonella typhimurium LT2
uccauaccguuucaacugccccu

SEQ ID NO: 3763007 - RNA, 17 nt, Salmonella typhimurium LT2
uccauagaaaucagcag

SEQ ID NO: 3763008 - RNA, 13 nt, Salmonella typhimurium LT2
uccauauccagca

SEQ ID NO: 3763009 - RNA, 18 nt, Salmonella typhimurium LT2
uccaucaauaauccggca

SEQ ID NO: 3763010 - RNA, 19 nt, Salmonella typhimurium LT2
uccaucaauaauccggcaa

SEQ ID NO: 3763011 - RNA, 13 nt, Salmonella typhimurium LT2
uccaucagccagg

SEQ ID NO: 3763012 - RNA, 13 nt, Salmonella typhimurium LT2
uccaucagcgcgg

SEQ ID NO: 3763013 - RNA, 23 nt, Salmonella typhimurium LT2
uccaucaguucggcgcgccagcc

SEQ ID NO: 3763014 - RNA, 13 nt, Salmonella typhimurium LT2
uccaucauuuccg

SEQ ID NO: 3763015 - RNA, 16 nt, Salmonella typhimurium LT2
uccauccggguaauuu

SEQ ID NO: 3763016 - RNA, 17 nt, Salmonella typhimurium LT2
uccaucgguucucugcc

SEQ ID NO: 3763017 - RNA, 19 nt, Salmonella typhimurium LT2
uccaucgguucucugccau

SEQ ID NO: 3763018 - RNA, 15 nt, Salmonella typhimurium LT2
uccaucuccggcgac

SEQ ID NO: 3763019 - RNA, 16 nt, Salmonella typhimurium LT2
uccaugaccguugcca

SEQ ID NO: 3763020 - RNA, 15 nt, Salmonella typhimurium LT2
uccaugagaagaaaa

SEQ ID NO: 3763021 - RNA, 16 nt, Salmonella typhimurium LT2
uccaugagaagaaaaa

SEQ ID NO: 3763022 - RNA, 18 nt, Salmonella typhimurium LT2
uccaugcaugacgcaggc

SEQ ID NO: 3763023 - RNA, 13 nt, Salmonella typhimurium LT2
uccaugccggcuu

SEQ ID NO: 3763024 - RNA, 21 nt, Salmonella typhimurium LT2
uccaugccuuuggccuggaga

SEQ ID NO: 3763025 - RNA, 14 nt, Salmonella typhimurium LT2
uccauggcaaaauu

SEQ ID NO: 3763026 - RNA, 19 nt, Salmonella typhimurium LT2
uccauguaaacuccauuaa

SEQ ID NO: 3763027 - RNA, 22 nt, Salmonella typhimurium LT2
ucccgcagcauuuccgccgccu

SEQ ID NO: 3763028 - RNA, 19 nt, Salmonella typhimurium LT2
ucccgcauauuuuucuaau

SEQ ID NO: 3763029 - RNA, 17 nt, Salmonella typhimurium LT2
ucccgcaucacccgcau

SEQ ID NO: 3763030 - RNA, 16 nt, Salmonella typhimurium LT2
ucccgccacuguccug

SEQ ID NO: 3763031 - RNA, 17 nt, Salmonella typhimurium LT2
ucccgccacuguccuga

SEQ ID NO: 3763032 - RNA, 19 nt, Salmonella typhimurium LT2
ucccgccgagaaaauaccg

SEQ ID NO: 3763033 - RNA, 11 nt, Salmonella typhimurium LT2
ucccgccgcca

SEQ ID NO: 3763034 - RNA, 17 nt, Salmonella typhimurium LT2
ucccgccucggucagua

SEQ ID NO: 3763035 - RNA, 17 nt, Salmonella typhimurium LT2
ucccgccuugcggcgcc

SEQ ID NO: 3763036 - RNA, 13 nt, Salmonella typhimurium LT2
ucccgcgcggucg

SEQ ID NO: 3763037 - RNA, 21 nt, Salmonella typhimurium LT2
ucccgcguucgcgcaguucau

SEQ ID NO: 3763038 - RNA, 21 nt, Salmonella typhimurium LT2
ucccggaacagcggagcgaag

SEQ ID NO: 3763039 - RNA, 22 nt, Salmonella typhimurium LT2
ucccggaacagcggagcgaaga

SEQ ID NO: 3763040 - RNA, 21 nt, Salmonella typhimurium LT2
ucccggcaauuaccgccagcg

SEQ ID NO: 3763041 - RNA, 14 nt, Salmonella typhimurium LT2
ucccggcaccgauc

SEQ ID NO: 3763042 - RNA, 22 nt, Salmonella typhimurium LT2
ucccggcaccgaucaucccacc

SEQ ID NO: 3763043 - RNA, 18 nt, Salmonella typhimurium LT2
ucccggcguaauccagcu

SEQ ID NO: 3763044 - RNA, 23 nt, Salmonella typhimurium LT2
ucccgggcgauaaaccagcccca

SEQ ID NO: 3763045 - RNA, 14 nt, Salmonella typhimurium LT2
ucccguaaaagaag

SEQ ID NO: 3763046 - RNA, 18 nt, Salmonella typhimurium LT2
ucccguagccugauaaau

SEQ ID NO: 3763047 - RNA, 15 nt, Salmonella typhimurium LT2
ucccguagcgucaac

SEQ ID NO: 3763048 - RNA, 20 nt, Salmonella typhimurium LT2
ucccguagcgucaacacgag

SEQ ID NO: 3763049 - RNA, 16 nt, Salmonella typhimurium LT2
ucccguaucuucaugu

SEQ ID NO: 3763050 - RNA, 14 nt, Salmonella typhimurium LT2
ucccgucccaccac

SEQ ID NO: 3763051 - RNA, 17 nt, Salmonella typhimurium LT2
ucccguuuuucauccag

SEQ ID NO: 3763052 - RNA, 19 nt, Salmonella typhimurium LT2
ucccuacucucgcaugggg

SEQ ID NO: 3763053 - RNA, 23 nt, Salmonella typhimurium LT2
ucccuacugcuuagcucaucagc

SEQ ID NO: 3763054 - RNA, 23 nt, Salmonella typhimurium LT2
ucccuauguaaagaaugaaaaaa

SEQ ID NO: 3763055 - RNA, 14 nt, Salmonella typhimurium LT2
ucccucaucaauac

SEQ ID NO: 3763056 - RNA, 14 nt, Salmonella typhimurium LT2
ucccucuccagggc

SEQ ID NO: 3763057 - RNA, 16 nt, Salmonella typhimurium LT2
ucccucuccagggcaa

SEQ ID NO: 3763058 - RNA, 23 nt, Salmonella typhimurium LT2
ucccugacaauacugaacgccgc

SEQ ID NO: 3763059 - RNA, 13 nt, Salmonella typhimurium LT2
ucccugacgcgca

SEQ ID NO: 3763060 - RNA, 15 nt, Salmonella typhimurium LT2
ucccugcaacgccug

SEQ ID NO: 3763061 - RNA, 17 nt, Salmonella typhimurium LT2
ucccugcggcugguugc

SEQ ID NO: 3763062 - RNA, 10 nt, Salmonella typhimurium LT2
ucccuggccg

SEQ ID NO: 3763063 - RNA, 19 nt, Salmonella typhimurium LT2
ucccuuccagcgacgccca

SEQ ID NO: 3763064 - RNA, 12 nt, Salmonella typhimurium LT2
ucccuucccagc

SEQ ID NO: 3763065 - RNA, 13 nt, Salmonella typhimurium LT2
ucccuucccagcc

SEQ ID NO: 3763066 - RNA, 21 nt, Salmonella typhimurium LT2
ucccuuccgccaccagguuca

SEQ ID NO: 3763067 - RNA, 19 nt, Salmonella typhimurium LT2
ucccuucgaucaugccuuu

SEQ ID NO: 3763068 - RNA, 16 nt, Salmonella typhimurium LT2
ucccuucucgcuaaua

SEQ ID NO: 3763069 - RNA, 12 nt, Salmonella typhimurium LT2
ucccuucuuuua

SEQ ID NO: 3763070 - RNA, 14 nt, Salmonella typhimurium LT2
ucccuucuuuuacu

SEQ ID NO: 3763071 - RNA, 15 nt, Salmonella typhimurium LT2
ucccuucuuuuacug

SEQ ID NO: 3763072 - RNA, 13 nt, Salmonella typhimurium LT2
ucccuugccagcg

SEQ ID NO: 3763073 - RNA, 14 nt, Salmonella typhimurium LT2
ucccuugccagcgc

SEQ ID NO: 3763074 - RNA, 15 nt, Salmonella typhimurium LT2
ucccuugccagcgca

SEQ ID NO: 3763075 - RNA, 16 nt, Salmonella typhimurium LT2
ucccuuuacaggugca

SEQ ID NO: 3763076 - RNA, 16 nt, Salmonella typhimurium LT2
ucccuuucaaaaaaga

SEQ ID NO: 3763077 - RNA, 15 nt, Salmonella typhimurium LT2
uccgacaauaaaaau

SEQ ID NO: 3763078 - RNA, 22 nt, Salmonella typhimurium LT2
uccgacagugaacggcauaauc

SEQ ID NO: 3763079 - RNA, 20 nt, Salmonella typhimurium LT2
uccgacgcaacucacgccau

SEQ ID NO: 3763080 - RNA, 20 nt, Salmonella typhimurium LT2
uccgacgcguuucacaucgc

SEQ ID NO: 3763081 - RNA, 12 nt, Salmonella typhimurium LT2
uccgacuucaug

SEQ ID NO: 3763082 - RNA, 18 nt, Salmonella typhimurium LT2
uccgagacucaaagaaaa

SEQ ID NO: 3763083 - RNA, 18 nt, Salmonella typhimurium LT2
uccgauuucguucuuucu

SEQ ID NO: 3763084 - RNA, 21 nt, Salmonella typhimurium LT2
uccgcaaagcccaucagcgcc

SEQ ID NO: 3763085 - RNA, 12 nt, Salmonella typhimurium LT2
uccgcaaagugg

SEQ ID NO: 3763086 - RNA, 15 nt, Salmonella typhimurium LT2
uccgcaauccuggcu

SEQ ID NO: 3763087 - RNA, 19 nt, Salmonella typhimurium LT2
uccgcaaucgcugccuuga

SEQ ID NO: 3763088 - RNA, 17 nt, Salmonella typhimurium LT2
uccgcaccuucaucauu

SEQ ID NO: 3763089 - RNA, 21 nt, Salmonella typhimurium LT2
uccgcacgccugcauaaagga

SEQ ID NO: 3763090 - RNA, 16 nt, Salmonella typhimurium LT2
uccgcacgcgcgcccu

SEQ ID NO: 3763091 - RNA, 12 nt, Salmonella typhimurium LT2
uccgcagagcug

SEQ ID NO: 3763092 - RNA, 13 nt, Salmonella typhimurium LT2
uccgcagccgcau

SEQ ID NO: 3763093 - RNA, 23 nt, Salmonella typhimurium LT2
uccgcagugcggagguuucgccu

SEQ ID NO: 3763094 - RNA, 19 nt, Salmonella typhimurium LT2
uccgcauaauuacgcccau

SEQ ID NO: 3763095 - RNA, 22 nt, Salmonella typhimurium LT2
uccgcaugagcugguggucuac

SEQ ID NO: 3763096 - RNA, 20 nt, Salmonella typhimurium LT2
uccgccaauuccugccagag

SEQ ID NO: 3763097 - RNA, 15 nt, Salmonella typhimurium LT2
uccgccacgcucgcu

SEQ ID NO: 3763098 - RNA, 16 nt, Salmonella typhimurium LT2
uccgccacgcucgcug

SEQ ID NO: 3763099 - RNA, 13 nt, Salmonella typhimurium LT2
uccgccagagcuu

SEQ ID NO: 3763100 - RNA, 16 nt, Salmonella typhimurium LT2
uccgccagcaacacuu

SEQ ID NO: 3763101 - RNA, 18 nt, Salmonella typhimurium LT2
uccgccagcaaugccgcc

SEQ ID NO: 3763102 - RNA, 13 nt, Salmonella typhimurium LT2
uccgccagcgccu

SEQ ID NO: 3763103 - RNA, 17 nt, Salmonella typhimurium LT2
uccgccauagccuaccc

SEQ ID NO: 3763104 - RNA, 15 nt, Salmonella typhimurium LT2
uccgccauccggcac

SEQ ID NO: 3763105 - RNA, 16 nt, Salmonella typhimurium LT2
uccgccaugaaaaaaa

SEQ ID NO: 3763106 - RNA, 15 nt, Salmonella typhimurium LT2
uccgccaugguuggg

SEQ ID NO: 3763107 - RNA, 13 nt, Salmonella typhimurium LT2
uccgccaugugcu

SEQ ID NO: 3763108 - RNA, 17 nt, Salmonella typhimurium LT2
uccgcccaggaacauga

SEQ ID NO: 3763109 - RNA, 17 nt, Salmonella typhimurium LT2
uccgcccggugcucaau

SEQ ID NO: 3763110 - RNA, 16 nt, Salmonella typhimurium LT2
uccgccgcaauagcca

SEQ ID NO: 3763111 - RNA, 14 nt, Salmonella typhimurium LT2
uccgccgccgccau

SEQ ID NO: 3763112 - RNA, 14 nt, Salmonella typhimurium LT2
uccgccgcgggcag

SEQ ID NO: 3763113 - RNA, 17 nt, Salmonella typhimurium LT2
uccgccgcgggcagcag

SEQ ID NO: 3763114 - RNA, 15 nt, Salmonella typhimurium LT2
uccgccgcuaucgcc

SEQ ID NO: 3763115 - RNA, 17 nt, Salmonella typhimurium LT2
uccgccgcuaucgccga

SEQ ID NO: 3763116 - RNA, 17 nt, Salmonella typhimurium LT2
uccgccugaucuuucug

SEQ ID NO: 3763117 - RNA, 20 nt, Salmonella typhimurium LT2
uccgccuggaacccaggcac

SEQ ID NO: 3763118 - RNA, 22 nt, Salmonella typhimurium LT2
uccgccuggaacccaggcaccu

SEQ ID NO: 3763119 - RNA, 19 nt, Salmonella typhimurium LT2
uccgccuuaucaggccugu

SEQ ID NO: 3763120 - RNA, 20 nt, Salmonella typhimurium LT2
uccgccuuaucaggccugug

SEQ ID NO: 3763121 - RNA, 23 nt, Salmonella typhimurium LT2
uccgcgagagaaaaaaauccagu

SEQ ID NO: 3763122 - RNA, 14 nt, Salmonella typhimurium LT2
uccgcgagcagcca

SEQ ID NO: 3763123 - RNA, 18 nt, Salmonella typhimurium LT2
uccgcgauagagcgcggu

SEQ ID NO: 3763124 - RNA, 23 nt, Salmonella typhimurium LT2
uccgcgauaucaaucaccucuuc

SEQ ID NO: 3763125 - RNA, 13 nt, Salmonella typhimurium LT2
uccgcgaugugua

SEQ ID NO: 3763126 - RNA, 15 nt, Salmonella typhimurium LT2
uccgcgcugaugguu

SEQ ID NO: 3763127 - RNA, 23 nt, Salmonella typhimurium LT2
uccgcgcugaugguuucggcaug

SEQ ID NO: 3763128 - RNA, 21 nt, Salmonella typhimurium LT2
uccgcguaaugguguccacaa

SEQ ID NO: 3763129 - RNA, 11 nt, Salmonella typhimurium LT2
uccgcguuagg

SEQ ID NO: 3763130 - RNA, 23 nt, Salmonella typhimurium LT2
uccgcuaccgcuuugacaacaaa

SEQ ID NO: 3763131 - RNA, 15 nt, Salmonella typhimurium LT2
uccucuuucccuuuu

SEQ ID NO: 3763132 - RNA, 18 nt, Salmonella typhimurium LT2
uccucuuucccuuuuuaa

SEQ ID NO: 3763133 - RNA, 15 nt, Salmonella typhimurium LT2
uccucuuuuaucacc

SEQ ID NO: 3763134 - RNA, 18 nt, Salmonella typhimurium LT2
uccucuuuucgaacgccg

SEQ ID NO: 3763135 - RNA, 21 nt, Salmonella typhimurium LT2
uccucuuuucgaacgccgaca

SEQ ID NO: 3763136 - RNA, 14 nt, Salmonella typhimurium LT2
uccugaaccagcgg

SEQ ID NO: 3763137 - RNA, 19 nt, Salmonella typhimurium LT2
uccugaaggacaagcugcg

SEQ ID NO: 3763138 - RNA, 20 nt, Salmonella typhimurium LT2
uccugaauagcaggcaaaaa

SEQ ID NO: 3763139 - RNA, 17 nt, Salmonella typhimurium LT2
uccugaaucgccgucag

SEQ ID NO: 3763140 - RNA, 12 nt, Salmonella typhimurium LT2
uccugacgcuga

SEQ ID NO: 3763141 - RNA, 19 nt, Salmonella typhimurium LT2
uccugagcagacauauuuu

SEQ ID NO: 3763142 - RNA, 13 nt, Salmonella typhimurium LT2
uccugagucacag

SEQ ID NO: 3763143 - RNA, 16 nt, Salmonella typhimurium LT2
uccugauaauccagaa

SEQ ID NO: 3763144 - RNA, 22 nt, Salmonella typhimurium LT2
uccugauagccguaaauaauca

SEQ ID NO: 3763145 - RNA, 22 nt, Salmonella typhimurium LT2
uccugauauucccguuccagcu

SEQ ID NO: 3763146 - RNA, 16 nt, Salmonella typhimurium LT2
uccugauccggcuguu

SEQ ID NO: 3763147 - RNA, 17 nt, Salmonella typhimurium LT2
uccugcaacagcaccag

SEQ ID NO: 3763148 - RNA, 19 nt, Salmonella typhimurium LT2
uccugcaacagcaccagca

SEQ ID NO: 3763149 - RNA, 14 nt, Salmonella typhimurium LT2
uccugcaaucgcuc

SEQ ID NO: 3763150 - RNA, 22 nt, Salmonella typhimurium LT2
uccugcacaauuuuagccgcau

SEQ ID NO: 3763151 - RNA, 17 nt, Salmonella typhimurium LT2
uccugcaccgccugcgg

SEQ ID NO: 3763152 - RNA, 17 nt, Salmonella typhimurium LT2
uccugcagacuccacgu

SEQ ID NO: 3763153 - RNA, 17 nt, Salmonella typhimurium LT2
uccugccagagacucuc

SEQ ID NO: 3763154 - RNA, 13 nt, Salmonella typhimurium LT2
uccugccccugcc

SEQ ID NO: 3763155 - RNA, 22 nt, Salmonella typhimurium LT2
uccugccgacaggcagguugcc

SEQ ID NO: 3763156 - RNA, 17 nt, Salmonella typhimurium LT2
uccugcgcagauaccgg

SEQ ID NO: 3763157 - RNA, 11 nt, Salmonella typhimurium LT2
uccugcgccag

SEQ ID NO: 3763158 - RNA, 23 nt, Salmonella typhimurium LT2
uccugcgccagcaccauggcuau

SEQ ID NO: 3763159 - RNA, 19 nt, Salmonella typhimurium LT2
uccugcgguaaacgcucgc

SEQ ID NO: 3763160 - RNA, 21 nt, Salmonella typhimurium LT2
uccugcuccugcggcguggaa

SEQ ID NO: 3763161 - RNA, 12 nt, Salmonella typhimurium LT2
uccugcucgccu

SEQ ID NO: 3763162 - RNA, 17 nt, Salmonella typhimurium LT2
uccugcuggcaaaacgc

SEQ ID NO: 3763163 - RNA, 21 nt, Salmonella typhimurium LT2
uccugcuggcaaaacgcaucc

SEQ ID NO: 3763164 - RNA, 12 nt, Salmonella typhimurium LT2
uccugcuguggu

SEQ ID NO: 3763165 - RNA, 16 nt, Salmonella typhimurium LT2
uccugcuucuggagag

SEQ ID NO: 3763166 - RNA, 14 nt, Salmonella typhimurium LT2
uccuggaagacuuc

SEQ ID NO: 3763167 - RNA, 17 nt, Salmonella typhimurium LT2
uccuggaagacuucacg

SEQ ID NO: 3763168 - RNA, 20 nt, Salmonella typhimurium LT2
uccuggauacguuccagcag

SEQ ID NO: 3763169 - RNA, 22 nt, Salmonella typhimurium LT2
uccuggaugaguaugugaaaaa

SEQ ID NO: 3763170 - RNA, 13 nt, Salmonella typhimurium LT2
uccuggauuuuac

SEQ ID NO: 3763171 - RNA, 20 nt, Salmonella typhimurium LT2
uccuggcgcuuuaagugcau

SEQ ID NO: 3763172 - RNA, 20 nt, Salmonella typhimurium LT2
uccuggcguaugcuuucagc

SEQ ID NO: 3763173 - RNA, 22 nt, Salmonella typhimurium LT2
uccugggcaaaauagcccggcu

SEQ ID NO: 3763174 - RNA, 22 nt, Salmonella typhimurium LT2
uccugggccgccacgaccugca

SEQ ID NO: 3763175 - RNA, 17 nt, Salmonella typhimurium LT2
uccugggcugccagggc

SEQ ID NO: 3763176 - RNA, 16 nt, Salmonella typhimurium LT2
uccuggggaacagaag

SEQ ID NO: 3763177 - RNA, 18 nt, Salmonella typhimurium LT2
uccugguccggcagguag

SEQ ID NO: 3763178 - RNA, 23 nt, Salmonella typhimurium LT2
uccuggugcgacaccacgcaggc

SEQ ID NO: 3763179 - RNA, 14 nt, Salmonella typhimurium LT2
uccuguaacagggg

SEQ ID NO: 3763180 - RNA, 22 nt, Salmonella typhimurium LT2
uccuguagcgucuuuugaguga

SEQ ID NO: 3763181 - RNA, 19 nt, Salmonella typhimurium LT2
uccuguaugacguuugcuu

SEQ ID NO: 3763182 - RNA, 18 nt, Salmonella typhimurium LT2
uccuguccugggccgcca

SEQ ID NO: 3763183 - RNA, 18 nt, Salmonella typhimurium LT2
uccugucgucaccagcag

SEQ ID NO: 3763184 - RNA, 14 nt, Salmonella typhimurium LT2
uccugugucggcag

SEQ ID NO: 3763185 - RNA, 17 nt, Salmonella typhimurium LT2
uccugugucuuuuacac

SEQ ID NO: 3763186 - RNA, 19 nt, Salmonella typhimurium LT2
uccuguuuacaggcgauuu

SEQ ID NO: 3763187 - RNA, 19 nt, Salmonella typhimurium LT2
uccuguuuuuucagcgcgc

SEQ ID NO: 3763188 - RNA, 13 nt, Salmonella typhimurium LT2
uccuuaacacaaa

SEQ ID NO: 3763189 - RNA, 17 nt, Salmonella typhimurium LT2
uccuuaacgucaucauc

SEQ ID NO: 3763190 - RNA, 23 nt, Salmonella typhimurium LT2
uccuuacuguagcgccgcuucca

SEQ ID NO: 3763191 - RNA, 16 nt, Salmonella typhimurium LT2
uccuuagauuaaucac

SEQ ID NO: 3763192 - RNA, 16 nt, Salmonella typhimurium LT2
uccuuaugaccgaguc

SEQ ID NO: 3763193 - RNA, 22 nt, Salmonella typhimurium LT2
uccuuaugggucacauccagac

SEQ ID NO: 3763194 - RNA, 23 nt, Salmonella typhimurium LT2
uccuuauuuacgguuggccagca

SEQ ID NO: 3763195 - RNA, 13 nt, Salmonella typhimurium LT2
uccuucagcuuca

SEQ ID NO: 3763196 - RNA, 21 nt, Salmonella typhimurium LT2
uccuucagcuucacgaagucu

SEQ ID NO: 3763197 - RNA, 13 nt, Salmonella typhimurium LT2
uccuucauauuuc

SEQ ID NO: 3763198 - RNA, 20 nt, Salmonella typhimurium LT2
uccuucauauuucaagccgc

SEQ ID NO: 3763199 - RNA, 13 nt, Salmonella typhimurium LT2
uccuucauucaga

SEQ ID NO: 3763200 - RNA, 20 nt, Salmonella typhimurium LT2
uccuuccacugguaggcauc

SEQ ID NO: 3763201 - RNA, 14 nt, Salmonella typhimurium LT2
uccuuccgccgcaa

SEQ ID NO: 3763202 - RNA, 15 nt, Salmonella typhimurium LT2
uccuucgcuuccugg

SEQ ID NO: 3763203 - RNA, 12 nt, Salmonella typhimurium LT2
uccuucgggcga

SEQ ID NO: 3763204 - RNA, 18 nt, Salmonella typhimurium LT2
uccuucuccuucgccaaa

SEQ ID NO: 3763205 - RNA, 10 nt, Salmonella typhimurium LT2
uccuucuucc

SEQ ID NO: 3763206 - RNA, 13 nt, Salmonella typhimurium LT2
uccuucuuccauu

SEQ ID NO: 3763207 - RNA, 19 nt, Salmonella typhimurium LT2
uccuucuuccauucccacc

SEQ ID NO: 3763208 - RNA, 16 nt, Salmonella typhimurium LT2
uccuucuucgccguca

SEQ ID NO: 3763209 - RNA, 19 nt, Salmonella typhimurium LT2
uccuugcacgccaaaaagu

SEQ ID NO: 3763210 - RNA, 14 nt, Salmonella typhimurium LT2
uccuugcagccaga

SEQ ID NO: 3763211 - RNA, 23 nt, Salmonella typhimurium LT2
uccuugcagccagaacucaucuu

SEQ ID NO: 3763212 - RNA, 23 nt, Salmonella typhimurium LT2
uccuugcccuguuucgcaggccg

SEQ ID NO: 3763213 - RNA, 18 nt, Salmonella typhimurium LT2
uccuuuaaucgccgugcc

SEQ ID NO: 3763214 - RNA, 20 nt, Salmonella typhimurium LT2
uccuuuaaugaagcaacugu

SEQ ID NO: 3763215 - RNA, 19 nt, Salmonella typhimurium LT2
uccuuuaucugcccuuucu

SEQ ID NO: 3763216 - RNA, 14 nt, Salmonella typhimurium LT2
uccuuugccuuucu

SEQ ID NO: 3763217 - RNA, 13 nt, Salmonella typhimurium LT2
uccuuuuaauuuu

SEQ ID NO: 3763218 - RNA, 13 nt, Salmonella typhimurium LT2
uccuuuuucaggc

SEQ ID NO: 3763219 - RNA, 15 nt, Salmonella typhimurium LT2
uccuuuuucaggcac

SEQ ID NO: 3763220 - RNA, 14 nt, Salmonella typhimurium LT2
ucgaaaccagcaua

SEQ ID NO: 3763221 - RNA, 22 nt, Salmonella typhimurium LT2
ucgaaacccaacaucgcgcugc

SEQ ID NO: 3763222 - RNA, 19 nt, Salmonella typhimurium LT2
ucgaaaucucgcuaaucau

SEQ ID NO: 3763223 - RNA, 14 nt, Salmonella typhimurium LT2
ucgaacaucugcgu

SEQ ID NO: 3763224 - RNA, 12 nt, Salmonella typhimurium LT2
ucgaaccugcga

SEQ ID NO: 3763225 - RNA, 20 nt, Salmonella typhimurium LT2
ucgaacgccgccugcgccag

SEQ ID NO: 3763226 - RNA, 23 nt, Salmonella typhimurium LT2
ucgaacgccgccugcgccagcgc

SEQ ID NO: 3763227 - RNA, 19 nt, Salmonella typhimurium LT2
ucgaacgcuuccgggcuca

SEQ ID NO: 3763228 - RNA, 16 nt, Salmonella typhimurium LT2
ucgaacgguaacagga

SEQ ID NO: 3763229 - RNA, 18 nt, Salmonella typhimurium LT2
ucgaacuuacggcgcgcc

SEQ ID NO: 3763230 - RNA, 17 nt, Salmonella typhimurium LT2
ucgaacuugaccagcac

SEQ ID NO: 3763231 - RNA, 15 nt, Salmonella typhimurium LT2
ucgaagaccuggccg

SEQ ID NO: 3763232 - RNA, 16 nt, Salmonella typhimurium LT2
ucgaaguaauaaaaaa

SEQ ID NO: 3763233 - RNA, 15 nt, Salmonella typhimurium LT2
ucgaauacagcgccu

SEQ ID NO: 3763234 - RNA, 16 nt, Salmonella typhimurium LT2
ucgaaucgccucaacc

SEQ ID NO: 3763235 - RNA, 15 nt, Salmonella typhimurium LT2
ucgccaaagauauag

SEQ ID NO: 3763236 - RNA, 18 nt, Salmonella typhimurium LT2
ucgccaaagcagcugcug

SEQ ID NO: 3763237 - RNA, 15 nt, Salmonella typhimurium LT2
ucgccaaagcgcugc

SEQ ID NO: 3763238 - RNA, 16 nt, Salmonella typhimurium LT2
ucgccaaagcguaaac

SEQ ID NO: 3763239 - RNA, 20 nt, Salmonella typhimurium LT2
ucgccaaagucauugcugcc

SEQ ID NO: 3763240 - RNA, 17 nt, Salmonella typhimurium LT2
ucgccaaaucaugccca

SEQ ID NO: 3763241 - RNA, 21 nt, Salmonella typhimurium LT2
ucgccaagcgguaaggcaccg

SEQ ID NO: 3763242 - RNA, 16 nt, Salmonella typhimurium LT2
ucgccaauuaaauauc

SEQ ID NO: 3763243 - RNA, 18 nt, Salmonella typhimurium LT2
ucgccaccagcaaaaguu

SEQ ID NO: 3763244 - RNA, 12 nt, Salmonella typhimurium LT2
ucgccaccagcg

SEQ ID NO: 3763245 - RNA, 17 nt, Salmonella typhimurium LT2
ucgccaccaugcugguu

SEQ ID NO: 3763246 - RNA, 13 nt, Salmonella typhimurium LT2
ucgccaccgcauu

SEQ ID NO: 3763247 - RNA, 21 nt, Salmonella typhimurium LT2
ucgccaccgcauuuucagcuu

SEQ ID NO: 3763248 - RNA, 18 nt, Salmonella typhimurium LT2
ucgccaccgcgcgcuuaa

SEQ ID NO: 3763249 - RNA, 22 nt, Salmonella typhimurium LT2
ucgccaccguaacuaaaauacu

SEQ ID NO: 3763250 - RNA, 17 nt, Salmonella typhimurium LT2
ucgccagacccagcgcu

SEQ ID NO: 3763251 - RNA, 14 nt, Salmonella typhimurium LT2
ucgccagaccgaaa

SEQ ID NO: 3763252 - RNA, 22 nt, Salmonella typhimurium LT2
ucgccagaugucggcggcaggu

SEQ ID NO: 3763253 - RNA, 18 nt, Salmonella typhimurium LT2
ucgccagcaacgcccaga

SEQ ID NO: 3763254 - RNA, 15 nt, Salmonella typhimurium LT2
ucgccagccauucgc

SEQ ID NO: 3763255 - RNA, 14 nt, Salmonella typhimurium LT2
ucgccagccccagc

SEQ ID NO: 3763256 - RNA, 14 nt, Salmonella typhimurium LT2
ucgccagccgcagc

SEQ ID NO: 3763257 - RNA, 19 nt, Salmonella typhimurium LT2
ucgccagccugaacaucuu

SEQ ID NO: 3763258 - RNA, 21 nt, Salmonella typhimurium LT2
ucgccagcuuaucgaccagcg

SEQ ID NO: 3763259 - RNA, 20 nt, Salmonella typhimurium LT2
ucgccaggaucgccgcugcg

SEQ ID NO: 3763260 - RNA, 21 nt, Salmonella typhimurium LT2
ucgccaggccaucgccgccau

SEQ ID NO: 3763261 - RNA, 21 nt, Salmonella typhimurium LT2
ucgccaguuuacgcguacucg

SEQ ID NO: 3763262 - RNA, 21 nt, Salmonella typhimurium LT2
ucgccauaaaucagauccacg

SEQ ID NO: 3763263 - RNA, 18 nt, Salmonella typhimurium LT2
ucgccauauccaagcccc

SEQ ID NO: 3763264 - RNA, 12 nt, Salmonella typhimurium LT2
ucgccauaucuu

SEQ ID NO: 3763265 - RNA, 13 nt, Salmonella typhimurium LT2
ucgccauccagau

SEQ ID NO: 3763266 - RNA, 15 nt, Salmonella typhimurium LT2
ucgccauccugacca

SEQ ID NO: 3763267 - RNA, 22 nt, Salmonella typhimurium LT2
ucgccaugaguucaauaugugc

SEQ ID NO: 3763268 - RNA, 20 nt, Salmonella typhimurium LT2
ucgccaugccgcgccuuacg

SEQ ID NO: 3763269 - RNA, 19 nt, Salmonella typhimurium LT2
ucgccaugucuucgcgcgu

SEQ ID NO: 3763270 - RNA, 15 nt, Salmonella typhimurium LT2
ucgccauucccgcga

SEQ ID NO: 3763271 - RNA, 16 nt, Salmonella typhimurium LT2
ucgccauucccgcgac

SEQ ID NO: 3763272 - RNA, 20 nt, Salmonella typhimurium LT2
ucgccauucggauaauccag

SEQ ID NO: 3763273 - RNA, 17 nt, Salmonella typhimurium LT2
ucgcccaaauaguccag

SEQ ID NO: 3763274 - RNA, 22 nt, Salmonella typhimurium LT2
ucgcccaaauaguccagcagcc

SEQ ID NO: 3763275 - RNA, 22 nt, Salmonella typhimurium LT2
ucgcccacgcccagagcgcggc

SEQ ID NO: 3763276 - RNA, 19 nt, Salmonella typhimurium LT2
ucgcccagcacuaacagca

SEQ ID NO: 3763277 - RNA, 13 nt, Salmonella typhimurium LT2
ucgcccaugacau

SEQ ID NO: 3763278 - RNA, 19 nt, Salmonella typhimurium LT2
ucgcccaugacauucccau

SEQ ID NO: 3763279 - RNA, 13 nt, Salmonella typhimurium LT2
ucgccccagcaua

SEQ ID NO: 3763280 - RNA, 16 nt, Salmonella typhimurium LT2
ucgccccgaauccacu

SEQ ID NO: 3763281 - RNA, 21 nt, Salmonella typhimurium LT2
ucgccccgaauccacugucca

SEQ ID NO: 3763282 - RNA, 18 nt, Salmonella typhimurium LT2
ucgcccgcagcaaaaaau

SEQ ID NO: 3763283 - RNA, 15 nt, Salmonella typhimurium LT2
ucgcccggaucgcgg

SEQ ID NO: 3763284 - RNA, 21 nt, Salmonella typhimurium LT2
ucgcccggaucgcggccuucg

SEQ ID NO: 3763285 - RNA, 22 nt, Salmonella typhimurium LT2
ucgcccgggcgauaucacggaa

SEQ ID NO: 3763286 - RNA, 21 nt, Salmonella typhimurium LT2
ucgcccgguagcauccgcgau

SEQ ID NO: 3763287 - RNA, 13 nt, Salmonella typhimurium LT2
ucgcccugccagu

SEQ ID NO: 3763288 - RNA, 23 nt, Salmonella typhimurium LT2
ucgcccugccagugaaaguuuuc

SEQ ID NO: 3763289 - RNA, 15 nt, Salmonella typhimurium LT2
ucgcccuguauacag

SEQ ID NO: 3763290 - RNA, 15 nt, Salmonella typhimurium LT2
ucgccgacugccacc

SEQ ID NO: 3763291 - RNA, 23 nt, Salmonella typhimurium LT2
ucgccgcaucauacauauauucc

SEQ ID NO: 3763292 - RNA, 18 nt, Salmonella typhimurium LT2
ucgccgccagccgaucua

SEQ ID NO: 3763293 - RNA, 18 nt, Salmonella typhimurium LT2
ucgccgccaucggcgcgu

SEQ ID NO: 3763294 - RNA, 17 nt, Salmonella typhimurium LT2
ucgccgccgccagguua

SEQ ID NO: 3763295 - RNA, 20 nt, Salmonella typhimurium LT2
ucgccgccguacucuuucgg

SEQ ID NO: 3763296 - RNA, 18 nt, Salmonella typhimurium LT2
ucgccgcgcgaagaggau

SEQ ID NO: 3763297 - RNA, 12 nt, Salmonella typhimurium LT2
ucgccgcgcgca

SEQ ID NO: 3763298 - RNA, 17 nt, Salmonella typhimurium LT2
ucgccgcgcgcauaggc

SEQ ID NO: 3763299 - RNA, 17 nt, Salmonella typhimurium LT2
ucgccgcugcgagcagc

SEQ ID NO: 3763300 - RNA, 20 nt, Salmonella typhimurium LT2
ucgccggcagacgauagcgg

SEQ ID NO: 3763301 - RNA, 23 nt, Salmonella typhimurium LT2
ucgccggcagacgauagcgggug

SEQ ID NO: 3763302 - RNA, 23 nt, Salmonella typhimurium LT2
ucgccgguagcuucagcggcgcg

SEQ ID NO: 3763303 - RNA, 18 nt, Salmonella typhimurium LT2
ucgccgucguucagccag

SEQ ID NO: 3763304 - RNA, 19 nt, Salmonella typhimurium LT2
ucgccgucguucagccagc

SEQ ID NO: 3763305 - RNA, 17 nt, Salmonella typhimurium LT2
ucgccguguaagagcug

SEQ ID NO: 3763306 - RNA, 16 nt, Salmonella typhimurium LT2
ucgccuauuuucucuu

SEQ ID NO: 3763307 - RNA, 13 nt, Salmonella typhimurium LT2
ucgccucccgcac

SEQ ID NO: 3763308 - RNA, 20 nt, Salmonella typhimurium LT2
ucgccugaaugcacugcuga

SEQ ID NO: 3763309 - RNA, 14 nt, Salmonella typhimurium LT2
ucgccugacaggag

SEQ ID NO: 3763310 - RNA, 16 nt, Salmonella typhimurium LT2
ucgccugacugaagac

SEQ ID NO: 3763311 - RNA, 18 nt, Salmonella typhimurium LT2
ucgccugacugaagacga

SEQ ID NO: 3763312 - RNA, 16 nt, Salmonella typhimurium LT2
ucgccugaugaccgcc

SEQ ID NO: 3763313 - RNA, 23 nt, Salmonella typhimurium LT2
ucgccugcgcucauauacccugc

SEQ ID NO: 3763314 - RNA, 20 nt, Salmonella typhimurium LT2
ucgccuggcaacgucgaccc

SEQ ID NO: 3763315 - RNA, 20 nt, Salmonella typhimurium LT2
ucgccuguaccgggcagaca

SEQ ID NO: 3763316 - RNA, 22 nt, Salmonella typhimurium LT2
ucgccuuaacucuuaaaucaug

SEQ ID NO: 3763317 - RNA, 16 nt, Salmonella typhimurium LT2
ucgccuuacccggccu

SEQ ID NO: 3763318 - RNA, 19 nt, Salmonella typhimurium LT2
ucgccuucauccgcauaac

SEQ ID NO: 3763319 - RNA, 15 nt, Salmonella typhimurium LT2
ucgccuuccagcgac

SEQ ID NO: 3763320 - RNA, 19 nt, Salmonella typhimurium LT2
ucgccuucgcccauaucca

SEQ ID NO: 3763321 - RNA, 15 nt, Salmonella typhimurium LT2
ucgccuuucaccagc

SEQ ID NO: 3763322 - RNA, 16 nt, Salmonella typhimurium LT2
ucgccuuucaccagcg

SEQ ID NO: 3763323 - RNA, 21 nt, Salmonella typhimurium LT2
ucgcgaauagugauaccagcc

SEQ ID NO: 3763324 - RNA, 17 nt, Salmonella typhimurium LT2
ucgcgaccaccaggaua

SEQ ID NO: 3763325 - RNA, 18 nt, Salmonella typhimurium LT2
ucgcgaccggaucaauaa

SEQ ID NO: 3763326 - RNA, 16 nt, Salmonella typhimurium LT2
ucgcgacgacgcuggu

SEQ ID NO: 3763327 - RNA, 15 nt, Salmonella typhimurium LT2
ucgcgauaggccucg

SEQ ID NO: 3763328 - RNA, 18 nt, Salmonella typhimurium LT2
ucgcgauccucauacagc

SEQ ID NO: 3763329 - RNA, 22 nt, Salmonella typhimurium LT2
ucgcgcagacaguggccaucuu

SEQ ID NO: 3763330 - RNA, 19 nt, Salmonella typhimurium LT2
ucgcgcagauagagcgccu

SEQ ID NO: 3763331 - RNA, 12 nt, Salmonella typhimurium LT2
ucgcgcagcagg

SEQ ID NO: 3763332 - RNA, 19 nt, Salmonella typhimurium LT2
ucgcgccaaaagaggcagc

SEQ ID NO: 3763333 - RNA, 23 nt, Salmonella typhimurium LT2
ucgcgccagcauggucuccagca

SEQ ID NO: 3763334 - RNA, 13 nt, Salmonella typhimurium LT2
ucgcgccagcgac

SEQ ID NO: 3763335 - RNA, 21 nt, Salmonella typhimurium LT2
ucgcgccagcgacaucccaga

SEQ ID NO: 3763336 - RNA, 20 nt, Salmonella typhimurium LT2
ucgcgccauuugccagauag

SEQ ID NO: 3763337 - RNA, 18 nt, Salmonella typhimurium LT2
ucgcgccgccgggcuuca

SEQ ID NO: 3763338 - RNA, 17 nt, Salmonella typhimurium LT2
ucggcguggggcaggcg

SEQ ID NO: 3763339 - RNA, 22 nt, Salmonella typhimurium LT2
ucggcguuguuaugcgucaaaa

SEQ ID NO: 3763340 - RNA, 14 nt, Salmonella typhimurium LT2
ucggcuccggcaaa

SEQ ID NO: 3763341 - RNA, 16 nt, Salmonella typhimurium LT2
ucggcugacgcgcuau

SEQ ID NO: 3763342 - RNA, 22 nt, Salmonella typhimurium LT2
ucggcuggcauuuuuauuuaac

SEQ ID NO: 3763343 - RNA, 14 nt, Salmonella typhimurium LT2
ucggcuucaccgau

SEQ ID NO: 3763344 - RNA, 16 nt, Salmonella typhimurium LT2
ucggcuucucccaaca

SEQ ID NO: 3763345 - RNA, 14 nt, Salmonella typhimurium LT2
ucggcuuuaucgcc

SEQ ID NO: 3763346 - RNA, 23 nt, Salmonella typhimurium LT2
ucggcuuuggcaaacggcgccag

SEQ ID NO: 3763347 - RNA, 14 nt, Salmonella typhimurium LT2
ucgggacggcgguc

SEQ ID NO: 3763348 - RNA, 18 nt, Salmonella typhimurium LT2
ucgggauauaugcaaaac

SEQ ID NO: 3763349 - RNA, 19 nt, Salmonella typhimurium LT2
ucgggaucagcgcgcucca

SEQ ID NO: 3763350 - RNA, 21 nt, Salmonella typhimurium LT2
ucgggcagcgcuucucuuucc

SEQ ID NO: 3763351 - RNA, 19 nt, Salmonella typhimurium LT2
ucgggcccguugccuggcg

SEQ ID NO: 3763352 - RNA, 22 nt, Salmonella typhimurium LT2
ucgggcgguugccacucuucca

SEQ ID NO: 3763353 - RNA, 23 nt, Salmonella typhimurium LT2
ucgggcguauuuuccugccagaa

SEQ ID NO: 3763354 - RNA, 16 nt, Salmonella typhimurium LT2
ucgggcuuccagcguu

SEQ ID NO: 3763355 - RNA, 18 nt, Salmonella typhimurium LT2
ucggggagacgggcggag

SEQ ID NO: 3763356 - RNA, 17 nt, Salmonella typhimurium LT2
ucggguaaaaguuugcu

SEQ ID NO: 3763357 - RNA, 11 nt, Salmonella typhimurium LT2
ucgguaaccau

SEQ ID NO: 3763358 - RNA, 15 nt, Salmonella typhimurium LT2
ucgguaaccauccau

SEQ ID NO: 3763359 - RNA, 20 nt, Salmonella typhimurium LT2
ucgguaagucugauaacggc

SEQ ID NO: 3763360 - RNA, 15 nt, Salmonella typhimurium LT2
ucgguacggcgcugc

SEQ ID NO: 3763361 - RNA, 15 nt, Salmonella typhimurium LT2
ucgguacuccccuuu

SEQ ID NO: 3763362 - RNA, 17 nt, Salmonella typhimurium LT2
ucgguaguguuaucgcc

SEQ ID NO: 3763363 - RNA, 16 nt, Salmonella typhimurium LT2
ucgguaugccuuccag

SEQ ID NO: 3763364 - RNA, 16 nt, Salmonella typhimurium LT2
ucggucaacauuccgu

SEQ ID NO: 3763365 - RNA, 18 nt, Salmonella typhimurium LT2
ucggucagauaaauaacg

SEQ ID NO: 3763366 - RNA, 20 nt, Salmonella typhimurium LT2
ucggucagauuaaucaggcg

SEQ ID NO: 3763367 - RNA, 22 nt, Salmonella typhimurium LT2
ucggucaucagggcguaagcgc

SEQ ID NO: 3763368 - RNA, 13 nt, Salmonella typhimurium LT2
ucggucuccagca

SEQ ID NO: 3763369 - RNA, 18 nt, Salmonella typhimurium LT2
ucggugaucuccucgccg

SEQ ID NO: 3763370 - RNA, 24 nt, Salmonella typhimurium LT2
ucggugcuuccggcacugcgccuu

SEQ ID NO: 3763371 - RNA, 17 nt, Salmonella typhimurium LT2
ucgguggcgguaucaau

SEQ ID NO: 3763372 - RNA, 15 nt, Salmonella typhimurium LT2
ucgguguaaacaggc

SEQ ID NO: 3763373 - RNA, 23 nt, Salmonella typhimurium LT2
ucgguguucacaauuguggucgu

SEQ ID NO: 3763374 - RNA, 24 nt, Salmonella typhimurium LT2
ucgguuaacaccaguuuauccgcc

SEQ ID NO: 3763375 - RNA, 14 nt, Salmonella typhimurium LT2
ucgguucgccgcag

SEQ ID NO: 3763376 - RNA, 18 nt, Salmonella typhimurium LT2
ucgguucgccgcgcgcau

SEQ ID NO: 3763377 - RNA, 20 nt, Salmonella typhimurium LT2
ucgguuugcagacgugcaau

SEQ ID NO: 3763378 - RNA, 22 nt, Salmonella typhimurium LT2
ucgguuugugucguaguggcau

SEQ ID NO: 3763379 - RNA, 20 nt, Salmonella typhimurium LT2
ucguaaacacgacgccgccg

SEQ ID NO: 3763380 - RNA, 19 nt, Salmonella typhimurium LT2
ucguaaagcgcauccagcu

SEQ ID NO: 3763381 - RNA, 17 nt, Salmonella typhimurium LT2
ucguaaaucaaaugaga

SEQ ID NO: 3763382 - RNA, 15 nt, Salmonella typhimurium LT2
ucguaaaucaauuuu

SEQ ID NO: 3763383 - RNA, 17 nt, Salmonella typhimurium LT2
ucguaacaggucacgac

SEQ ID NO: 3763384 - RNA, 12 nt, Salmonella typhimurium LT2
ucguaauuuaaa

SEQ ID NO: 3763385 - RNA, 16 nt, Salmonella typhimurium LT2
ucguaauuuaaaccgc

SEQ ID NO: 3763386 - RNA, 16 nt, Salmonella typhimurium LT2
ucguacauguccagau

SEQ ID NO: 3763387 - RNA, 11 nt, Salmonella typhimurium LT2
ucguaccuuca

SEQ ID NO: 3763388 - RNA, 19 nt, Salmonella typhimurium LT2
ucguacuguggaaccgggu

SEQ ID NO: 3763389 - RNA, 15 nt, Salmonella typhimurium LT2
ucguagacucaggcg

SEQ ID NO: 3763390 - RNA, 18 nt, Salmonella typhimurium LT2
ucguagccaccaucuuuu

SEQ ID NO: 3763391 - RNA, 15 nt, Salmonella typhimurium LT2
ucguagccgcgcgcc

SEQ ID NO: 3763392 - RNA, 15 nt, Salmonella typhimurium LT2
ucguagcucauggcg

SEQ ID NO: 3763393 - RNA, 13 nt, Salmonella typhimurium LT2
ucguagguucgac

SEQ ID NO: 3763394 - RNA, 18 nt, Salmonella typhimurium LT2
ucguagucaggcagcagg

SEQ ID NO: 3763395 - RNA, 18 nt, Salmonella typhimurium LT2
ucguaguggaucagcaga

SEQ ID NO: 3763396 - RNA, 13 nt, Salmonella typhimurium LT2
ucguauccccagu

SEQ ID NO: 3763397 - RNA, 20 nt, Salmonella typhimurium LT2
ucguauccccagucuuccug

SEQ ID NO: 3763398 - RNA, 21 nt, Salmonella typhimurium LT2
ucguauccccagucuuccugc

SEQ ID NO: 3763399 - RNA, 16 nt, Salmonella typhimurium LT2
ucguauugacaacaaa

SEQ ID NO: 3763400 - RNA, 19 nt, Salmonella typhimurium LT2
ucguauugacaacaaaucc

SEQ ID NO: 3763401 - RNA, 15 nt, Salmonella typhimurium LT2
ucgucaaauuacgcc

SEQ ID NO: 3763402 - RNA, 13 nt, Salmonella typhimurium LT2
ucgucacagaccc

SEQ ID NO: 3763403 - RNA, 19 nt, Salmonella typhimurium LT2
ucgucaccugauagcgggu

SEQ ID NO: 3763404 - RNA, 16 nt, Salmonella typhimurium LT2
ucgucacgguuuaucc

SEQ ID NO: 3763405 - RNA, 21 nt, Salmonella typhimurium LT2
ucgucacgguuuauccccgcu

SEQ ID NO: 3763406 - RNA, 21 nt, Salmonella typhimurium LT2
ucgucagacggacaucagagg

SEQ ID NO: 3763407 - RNA, 22 nt, Salmonella typhimurium LT2
ucgucagccgugagcagaucgu

SEQ ID NO: 3763408 - RNA, 19 nt, Salmonella typhimurium LT2
ucgucauaauuucguuuua

SEQ ID NO: 3763409 - RNA, 15 nt, Salmonella typhimurium LT2
ucgucauuaaugccu

SEQ ID NO: 3763410 - RNA, 21 nt, Salmonella typhimurium LT2
ucgucauucauggcgcgcgcc

SEQ ID NO: 3763411 - RNA, 13 nt, Salmonella typhimurium LT2
ucguccaccuaaa

SEQ ID NO: 3763412 - RNA, 15 nt, Salmonella typhimurium LT2
ucguccaguaaaauc

SEQ ID NO: 3763413 - RNA, 21 nt, Salmonella typhimurium LT2
ucguccaguaaaaucgggccu

SEQ ID NO: 3763414 - RNA, 15 nt, Salmonella typhimurium LT2
ucguccugauagccg

SEQ ID NO: 3763415 - RNA, 23 nt, Salmonella typhimurium LT2
ucguccugauccggcuguuccag

SEQ ID NO: 3763416 - RNA, 15 nt, Salmonella typhimurium LT2
ucgucgaaaccguau

SEQ ID NO: 3763417 - RNA, 21 nt, Salmonella typhimurium LT2
ucgucgaaaccguauagccgc

SEQ ID NO: 3763418 - RNA, 14 nt, Salmonella typhimurium LT2
ucgucgagcugcgc

SEQ ID NO: 3763419 - RNA, 15 nt, Salmonella typhimurium LT2
ucgucgccgaucggc

SEQ ID NO: 3763420 - RNA, 21 nt, Salmonella typhimurium LT2
ucgucgccgccaaagcgcccg

SEQ ID NO: 3763421 - RNA, 16 nt, Salmonella typhimurium LT2
ucgucgccuuccagcg

SEQ ID NO: 3763422 - RNA, 21 nt, Salmonella typhimurium LT2
ucgucuaccguuucgaccgug

SEQ ID NO: 3763423 - RNA, 16 nt, Salmonella typhimurium LT2
ucgucugacgcuugca

SEQ ID NO: 3763424 - RNA, 17 nt, Salmonella typhimurium LT2
ucgucuucaucccaguc

SEQ ID NO: 3763425 - RNA, 18 nt, Salmonella typhimurium LT2
ucgucuucgaccgccaua

SEQ ID NO: 3763426 - RNA, 23 nt, Salmonella typhimurium LT2
ucgucuuguguggagguuucuuc

SEQ ID NO: 3763427 - RNA, 16 nt, Salmonella typhimurium LT2
ucgugacccacacaua

SEQ ID NO: 3763428 - RNA, 20 nt, Salmonella typhimurium LT2
ucgugacccguuucccggau

SEQ ID NO: 3763429 - RNA, 16 nt, Salmonella typhimurium LT2
ucgugacgcucgacug

SEQ ID NO: 3763430 - RNA, 15 nt, Salmonella typhimurium LT2
ucgugagcgcgucau

SEQ ID NO: 3763431 - RNA, 17 nt, Salmonella typhimurium LT2
ucgugauaaagcugacg

SEQ ID NO: 3763432 - RNA, 19 nt, Salmonella typhimurium LT2
ucgugauaacgaugcggau

SEQ ID NO: 3763433 - RNA, 13 nt, Salmonella typhimurium LT2
ucgugauaacgcg

SEQ ID NO: 3763434 - RNA, 14 nt, Salmonella typhimurium LT2
ucgugauagacggc

SEQ ID NO: 3763435 - RNA, 16 nt, Salmonella typhimurium LT2
ucgugaugugguugug

SEQ ID NO: 3763436 - RNA, 20 nt, Salmonella typhimurium LT2
ucgugauugauucgcgccag

SEQ ID NO: 3763437 - RNA, 18 nt, Salmonella typhimurium LT2
ucgugcaaccgccugcac

SEQ ID NO: 3763438 - RNA, 15 nt, Salmonella typhimurium LT2
ucgugcagcgccgcc

SEQ ID NO: 3763439 - RNA, 18 nt, Salmonella typhimurium LT2
ucgugccgauaucaauaa

SEQ ID NO: 3763440 - RNA, 15 nt, Salmonella typhimurium LT2
ucguguaaaugacgc

SEQ ID NO: 3763441 - RNA, 20 nt, Salmonella typhimurium LT2
ucguguggcggaaugaccug

SEQ ID NO: 3763442 - RNA, 20 nt, Salmonella typhimurium LT2
ucuccuggaugcgcugaaau

SEQ ID NO: 3763443 - RNA, 13 nt, Salmonella typhimurium LT2
ucucgaugauaaa

SEQ ID NO: 3763444 - RNA, 16 nt, Salmonella typhimurium LT2
ucucgcacucgccgcc

SEQ ID NO: 3763445 - RNA, 14 nt, Salmonella typhimurium LT2
ucucgccaaaucau

SEQ ID NO: 3763446 - RNA, 17 nt, Salmonella typhimurium LT2
ucucgccgguuggcaug

SEQ ID NO: 3763447 - RNA, 20 nt, Salmonella typhimurium LT2
ucucgcguggacgcuuuuau

SEQ ID NO: 3763448 - RNA, 16 nt, Salmonella typhimurium LT2
ucucgcuaaucaucag

SEQ ID NO: 3763449 - RNA, 15 nt, Salmonella typhimurium LT2
ucucgguauccagcu

SEQ ID NO: 3763450 - RNA, 20 nt, Salmonella typhimurium LT2
ucucguaaaucaauuuuaau

SEQ ID NO: 3763451 - RNA, 12 nt, Salmonella typhimurium LT2
ucucgucaaggu

SEQ ID NO: 3763452 - RNA, 14 nt, Salmonella typhimurium LT2
ucucgucgccaggg

SEQ ID NO: 3763453 - RNA, 12 nt, Salmonella typhimurium LT2
ucucgugaacag

SEQ ID NO: 3763454 - RNA, 23 nt, Salmonella typhimurium LT2
ucucuauaaucagguaaguguaa

SEQ ID NO: 3763455 - RNA, 13 nt, Salmonella typhimurium LT2
ucucuauuaaccg

SEQ ID NO: 3763456 - RNA, 13 nt, Salmonella typhimurium LT2
ucucuccgccugc

SEQ ID NO: 3763457 - RNA, 17 nt, Salmonella typhimurium LT2
ucucugaggguguucau

SEQ ID NO: 3763458 - RNA, 20 nt, Salmonella typhimurium LT2
ucucuggcgcgggcuucacg

SEQ ID NO: 3763459 - RNA, 18 nt, Salmonella typhimurium LT2
ucucugguuucccugccu

SEQ ID NO: 3763460 - RNA, 17 nt, Salmonella typhimurium LT2
ucucuuaaguauauaug

SEQ ID NO: 3763461 - RNA, 19 nt, Salmonella typhimurium LT2
ucucuuaugccgcuuuugc

SEQ ID NO: 3763462 - RNA, 21 nt, Salmonella typhimurium LT2
ucucuucaugcauaaccgcgc

SEQ ID NO: 3763463 - RNA, 15 nt, Salmonella typhimurium LT2
ucucuucccagcgaa

SEQ ID NO: 3763464 - RNA, 13 nt, Salmonella typhimurium LT2
ucucuuccgccag

SEQ ID NO: 3763465 - RNA, 16 nt, Salmonella typhimurium LT2
ucucuuccgccagcgc

SEQ ID NO: 3763466 - RNA, 13 nt, Salmonella typhimurium LT2
ucucuucuaucug

SEQ ID NO: 3763467 - RNA, 20 nt, Salmonella typhimurium LT2
ucucuucugcugacauuccu

SEQ ID NO: 3763468 - RNA, 15 nt, Salmonella typhimurium LT2
ucucuucuuuaaggc

SEQ ID NO: 3763469 - RNA, 12 nt, Salmonella typhimurium LT2
ucucuugccugc

SEQ ID NO: 3763470 - RNA, 20 nt, Salmonella typhimurium LT2
ucucuugugcuuccagcucc

SEQ ID NO: 3763471 - RNA, 14 nt, Salmonella typhimurium LT2
ucucuuuagcgcua

SEQ ID NO: 3763472 - RNA, 14 nt, Salmonella typhimurium LT2
ucucuuucaccagc

SEQ ID NO: 3763473 - RNA, 23 nt, Salmonella typhimurium LT2
ucugaaaaaccgucggcaauaca

SEQ ID NO: 3763474 - RNA, 15 nt, Salmonella typhimurium LT2
ucugaaaggcgucag

SEQ ID NO: 3763475 - RNA, 21 nt, Salmonella typhimurium LT2
ucugaacaaucgccugacuga

SEQ ID NO: 3763476 - RNA, 22 nt, Salmonella typhimurium LT2
ucugaacaaucgccugacugaa

SEQ ID NO: 3763477 - RNA, 22 nt, Salmonella typhimurium LT2
ucugaauaaccauuccuauuuu

SEQ ID NO: 3763478 - RNA, 22 nt, Salmonella typhimurium LT2
ucugaaucaaugcaucuucacu

SEQ ID NO: 3763479 - RNA, 20 nt, Salmonella typhimurium LT2
ucugaauucgccaccagcaa

SEQ ID NO: 3763480 - RNA, 15 nt, Salmonella typhimurium LT2
ucugacacagaggaa

SEQ ID NO: 3763481 - RNA, 11 nt, Salmonella typhimurium LT2
ucugacaucag

SEQ ID NO: 3763482 - RNA, 10 nt, Salmonella typhimurium LT2
ucugaccagu

SEQ ID NO: 3763483 - RNA, 13 nt, Salmonella typhimurium LT2
ucugacccgcgaa

SEQ ID NO: 3763484 - RNA, 18 nt, Salmonella typhimurium LT2
ucugaccuacaaucgucu

SEQ ID NO: 3763485 - RNA, 18 nt, Salmonella typhimurium LT2
ucugacgcuuaucaauag

SEQ ID NO: 3763486 - RNA, 21 nt, Salmonella typhimurium LT2
ucugacugcgugagcguggaa

SEQ ID NO: 3763487 - RNA, 23 nt, Salmonella typhimurium LT2
ucugagaauuuggguuuauguag

SEQ ID NO: 3763488 - RNA, 20 nt, Salmonella typhimurium LT2
ucugaguauacagacagcag

SEQ ID NO: 3763489 - RNA, 22 nt, Salmonella typhimurium LT2
ucugaguauacagacagcagau

SEQ ID NO: 3763490 - RNA, 14 nt, Salmonella typhimurium LT2
ucugagucgccaga

SEQ ID NO: 3763491 - RNA, 17 nt, Salmonella typhimurium LT2
ucugauaagcgcagcgu

SEQ ID NO: 3763492 - RNA, 19 nt, Salmonella typhimurium LT2
ucugauacugcuccggcgc

SEQ ID NO: 3763493 - RNA, 22 nt, Salmonella typhimurium LT2
ucugauagcuaaccagcgagcu

SEQ ID NO: 3763494 - RNA, 20 nt, Salmonella typhimurium LT2
ucugaucuguuugccagagg

SEQ ID NO: 3763495 - RNA, 18 nt, Salmonella typhimurium LT2
ucugaugagcgcagcgac

SEQ ID NO: 3763496 - RNA, 14 nt, Salmonella typhimurium LT2
ucugaugccugaag

SEQ ID NO: 3763497 - RNA, 15 nt, Salmonella typhimurium LT2
ucugauggcgcugcg

SEQ ID NO: 3763498 - RNA, 17 nt, Salmonella typhimurium LT2
ucugcaaaauauauaau

SEQ ID NO: 3763499 - RNA, 19 nt, Salmonella typhimurium LT2
ucugcaacuguugcgccag

SEQ ID NO: 3763500 - RNA, 22 nt, Salmonella typhimurium LT2
ucugcaaugguaaaacgcuggc

SEQ ID NO: 3763501 - RNA, 15 nt, Salmonella typhimurium LT2
ucugcacgcacgacg

SEQ ID NO: 3763502 - RNA, 17 nt, Salmonella typhimurium LT2
ucugcacuuugccagag

SEQ ID NO: 3763503 - RNA, 21 nt, Salmonella typhimurium LT2
ucugcaggcgggugcgcagcc

SEQ ID NO: 3763504 - RNA, 16 nt, Salmonella typhimurium LT2
ucugcauaagcguuaa

SEQ ID NO: 3763505 - RNA, 17 nt, Salmonella typhimurium LT2
ucugcauguaguaagcc

SEQ ID NO: 3763506 - RNA, 22 nt, Salmonella typhimurium LT2
ucugccacaauuugcagauuua

SEQ ID NO: 3763507 - RNA, 16 nt, Salmonella typhimurium LT2
ucugccagcagcggcg

SEQ ID NO: 3763508 - RNA, 17 nt, Salmonella typhimurium LT2
ucugccaguagcugcuc

SEQ ID NO: 3763509 - RNA, 19 nt, Salmonella typhimurium LT2
ucugccaguuaucgguaau

SEQ ID NO: 3763510 - RNA, 13 nt, Salmonella typhimurium LT2
ucugccgcuuuga

SEQ ID NO: 3763511 - RNA, 16 nt, Salmonella typhimurium LT2
ucugccugcagaccca

SEQ ID NO: 3763512 - RNA, 20 nt, Salmonella typhimurium LT2
ucugccuuuuuuaauccagg

SEQ ID NO: 3763513 - RNA, 15 nt, Salmonella typhimurium LT2
ucugcgcaauguuca

SEQ ID NO: 3763514 - RNA, 14 nt, Salmonella typhimurium LT2
ucugcgcauuaacg

SEQ ID NO: 3763515 - RNA, 19 nt, Salmonella typhimurium LT2
ucugcgccaccagcgcagu

SEQ ID NO: 3763516 - RNA, 22 nt, Salmonella typhimurium LT2
ucugcgccagccagcucaccag

SEQ ID NO: 3763517 - RNA, 12 nt, Salmonella typhimurium LT2
ucugcgccgccg

SEQ ID NO: 3763518 - RNA, 18 nt, Salmonella typhimurium LT2
ucugcgccgcuugugccg

SEQ ID NO: 3763519 - RNA, 18 nt, Salmonella typhimurium LT2
ucugcgccuuuggcagga

SEQ ID NO: 3763520 - RNA, 23 nt, Salmonella typhimurium LT2
ucugcgcuaagcguuacggaaaa

SEQ ID NO: 3763521 - RNA, 18 nt, Salmonella typhimurium LT2
ucugcgggacgcaucauc

SEQ ID NO: 3763522 - RNA, 15 nt, Salmonella typhimurium LT2
ucugcgguaacaauc

SEQ ID NO: 3763523 - RNA, 15 nt, Salmonella typhimurium LT2
ucugcgucuucuucc

SEQ ID NO: 3763524 - RNA, 13 nt, Salmonella typhimurium LT2
ucugcgugaagac

SEQ ID NO: 3763525 - RNA, 19 nt, Salmonella typhimurium LT2
ucugcgugaugcaucagaa

SEQ ID NO: 3763526 - RNA, 13 nt, Salmonella typhimurium LT2
ucugcuccgccag

SEQ ID NO: 3763527 - RNA, 15 nt, Salmonella typhimurium LT2
ucugcugauaauacu

SEQ ID NO: 3763528 - RNA, 16 nt, Salmonella typhimurium LT2
ucugcugauaauacug

SEQ ID NO: 3763529 - RNA, 20 nt, Salmonella typhimurium LT2
ucugcugcucccucacgcgu

SEQ ID NO: 3763530 - RNA, 21 nt, Salmonella typhimurium LT2
ucugcugggcgauuucacgaa

SEQ ID NO: 3763531 - RNA, 21 nt, Salmonella typhimurium LT2
ucugcugugccgggaaaagga

SEQ ID NO: 3763532 - RNA, 19 nt, Salmonella typhimurium LT2
ucuggacgggccgccaucu

SEQ ID NO: 3763533 - RNA, 17 nt, Salmonella typhimurium LT2
ucuggauagucuucaag

SEQ ID NO: 3763534 - RNA, 17 nt, Salmonella typhimurium LT2
ucuggauuacaaaaaua

SEQ ID NO: 3763535 - RNA, 16 nt, Salmonella typhimurium LT2
ucuggauugcagagaa

SEQ ID NO: 3763536 - RNA, 13 nt, Salmonella typhimurium LT2
ucuggcaauaagg

SEQ ID NO: 3763537 - RNA, 20 nt, Salmonella typhimurium LT2
ucuggcagcggcaguaaauu

SEQ ID NO: 3763538 - RNA, 15 nt, Salmonella typhimurium LT2
ucuggccaguuucaa

SEQ ID NO: 3763539 - RNA, 17 nt, Salmonella typhimurium LT2
ucuggcgaaaguaacca

SEQ ID NO: 3763540 - RNA, 14 nt, Salmonella typhimurium LT2
ucuggcgaggcgcc

SEQ ID NO: 3763541 - RNA, 18 nt, Salmonella typhimurium LT2
ucuggcgcaaugcugacg

SEQ ID NO: 3763542 - RNA, 23 nt, Salmonella typhimurium LT2
ucuggcgcagauacgcgucaaag

SEQ ID NO: 3763543 - RNA, 19 nt, Salmonella typhimurium LT2
ucuggcgcauuccagaccc

SEQ ID NO: 3763544 - RNA, 13 nt, Salmonella typhimurium LT2
ucuggcgccgcaa

SEQ ID NO: 3763545 - RNA, 16 nt, Salmonella typhimurium LT2
ucuggcguuacggaac

SEQ ID NO: 3763546 - RNA, 22 nt, Salmonella typhimurium LT2
ucuuuaauuuacguccaccguu

SEQ ID NO: 3763547 - RNA, 20 nt, Salmonella typhimurium LT2
ucuuuaauuugugccagcgu

SEQ ID NO: 3763548 - RNA, 22 nt, Salmonella typhimurium LT2
ucuuuacgcagcaagaacagag

SEQ ID NO: 3763549 - RNA, 16 nt, Salmonella typhimurium LT2
ucuuuagauaauuucg

SEQ ID NO: 3763550 - RNA, 17 nt, Salmonella typhimurium LT2
ucuuuauccugaaggac

SEQ ID NO: 3763551 - RNA, 15 nt, Salmonella typhimurium LT2
ucuuuaucuaucacc

SEQ ID NO: 3763552 - RNA, 12 nt, Salmonella typhimurium LT2
ucuuuaucuucu

SEQ ID NO: 3763553 - RNA, 21 nt, Salmonella typhimurium LT2
ucuuuaucuucugcugcuccc

SEQ ID NO: 3763554 - RNA, 19 nt, Salmonella typhimurium LT2
ucuuuaugggcauuucauu

SEQ ID NO: 3763555 - RNA, 16 nt, Salmonella typhimurium LT2
ucuuuauuaaaaagca

SEQ ID NO: 3763556 - RNA, 14 nt, Salmonella typhimurium LT2
ucuuuauugguugc

SEQ ID NO: 3763557 - RNA, 19 nt, Salmonella typhimurium LT2
ucuuucaauccuucuucug

SEQ ID NO: 3763558 - RNA, 13 nt, Salmonella typhimurium LT2
ucuuucaccauua

SEQ ID NO: 3763559 - RNA, 23 nt, Salmonella typhimurium LT2
ucuuucagccggcuaucuucuuc

SEQ ID NO: 3763560 - RNA, 13 nt, Salmonella typhimurium LT2
ucuuucagguucc

SEQ ID NO: 3763561 - RNA, 13 nt, Salmonella typhimurium LT2
ucuuucccuuuuu

SEQ ID NO: 3763562 - RNA, 14 nt, Salmonella typhimurium LT2
ucuuuccgcuacua

SEQ ID NO: 3763563 - RNA, 15 nt, Salmonella typhimurium LT2
ucuuuccuuuuucag

SEQ ID NO: 3763564 - RNA, 14 nt, Salmonella typhimurium LT2
ucuuucggcgccug

SEQ ID NO: 3763565 - RNA, 13 nt, Salmonella typhimurium LT2
ucuuucgucacua

SEQ ID NO: 3763566 - RNA, 16 nt, Salmonella typhimurium LT2
ucuuucugccaucgcu

SEQ ID NO: 3763567 - RNA, 15 nt, Salmonella typhimurium LT2
ucuuucuguguugcu

SEQ ID NO: 3763568 - RNA, 15 nt, Salmonella typhimurium LT2
ucuuugaccagcgac

SEQ ID NO: 3763569 - RNA, 19 nt, Salmonella typhimurium LT2
ucuuugcaccgcuaaaaaa

SEQ ID NO: 3763570 - RNA, 18 nt, Salmonella typhimurium LT2
ucuuugcgcgucucuccc

SEQ ID NO: 3763571 - RNA, 12 nt, Salmonella typhimurium LT2
ucuuuggagauu

SEQ ID NO: 3763572 - RNA, 17 nt, Salmonella typhimurium LT2
ucuuuggagauuucggc

SEQ ID NO: 3763573 - RNA, 23 nt, Salmonella typhimurium LT2
ucuuugugcgagaguuuuucagc

SEQ ID NO: 3763574 - RNA, 12 nt, Salmonella typhimurium LT2
ucuuuuaaaaga

SEQ ID NO: 3763575 - RNA, 22 nt, Salmonella typhimurium LT2
ucuuuuaaggcggcaaagauaa

SEQ ID NO: 3763576 - RNA, 16 nt, Salmonella typhimurium LT2
ucuuuuaucacccgga

SEQ ID NO: 3763577 - RNA, 12 nt, Salmonella typhimurium LT2
ucuuuuauuauu

SEQ ID NO: 3763578 - RNA, 13 nt, Salmonella typhimurium LT2
ucuuuuauuucau

SEQ ID NO: 3763579 - RNA, 13 nt, Salmonella typhimurium LT2
ucuuuucaauaaa

SEQ ID NO: 3763580 - RNA, 12 nt, Salmonella typhimurium LT2
ucuuuugcaaua

SEQ ID NO: 3763581 - RNA, 20 nt, Salmonella typhimurium LT2
ucuuuugucguccccuggac

SEQ ID NO: 3763582 - RNA, 12 nt, Salmonella typhimurium LT2
ucuuuuuccagc

SEQ ID NO: 3763583 - RNA, 23 nt, Salmonella typhimurium LT2
ucuuuuucgaucagcauaucgau

SEQ ID NO: 3763584 - RNA, 11 nt, Salmonella typhimurium LT2
ugaaaaaaacg

SEQ ID NO: 3763585 - RNA, 12 nt, Salmonella typhimurium LT2
ugaaaaauagac

SEQ ID NO: 3763586 - RNA, 12 nt, Salmonella typhimurium LT2
ugaaaaaucccc

SEQ ID NO: 3763587 - RNA, 13 nt, Salmonella typhimurium LT2
ugaaaaauguuca

SEQ ID NO: 3763588 - RNA, 12 nt, Salmonella typhimurium LT2
ugaaaaccugca

SEQ ID NO: 3763589 - RNA, 14 nt, Salmonella typhimurium LT2
ugaaaacgaaucuc

SEQ ID NO: 3763590 - RNA, 22 nt, Salmonella typhimurium LT2
ugaaaaggggaucgugcaguaa

SEQ ID NO: 3763591 - RNA, 11 nt, Salmonella typhimurium LT2
ugaaaagugaa

SEQ ID NO: 3763592 - RNA, 15 nt, Salmonella typhimurium LT2
ugaaaauagcgccau

SEQ ID NO: 3763593 - RNA, 15 nt, Salmonella typhimurium LT2
ugaaaaucaaaaaca

SEQ ID NO: 3763594 - RNA, 13 nt, Salmonella typhimurium LT2
ugaaaaugaaaaa

SEQ ID NO: 3763595 - RNA, 21 nt, Salmonella typhimurium LT2
ugaaacaagcggcggccaacc

SEQ ID NO: 3763596 - RNA, 15 nt, Salmonella typhimurium LT2
ugaaacagaauaaac

SEQ ID NO: 3763597 - RNA, 22 nt, Salmonella typhimurium LT2
ugaaacaguccggcgaaaaaag

SEQ ID NO: 3763598 - RNA, 20 nt, Salmonella typhimurium LT2
ugaaacauauauauccgcua

SEQ ID NO: 3763599 - RNA, 14 nt, Salmonella typhimurium LT2
ugaaaccccaaauc

SEQ ID NO: 3763600 - RNA, 20 nt, Salmonella typhimurium LT2
ugaaaccccaaaucagcaaa

SEQ ID NO: 3763601 - RNA, 23 nt, Salmonella typhimurium LT2
ugaaaccggcgcgccuuccagca

SEQ ID NO: 3763602 - RNA, 15 nt, Salmonella typhimurium LT2
ugaaacgcauccagc

SEQ ID NO: 3763603 - RNA, 15 nt, Salmonella typhimurium LT2
ugaaacgugaaauau

SEQ ID NO: 3763604 - RNA, 19 nt, Salmonella typhimurium LT2
ugaaagaccuaaaccacgu

SEQ ID NO: 3763605 - RNA, 14 nt, Salmonella typhimurium LT2
ugaaagauuauuuu

SEQ ID NO: 3763606 - RNA, 23 nt, Salmonella typhimurium LT2
ugaaagauuauuuuaucaucagc

SEQ ID NO: 3763607 - RNA, 22 nt, Salmonella typhimurium LT2
ugaaagcucggcgggguuuuuu

SEQ ID NO: 3763608 - RNA, 18 nt, Salmonella typhimurium LT2
ugaaaggaagugcaacug

SEQ ID NO: 3763609 - RNA, 13 nt, Salmonella typhimurium LT2
ugaaaggccauca

SEQ ID NO: 3763610 - RNA, 13 nt, Salmonella typhimurium LT2
ugaaaggcgucag

SEQ ID NO: 3763611 - RNA, 15 nt, Salmonella typhimurium LT2
ugaaaguaaguuuau

SEQ ID NO: 3763612 - RNA, 15 nt, Salmonella typhimurium LT2
ugaaagugauuucau

SEQ ID NO: 3763613 - RNA, 22 nt, Salmonella typhimurium LT2
ugaaauaccaggcggcuuuuuc

SEQ ID NO: 3763614 - RNA, 15 nt, Salmonella typhimurium LT2
ugaaauagcgcugcg

SEQ ID NO: 3763615 - RNA, 20 nt, Salmonella typhimurium LT2
ugaaaucacccagaugcgaa

SEQ ID NO: 3763616 - RNA, 16 nt, Salmonella typhimurium LT2
ugaaauccggcuuuga

SEQ ID NO: 3763617 - RNA, 16 nt, Salmonella typhimurium LT2
ugaaaucgaacagguu

SEQ ID NO: 3763618 - RNA, 20 nt, Salmonella typhimurium LT2
ugaaaucgccuguuaauggu

SEQ ID NO: 3763619 - RNA, 14 nt, Salmonella typhimurium LT2
ugaaaucgucgcca

SEQ ID NO: 3763620 - RNA, 15 nt, Salmonella typhimurium LT2
ugaacacaaaaaacg

SEQ ID NO: 3763621 - RNA, 19 nt, Salmonella typhimurium LT2
ugaacacacccuucucagg

SEQ ID NO: 3763622 - RNA, 21 nt, Salmonella typhimurium LT2
ugaacaccacugaaaaauaau

SEQ ID NO: 3763623 - RNA, 12 nt, Salmonella typhimurium LT2
ugaacaggcgug

SEQ ID NO: 3763624 - RNA, 12 nt, Salmonella typhimurium LT2
ugaacaggguga

SEQ ID NO: 3763625 - RNA, 21 nt, Salmonella typhimurium LT2
ugaacagggugacucauuuca

SEQ ID NO: 3763626 - RNA, 18 nt, Salmonella typhimurium LT2
ugaacagucccaccagcg

SEQ ID NO: 3763627 - RNA, 21 nt, Salmonella typhimurium LT2
ugaacaguuucgccagcgcgg

SEQ ID NO: 3763628 - RNA, 20 nt, Salmonella typhimurium LT2
ugaacauacguuuaaagcgc

SEQ ID NO: 3763629 - RNA, 18 nt, Salmonella typhimurium LT2
ugaacauauccgcgcaaa

SEQ ID NO: 3763630 - RNA, 20 nt, Salmonella typhimurium LT2
ugaaccagcaucccacgaau

SEQ ID NO: 3763631 - RNA, 16 nt, Salmonella typhimurium LT2
ugaaccauaucaaaca

SEQ ID NO: 3763632 - RNA, 20 nt, Salmonella typhimurium LT2
ugaacccgaccgucuuuguc

SEQ ID NO: 3763633 - RNA, 20 nt, Salmonella typhimurium LT2
ugaaccgguaaagcagugca

SEQ ID NO: 3763634 - RNA, 20 nt, Salmonella typhimurium LT2
ugaaccgucgccuccagcga

SEQ ID NO: 3763635 - RNA, 20 nt, Salmonella typhimurium LT2
ugaaccuccugugaagacau

SEQ ID NO: 3763636 - RNA, 14 nt, Salmonella typhimurium LT2
ugaaccucuucacc

SEQ ID NO: 3763637 - RNA, 14 nt, Salmonella typhimurium LT2
ugaacgccaaauac

SEQ ID NO: 3763638 - RNA, 13 nt, Salmonella typhimurium LT2
ugaacgccaggcc

SEQ ID NO: 3763639 - RNA, 16 nt, Salmonella typhimurium LT2
ugaacggcucaaaaua

SEQ ID NO: 3763640 - RNA, 18 nt, Salmonella typhimurium LT2
ugaacggcucaaaauaau

SEQ ID NO: 3763641 - RNA, 22 nt, Salmonella typhimurium LT2
ugaacggggaucaaaauuaagc

SEQ ID NO: 3763642 - RNA, 21 nt, Salmonella typhimurium LT2
ugaacguuuuagcauguaagc

SEQ ID NO: 3763643 - RNA, 22 nt, Salmonella typhimurium LT2
ugaacuacgccccggcgcgcca

SEQ ID NO: 3763644 - RNA, 21 nt, Salmonella typhimurium LT2
ugaacucgacgccuucuucgu

SEQ ID NO: 3763645 - RNA, 17 nt, Salmonella typhimurium LT2
ugaacucgacuuuuucc

SEQ ID NO: 3763646 - RNA, 14 nt, Salmonella typhimurium LT2
ugaacucuuucaga

SEQ ID NO: 3763647 - RNA, 19 nt, Salmonella typhimurium LT2
ugaacugcccggagccaau

SEQ ID NO: 3763648 - RNA, 19 nt, Salmonella typhimurium LT2
ugaagaaaauacugauuaa

SEQ ID NO: 3763649 - RNA, 17 nt, Salmonella typhimurium LT2
ugaagaagucgaaggcg

SEQ ID NO: 3763650 - RNA, 18 nt, Salmonella typhimurium LT2
ugaagauaaacagcagcg

SEQ ID NO: 3763651 - RNA, 14 nt, Salmonella typhimurium LT2
ugacccucccugcg

SEQ ID NO: 3763652 - RNA, 20 nt, Salmonella typhimurium LT2
ugaccgaaccgcuguagucu

SEQ ID NO: 3763653 - RNA, 15 nt, Salmonella typhimurium LT2
ugaccgaagcaggcg

SEQ ID NO: 3763654 - RNA, 19 nt, Salmonella typhimurium LT2
ugaccgauuuguggcguua

SEQ ID NO: 3763655 - RNA, 16 nt, Salmonella typhimurium LT2
ugaccgcacagcagac

SEQ ID NO: 3763656 - RNA, 17 nt, Salmonella typhimurium LT2
ugaccgccgucauagca

SEQ ID NO: 3763657 - RNA, 14 nt, Salmonella typhimurium LT2
ugaccgcguugcca

SEQ ID NO: 3763658 - RNA, 18 nt, Salmonella typhimurium LT2
ugaccgguaagcccaugg

SEQ ID NO: 3763659 - RNA, 14 nt, Salmonella typhimurium LT2
ugaccuacaggccg

SEQ ID NO: 3763660 - RNA, 12 nt, Salmonella typhimurium LT2
ugaccucgccua

SEQ ID NO: 3763661 - RNA, 12 nt, Salmonella typhimurium LT2
ugaccugaacgc

SEQ ID NO: 3763662 - RNA, 18 nt, Salmonella typhimurium LT2
ugaccugcagcuccgcaa

SEQ ID NO: 3763663 - RNA, 15 nt, Salmonella typhimurium LT2
ugaccugcccauccu

SEQ ID NO: 3763664 - RNA, 15 nt, Salmonella typhimurium LT2
ugaccuuaauccagc

SEQ ID NO: 3763665 - RNA, 13 nt, Salmonella typhimurium LT2
ugacgaaaaaaga

SEQ ID NO: 3763666 - RNA, 21 nt, Salmonella typhimurium LT2
ugacgaaaacccgccaccauc

SEQ ID NO: 3763667 - RNA, 13 nt, Salmonella typhimurium LT2
ugacgaaacauua

SEQ ID NO: 3763668 - RNA, 20 nt, Salmonella typhimurium LT2
ugacgaauaccgugcacgcu

SEQ ID NO: 3763669 - RNA, 16 nt, Salmonella typhimurium LT2
ugacgaauagcgcgcu

SEQ ID NO: 3763670 - RNA, 15 nt, Salmonella typhimurium LT2
ugacgacccgcuucc

SEQ ID NO: 3763671 - RNA, 23 nt, Salmonella typhimurium LT2
ugacgagcagguuacucuuccac

SEQ ID NO: 3763672 - RNA, 23 nt, Salmonella typhimurium LT2
ugacgauaugcugccgauugccg

SEQ ID NO: 3763673 - RNA, 14 nt, Salmonella typhimurium LT2
ugacgauauuccgc

SEQ ID NO: 3763674 - RNA, 15 nt, Salmonella typhimurium LT2
ugacgaucaacagac

SEQ ID NO: 3763675 - RNA, 18 nt, Salmonella typhimurium LT2
ugacgauguucgucccug

SEQ ID NO: 3763676 - RNA, 19 nt, Salmonella typhimurium LT2
ugacgauuuuuaagcugcg

SEQ ID NO: 3763677 - RNA, 14 nt, Salmonella typhimurium LT2
ugacgcacaguguu

SEQ ID NO: 3763678 - RNA, 15 nt, Salmonella typhimurium LT2
ugacgcaccguggaa

SEQ ID NO: 3763679 - RNA, 14 nt, Salmonella typhimurium LT2
ugacgcagacguca

SEQ ID NO: 3763680 - RNA, 13 nt, Salmonella typhimurium LT2
ugacgcagcagcu

SEQ ID NO: 3763681 - RNA, 20 nt, Salmonella typhimurium LT2
ugacgcagcaucucaauauc

SEQ ID NO: 3763682 - RNA, 17 nt, Salmonella typhimurium LT2
ugacgccaagcugcaga

SEQ ID NO: 3763683 - RNA, 12 nt, Salmonella typhimurium LT2
ugacgccaggca

SEQ ID NO: 3763684 - RNA, 14 nt, Salmonella typhimurium LT2
ugacgcgaucgccg

SEQ ID NO: 3763685 - RNA, 15 nt, Salmonella typhimurium LT2
ugacgcgaucgccgu

SEQ ID NO: 3763686 - RNA, 16 nt, Salmonella typhimurium LT2
ugacgcguuaauaucc

SEQ ID NO: 3763687 - RNA, 22 nt, Salmonella typhimurium LT2
ugacgcuaaccucuauaguaaa

SEQ ID NO: 3763688 - RNA, 13 nt, Salmonella typhimurium LT2
ugacgcuaacgcg

SEQ ID NO: 3763689 - RNA, 14 nt, Salmonella typhimurium LT2
ugacgcuccugaau

SEQ ID NO: 3763690 - RNA, 14 nt, Salmonella typhimurium LT2
ugacgcuuugcauu

SEQ ID NO: 3763691 - RNA, 16 nt, Salmonella typhimurium LT2
ugacggaaaccagcau

SEQ ID NO: 3763692 - RNA, 19 nt, Salmonella typhimurium LT2
ugacggauucuuccucucg

SEQ ID NO: 3763693 - RNA, 23 nt, Salmonella typhimurium LT2
ugacggccugucuccgcagcagg

SEQ ID NO: 3763694 - RNA, 11 nt, Salmonella typhimurium LT2
ugacggcgcuc

SEQ ID NO: 3763695 - RNA, 16 nt, Salmonella typhimurium LT2
ugacggcgcugucacu

SEQ ID NO: 3763696 - RNA, 18 nt, Salmonella typhimurium LT2
ugacgggaaaucucccug

SEQ ID NO: 3763697 - RNA, 20 nt, Salmonella typhimurium LT2
ugacgggaaaucucccuggc

SEQ ID NO: 3763698 - RNA, 18 nt, Salmonella typhimurium LT2
ugacgggcggcuuccguu

SEQ ID NO: 3763699 - RNA, 21 nt, Salmonella typhimurium LT2
ugacgguagccguuuugcugu

SEQ ID NO: 3763700 - RNA, 16 nt, Salmonella typhimurium LT2
ugacggugauguuggc

SEQ ID NO: 3763701 - RNA, 15 nt, Salmonella typhimurium LT2
ugacgguuuauaugc

SEQ ID NO: 3763702 - RNA, 16 nt, Salmonella typhimurium LT2
ugacguaaaucugaaa

SEQ ID NO: 3763703 - RNA, 20 nt, Salmonella typhimurium LT2
ugacguaaaucugaaauaaa

SEQ ID NO: 3763704 - RNA, 16 nt, Salmonella typhimurium LT2
ugacguaaauucugau

SEQ ID NO: 3763705 - RNA, 18 nt, Salmonella typhimurium LT2
ugacguaaauucugauug

SEQ ID NO: 3763706 - RNA, 15 nt, Salmonella typhimurium LT2
ugacguaauaccgaa

SEQ ID NO: 3763707 - RNA, 16 nt, Salmonella typhimurium LT2
ugacguccaggccgua

SEQ ID NO: 3763708 - RNA, 19 nt, Salmonella typhimurium LT2
ugacguccaggccguagcg

SEQ ID NO: 3763709 - RNA, 18 nt, Salmonella typhimurium LT2
ugacguuaacgcagcauc

SEQ ID NO: 3763710 - RNA, 23 nt, Salmonella typhimurium LT2
ugacguugccgaccugucgauca

SEQ ID NO: 3763711 - RNA, 18 nt, Salmonella typhimurium LT2
ugacguuugcuucaggcg

SEQ ID NO: 3763712 - RNA, 16 nt, Salmonella typhimurium LT2
ugacucuguggccgcg

SEQ ID NO: 3763713 - RNA, 12 nt, Salmonella typhimurium LT2
ugacugaagacg

SEQ ID NO: 3763714 - RNA, 17 nt, Salmonella typhimurium LT2
ugacugaagauguucag

SEQ ID NO: 3763715 - RNA, 16 nt, Salmonella typhimurium LT2
ugacugaauuaucagg

SEQ ID NO: 3763716 - RNA, 17 nt, Salmonella typhimurium LT2
ugacugaauuuucagcc

SEQ ID NO: 3763717 - RNA, 13 nt, Salmonella typhimurium LT2
ugacugcugucau

SEQ ID NO: 3763718 - RNA, 19 nt, Salmonella typhimurium LT2
ugacugguuuguugcgucu

SEQ ID NO: 3763719 - RNA, 16 nt, Salmonella typhimurium LT2
ugacugucauuucuca

SEQ ID NO: 3763720 - RNA, 14 nt, Salmonella typhimurium LT2
ugacuuacaggcug

SEQ ID NO: 3763721 - RNA, 17 nt, Salmonella typhimurium LT2
ugacuuacgcacuguug

SEQ ID NO: 3763722 - RNA, 20 nt, Salmonella typhimurium LT2
ugacuucgcagcccaucgcg

SEQ ID NO: 3763723 - RNA, 12 nt, Salmonella typhimurium LT2
ugacuuuccagu

SEQ ID NO: 3763724 - RNA, 13 nt, Salmonella typhimurium LT2
ugagaaaaauacg

SEQ ID NO: 3763725 - RNA, 15 nt, Salmonella typhimurium LT2
ugagaaaaggaagaa

SEQ ID NO: 3763726 - RNA, 12 nt, Salmonella typhimurium LT2
ugagaaaaguaa

SEQ ID NO: 3763727 - RNA, 17 nt, Salmonella typhimurium LT2
ugagaaauagcgcgcca

SEQ ID NO: 3763728 - RNA, 18 nt, Salmonella typhimurium LT2
ugagaaauuauuuuaaau

SEQ ID NO: 3763729 - RNA, 12 nt, Salmonella typhimurium LT2
ugagaagaaaaa

SEQ ID NO: 3763730 - RNA, 14 nt, Salmonella typhimurium LT2
ugagaagggcagau

SEQ ID NO: 3763731 - RNA, 14 nt, Salmonella typhimurium LT2
ugagaauggcggga

SEQ ID NO: 3763732 - RNA, 19 nt, Salmonella typhimurium LT2
ugagaauuuccaguucaau

SEQ ID NO: 3763733 - RNA, 18 nt, Salmonella typhimurium LT2
ugagacccaaaggaggaa

SEQ ID NO: 3763734 - RNA, 22 nt, Salmonella typhimurium LT2
ugagacgcgaaacgaaacccaa

SEQ ID NO: 3763735 - RNA, 21 nt, Salmonella typhimurium LT2
ugagacguuauuagccggaua

SEQ ID NO: 3763736 - RNA, 16 nt, Salmonella typhimurium LT2
ugagauacugcgaucg

SEQ ID NO: 3763737 - RNA, 18 nt, Salmonella typhimurium LT2
ugagauauggcacuuuca

SEQ ID NO: 3763738 - RNA, 12 nt, Salmonella typhimurium LT2
ugagaucguuau

SEQ ID NO: 3763739 - RNA, 21 nt, Salmonella typhimurium LT2
ugagaugcaggccaagcagcg

SEQ ID NO: 3763740 - RNA, 14 nt, Salmonella typhimurium LT2
ugagauuacugcgu

SEQ ID NO: 3763741 - RNA, 14 nt, Salmonella typhimurium LT2
ugagcaaaaugcuc

SEQ ID NO: 3763742 - RNA, 18 nt, Salmonella typhimurium LT2
ugagcaaugcagaaguuu

SEQ ID NO: 3763743 - RNA, 15 nt, Salmonella typhimurium LT2
ugagcaaugggaagg

SEQ ID NO: 3763744 - RNA, 18 nt, Salmonella typhimurium LT2
ugagcaaugggaaggaaa

SEQ ID NO: 3763745 - RNA, 19 nt, Salmonella typhimurium LT2
ugagcagacauauuuucaa

SEQ ID NO: 3763746 - RNA, 20 nt, Salmonella typhimurium LT2
ugagcagaucagcacgcgcc

SEQ ID NO: 3763747 - RNA, 12 nt, Salmonella typhimurium LT2
ugagcagcgcga

SEQ ID NO: 3763748 - RNA, 13 nt, Salmonella typhimurium LT2
ugagcagcggcug

SEQ ID NO: 3763749 - RNA, 17 nt, Salmonella typhimurium LT2
ugagccaauuuaugccg

SEQ ID NO: 3763750 - RNA, 18 nt, Salmonella typhimurium LT2
ugagccagaugucgccag

SEQ ID NO: 3763751 - RNA, 14 nt, Salmonella typhimurium LT2
ugagccagugagcg

SEQ ID NO: 3763752 - RNA, 21 nt, Salmonella typhimurium LT2
ugagcgaacggcuuuccagca

SEQ ID NO: 3763753 - RNA, 15 nt, Salmonella typhimurium LT2
ugagcgccauaucgg

SEQ ID NO: 3763754 - RNA, 17 nt, Salmonella typhimurium LT2
ugagcgccaucaggaua

SEQ ID NO: 3763755 - RNA, 22 nt, Salmonella typhimurium LT2
ugagcgccuggacccacaagcc

SEQ ID NO: 3763756 - RNA, 21 nt, Salmonella typhimurium LT2
ugaucgggauuggaucgacgc

SEQ ID NO: 3763757 - RNA, 17 nt, Salmonella typhimurium LT2
ugaucgucgcgaucgcg

SEQ ID NO: 3763758 - RNA, 15 nt, Salmonella typhimurium LT2
ugaucguuucauuuu

SEQ ID NO: 3763759 - RNA, 15 nt, Salmonella typhimurium LT2
ugaucucaucgauca

SEQ ID NO: 3763760 - RNA, 21 nt, Salmonella typhimurium LT2
ugaucuccgcgcaaucgccga

SEQ ID NO: 3763761 - RNA, 12 nt, Salmonella typhimurium LT2
ugaucuugcuca

SEQ ID NO: 3763762 - RNA, 20 nt, Salmonella typhimurium LT2
ugaucuugcucaauaauacg

SEQ ID NO: 3763763 - RNA, 15 nt, Salmonella typhimurium LT2
ugaugacggcuggua

SEQ ID NO: 3763764 - RNA, 21 nt, Salmonella typhimurium LT2
ugaugacgggaucgaaccgcc

SEQ ID NO: 3763765 - RNA, 18 nt, Salmonella typhimurium LT2
ugaugagaugcaggccaa

SEQ ID NO: 3763766 - RNA, 14 nt, Salmonella typhimurium LT2
ugaugagcaauacc

SEQ ID NO: 3763767 - RNA, 14 nt, Salmonella typhimurium LT2
ugaugauaaccgcc

SEQ ID NO: 3763768 - RNA, 17 nt, Salmonella typhimurium LT2
ugaugaucaauaacgcc

SEQ ID NO: 3763769 - RNA, 14 nt, Salmonella typhimurium LT2
ugaugaucgcggua

SEQ ID NO: 3763770 - RNA, 13 nt, Salmonella typhimurium LT2
ugaugaugccagg

SEQ ID NO: 3763771 - RNA, 22 nt, Salmonella typhimurium LT2
ugaugauuaaugcugcaccaca

SEQ ID NO: 3763772 - RNA, 14 nt, Salmonella typhimurium LT2
ugaugauuacucuu

SEQ ID NO: 3763773 - RNA, 23 nt, Salmonella typhimurium LT2
ugaugauuacucuucauucaugc

SEQ ID NO: 3763774 - RNA, 16 nt, Salmonella typhimurium LT2
ugaugcaucagaacaa

SEQ ID NO: 3763775 - RNA, 20 nt, Salmonella typhimurium LT2
ugaugcaucagaacaaacuu

SEQ ID NO: 3763776 - RNA, 15 nt, Salmonella typhimurium LT2
ugaugccguuuucau

SEQ ID NO: 3763777 - RNA, 13 nt, Salmonella typhimurium LT2
ugaugccuggcag

SEQ ID NO: 3763778 - RNA, 14 nt, Salmonella typhimurium LT2
ugaugccuggcagu

SEQ ID NO: 3763779 - RNA, 21 nt, Salmonella typhimurium LT2
ugaugcuaacgcccucucucc

SEQ ID NO: 3763780 - RNA, 13 nt, Salmonella typhimurium LT2
ugaugcuugcucg

SEQ ID NO: 3763781 - RNA, 19 nt, Salmonella typhimurium LT2
ugauggagguuguuuuauu

SEQ ID NO: 3763782 - RNA, 15 nt, Salmonella typhimurium LT2
ugauggccacaucgu

SEQ ID NO: 3763783 - RNA, 17 nt, Salmonella typhimurium LT2
ugauggcgcagcgccau

SEQ ID NO: 3763784 - RNA, 19 nt, Salmonella typhimurium LT2
ugauggcgcagcgccauca

SEQ ID NO: 3763785 - RNA, 18 nt, Salmonella typhimurium LT2
ugauggcgcuaagccagc

SEQ ID NO: 3763786 - RNA, 20 nt, Salmonella typhimurium LT2
ugauggcgcuacgcuuauca

SEQ ID NO: 3763787 - RNA, 15 nt, Salmonella typhimurium LT2
ugauggcgcugccuu

SEQ ID NO: 3763788 - RNA, 13 nt, Salmonella typhimurium LT2
ugauggcgcugcg

SEQ ID NO: 3763789 - RNA, 17 nt, Salmonella typhimurium LT2
ugauggcguaauccgga

SEQ ID NO: 3763790 - RNA, 20 nt, Salmonella typhimurium LT2
ugauggcguaauuaaccgcg

SEQ ID NO: 3763791 - RNA, 18 nt, Salmonella typhimurium LT2
ugaugggcgcacagcgcc

SEQ ID NO: 3763792 - RNA, 13 nt, Salmonella typhimurium LT2
ugauggucuccag

SEQ ID NO: 3763793 - RNA, 21 nt, Salmonella typhimurium LT2
ugaugguuucggcaugccacu

SEQ ID NO: 3763794 - RNA, 13 nt, Salmonella typhimurium LT2
ugauguagucgcu

SEQ ID NO: 3763795 - RNA, 14 nt, Salmonella typhimurium LT2
ugaugucaauaacc

SEQ ID NO: 3763796 - RNA, 23 nt, Salmonella typhimurium LT2
ugauguccacacugacgcgccag

SEQ ID NO: 3763797 - RNA, 19 nt, Salmonella typhimurium LT2
ugauguccgcagccgcauu

SEQ ID NO: 3763798 - RNA, 21 nt, Salmonella typhimurium LT2
ugauguugugacgaaaaaaga

SEQ ID NO: 3763799 - RNA, 22 nt, Salmonella typhimurium LT2
ugauguuugugaccccggccuc

SEQ ID NO: 3763800 - RNA, 16 nt, Salmonella typhimurium LT2
ugauuaacagcgccau

SEQ ID NO: 3763801 - RNA, 22 nt, Salmonella typhimurium LT2
ugauuaaucagcucagcaacaa

SEQ ID NO: 3763802 - RNA, 14 nt, Salmonella typhimurium LT2
ugauuaaucgucau

SEQ ID NO: 3763803 - RNA, 18 nt, Salmonella typhimurium LT2
ugauuacugagaugacgc

SEQ ID NO: 3763804 - RNA, 16 nt, Salmonella typhimurium LT2
ugauucauacgcuuuc

SEQ ID NO: 3763805 - RNA, 19 nt, Salmonella typhimurium LT2
ugauucauucccauacugc

SEQ ID NO: 3763806 - RNA, 22 nt, Salmonella typhimurium LT2
ugauucgcccguuguccgccag

SEQ ID NO: 3763807 - RNA, 19 nt, Salmonella typhimurium LT2
ugauucguggcucaaggau

SEQ ID NO: 3763808 - RNA, 13 nt, Salmonella typhimurium LT2
ugauugaugcuug

SEQ ID NO: 3763809 - RNA, 13 nt, Salmonella typhimurium LT2
ugauugauuuugu

SEQ ID NO: 3763810 - RNA, 16 nt, Salmonella typhimurium LT2
ugauugcgacaggcug

SEQ ID NO: 3763811 - RNA, 16 nt, Salmonella typhimurium LT2
ugauuggcaaacugcc

SEQ ID NO: 3763812 - RNA, 11 nt, Salmonella typhimurium LT2
ugauuuccaga

SEQ ID NO: 3763813 - RNA, 12 nt, Salmonella typhimurium LT2
ugauuugccaga

SEQ ID NO: 3763814 - RNA, 18 nt, Salmonella typhimurium LT2
ugauuuucuccagcagac

SEQ ID NO: 3763815 - RNA, 12 nt, Salmonella typhimurium LT2
ugauuuuucauc

SEQ ID NO: 3763816 - RNA, 19 nt, Salmonella typhimurium LT2
ugauuuuuuaauucauaua

SEQ ID NO: 3763817 - RNA, 14 nt, Salmonella typhimurium LT2
ugcaaaaaaagaaa

SEQ ID NO: 3763818 - RNA, 16 nt, Salmonella typhimurium LT2
ugcaaaagacggcuuu

SEQ ID NO: 3763819 - RNA, 18 nt, Salmonella typhimurium LT2
ugcaaaaugcuucuucaa

SEQ ID NO: 3763820 - RNA, 11 nt, Salmonella typhimurium LT2
ugcaaauacca

SEQ ID NO: 3763821 - RNA, 13 nt, Salmonella typhimurium LT2
ugcaacagcacca

SEQ ID NO: 3763822 - RNA, 15 nt, Salmonella typhimurium LT2
ugcaacagcaccagc

SEQ ID NO: 3763823 - RNA, 19 nt, Salmonella typhimurium LT2
ugcaacagcaccagcaggu

SEQ ID NO: 3763824 - RNA, 16 nt, Salmonella typhimurium LT2
ugcaacaugcccaguu

SEQ ID NO: 3763825 - RNA, 23 nt, Salmonella typhimurium LT2
ugcaacccauauucgucuucauc

SEQ ID NO: 3763826 - RNA, 15 nt, Salmonella typhimurium LT2
ugcaacccgccgcca

SEQ ID NO: 3763827 - RNA, 17 nt, Salmonella typhimurium LT2
ugcaaccgcucuuuugc

SEQ ID NO: 3763828 - RNA, 23 nt, Salmonella typhimurium LT2
ugcaacgaucccuaauaaaauaa

SEQ ID NO: 3763829 - RNA, 19 nt, Salmonella typhimurium LT2
ugcaacuguugcgccagca

SEQ ID NO: 3763830 - RNA, 19 nt, Salmonella typhimurium LT2
ugcaacuucaccuucggug

SEQ ID NO: 3763831 - RNA, 19 nt, Salmonella typhimurium LT2
ugcaagccugauacuuuua

SEQ ID NO: 3763832 - RNA, 22 nt, Salmonella typhimurium LT2
ugcaagggaaucucuucacgau

SEQ ID NO: 3763833 - RNA, 21 nt, Salmonella typhimurium LT2
ugcaauaaaauauccuccacc

SEQ ID NO: 3763834 - RNA, 14 nt, Salmonella typhimurium LT2
ugcaauaucaauac

SEQ ID NO: 3763835 - RNA, 18 nt, Salmonella typhimurium LT2
ugcaauaucccucgaagu

SEQ ID NO: 3763836 - RNA, 16 nt, Salmonella typhimurium LT2
ugcaauauuuaagccc

SEQ ID NO: 3763837 - RNA, 20 nt, Salmonella typhimurium LT2
ugcaaucagcgaaggcaacu

SEQ ID NO: 3763838 - RNA, 23 nt, Salmonella typhimurium LT2
ugcaaucagcgaaggcaacugau

SEQ ID NO: 3763839 - RNA, 18 nt, Salmonella typhimurium LT2
ugcaaucuuuacccggcg

SEQ ID NO: 3763840 - RNA, 22 nt, Salmonella typhimurium LT2
ugcaaugccguuaccguucagg

SEQ ID NO: 3763841 - RNA, 15 nt, Salmonella typhimurium LT2
ugcaaugcgcuccag

SEQ ID NO: 3763842 - RNA, 19 nt, Salmonella typhimurium LT2
ugcaaugcgcuccagcuuc

SEQ ID NO: 3763843 - RNA, 13 nt, Salmonella typhimurium LT2
ugcaauggcaacg

SEQ ID NO: 3763844 - RNA, 15 nt, Salmonella typhimurium LT2
ugcaauguucaauau

SEQ ID NO: 3763845 - RNA, 16 nt, Salmonella typhimurium LT2
ugcaauguucaauauc

SEQ ID NO: 3763846 - RNA, 22 nt, Salmonella typhimurium LT2
ugcaauguucaauaucaaauug

SEQ ID NO: 3763847 - RNA, 13 nt, Salmonella typhimurium LT2
ugcaauuaauaua

SEQ ID NO: 3763848 - RNA, 15 nt, Salmonella typhimurium LT2
ugcaauuaauauauu

SEQ ID NO: 3763849 - RNA, 14 nt, Salmonella typhimurium LT2
ugcaauuccgccau

SEQ ID NO: 3763850 - RNA, 16 nt, Salmonella typhimurium LT2
ugcaauuguuccugcg

SEQ ID NO: 3763851 - RNA, 14 nt, Salmonella typhimurium LT2
ugcaauuuccccug

SEQ ID NO: 3763852 - RNA, 22 nt, Salmonella typhimurium LT2
ugcacaccccgcgccgcugaga

SEQ ID NO: 3763853 - RNA, 13 nt, Salmonella typhimurium LT2
ugcacagucugca

SEQ ID NO: 3763854 - RNA, 18 nt, Salmonella typhimurium LT2
ugcacaucgccauuaaaa

SEQ ID NO: 3763855 - RNA, 19 nt, Salmonella typhimurium LT2
ugcacauguuucagcaccu

SEQ ID NO: 3763856 - RNA, 12 nt, Salmonella typhimurium LT2
ugcaccaaaucc

SEQ ID NO: 3763857 - RNA, 18 nt, Salmonella typhimurium LT2
ugcaccaaucaucacgua

SEQ ID NO: 3763858 - RNA, 22 nt, Salmonella typhimurium LT2
ugcaccacccgguuauaacgcg

SEQ ID NO: 3763859 - RNA, 17 nt, Salmonella typhimurium LT2
ugcacccggagagaaac

SEQ ID NO: 3763860 - RNA, 15 nt, Salmonella typhimurium LT2
ugccgccauuuuauc

SEQ ID NO: 3763861 - RNA, 13 nt, Salmonella typhimurium LT2
ugccgcccaccug

SEQ ID NO: 3763862 - RNA, 15 nt, Salmonella typhimurium LT2
ugccgcccaggccug

SEQ ID NO: 3763863 - RNA, 16 nt, Salmonella typhimurium LT2
ugccgcccaggccuga

SEQ ID NO: 3763864 - RNA, 20 nt, Salmonella typhimurium LT2
ugccgcccagggaaagauca

SEQ ID NO: 3763865 - RNA, 14 nt, Salmonella typhimurium LT2
ugccgcccauccag

SEQ ID NO: 3763866 - RNA, 15 nt, Salmonella typhimurium LT2
ugccgcccguacaga

SEQ ID NO: 3763867 - RNA, 22 nt, Salmonella typhimurium LT2
ugccgcccguacagacaucauc

SEQ ID NO: 3763868 - RNA, 21 nt, Salmonella typhimurium LT2
ugccgccgacaaccagcgaaa

SEQ ID NO: 3763869 - RNA, 19 nt, Salmonella typhimurium LT2
ugccgccgcgaugcaucuu

SEQ ID NO: 3763870 - RNA, 21 nt, Salmonella typhimurium LT2
ugccgccggcuucuuccggcc

SEQ ID NO: 3763871 - RNA, 23 nt, Salmonella typhimurium LT2
ugccgccgucaucugcgccgaca

SEQ ID NO: 3763872 - RNA, 16 nt, Salmonella typhimurium LT2
ugccgccgucgcggcu

SEQ ID NO: 3763873 - RNA, 22 nt, Salmonella typhimurium LT2
ugccgccuccagcauacugaug

SEQ ID NO: 3763874 - RNA, 17 nt, Salmonella typhimurium LT2
ugccgccugccgcgccg

SEQ ID NO: 3763875 - RNA, 21 nt, Salmonella typhimurium LT2
ugccgcggcuucaucaccauc

SEQ ID NO: 3763876 - RNA, 22 nt, Salmonella typhimurium LT2
ugccgcuggugcuacgggcgcu

SEQ ID NO: 3763877 - RNA, 16 nt, Salmonella typhimurium LT2
ugccgcugucgccaga

SEQ ID NO: 3763878 - RNA, 18 nt, Salmonella typhimurium LT2
ugccggaaaccuguuccc

SEQ ID NO: 3763879 - RNA, 19 nt, Salmonella typhimurium LT2
ugccggacggcggcugcga

SEQ ID NO: 3763880 - RNA, 19 nt, Salmonella typhimurium LT2
ugccggauggcggcgucgc

SEQ ID NO: 3763881 - RNA, 22 nt, Salmonella typhimurium LT2
ugccggauggcggcugaugccc

SEQ ID NO: 3763882 - RNA, 23 nt, Salmonella typhimurium LT2
ugccggauggcgguauaacugcc

SEQ ID NO: 3763883 - RNA, 14 nt, Salmonella typhimurium LT2
ugccggauuuuuca

SEQ ID NO: 3763884 - RNA, 21 nt, Salmonella typhimurium LT2
ugccggccugauauccacguu

SEQ ID NO: 3763885 - RNA, 16 nt, Salmonella typhimurium LT2
ugccgggaaaacggcc

SEQ ID NO: 3763886 - RNA, 14 nt, Salmonella typhimurium LT2
ugccgggagcagau

SEQ ID NO: 3763887 - RNA, 15 nt, Salmonella typhimurium LT2
ugccgggccuggcau

SEQ ID NO: 3763888 - RNA, 11 nt, Salmonella typhimurium LT2
ugccggguuaa

SEQ ID NO: 3763889 - RNA, 13 nt, Salmonella typhimurium LT2
ugccggucggcgu

SEQ ID NO: 3763890 - RNA, 18 nt, Salmonella typhimurium LT2
ugccggugaauaccgaac

SEQ ID NO: 3763891 - RNA, 14 nt, Salmonella typhimurium LT2
ugccgguuggccgg

SEQ ID NO: 3763892 - RNA, 15 nt, Salmonella typhimurium LT2
ugccgguuggccggc

SEQ ID NO: 3763893 - RNA, 22 nt, Salmonella typhimurium LT2
ugccguacgcggcuugccaagc

SEQ ID NO: 3763894 - RNA, 14 nt, Salmonella typhimurium LT2
ugccguagcgcgcu

SEQ ID NO: 3763895 - RNA, 17 nt, Salmonella typhimurium LT2
ugccguauaauccagcu

SEQ ID NO: 3763896 - RNA, 17 nt, Salmonella typhimurium LT2
ugccguauaccagcguc

SEQ ID NO: 3763897 - RNA, 16 nt, Salmonella typhimurium LT2
ugccgucaucagcaag

SEQ ID NO: 3763898 - RNA, 18 nt, Salmonella typhimurium LT2
ugccguccugaucaaggc

SEQ ID NO: 3763899 - RNA, 18 nt, Salmonella typhimurium LT2
ugccgucgaucucaggcu

SEQ ID NO: 3763900 - RNA, 18 nt, Salmonella typhimurium LT2
ugccgugcauguccagac

SEQ ID NO: 3763901 - RNA, 12 nt, Salmonella typhimurium LT2
ugccgugccggg

SEQ ID NO: 3763902 - RNA, 18 nt, Salmonella typhimurium LT2
ugccguguaaggcaaucg

SEQ ID NO: 3763903 - RNA, 19 nt, Salmonella typhimurium LT2
ugccguuauacaucgcuuu

SEQ ID NO: 3763904 - RNA, 21 nt, Salmonella typhimurium LT2
ugccguuuuaacgucaucacc

SEQ ID NO: 3763905 - RNA, 17 nt, Salmonella typhimurium LT2
ugccguuuuccagccgu

SEQ ID NO: 3763906 - RNA, 19 nt, Salmonella typhimurium LT2
ugccuaacuggaaaaagac

SEQ ID NO: 3763907 - RNA, 14 nt, Salmonella typhimurium LT2
ugccuacgcggcca

SEQ ID NO: 3763908 - RNA, 15 nt, Salmonella typhimurium LT2
ugccucacccugaaa

SEQ ID NO: 3763909 - RNA, 15 nt, Salmonella typhimurium LT2
ugccucauuaaaaaa

SEQ ID NO: 3763910 - RNA, 19 nt, Salmonella typhimurium LT2
ugccucauuaaaaaaacau

SEQ ID NO: 3763911 - RNA, 17 nt, Salmonella typhimurium LT2
ugccucccguuucagug

SEQ ID NO: 3763912 - RNA, 14 nt, Salmonella typhimurium LT2
ugccucgaaaauau

SEQ ID NO: 3763913 - RNA, 17 nt, Salmonella typhimurium LT2
ugccucguuucccucau

SEQ ID NO: 3763914 - RNA, 18 nt, Salmonella typhimurium LT2
ugccugaccggcauuuuc

SEQ ID NO: 3763915 - RNA, 20 nt, Salmonella typhimurium LT2
ugccugacgaaaacccgcca

SEQ ID NO: 3763916 - RNA, 14 nt, Salmonella typhimurium LT2
ugccugacgccacc

SEQ ID NO: 3763917 - RNA, 15 nt, Salmonella typhimurium LT2
ugccugauggcgcga

SEQ ID NO: 3763918 - RNA, 14 nt, Salmonella typhimurium LT2
ugccugccgccucc

SEQ ID NO: 3763919 - RNA, 15 nt, Salmonella typhimurium LT2
ugccugccgccucca

SEQ ID NO: 3763920 - RNA, 21 nt, Salmonella typhimurium LT2
ugccugccggauuuuucauag

SEQ ID NO: 3763921 - RNA, 22 nt, Salmonella typhimurium LT2
ugccugccgucgcggcuuucag

SEQ ID NO: 3763922 - RNA, 22 nt, Salmonella typhimurium LT2
ugccugcgcuuacggccauggg

SEQ ID NO: 3763923 - RNA, 15 nt, Salmonella typhimurium LT2
ugccuggagccagcc

SEQ ID NO: 3763924 - RNA, 12 nt, Salmonella typhimurium LT2
ugccuggcaguu

SEQ ID NO: 3763925 - RNA, 18 nt, Salmonella typhimurium LT2
ugccugucgucaccugua

SEQ ID NO: 3763926 - RNA, 18 nt, Salmonella typhimurium LT2
ugccugugcgaagcgccc

SEQ ID NO: 3763927 - RNA, 18 nt, Salmonella typhimurium LT2
ugccuguguaucgcccug

SEQ ID NO: 3763928 - RNA, 21 nt, Salmonella typhimurium LT2
ugccuguucgugcguugucag

SEQ ID NO: 3763929 - RNA, 18 nt, Salmonella typhimurium LT2
ugccuguuuacggcaggc

SEQ ID NO: 3763930 - RNA, 16 nt, Salmonella typhimurium LT2
ugccuuauccggccua

SEQ ID NO: 3763931 - RNA, 16 nt, Salmonella typhimurium LT2
ugccuuauucacagcg

SEQ ID NO: 3763932 - RNA, 17 nt, Salmonella typhimurium LT2
ugccuucgaagaauucc

SEQ ID NO: 3763933 - RNA, 22 nt, Salmonella typhimurium LT2
ugccuucgaagaauuccaccuu

SEQ ID NO: 3763934 - RNA, 14 nt, Salmonella typhimurium LT2
ugccuucgccgccg

SEQ ID NO: 3763935 - RNA, 16 nt, Salmonella typhimurium LT2
ugccuugcgaauggag

SEQ ID NO: 3763936 - RNA, 12 nt, Salmonella typhimurium LT2
ugccuuucagau

SEQ ID NO: 3763937 - RNA, 14 nt, Salmonella typhimurium LT2
ugccuuucgccagc

SEQ ID NO: 3763938 - RNA, 16 nt, Salmonella typhimurium LT2
ugccuuuggcaaucau

SEQ ID NO: 3763939 - RNA, 15 nt, Salmonella typhimurium LT2
ugccuuuggccugga

SEQ ID NO: 3763940 - RNA, 18 nt, Salmonella typhimurium LT2
ugcgaaaauacucccggc

SEQ ID NO: 3763941 - RNA, 16 nt, Salmonella typhimurium LT2
ugcgaaacaggcggca

SEQ ID NO: 3763942 - RNA, 21 nt, Salmonella typhimurium LT2
ugcgaaauuuaauauaugaac

SEQ ID NO: 3763943 - RNA, 22 nt, Salmonella typhimurium LT2
ugcgaacagcgcuccacgcguc

SEQ ID NO: 3763944 - RNA, 17 nt, Salmonella typhimurium LT2
ugcgaacauuucagcgc

SEQ ID NO: 3763945 - RNA, 21 nt, Salmonella typhimurium LT2
ugcgaacgauaccauccccuu

SEQ ID NO: 3763946 - RNA, 15 nt, Salmonella typhimurium LT2
ugcgaauaaacacau

SEQ ID NO: 3763947 - RNA, 16 nt, Salmonella typhimurium LT2
ugcgaauaacaucauc

SEQ ID NO: 3763948 - RNA, 18 nt, Salmonella typhimurium LT2
ugcgaauaacaucauccg

SEQ ID NO: 3763949 - RNA, 24 nt, Salmonella typhimurium LT2
ugcgaauaaucgccggacggcgca

SEQ ID NO: 3763950 - RNA, 21 nt, Salmonella typhimurium LT2
ugcgaauggagaagcgcgccu

SEQ ID NO: 3763951 - RNA, 18 nt, Salmonella typhimurium LT2
ugcgacaacucgacuuuu

SEQ ID NO: 3763952 - RNA, 17 nt, Salmonella typhimurium LT2
ugcgacacgcugcauau

SEQ ID NO: 3763953 - RNA, 12 nt, Salmonella typhimurium LT2
ugcgacagauac

SEQ ID NO: 3763954 - RNA, 21 nt, Salmonella typhimurium LT2
ugcgacaucagccagccgcca

SEQ ID NO: 3763955 - RNA, 23 nt, Salmonella typhimurium LT2
ugcgacgguaaaaauaucugaau

SEQ ID NO: 3763956 - RNA, 21 nt, Salmonella typhimurium LT2
ugcgacucggugccgcugcug

SEQ ID NO: 3763957 - RNA, 13 nt, Salmonella typhimurium LT2
ugcgacugcccaa

SEQ ID NO: 3763958 - RNA, 17 nt, Salmonella typhimurium LT2
ugcgacugcccaacagc

SEQ ID NO: 3763959 - RNA, 18 nt, Salmonella typhimurium LT2
ugcgacuuugcgccggca

SEQ ID NO: 3763960 - RNA, 11 nt, Salmonella typhimurium LT2
ugcgagaaaaa

SEQ ID NO: 3763961 - RNA, 16 nt, Salmonella typhimurium LT2
ugcgagcgucagucac

SEQ ID NO: 3763962 - RNA, 17 nt, Salmonella typhimurium LT2
ugcgaggucaccgggcg

SEQ ID NO: 3763963 - RNA, 18 nt, Salmonella typhimurium LT2
ugcgaggucaccgggcga

SEQ ID NO: 3763964 - RNA, 15 nt, Salmonella typhimurium LT2
ugcgcuuccagcaug

SEQ ID NO: 3763965 - RNA, 22 nt, Salmonella typhimurium LT2
ugcgcuucgaugcguucaaaaa

SEQ ID NO: 3763966 - RNA, 22 nt, Salmonella typhimurium LT2
ugcgcuuuagcguaggccacaa

SEQ ID NO: 3763967 - RNA, 15 nt, Salmonella typhimurium LT2
ugcgcuuucagcgca

SEQ ID NO: 3763968 - RNA, 17 nt, Salmonella typhimurium LT2
ugcggaauacacgaaca

SEQ ID NO: 3763969 - RNA, 20 nt, Salmonella typhimurium LT2
ugcggaauaugagcacagcc

SEQ ID NO: 3763970 - RNA, 20 nt, Salmonella typhimurium LT2
ugcggaauuaaacgccgccu

SEQ ID NO: 3763971 - RNA, 13 nt, Salmonella typhimurium LT2
ugcggauagucau

SEQ ID NO: 3763972 - RNA, 15 nt, Salmonella typhimurium LT2
ugcggaugcgccauc

SEQ ID NO: 3763973 - RNA, 21 nt, Salmonella typhimurium LT2
ugcggauuaucguccggcauc

SEQ ID NO: 3763974 - RNA, 21 nt, Salmonella typhimurium LT2
ugcggauuuuucgccaguaag

SEQ ID NO: 3763975 - RNA, 19 nt, Salmonella typhimurium LT2
ugcggcacacagccaaaau

SEQ ID NO: 3763976 - RNA, 23 nt, Salmonella typhimurium LT2
ugcggcacacagccaaaauaugc

SEQ ID NO: 3763977 - RNA, 19 nt, Salmonella typhimurium LT2
ugcggcacgagcacugugg

SEQ ID NO: 3763978 - RNA, 23 nt, Salmonella typhimurium LT2
ugcggcauagccuaucgggacga

SEQ ID NO: 3763979 - RNA, 13 nt, Salmonella typhimurium LT2
ugcggcaucagau

SEQ ID NO: 3763980 - RNA, 13 nt, Salmonella typhimurium LT2
ugcggcauccggc

SEQ ID NO: 3763981 - RNA, 18 nt, Salmonella typhimurium LT2
ugcggcauuagcaugggc

SEQ ID NO: 3763982 - RNA, 20 nt, Salmonella typhimurium LT2
ugcggccaugaucgccgcca

SEQ ID NO: 3763983 - RNA, 14 nt, Salmonella typhimurium LT2
ugcggcgcagggcg

SEQ ID NO: 3763984 - RNA, 21 nt, Salmonella typhimurium LT2
ugcggcgccaggacaacgccg

SEQ ID NO: 3763985 - RNA, 15 nt, Salmonella typhimurium LT2
ugcggcgccaucaau

SEQ ID NO: 3763986 - RNA, 17 nt, Salmonella typhimurium LT2
ugcggcgcgcccggcaa

SEQ ID NO: 3763987 - RNA, 22 nt, Salmonella typhimurium LT2
ugcggcggacgccgggugaucg

SEQ ID NO: 3763988 - RNA, 23 nt, Salmonella typhimurium LT2
ugcggcggggauaaucagcagcg

SEQ ID NO: 3763989 - RNA, 22 nt, Salmonella typhimurium LT2
ugcggcguacugcaacgcgcau

SEQ ID NO: 3763990 - RNA, 15 nt, Salmonella typhimurium LT2
ugcggcgugcggcug

SEQ ID NO: 3763991 - RNA, 19 nt, Salmonella typhimurium LT2
ugcggcuguguucauccca

SEQ ID NO: 3763992 - RNA, 15 nt, Salmonella typhimurium LT2
ugcggcuuacccuga

SEQ ID NO: 3763993 - RNA, 16 nt, Salmonella typhimurium LT2
ugcggcuucagcgaca

SEQ ID NO: 3763994 - RNA, 17 nt, Salmonella typhimurium LT2
ugcggcuuuaaguuuuu

SEQ ID NO: 3763995 - RNA, 23 nt, Salmonella typhimurium LT2
ugcgggaaauaccauccgcgccg

SEQ ID NO: 3763996 - RNA, 16 nt, Salmonella typhimurium LT2
ugcgggagaucggcug

SEQ ID NO: 3763997 - RNA, 19 nt, Salmonella typhimurium LT2
ugcggggagcgaaaaggcc

SEQ ID NO: 3763998 - RNA, 14 nt, Salmonella typhimurium LT2
ugcggguucauccg

SEQ ID NO: 3763999 - RNA, 21 nt, Salmonella typhimurium LT2
ugcgguaugcguugcaaauau

SEQ ID NO: 3764000 - RNA, 15 nt, Salmonella typhimurium LT2
ugcggucuccugaac

SEQ ID NO: 3764001 - RNA, 20 nt, Salmonella typhimurium LT2
ugcggugagaaacgcgccac

SEQ ID NO: 3764002 - RNA, 18 nt, Salmonella typhimurium LT2
ugcgguuacguccggcau

SEQ ID NO: 3764003 - RNA, 22 nt, Salmonella typhimurium LT2
ugcguaaagaucugcgccgccg

SEQ ID NO: 3764004 - RNA, 21 nt, Salmonella typhimurium LT2
ugcguaauacggagcaaaaaa

SEQ ID NO: 3764005 - RNA, 21 nt, Salmonella typhimurium LT2
ugcguaaucuuuucauauuau

SEQ ID NO: 3764006 - RNA, 19 nt, Salmonella typhimurium LT2
ugcguaaugagcgucgcca

SEQ ID NO: 3764007 - RNA, 18 nt, Salmonella typhimurium LT2
ugcguaauguugauauca

SEQ ID NO: 3764008 - RNA, 19 nt, Salmonella typhimurium LT2
ugcguacaaucgcguuuuc

SEQ ID NO: 3764009 - RNA, 18 nt, Salmonella typhimurium LT2
ugcguaccugcggcgcuu

SEQ ID NO: 3764010 - RNA, 21 nt, Salmonella typhimurium LT2
ugcguaccugcggcgcuuugc

SEQ ID NO: 3764011 - RNA, 19 nt, Salmonella typhimurium LT2
ugcguagacaaugcaggcc

SEQ ID NO: 3764012 - RNA, 16 nt, Salmonella typhimurium LT2
ugcguagcaccaguac

SEQ ID NO: 3764013 - RNA, 14 nt, Salmonella typhimurium LT2
ugcguauccagcgc

SEQ ID NO: 3764014 - RNA, 15 nt, Salmonella typhimurium LT2
ugcguaucguaagcc

SEQ ID NO: 3764015 - RNA, 15 nt, Salmonella typhimurium LT2
ugcguauuuuuauuu

SEQ ID NO: 3764016 - RNA, 21 nt, Salmonella typhimurium LT2
ugcguauuuuucguaagccgc

SEQ ID NO: 3764017 - RNA, 15 nt, Salmonella typhimurium LT2
ugcgucaccgggcug

SEQ ID NO: 3764018 - RNA, 18 nt, Salmonella typhimurium LT2
ugcgucagauaaaaugag

SEQ ID NO: 3764019 - RNA, 19 nt, Salmonella typhimurium LT2
ugcgucaucauccgguaau

SEQ ID NO: 3764020 - RNA, 13 nt, Salmonella typhimurium LT2
ugcgucccagcac

SEQ ID NO: 3764021 - RNA, 17 nt, Salmonella typhimurium LT2
ugcgucgccccaaucgc

SEQ ID NO: 3764022 - RNA, 15 nt, Salmonella typhimurium LT2
ugcgucgcuuccugu

SEQ ID NO: 3764023 - RNA, 19 nt, Salmonella typhimurium LT2
ugcgucggguggcaucuga

SEQ ID NO: 3764024 - RNA, 17 nt, Salmonella typhimurium LT2
ugcgugacaaucuccuc

SEQ ID NO: 3764025 - RNA, 19 nt, Salmonella typhimurium LT2
ugcgugagcaggggccgga

SEQ ID NO: 3764026 - RNA, 15 nt, Salmonella typhimurium LT2
ugcgugaugcaucag

SEQ ID NO: 3764027 - RNA, 18 nt, Salmonella typhimurium LT2
ugcgugaugcaucagaac

SEQ ID NO: 3764028 - RNA, 13 nt, Salmonella typhimurium LT2
ugcgugcgcgcca

SEQ ID NO: 3764029 - RNA, 21 nt, Salmonella typhimurium LT2
ugcguggcgcugggccgacgu

SEQ ID NO: 3764030 - RNA, 14 nt, Salmonella typhimurium LT2
ugcguggucauccg

SEQ ID NO: 3764031 - RNA, 23 nt, Salmonella typhimurium LT2
ugcguuaaacgcugugaccagua

SEQ ID NO: 3764032 - RNA, 23 nt, Salmonella typhimurium LT2
ugcguuaacggcuucguuucaga

SEQ ID NO: 3764033 - RNA, 14 nt, Salmonella typhimurium LT2
ugcguuacaggaca

SEQ ID NO: 3764034 - RNA, 16 nt, Salmonella typhimurium LT2
ugcguucauggcgcga

SEQ ID NO: 3764035 - RNA, 22 nt, Salmonella typhimurium LT2
ugcguuccgcucagcgucacuc

SEQ ID NO: 3764036 - RNA, 12 nt, Salmonella typhimurium LT2
ugcguucuucca

SEQ ID NO: 3764037 - RNA, 13 nt, Salmonella typhimurium LT2
ugcguucuuccac

SEQ ID NO: 3764038 - RNA, 23 nt, Salmonella typhimurium LT2
ugcguuggaaauacguuaacccg

SEQ ID NO: 3764039 - RNA, 20 nt, Salmonella typhimurium LT2
ugcguuggcucgcugccaaa

SEQ ID NO: 3764040 - RNA, 14 nt, Salmonella typhimurium LT2
ugcuacgccugccu

SEQ ID NO: 3764041 - RNA, 13 nt, Salmonella typhimurium LT2
ugcuacgcgccag

SEQ ID NO: 3764042 - RNA, 23 nt, Salmonella typhimurium LT2
ugcuaguagcggaauaucuuccc

SEQ ID NO: 3764043 - RNA, 19 nt, Salmonella typhimurium LT2
ugcuaguggauaaacauua

SEQ ID NO: 3764044 - RNA, 21 nt, Salmonella typhimurium LT2
ugcuauaugcaggcauaaaaa

SEQ ID NO: 3764045 - RNA, 19 nt, Salmonella typhimurium LT2
ugcuaucaaacugaaaauc

SEQ ID NO: 3764046 - RNA, 14 nt, Salmonella typhimurium LT2
ugcuaucccaggcg

SEQ ID NO: 3764047 - RNA, 17 nt, Salmonella typhimurium LT2
ugcuaucgucgcgcaau

SEQ ID NO: 3764048 - RNA, 23 nt, Salmonella typhimurium LT2
ugcuaugccugaaagcaaguauc

SEQ ID NO: 3764049 - RNA, 14 nt, Salmonella typhimurium LT2
ugcuauucagcagu

SEQ ID NO: 3764050 - RNA, 19 nt, Salmonella typhimurium LT2
ugcuauucagcaguucauu

SEQ ID NO: 3764051 - RNA, 19 nt, Salmonella typhimurium LT2
ugcuauugaaaaaaccgcc

SEQ ID NO: 3764052 - RNA, 21 nt, Salmonella typhimurium LT2
ugcucaaaaagcucaagcgca

SEQ ID NO: 3764053 - RNA, 21 nt, Salmonella typhimurium LT2
ugcucaacauacgggcuuuug

SEQ ID NO: 3764054 - RNA, 13 nt, Salmonella typhimurium LT2
ugcucaauauuau

SEQ ID NO: 3764055 - RNA, 14 nt, Salmonella typhimurium LT2
ugcucaaucgccug

SEQ ID NO: 3764056 - RNA, 11 nt, Salmonella typhimurium LT2
ugcucaaugau

SEQ ID NO: 3764057 - RNA, 12 nt, Salmonella typhimurium LT2
ugcucagccccu

SEQ ID NO: 3764058 - RNA, 17 nt, Salmonella typhimurium LT2
ugcucaggcugaccguc

SEQ ID NO: 3764059 - RNA, 23 nt, Salmonella typhimurium LT2
ugcucagguaggugauaagcagg

SEQ ID NO: 3764060 - RNA, 22 nt, Salmonella typhimurium LT2
ugcucauaacccuccugccuuu

SEQ ID NO: 3764061 - RNA, 20 nt, Salmonella typhimurium LT2
ugcucauccaacugcgccug

SEQ ID NO: 3764062 - RNA, 21 nt, Salmonella typhimurium LT2
ugcucaugacaucgcccuggg

SEQ ID NO: 3764063 - RNA, 14 nt, Salmonella typhimurium LT2
ugcucauugccuuu

SEQ ID NO: 3764064 - RNA, 21 nt, Salmonella typhimurium LT2
ugcucauugccuuucaauacu

SEQ ID NO: 3764065 - RNA, 20 nt, Salmonella typhimurium LT2
ugcuccagcccgaaaggaca

SEQ ID NO: 3764066 - RNA, 16 nt, Salmonella typhimurium LT2
ugcuccaguuguucca

SEQ ID NO: 3764067 - RNA, 20 nt, Salmonella typhimurium LT2
uggaaguugaagaaaaaccc

SEQ ID NO: 3764068 - RNA, 14 nt, Salmonella typhimurium LT2
uggaauaccacauc

SEQ ID NO: 3764069 - RNA, 16 nt, Salmonella typhimurium LT2
uggaaucuaccgccau

SEQ ID NO: 3764070 - RNA, 16 nt, Salmonella typhimurium LT2
uggaauguucuccucu

SEQ ID NO: 3764071 - RNA, 23 nt, Salmonella typhimurium LT2
uggacaacauuucgcacccuguc

SEQ ID NO: 3764072 - RNA, 17 nt, Salmonella typhimurium LT2
uggacaaggaucguuac

SEQ ID NO: 3764073 - RNA, 19 nt, Salmonella typhimurium LT2
uggacaaguaaaccgguca

SEQ ID NO: 3764074 - RNA, 20 nt, Salmonella typhimurium LT2
uggacagggucgauucccag

SEQ ID NO: 3764075 - RNA, 13 nt, Salmonella typhimurium LT2
uggacgcguucca

SEQ ID NO: 3764076 - RNA, 16 nt, Salmonella typhimurium LT2
uggacggcaucaggaa

SEQ ID NO: 3764077 - RNA, 14 nt, Salmonella typhimurium LT2
uggacgucaugccg

SEQ ID NO: 3764078 - RNA, 21 nt, Salmonella typhimurium LT2
uggacguggguuucaauauag

SEQ ID NO: 3764079 - RNA, 15 nt, Salmonella typhimurium LT2
uggacuaugcuccag

SEQ ID NO: 3764080 - RNA, 16 nt, Salmonella typhimurium LT2
uggagacacuucagcc

SEQ ID NO: 3764081 - RNA, 21 nt, Salmonella typhimurium LT2
uggagacacuucagccggaua

SEQ ID NO: 3764082 - RNA, 16 nt, Salmonella typhimurium LT2
uggagacagaacagga

SEQ ID NO: 3764083 - RNA, 20 nt, Salmonella typhimurium LT2
uggagagcaucaucugccau

SEQ ID NO: 3764084 - RNA, 19 nt, Salmonella typhimurium LT2
uggagagcgauaaacucag

SEQ ID NO: 3764085 - RNA, 19 nt, Salmonella typhimurium LT2
uggagaggccaccagcgcc

SEQ ID NO: 3764086 - RNA, 14 nt, Salmonella typhimurium LT2
uggagcgagcuggu

SEQ ID NO: 3764087 - RNA, 15 nt, Salmonella typhimurium LT2
uggaggaacagcgcc

SEQ ID NO: 3764088 - RNA, 16 nt, Salmonella typhimurium LT2
uggaggguaagaaagu

SEQ ID NO: 3764089 - RNA, 13 nt, Salmonella typhimurium LT2
uggagguuguuuu

SEQ ID NO: 3764090 - RNA, 15 nt, Salmonella typhimurium LT2
uggagguuucuucau

SEQ ID NO: 3764091 - RNA, 19 nt, Salmonella typhimurium LT2
uggagguuucuucaucaaa

SEQ ID NO: 3764092 - RNA, 18 nt, Salmonella typhimurium LT2
uggaguagauguagcuga

SEQ ID NO: 3764093 - RNA, 17 nt, Salmonella typhimurium LT2
uggagucuaaaaauaau

SEQ ID NO: 3764094 - RNA, 18 nt, Salmonella typhimurium LT2
uggagucuaaaaauaauu

SEQ ID NO: 3764095 - RNA, 23 nt, Salmonella typhimurium LT2
uggaguuuaaacacucuccacca

SEQ ID NO: 3764096 - RNA, 18 nt, Salmonella typhimurium LT2
uggauaaagccaauggug

SEQ ID NO: 3764097 - RNA, 13 nt, Salmonella typhimurium LT2
uggauaaggcgug

SEQ ID NO: 3764098 - RNA, 16 nt, Salmonella typhimurium LT2
uggauacguuccagca

SEQ ID NO: 3764099 - RNA, 20 nt, Salmonella typhimurium LT2
uggauagcaccauaaacggc

SEQ ID NO: 3764100 - RNA, 21 nt, Salmonella typhimurium LT2
uggauagcaccauaaacggca

SEQ ID NO: 3764101 - RNA, 17 nt, Salmonella typhimurium LT2
uggauagucaggcgaug

SEQ ID NO: 3764102 - RNA, 15 nt, Salmonella typhimurium LT2
uggauagucuucaag

SEQ ID NO: 3764103 - RNA, 22 nt, Salmonella typhimurium LT2
uggauauaacauuuuuguaaua

SEQ ID NO: 3764104 - RNA, 15 nt, Salmonella typhimurium LT2
uggauauccagcaua

SEQ ID NO: 3764105 - RNA, 20 nt, Salmonella typhimurium LT2
uggaucacuuuugccgucag

SEQ ID NO: 3764106 - RNA, 14 nt, Salmonella typhimurium LT2
uggaucaggcgcuu

SEQ ID NO: 3764107 - RNA, 14 nt, Salmonella typhimurium LT2
uggaucggcuugcc

SEQ ID NO: 3764108 - RNA, 14 nt, Salmonella typhimurium LT2
uggaugaacucaau

SEQ ID NO: 3764109 - RNA, 23 nt, Salmonella typhimurium LT2
uggaugaacucaauccauuccga

SEQ ID NO: 3764110 - RNA, 20 nt, Salmonella typhimurium LT2
uggauggcuuccguuagcgu

SEQ ID NO: 3764111 - RNA, 22 nt, Salmonella typhimurium LT2
uggauggucucuucgcuggcgg

SEQ ID NO: 3764112 - RNA, 22 nt, Salmonella typhimurium LT2
uggauuaaaaaaggcagaagaa

SEQ ID NO: 3764113 - RNA, 20 nt, Salmonella typhimurium LT2
uggauucaugaucuuuccuu

SEQ ID NO: 3764114 - RNA, 15 nt, Salmonella typhimurium LT2
uggauuccuggcuug

SEQ ID NO: 3764115 - RNA, 22 nt, Salmonella typhimurium LT2
uggauuuauggcacaucaggca

SEQ ID NO: 3764116 - RNA, 21 nt, Salmonella typhimurium LT2
uggauuuuccguuaagcugga

SEQ ID NO: 3764117 - RNA, 18 nt, Salmonella typhimurium LT2
uggauuuuugacuaaagu

SEQ ID NO: 3764118 - RNA, 22 nt, Salmonella typhimurium LT2
uggcaaaaaaggccagacucau

SEQ ID NO: 3764119 - RNA, 17 nt, Salmonella typhimurium LT2
uggcaaaacgcauccag

SEQ ID NO: 3764120 - RNA, 20 nt, Salmonella typhimurium LT2
uggcaaaacgcucaacgcgu

SEQ ID NO: 3764121 - RNA, 14 nt, Salmonella typhimurium LT2
uggcaaaagacauu

SEQ ID NO: 3764122 - RNA, 20 nt, Salmonella typhimurium LT2
uggcaaacggauauuuuagg

SEQ ID NO: 3764123 - RNA, 21 nt, Salmonella typhimurium LT2
uggcaacuugccgaucaugac

SEQ ID NO: 3764124 - RNA, 20 nt, Salmonella typhimurium LT2
uggcaagaaccgcuuuuccu

SEQ ID NO: 3764125 - RNA, 13 nt, Salmonella typhimurium LT2
uggcaagaaucac

SEQ ID NO: 3764126 - RNA, 17 nt, Salmonella typhimurium LT2
uggcaagauuaaccagc

SEQ ID NO: 3764127 - RNA, 17 nt, Salmonella typhimurium LT2
uggcaagcgcuaagcaa

SEQ ID NO: 3764128 - RNA, 15 nt, Salmonella typhimurium LT2
uggcaaggguaugaa

SEQ ID NO: 3764129 - RNA, 21 nt, Salmonella typhimurium LT2
uggcaaguaugaaaagcgcgu

SEQ ID NO: 3764130 - RNA, 20 nt, Salmonella typhimurium LT2
uggcaaucaguacgcgcgcg

SEQ ID NO: 3764131 - RNA, 21 nt, Salmonella typhimurium LT2
uggcaaucauaccgucagauu

SEQ ID NO: 3764132 - RNA, 23 nt, Salmonella typhimurium LT2
uggcaaucauaccgucagauucu

SEQ ID NO: 3764133 - RNA, 17 nt, Salmonella typhimurium LT2
uggcacacgucuaccca

SEQ ID NO: 3764134 - RNA, 13 nt, Salmonella typhimurium LT2
uggcacuggcagc

SEQ ID NO: 3764135 - RNA, 21 nt, Salmonella typhimurium LT2
uggcacuggcagccucguccu

SEQ ID NO: 3764136 - RNA, 13 nt, Salmonella typhimurium LT2
uggcacuuucaga

SEQ ID NO: 3764137 - RNA, 20 nt, Salmonella typhimurium LT2
uggcacuuuccgguuuccau

SEQ ID NO: 3764138 - RNA, 16 nt, Salmonella typhimurium LT2
uggcagaccguggccg

SEQ ID NO: 3764139 - RNA, 15 nt, Salmonella typhimurium LT2
uggcagauaaaccac

SEQ ID NO: 3764140 - RNA, 16 nt, Salmonella typhimurium LT2
uggcagccucguccug

SEQ ID NO: 3764141 - RNA, 23 nt, Salmonella typhimurium LT2
uggcagccucguccugcaauuug

SEQ ID NO: 3764142 - RNA, 23 nt, Salmonella typhimurium LT2
uggcagcgccugacggcgcuguc

SEQ ID NO: 3764143 - RNA, 18 nt, Salmonella typhimurium LT2
uggcagcggcaguaaauu

SEQ ID NO: 3764144 - RNA, 19 nt, Salmonella typhimurium LT2
uggcagcggcaguaaauuu

SEQ ID NO: 3764145 - RNA, 19 nt, Salmonella typhimurium LT2
uggcaggcgcgaccucauc

SEQ ID NO: 3764146 - RNA, 20 nt, Salmonella typhimurium LT2
uggcagggacaacgcauugc

SEQ ID NO: 3764147 - RNA, 18 nt, Salmonella typhimurium LT2
uggcagggcugaaucggc

SEQ ID NO: 3764148 - RNA, 19 nt, Salmonella typhimurium LT2
uggcauaaccgcagcgcgg

SEQ ID NO: 3764149 - RNA, 17 nt, Salmonella typhimurium LT2
uggcauagccaguggaa

SEQ ID NO: 3764150 - RNA, 20 nt, Salmonella typhimurium LT2
uggcauauuugccccuuccg

SEQ ID NO: 3764151 - RNA, 12 nt, Salmonella typhimurium LT2
uggcauccagca

SEQ ID NO: 3764152 - RNA, 20 nt, Salmonella typhimurium LT2
uggcauugccggaaaccaac

SEQ ID NO: 3764153 - RNA, 13 nt, Salmonella typhimurium LT2
uggcauuucgcau

SEQ ID NO: 3764154 - RNA, 13 nt, Salmonella typhimurium LT2
uggccaaauaacc

SEQ ID NO: 3764155 - RNA, 16 nt, Salmonella typhimurium LT2
uggccaaucagcgggu

SEQ ID NO: 3764156 - RNA, 13 nt, Salmonella typhimurium LT2
uggccacaucguu

SEQ ID NO: 3764157 - RNA, 15 nt, Salmonella typhimurium LT2
uggccacaucguuac

SEQ ID NO: 3764158 - RNA, 17 nt, Salmonella typhimurium LT2
uggccacaucguuaccc

SEQ ID NO: 3764159 - RNA, 23 nt, Salmonella typhimurium LT2
uggccaccagcacaauggucagc

SEQ ID NO: 3764160 - RNA, 22 nt, Salmonella typhimurium LT2
uggccaccagcuuaucaggaug

SEQ ID NO: 3764161 - RNA, 22 nt, Salmonella typhimurium LT2
uggccaccuuuacgguggccuu

SEQ ID NO: 3764162 - RNA, 14 nt, Salmonella typhimurium LT2
uggccagcacaaua

SEQ ID NO: 3764163 - RNA, 13 nt, Salmonella typhimurium LT2
uggccagcauggc

SEQ ID NO: 3764164 - RNA, 19 nt, Salmonella typhimurium LT2
uggccaggaauaaagguca

SEQ ID NO: 3764165 - RNA, 13 nt, Salmonella typhimurium LT2
uggccaguuucaa

SEQ ID NO: 3764166 - RNA, 14 nt, Salmonella typhimurium LT2
uggccaucuuccag

SEQ ID NO: 3764167 - RNA, 18 nt, Salmonella typhimurium LT2
uggccaucuuccagcauc

SEQ ID NO: 3764168 - RNA, 19 nt, Salmonella typhimurium LT2
uggcccauuuuggccgcuu

SEQ ID NO: 3764169 - RNA, 14 nt, Salmonella typhimurium LT2
uggccccugagcaa

SEQ ID NO: 3764170 - RNA, 23 nt, Salmonella typhimurium LT2
uggcuaugacaaguccgccgcua

SEQ ID NO: 3764171 - RNA, 21 nt, Salmonella typhimurium LT2
uggcucaagauucaguuccac

SEQ ID NO: 3764172 - RNA, 18 nt, Salmonella typhimurium LT2
uggcucagauugaacgcu

SEQ ID NO: 3764173 - RNA, 19 nt, Salmonella typhimurium LT2
uggcucccgcagccacucc

SEQ ID NO: 3764174 - RNA, 18 nt, Salmonella typhimurium LT2
uggcucggcgucaucccg

SEQ ID NO: 3764175 - RNA, 16 nt, Salmonella typhimurium LT2
uggcucucggcaacaa

SEQ ID NO: 3764176 - RNA, 23 nt, Salmonella typhimurium LT2
uggcucuuagcagcauaaacauc

SEQ ID NO: 3764177 - RNA, 14 nt, Salmonella typhimurium LT2
uggcugagaaaaau

SEQ ID NO: 3764178 - RNA, 17 nt, Salmonella typhimurium LT2
uggcugagaaaaauacg

SEQ ID NO: 3764179 - RNA, 23 nt, Salmonella typhimurium LT2
uggcugagaaaaauacgccagau

SEQ ID NO: 3764180 - RNA, 20 nt, Salmonella typhimurium LT2
uggcugaggccgcucgccau

SEQ ID NO: 3764181 - RNA, 14 nt, Salmonella typhimurium LT2
uggcugccaguucg

SEQ ID NO: 3764182 - RNA, 21 nt, Salmonella typhimurium LT2
uggcugcgcgucccucuccag

SEQ ID NO: 3764183 - RNA, 14 nt, Salmonella typhimurium LT2
uggcuggccugcug

SEQ ID NO: 3764184 - RNA, 22 nt, Salmonella typhimurium LT2
uggcuggcgcaauguucuggga

SEQ ID NO: 3764185 - RNA, 16 nt, Salmonella typhimurium LT2
uggcuggcgcugacga

SEQ ID NO: 3764186 - RNA, 20 nt, Salmonella typhimurium LT2
uggcuggguaaaaucagcgc

SEQ ID NO: 3764187 - RNA, 23 nt, Salmonella typhimurium LT2
uggcuguagauacugaccaagcg

SEQ ID NO: 3764188 - RNA, 17 nt, Salmonella typhimurium LT2
uggcugucggcagaacc

SEQ ID NO: 3764189 - RNA, 16 nt, Salmonella typhimurium LT2
uggcugugcgugaccc

SEQ ID NO: 3764190 - RNA, 17 nt, Salmonella typhimurium LT2
uggcuguuaguaaacag

SEQ ID NO: 3764191 - RNA, 14 nt, Salmonella typhimurium LT2
uggcuuaacucacc

SEQ ID NO: 3764192 - RNA, 16 nt, Salmonella typhimurium LT2
uggcuuaccugcucug

SEQ ID NO: 3764193 - RNA, 15 nt, Salmonella typhimurium LT2
uggcuuccuacccuc

SEQ ID NO: 3764194 - RNA, 16 nt, Salmonella typhimurium LT2
uggcuucuggcggcaa

SEQ ID NO: 3764195 - RNA, 21 nt, Salmonella typhimurium LT2
uggcuucuuaaaauagccagc

SEQ ID NO: 3764196 - RNA, 17 nt, Salmonella typhimurium LT2
uggcuuuacccgggcca

SEQ ID NO: 3764197 - RNA, 23 nt, Salmonella typhimurium LT2
uggcuuuaugcacgccgggaaua

SEQ ID NO: 3764198 - RNA, 18 nt, Salmonella typhimurium LT2
uggcuuucuaccugcaau

SEQ ID NO: 3764199 - RNA, 16 nt, Salmonella typhimurium LT2
uggcuuugcgccacuu

SEQ ID NO: 3764200 - RNA, 16 nt, Salmonella typhimurium LT2
ugggaacuagcgaauc

SEQ ID NO: 3764201 - RNA, 12 nt, Salmonella typhimurium LT2
ugggaaggaaaa

SEQ ID NO: 3764202 - RNA, 19 nt, Salmonella typhimurium LT2
ugggaauaaggcaccgaug

SEQ ID NO: 3764203 - RNA, 20 nt, Salmonella typhimurium LT2
ugggacguuuggcuuauccg

SEQ ID NO: 3764204 - RNA, 15 nt, Salmonella typhimurium LT2
ugggauaaugucgac

SEQ ID NO: 3764205 - RNA, 14 nt, Salmonella typhimurium LT2
ugggaucagguaag

SEQ ID NO: 3764206 - RNA, 15 nt, Salmonella typhimurium LT2
ugggaucgacucauc

SEQ ID NO: 3764207 - RNA, 23 nt, Salmonella typhimurium LT2
ugggaugcguaauccggccuggc

SEQ ID NO: 3764208 - RNA, 14 nt, Salmonella typhimurium LT2
ugggcaaucaucag

SEQ ID NO: 3764209 - RNA, 13 nt, Salmonella typhimurium LT2
ugggccagcagcg

SEQ ID NO: 3764210 - RNA, 17 nt, Salmonella typhimurium LT2
ugggccagcagcgcauc

SEQ ID NO: 3764211 - RNA, 18 nt, Salmonella typhimurium LT2
ugggccgguacuuucgcc

SEQ ID NO: 3764212 - RNA, 14 nt, Salmonella typhimurium LT2
ugggccucaauaua

SEQ ID NO: 3764213 - RNA, 23 nt, Salmonella typhimurium LT2
ugggcgcgaucaguucuugcagg

SEQ ID NO: 3764214 - RNA, 22 nt, Salmonella typhimurium LT2
ugggcggcaacccgcuccagaa

SEQ ID NO: 3764215 - RNA, 22 nt, Salmonella typhimurium LT2
ugggcgucuuaaugcucuccag

SEQ ID NO: 3764216 - RNA, 17 nt, Salmonella typhimurium LT2
ugggcucaucaaacagc

SEQ ID NO: 3764217 - RNA, 21 nt, Salmonella typhimurium LT2
ugggcucaucaaacagcggca

SEQ ID NO: 3764218 - RNA, 15 nt, Salmonella typhimurium LT2
ugggcugaccaugcg

SEQ ID NO: 3764219 - RNA, 18 nt, Salmonella typhimurium LT2
uggggaaaaaccccuggu

SEQ ID NO: 3764220 - RNA, 21 nt, Salmonella typhimurium LT2
uggggacgcgcaaacgcuggc

SEQ ID NO: 3764221 - RNA, 16 nt, Salmonella typhimurium LT2
uggggauuaagcgagc

SEQ ID NO: 3764222 - RNA, 18 nt, Salmonella typhimurium LT2
uggggauugggcagacuu

SEQ ID NO: 3764223 - RNA, 14 nt, Salmonella typhimurium LT2
uggggguucaaguc

SEQ ID NO: 3764224 - RNA, 15 nt, Salmonella typhimurium LT2
uggggugagcgacaa

SEQ ID NO: 3764225 - RNA, 17 nt, Salmonella typhimurium LT2
uggguaaauaccaggca

SEQ ID NO: 3764226 - RNA, 19 nt, Salmonella typhimurium LT2
uggguaaauaccaggcacu

SEQ ID NO: 3764227 - RNA, 19 nt, Salmonella typhimurium LT2
ugggucacauccagacagc

SEQ ID NO: 3764228 - RNA, 13 nt, Salmonella typhimurium LT2
ugggucagugguc

SEQ ID NO: 3764229 - RNA, 16 nt, Salmonella typhimurium LT2
uggguuaacgcgccau

SEQ ID NO: 3764230 - RNA, 15 nt, Salmonella typhimurium LT2
ugguaaaacgcuggc

SEQ ID NO: 3764231 - RNA, 23 nt, Salmonella typhimurium LT2
ugguaaaauuauugugagaaaag

SEQ ID NO: 3764232 - RNA, 21 nt, Salmonella typhimurium LT2
ugguaaagaagccgccgccau

SEQ ID NO: 3764233 - RNA, 15 nt, Salmonella typhimurium LT2
ugguaaaggcguaga

SEQ ID NO: 3764234 - RNA, 17 nt, Salmonella typhimurium LT2
ugguaagagagccuuau

SEQ ID NO: 3764235 - RNA, 13 nt, Salmonella typhimurium LT2
ugguaagcgcagc

SEQ ID NO: 3764236 - RNA, 18 nt, Salmonella typhimurium LT2
ugguaauuaaaggcagcg

SEQ ID NO: 3764237 - RNA, 13 nt, Salmonella typhimurium LT2
ugguaauuuaaag

SEQ ID NO: 3764238 - RNA, 22 nt, Salmonella typhimurium LT2
ugguaauuuaaaguaaggcuga

SEQ ID NO: 3764239 - RNA, 18 nt, Salmonella typhimurium LT2
ugguaccaaacagcagaa

SEQ ID NO: 3764240 - RNA, 16 nt, Salmonella typhimurium LT2
ugguacguccauccgc

SEQ ID NO: 3764241 - RNA, 12 nt, Salmonella typhimurium LT2
ugguagaaaaac

SEQ ID NO: 3764242 - RNA, 19 nt, Salmonella typhimurium LT2
ugguagacaaacagcgcgc

SEQ ID NO: 3764243 - RNA, 15 nt, Salmonella typhimurium LT2
ugguagacccggcau

SEQ ID NO: 3764244 - RNA, 14 nt, Salmonella typhimurium LT2
ugguagacgcgcua

SEQ ID NO: 3764245 - RNA, 20 nt, Salmonella typhimurium LT2
ugguagacgcgcuagcuuca

SEQ ID NO: 3764246 - RNA, 15 nt, Salmonella typhimurium LT2
ugguagcccucgcaa

SEQ ID NO: 3764247 - RNA, 16 nt, Salmonella typhimurium LT2
ugguaguaagucagcu

SEQ ID NO: 3764248 - RNA, 21 nt, Salmonella typhimurium LT2
ugguagucaaauuccagcaac

SEQ ID NO: 3764249 - RNA, 14 nt, Salmonella typhimurium LT2
ugguauaaaucccg

SEQ ID NO: 3764250 - RNA, 14 nt, Salmonella typhimurium LT2
ugguauuucaggcc

SEQ ID NO: 3764251 - RNA, 15 nt, Salmonella typhimurium LT2
uggucaaacaaauca

SEQ ID NO: 3764252 - RNA, 15 nt, Salmonella typhimurium LT2
uggucaccaugacgc

SEQ ID NO: 3764253 - RNA, 12 nt, Salmonella typhimurium LT2
uggucagcgcgc

SEQ ID NO: 3764254 - RNA, 15 nt, Salmonella typhimurium LT2
uggucaggcuaaaug

SEQ ID NO: 3764255 - RNA, 12 nt, Salmonella typhimurium LT2
uggucaucgcgg

SEQ ID NO: 3764256 - RNA, 20 nt, Salmonella typhimurium LT2
uggucaugauaucgccugcu

SEQ ID NO: 3764257 - RNA, 17 nt, Salmonella typhimurium LT2
ugguccggcagguagua

SEQ ID NO: 3764258 - RNA, 14 nt, Salmonella typhimurium LT2
uggucgaaaauauc

SEQ ID NO: 3764259 - RNA, 17 nt, Salmonella typhimurium LT2
uggucgaccguucgcac

SEQ ID NO: 3764260 - RNA, 15 nt, Salmonella typhimurium LT2
uggucgagauacugc

SEQ ID NO: 3764261 - RNA, 15 nt, Salmonella typhimurium LT2
uggucgccagcgucu

SEQ ID NO: 3764262 - RNA, 14 nt, Salmonella typhimurium LT2
uggucgguauuauc

SEQ ID NO: 3764263 - RNA, 21 nt, Salmonella typhimurium LT2
uggucguuagccagauggcug

SEQ ID NO: 3764264 - RNA, 18 nt, Salmonella typhimurium LT2
uggucuaucgcuucuccc

SEQ ID NO: 3764265 - RNA, 18 nt, Salmonella typhimurium LT2
uggucuccgccuggaacc

SEQ ID NO: 3764266 - RNA, 23 nt, Salmonella typhimurium LT2
uggucucucgugcaggccggaua

SEQ ID NO: 3764267 - RNA, 16 nt, Salmonella typhimurium LT2
uggucugacccgcgaa

SEQ ID NO: 3764268 - RNA, 23 nt, Salmonella typhimurium LT2
uggucuuaaugcugcgguugagc

SEQ ID NO: 3764269 - RNA, 21 nt, Salmonella typhimurium LT2
uggugaaacugaugugacauu

SEQ ID NO: 3764270 - RNA, 20 nt, Salmonella typhimurium LT2
uggugacugucgagaugcgu

SEQ ID NO: 3764271 - RNA, 19 nt, Salmonella typhimurium LT2
uggugagguugagauccug

SEQ ID NO: 3764272 - RNA, 20 nt, Salmonella typhimurium LT2
uggugauagcgcgccagcac

SEQ ID NO: 3764273 - RNA, 13 nt, Salmonella typhimurium LT2
uggugauucaaau

SEQ ID NO: 3764274 - RNA, 18 nt, Salmonella typhimurium LT2
uguagguuccgacaauaa

SEQ ID NO: 3764275 - RNA, 12 nt, Salmonella typhimurium LT2
uguaguuaucgc

SEQ ID NO: 3764276 - RNA, 20 nt, Salmonella typhimurium LT2
uguaguuuuucggcaguggc

SEQ ID NO: 3764277 - RNA, 12 nt, Salmonella typhimurium LT2
uguaguuuuuug

SEQ ID NO: 3764278 - RNA, 17 nt, Salmonella typhimurium LT2
uguauacauacauacau

SEQ ID NO: 3764279 - RNA, 16 nt, Salmonella typhimurium LT2
uguauagacaaguaua

SEQ ID NO: 3764280 - RNA, 14 nt, Salmonella typhimurium LT2
uguaucauuuugau

SEQ ID NO: 3764281 - RNA, 16 nt, Salmonella typhimurium LT2
uguauccaccaccugg

SEQ ID NO: 3764282 - RNA, 20 nt, Salmonella typhimurium LT2
uguaucgcgcggauuccgcc

SEQ ID NO: 3764283 - RNA, 22 nt, Salmonella typhimurium LT2
uguaugcucauaagacgcauua

SEQ ID NO: 3764284 - RNA, 13 nt, Salmonella typhimurium LT2
uguauuaaaggau

SEQ ID NO: 3764285 - RNA, 22 nt, Salmonella typhimurium LT2
uguauuaaaggaucgauuaagg

SEQ ID NO: 3764286 - RNA, 16 nt, Salmonella typhimurium LT2
uguauucgcagggcug

SEQ ID NO: 3764287 - RNA, 15 nt, Salmonella typhimurium LT2
uguauugcauuuuau

SEQ ID NO: 3764288 - RNA, 20 nt, Salmonella typhimurium LT2
uguauuggucuaucgcuucu

SEQ ID NO: 3764289 - RNA, 23 nt, Salmonella typhimurium LT2
uguauuuucuaucuuuuuaagau

SEQ ID NO: 3764290 - RNA, 13 nt, Salmonella typhimurium LT2
ugucaaagcgcca

SEQ ID NO: 3764291 - RNA, 14 nt, Salmonella typhimurium LT2
ugucaauccggcga

SEQ ID NO: 3764292 - RNA, 15 nt, Salmonella typhimurium LT2
ugucacaaacggcac

SEQ ID NO: 3764293 - RNA, 16 nt, Salmonella typhimurium LT2
ugucacaaacggcaca

SEQ ID NO: 3764294 - RNA, 17 nt, Salmonella typhimurium LT2
ugucacaaaggugagac

SEQ ID NO: 3764295 - RNA, 12 nt, Salmonella typhimurium LT2
ugucaccaauaa

SEQ ID NO: 3764296 - RNA, 14 nt, Salmonella typhimurium LT2
ugucacgcaggggg

SEQ ID NO: 3764297 - RNA, 19 nt, Salmonella typhimurium LT2
ugucacuauucuuaucauu

SEQ ID NO: 3764298 - RNA, 17 nt, Salmonella typhimurium LT2
ugucagaauuuccccag

SEQ ID NO: 3764299 - RNA, 20 nt, Salmonella typhimurium LT2
ugucagaauuuccccaguua

SEQ ID NO: 3764300 - RNA, 12 nt, Salmonella typhimurium LT2
ugucaggaugaa

SEQ ID NO: 3764301 - RNA, 16 nt, Salmonella typhimurium LT2
ugucaggcaaaaauaa

SEQ ID NO: 3764302 - RNA, 21 nt, Salmonella typhimurium LT2
ugucauagucggcgccaaagu

SEQ ID NO: 3764303 - RNA, 16 nt, Salmonella typhimurium LT2
ugucauauuugugagc

SEQ ID NO: 3764304 - RNA, 17 nt, Salmonella typhimurium LT2
ugucaucaagauuuugu

SEQ ID NO: 3764305 - RNA, 14 nt, Salmonella typhimurium LT2
ugucauccaccagg

SEQ ID NO: 3764306 - RNA, 19 nt, Salmonella typhimurium LT2
ugucauccuguucauccac

SEQ ID NO: 3764307 - RNA, 14 nt, Salmonella typhimurium LT2
ugucaucgccgcua

SEQ ID NO: 3764308 - RNA, 13 nt, Salmonella typhimurium LT2
ugucaucggcuuu

SEQ ID NO: 3764309 - RNA, 21 nt, Salmonella typhimurium LT2
ugucaucggucauaaccggcc

SEQ ID NO: 3764310 - RNA, 16 nt, Salmonella typhimurium LT2
ugucaugaagcucaac

SEQ ID NO: 3764311 - RNA, 20 nt, Salmonella typhimurium LT2
ugucaugcuaaaacagauaa

SEQ ID NO: 3764312 - RNA, 21 nt, Salmonella typhimurium LT2
ugucauuccuuccacgcguac

SEQ ID NO: 3764313 - RNA, 22 nt, Salmonella typhimurium LT2
uguccaacguugugcuccgccg

SEQ ID NO: 3764314 - RNA, 14 nt, Salmonella typhimurium LT2
uguccacacugacg

SEQ ID NO: 3764315 - RNA, 12 nt, Salmonella typhimurium LT2
uguccacccucc

SEQ ID NO: 3764316 - RNA, 14 nt, Salmonella typhimurium LT2
uguccacccuccca

SEQ ID NO: 3764317 - RNA, 18 nt, Salmonella typhimurium LT2
uguccacggggcggcaau

SEQ ID NO: 3764318 - RNA, 20 nt, Salmonella typhimurium LT2
uguccagaucuucacgcguc

SEQ ID NO: 3764319 - RNA, 15 nt, Salmonella typhimurium LT2
uguccagaucuuccc

SEQ ID NO: 3764320 - RNA, 18 nt, Salmonella typhimurium LT2
uguccagaucuucccagu

SEQ ID NO: 3764321 - RNA, 16 nt, Salmonella typhimurium LT2
uguccagcagugucug

SEQ ID NO: 3764322 - RNA, 20 nt, Salmonella typhimurium LT2
uguccaggucaucaccucca

SEQ ID NO: 3764323 - RNA, 22 nt, Salmonella typhimurium LT2
uguccaggucaucaccuccagc

SEQ ID NO: 3764324 - RNA, 20 nt, Salmonella typhimurium LT2
uguccaucagauucaacagg

SEQ ID NO: 3764325 - RNA, 21 nt, Salmonella typhimurium LT2
uguccaugcaugacgcaggcg

SEQ ID NO: 3764326 - RNA, 20 nt, Salmonella typhimurium LT2
ugucccagcgucaacugcgc

SEQ ID NO: 3764327 - RNA, 12 nt, Salmonella typhimurium LT2
ugucccaggcca

SEQ ID NO: 3764328 - RNA, 21 nt, Salmonella typhimurium LT2
ugucccuucaugacuuuuuuc

SEQ ID NO: 3764329 - RNA, 16 nt, Salmonella typhimurium LT2
uguccggcgcuucggc

SEQ ID NO: 3764330 - RNA, 15 nt, Salmonella typhimurium LT2
uguccgggcguuuca

SEQ ID NO: 3764331 - RNA, 20 nt, Salmonella typhimurium LT2
uguccgggcguuucagcuuc

SEQ ID NO: 3764332 - RNA, 15 nt, Salmonella typhimurium LT2
uguccgucagcgcau

SEQ ID NO: 3764333 - RNA, 18 nt, Salmonella typhimurium LT2
uguccguuuuuucugucg

SEQ ID NO: 3764334 - RNA, 21 nt, Salmonella typhimurium LT2
uguccucggcaacauaccggg

SEQ ID NO: 3764335 - RNA, 20 nt, Salmonella typhimurium LT2
uguccugacggcgacgcgcc

SEQ ID NO: 3764336 - RNA, 21 nt, Salmonella typhimurium LT2
uguccuuuaucugcccuuucu

SEQ ID NO: 3764337 - RNA, 22 nt, Salmonella typhimurium LT2
uguccuuugcuacaccccuucu

SEQ ID NO: 3764338 - RNA, 20 nt, Salmonella typhimurium LT2
ugucgaaacaacacacggcg

SEQ ID NO: 3764339 - RNA, 15 nt, Salmonella typhimurium LT2
ugucgaaaccagcau

SEQ ID NO: 3764340 - RNA, 19 nt, Salmonella typhimurium LT2
ugucgaaauugccgcccgu

SEQ ID NO: 3764341 - RNA, 17 nt, Salmonella typhimurium LT2
ugucgacaauaaauugc

SEQ ID NO: 3764342 - RNA, 17 nt, Salmonella typhimurium LT2
ugucgaccgcuccacuc

SEQ ID NO: 3764343 - RNA, 15 nt, Salmonella typhimurium LT2
ugucgauaaacucau

SEQ ID NO: 3764344 - RNA, 14 nt, Salmonella typhimurium LT2
ugucgauaauaucc

SEQ ID NO: 3764345 - RNA, 20 nt, Salmonella typhimurium LT2
ugucgauuuccgguuccagc

SEQ ID NO: 3764346 - RNA, 22 nt, Salmonella typhimurium LT2
ugucgauuuccgguuccagcgg

SEQ ID NO: 3764347 - RNA, 18 nt, Salmonella typhimurium LT2
ugucgcaauaaacgggca

SEQ ID NO: 3764348 - RNA, 12 nt, Salmonella typhimurium LT2
ugucgccaggcc

SEQ ID NO: 3764349 - RNA, 17 nt, Salmonella typhimurium LT2
ugucgccggggcgcugg

SEQ ID NO: 3764350 - RNA, 19 nt, Salmonella typhimurium LT2
ugucgccgguuagcgccgc

SEQ ID NO: 3764351 - RNA, 14 nt, Salmonella typhimurium LT2
ugucgccucgcuaa

SEQ ID NO: 3764352 - RNA, 22 nt, Salmonella typhimurium LT2
ugucgccugcugcuggacagga

SEQ ID NO: 3764353 - RNA, 17 nt, Salmonella typhimurium LT2
ugucgcgagcuuccagu

SEQ ID NO: 3764354 - RNA, 22 nt, Salmonella typhimurium LT2
ugucgcugaguacgcaccagcc

SEQ ID NO: 3764355 - RNA, 17 nt, Salmonella typhimurium LT2
ugucggcucauccagca

SEQ ID NO: 3764356 - RNA, 21 nt, Salmonella typhimurium LT2
ugucgggcaaaaugcgucggc

SEQ ID NO: 3764357 - RNA, 17 nt, Salmonella typhimurium LT2
ugucgggccaggcuccg

SEQ ID NO: 3764358 - RNA, 19 nt, Salmonella typhimurium LT2
ugucgggccuacagaugaa

SEQ ID NO: 3764359 - RNA, 18 nt, Salmonella typhimurium LT2
ugucggucugauaagcgc

SEQ ID NO: 3764360 - RNA, 19 nt, Salmonella typhimurium LT2
ugucguauaccguuucucc

SEQ ID NO: 3764361 - RNA, 15 nt, Salmonella typhimurium LT2
ugucgucgauuuucu

SEQ ID NO: 3764362 - RNA, 13 nt, Salmonella typhimurium LT2
ugucguuaucgcc

SEQ ID NO: 3764363 - RNA, 21 nt, Salmonella typhimurium LT2
ugucuacacuuugcgccgcca

SEQ ID NO: 3764364 - RNA, 13 nt, Salmonella typhimurium LT2
ugucuccaccgcc

SEQ ID NO: 3764365 - RNA, 16 nt, Salmonella typhimurium LT2
ugucuccgucacuucc

SEQ ID NO: 3764366 - RNA, 13 nt, Salmonella typhimurium LT2
ugucucuccagua

SEQ ID NO: 3764367 - RNA, 14 nt, Salmonella typhimurium LT2
ugucugaaugaguc

SEQ ID NO: 3764368 - RNA, 15 nt, Salmonella typhimurium LT2
ugucugacgcuuauc

SEQ ID NO: 3764369 - RNA, 14 nt, Salmonella typhimurium LT2
ugucugggcauuac

SEQ ID NO: 3764370 - RNA, 13 nt, Salmonella typhimurium LT2
ugucuuaaauaug

SEQ ID NO: 3764371 - RNA, 15 nt, Salmonella typhimurium LT2
ugucuucugccagca

SEQ ID NO: 3764372 - RNA, 22 nt, Salmonella typhimurium LT2
ugucuucuuucgguucgccgca

SEQ ID NO: 3764373 - RNA, 14 nt, Salmonella typhimurium LT2
ugucuugucugggc

SEQ ID NO: 3764374 - RNA, 22 nt, Salmonella typhimurium LT2
ugugaagacauuugauuccagc

SEQ ID NO: 3764375 - RNA, 18 nt, Salmonella typhimurium LT2
ugugaauauauuggcagg

SEQ ID NO: 3764376 - RNA, 18 nt, Salmonella typhimurium LT2
ugugacagcaacaucuau

SEQ ID NO: 3764377 - RNA, 14 nt, Salmonella typhimurium LT2
ugugacggcauguc

SEQ ID NO: 3764378 - RNA, 15 nt, Salmonella typhimurium LT2
uguuucaguucggag

SEQ ID NO: 3764379 - RNA, 16 nt, Salmonella typhimurium LT2
uguuucaucucaucaa

SEQ ID NO: 3764380 - RNA, 13 nt, Salmonella typhimurium LT2
uguuucauuucgc

SEQ ID NO: 3764381 - RNA, 15 nt, Salmonella typhimurium LT2
uguuuccagugcagc

SEQ ID NO: 3764382 - RNA, 23 nt, Salmonella typhimurium LT2
uguuuccauacauuuuuguaaua

SEQ ID NO: 3764383 - RNA, 15 nt, Salmonella typhimurium LT2
uguuucgucaauauu

SEQ ID NO: 3764384 - RNA, 17 nt, Salmonella typhimurium LT2
uguuucucuuccgccag

SEQ ID NO: 3764385 - RNA, 23 nt, Salmonella typhimurium LT2
uguuucuuuuaaggcggcaaaga

SEQ ID NO: 3764386 - RNA, 22 nt, Salmonella typhimurium LT2
uguuugaugucgaggaaaaaca

SEQ ID NO: 3764387 - RNA, 20 nt, Salmonella typhimurium LT2
uguuugcugagaauuuccag

SEQ ID NO: 3764388 - RNA, 13 nt, Salmonella typhimurium LT2
uguuuggugcuga

SEQ ID NO: 3764389 - RNA, 14 nt, Salmonella typhimurium LT2
uguuuuaaauucaa

SEQ ID NO: 3764390 - RNA, 13 nt, Salmonella typhimurium LT2
uguuuuaacggaa

SEQ ID NO: 3764391 - RNA, 19 nt, Salmonella typhimurium LT2
uguuuuaccaaaucaauag

SEQ ID NO: 3764392 - RNA, 14 nt, Salmonella typhimurium LT2
uguuuuaccuguuu

SEQ ID NO: 3764393 - RNA, 15 nt, Salmonella typhimurium LT2
uguuuuauacucaaa

SEQ ID NO: 3764394 - RNA, 20 nt, Salmonella typhimurium LT2
uguuuuauacucaaaaaauc

SEQ ID NO: 3764395 - RNA, 16 nt, Salmonella typhimurium LT2
uguuuuauuaccuccu

SEQ ID NO: 3764396 - RNA, 16 nt, Salmonella typhimurium LT2
uguuuucagcaaauaa

SEQ ID NO: 3764397 - RNA, 19 nt, Salmonella typhimurium LT2
uguuuucauauguuugaua

SEQ ID NO: 3764398 - RNA, 15 nt, Salmonella typhimurium LT2
uguuuuccagcguaa

SEQ ID NO: 3764399 - RNA, 21 nt, Salmonella typhimurium LT2
uguuuucgagccuugccgcaa

SEQ ID NO: 3764400 - RNA, 15 nt, Salmonella typhimurium LT2
uguuuucugccagca

SEQ ID NO: 3764401 - RNA, 15 nt, Salmonella typhimurium LT2
uguuuuuauacaucc

SEQ ID NO: 3764402 - RNA, 16 nt, Salmonella typhimurium LT2
uguuuuuauuuuucuu

SEQ ID NO: 3764403 - RNA, 23 nt, Salmonella typhimurium LT2
uguuuuuucagcgcgccgcgcag

SEQ ID NO: 3764404 - RNA, 11 nt, Salmonella typhimurium LT2
uuaaaaaaacg

SEQ ID NO: 3764405 - RNA, 22 nt, Salmonella typhimurium LT2
uuaaaaacagguugcguaacgc

SEQ ID NO: 3764406 - RNA, 12 nt, Salmonella typhimurium LT2
uuaaaaacauca

SEQ ID NO: 3764407 - RNA, 16 nt, Salmonella typhimurium LT2
uuaaaaagagaaaaaa

SEQ ID NO: 3764408 - RNA, 13 nt, Salmonella typhimurium LT2
uuaaaaagcugca

SEQ ID NO: 3764409 - RNA, 17 nt, Salmonella typhimurium LT2
uuaaaaagcugcauaau

SEQ ID NO: 3764410 - RNA, 12 nt, Salmonella typhimurium LT2
uuaaaaauaacg

SEQ ID NO: 3764411 - RNA, 17 nt, Salmonella typhimurium LT2
uuaaaacgcacgcuguc

SEQ ID NO: 3764412 - RNA, 15 nt, Salmonella typhimurium LT2
uuaaaagagaaaaag

SEQ ID NO: 3764413 - RNA, 16 nt, Salmonella typhimurium LT2
uuaaaagagaaaaaga

SEQ ID NO: 3764414 - RNA, 21 nt, Salmonella typhimurium LT2
uuaaaaguacaaugcaaagaa

SEQ ID NO: 3764415 - RNA, 12 nt, Salmonella typhimurium LT2
uuaaacacaucc

SEQ ID NO: 3764416 - RNA, 13 nt, Salmonella typhimurium LT2
uuaaaccacaccu

SEQ ID NO: 3764417 - RNA, 13 nt, Salmonella typhimurium LT2
uuaaaccgcccau

SEQ ID NO: 3764418 - RNA, 19 nt, Salmonella typhimurium LT2
uuaaacgccggauuccaga

SEQ ID NO: 3764419 - RNA, 22 nt, Salmonella typhimurium LT2
uuaaacgccggauuccagaaua

SEQ ID NO: 3764420 - RNA, 13 nt, Salmonella typhimurium LT2
uuaaauaaaaaug

SEQ ID NO: 3764421 - RNA, 19 nt, Salmonella typhimurium LT2
uuaaauaccagcaccugaa

SEQ ID NO: 3764422 - RNA, 17 nt, Salmonella typhimurium LT2
uuaaauaugaaagagaa

SEQ ID NO: 3764423 - RNA, 20 nt, Salmonella typhimurium LT2
uuaaaugcccgauggcgcuu

SEQ ID NO: 3764424 - RNA, 20 nt, Salmonella typhimurium LT2
uuaaaugccuguuuauauuc

SEQ ID NO: 3764425 - RNA, 20 nt, Salmonella typhimurium LT2
uuaaaugugcggcguacugc

SEQ ID NO: 3764426 - RNA, 16 nt, Salmonella typhimurium LT2
uuaaauguuugcuuua

SEQ ID NO: 3764427 - RNA, 12 nt, Salmonella typhimurium LT2
uuaaauugaaaa

SEQ ID NO: 3764428 - RNA, 15 nt, Salmonella typhimurium LT2
uuaaauugaaaacca

SEQ ID NO: 3764429 - RNA, 17 nt, Salmonella typhimurium LT2
uuaaauugaaaaccaua

SEQ ID NO: 3764430 - RNA, 17 nt, Salmonella typhimurium LT2
uuaaauugcuauaccgc

SEQ ID NO: 3764431 - RNA, 15 nt, Salmonella typhimurium LT2
uuaaauuuuuaauaa

SEQ ID NO: 3764432 - RNA, 13 nt, Salmonella typhimurium LT2
uuaacacccggau

SEQ ID NO: 3764433 - RNA, 15 nt, Salmonella typhimurium LT2
uuaacacccggauau

SEQ ID NO: 3764434 - RNA, 20 nt, Salmonella typhimurium LT2
uuaacagcgccaucaggaaa

SEQ ID NO: 3764435 - RNA, 20 nt, Salmonella typhimurium LT2
uuaacagcgcgaccaggaaa

SEQ ID NO: 3764436 - RNA, 16 nt, Salmonella typhimurium LT2
uuaacaucaccuuuca

SEQ ID NO: 3764437 - RNA, 15 nt, Salmonella typhimurium LT2
uuaaccagcaguccu

SEQ ID NO: 3764438 - RNA, 19 nt, Salmonella typhimurium LT2
uuaaccccucgcagacuga

SEQ ID NO: 3764439 - RNA, 17 nt, Salmonella typhimurium LT2
uuaacccuguggauuaa

SEQ ID NO: 3764440 - RNA, 17 nt, Salmonella typhimurium LT2
uuaaccugauccaggaa

SEQ ID NO: 3764441 - RNA, 18 nt, Salmonella typhimurium LT2
uuaaccugguucaaaaug

SEQ ID NO: 3764442 - RNA, 15 nt, Salmonella typhimurium LT2
uuaacgacaaaaaua

SEQ ID NO: 3764443 - RNA, 18 nt, Salmonella typhimurium LT2
uuaacgcauguuccgcua

SEQ ID NO: 3764444 - RNA, 22 nt, Salmonella typhimurium LT2
uuaacgcgaauccgccauagcc

SEQ ID NO: 3764445 - RNA, 17 nt, Salmonella typhimurium LT2
uuaacgcgccaucuuuc

SEQ ID NO: 3764446 - RNA, 22 nt, Salmonella typhimurium LT2
uuaacggcccaggcaucgacgc

SEQ ID NO: 3764447 - RNA, 19 nt, Salmonella typhimurium LT2
uuaacguccauaccgguug

SEQ ID NO: 3764448 - RNA, 15 nt, Salmonella typhimurium LT2
uuaacucaucacagc

SEQ ID NO: 3764449 - RNA, 17 nt, Salmonella typhimurium LT2
uuaacugcacuuucugc

SEQ ID NO: 3764450 - RNA, 14 nt, Salmonella typhimurium LT2
uuaacuuaaauaaa

SEQ ID NO: 3764451 - RNA, 19 nt, Salmonella typhimurium LT2
uuaacuucuccuccaucag

SEQ ID NO: 3764452 - RNA, 18 nt, Salmonella typhimurium LT2
uuaacuucugcagggaaa

SEQ ID NO: 3764453 - RNA, 18 nt, Salmonella typhimurium LT2
uuaagaaacugagugugu

SEQ ID NO: 3764454 - RNA, 13 nt, Salmonella typhimurium LT2
uuaagaagucugu

SEQ ID NO: 3764455 - RNA, 22 nt, Salmonella typhimurium LT2
uuaagaagucugugaggaaagc

SEQ ID NO: 3764456 - RNA, 21 nt, Salmonella typhimurium LT2
uuaagacgcuucauaucgccc

SEQ ID NO: 3764457 - RNA, 23 nt, Salmonella typhimurium LT2
uuaagacgcuucauaucgcccag

SEQ ID NO: 3764458 - RNA, 14 nt, Salmonella typhimurium LT2
uuaagauccugacu

SEQ ID NO: 3764459 - RNA, 23 nt, Salmonella typhimurium LT2
uuaagaucgcaggccaaaaaaac

SEQ ID NO: 3764460 - RNA, 14 nt, Salmonella typhimurium LT2
uuaagauguugcgu

SEQ ID NO: 3764461 - RNA, 23 nt, Salmonella typhimurium LT2
uuaagcaacugauuaaucugccg

SEQ ID NO: 3764462 - RNA, 22 nt, Salmonella typhimurium LT2
uuaagccccucgcuaaugcccg

SEQ ID NO: 3764463 - RNA, 18 nt, Salmonella typhimurium LT2
uuaagccuuuuuaaauau

SEQ ID NO: 3764464 - RNA, 20 nt, Salmonella typhimurium LT2
uuaagccuuuuuaaauauua

SEQ ID NO: 3764465 - RNA, 22 nt, Salmonella typhimurium LT2
uuaagcgccuccacaaagcgcg

SEQ ID NO: 3764466 - RNA, 18 nt, Salmonella typhimurium LT2
uuaagcgggucccagaag

SEQ ID NO: 3764467 - RNA, 15 nt, Salmonella typhimurium LT2
uuaaggauauauacu

SEQ ID NO: 3764468 - RNA, 15 nt, Salmonella typhimurium LT2
uuaaggcaucaauac

SEQ ID NO: 3764469 - RNA, 17 nt, Salmonella typhimurium LT2
uuaaggcggcaaagaua

SEQ ID NO: 3764470 - RNA, 20 nt, Salmonella typhimurium LT2
uuaaguuugccgacauccuu

SEQ ID NO: 3764471 - RNA, 21 nt, Salmonella typhimurium LT2
uuaauaaccaauuaaauuauu

SEQ ID NO: 3764472 - RNA, 13 nt, Salmonella typhimurium LT2
uuaauaacccagg

SEQ ID NO: 3764473 - RNA, 11 nt, Salmonella typhimurium LT2
uuaauacacga

SEQ ID NO: 3764474 - RNA, 20 nt, Salmonella typhimurium LT2
uuaauaccagcgccaaucac

SEQ ID NO: 3764475 - RNA, 24 nt, Salmonella typhimurium LT2
uuaauaccgugcaggacagacaga

SEQ ID NO: 3764476 - RNA, 14 nt, Salmonella typhimurium LT2
uuaauacgcugucg

SEQ ID NO: 3764477 - RNA, 21 nt, Salmonella typhimurium LT2
uuaauauaugaaccaagauaa

SEQ ID NO: 3764478 - RNA, 15 nt, Salmonella typhimurium LT2
uuaauauauuuauau

SEQ ID NO: 3764479 - RNA, 16 nt, Salmonella typhimurium LT2
uuaauauauuuauaua

SEQ ID NO: 3764480 - RNA, 11 nt, Salmonella typhimurium LT2
uuaaucaaaau

SEQ ID NO: 3764481 - RNA, 18 nt, Salmonella typhimurium LT2
uuaaucaagcccagcuca

SEQ ID NO: 3764482 - RNA, 23 nt, Salmonella typhimurium LT2
uuagaacgcggaaguauccugga

SEQ ID NO: 3764483 - RNA, 22 nt, Salmonella typhimurium LT2
uuagaauagcaucaauuucucu

SEQ ID NO: 3764484 - RNA, 21 nt, Salmonella typhimurium LT2
uuagaauagccgggguaauau

SEQ ID NO: 3764485 - RNA, 14 nt, Salmonella typhimurium LT2
uuagacaucaaaau

SEQ ID NO: 3764486 - RNA, 21 nt, Salmonella typhimurium LT2
uuagagcacaucacucauaau

SEQ ID NO: 3764487 - RNA, 13 nt, Salmonella typhimurium LT2
uuagagccaauau

SEQ ID NO: 3764488 - RNA, 21 nt, Salmonella typhimurium LT2
uuagauguaauucaugcugua

SEQ ID NO: 3764489 - RNA, 14 nt, Salmonella typhimurium LT2
uuagcagcaauaau

SEQ ID NO: 3764490 - RNA, 14 nt, Salmonella typhimurium LT2
uuagccacgccguc

SEQ ID NO: 3764491 - RNA, 22 nt, Salmonella typhimurium LT2
uuagccacuuaccaaucgcggc

SEQ ID NO: 3764492 - RNA, 14 nt, Salmonella typhimurium LT2
uuagccaucccggc

SEQ ID NO: 3764493 - RNA, 17 nt, Salmonella typhimurium LT2
uuagccccugacgcugc

SEQ ID NO: 3764494 - RNA, 22 nt, Salmonella typhimurium LT2
uuagcccuuucauuucugccug

SEQ ID NO: 3764495 - RNA, 13 nt, Salmonella typhimurium LT2
uuagcgaaacagu

SEQ ID NO: 3764496 - RNA, 20 nt, Salmonella typhimurium LT2
uuagcgacauacauaacgcg

SEQ ID NO: 3764497 - RNA, 15 nt, Salmonella typhimurium LT2
uuagcgcaaaagcgc

SEQ ID NO: 3764498 - RNA, 15 nt, Salmonella typhimurium LT2
uuagcgcccauaaug

SEQ ID NO: 3764499 - RNA, 18 nt, Salmonella typhimurium LT2
uuagcgcucacuaccgcg

SEQ ID NO: 3764500 - RNA, 17 nt, Salmonella typhimurium LT2
uuagcgguacucuuuuu

SEQ ID NO: 3764501 - RNA, 16 nt, Salmonella typhimurium LT2
uuagcguuucaaccgc

SEQ ID NO: 3764502 - RNA, 18 nt, Salmonella typhimurium LT2
uuagcguuucaaccgcgc

SEQ ID NO: 3764503 - RNA, 14 nt, Salmonella typhimurium LT2
uuagcuaacucuau

SEQ ID NO: 3764504 - RNA, 18 nt, Salmonella typhimurium LT2
uuagcuggcauaaccgca

SEQ ID NO: 3764505 - RNA, 14 nt, Salmonella typhimurium LT2
uuagcuucagcaaa

SEQ ID NO: 3764506 - RNA, 21 nt, Salmonella typhimurium LT2
uuagcuuguguaggccggaua

SEQ ID NO: 3764507 - RNA, 14 nt, Salmonella typhimurium LT2
uuaggcacaucaau

SEQ ID NO: 3764508 - RNA, 15 nt, Salmonella typhimurium LT2
uuagggcgcggcugg

SEQ ID NO: 3764509 - RNA, 23 nt, Salmonella typhimurium LT2
uuaggggcucuuuuuuuauagca

SEQ ID NO: 3764510 - RNA, 16 nt, Salmonella typhimurium LT2
uuagguucuucaaugc

SEQ ID NO: 3764511 - RNA, 15 nt, Salmonella typhimurium LT2
uuaguagguggccca

SEQ ID NO: 3764512 - RNA, 17 nt, Salmonella typhimurium LT2
uuagucugccauuuccu

SEQ ID NO: 3764513 - RNA, 15 nt, Salmonella typhimurium LT2
uuagugcucagcuug

SEQ ID NO: 3764514 - RNA, 18 nt, Salmonella typhimurium LT2
uuaguguccuuacggacg

SEQ ID NO: 3764515 - RNA, 21 nt, Salmonella typhimurium LT2
uuaguuacgcacgccagauaa

SEQ ID NO: 3764516 - RNA, 18 nt, Salmonella typhimurium LT2
uuauaaaacuucgauaau

SEQ ID NO: 3764517 - RNA, 13 nt, Salmonella typhimurium LT2
uuauaaaauaacg

SEQ ID NO: 3764518 - RNA, 22 nt, Salmonella typhimurium LT2
uuauaaaauauuuaacuuaaau

SEQ ID NO: 3764519 - RNA, 19 nt, Salmonella typhimurium LT2
uuauaaaucaggaaaaagg

SEQ ID NO: 3764520 - RNA, 14 nt, Salmonella typhimurium LT2
uuauaaauccccgc

SEQ ID NO: 3764521 - RNA, 14 nt, Salmonella typhimurium LT2
uuauaaauuuuuua

SEQ ID NO: 3764522 - RNA, 15 nt, Salmonella typhimurium LT2
uuauaacguaucguu

SEQ ID NO: 3764523 - RNA, 22 nt, Salmonella typhimurium LT2
uuauaacuaaacucaucuuuau

SEQ ID NO: 3764524 - RNA, 12 nt, Salmonella typhimurium LT2
uuauacaaaaug

SEQ ID NO: 3764525 - RNA, 18 nt, Salmonella typhimurium LT2
uuauacaccgggaaaagc

SEQ ID NO: 3764526 - RNA, 16 nt, Salmonella typhimurium LT2
uuauacagcaccugcu

SEQ ID NO: 3764527 - RNA, 15 nt, Salmonella typhimurium LT2
uuauacaucgcuuuc

SEQ ID NO: 3764528 - RNA, 15 nt, Salmonella typhimurium LT2
uuauacucaaaaaau

SEQ ID NO: 3764529 - RNA, 18 nt, Salmonella typhimurium LT2
uuauagcucagcgcggca

SEQ ID NO: 3764530 - RNA, 14 nt, Salmonella typhimurium LT2
uuauaggucagguu

SEQ ID NO: 3764531 - RNA, 22 nt, Salmonella typhimurium LT2
uuauauaaaaaaugguuuuauu

SEQ ID NO: 3764532 - RNA, 12 nt, Salmonella typhimurium LT2
uuauauaaaaau

SEQ ID NO: 3764533 - RNA, 14 nt, Salmonella typhimurium LT2
uuauauaaaaauag

SEQ ID NO: 3764534 - RNA, 14 nt, Salmonella typhimurium LT2
uuauauauguucaa

SEQ ID NO: 3764535 - RNA, 22 nt, Salmonella typhimurium LT2
uuauauauguucaauauucaau

SEQ ID NO: 3764536 - RNA, 14 nt, Salmonella typhimurium LT2
uuaucaaaaaccuu

SEQ ID NO: 3764537 - RNA, 15 nt, Salmonella typhimurium LT2
uuaucaauaaccgcc

SEQ ID NO: 3764538 - RNA, 14 nt, Salmonella typhimurium LT2
uuaucaauccugcc

SEQ ID NO: 3764539 - RNA, 23 nt, Salmonella typhimurium LT2
uuaucaauccugccaaauaaucc

SEQ ID NO: 3764540 - RNA, 22 nt, Salmonella typhimurium LT2
uuaucacuauuacgauugcgcc

SEQ ID NO: 3764541 - RNA, 15 nt, Salmonella typhimurium LT2
uuaucagauaacccg

SEQ ID NO: 3764542 - RNA, 20 nt, Salmonella typhimurium LT2
uuaucagcaauaauuuuacc

SEQ ID NO: 3764543 - RNA, 17 nt, Salmonella typhimurium LT2
uuaucaggauaauuuca

SEQ ID NO: 3764544 - RNA, 21 nt, Salmonella typhimurium LT2
uuaucaggccgacaaaugacg

SEQ ID NO: 3764545 - RNA, 14 nt, Salmonella typhimurium LT2
uuaucaggccugua

SEQ ID NO: 3764546 - RNA, 16 nt, Salmonella typhimurium LT2
uuaucaucguaaaauc

SEQ ID NO: 3764547 - RNA, 20 nt, Salmonella typhimurium LT2
uuaucauuuuuucuaagaug

SEQ ID NO: 3764548 - RNA, 17 nt, Salmonella typhimurium LT2
uuauccacaaacuccag

SEQ ID NO: 3764549 - RNA, 21 nt, Salmonella typhimurium LT2
uuauccagcagccacagaaug

SEQ ID NO: 3764550 - RNA, 17 nt, Salmonella typhimurium LT2
uuauccaggcgggcauc

SEQ ID NO: 3764551 - RNA, 18 nt, Salmonella typhimurium LT2
uuauccccacuaccgcca

SEQ ID NO: 3764552 - RNA, 11 nt, Salmonella typhimurium LT2
uuauccccuuc

SEQ ID NO: 3764553 - RNA, 17 nt, Salmonella typhimurium LT2
uuaucccgcccgaucuc

SEQ ID NO: 3764554 - RNA, 17 nt, Salmonella typhimurium LT2
uuauccgccagccaguc

SEQ ID NO: 3764555 - RNA, 23 nt, Salmonella typhimurium LT2
uuauccgccagcgcaacgcgcau

SEQ ID NO: 3764556 - RNA, 15 nt, Salmonella typhimurium LT2
uuauccggcaaaaga

SEQ ID NO: 3764557 - RNA, 19 nt, Salmonella typhimurium LT2
uuauccggccuacagcuga

SEQ ID NO: 3764558 - RNA, 18 nt, Salmonella typhimurium LT2
uuauccggccuacgcguc

SEQ ID NO: 3764559 - RNA, 22 nt, Salmonella typhimurium LT2
uuauccggccuacgguaaacug

SEQ ID NO: 3764560 - RNA, 16 nt, Salmonella typhimurium LT2
uuauccugcaaauagc

SEQ ID NO: 3764561 - RNA, 17 nt, Salmonella typhimurium LT2
uuauccugcaaauagcg

SEQ ID NO: 3764562 - RNA, 13 nt, Salmonella typhimurium LT2
uuauccugcacga

SEQ ID NO: 3764563 - RNA, 22 nt, Salmonella typhimurium LT2
uuaucgaaauagcggugaacuu

SEQ ID NO: 3764564 - RNA, 15 nt, Salmonella typhimurium LT2
uuaucgccaaagaua

SEQ ID NO: 3764565 - RNA, 16 nt, Salmonella typhimurium LT2
uuaucgccccaggcga

SEQ ID NO: 3764566 - RNA, 18 nt, Salmonella typhimurium LT2
uuaucgccccaggcgaua

SEQ ID NO: 3764567 - RNA, 17 nt, Salmonella typhimurium LT2
uuaucgccguaaccgcc

SEQ ID NO: 3764568 - RNA, 12 nt, Salmonella typhimurium LT2
uuaucgcuauca

SEQ ID NO: 3764569 - RNA, 21 nt, Salmonella typhimurium LT2
uuaucgguaaugauaucgccc

SEQ ID NO: 3764570 - RNA, 14 nt, Salmonella typhimurium LT2
uuaucuaucaccgc

SEQ ID NO: 3764571 - RNA, 16 nt, Salmonella typhimurium LT2
uuaucucuuuugcuuc

SEQ ID NO: 3764572 - RNA, 19 nt, Salmonella typhimurium LT2
uuaucuggcgcaaccggcg

SEQ ID NO: 3764573 - RNA, 18 nt, Salmonella typhimurium LT2
uuaucugggucaggaacu

SEQ ID NO: 3764574 - RNA, 12 nt, Salmonella typhimurium LT2
uuaucuggucug

SEQ ID NO: 3764575 - RNA, 20 nt, Salmonella typhimurium LT2
uuaucuggucugcaugccgc

SEQ ID NO: 3764576 - RNA, 20 nt, Salmonella typhimurium LT2
uuaucugugggucugcggcg

SEQ ID NO: 3764577 - RNA, 12 nt, Salmonella typhimurium LT2
uuaucuuauaaa

SEQ ID NO: 3764578 - RNA, 22 nt, Salmonella typhimurium LT2
uuaucuuauaaauaagaaucca

SEQ ID NO: 3764579 - RNA, 20 nt, Salmonella typhimurium LT2
uuaucuugagucaaaagauu

SEQ ID NO: 3764580 - RNA, 16 nt, Salmonella typhimurium LT2
uuaucuuuaaauuuca

SEQ ID NO: 3764581 - RNA, 17 nt, Salmonella typhimurium LT2
uuaucuuuuacgcuguc

SEQ ID NO: 3764582 - RNA, 16 nt, Salmonella typhimurium LT2
uuaucuuuuauuucau

SEQ ID NO: 3764583 - RNA, 14 nt, Salmonella typhimurium LT2
uuaugaaugacagu

SEQ ID NO: 3764584 - RNA, 16 nt, Salmonella typhimurium LT2
uuaugacgggaaacag

SEQ ID NO: 3764585 - RNA, 17 nt, Salmonella typhimurium LT2
uuaugauuuuaacauca

SEQ ID NO: 3764586 - RNA, 13 nt, Salmonella typhimurium LT2
uucagccugaagc

SEQ ID NO: 3764587 - RNA, 15 nt, Salmonella typhimurium LT2
uucagccugaagcca

SEQ ID NO: 3764588 - RNA, 15 nt, Salmonella typhimurium LT2
uucagcgacuucguc

SEQ ID NO: 3764589 - RNA, 16 nt, Salmonella typhimurium LT2
uucagcguacagaagg

SEQ ID NO: 3764590 - RNA, 16 nt, Salmonella typhimurium LT2
uucagcguugcagcca

SEQ ID NO: 3764591 - RNA, 19 nt, Salmonella typhimurium LT2
uucagcguuucaccuucac

SEQ ID NO: 3764592 - RNA, 20 nt, Salmonella typhimurium LT2
uucagcucuuuuagcgcccg

SEQ ID NO: 3764593 - RNA, 20 nt, Salmonella typhimurium LT2
uucagcuuguggaaauaguc

SEQ ID NO: 3764594 - RNA, 23 nt, Salmonella typhimurium LT2
uucaggccaugcuuuugcaggua

SEQ ID NO: 3764595 - RNA, 13 nt, Salmonella typhimurium LT2
uucaggcuggcaa

SEQ ID NO: 3764596 - RNA, 20 nt, Salmonella typhimurium LT2
uucaguaaaucaacuuuuuu

SEQ ID NO: 3764597 - RNA, 14 nt, Salmonella typhimurium LT2
uucaguaagacaaa

SEQ ID NO: 3764598 - RNA, 16 nt, Salmonella typhimurium LT2
uucaguaagacaaaaa

SEQ ID NO: 3764599 - RNA, 17 nt, Salmonella typhimurium LT2
uucaguaagacaaaaau

SEQ ID NO: 3764600 - RNA, 19 nt, Salmonella typhimurium LT2
uucaguaagaguaccauuc

SEQ ID NO: 3764601 - RNA, 15 nt, Salmonella typhimurium LT2
uucagucaacagugu

SEQ ID NO: 3764602 - RNA, 19 nt, Salmonella typhimurium LT2
uucagucauaauccuuccu

SEQ ID NO: 3764603 - RNA, 21 nt, Salmonella typhimurium LT2
uucagucuacuacacacuuac

SEQ ID NO: 3764604 - RNA, 16 nt, Salmonella typhimurium LT2
uucagucuggcaaacc

SEQ ID NO: 3764605 - RNA, 23 nt, Salmonella typhimurium LT2
uucaguggucaggcgaccaauau

SEQ ID NO: 3764606 - RNA, 21 nt, Salmonella typhimurium LT2
uucaguucaucuuccacacua

SEQ ID NO: 3764607 - RNA, 12 nt, Salmonella typhimurium LT2
uucaguuucuuc

SEQ ID NO: 3764608 - RNA, 23 nt, Salmonella typhimurium LT2
uucaguuuuuccagcacggcaua

SEQ ID NO: 3764609 - RNA, 13 nt, Salmonella typhimurium LT2
uucauaaaagauc

SEQ ID NO: 3764610 - RNA, 17 nt, Salmonella typhimurium LT2
uucauaaagugccaggg

SEQ ID NO: 3764611 - RNA, 16 nt, Salmonella typhimurium LT2
uucauaacaccaauac

SEQ ID NO: 3764612 - RNA, 13 nt, Salmonella typhimurium LT2
uucauaauaagcg

SEQ ID NO: 3764613 - RNA, 21 nt, Salmonella typhimurium LT2
uucauaccggauauggcaaaa

SEQ ID NO: 3764614 - RNA, 14 nt, Salmonella typhimurium LT2
uucauagaaccacu

SEQ ID NO: 3764615 - RNA, 15 nt, Salmonella typhimurium LT2
uucauagaaccacuu

SEQ ID NO: 3764616 - RNA, 16 nt, Salmonella typhimurium LT2
uucauagcagcaagua

SEQ ID NO: 3764617 - RNA, 19 nt, Salmonella typhimurium LT2
uucauaguuugcauaaccg

SEQ ID NO: 3764618 - RNA, 21 nt, Salmonella typhimurium LT2
uucauauagucauaauacuca

SEQ ID NO: 3764619 - RNA, 15 nt, Salmonella typhimurium LT2
uucauauuaaauucc

SEQ ID NO: 3764620 - RNA, 20 nt, Salmonella typhimurium LT2
uucauauucaaaauccgcca

SEQ ID NO: 3764621 - RNA, 16 nt, Salmonella typhimurium LT2
uucaucaaagaaaacc

SEQ ID NO: 3764622 - RNA, 16 nt, Salmonella typhimurium LT2
uucaucaaagaaauac

SEQ ID NO: 3764623 - RNA, 17 nt, Salmonella typhimurium LT2
uucaucaguaacugacg

SEQ ID NO: 3764624 - RNA, 12 nt, Salmonella typhimurium LT2
uucaucauaucu

SEQ ID NO: 3764625 - RNA, 16 nt, Salmonella typhimurium LT2
uucaucauaucuuccc

SEQ ID NO: 3764626 - RNA, 14 nt, Salmonella typhimurium LT2
uucaucauuuuccc

SEQ ID NO: 3764627 - RNA, 15 nt, Salmonella typhimurium LT2
uucauccagaccuga

SEQ ID NO: 3764628 - RNA, 14 nt, Salmonella typhimurium LT2
uucauccagcagca

SEQ ID NO: 3764629 - RNA, 11 nt, Salmonella typhimurium LT2
uucauccagcg

SEQ ID NO: 3764630 - RNA, 18 nt, Salmonella typhimurium LT2
uucauccagcgcgcggca

SEQ ID NO: 3764631 - RNA, 23 nt, Salmonella typhimurium LT2
uucauccauugcuuccuugauau

SEQ ID NO: 3764632 - RNA, 23 nt, Salmonella typhimurium LT2
uucaucccagcuaaaaagcuguc

SEQ ID NO: 3764633 - RNA, 13 nt, Salmonella typhimurium LT2
uucauccggauaa

SEQ ID NO: 3764634 - RNA, 17 nt, Salmonella typhimurium LT2
uucauccggauaaagcc

SEQ ID NO: 3764635 - RNA, 14 nt, Salmonella typhimurium LT2
uucauccucaacca

SEQ ID NO: 3764636 - RNA, 16 nt, Salmonella typhimurium LT2
uucaucgacaaauacu

SEQ ID NO: 3764637 - RNA, 14 nt, Salmonella typhimurium LT2
uucaucgccgcgac

SEQ ID NO: 3764638 - RNA, 15 nt, Salmonella typhimurium LT2
uucaucggcucgacu

SEQ ID NO: 3764639 - RNA, 19 nt, Salmonella typhimurium LT2
uucaucgguaauauuaagg

SEQ ID NO: 3764640 - RNA, 20 nt, Salmonella typhimurium LT2
uucaucguuacgcagauagg

SEQ ID NO: 3764641 - RNA, 14 nt, Salmonella typhimurium LT2
uucaucucaucaau

SEQ ID NO: 3764642 - RNA, 15 nt, Salmonella typhimurium LT2
uucaucucaucaaug

SEQ ID NO: 3764643 - RNA, 21 nt, Salmonella typhimurium LT2
uucaugaaacucgcguagcgu

SEQ ID NO: 3764644 - RNA, 14 nt, Salmonella typhimurium LT2
uucaugaaucauca

SEQ ID NO: 3764645 - RNA, 18 nt, Salmonella typhimurium LT2
uucaugaaucaucacaau

SEQ ID NO: 3764646 - RNA, 16 nt, Salmonella typhimurium LT2
uucaugauacccagcg

SEQ ID NO: 3764647 - RNA, 18 nt, Salmonella typhimurium LT2
uucaugaucuuuccuuuu

SEQ ID NO: 3764648 - RNA, 16 nt, Salmonella typhimurium LT2
uucaugcacaaaaccc

SEQ ID NO: 3764649 - RNA, 18 nt, Salmonella typhimurium LT2
uucaugcacgaugguauc

SEQ ID NO: 3764650 - RNA, 13 nt, Salmonella typhimurium LT2
uucaugcgcggcg

SEQ ID NO: 3764651 - RNA, 16 nt, Salmonella typhimurium LT2
uucaugcuguauaaac

SEQ ID NO: 3764652 - RNA, 15 nt, Salmonella typhimurium LT2
uucaugcuucucaaa

SEQ ID NO: 3764653 - RNA, 20 nt, Salmonella typhimurium LT2
uucauggcgcgacauggcga

SEQ ID NO: 3764654 - RNA, 19 nt, Salmonella typhimurium LT2
uucaugguacucaacauca

SEQ ID NO: 3764655 - RNA, 14 nt, Salmonella typhimurium LT2
uucauuaaaccacu

SEQ ID NO: 3764656 - RNA, 13 nt, Salmonella typhimurium LT2
uucauuacgcuuc

SEQ ID NO: 3764657 - RNA, 12 nt, Salmonella typhimurium LT2
uucauuauaaaa

SEQ ID NO: 3764658 - RNA, 13 nt, Salmonella typhimurium LT2
uucauuauaaaac

SEQ ID NO: 3764659 - RNA, 15 nt, Salmonella typhimurium LT2
uucauuauaaaacau

SEQ ID NO: 3764660 - RNA, 17 nt, Salmonella typhimurium LT2
uucauuauaaaacauaa

SEQ ID NO: 3764661 - RNA, 14 nt, Salmonella typhimurium LT2
uucauuauaaaacu

SEQ ID NO: 3764662 - RNA, 13 nt, Salmonella typhimurium LT2
uucauuauuucau

SEQ ID NO: 3764663 - RNA, 16 nt, Salmonella typhimurium LT2
uucauucgccaccagg

SEQ ID NO: 3764664 - RNA, 19 nt, Salmonella typhimurium LT2
uucauucgccaccaggcuc

SEQ ID NO: 3764665 - RNA, 22 nt, Salmonella typhimurium LT2
uucauuggcuaaugaagacgaa

SEQ ID NO: 3764666 - RNA, 15 nt, Salmonella typhimurium LT2
uucauuucaaugcgu

SEQ ID NO: 3764667 - RNA, 15 nt, Salmonella typhimurium LT2
uucauuucaauguaa

SEQ ID NO: 3764668 - RNA, 20 nt, Salmonella typhimurium LT2
uucauuucgcccaucgcuuu

SEQ ID NO: 3764669 - RNA, 12 nt, Salmonella typhimurium LT2
uucauuugcaau

SEQ ID NO: 3764670 - RNA, 13 nt, Salmonella typhimurium LT2
uucauuugcaaug

SEQ ID NO: 3764671 - RNA, 22 nt, Salmonella typhimurium LT2
uucauuuguuccucgaaacgcu

SEQ ID NO: 3764672 - RNA, 18 nt, Salmonella typhimurium LT2
uuccacacggcauucacg

SEQ ID NO: 3764673 - RNA, 17 nt, Salmonella typhimurium LT2
uuccacacguccauccg

SEQ ID NO: 3764674 - RNA, 17 nt, Salmonella typhimurium LT2
uuccaccaccuccugcu

SEQ ID NO: 3764675 - RNA, 20 nt, Salmonella typhimurium LT2
uuccaccagauuucgcaaca

SEQ ID NO: 3764676 - RNA, 18 nt, Salmonella typhimurium LT2
uuccaccgucuugcugcg

SEQ ID NO: 3764677 - RNA, 21 nt, Salmonella typhimurium LT2
uuccacgccgucgaugauggc

SEQ ID NO: 3764678 - RNA, 23 nt, Salmonella typhimurium LT2
uuccacgcguacgguuacaaccc

SEQ ID NO: 3764679 - RNA, 23 nt, Salmonella typhimurium LT2
uuccacugcaucucuuccaggau

SEQ ID NO: 3764680 - RNA, 21 nt, Salmonella typhimurium LT2
uuccagaagcgcuuugccaau

SEQ ID NO: 3764681 - RNA, 15 nt, Salmonella typhimurium LT2
uuccagaugucagua

SEQ ID NO: 3764682 - RNA, 22 nt, Salmonella typhimurium LT2
uuccagcagauccauuaaaugc

SEQ ID NO: 3764683 - RNA, 20 nt, Salmonella typhimurium LT2
uuccagcagcucaucaauaa

SEQ ID NO: 3764684 - RNA, 22 nt, Salmonella typhimurium LT2
uuccagcauccugacauuaccc

SEQ ID NO: 3764685 - RNA, 21 nt, Salmonella typhimurium LT2
uuccagcaucgaccaggauuu

SEQ ID NO: 3764686 - RNA, 17 nt, Salmonella typhimurium LT2
uuccagcauuucuucaa

SEQ ID NO: 3764687 - RNA, 23 nt, Salmonella typhimurium LT2
uuccagccgcccgcgauaaaaau

SEQ ID NO: 3764688 - RNA, 11 nt, Salmonella typhimurium LT2
uuccagcgcca

SEQ ID NO: 3764689 - RNA, 16 nt, Salmonella typhimurium LT2
uuccagcgccauaaga

SEQ ID NO: 3764690 - RNA, 14 nt, Salmonella typhimurium LT2
uucgagcagaacug

SEQ ID NO: 3764691 - RNA, 16 nt, Salmonella typhimurium LT2
uucgagggcgauuuug

SEQ ID NO: 3764692 - RNA, 23 nt, Salmonella typhimurium LT2
uucgauaacggucauaucgucau

SEQ ID NO: 3764693 - RNA, 14 nt, Salmonella typhimurium LT2
uucgauaauaaaau

SEQ ID NO: 3764694 - RNA, 13 nt, Salmonella typhimurium LT2
uucgaucaugccu

SEQ ID NO: 3764695 - RNA, 14 nt, Salmonella typhimurium LT2
uucgaugaaaaaga

SEQ ID NO: 3764696 - RNA, 17 nt, Salmonella typhimurium LT2
uucgauggccucaucau

SEQ ID NO: 3764697 - RNA, 20 nt, Salmonella typhimurium LT2
uucgauuguugacugccagc

SEQ ID NO: 3764698 - RNA, 20 nt, Salmonella typhimurium LT2
uucgcaacaugaauuaacuu

SEQ ID NO: 3764699 - RNA, 21 nt, Salmonella typhimurium LT2
uucgcaaccuaaccaaacaga

SEQ ID NO: 3764700 - RNA, 18 nt, Salmonella typhimurium LT2
uucgcagcaauucugcug

SEQ ID NO: 3764701 - RNA, 18 nt, Salmonella typhimurium LT2
uucgcagcgauauuucuc

SEQ ID NO: 3764702 - RNA, 18 nt, Salmonella typhimurium LT2
uucgcagcguucgaaugc

SEQ ID NO: 3764703 - RNA, 20 nt, Salmonella typhimurium LT2
uucgcaugaauucaacgccc

SEQ ID NO: 3764704 - RNA, 19 nt, Salmonella typhimurium LT2
uucgcauguugacugcgcu

SEQ ID NO: 3764705 - RNA, 18 nt, Salmonella typhimurium LT2
uucgccaccagcaaaagu

SEQ ID NO: 3764706 - RNA, 20 nt, Salmonella typhimurium LT2
uucgccaccagcaaaaguug

SEQ ID NO: 3764707 - RNA, 15 nt, Salmonella typhimurium LT2
uucgccacgcucacu

SEQ ID NO: 3764708 - RNA, 17 nt, Salmonella typhimurium LT2
uucgccacgcucacuuu

SEQ ID NO: 3764709 - RNA, 13 nt, Salmonella typhimurium LT2
uucgcccacgccc

SEQ ID NO: 3764710 - RNA, 15 nt, Salmonella typhimurium LT2
uucgcccacggcaug

SEQ ID NO: 3764711 - RNA, 18 nt, Salmonella typhimurium LT2
uucgcccggcgccagcuc

SEQ ID NO: 3764712 - RNA, 22 nt, Salmonella typhimurium LT2
uucgcccguuguccgccagcgu

SEQ ID NO: 3764713 - RNA, 21 nt, Salmonella typhimurium LT2
uucgcgaauagugcagaaagg

SEQ ID NO: 3764714 - RNA, 13 nt, Salmonella typhimurium LT2
uucgcgcaguuca

SEQ ID NO: 3764715 - RNA, 23 nt, Salmonella typhimurium LT2
uucgcgcauugcgauaugcuguu

SEQ ID NO: 3764716 - RNA, 23 nt, Salmonella typhimurium LT2
uucgcgcgucaacggcgcggcgu

SEQ ID NO: 3764717 - RNA, 16 nt, Salmonella typhimurium LT2
uucgcggaauuucagg

SEQ ID NO: 3764718 - RNA, 15 nt, Salmonella typhimurium LT2
uucgcggcaaacaca

SEQ ID NO: 3764719 - RNA, 15 nt, Salmonella typhimurium LT2
uucgcguaaugcaau

SEQ ID NO: 3764720 - RNA, 13 nt, Salmonella typhimurium LT2
uucgcguucagaa

SEQ ID NO: 3764721 - RNA, 14 nt, Salmonella typhimurium LT2
uucgcucucgccac

SEQ ID NO: 3764722 - RNA, 13 nt, Salmonella typhimurium LT2
uucgcugcaacuu

SEQ ID NO: 3764723 - RNA, 15 nt, Salmonella typhimurium LT2
uucgcuuaccaggcc

SEQ ID NO: 3764724 - RNA, 22 nt, Salmonella typhimurium LT2
uucgcuucgguaaaaacagcca

SEQ ID NO: 3764725 - RNA, 23 nt, Salmonella typhimurium LT2
uucgcuugcccggccguuaccgu

SEQ ID NO: 3764726 - RNA, 17 nt, Salmonella typhimurium LT2
uucgcuugcggcugcca

SEQ ID NO: 3764727 - RNA, 17 nt, Salmonella typhimurium LT2
uucggagauauacaucu

SEQ ID NO: 3764728 - RNA, 18 nt, Salmonella typhimurium LT2
uucggauuauuggucagc

SEQ ID NO: 3764729 - RNA, 13 nt, Salmonella typhimurium LT2
uucggcaauccau

SEQ ID NO: 3764730 - RNA, 14 nt, Salmonella typhimurium LT2
uucggcaaucugcu

SEQ ID NO: 3764731 - RNA, 18 nt, Salmonella typhimurium LT2
uucggcagauuaccggca

SEQ ID NO: 3764732 - RNA, 21 nt, Salmonella typhimurium LT2
uucggcagcgcgaacaggcug

SEQ ID NO: 3764733 - RNA, 13 nt, Salmonella typhimurium LT2
uucggcuucaauu

SEQ ID NO: 3764734 - RNA, 17 nt, Salmonella typhimurium LT2
uucgggcacuccggcuc

SEQ ID NO: 3764735 - RNA, 19 nt, Salmonella typhimurium LT2
uucgggcgcaugcugccau

SEQ ID NO: 3764736 - RNA, 14 nt, Salmonella typhimurium LT2
uucggguuuuccug

SEQ ID NO: 3764737 - RNA, 17 nt, Salmonella typhimurium LT2
uucgguaguuccagaau

SEQ ID NO: 3764738 - RNA, 18 nt, Salmonella typhimurium LT2
uucgguauuaaaacgcac

SEQ ID NO: 3764739 - RNA, 13 nt, Salmonella typhimurium LT2
uucggucagaucc

SEQ ID NO: 3764740 - RNA, 20 nt, Salmonella typhimurium LT2
uucguaauagcgucuaaauu

SEQ ID NO: 3764741 - RNA, 22 nt, Salmonella typhimurium LT2
uucguaauagcgucuaaauuuc

SEQ ID NO: 3764742 - RNA, 17 nt, Salmonella typhimurium LT2
uucguacauguccagau

SEQ ID NO: 3764743 - RNA, 16 nt, Salmonella typhimurium LT2
uucguagacucaggcg

SEQ ID NO: 3764744 - RNA, 23 nt, Salmonella typhimurium LT2
uucguaggauuuaaaccgccccg

SEQ ID NO: 3764745 - RNA, 21 nt, Salmonella typhimurium LT2
uucguaggcaacaauuucuac

SEQ ID NO: 3764746 - RNA, 15 nt, Salmonella typhimurium LT2
uucguccagggugaa

SEQ ID NO: 3764747 - RNA, 12 nt, Salmonella typhimurium LT2
uucgucggcaaa

SEQ ID NO: 3764748 - RNA, 22 nt, Salmonella typhimurium LT2
uucgucggcaaaacgcgccacg

SEQ ID NO: 3764749 - RNA, 16 nt, Salmonella typhimurium LT2
uucgucgguaccgcuu

SEQ ID NO: 3764750 - RNA, 15 nt, Salmonella typhimurium LT2
uucgucuucaucuuc

SEQ ID NO: 3764751 - RNA, 18 nt, Salmonella typhimurium LT2
uucgucuuuauucaucau

SEQ ID NO: 3764752 - RNA, 18 nt, Salmonella typhimurium LT2
uucgugaaaaccuaaaua

SEQ ID NO: 3764753 - RNA, 17 nt, Salmonella typhimurium LT2
uucgugcaguccuguag

SEQ ID NO: 3764754 - RNA, 15 nt, Salmonella typhimurium LT2
uucguguaaaugacg

SEQ ID NO: 3764755 - RNA, 17 nt, Salmonella typhimurium LT2
uucguuauaaggccugc

SEQ ID NO: 3764756 - RNA, 14 nt, Salmonella typhimurium LT2
uucguucucugaau

SEQ ID NO: 3764757 - RNA, 21 nt, Salmonella typhimurium LT2
uucuaaaaguaagcuauguuu

SEQ ID NO: 3764758 - RNA, 15 nt, Salmonella typhimurium LT2
uucuaacaaaacaga

SEQ ID NO: 3764759 - RNA, 15 nt, Salmonella typhimurium LT2
uucuaccgcuucuua

SEQ ID NO: 3764760 - RNA, 13 nt, Salmonella typhimurium LT2
uucuaccugcaau

SEQ ID NO: 3764761 - RNA, 17 nt, Salmonella typhimurium LT2
uucuacucugcucgcca

SEQ ID NO: 3764762 - RNA, 18 nt, Salmonella typhimurium LT2
uucuacucugcucgccag

SEQ ID NO: 3764763 - RNA, 19 nt, Salmonella typhimurium LT2
uucuacucuucacccuucu

SEQ ID NO: 3764764 - RNA, 18 nt, Salmonella typhimurium LT2
uucuacuuccaccaccuc

SEQ ID NO: 3764765 - RNA, 13 nt, Salmonella typhimurium LT2
uucuauuaaauca

SEQ ID NO: 3764766 - RNA, 15 nt, Salmonella typhimurium LT2
uucucaaaggcuuug

SEQ ID NO: 3764767 - RNA, 22 nt, Salmonella typhimurium LT2
uucucacagaaucaucaggcua

SEQ ID NO: 3764768 - RNA, 21 nt, Salmonella typhimurium LT2
uucucaggcaucgcugauaaa

SEQ ID NO: 3764769 - RNA, 18 nt, Salmonella typhimurium LT2
uucucauccccccuguag

SEQ ID NO: 3764770 - RNA, 15 nt, Salmonella typhimurium LT2
uucuccaugccagaa

SEQ ID NO: 3764771 - RNA, 23 nt, Salmonella typhimurium LT2
uucucccgccagaugcagcggca

SEQ ID NO: 3764772 - RNA, 15 nt, Salmonella typhimurium LT2
uucucccuacugcuu

SEQ ID NO: 3764773 - RNA, 22 nt, Salmonella typhimurium LT2
uucuccgggauagcaaucucgc

SEQ ID NO: 3764774 - RNA, 19 nt, Salmonella typhimurium LT2
uucuccugcaucugcgcau

SEQ ID NO: 3764775 - RNA, 15 nt, Salmonella typhimurium LT2
uucucgccgugacug

SEQ ID NO: 3764776 - RNA, 15 nt, Salmonella typhimurium LT2
uucucgcgcagccag

SEQ ID NO: 3764777 - RNA, 17 nt, Salmonella typhimurium LT2
uucucgcggcaguaagc

SEQ ID NO: 3764778 - RNA, 14 nt, Salmonella typhimurium LT2
uucucuuccacaaa

SEQ ID NO: 3764779 - RNA, 13 nt, Salmonella typhimurium LT2
uucucuucugcug

SEQ ID NO: 3764780 - RNA, 15 nt, Salmonella typhimurium LT2
uucucuucuucaaug

SEQ ID NO: 3764781 - RNA, 18 nt, Salmonella typhimurium LT2
uucugaauaaauugaauu

SEQ ID NO: 3764782 - RNA, 12 nt, Salmonella typhimurium LT2
uucugaauaaua

SEQ ID NO: 3764783 - RNA, 15 nt, Salmonella typhimurium LT2
uucugaauuucacgc

SEQ ID NO: 3764784 - RNA, 20 nt, Salmonella typhimurium LT2
uucugacagaauauaggaga

SEQ ID NO: 3764785 - RNA, 18 nt, Salmonella typhimurium LT2
uucugaccgcauuuucuc

SEQ ID NO: 3764786 - RNA, 17 nt, Salmonella typhimurium LT2
uucugauaacgcaggcg

SEQ ID NO: 3764787 - RNA, 15 nt, Salmonella typhimurium LT2
uucugauaagcgcag

SEQ ID NO: 3764788 - RNA, 17 nt, Salmonella typhimurium LT2
uucugccagcagaagac

SEQ ID NO: 3764789 - RNA, 19 nt, Salmonella typhimurium LT2
uucugcgccauuuccagcc

SEQ ID NO: 3764790 - RNA, 22 nt, Salmonella typhimurium LT2
uucugcgcuaagcguuacggaa

SEQ ID NO: 3764791 - RNA, 23 nt, Salmonella typhimurium LT2
uucugcgcuaagcguuacggaaa

SEQ ID NO: 3764792 - RNA, 14 nt, Salmonella typhimurium LT2
uucugcucaaugau

SEQ ID NO: 3764793 - RNA, 12 nt, Salmonella typhimurium LT2
uucuggaaguag

SEQ ID NO: 3764794 - RNA, 16 nt, Salmonella typhimurium LT2
uugcagacgugcaaua

SEQ ID NO: 3764795 - RNA, 21 nt, Salmonella typhimurium LT2
uugcagcaaauacagaugcug

SEQ ID NO: 3764796 - RNA, 12 nt, Salmonella typhimurium LT2
uugcagcgccau

SEQ ID NO: 3764797 - RNA, 13 nt, Salmonella typhimurium LT2
uugcauaaagaac

SEQ ID NO: 3764798 - RNA, 16 nt, Salmonella typhimurium LT2
uugcauuuuaucuuuu

SEQ ID NO: 3764799 - RNA, 22 nt, Salmonella typhimurium LT2
uugccaaaaaaucagcaaucgc

SEQ ID NO: 3764800 - RNA, 21 nt, Salmonella typhimurium LT2
uugccacaauaucaucgucau

SEQ ID NO: 3764801 - RNA, 16 nt, Salmonella typhimurium LT2
uugccacgccauacgu

SEQ ID NO: 3764802 - RNA, 23 nt, Salmonella typhimurium LT2
uugccacuggcuuuccugaucaa

SEQ ID NO: 3764803 - RNA, 18 nt, Salmonella typhimurium LT2
uugccagaaacgcguagc

SEQ ID NO: 3764804 - RNA, 18 nt, Salmonella typhimurium LT2
uugccagcgcauccaccg

SEQ ID NO: 3764805 - RNA, 15 nt, Salmonella typhimurium LT2
uugccagugaaaaaa

SEQ ID NO: 3764806 - RNA, 12 nt, Salmonella typhimurium LT2
uugccauacgcc

SEQ ID NO: 3764807 - RNA, 16 nt, Salmonella typhimurium LT2
uugccauacgcccacg

SEQ ID NO: 3764808 - RNA, 15 nt, Salmonella typhimurium LT2
uugccaugaaaacga

SEQ ID NO: 3764809 - RNA, 20 nt, Salmonella typhimurium LT2
uugccauucgccagcccgau

SEQ ID NO: 3764810 - RNA, 21 nt, Salmonella typhimurium LT2
uugccccauaauucaaccggc

SEQ ID NO: 3764811 - RNA, 15 nt, Salmonella typhimurium LT2
uugccccgcuuucag

SEQ ID NO: 3764812 - RNA, 12 nt, Salmonella typhimurium LT2
uugccccuuccg

SEQ ID NO: 3764813 - RNA, 21 nt, Salmonella typhimurium LT2
uugcccgcgcuucgcuauucc

SEQ ID NO: 3764814 - RNA, 22 nt, Salmonella typhimurium LT2
uugcccggccguuaccguggcg

SEQ ID NO: 3764815 - RNA, 20 nt, Salmonella typhimurium LT2
uugcccgguggcgcugcgcu

SEQ ID NO: 3764816 - RNA, 22 nt, Salmonella typhimurium LT2
uugccgcaauugguaauuaaag

SEQ ID NO: 3764817 - RNA, 15 nt, Salmonella typhimurium LT2
uugccgccgagcaga

SEQ ID NO: 3764818 - RNA, 20 nt, Salmonella typhimurium LT2
uugccgcgcggauucuccag

SEQ ID NO: 3764819 - RNA, 16 nt, Salmonella typhimurium LT2
uugccggagaccuuuu

SEQ ID NO: 3764820 - RNA, 20 nt, Salmonella typhimurium LT2
uugccggagagaugccgcca

SEQ ID NO: 3764821 - RNA, 16 nt, Salmonella typhimurium LT2
uugccgucaacacgca

SEQ ID NO: 3764822 - RNA, 14 nt, Salmonella typhimurium LT2
uugccgucgccgga

SEQ ID NO: 3764823 - RNA, 15 nt, Salmonella typhimurium LT2
uugccguuaacugcu

SEQ ID NO: 3764824 - RNA, 18 nt, Salmonella typhimurium LT2
uugccguuaacugcugcu

SEQ ID NO: 3764825 - RNA, 23 nt, Salmonella typhimurium LT2
uugccugauggcgcuacgccuga

SEQ ID NO: 3764826 - RNA, 20 nt, Salmonella typhimurium LT2
uugccugauggcgcugcgcu

SEQ ID NO: 3764827 - RNA, 17 nt, Salmonella typhimurium LT2
uugccuucgccgcccaa

SEQ ID NO: 3764828 - RNA, 18 nt, Salmonella typhimurium LT2
uugccuuguuucgucaau

SEQ ID NO: 3764829 - RNA, 15 nt, Salmonella typhimurium LT2
uugccuuucagaucg

SEQ ID NO: 3764830 - RNA, 16 nt, Salmonella typhimurium LT2
uugcgaaaaagugaua

SEQ ID NO: 3764831 - RNA, 15 nt, Salmonella typhimurium LT2
uugcgaacaguuccg

SEQ ID NO: 3764832 - RNA, 18 nt, Salmonella typhimurium LT2
uugcgaaguucauauggc

SEQ ID NO: 3764833 - RNA, 17 nt, Salmonella typhimurium LT2
uugcgacaaccuguagg

SEQ ID NO: 3764834 - RNA, 14 nt, Salmonella typhimurium LT2
uugcgacaggcugc

SEQ ID NO: 3764835 - RNA, 19 nt, Salmonella typhimurium LT2
uugcgacaggcugccgacu

SEQ ID NO: 3764836 - RNA, 14 nt, Salmonella typhimurium LT2
uugcgauacagcgu

SEQ ID NO: 3764837 - RNA, 20 nt, Salmonella typhimurium LT2
uugcgauacagcguaucggc

SEQ ID NO: 3764838 - RNA, 19 nt, Salmonella typhimurium LT2
uugcgcaagcacugaaugc

SEQ ID NO: 3764839 - RNA, 19 nt, Salmonella typhimurium LT2
uugcgcagcauaucgccgu

SEQ ID NO: 3764840 - RNA, 20 nt, Salmonella typhimurium LT2
uugcgccaccuuaaucgacu

SEQ ID NO: 3764841 - RNA, 15 nt, Salmonella typhimurium LT2
uugcgccacggaugg

SEQ ID NO: 3764842 - RNA, 14 nt, Salmonella typhimurium LT2
uugcgccacugcca

SEQ ID NO: 3764843 - RNA, 14 nt, Salmonella typhimurium LT2
uugcgccagcgcca

SEQ ID NO: 3764844 - RNA, 16 nt, Salmonella typhimurium LT2
uugcgcgaccacgcca

SEQ ID NO: 3764845 - RNA, 15 nt, Salmonella typhimurium LT2
uugcgcgccacgccc

SEQ ID NO: 3764846 - RNA, 16 nt, Salmonella typhimurium LT2
uugcgcgccacgccca

SEQ ID NO: 3764847 - RNA, 20 nt, Salmonella typhimurium LT2
uugcgcgguuaacagccgcu

SEQ ID NO: 3764848 - RNA, 18 nt, Salmonella typhimurium LT2
uugcgcgucucucccuca

SEQ ID NO: 3764849 - RNA, 16 nt, Salmonella typhimurium LT2
uugcgcuccggcacug

SEQ ID NO: 3764850 - RNA, 14 nt, Salmonella typhimurium LT2
uugcgcucugccag

SEQ ID NO: 3764851 - RNA, 22 nt, Salmonella typhimurium LT2
uugcggaauacacgaacacaga

SEQ ID NO: 3764852 - RNA, 21 nt, Salmonella typhimurium LT2
uugcggaauaugagcacagcc

SEQ ID NO: 3764853 - RNA, 15 nt, Salmonella typhimurium LT2
uugcggcacacagcc

SEQ ID NO: 3764854 - RNA, 12 nt, Salmonella typhimurium LT2
uugcggcaucag

SEQ ID NO: 3764855 - RNA, 15 nt, Salmonella typhimurium LT2
uugcggcgcagggcg

SEQ ID NO: 3764856 - RNA, 20 nt, Salmonella typhimurium LT2
uugcgggccucguuaaaauc

SEQ ID NO: 3764857 - RNA, 14 nt, Salmonella typhimurium LT2
uugcguauuuuuau

SEQ ID NO: 3764858 - RNA, 14 nt, Salmonella typhimurium LT2
uugcgucaccgggc

SEQ ID NO: 3764859 - RNA, 12 nt, Salmonella typhimurium LT2
uugcgucaugcg

SEQ ID NO: 3764860 - RNA, 14 nt, Salmonella typhimurium LT2
uugcguccauuaag

SEQ ID NO: 3764861 - RNA, 21 nt, Salmonella typhimurium LT2
uugcucaaaaagcucaagcgc

SEQ ID NO: 3764862 - RNA, 11 nt, Salmonella typhimurium LT2
uugcucaagcu

SEQ ID NO: 3764863 - RNA, 19 nt, Salmonella typhimurium LT2
uugcucaggcgcgaauaau

SEQ ID NO: 3764864 - RNA, 18 nt, Salmonella typhimurium LT2
uugcucguaccaggcccc

SEQ ID NO: 3764865 - RNA, 17 nt, Salmonella typhimurium LT2
uugcucucggguacacu

SEQ ID NO: 3764866 - RNA, 12 nt, Salmonella typhimurium LT2
uugcucuuucug

SEQ ID NO: 3764867 - RNA, 17 nt, Salmonella typhimurium LT2
uugcugaagauaaaauu

SEQ ID NO: 3764868 - RNA, 17 nt, Salmonella typhimurium LT2
uugcugagcagccagcc

SEQ ID NO: 3764869 - RNA, 21 nt, Salmonella typhimurium LT2
uugcugagccaucauuaccaa

SEQ ID NO: 3764870 - RNA, 15 nt, Salmonella typhimurium LT2
uugcugauuaaaauc

SEQ ID NO: 3764871 - RNA, 19 nt, Salmonella typhimurium LT2
uugcugcccgccgccagcc

SEQ ID NO: 3764872 - RNA, 23 nt, Salmonella typhimurium LT2
uugcugccgauuggucaauaagu

SEQ ID NO: 3764873 - RNA, 15 nt, Salmonella typhimurium LT2
uugcugcguaaccgc

SEQ ID NO: 3764874 - RNA, 21 nt, Salmonella typhimurium LT2
uugcugcugcggaucgucucu

SEQ ID NO: 3764875 - RNA, 14 nt, Salmonella typhimurium LT2
uugcugcuguauuu

SEQ ID NO: 3764876 - RNA, 18 nt, Salmonella typhimurium LT2
uugcuggcaagaaccgcu

SEQ ID NO: 3764877 - RNA, 23 nt, Salmonella typhimurium LT2
uugcuggcucaggcguugacuua

SEQ ID NO: 3764878 - RNA, 17 nt, Salmonella typhimurium LT2
uugcuggcuugcucagg

SEQ ID NO: 3764879 - RNA, 17 nt, Salmonella typhimurium LT2
uugcugugaagcaauuc

SEQ ID NO: 3764880 - RNA, 12 nt, Salmonella typhimurium LT2
uugcuguuccag

SEQ ID NO: 3764881 - RNA, 22 nt, Salmonella typhimurium LT2
uugcuugugagggcaaaguucc

SEQ ID NO: 3764882 - RNA, 17 nt, Salmonella typhimurium LT2
uugcuuuauuuuuaauu

SEQ ID NO: 3764883 - RNA, 17 nt, Salmonella typhimurium LT2
uugcuuuucaucaccau

SEQ ID NO: 3764884 - RNA, 22 nt, Salmonella typhimurium LT2
uuggaaaaccccaucccggcaa

SEQ ID NO: 3764885 - RNA, 12 nt, Salmonella typhimurium LT2
uuggacggcauc

SEQ ID NO: 3764886 - RNA, 14 nt, Salmonella typhimurium LT2
uuggaggccggaua

SEQ ID NO: 3764887 - RNA, 14 nt, Salmonella typhimurium LT2
uuggaucgacgcug

SEQ ID NO: 3764888 - RNA, 13 nt, Salmonella typhimurium LT2
uuggaucggcaaa

SEQ ID NO: 3764889 - RNA, 17 nt, Salmonella typhimurium LT2
uuggauucauuaaacca

SEQ ID NO: 3764890 - RNA, 23 nt, Salmonella typhimurium LT2
uuggcaaacugccgguaaagaaa

SEQ ID NO: 3764891 - RNA, 22 nt, Salmonella typhimurium LT2
uuggcaacccguaccuccagcg

SEQ ID NO: 3764892 - RNA, 14 nt, Salmonella typhimurium LT2
uuggcaaucacaag

SEQ ID NO: 3764893 - RNA, 21 nt, Salmonella typhimurium LT2
uuggcagggcugaaucggcac

SEQ ID NO: 3764894 - RNA, 19 nt, Salmonella typhimurium LT2
uuggcauagccaguggaac

SEQ ID NO: 3764895 - RNA, 20 nt, Salmonella typhimurium LT2
uuggcaucauaaaaggcauc

SEQ ID NO: 3764896 - RNA, 13 nt, Salmonella typhimurium LT2
uuggcauccagca

SEQ ID NO: 3764897 - RNA, 15 nt, Salmonella typhimurium LT2
uuggccagcauggcg

SEQ ID NO: 3764898 - RNA, 13 nt, Salmonella typhimurium LT2
uuuaccgugaaug

SEQ ID NO: 3764899 - RNA, 18 nt, Salmonella typhimurium LT2
uuuaccuguacccgguac

SEQ ID NO: 3764900 - RNA, 17 nt, Salmonella typhimurium LT2
uuuaccuguuuaucuga

SEQ ID NO: 3764901 - RNA, 19 nt, Salmonella typhimurium LT2
uuuacgcagcaagaacaga

SEQ ID NO: 3764902 - RNA, 10 nt, Salmonella typhimurium LT2
uuuacgccau

SEQ ID NO: 3764903 - RNA, 21 nt, Salmonella typhimurium LT2
uuuacgccgccauccggcaca

SEQ ID NO: 3764904 - RNA, 20 nt, Salmonella typhimurium LT2
uuuacggcccuaccauuacc

SEQ ID NO: 3764905 - RNA, 22 nt, Salmonella typhimurium LT2
uuuacguaacugcgguaaauaa

SEQ ID NO: 3764906 - RNA, 16 nt, Salmonella typhimurium LT2
uuuacguucgaugauu

SEQ ID NO: 3764907 - RNA, 17 nt, Salmonella typhimurium LT2
uuuacuauagauauuaa

SEQ ID NO: 3764908 - RNA, 17 nt, Salmonella typhimurium LT2
uuuacuauugccgauaa

SEQ ID NO: 3764909 - RNA, 18 nt, Salmonella typhimurium LT2
uuuacuccauucccagcu

SEQ ID NO: 3764910 - RNA, 18 nt, Salmonella typhimurium LT2
uuuacucuucgacacauu

SEQ ID NO: 3764911 - RNA, 23 nt, Salmonella typhimurium LT2
uuuacuuaguaucauauuuucuu

SEQ ID NO: 3764912 - RNA, 16 nt, Salmonella typhimurium LT2
uuuacuucuucaggcu

SEQ ID NO: 3764913 - RNA, 12 nt, Salmonella typhimurium LT2
uuuacuuucauu

SEQ ID NO: 3764914 - RNA, 13 nt, Salmonella typhimurium LT2
uuuagcaccagac

SEQ ID NO: 3764915 - RNA, 16 nt, Salmonella typhimurium LT2
uuuagcaccuuacgaa

SEQ ID NO: 3764916 - RNA, 11 nt, Salmonella typhimurium LT2
uuuagcacguu

SEQ ID NO: 3764917 - RNA, 14 nt, Salmonella typhimurium LT2
uuuagccagcagcg

SEQ ID NO: 3764918 - RNA, 16 nt, Salmonella typhimurium LT2
uuuagcgauaaacggc

SEQ ID NO: 3764919 - RNA, 15 nt, Salmonella typhimurium LT2
uuuaggucaaaaaag

SEQ ID NO: 3764920 - RNA, 11 nt, Salmonella typhimurium LT2
uuuagucguca

SEQ ID NO: 3764921 - RNA, 16 nt, Salmonella typhimurium LT2
uuuagugcucagcuug

SEQ ID NO: 3764922 - RNA, 13 nt, Salmonella typhimurium LT2
uuuaguuaucagg

SEQ ID NO: 3764923 - RNA, 13 nt, Salmonella typhimurium LT2
uuuauaaaacuac

SEQ ID NO: 3764924 - RNA, 16 nt, Salmonella typhimurium LT2
uuuauaaauuaacucu

SEQ ID NO: 3764925 - RNA, 19 nt, Salmonella typhimurium LT2
uuuauacucaauaaccucu

SEQ ID NO: 3764926 - RNA, 11 nt, Salmonella typhimurium LT2
uuuaucagaag

SEQ ID NO: 3764927 - RNA, 22 nt, Salmonella typhimurium LT2
uuuaucagaugugguauuuucu

SEQ ID NO: 3764928 - RNA, 23 nt, Salmonella typhimurium LT2
uuuauccacgccgcuaucgacca

SEQ ID NO: 3764929 - RNA, 11 nt, Salmonella typhimurium LT2
uuuauccagua

SEQ ID NO: 3764930 - RNA, 17 nt, Salmonella typhimurium LT2
uuuauccauuucaucag

SEQ ID NO: 3764931 - RNA, 20 nt, Salmonella typhimurium LT2
uuuauccggcacgguaaacc

SEQ ID NO: 3764932 - RNA, 18 nt, Salmonella typhimurium LT2
uuuaucgaaguaauaaaa

SEQ ID NO: 3764933 - RNA, 19 nt, Salmonella typhimurium LT2
uuuaucgaaguaauaaaaa

SEQ ID NO: 3764934 - RNA, 22 nt, Salmonella typhimurium LT2
uuuaucgaagugcgaaauuuaa

SEQ ID NO: 3764935 - RNA, 24 nt, Salmonella typhimurium LT2
uuuaucuauucagguuauuugccu

SEQ ID NO: 3764936 - RNA, 18 nt, Salmonella typhimurium LT2
uuuaucuuuuacgcuguc

SEQ ID NO: 3764937 - RNA, 22 nt, Salmonella typhimurium LT2
uuuaugacuggggcguuuuuua

SEQ ID NO: 3764938 - RNA, 20 nt, Salmonella typhimurium LT2
uuuaugcguuuaauugaauu

SEQ ID NO: 3764939 - RNA, 15 nt, Salmonella typhimurium LT2
uuuauggcacaucag

SEQ ID NO: 3764940 - RNA, 20 nt, Salmonella typhimurium LT2
uuuauggccaaccagauuuu

SEQ ID NO: 3764941 - RNA, 15 nt, Salmonella typhimurium LT2
uuuaugggcauuuca

SEQ ID NO: 3764942 - RNA, 14 nt, Salmonella typhimurium LT2
uuuaugucaguaau

SEQ ID NO: 3764943 - RNA, 13 nt, Salmonella typhimurium LT2
uuuaugugccgau

SEQ ID NO: 3764944 - RNA, 22 nt, Salmonella typhimurium LT2
uuuauuacgcgcucucauaagc

SEQ ID NO: 3764945 - RNA, 14 nt, Salmonella typhimurium LT2
uuuauuacgcuucu

SEQ ID NO: 3764946 - RNA, 13 nt, Salmonella typhimurium LT2
uuuauugauuauu

SEQ ID NO: 3764947 - RNA, 20 nt, Salmonella typhimurium LT2
uuuauuucaucuauuauuuu

SEQ ID NO: 3764948 - RNA, 14 nt, Salmonella typhimurium LT2
uuuauuuguauuau

SEQ ID NO: 3764949 - RNA, 19 nt, Salmonella typhimurium LT2
uuuauuuuuaauugcugaa

SEQ ID NO: 3764950 - RNA, 17 nt, Salmonella typhimurium LT2
uuucaaaaugacaaauu

SEQ ID NO: 3764951 - RNA, 19 nt, Salmonella typhimurium LT2
uuucaaauccagcuguccg

SEQ ID NO: 3764952 - RNA, 20 nt, Salmonella typhimurium LT2
uuucaacagcacccaggcac

SEQ ID NO: 3764953 - RNA, 22 nt, Salmonella typhimurium LT2
uuucaacguuuuauuacgcuuc

SEQ ID NO: 3764954 - RNA, 15 nt, Salmonella typhimurium LT2
uuucaacugccccuu

SEQ ID NO: 3764955 - RNA, 12 nt, Salmonella typhimurium LT2
uuucaacuggcu

SEQ ID NO: 3764956 - RNA, 19 nt, Salmonella typhimurium LT2
uuucaacuuccgcguuagg

SEQ ID NO: 3764957 - RNA, 22 nt, Salmonella typhimurium LT2
uuucaagcagacgaucggcgug

SEQ ID NO: 3764958 - RNA, 11 nt, Salmonella typhimurium LT2
uuucaauaaua

SEQ ID NO: 3764959 - RNA, 18 nt, Salmonella typhimurium LT2
uuucaauacuccacaguu

SEQ ID NO: 3764960 - RNA, 20 nt, Salmonella typhimurium LT2
uuucaauccuucuucugaaa

SEQ ID NO: 3764961 - RNA, 13 nt, Salmonella typhimurium LT2
uuucaaucgccac

SEQ ID NO: 3764962 - RNA, 16 nt, Salmonella typhimurium LT2
uuucaaucgccaccac

SEQ ID NO: 3764963 - RNA, 20 nt, Salmonella typhimurium LT2
uuucacccccagcugacugg

SEQ ID NO: 3764964 - RNA, 20 nt, Salmonella typhimurium LT2
uuucaccucacuccagaccu

SEQ ID NO: 3764965 - RNA, 19 nt, Salmonella typhimurium LT2
uuucaccuggaugcugccu

SEQ ID NO: 3764966 - RNA, 21 nt, Salmonella typhimurium LT2
uuucacgccuuuugacgcuuc

SEQ ID NO: 3764967 - RNA, 21 nt, Salmonella typhimurium LT2
uuucacuaauccccauuuuuu

SEQ ID NO: 3764968 - RNA, 12 nt, Salmonella typhimurium LT2
uuucacuauaaa

SEQ ID NO: 3764969 - RNA, 19 nt, Salmonella typhimurium LT2
uuucacucgcauucuucag

SEQ ID NO: 3764970 - RNA, 14 nt, Salmonella typhimurium LT2
uuucacuuccaugc

SEQ ID NO: 3764971 - RNA, 23 nt, Salmonella typhimurium LT2
uuucagauuuuuaauguccagca

SEQ ID NO: 3764972 - RNA, 14 nt, Salmonella typhimurium LT2
uuucagcaagaagc

SEQ ID NO: 3764973 - RNA, 13 nt, Salmonella typhimurium LT2
uuucagcaggccu

SEQ ID NO: 3764974 - RNA, 14 nt, Salmonella typhimurium LT2
uuucagcauuaaga

SEQ ID NO: 3764975 - RNA, 19 nt, Salmonella typhimurium LT2
uuucagccgcgcauagcug

SEQ ID NO: 3764976 - RNA, 12 nt, Salmonella typhimurium LT2
uuucagcgccag

SEQ ID NO: 3764977 - RNA, 16 nt, Salmonella typhimurium LT2
uuucagcucgcaggcc

SEQ ID NO: 3764978 - RNA, 18 nt, Salmonella typhimurium LT2
uuucagcucgcaggccau

SEQ ID NO: 3764979 - RNA, 19 nt, Salmonella typhimurium LT2
uuucaggcaaaaaaaaccg

SEQ ID NO: 3764980 - RNA, 15 nt, Salmonella typhimurium LT2
uuucaggcugcucau

SEQ ID NO: 3764981 - RNA, 13 nt, Salmonella typhimurium LT2
uuucagucaucau

SEQ ID NO: 3764982 - RNA, 14 nt, Salmonella typhimurium LT2
uuucagugauaaag

SEQ ID NO: 3764983 - RNA, 16 nt, Salmonella typhimurium LT2
uuucagugauaaagcc

SEQ ID NO: 3764984 - RNA, 11 nt, Salmonella typhimurium LT2
uuucaguucaa

SEQ ID NO: 3764985 - RNA, 23 nt, Salmonella typhimurium LT2
uuucauagcagcaaguauaauca

SEQ ID NO: 3764986 - RNA, 20 nt, Salmonella typhimurium LT2
uuucauaugcgggguuugca

SEQ ID NO: 3764987 - RNA, 14 nt, Salmonella typhimurium LT2
uuucauauuuuccu

SEQ ID NO: 3764988 - RNA, 20 nt, Salmonella typhimurium LT2
uuucaucaucuguugcaauu

SEQ ID NO: 3764989 - RNA, 13 nt, Salmonella typhimurium LT2
uuucaucuacgcu

SEQ ID NO: 3764990 - RNA, 14 nt, Salmonella typhimurium LT2
uuucaucuauuauu

SEQ ID NO: 3764991 - RNA, 21 nt, Salmonella typhimurium LT2
uuucaucuauuauuuuucuau

SEQ ID NO: 3764992 - RNA, 15 nt, Salmonella typhimurium LT2
uuucaucugcaguaa

SEQ ID NO: 3764993 - RNA, 20 nt, Salmonella typhimurium LT2
uuucaucuuuaaaaucgcgc

SEQ ID NO: 3764994 - RNA, 22 nt, Salmonella typhimurium LT2
uuucauggucaucgcaaauucu

SEQ ID NO: 3764995 - RNA, 14 nt, Salmonella typhimurium LT2
uuucauuacgcuuc

SEQ ID NO: 3764996 - RNA, 13 nt, Salmonella typhimurium LT2
uuucauuauaaaa

SEQ ID NO: 3764997 - RNA, 20 nt, Salmonella typhimurium LT2
uuucauucagggaaucagcg

SEQ ID NO: 3764998 - RNA, 13 nt, Salmonella typhimurium LT2
uuuccaaaaucca

SEQ ID NO: 3764999 - RNA, 23 nt, Salmonella typhimurium LT2
uuuccaaaauccagggaaaccau

SEQ ID NO: 3765000 - RNA, 16 nt, Salmonella typhimurium LT2
uuuccagcaucgacca

SEQ ID NO: 3765001 - RNA, 20 nt, Salmonella typhimurium LT2
uuuccagccccuucgcuguc

SEQ ID NO: 3765002 - RNA, 22 nt, Salmonella typhimurium LT2
uuuccagcuccagccgcugccu

SEQ ID NO: 3765003 - RNA, 13 nt, Salmonella typhimurium LT2
uuuccagugccag

SEQ ID NO: 3765004 - RNA, 16 nt, Salmonella typhimurium LT2
uuuccaguucaaucag

SEQ ID NO: 3765005 - RNA, 20 nt, Salmonella typhimurium LT2
uuuccaguugcggcaucaga

SEQ ID NO: 3765006 - RNA, 20 nt, Salmonella typhimurium LT2
uuucccaacuguauuuugaa

SEQ ID NO: 3765007 - RNA, 13 nt, Salmonella typhimurium LT2
uuucccacuguuc

SEQ ID NO: 3765008 - RNA, 13 nt, Salmonella typhimurium LT2
uuucccaguggcg

SEQ ID NO: 3765009 - RNA, 15 nt, Salmonella typhimurium LT2
uuucccccacuucug

SEQ ID NO: 3765010 - RNA, 19 nt, Salmonella typhimurium LT2
uuuccccccuccaucaaau

SEQ ID NO: 3765011 - RNA, 23 nt, Salmonella typhimurium LT2
uuucccccgcugaggccugcaca

SEQ ID NO: 3765012 - RNA, 16 nt, Salmonella typhimurium LT2
uuuccccgaugccauu

SEQ ID NO: 3765013 - RNA, 19 nt, Salmonella typhimurium LT2
uuuccccguuuuacaccag

SEQ ID NO: 3765014 - RNA, 16 nt, Salmonella typhimurium LT2
uuuccccugcgaacag

SEQ ID NO: 3765015 - RNA, 17 nt, Salmonella typhimurium LT2
uuucccggauaaauguu

SEQ ID NO: 3765016 - RNA, 23 nt, Salmonella typhimurium LT2
uuucccggcguaauccagcuuca

SEQ ID NO: 3765017 - RNA, 12 nt, Salmonella typhimurium LT2
uuuccgaaucag

SEQ ID NO: 3765018 - RNA, 18 nt, Salmonella typhimurium LT2
uuuccgcagccagaauca

SEQ ID NO: 3765019 - RNA, 22 nt, Salmonella typhimurium LT2
uuuccgccauagaacauauuca

SEQ ID NO: 3765020 - RNA, 17 nt, Salmonella typhimurium LT2
uuuccgccgccuucugc

SEQ ID NO: 3765021 - RNA, 18 nt, Salmonella typhimurium LT2
uuuccgcgagagaaaaaa

SEQ ID NO: 3765022 - RNA, 13 nt, Salmonella typhimurium LT2
uuuccggcaccag

SEQ ID NO: 3765023 - RNA, 23 nt, Salmonella typhimurium LT2
uuuccggcgcaaucuuugccgca

SEQ ID NO: 3765024 - RNA, 23 nt, Salmonella typhimurium LT2
uuuccggcuguuuugcuucuuca

SEQ ID NO: 3765025 - RNA, 15 nt, Salmonella typhimurium LT2
uuuccggucgcgcaa

SEQ ID NO: 3765026 - RNA, 22 nt, Salmonella typhimurium LT2
uuuccguuuguaacauauuuuu

SEQ ID NO: 3765027 - RNA, 19 nt, Salmonella typhimurium LT2
uuuccucguuuaaugcgaa

SEQ ID NO: 3765028 - RNA, 16 nt, Salmonella typhimurium LT2
uuuccucuucuugcug

SEQ ID NO: 3765029 - RNA, 20 nt, Salmonella typhimurium LT2
uuuccugauuugcggcagaa

SEQ ID NO: 3765030 - RNA, 16 nt, Salmonella typhimurium LT2
uuuccugcugccaucg

SEQ ID NO: 3765031 - RNA, 21 nt, Salmonella typhimurium LT2
uuucgaaacguucgcauccca

SEQ ID NO: 3765032 - RNA, 22 nt, Salmonella typhimurium LT2
uuucgaacgccgacaucacgca

SEQ ID NO: 3765033 - RNA, 22 nt, Salmonella typhimurium LT2
uuucgacaaacaccgagccaga

SEQ ID NO: 3765034 - RNA, 17 nt, Salmonella typhimurium LT2
uuucgacggcaaccuuc

SEQ ID NO: 3765035 - RNA, 15 nt, Salmonella typhimurium LT2
uuucgagcagaacug

SEQ ID NO: 3765036 - RNA, 18 nt, Salmonella typhimurium LT2
uuucgagcagaacuggcg

SEQ ID NO: 3765037 - RNA, 21 nt, Salmonella typhimurium LT2
uuucgagccuugccgcaauug

SEQ ID NO: 3765038 - RNA, 14 nt, Salmonella typhimurium LT2
uuucgauaaccgcc

SEQ ID NO: 3765039 - RNA, 16 nt, Salmonella typhimurium LT2
uuucgaugaaaaagag

SEQ ID NO: 3765040 - RNA, 15 nt, Salmonella typhimurium LT2
uuucgcaaacugguc

SEQ ID NO: 3765041 - RNA, 17 nt, Salmonella typhimurium LT2
uuucgccagaaccgcgc

SEQ ID NO: 3765042 - RNA, 18 nt, Salmonella typhimurium LT2
uuucgccagcaacgccca

SEQ ID NO: 3765043 - RNA, 12 nt, Salmonella typhimurium LT2
uuucgccagcau

SEQ ID NO: 3765044 - RNA, 22 nt, Salmonella typhimurium LT2
uuucgcccgguucauuaccgac

SEQ ID NO: 3765045 - RNA, 23 nt, Salmonella typhimurium LT2
uuucgccguguaagagcuggucg

SEQ ID NO: 3765046 - RNA, 18 nt, Salmonella typhimurium LT2
uuucgcuccacuggcccc

SEQ ID NO: 3765047 - RNA, 14 nt, Salmonella typhimurium LT2
uuucggcgcgcugg

SEQ ID NO: 3765048 - RNA, 14 nt, Salmonella typhimurium LT2
uuucgguucgccgc

SEQ ID NO: 3765049 - RNA, 14 nt, Salmonella typhimurium LT2
uuucguaagccgcg

SEQ ID NO: 3765050 - RNA, 17 nt, Salmonella typhimurium LT2
uuucguacauguccaga

SEQ ID NO: 3765051 - RNA, 12 nt, Salmonella typhimurium LT2
uuucguaccgaa

SEQ ID NO: 3765052 - RNA, 20 nt, Salmonella typhimurium LT2
uuucguacgaacucuuucuu

SEQ ID NO: 3765053 - RNA, 13 nt, Salmonella typhimurium LT2
uuucgucaauauu

SEQ ID NO: 3765054 - RNA, 21 nt, Salmonella typhimurium LT2
uuucgucagcacuucccacug

SEQ ID NO: 3765055 - RNA, 13 nt, Salmonella typhimurium LT2
uuucuacaaaugu

SEQ ID NO: 3765056 - RNA, 16 nt, Salmonella typhimurium LT2
uuucuaccugcaaugu

SEQ ID NO: 3765057 - RNA, 19 nt, Salmonella typhimurium LT2
uuucuagggauaacaguau

SEQ ID NO: 3765058 - RNA, 16 nt, Salmonella typhimurium LT2
uuucuaguaugucuau

SEQ ID NO: 3765059 - RNA, 13 nt, Salmonella typhimurium LT2
uuucuaucccuuc

SEQ ID NO: 3765060 - RNA, 16 nt, Salmonella typhimurium LT2
uuucuaugugcgccag

SEQ ID NO: 3765061 - RNA, 13 nt, Salmonella typhimurium LT2
uuucucaauacga

SEQ ID NO: 3765062 - RNA, 12 nt, Salmonella typhimurium LT2
uuucucaucaag

SEQ ID NO: 3765063 - RNA, 13 nt, Salmonella typhimurium LT2
uuucucauuaaaa

SEQ ID NO: 3765064 - RNA, 18 nt, Salmonella typhimurium LT2
uuucucauuaaaaaaccg

SEQ ID NO: 3765065 - RNA, 19 nt, Salmonella typhimurium LT2
uuucucccgccagaugcag

SEQ ID NO: 3765066 - RNA, 22 nt, Salmonella typhimurium LT2
uuucucccggauggcaaaaaca

SEQ ID NO: 3765067 - RNA, 14 nt, Salmonella typhimurium LT2
uuucuccguuguug

SEQ ID NO: 3765068 - RNA, 19 nt, Salmonella typhimurium LT2
uuucucggcuuuccagcuc

SEQ ID NO: 3765069 - RNA, 22 nt, Salmonella typhimurium LT2
uuucucugguuucccugccuca

SEQ ID NO: 3765070 - RNA, 14 nt, Salmonella typhimurium LT2
uuucugaucuguuu

SEQ ID NO: 3765071 - RNA, 15 nt, Salmonella typhimurium LT2
uuucugggcaacuca

SEQ ID NO: 3765072 - RNA, 12 nt, Salmonella typhimurium LT2
uuucuguauuuu

SEQ ID NO: 3765073 - RNA, 14 nt, Salmonella typhimurium LT2
uuucuguuccgaaa

SEQ ID NO: 3765074 - RNA, 15 nt, Salmonella typhimurium LT2
uuucuguuccgaaau

SEQ ID NO: 3765075 - RNA, 13 nt, Salmonella typhimurium LT2
uuucuuaauuccu

SEQ ID NO: 3765076 - RNA, 19 nt, Salmonella typhimurium LT2
uuucuuccauuagcuguug

SEQ ID NO: 3765077 - RNA, 15 nt, Salmonella typhimurium LT2
uuucuucgcgguaac

SEQ ID NO: 3765078 - RNA, 18 nt, Salmonella typhimurium LT2
uuucuucgcucucgacau

SEQ ID NO: 3765079 - RNA, 14 nt, Salmonella typhimurium LT2
uuucuucuauuucu

SEQ ID NO: 3765080 - RNA, 12 nt, Salmonella typhimurium LT2
uuucuucucaac

SEQ ID NO: 3765081 - RNA, 23 nt, Salmonella typhimurium LT2
uuucuucuuugcgcgucucuccc

SEQ ID NO: 3765082 - RNA, 21 nt, Salmonella typhimurium LT2
uuucuugccacuggccuccca

SEQ ID NO: 3765083 - RNA, 22 nt, Salmonella typhimurium LT2
uuucuugcgccagcgcgcguac

SEQ ID NO: 3765084 - RNA, 13 nt, Salmonella typhimurium LT2
uuucuuucaucaa

SEQ ID NO: 3765085 - RNA, 14 nt, Salmonella typhimurium LT2
uuucuuucaucaaa

SEQ ID NO: 3765086 - RNA, 13 nt, Salmonella typhimurium LT2
uuucuuucaucag

SEQ ID NO: 3765087 - RNA, 20 nt, Salmonella typhimurium LT2
uuugaaaaucacaucgccgg

SEQ ID NO: 3765088 - RNA, 15 nt, Salmonella typhimurium LT2
uuugaacucuuucag

SEQ ID NO: 3765089 - RNA, 18 nt, Salmonella typhimurium LT2
uuugaacucuuucagacc

SEQ ID NO: 3765090 - RNA, 15 nt, Salmonella typhimurium LT2
uuugaauaaucccgc

SEQ ID NO: 3765091 - RNA, 14 nt, Salmonella typhimurium LT2
uuugacauugucau

SEQ ID NO: 3765092 - RNA, 23 nt, Salmonella typhimurium LT2
uuugaccagauaaucaaacgcgc

SEQ ID NO: 3765093 - RNA, 18 nt, Salmonella typhimurium LT2
uuugaccagcaucgccgg

SEQ ID NO: 3765094 - RNA, 17 nt, Salmonella typhimurium LT2
uuugaccugaauccaga

SEQ ID NO: 3765095 - RNA, 22 nt, Salmonella typhimurium LT2
uuugacucgcuacgcucgcccu

SEQ ID NO: 3765096 - RNA, 20 nt, Salmonella typhimurium LT2
uuugacuucacuuucaagcc

SEQ ID NO: 3765097 - RNA, 17 nt, Salmonella typhimurium LT2
uuugagcagcgccaucu

SEQ ID NO: 3765098 - RNA, 12 nt, Salmonella typhimurium LT2
uuugaggaaacc

SEQ ID NO: 3765099 - RNA, 18 nt, Salmonella typhimurium LT2
uuugaggaaaccuuucuu

SEQ ID NO: 3765100 - RNA, 19 nt, Salmonella typhimurium LT2
uuugagguaugucgaauau

SEQ ID NO: 3765101 - RNA, 17 nt, Salmonella typhimurium LT2
uuugagucgcauccagu

SEQ ID NO: 3765102 - RNA, 14 nt, Salmonella typhimurium LT2
uuugauaaaaacac

SEQ ID NO: 3765103 - RNA, 17 nt, Salmonella typhimurium LT2
uuugauaaacugcgcca

SEQ ID NO: 3765104 - RNA, 22 nt, Salmonella typhimurium LT2
uuugauaaacugcgccauguuc

SEQ ID NO: 3765105 - RNA, 15 nt, Salmonella typhimurium LT2
uuugauaagagaaaa

SEQ ID NO: 3765106 - RNA, 14 nt, Salmonella typhimurium LT2
uuugauacucugcu

SEQ ID NO: 3765107 - RNA, 17 nt, Salmonella typhimurium LT2
uuuuaauuuucuguaau

SEQ ID NO: 3765108 - RNA, 18 nt, Salmonella typhimurium LT2
uuuuacaggcacuuacuc

SEQ ID NO: 3765109 - RNA, 16 nt, Salmonella typhimurium LT2
uuuuacauagugucua

SEQ ID NO: 3765110 - RNA, 13 nt, Salmonella typhimurium LT2
uuuuacaucuuuc

SEQ ID NO: 3765111 - RNA, 20 nt, Salmonella typhimurium LT2
uuuuaccaguacaauuucug

SEQ ID NO: 3765112 - RNA, 23 nt, Salmonella typhimurium LT2
uuuuaccccccaugaauuacagc

SEQ ID NO: 3765113 - RNA, 23 nt, Salmonella typhimurium LT2
uuuuacgagaaccaacugccaaa

SEQ ID NO: 3765114 - RNA, 19 nt, Salmonella typhimurium LT2
uuuuacugcguaaucuuuu

SEQ ID NO: 3765115 - RNA, 15 nt, Salmonella typhimurium LT2
uuuuacuuucauucc

SEQ ID NO: 3765116 - RNA, 14 nt, Salmonella typhimurium LT2
uuuuacuuuccaua

SEQ ID NO: 3765117 - RNA, 14 nt, Salmonella typhimurium LT2
uuuuagaacuaucu

SEQ ID NO: 3765118 - RNA, 19 nt, Salmonella typhimurium LT2
uuuuagaacuaucugaaag

SEQ ID NO: 3765119 - RNA, 14 nt, Salmonella typhimurium LT2
uuuuagcagugcaa

SEQ ID NO: 3765120 - RNA, 16 nt, Salmonella typhimurium LT2
uuuuagcauaacguuu

SEQ ID NO: 3765121 - RNA, 17 nt, Salmonella typhimurium LT2
uuuuagcguuucaucgg

SEQ ID NO: 3765122 - RNA, 14 nt, Salmonella typhimurium LT2
uuuuagcuuaaaaa

SEQ ID NO: 3765123 - RNA, 20 nt, Salmonella typhimurium LT2
uuuuagcuuaaaaaauccug

SEQ ID NO: 3765124 - RNA, 20 nt, Salmonella typhimurium LT2
uuuuaggcacaucaauaaau

SEQ ID NO: 3765125 - RNA, 15 nt, Salmonella typhimurium LT2
uuuuaggcuauaaaa

SEQ ID NO: 3765126 - RNA, 13 nt, Salmonella typhimurium LT2
uuuuauaaaauuu

SEQ ID NO: 3765127 - RNA, 14 nt, Salmonella typhimurium LT2
uuuuauaaauauag

SEQ ID NO: 3765128 - RNA, 13 nt, Salmonella typhimurium LT2
uuuuauacauccu

SEQ ID NO: 3765129 - RNA, 12 nt, Salmonella typhimurium LT2
uuuuaucagacc

SEQ ID NO: 3765130 - RNA, 20 nt, Salmonella typhimurium LT2
uuuuaucagaccugccugau

SEQ ID NO: 3765131 - RNA, 12 nt, Salmonella typhimurium LT2
uuuuaucagacu

SEQ ID NO: 3765132 - RNA, 13 nt, Salmonella typhimurium LT2
uuuuaucagcuug

SEQ ID NO: 3765133 - RNA, 12 nt, Salmonella typhimurium LT2
uuuuauccauuu

SEQ ID NO: 3765134 - RNA, 20 nt, Salmonella typhimurium LT2
uuuuaucgaaguaauaaaaa

SEQ ID NO: 3765135 - RNA, 21 nt, Salmonella typhimurium LT2
uuuuaucgaaguaauaaaaaa

SEQ ID NO: 3765136 - RNA, 23 nt, Salmonella typhimurium LT2
uuuuaucgaaguaauaaaaaaca

SEQ ID NO: 3765137 - RNA, 20 nt, Salmonella typhimurium LT2
uuuuaugcacgcuauaacgu

SEQ ID NO: 3765138 - RNA, 16 nt, Salmonella typhimurium LT2
uuuuaugcguuuaauu

SEQ ID NO: 3765139 - RNA, 21 nt, Salmonella typhimurium LT2
uuuuauguguauagcuuuucu

SEQ ID NO: 3765140 - RNA, 19 nt, Salmonella typhimurium LT2
uuuuauuuguguauuuuuu

SEQ ID NO: 3765141 - RNA, 15 nt, Salmonella typhimurium LT2
uuuuauuuuagcuuc

SEQ ID NO: 3765142 - RNA, 21 nt, Salmonella typhimurium LT2
uuuuauuuuagcuucuucaua

SEQ ID NO: 3765143 - RNA, 14 nt, Salmonella typhimurium LT2
uuuucaaaagagag

SEQ ID NO: 3765144 - RNA, 15 nt, Salmonella typhimurium LT2
uuuucaaacaaacau

SEQ ID NO: 3765145 - RNA, 12 nt, Salmonella typhimurium LT2
uuuucaaagaug

SEQ ID NO: 3765146 - RNA, 15 nt, Salmonella typhimurium LT2
uuuucaaauccagcu

SEQ ID NO: 3765147 - RNA, 17 nt, Salmonella typhimurium LT2
uuuucaaccacggauaa

SEQ ID NO: 3765148 - RNA, 20 nt, Salmonella typhimurium LT2
uuuucaaugucgcaaucggc

SEQ ID NO: 3765149 - RNA, 17 nt, Salmonella typhimurium LT2
uuuucaauuugugagac

SEQ ID NO: 3765150 - RNA, 19 nt, Salmonella typhimurium LT2
uuuucacgaccagccaaca

SEQ ID NO: 3765151 - RNA, 23 nt, Salmonella typhimurium LT2
uuuucacuaauccccauuuuuuu

SEQ ID NO: 3765152 - RNA, 21 nt, Salmonella typhimurium LT2
uuuucagauagcgaaccauca

SEQ ID NO: 3765153 - RNA, 13 nt, Salmonella typhimurium LT2
uuuucagcauuaa

SEQ ID NO: 3765154 - RNA, 15 nt, Salmonella typhimurium LT2
uuuucaggcacagaa

SEQ ID NO: 3765155 - RNA, 14 nt, Salmonella typhimurium LT2
uuuucaucugcagu

SEQ ID NO: 3765156 - RNA, 14 nt, Salmonella typhimurium LT2
uuuucauuauaaaa

SEQ ID NO: 3765157 - RNA, 16 nt, Salmonella typhimurium LT2
uuuucauuauaaaacu

SEQ ID NO: 3765158 - RNA, 18 nt, Salmonella typhimurium LT2
uuuuccacagacccagua

SEQ ID NO: 3765159 - RNA, 12 nt, Salmonella typhimurium LT2
uuuuccagcuca

SEQ ID NO: 3765160 - RNA, 13 nt, Salmonella typhimurium LT2
uuuuccaucacgu

SEQ ID NO: 3765161 - RNA, 14 nt, Salmonella typhimurium LT2
uuuucccauaaaag

SEQ ID NO: 3765162 - RNA, 19 nt, Salmonella typhimurium LT2
uuuuccugcugccaucgcu

SEQ ID NO: 3765163 - RNA, 20 nt, Salmonella typhimurium LT2
uuuuccugcugguagagcau

SEQ ID NO: 3765164 - RNA, 17 nt, Salmonella typhimurium LT2
uuuucgaugcacgccac

SEQ ID NO: 3765165 - RNA, 18 nt, Salmonella typhimurium LT2
uuuucgcagcaauucugc

SEQ ID NO: 3765166 - RNA, 18 nt, Salmonella typhimurium LT2
uuuucgcccccagcacga

SEQ ID NO: 3765167 - RNA, 17 nt, Salmonella typhimurium LT2
uuuucgcccgguucauu

SEQ ID NO: 3765168 - RNA, 20 nt, Salmonella typhimurium LT2
uuuucgcuucgguaaaaaca

SEQ ID NO: 3765169 - RNA, 14 nt, Salmonella typhimurium LT2
uuuucguuccagag

SEQ ID NO: 3765170 - RNA, 15 nt, Salmonella typhimurium LT2
uuuucucaauacgau

SEQ ID NO: 3765171 - RNA, 23 nt, Salmonella typhimurium LT2
uuuucugcccauuucagcauuaa

SEQ ID NO: 3765172 - RNA, 18 nt, Salmonella typhimurium LT2
uuuucugcgccaccagcg

SEQ ID NO: 3765173 - RNA, 17 nt, Salmonella typhimurium LT2
uuuucuucuucggcuuc

SEQ ID NO: 3765174 - RNA, 22 nt, Salmonella typhimurium LT2
uuuucuugcuacauaucuguuu

SEQ ID NO: 3765175 - RNA, 14 nt, Salmonella typhimurium LT2
uuuugaaaucuugc

SEQ ID NO: 3765176 - RNA, 11 nt, Salmonella typhimurium LT2
uuuugaauaau

SEQ ID NO: 3765177 - RNA, 18 nt, Salmonella typhimurium LT2
uuuugacaacaaaaagau

SEQ ID NO: 3765178 - RNA, 19 nt, Salmonella typhimurium LT2
uuuugaguuugucauccag

SEQ ID NO: 3765179 - RNA, 17 nt, Salmonella typhimurium LT2
uuuugauaaaucagcac

SEQ ID NO: 3765180 - RNA, 20 nt, Salmonella typhimurium LT2
uuuugauaagagaaaauacc

SEQ ID NO: 3765181 - RNA, 14 nt, Salmonella typhimurium LT2
uuuugauauaaccg

SEQ ID NO: 3765182 - RNA, 14 nt, Salmonella typhimurium LT2
uuuugcaaaacuga

SEQ ID NO: 3765183 - RNA, 22 nt, Salmonella typhimurium LT2
uuuugcagcaacugauucaaaa

SEQ ID NO: 3765184 - RNA, 21 nt, Salmonella typhimurium LT2
uuuugcccgaucccauguuca

SEQ ID NO: 3765185 - RNA, 17 nt, Salmonella typhimurium LT2
uuuugcccgcucgcuua

SEQ ID NO: 3765186 - RNA, 12 nt, Salmonella typhimurium LT2
uuuugccgauaa

SEQ ID NO: 3765187 - RNA, 10 nt, Salmonella typhimurium LT2
uuuugccgcc

SEQ ID NO: 3765188 - RNA, 21 nt, Salmonella typhimurium LT2
uuuugccgcccagucacggcu

SEQ ID NO: 3765189 - RNA, 16 nt, Salmonella typhimurium LT2
uuuugccggaccugcg

SEQ ID NO: 3765190 - RNA, 17 nt, Salmonella typhimurium LT2
uuuugccguugcuguuc

SEQ ID NO: 3765191 - RNA, 15 nt, Salmonella typhimurium LT2
uuuugcgguuuuaau

SEQ ID NO: 3765192 - RNA, 21 nt, Salmonella typhimurium LT2
uuuugcucucggguacacucu

SEQ ID NO: 3765193 - RNA, 13 nt, Salmonella typhimurium LT2
uuuugcuucuuca

SEQ ID NO: 3765194 - RNA, 15 nt, Salmonella typhimurium LT2
uuuuguagacucgcg

SEQ ID NO: 3765195 - RNA, 16 nt, Salmonella typhimurium LT2
uuuugugaauaucacc

SEQ ID NO: 3765196 - RNA, 12 nt, Salmonella typhimurium LT2
uuuuguggccug

SEQ ID NO: 3765197 - RNA, 20 nt, Salmonella typhimurium LT2
uuuuguggccugcuuaaaca

SEQ ID NO: 3765198 - RNA, 12 nt, Salmonella typhimurium LT2
uuuuuaauaaua

SEQ ID NO: 3765199 - RNA, 12 nt, Salmonella typhimurium LT2
uuuuuaauauca

SEQ ID NO: 3765200 - RNA, 12 nt, Salmonella typhimurium LT2
uuuuuacauucu

SEQ ID NO: 3765201 - RNA, 16 nt, Salmonella typhimurium LT2
uuuuuacgccugaacg

SEQ ID NO: 3765202 - RNA, 18 nt, Salmonella typhimurium LT2
uuuuuacgucagcaauac

SEQ ID NO: 3765203 - RNA, 17 nt, Salmonella typhimurium LT2
uuuuuagcgugccgacg

SEQ ID NO: 3765204 - RNA, 23 nt, Salmonella typhimurium LT2
uuuuuaggcuauaaaaaucaucc

SEQ ID NO: 3765205 - RNA, 21 nt, Salmonella typhimurium LT2
uuuuuauauuccgcaggcaag

SEQ ID NO: 3765206 - RNA, 12 nt, Salmonella typhimurium LT2
uuuuuauucaua

SEQ ID NO: 3765207 - RNA, 15 nt, Salmonella typhimurium LT2
uuuuucaccaucugc

SEQ ID NO: 3765208 - RNA, 21 nt, Salmonella typhimurium LT2
uuuuucacgaccagccaacag

SEQ ID NO: 3765209 - RNA, 12 nt, Salmonella typhimurium LT2
uuuuucagaucu

SEQ ID NO: 3765210 - RNA, 12 nt, Salmonella typhimurium LT2
uuuuucaucauc

SEQ ID NO: 3765211 - RNA, 12 nt, Salmonella typhimurium LT2
uuuuucaucugc

SEQ ID NO: 3765212 - RNA, 20 nt, Salmonella typhimurium LT2
aucauucccgcccaguauuc

SEQ ID NO: 3765213 - RNA, 22 nt, Salmonella typhimurium LT2
aucauucccguaucuucauguu

SEQ ID NO: 3765214 - RNA, 22 nt, Salmonella typhimurium LT2
aucauucgagaugcauaaaaaa

SEQ ID NO: 3765215 - RNA, 22 nt, Salmonella typhimurium LT2
aucauucgcgaauagugcagaa

SEQ ID NO: 3765216 - RNA, 16 nt, Salmonella typhimurium LT2
aucauucucuacgccc

SEQ ID NO: 3765217 - RNA, 15 nt, Salmonella typhimurium LT2
aucauucuuauucgu

SEQ ID NO: 3765218 - RNA, 14 nt, Salmonella typhimurium LT2
aucauugacuucaa

SEQ ID NO: 3765219 - RNA, 14 nt, Salmonella typhimurium LT2
aucauugcgccaag

SEQ ID NO: 3765220 - RNA, 22 nt, Salmonella typhimurium LT2
aucauugguuaacucaagcgaa

SEQ ID NO: 3765221 - RNA, 16 nt, Salmonella typhimurium LT2
aucauuucaucuacgc

SEQ ID NO: 3765222 - RNA, 12 nt, Salmonella typhimurium LT2
aucauuucuaca

SEQ ID NO: 3765223 - RNA, 16 nt, Salmonella typhimurium LT2
aucauuuucccacuga

SEQ ID NO: 3765224 - RNA, 13 nt, Salmonella typhimurium LT2
aucauuuuuuaau

SEQ ID NO: 3765225 - RNA, 13 nt, Salmonella typhimurium LT2
auccaacacggcg

SEQ ID NO: 3765226 - RNA, 21 nt, Salmonella typhimurium LT2
auccaacacggcgcucaggau

SEQ ID NO: 3765227 - RNA, 17 nt, Salmonella typhimurium LT2
auccaaccgcugaccau

SEQ ID NO: 3765228 - RNA, 23 nt, Salmonella typhimurium LT2
auccaaccgcugaccaucaacaa

SEQ ID NO: 3765229 - RNA, 22 nt, Salmonella typhimurium LT2
auccaacgcgguuuucccuuuu

SEQ ID NO: 3765230 - RNA, 16 nt, Salmonella typhimurium LT2
auccaacgguacgacg

SEQ ID NO: 3765231 - RNA, 17 nt, Salmonella typhimurium LT2
auccaacucaguuucca

SEQ ID NO: 3765232 - RNA, 21 nt, Salmonella typhimurium LT2
auccaacuuaugaaaaccugu

SEQ ID NO: 3765233 - RNA, 16 nt, Salmonella typhimurium LT2
auccaaugacagugaa

SEQ ID NO: 3765234 - RNA, 16 nt, Salmonella typhimurium LT2
auccacacaggccugc

SEQ ID NO: 3765235 - RNA, 16 nt, Salmonella typhimurium LT2
auccacauacugcaau

SEQ ID NO: 3765236 - RNA, 20 nt, Salmonella typhimurium LT2
auccacauuccagaccugaa

SEQ ID NO: 3765237 - RNA, 19 nt, Salmonella typhimurium LT2
auccaccaccagcaucacg

SEQ ID NO: 3765238 - RNA, 15 nt, Salmonella typhimurium LT2
auccaccaccagguu

SEQ ID NO: 3765239 - RNA, 20 nt, Salmonella typhimurium LT2
auccaccagcccaucuuucg

SEQ ID NO: 3765240 - RNA, 14 nt, Salmonella typhimurium LT2
auccaccagcccca

SEQ ID NO: 3765241 - RNA, 13 nt, Salmonella typhimurium LT2
auccaccaggcau

SEQ ID NO: 3765242 - RNA, 19 nt, Salmonella typhimurium LT2
auccacccuggcgcagugg

SEQ ID NO: 3765243 - RNA, 23 nt, Salmonella typhimurium LT2
auccacgccgcuaucgaccagca

SEQ ID NO: 3765244 - RNA, 16 nt, Salmonella typhimurium LT2
auccacggaucgacau

SEQ ID NO: 3765245 - RNA, 18 nt, Salmonella typhimurium LT2
auccacggcaucaauaac

SEQ ID NO: 3765246 - RNA, 19 nt, Salmonella typhimurium LT2
auccacggguuacaacugc

SEQ ID NO: 3765247 - RNA, 23 nt, Salmonella typhimurium LT2
auccacucggcgcugucguucca

SEQ ID NO: 3765248 - RNA, 18 nt, Salmonella typhimurium LT2
auccacugagcgcgccau

SEQ ID NO: 3765249 - RNA, 20 nt, Salmonella typhimurium LT2
auccacugagcgcgccauga

SEQ ID NO: 3765250 - RNA, 24 nt, Salmonella typhimurium LT2
auccacuuucgcuacaucggcuac

SEQ ID NO: 3765251 - RNA, 23 nt, Salmonella typhimurium LT2
auccagaacugcgaaaucaccga

SEQ ID NO: 3765252 - RNA, 18 nt, Salmonella typhimurium LT2
auccagaauaccagaauc

SEQ ID NO: 3765253 - RNA, 21 nt, Salmonella typhimurium LT2
auccagaauacgccgccgccc

SEQ ID NO: 3765254 - RNA, 22 nt, Salmonella typhimurium LT2
auccagacaaacaccgccuggc

SEQ ID NO: 3765255 - RNA, 15 nt, Salmonella typhimurium LT2
auccagacuuuuuug

SEQ ID NO: 3765256 - RNA, 22 nt, Salmonella typhimurium LT2
auccagagcggauaaauaguga

SEQ ID NO: 3765257 - RNA, 22 nt, Salmonella typhimurium LT2
auccagaggguaauuucuucca

SEQ ID NO: 3765258 - RNA, 14 nt, Salmonella typhimurium LT2
auccagcaaaauaa

SEQ ID NO: 3765259 - RNA, 11 nt, Salmonella typhimurium LT2
auccagcacag

SEQ ID NO: 3765260 - RNA, 14 nt, Salmonella typhimurium LT2
auccagcacaggua

SEQ ID NO: 3765261 - RNA, 20 nt, Salmonella typhimurium LT2
auccagcaccucauccccca

SEQ ID NO: 3765262 - RNA, 21 nt, Salmonella typhimurium LT2
auccagcaccucaucccccag

SEQ ID NO: 3765263 - RNA, 10 nt, Salmonella typhimurium LT2
auccagcagc

SEQ ID NO: 3765264 - RNA, 15 nt, Salmonella typhimurium LT2
auccagcagcaggca

SEQ ID NO: 3765265 - RNA, 11 nt, Salmonella typhimurium LT2
auccagcagcc

SEQ ID NO: 3765266 - RNA, 12 nt, Salmonella typhimurium LT2
auccagcagcca

SEQ ID NO: 3765267 - RNA, 15 nt, Salmonella typhimurium LT2
auccagcaguaaaua

SEQ ID NO: 3765268 - RNA, 11 nt, Salmonella typhimurium LT2
auccagcccca

SEQ ID NO: 3765269 - RNA, 23 nt, Salmonella typhimurium LT2
auccagccccagcgccagcugcg

SEQ ID NO: 3765270 - RNA, 15 nt, Salmonella typhimurium LT2
auccagccguugcca

SEQ ID NO: 3765271 - RNA, 16 nt, Salmonella typhimurium LT2
auccagccguugccau

SEQ ID NO: 3765272 - RNA, 21 nt, Salmonella typhimurium LT2
auccagcgccaggauaucuuc

SEQ ID NO: 3765273 - RNA, 14 nt, Salmonella typhimurium LT2
auccagcgccguug

SEQ ID NO: 3765274 - RNA, 21 nt, Salmonella typhimurium LT2
auccagcgcguaaauaccuuc

SEQ ID NO: 3765275 - RNA, 18 nt, Salmonella typhimurium LT2
auccagcgguaaaucgcu

SEQ ID NO: 3765276 - RNA, 20 nt, Salmonella typhimurium LT2
auccagcgguagcggcacgu

SEQ ID NO: 3765277 - RNA, 23 nt, Salmonella typhimurium LT2
auccagcggugcgcgguuaugcg

SEQ ID NO: 3765278 - RNA, 17 nt, Salmonella typhimurium LT2
auccagcgguuacuuuu

SEQ ID NO: 3765279 - RNA, 22 nt, Salmonella typhimurium LT2
auccagcgguugcgcuucggcg

SEQ ID NO: 3765280 - RNA, 15 nt, Salmonella typhimurium LT2
auccagcgucacagg

SEQ ID NO: 3765281 - RNA, 15 nt, Salmonella typhimurium LT2
auccagcucuucuuc

SEQ ID NO: 3765282 - RNA, 21 nt, Salmonella typhimurium LT2
auccagcucuuucaauccuuc

SEQ ID NO: 3765283 - RNA, 21 nt, Salmonella typhimurium LT2
auccaggagagcaccuuuuuu

SEQ ID NO: 3765284 - RNA, 20 nt, Salmonella typhimurium LT2
auccaggccgucggcgccag

SEQ ID NO: 3765285 - RNA, 14 nt, Salmonella typhimurium LT2
auccaggcgggcau

SEQ ID NO: 3765286 - RNA, 17 nt, Salmonella typhimurium LT2
auccagggaaaccaugu

SEQ ID NO: 3765287 - RNA, 21 nt, Salmonella typhimurium LT2
auccaggguuuacugccagua

SEQ ID NO: 3765288 - RNA, 17 nt, Salmonella typhimurium LT2
auccagguaacauacaa

SEQ ID NO: 3765289 - RNA, 17 nt, Salmonella typhimurium LT2
auccaggucuuccgccg

SEQ ID NO: 3765290 - RNA, 14 nt, Salmonella typhimurium LT2
auccagguggaucg

SEQ ID NO: 3765291 - RNA, 19 nt, Salmonella typhimurium LT2
auccagguggaucggaaau

SEQ ID NO: 3765292 - RNA, 21 nt, Salmonella typhimurium LT2
auccaguaacgcguccaacug

SEQ ID NO: 3765293 - RNA, 16 nt, Salmonella typhimurium LT2
auccaguacaagcagg

SEQ ID NO: 3765294 - RNA, 23 nt, Salmonella typhimurium LT2
auccaguggugaaaaagcggcug

SEQ ID NO: 3765295 - RNA, 14 nt, Salmonella typhimurium LT2
auccaguuucguga

SEQ ID NO: 3765296 - RNA, 15 nt, Salmonella typhimurium LT2
auccaguuuuuucca

SEQ ID NO: 3765297 - RNA, 20 nt, Salmonella typhimurium LT2
auccaguuuuuuccagcgcg

SEQ ID NO: 3765298 - RNA, 22 nt, Salmonella typhimurium LT2
auccauaauacgacucaauaca

SEQ ID NO: 3765299 - RNA, 14 nt, Salmonella typhimurium LT2
auccauauucuucg

SEQ ID NO: 3765300 - RNA, 21 nt, Salmonella typhimurium LT2
auccaucagaucgaucuuguu

SEQ ID NO: 3765301 - RNA, 20 nt, Salmonella typhimurium LT2
auccaucgguucucugccau

SEQ ID NO: 3765302 - RNA, 22 nt, Salmonella typhimurium LT2
auccaugccggcuuuccgcacc

SEQ ID NO: 3765303 - RNA, 16 nt, Salmonella typhimurium LT2
auccauguacgcaggc

SEQ ID NO: 3765304 - RNA, 14 nt, Salmonella typhimurium LT2
auccauguugccau

SEQ ID NO: 3765305 - RNA, 20 nt, Salmonella typhimurium LT2
auccauguugccaugaucca

SEQ ID NO: 3765306 - RNA, 18 nt, Salmonella typhimurium LT2
auccauuaaaugcgccag

SEQ ID NO: 3765307 - RNA, 16 nt, Salmonella typhimurium LT2
auccauuaaugccgca

SEQ ID NO: 3765308 - RNA, 21 nt, Salmonella typhimurium LT2
auccauuuaacuaaggggaca

SEQ ID NO: 3765309 - RNA, 18 nt, Salmonella typhimurium LT2
auccauuucaucaggcag

SEQ ID NO: 3765310 - RNA, 14 nt, Salmonella typhimurium LT2
aucccaaaauuuac

SEQ ID NO: 3765311 - RNA, 12 nt, Salmonella typhimurium LT2
aucccaaucagg

SEQ ID NO: 3765312 - RNA, 17 nt, Salmonella typhimurium LT2
aucccacaacuguucuu

SEQ ID NO: 3765313 - RNA, 20 nt, Salmonella typhimurium LT2
aucccaccaauugccacaua

SEQ ID NO: 3765314 - RNA, 17 nt, Salmonella typhimurium LT2
aucccaccauaaagcga

SEQ ID NO: 3765315 - RNA, 18 nt, Salmonella typhimurium LT2
aucccaccauaaagcgaa

SEQ ID NO: 3765316 - RNA, 16 nt, Salmonella typhimurium LT2
aucccacccagcaaua

SEQ ID NO: 3765317 - RNA, 16 nt, Salmonella typhimurium LT2
aucccacgccgcugau

SEQ ID NO: 3765318 - RNA, 12 nt, Salmonella typhimurium LT2
aucccacgucgc

SEQ ID NO: 3765319 - RNA, 20 nt, Salmonella typhimurium LT2
aucccacuccaucgccugau

SEQ ID NO: 3765320 - RNA, 14 nt, Salmonella typhimurium LT2
aucccacugcacgc

SEQ ID NO: 3765321 - RNA, 17 nt, Salmonella typhimurium LT2
aucccagccgcgaugau

SEQ ID NO: 3765322 - RNA, 17 nt, Salmonella typhimurium LT2
aucccaugcaccagccc

SEQ ID NO: 3765323 - RNA, 19 nt, Salmonella typhimurium LT2
aucccaugcaccagcccca

SEQ ID NO: 3765324 - RNA, 17 nt, Salmonella typhimurium LT2
auccccagucuuccugc

SEQ ID NO: 3765325 - RNA, 15 nt, Salmonella typhimurium LT2
aucccccugccacaa

SEQ ID NO: 3765326 - RNA, 15 nt, Salmonella typhimurium LT2
auccccgccgccauc

SEQ ID NO: 3765327 - RNA, 15 nt, Salmonella typhimurium LT2
auccccgccgggcuu

SEQ ID NO: 3765328 - RNA, 16 nt, Salmonella typhimurium LT2
auccccgccucaccgc

SEQ ID NO: 3765329 - RNA, 13 nt, Salmonella typhimurium LT2
auccccggcaacc

SEQ ID NO: 3765330 - RNA, 18 nt, Salmonella typhimurium LT2
auccccuacggugugccu

SEQ ID NO: 3765331 - RNA, 13 nt, Salmonella typhimurium LT2
auccccugcuccu

SEQ ID NO: 3765332 - RNA, 14 nt, Salmonella typhimurium LT2
auccccugcuccug

SEQ ID NO: 3765333 - RNA, 16 nt, Salmonella typhimurium LT2
auccccuucaggaaua

SEQ ID NO: 3765334 - RNA, 22 nt, Salmonella typhimurium LT2
aucccgauuucgcuccacuggc

SEQ ID NO: 3765335 - RNA, 16 nt, Salmonella typhimurium LT2
aucccgccuugcggcg

SEQ ID NO: 3765336 - RNA, 16 nt, Salmonella typhimurium LT2
aucccgcgcugcgccg

SEQ ID NO: 3765337 - RNA, 15 nt, Salmonella typhimurium LT2
aucccgcugaagacu

SEQ ID NO: 3765338 - RNA, 21 nt, Salmonella typhimurium LT2
aucccgcugaagacuggcaag

SEQ ID NO: 3765339 - RNA, 22 nt, Salmonella typhimurium LT2
aucccggccauaauacgcuugc

SEQ ID NO: 3765340 - RNA, 23 nt, Salmonella typhimurium LT2
aucccggcuggguucauccagca

SEQ ID NO: 3765341 - RNA, 19 nt, Salmonella typhimurium LT2
aucccggucgcgccagcga

SEQ ID NO: 3765342 - RNA, 15 nt, Salmonella typhimurium LT2
aucccgguuucccgc

SEQ ID NO: 3765343 - RNA, 18 nt, Salmonella typhimurium LT2
aucccuaacuggucaaac

SEQ ID NO: 3765344 - RNA, 14 nt, Salmonella typhimurium LT2
aucccuaauaaaau

SEQ ID NO: 3765345 - RNA, 17 nt, Salmonella typhimurium LT2
aucccuaauaagguauu

SEQ ID NO: 3765346 - RNA, 16 nt, Salmonella typhimurium LT2
aucccugaucggccag

SEQ ID NO: 3765347 - RNA, 16 nt, Salmonella typhimurium LT2
aucccuuccugaccuu

SEQ ID NO: 3765348 - RNA, 16 nt, Salmonella typhimurium LT2
aucccuucucauggac

SEQ ID NO: 3765349 - RNA, 18 nt, Salmonella typhimurium LT2
aucccuuucaaaaaagag

SEQ ID NO: 3765350 - RNA, 21 nt, Salmonella typhimurium LT2
aucccuuucaaaaaagagaag

SEQ ID NO: 3765351 - RNA, 19 nt, Salmonella typhimurium LT2
auccgaaaugaccaccgca

SEQ ID NO: 3765352 - RNA, 13 nt, Salmonella typhimurium LT2
auccgaagaacca

SEQ ID NO: 3765353 - RNA, 17 nt, Salmonella typhimurium LT2
auccgacgccuguucga

SEQ ID NO: 3765354 - RNA, 22 nt, Salmonella typhimurium LT2
auccgcagacuuuagccauucc

SEQ ID NO: 3765355 - RNA, 14 nt, Salmonella typhimurium LT2
auccgcauccguca

SEQ ID NO: 3765356 - RNA, 15 nt, Salmonella typhimurium LT2
auccgccagccagcc

SEQ ID NO: 3765357 - RNA, 16 nt, Salmonella typhimurium LT2
auccgccgagggcauu

SEQ ID NO: 3765358 - RNA, 13 nt, Salmonella typhimurium LT2
auccgccgccgca

SEQ ID NO: 3765359 - RNA, 15 nt, Salmonella typhimurium LT2
auccgcgaauaccuu

SEQ ID NO: 3765360 - RNA, 20 nt, Salmonella typhimurium LT2
auccgcguggacgcguucca

SEQ ID NO: 3765361 - RNA, 22 nt, Salmonella typhimurium LT2
auccgcguuacccaugagcgaa

SEQ ID NO: 3765362 - RNA, 22 nt, Salmonella typhimurium LT2
auccgcuauuaccaguaaugac

SEQ ID NO: 3765363 - RNA, 22 nt, Salmonella typhimurium LT2
auccggaaaauggguaucgccu

SEQ ID NO: 3765364 - RNA, 15 nt, Salmonella typhimurium LT2
auccggauauucugc

SEQ ID NO: 3765365 - RNA, 15 nt, Salmonella typhimurium LT2
auccggauuguuuuu

SEQ ID NO: 3765366 - RNA, 19 nt, Salmonella typhimurium LT2
auccggcaaaagaggcuaa

SEQ ID NO: 3765367 - RNA, 21 nt, Salmonella typhimurium LT2
auccggcaaaaugcccggcug

SEQ ID NO: 3765368 - RNA, 14 nt, Salmonella typhimurium LT2
auccggcaaaauua

SEQ ID NO: 3765369 - RNA, 14 nt, Salmonella typhimurium LT2
auccggcaagcgcu

SEQ ID NO: 3765370 - RNA, 16 nt, Salmonella typhimurium LT2
auccggcaagcgcugg

SEQ ID NO: 3765371 - RNA, 14 nt, Salmonella typhimurium LT2
auccggcaaggguc

SEQ ID NO: 3765372 - RNA, 18 nt, Salmonella typhimurium LT2
auccggcaauuuauaccg

SEQ ID NO: 3765373 - RNA, 11 nt, Salmonella typhimurium LT2
auccggcacug

SEQ ID NO: 3765374 - RNA, 15 nt, Salmonella typhimurium LT2
auccggcaucacagg

SEQ ID NO: 3765375 - RNA, 17 nt, Salmonella typhimurium LT2
auccggccuacaagccg

SEQ ID NO: 3765376 - RNA, 17 nt, Salmonella typhimurium LT2
auccggccuacguucca

SEQ ID NO: 3765377 - RNA, 23 nt, Salmonella typhimurium LT2
auccggccuacucuugagccaga

SEQ ID NO: 3765378 - RNA, 19 nt, Salmonella typhimurium LT2
auccggccugcaggcaacg

SEQ ID NO: 3765379 - RNA, 13 nt, Salmonella typhimurium LT2
auccggccugccc

SEQ ID NO: 3765380 - RNA, 22 nt, Salmonella typhimurium LT2
auccggccugcgaaacagggca

SEQ ID NO: 3765381 - RNA, 14 nt, Salmonella typhimurium LT2
auccggccuggcgc

SEQ ID NO: 3765382 - RNA, 22 nt, Salmonella typhimurium LT2
auccggccuguaaacagaugcu

SEQ ID NO: 3765383 - RNA, 13 nt, Salmonella typhimurium LT2
auccggcgaggcg

SEQ ID NO: 3765384 - RNA, 19 nt, Salmonella typhimurium LT2
auccggcgcugugcggcgu

SEQ ID NO: 3765385 - RNA, 21 nt, Salmonella typhimurium LT2
auccggcgcugugcggcgugc

SEQ ID NO: 3765386 - RNA, 15 nt, Salmonella typhimurium LT2
auccggcuacgggcg

SEQ ID NO: 3765387 - RNA, 21 nt, Salmonella typhimurium LT2
auccggcuguuccaguacgcu

SEQ ID NO: 3765388 - RNA, 23 nt, Salmonella typhimurium LT2
auccggcuucuggcuaccgggcg

SEQ ID NO: 3765389 - RNA, 16 nt, Salmonella typhimurium LT2
auccgggcugaacgcc

SEQ ID NO: 3765390 - RNA, 12 nt, Salmonella typhimurium LT2
auccgguaaaca

SEQ ID NO: 3765391 - RNA, 15 nt, Salmonella typhimurium LT2
auccgguucaaggca

SEQ ID NO: 3765392 - RNA, 18 nt, Salmonella typhimurium LT2
auccgguucaaggcagga

SEQ ID NO: 3765393 - RNA, 21 nt, Salmonella typhimurium LT2
auccgguuuucguuaacugga

SEQ ID NO: 3765394 - RNA, 19 nt, Salmonella typhimurium LT2
auccgucaaaaugaucaga

SEQ ID NO: 3765395 - RNA, 15 nt, Salmonella typhimurium LT2
auccguccucuuucc

SEQ ID NO: 3765396 - RNA, 18 nt, Salmonella typhimurium LT2
auccgugaauguccugcg

SEQ ID NO: 3765397 - RNA, 14 nt, Salmonella typhimurium LT2
auccgugaccugcu

SEQ ID NO: 3765398 - RNA, 21 nt, Salmonella typhimurium LT2
auccguucaucgguaauauua

SEQ ID NO: 3765399 - RNA, 19 nt, Salmonella typhimurium LT2
auccguuccaaucucuuuu

SEQ ID NO: 3765400 - RNA, 22 nt, Salmonella typhimurium LT2
auccucauaaauagccagcauc

SEQ ID NO: 3765401 - RNA, 15 nt, Salmonella typhimurium LT2
auccuccauccaggu

SEQ ID NO: 3765402 - RNA, 14 nt, Salmonella typhimurium LT2
auccuccugcagac

SEQ ID NO: 3765403 - RNA, 15 nt, Salmonella typhimurium LT2
auccucuccugaagc

SEQ ID NO: 3765404 - RNA, 20 nt, Salmonella typhimurium LT2
auccucuccugaagccagcg

SEQ ID NO: 3765405 - RNA, 20 nt, Salmonella typhimurium LT2
auccucuuggguuauuucga

SEQ ID NO: 3765406 - RNA, 22 nt, Salmonella typhimurium LT2
auccugaaccagcggcaccagc

SEQ ID NO: 3765407 - RNA, 13 nt, Salmonella typhimurium LT2
auccugaagcggc

SEQ ID NO: 3765408 - RNA, 18 nt, Salmonella typhimurium LT2
auccugacucaccagcac

SEQ ID NO: 3765409 - RNA, 22 nt, Salmonella typhimurium LT2
auccugauccugcaacagcacc

SEQ ID NO: 3765410 - RNA, 20 nt, Salmonella typhimurium LT2
auccugcaaauagcgcugau

SEQ ID NO: 3765411 - RNA, 19 nt, Salmonella typhimurium LT2
auccugcaccgccugcggc

SEQ ID NO: 3765412 - RNA, 14 nt, Salmonella typhimurium LT2
auccugcacuucca

SEQ ID NO: 3765413 - RNA, 17 nt, Salmonella typhimurium LT2
auccugcaggguaauua

SEQ ID NO: 3765414 - RNA, 22 nt, Salmonella typhimurium LT2
auccugccuacaggacugcacg

SEQ ID NO: 3765415 - RNA, 21 nt, Salmonella typhimurium LT2
auccugcgccauugcgggagc

SEQ ID NO: 3765416 - RNA, 18 nt, Salmonella typhimurium LT2
auccugcggaacgcggau

SEQ ID NO: 3765417 - RNA, 22 nt, Salmonella typhimurium LT2
auccuguaacgcauaagcgcga

SEQ ID NO: 3765418 - RNA, 15 nt, Salmonella typhimurium LT2
auccuguaccaccac

SEQ ID NO: 3765419 - RNA, 11 nt, Salmonella typhimurium LT2
auccuguccug

SEQ ID NO: 3765420 - RNA, 19 nt, Salmonella typhimurium LT2
auccuguuuuuucagcgcg

SEQ ID NO: 3765421 - RNA, 20 nt, Salmonella typhimurium LT2
auccuguuuuuucagcgcgc

SEQ ID NO: 3765422 - RNA, 17 nt, Salmonella typhimurium LT2
aggaagcugcgcagcac

SEQ ID NO: 3765423 - RNA, 19 nt, Salmonella typhimurium LT2
aggaagcugcgcagcacuu

SEQ ID NO: 3765424 - RNA, 13 nt, Salmonella typhimurium LT2
aggaaggagcaaa

SEQ ID NO: 3765425 - RNA, 15 nt, Salmonella typhimurium LT2
aggaaggagcaaaca

SEQ ID NO: 3765426 - RNA, 20 nt, Salmonella typhimurium LT2
aggaaggucgcauccgcguu

SEQ ID NO: 3765427 - RNA, 13 nt, Salmonella typhimurium LT2
aggaagucagcuu

SEQ ID NO: 3765428 - RNA, 18 nt, Salmonella typhimurium LT2
aggaaguugcucccgcac

SEQ ID NO: 3765429 - RNA, 13 nt, Salmonella typhimurium LT2
aggaauaacaucg

SEQ ID NO: 3765430 - RNA, 13 nt, Salmonella typhimurium LT2
aggaauaacgcgc

SEQ ID NO: 3765431 - RNA, 20 nt, Salmonella typhimurium LT2
aggaauacccagcucagcuu

SEQ ID NO: 3765432 - RNA, 16 nt, Salmonella typhimurium LT2
aggaauccagcgcgcc

SEQ ID NO: 3765433 - RNA, 14 nt, Salmonella typhimurium LT2
aggaaugaaaacga

SEQ ID NO: 3765434 - RNA, 19 nt, Salmonella typhimurium LT2
aggaaugaaaacgaaucga

SEQ ID NO: 3765435 - RNA, 22 nt, Salmonella typhimurium LT2
aggaauuacggacgauacaccu

SEQ ID NO: 3765436 - RNA, 21 nt, Salmonella typhimurium LT2
aggaauuguccacccucccag

SEQ ID NO: 3765437 - RNA, 22 nt, Salmonella typhimurium LT2
aggaauuuucccauaaaagagc

SEQ ID NO: 3765438 - RNA, 18 nt, Salmonella typhimurium LT2
aggacaaccccuacgcag

SEQ ID NO: 3765439 - RNA, 17 nt, Salmonella typhimurium LT2
aggacacguuaauuauu

SEQ ID NO: 3765440 - RNA, 16 nt, Salmonella typhimurium LT2
aggacaucaaaggcag

SEQ ID NO: 3765441 - RNA, 19 nt, Salmonella typhimurium LT2
aggacauucagcacgcuuu

SEQ ID NO: 3765442 - RNA, 18 nt, Salmonella typhimurium LT2
aggaccaaaacaauacug

SEQ ID NO: 3765443 - RNA, 14 nt, Salmonella typhimurium LT2
aggaccugauuaau

SEQ ID NO: 3765444 - RNA, 15 nt, Salmonella typhimurium LT2
aggacgaaaaaugaa

SEQ ID NO: 3765445 - RNA, 14 nt, Salmonella typhimurium LT2
aggacguucuucuc

SEQ ID NO: 3765446 - RNA, 15 nt, Salmonella typhimurium LT2
aggacucaaucacuu

SEQ ID NO: 3765447 - RNA, 16 nt, Salmonella typhimurium LT2
aggacucaaucacuua

SEQ ID NO: 3765448 - RNA, 14 nt, Salmonella typhimurium LT2
aggagacgccgccc

SEQ ID NO: 3765449 - RNA, 14 nt, Salmonella typhimurium LT2
aggagauaucaaaa

SEQ ID NO: 3765450 - RNA, 22 nt, Salmonella typhimurium LT2
aggagcaaacagcgugggaagc

SEQ ID NO: 3765451 - RNA, 19 nt, Salmonella typhimurium LT2
aggagcgccguggaaaaga

SEQ ID NO: 3765452 - RNA, 13 nt, Salmonella typhimurium LT2
aggagcggaagag

SEQ ID NO: 3765453 - RNA, 17 nt, Salmonella typhimurium LT2
aggaggauauucgucca

SEQ ID NO: 3765454 - RNA, 14 nt, Salmonella typhimurium LT2
aggagguucaucau

SEQ ID NO: 3765455 - RNA, 14 nt, Salmonella typhimurium LT2
aggaguaguuaaaa

SEQ ID NO: 3765456 - RNA, 21 nt, Salmonella typhimurium LT2
aggaguucgguuacaugcuga

SEQ ID NO: 3765457 - RNA, 15 nt, Salmonella typhimurium LT2
aggauaaccuuccgg

SEQ ID NO: 3765458 - RNA, 18 nt, Salmonella typhimurium LT2
aggauaaccuuccggcac

SEQ ID NO: 3765459 - RNA, 20 nt, Salmonella typhimurium LT2
aggauagaaaacauauuggu

SEQ ID NO: 3765460 - RNA, 15 nt, Salmonella typhimurium LT2
aggauagugauauag

SEQ ID NO: 3765461 - RNA, 13 nt, Salmonella typhimurium LT2
aggauauccugcg

SEQ ID NO: 3765462 - RNA, 21 nt, Salmonella typhimurium LT2
aggauauucguccaccuaaag

SEQ ID NO: 3765463 - RNA, 16 nt, Salmonella typhimurium LT2
aggauauuuauuuuau

SEQ ID NO: 3765464 - RNA, 20 nt, Salmonella typhimurium LT2
aggaucaaaaucgcgcccca

SEQ ID NO: 3765465 - RNA, 17 nt, Salmonella typhimurium LT2
aggaucaguaacaggac

SEQ ID NO: 3765466 - RNA, 19 nt, Salmonella typhimurium LT2
aggaucauuggccagauaa

SEQ ID NO: 3765467 - RNA, 21 nt, Salmonella typhimurium LT2
aggaucuucaucccauccggg

SEQ ID NO: 3765468 - RNA, 20 nt, Salmonella typhimurium LT2
aggaugaaaaguauggcggu

SEQ ID NO: 3765469 - RNA, 19 nt, Salmonella typhimurium LT2
aggaugugaggcagauacg

SEQ ID NO: 3765470 - RNA, 20 nt, Salmonella typhimurium LT2
aggauuauuggcaucauaaa

SEQ ID NO: 3765471 - RNA, 13 nt, Salmonella typhimurium LT2
aggauugcuguga

SEQ ID NO: 3765472 - RNA, 19 nt, Salmonella typhimurium LT2
aggauuugucucaucugau

SEQ ID NO: 3765473 - RNA, 20 nt, Salmonella typhimurium LT2
aggauuuucgcgucggacag

SEQ ID NO: 3765474 - RNA, 12 nt, Salmonella typhimurium LT2
aggcaaaccagc

SEQ ID NO: 3765475 - RNA, 14 nt, Salmonella typhimurium LT2
aggcaaaccagcac

SEQ ID NO: 3765476 - RNA, 15 nt, Salmonella typhimurium LT2
aggcaaaccagcacc

SEQ ID NO: 3765477 - RNA, 20 nt, Salmonella typhimurium LT2
aggcaaacgcggugaaggca

SEQ ID NO: 3765478 - RNA, 16 nt, Salmonella typhimurium LT2
aggcaacaauuucuac

SEQ ID NO: 3765479 - RNA, 17 nt, Salmonella typhimurium LT2
aggcaacaauuucuacu

SEQ ID NO: 3765480 - RNA, 21 nt, Salmonella typhimurium LT2
aggcaacagauugaugcccuc

SEQ ID NO: 3765481 - RNA, 19 nt, Salmonella typhimurium LT2
aggcaaguucgugagcgaa

SEQ ID NO: 3765482 - RNA, 17 nt, Salmonella typhimurium LT2
aggcaaugccuuuucac

SEQ ID NO: 3765483 - RNA, 22 nt, Salmonella typhimurium LT2
aggcaccguuucuuugcugccg

SEQ ID NO: 3765484 - RNA, 21 nt, Salmonella typhimurium LT2
aggcaccuguaaccuuaaaag

SEQ ID NO: 3765485 - RNA, 16 nt, Salmonella typhimurium LT2
aggcacgccggcaauc

SEQ ID NO: 3765486 - RNA, 16 nt, Salmonella typhimurium LT2
aggcacguuauuggca

SEQ ID NO: 3765487 - RNA, 19 nt, Salmonella typhimurium LT2
aggcacuacggugugccug

SEQ ID NO: 3765488 - RNA, 20 nt, Salmonella typhimurium LT2
aggcacuuuccagaccaaga

SEQ ID NO: 3765489 - RNA, 17 nt, Salmonella typhimurium LT2
aggcagagcgcgcucug

SEQ ID NO: 3765490 - RNA, 19 nt, Salmonella typhimurium LT2
aggcagcaggauauccugc

SEQ ID NO: 3765491 - RNA, 23 nt, Salmonella typhimurium LT2
aggcagccacaaugggggcauaa

SEQ ID NO: 3765492 - RNA, 18 nt, Salmonella typhimurium LT2
aggcagccagguccagau

SEQ ID NO: 3765493 - RNA, 19 nt, Salmonella typhimurium LT2
aggcagccggauuuuaaau

SEQ ID NO: 3765494 - RNA, 22 nt, Salmonella typhimurium LT2
aggcagccggauuuuaaauugg

SEQ ID NO: 3765495 - RNA, 13 nt, Salmonella typhimurium LT2
aggcagcgccagc

SEQ ID NO: 3765496 - RNA, 17 nt, Salmonella typhimurium LT2
aggcagcgcgcugucuu

SEQ ID NO: 3765497 - RNA, 19 nt, Salmonella typhimurium LT2
aggcaggaauucggccuuc

SEQ ID NO: 3765498 - RNA, 17 nt, Salmonella typhimurium LT2
aggcaggcaacaugacc

SEQ ID NO: 3765499 - RNA, 20 nt, Salmonella typhimurium LT2
aggcagggcgaugcgcgagc

SEQ ID NO: 3765500 - RNA, 11 nt, Salmonella typhimurium LT2
aggcaguuugc

SEQ ID NO: 3765501 - RNA, 13 nt, Salmonella typhimurium LT2
aggcauaaugcca

SEQ ID NO: 3765502 - RNA, 14 nt, Salmonella typhimurium LT2
aggcaucagauaaa

SEQ ID NO: 3765503 - RNA, 23 nt, Salmonella typhimurium LT2
aggcaucaggcugguauaaaaac

SEQ ID NO: 3765504 - RNA, 23 nt, Salmonella typhimurium LT2
aggcauccgugaccugcugacua

SEQ ID NO: 3765505 - RNA, 20 nt, Salmonella typhimurium LT2
aggcaucgcgccgccgggcu

SEQ ID NO: 3765506 - RNA, 19 nt, Salmonella typhimurium LT2
aggcaucgcugauaaaaac

SEQ ID NO: 3765507 - RNA, 18 nt, Salmonella typhimurium LT2
aggcaucgguucugcgac

SEQ ID NO: 3765508 - RNA, 20 nt, Salmonella typhimurium LT2
aggcaugccaaaccagacuc

SEQ ID NO: 3765509 - RNA, 15 nt, Salmonella typhimurium LT2
aggcauggcagcagg

SEQ ID NO: 3765510 - RNA, 14 nt, Salmonella typhimurium LT2
aggcauuaaaaaaa

SEQ ID NO: 3765511 - RNA, 20 nt, Salmonella typhimurium LT2
aggcauugauaaagcgcuca

SEQ ID NO: 3765512 - RNA, 23 nt, Salmonella typhimurium LT2
aggcauugcccuguaaggggcau

SEQ ID NO: 3765513 - RNA, 14 nt, Salmonella typhimurium LT2
aggcauuggacggg

SEQ ID NO: 3765514 - RNA, 19 nt, Salmonella typhimurium LT2
aggcauuuaugccgccauc

SEQ ID NO: 3765515 - RNA, 16 nt, Salmonella typhimurium LT2
auaccgcuuuguaaaa

SEQ ID NO: 3765516 - RNA, 15 nt, Salmonella typhimurium LT2
auaccggaggagugc

SEQ ID NO: 3765517 - RNA, 22 nt, Salmonella typhimurium LT2
auaccggaggagugcgccaguu

SEQ ID NO: 3765518 - RNA, 15 nt, Salmonella typhimurium LT2
auaccggauugcucg

SEQ ID NO: 3765519 - RNA, 19 nt, Salmonella typhimurium LT2
auaccggcaacgccgggaa

SEQ ID NO: 3765520 - RNA, 23 nt, Salmonella typhimurium LT2
auaccggugcgccccagcaugag

SEQ ID NO: 3765521 - RNA, 18 nt, Salmonella typhimurium LT2
auaccguagaucgccagc

SEQ ID NO: 3765522 - RNA, 19 nt, Salmonella typhimurium LT2
auaccgugugcagugacag

SEQ ID NO: 3765523 - RNA, 19 nt, Salmonella typhimurium LT2
auaccguuuggaucugucg

SEQ ID NO: 3765524 - RNA, 20 nt, Salmonella typhimurium LT2
auaccuaacucuuccgcaau

SEQ ID NO: 3765525 - RNA, 22 nt, Salmonella typhimurium LT2
auaccuguugcacgcauggcac

SEQ ID NO: 3765526 - RNA, 20 nt, Salmonella typhimurium LT2
auaccuucuucacuaaaaac

SEQ ID NO: 3765527 - RNA, 22 nt, Salmonella typhimurium LT2
auaccuucuucacuaaaaacag

SEQ ID NO: 3765528 - RNA, 21 nt, Salmonella typhimurium LT2
auaccuuuaaccucuuuuuca

SEQ ID NO: 3765529 - RNA, 21 nt, Salmonella typhimurium LT2
auaccuuuaagcgcuucguga

SEQ ID NO: 3765530 - RNA, 12 nt, Salmonella typhimurium LT2
auaccuuuucau

SEQ ID NO: 3765531 - RNA, 23 nt, Salmonella typhimurium LT2
auacgaaaauccucuuucgccau

SEQ ID NO: 3765532 - RNA, 21 nt, Salmonella typhimurium LT2
auacgauauucuguuagcgcc

SEQ ID NO: 3765533 - RNA, 22 nt, Salmonella typhimurium LT2
auacgcagaucuuuuugcuccu

SEQ ID NO: 3765534 - RNA, 13 nt, Salmonella typhimurium LT2
auacgcagcacuu

SEQ ID NO: 3765535 - RNA, 18 nt, Salmonella typhimurium LT2
auacgccacgcuccagcg

SEQ ID NO: 3765536 - RNA, 21 nt, Salmonella typhimurium LT2
auacgccauacccgauaucgc

SEQ ID NO: 3765537 - RNA, 18 nt, Salmonella typhimurium LT2
auacgccgccagcaauac

SEQ ID NO: 3765538 - RNA, 22 nt, Salmonella typhimurium LT2
auacgccgcuggugcuguuuuu

SEQ ID NO: 3765539 - RNA, 16 nt, Salmonella typhimurium LT2
auacgccuauuuucug

SEQ ID NO: 3765540 - RNA, 14 nt, Salmonella typhimurium LT2
auacgcucaauaua

SEQ ID NO: 3765541 - RNA, 13 nt, Salmonella typhimurium LT2
auacgcuccagcu

SEQ ID NO: 3765542 - RNA, 12 nt, Salmonella typhimurium LT2
auacgcugaaga

SEQ ID NO: 3765543 - RNA, 18 nt, Salmonella typhimurium LT2
auacgcugcgucaggcga

SEQ ID NO: 3765544 - RNA, 23 nt, Salmonella typhimurium LT2
auacgcugcgucaggcgauagcc

SEQ ID NO: 3765545 - RNA, 15 nt, Salmonella typhimurium LT2
auacgcuugcgccag

SEQ ID NO: 3765546 - RNA, 20 nt, Salmonella typhimurium LT2
auacgcuugcgccagcauca

SEQ ID NO: 3765547 - RNA, 13 nt, Salmonella typhimurium LT2
auacgcuuucuga

SEQ ID NO: 3765548 - RNA, 19 nt, Salmonella typhimurium LT2
auacggaacugggugccau

SEQ ID NO: 3765549 - RNA, 18 nt, Salmonella typhimurium LT2
auacggacgccagauaau

SEQ ID NO: 3765550 - RNA, 16 nt, Salmonella typhimurium LT2
auacggaugccgauuu

SEQ ID NO: 3765551 - RNA, 20 nt, Salmonella typhimurium LT2
auacggauuaggcaagcugg

SEQ ID NO: 3765552 - RNA, 21 nt, Salmonella typhimurium LT2
auacggcggcaaugccgccgu

SEQ ID NO: 3765553 - RNA, 16 nt, Salmonella typhimurium LT2
auacggcuccagcaca

SEQ ID NO: 3765554 - RNA, 15 nt, Salmonella typhimurium LT2
auacggggucuaagg

SEQ ID NO: 3765555 - RNA, 22 nt, Salmonella typhimurium LT2
auacgucgugacccacacauag

SEQ ID NO: 3765556 - RNA, 14 nt, Salmonella typhimurium LT2
auacgucugcgcug

SEQ ID NO: 3765557 - RNA, 18 nt, Salmonella typhimurium LT2
auacgucuuacgccaugc

SEQ ID NO: 3765558 - RNA, 19 nt, Salmonella typhimurium LT2
auacguuauaaauuuuuua

SEQ ID NO: 3765559 - RNA, 14 nt, Salmonella typhimurium LT2
auacguuccagcag

SEQ ID NO: 3765560 - RNA, 14 nt, Salmonella typhimurium LT2
auacguuugguacc

SEQ ID NO: 3765561 - RNA, 22 nt, Salmonella typhimurium LT2
auacuauccaacagaaggcuuc

SEQ ID NO: 3765562 - RNA, 18 nt, Salmonella typhimurium LT2
auacucacgaauaagaau

SEQ ID NO: 3765563 - RNA, 19 nt, Salmonella typhimurium LT2
auacucacgacuuucacca

SEQ ID NO: 3765564 - RNA, 16 nt, Salmonella typhimurium LT2
auacucccggcgcugg

SEQ ID NO: 3765565 - RNA, 20 nt, Salmonella typhimurium LT2
auacuccugcaacagaagag

SEQ ID NO: 3765566 - RNA, 13 nt, Salmonella typhimurium LT2
auacucugcgcug

SEQ ID NO: 3765567 - RNA, 14 nt, Salmonella typhimurium LT2
auacucugcuuuuu

SEQ ID NO: 3765568 - RNA, 22 nt, Salmonella typhimurium LT2
auacucuuggagagcaucaucu

SEQ ID NO: 3765569 - RNA, 18 nt, Salmonella typhimurium LT2
auacucuuugaacagcca

SEQ ID NO: 3765570 - RNA, 19 nt, Salmonella typhimurium LT2
auacucuuugaacagccag

SEQ ID NO: 3765571 - RNA, 14 nt, Salmonella typhimurium LT2
auacugaacgccgc

SEQ ID NO: 3765572 - RNA, 22 nt, Salmonella typhimurium LT2
auacugaacuauaggaaaauaa

SEQ ID NO: 3765573 - RNA, 22 nt, Salmonella typhimurium LT2
auacugacgagcgacgaggcau

SEQ ID NO: 3765574 - RNA, 13 nt, Salmonella typhimurium LT2
auacugauaaaaa

SEQ ID NO: 3765575 - RNA, 17 nt, Salmonella typhimurium LT2
auacugcaaccgacgaa

SEQ ID NO: 3765576 - RNA, 16 nt, Salmonella typhimurium LT2
auacugccgcccaucg

SEQ ID NO: 3765577 - RNA, 13 nt, Salmonella typhimurium LT2
auacugccgccgu

SEQ ID NO: 3765578 - RNA, 18 nt, Salmonella typhimurium LT2
auacuggaagcuacaggu

SEQ ID NO: 3765579 - RNA, 18 nt, Salmonella typhimurium LT2
auacuggccgguuuuaaa

SEQ ID NO: 3765580 - RNA, 22 nt, Salmonella typhimurium LT2
auacuggccgguuuuaaaaaua

SEQ ID NO: 3765581 - RNA, 16 nt, Salmonella typhimurium LT2
auacugugggauuuuu

SEQ ID NO: 3765582 - RNA, 18 nt, Salmonella typhimurium LT2
auacugugggauuuuugg

SEQ ID NO: 3765583 - RNA, 19 nt, Salmonella typhimurium LT2
auacugugucgggccaggc

SEQ ID NO: 3765584 - RNA, 17 nt, Salmonella typhimurium LT2
auacuguuccaggcgaa

SEQ ID NO: 3765585 - RNA, 12 nt, Salmonella typhimurium LT2
auacuuaacccu

SEQ ID NO: 3765586 - RNA, 13 nt, Salmonella typhimurium LT2
auacuucaucagg

SEQ ID NO: 3765587 - RNA, 18 nt, Salmonella typhimurium LT2
auagaaccgaacaacgcc

SEQ ID NO: 3765588 - RNA, 20 nt, Salmonella typhimurium LT2
auagaaccgaacaacgccag

SEQ ID NO: 3765589 - RNA, 23 nt, Salmonella typhimurium LT2
auagaacgguuuugcgcugguac

SEQ ID NO: 3765590 - RNA, 15 nt, Salmonella typhimurium LT2
auagacauccagcau

SEQ ID NO: 3765591 - RNA, 13 nt, Salmonella typhimurium LT2
auagaccacgcca

SEQ ID NO: 3765592 - RNA, 23 nt, Salmonella typhimurium LT2
auagaccacgccaucaacagcgg

SEQ ID NO: 3765593 - RNA, 15 nt, Salmonella typhimurium LT2
auagacgacaucuuu

SEQ ID NO: 3765594 - RNA, 22 nt, Salmonella typhimurium LT2
auagacgacaucuuuuccugaa

SEQ ID NO: 3765595 - RNA, 19 nt, Salmonella typhimurium LT2
auagacgccggucaugcca

SEQ ID NO: 3765596 - RNA, 15 nt, Salmonella typhimurium LT2
auagacggccugcaa

SEQ ID NO: 3765597 - RNA, 16 nt, Salmonella typhimurium LT2
auagacguaaugauca

SEQ ID NO: 3765598 - RNA, 17 nt, Salmonella typhimurium LT2
auagacguaaugaucag

SEQ ID NO: 3765599 - RNA, 14 nt, Salmonella typhimurium LT2
auagagaaaucaac

SEQ ID NO: 3765600 - RNA, 18 nt, Salmonella typhimurium LT2
auagagcaaucuggcagu

SEQ ID NO: 3765601 - RNA, 15 nt, Salmonella typhimurium LT2
auagaguaauacauc

SEQ ID NO: 3765602 - RNA, 15 nt, Salmonella typhimurium LT2
auagauaugaaagaa

SEQ ID NO: 3765603 - RNA, 12 nt, Salmonella typhimurium LT2
auagauauuaaa

SEQ ID NO: 3765604 - RNA, 16 nt, Salmonella typhimurium LT2
auagaucaggcgacca

SEQ ID NO: 3765605 - RNA, 18 nt, Salmonella typhimurium LT2
auagauccggauugauau

SEQ ID NO: 3765606 - RNA, 18 nt, Salmonella typhimurium LT2
auagcaaacuacuuucgg

SEQ ID NO: 3765607 - RNA, 17 nt, Salmonella typhimurium LT2
auagcaacguccgcagc

SEQ ID NO: 3765608 - RNA, 18 nt, Salmonella typhimurium LT2
auagcaacguccgcagcc

SEQ ID NO: 3765609 - RNA, 15 nt, Salmonella typhimurium LT2
auagcaauaaauacc

SEQ ID NO: 3765610 - RNA, 17 nt, Salmonella typhimurium LT2
auagcaauacuuuccag

SEQ ID NO: 3765611 - RNA, 21 nt, Salmonella typhimurium LT2
auagcaggcacuacggugugc

SEQ ID NO: 3765612 - RNA, 14 nt, Salmonella typhimurium LT2
auagcaggcaucaa

SEQ ID NO: 3765613 - RNA, 13 nt, Salmonella typhimurium LT2
auagcaucaccag

SEQ ID NO: 3765614 - RNA, 16 nt, Salmonella typhimurium LT2
auagcaucuuccucug

SEQ ID NO: 3765615 - RNA, 13 nt, Salmonella typhimurium LT2
auagccaaaagcu

SEQ ID NO: 3765616 - RNA, 14 nt, Salmonella typhimurium LT2
auagccacaggcug

SEQ ID NO: 3765617 - RNA, 17 nt, Salmonella typhimurium LT2
auagccagcccccugcc

SEQ ID NO: 3765618 - RNA, 21 nt, Salmonella typhimurium LT2
auagccagcgugaaccuguua

SEQ ID NO: 3765619 - RNA, 20 nt, Salmonella typhimurium LT2
auaucaaacacaaauuucga

SEQ ID NO: 3765620 - RNA, 18 nt, Salmonella typhimurium LT2
auaucaacggucaggcug

SEQ ID NO: 3765621 - RNA, 12 nt, Salmonella typhimurium LT2
auaucaaugcgc

SEQ ID NO: 3765622 - RNA, 14 nt, Salmonella typhimurium LT2
auaucaauucaaca

SEQ ID NO: 3765623 - RNA, 19 nt, Salmonella typhimurium LT2
auaucagacgcgcaaaacu

SEQ ID NO: 3765624 - RNA, 17 nt, Salmonella typhimurium LT2
auaucaggacuuuuucc

SEQ ID NO: 3765625 - RNA, 19 nt, Salmonella typhimurium LT2
auaucaggcaaaaaucguc

SEQ ID NO: 3765626 - RNA, 19 nt, Salmonella typhimurium LT2
auaucaguuaugacagaca

SEQ ID NO: 3765627 - RNA, 22 nt, Salmonella typhimurium LT2
auaucaucgucauuaaugccua

SEQ ID NO: 3765628 - RNA, 19 nt, Salmonella typhimurium LT2
auaucauuaugucauagca

SEQ ID NO: 3765629 - RNA, 18 nt, Salmonella typhimurium LT2
auaucccggcugacauaa

SEQ ID NO: 3765630 - RNA, 19 nt, Salmonella typhimurium LT2
auaucccggcugacauaau

SEQ ID NO: 3765631 - RNA, 23 nt, Salmonella typhimurium LT2
auaucccguggugcguugcgcca

SEQ ID NO: 3765632 - RNA, 20 nt, Salmonella typhimurium LT2
auaucccuucucauggacac

SEQ ID NO: 3765633 - RNA, 22 nt, Salmonella typhimurium LT2
auauccgcugcggucaggaaug

SEQ ID NO: 3765634 - RNA, 14 nt, Salmonella typhimurium LT2
auauccuaacuuau

SEQ ID NO: 3765635 - RNA, 14 nt, Salmonella typhimurium LT2
auauccuccaccuc

SEQ ID NO: 3765636 - RNA, 17 nt, Salmonella typhimurium LT2
auauccugaugcgccuc

SEQ ID NO: 3765637 - RNA, 22 nt, Salmonella typhimurium LT2
auauccugcaccgccugcggca

SEQ ID NO: 3765638 - RNA, 23 nt, Salmonella typhimurium LT2
auauccugcaccgccugcggcau

SEQ ID NO: 3765639 - RNA, 17 nt, Salmonella typhimurium LT2
auaucgaagcccagcuc

SEQ ID NO: 3765640 - RNA, 13 nt, Salmonella typhimurium LT2
auaucgccauuca

SEQ ID NO: 3765641 - RNA, 20 nt, Salmonella typhimurium LT2
auaucgcgagcaauuuccuc

SEQ ID NO: 3765642 - RNA, 15 nt, Salmonella typhimurium LT2
auaucggcggaaauu

SEQ ID NO: 3765643 - RNA, 13 nt, Salmonella typhimurium LT2
auaucguaaauua

SEQ ID NO: 3765644 - RNA, 15 nt, Salmonella typhimurium LT2
auaucguugccgccg

SEQ ID NO: 3765645 - RNA, 15 nt, Salmonella typhimurium LT2
auaucugcgccgcca

SEQ ID NO: 3765646 - RNA, 20 nt, Salmonella typhimurium LT2
auaucuguauaaauaaaauu

SEQ ID NO: 3765647 - RNA, 19 nt, Salmonella typhimurium LT2
auaucuuacggaaaaaugu

SEQ ID NO: 3765648 - RNA, 14 nt, Salmonella typhimurium LT2
auaucuuccagcgc

SEQ ID NO: 3765649 - RNA, 13 nt, Salmonella typhimurium LT2
auaugaaccaaga

SEQ ID NO: 3765650 - RNA, 17 nt, Salmonella typhimurium LT2
auaugaaccaagauaag

SEQ ID NO: 3765651 - RNA, 15 nt, Salmonella typhimurium LT2
auaugacccgggcgu

SEQ ID NO: 3765652 - RNA, 14 nt, Salmonella typhimurium LT2
auaugagcacagcc

SEQ ID NO: 3765653 - RNA, 19 nt, Salmonella typhimurium LT2
auaugauagaaguuaugca

SEQ ID NO: 3765654 - RNA, 21 nt, Salmonella typhimurium LT2
auaugaucgaaaaugcgcaug

SEQ ID NO: 3765655 - RNA, 18 nt, Salmonella typhimurium LT2
auaugcaauuaauauauu

SEQ ID NO: 3765656 - RNA, 16 nt, Salmonella typhimurium LT2
auaugcagcagccagu

SEQ ID NO: 3765657 - RNA, 14 nt, Salmonella typhimurium LT2
auaugcaggcauaa

SEQ ID NO: 3765658 - RNA, 21 nt, Salmonella typhimurium LT2
auaugcaggcauaaaaaagag

SEQ ID NO: 3765659 - RNA, 20 nt, Salmonella typhimurium LT2
auaugcaggggcaguaaauu

SEQ ID NO: 3765660 - RNA, 22 nt, Salmonella typhimurium LT2
auaugccaaguaauaaagagaa

SEQ ID NO: 3765661 - RNA, 21 nt, Salmonella typhimurium LT2
auaugccagcucaaaucgcgg

SEQ ID NO: 3765662 - RNA, 13 nt, Salmonella typhimurium LT2
auaugccaggcau

SEQ ID NO: 3765663 - RNA, 22 nt, Salmonella typhimurium LT2
auaugccaggcuuccugcgcug

SEQ ID NO: 3765664 - RNA, 21 nt, Salmonella typhimurium LT2
auaugccaggggaaauccugg

SEQ ID NO: 3765665 - RNA, 21 nt, Salmonella typhimurium LT2
auaugccggccgcaguuuucc

SEQ ID NO: 3765666 - RNA, 19 nt, Salmonella typhimurium LT2
auaugcuugccggaugcaa

SEQ ID NO: 3765667 - RNA, 14 nt, Salmonella typhimurium LT2
auauggaugaggau

SEQ ID NO: 3765668 - RNA, 23 nt, Salmonella typhimurium LT2
auauggcacuuucagauaccaaa

SEQ ID NO: 3765669 - RNA, 19 nt, Salmonella typhimurium LT2
auauggccguuuucaugca

SEQ ID NO: 3765670 - RNA, 15 nt, Salmonella typhimurium LT2
auaugguuauccagc

SEQ ID NO: 3765671 - RNA, 13 nt, Salmonella typhimurium LT2
auauguaaaucgg

SEQ ID NO: 3765672 - RNA, 22 nt, Salmonella typhimurium LT2
auaugucugauucuuaucugug

SEQ ID NO: 3765673 - RNA, 17 nt, Salmonella typhimurium LT2
auauguguaucuugcuu

SEQ ID NO: 3765674 - RNA, 17 nt, Salmonella typhimurium LT2
auauguuaccuguuaaa

SEQ ID NO: 3765675 - RNA, 19 nt, Salmonella typhimurium LT2
auauguucccgacggcagg

SEQ ID NO: 3765676 - RNA, 17 nt, Salmonella typhimurium LT2
auauguuugacaagcag

SEQ ID NO: 3765677 - RNA, 12 nt, Salmonella typhimurium LT2
auauuaaaagac

SEQ ID NO: 3765678 - RNA, 14 nt, Salmonella typhimurium LT2
auauuaaaagccgc

SEQ ID NO: 3765679 - RNA, 15 nt, Salmonella typhimurium LT2
auauuaaauuuauac

SEQ ID NO: 3765680 - RNA, 19 nt, Salmonella typhimurium LT2
auauuagcgguacucuuuu

SEQ ID NO: 3765681 - RNA, 12 nt, Salmonella typhimurium LT2
auauuauaaaau

SEQ ID NO: 3765682 - RNA, 14 nt, Salmonella typhimurium LT2
auauuauaaaauaa

SEQ ID NO: 3765683 - RNA, 13 nt, Salmonella typhimurium LT2
auauuauauguuu

SEQ ID NO: 3765684 - RNA, 19 nt, Salmonella typhimurium LT2
auauuaucgcgcugaauaa

SEQ ID NO: 3765685 - RNA, 12 nt, Salmonella typhimurium LT2
auauuauucugu

SEQ ID NO: 3765686 - RNA, 15 nt, Salmonella typhimurium LT2
auauuauugcccuuu

SEQ ID NO: 3765687 - RNA, 15 nt, Salmonella typhimurium LT2
auauuauuuuuuuau

SEQ ID NO: 3765688 - RNA, 15 nt, Salmonella typhimurium LT2
auauucaaaauccgc

SEQ ID NO: 3765689 - RNA, 22 nt, Salmonella typhimurium LT2
auauucaacgaaugccugcaua

SEQ ID NO: 3765690 - RNA, 13 nt, Salmonella typhimurium LT2
auauucagaauuu

SEQ ID NO: 3765691 - RNA, 15 nt, Salmonella typhimurium LT2
auauucaugcuuuca

SEQ ID NO: 3765692 - RNA, 18 nt, Salmonella typhimurium LT2
auauuccaucaauaaucc

SEQ ID NO: 3765693 - RNA, 16 nt, Salmonella typhimurium LT2
auauuccgcgcuaucg

SEQ ID NO: 3765694 - RNA, 17 nt, Salmonella typhimurium LT2
auauuccggcgcuggcg

SEQ ID NO: 3765695 - RNA, 22 nt, Salmonella typhimurium LT2
auauucguccuuuaucagaugu

SEQ ID NO: 3765696 - RNA, 22 nt, Salmonella typhimurium LT2
auauucuuuguuuaaaaauuuu

SEQ ID NO: 3765697 - RNA, 18 nt, Salmonella typhimurium LT2
auauugauggccacaucg

SEQ ID NO: 3765698 - RNA, 12 nt, Salmonella typhimurium LT2
auauugccgccu

SEQ ID NO: 3765699 - RNA, 19 nt, Salmonella typhimurium LT2
auauugcguaagcagcugc

SEQ ID NO: 3765700 - RNA, 15 nt, Salmonella typhimurium LT2
auauuggcuggccug

SEQ ID NO: 3765701 - RNA, 17 nt, Salmonella typhimurium LT2
auauuggcuggccugcu

SEQ ID NO: 3765702 - RNA, 17 nt, Salmonella typhimurium LT2
auauuguagguuuuccu

SEQ ID NO: 3765703 - RNA, 15 nt, Salmonella typhimurium LT2
auauugucauaaugu

SEQ ID NO: 3765704 - RNA, 23 nt, Salmonella typhimurium LT2
auauugugccucuuuuuucgcca

SEQ ID NO: 3765705 - RNA, 19 nt, Salmonella typhimurium LT2
auauuuaacuuaaauaaaa

SEQ ID NO: 3765706 - RNA, 21 nt, Salmonella typhimurium LT2
auauuuaacuuaaauaaaaau

SEQ ID NO: 3765707 - RNA, 16 nt, Salmonella typhimurium LT2
auauuuaccgccgcuu

SEQ ID NO: 3765708 - RNA, 20 nt, Salmonella typhimurium LT2
auauuuauuuacgccggaua

SEQ ID NO: 3765709 - RNA, 20 nt, Salmonella typhimurium LT2
auauuuauuuuauaaauuaa

SEQ ID NO: 3765710 - RNA, 14 nt, Salmonella typhimurium LT2
auauuucaagccgc

SEQ ID NO: 3765711 - RNA, 17 nt, Salmonella typhimurium LT2
auauuucaagccgcagc

SEQ ID NO: 3765712 - RNA, 22 nt, Salmonella typhimurium LT2
auauuucuuuaugggcauuuca

SEQ ID NO: 3765713 - RNA, 13 nt, Salmonella typhimurium LT2
auauuuguaucug

SEQ ID NO: 3765714 - RNA, 14 nt, Salmonella typhimurium LT2
auauuuuaucacua

SEQ ID NO: 3765715 - RNA, 16 nt, Salmonella typhimurium LT2
auauuuucagaaauca

SEQ ID NO: 3765716 - RNA, 21 nt, Salmonella typhimurium LT2
auauuuucuugcuacauaucu

SEQ ID NO: 3765717 - RNA, 23 nt, Salmonella typhimurium LT2
auauuuuguaggccuaaaaauag

SEQ ID NO: 3765718 - RNA, 13 nt, Salmonella typhimurium LT2
auauuuuguaguu

SEQ ID NO: 3765719 - RNA, 22 nt, Salmonella typhimurium LT2
auauuuugucaggccgcguggg

SEQ ID NO: 3765720 - RNA, 19 nt, Salmonella typhimurium LT2
auauuuuguuuuaaauuca

SEQ ID NO: 3765721 - RNA, 21 nt, Salmonella typhimurium LT2
auauuuuguuuuaaauucaac

SEQ ID NO: 3765722 - RNA, 13 nt, Salmonella typhimurium LT2
auauuuuucuaau

SEQ ID NO: 3765723 - RNA, 19 nt, Salmonella typhimurium LT2
aucagauacggcuccagca

SEQ ID NO: 3765724 - RNA, 11 nt, Salmonella typhimurium LT2
aucagaugacc

SEQ ID NO: 3765725 - RNA, 21 nt, Salmonella typhimurium LT2
aucagaugcgcuucagcgacu

SEQ ID NO: 3765726 - RNA, 23 nt, Salmonella typhimurium LT2
aucagauucgcuacugcaucugc

SEQ ID NO: 3765727 - RNA, 21 nt, Salmonella typhimurium LT2
aucagauugcgaaagaauuac

SEQ ID NO: 3765728 - RNA, 20 nt, Salmonella typhimurium LT2
aucagcaaacgaccuuucgc

SEQ ID NO: 3765729 - RNA, 18 nt, Salmonella typhimurium LT2
aucagcaacacaaucagg

SEQ ID NO: 3765730 - RNA, 14 nt, Salmonella typhimurium LT2
aucagcaacgcgcc

SEQ ID NO: 3765731 - RNA, 18 nt, Salmonella typhimurium LT2
aucagcaagaugacccau

SEQ ID NO: 3765732 - RNA, 19 nt, Salmonella typhimurium LT2
aucagcacgcggaacacgg

SEQ ID NO: 3765733 - RNA, 13 nt, Salmonella typhimurium LT2
aucagcagaucca

SEQ ID NO: 3765734 - RNA, 11 nt, Salmonella typhimurium LT2
aucagcagcga

SEQ ID NO: 3765735 - RNA, 19 nt, Salmonella typhimurium LT2
aucagcauagcgccuucag

SEQ ID NO: 3765736 - RNA, 13 nt, Salmonella typhimurium LT2
aucagcaucccac

SEQ ID NO: 3765737 - RNA, 15 nt, Salmonella typhimurium LT2
aucagcaucccaccg

SEQ ID NO: 3765738 - RNA, 19 nt, Salmonella typhimurium LT2
aucagcauuggucaucgcc

SEQ ID NO: 3765739 - RNA, 22 nt, Salmonella typhimurium LT2
aucagcauuggucaucgcccau

SEQ ID NO: 3765740 - RNA, 14 nt, Salmonella typhimurium LT2
aucagcauuuucac

SEQ ID NO: 3765741 - RNA, 12 nt, Salmonella typhimurium LT2
aucagccagcau

SEQ ID NO: 3765742 - RNA, 15 nt, Salmonella typhimurium LT2
aucagccagccgcca

SEQ ID NO: 3765743 - RNA, 16 nt, Salmonella typhimurium LT2
aucagccagccgccaa

SEQ ID NO: 3765744 - RNA, 13 nt, Salmonella typhimurium LT2
aucagccauuaac

SEQ ID NO: 3765745 - RNA, 17 nt, Salmonella typhimurium LT2
aucagccauuaaccaga

SEQ ID NO: 3765746 - RNA, 22 nt, Salmonella typhimurium LT2
aucagccugagcgccagcgugc

SEQ ID NO: 3765747 - RNA, 13 nt, Salmonella typhimurium LT2
aucagcgacuggu

SEQ ID NO: 3765748 - RNA, 16 nt, Salmonella typhimurium LT2
aucagcgcaauaaauu

SEQ ID NO: 3765749 - RNA, 18 nt, Salmonella typhimurium LT2
aucagcgccaccacaaac

SEQ ID NO: 3765750 - RNA, 14 nt, Salmonella typhimurium LT2
aucagcgccagccc

SEQ ID NO: 3765751 - RNA, 20 nt, Salmonella typhimurium LT2
aucagcgccauuaacgccau

SEQ ID NO: 3765752 - RNA, 20 nt, Salmonella typhimurium LT2
aucagcgcgcuccagaccac

SEQ ID NO: 3765753 - RNA, 12 nt, Salmonella typhimurium LT2
aucagcgcgugc

SEQ ID NO: 3765754 - RNA, 18 nt, Salmonella typhimurium LT2
aucagcgcguuuuccauc

SEQ ID NO: 3765755 - RNA, 15 nt, Salmonella typhimurium LT2
aucagcgcuccgaca

SEQ ID NO: 3765756 - RNA, 22 nt, Salmonella typhimurium LT2
aucagcggcacauaagcgauuc

SEQ ID NO: 3765757 - RNA, 15 nt, Salmonella typhimurium LT2
aucagcggcagcucg

SEQ ID NO: 3765758 - RNA, 18 nt, Salmonella typhimurium LT2
aucagcggcagcucgugc

SEQ ID NO: 3765759 - RNA, 21 nt, Salmonella typhimurium LT2
aucagcgucagcaccaguaca

SEQ ID NO: 3765760 - RNA, 23 nt, Salmonella typhimurium LT2
aucagcguguacggccugauaac

SEQ ID NO: 3765761 - RNA, 23 nt, Salmonella typhimurium LT2
aucagcguuucgccguaaaacaa

SEQ ID NO: 3765762 - RNA, 16 nt, Salmonella typhimurium LT2
aucagcugcugcgcuu

SEQ ID NO: 3765763 - RNA, 23 nt, Salmonella typhimurium LT2
aucagcugcugcgcuuuccaggc

SEQ ID NO: 3765764 - RNA, 17 nt, Salmonella typhimurium LT2
aucagcuucggcggcau

SEQ ID NO: 3765765 - RNA, 21 nt, Salmonella typhimurium LT2
aucaggaaaaagggaauaaua

SEQ ID NO: 3765766 - RNA, 15 nt, Salmonella typhimurium LT2
aucaggaaaucuucc

SEQ ID NO: 3765767 - RNA, 18 nt, Salmonella typhimurium LT2
aucaggaaaucuuccagu

SEQ ID NO: 3765768 - RNA, 16 nt, Salmonella typhimurium LT2
aucaggaaaugaacca

SEQ ID NO: 3765769 - RNA, 13 nt, Salmonella typhimurium LT2
aucaggacaucaa

SEQ ID NO: 3765770 - RNA, 16 nt, Salmonella typhimurium LT2
aucaggacauggucac

SEQ ID NO: 3765771 - RNA, 16 nt, Salmonella typhimurium LT2
aucaggauaauuucac

SEQ ID NO: 3765772 - RNA, 14 nt, Salmonella typhimurium LT2
aucaggaucaaaau

SEQ ID NO: 3765773 - RNA, 16 nt, Salmonella typhimurium LT2
aucaggaucuucaucc

SEQ ID NO: 3765774 - RNA, 15 nt, Salmonella typhimurium LT2
aucaggauuauuaca

SEQ ID NO: 3765775 - RNA, 22 nt, Salmonella typhimurium LT2
aucaggauucgacggccagcgc

SEQ ID NO: 3765776 - RNA, 23 nt, Salmonella typhimurium LT2
aucaggcaagacccgaaccugcg

SEQ ID NO: 3765777 - RNA, 19 nt, Salmonella typhimurium LT2
aucaggcaggucugauaaa

SEQ ID NO: 3765778 - RNA, 15 nt, Salmonella typhimurium LT2
aucaggcauaaaccu

SEQ ID NO: 3765779 - RNA, 17 nt, Salmonella typhimurium LT2
aucaggcauguugcgca

SEQ ID NO: 3765780 - RNA, 13 nt, Salmonella typhimurium LT2
aucaggcccagua

SEQ ID NO: 3765781 - RNA, 19 nt, Salmonella typhimurium LT2
aucaggccgacaaaugacg

SEQ ID NO: 3765782 - RNA, 15 nt, Salmonella typhimurium LT2
aucaggccuaccagc

SEQ ID NO: 3765783 - RNA, 17 nt, Salmonella typhimurium LT2
aucaggccuaccagccg

SEQ ID NO: 3765784 - RNA, 19 nt, Salmonella typhimurium LT2
aucaggccuacgacagcgc

SEQ ID NO: 3765785 - RNA, 21 nt, Salmonella typhimurium LT2
aucaggccuacgggucauggu

SEQ ID NO: 3765786 - RNA, 16 nt, Salmonella typhimurium LT2
aucaggcguucauaaa

SEQ ID NO: 3765787 - RNA, 22 nt, Salmonella typhimurium LT2
aucaggcugguauaaaaacugc

SEQ ID NO: 3765788 - RNA, 16 nt, Salmonella typhimurium LT2
aucagggaaaaaugug

SEQ ID NO: 3765789 - RNA, 15 nt, Salmonella typhimurium LT2
aucagggugccaggc

SEQ ID NO: 3765790 - RNA, 20 nt, Salmonella typhimurium LT2
aucagguaucccgccagcgg

SEQ ID NO: 3765791 - RNA, 20 nt, Salmonella typhimurium LT2
aucaggugaauaccaaagcc

SEQ ID NO: 3765792 - RNA, 20 nt, Salmonella typhimurium LT2
aucaggugaguaaauaaaaa

SEQ ID NO: 3765793 - RNA, 21 nt, Salmonella typhimurium LT2
aucaggugaguaaauaaaaac

SEQ ID NO: 3765794 - RNA, 21 nt, Salmonella typhimurium LT2
aucaggugcgagagcuguccu

SEQ ID NO: 3765795 - RNA, 14 nt, Salmonella typhimurium LT2
aucaguaacugacg

SEQ ID NO: 3765796 - RNA, 22 nt, Salmonella typhimurium LT2
aucaguacgaccccgccgagaa

SEQ ID NO: 3765797 - RNA, 10 nt, Salmonella typhimurium LT2
aucaguagcu

SEQ ID NO: 3765798 - RNA, 21 nt, Salmonella typhimurium LT2
aucaguaugagcgaacggcuu

SEQ ID NO: 3765799 - RNA, 18 nt, Salmonella typhimurium LT2
aucaguccccacauuacg

SEQ ID NO: 3765800 - RNA, 22 nt, Salmonella typhimurium LT2
aucaguccccagcguaccacgc

SEQ ID NO: 3765801 - RNA, 17 nt, Salmonella typhimurium LT2
aucagugagaagggcag

SEQ ID NO: 3765802 - RNA, 19 nt, Salmonella typhimurium LT2
aucaguggcggcaaaaaau

SEQ ID NO: 3765803 - RNA, 16 nt, Salmonella typhimurium LT2
aucaguucaggaacau

SEQ ID NO: 3765804 - RNA, 15 nt, Salmonella typhimurium LT2
aucaguugcaggaag

SEQ ID NO: 3765805 - RNA, 14 nt, Salmonella typhimurium LT2
aucaguuugcgaag

SEQ ID NO: 3765806 - RNA, 21 nt, Salmonella typhimurium LT2
aucauaaaaggcugagaaggu

SEQ ID NO: 3765807 - RNA, 12 nt, Salmonella typhimurium LT2
aucauaaaucga

SEQ ID NO: 3765808 - RNA, 14 nt, Salmonella typhimurium LT2
aucauacugaacuc

SEQ ID NO: 3765809 - RNA, 14 nt, Salmonella typhimurium LT2
aucauauaaaacag

SEQ ID NO: 3765810 - RNA, 12 nt, Salmonella typhimurium LT2
aucauauaaucu

SEQ ID NO: 3765811 - RNA, 22 nt, Salmonella typhimurium LT2
aucauaugugccgaugacgcuc

SEQ ID NO: 3765812 - RNA, 16 nt, Salmonella typhimurium LT2
aucauauucgcagcuc

SEQ ID NO: 3765813 - RNA, 21 nt, Salmonella typhimurium LT2
aucauauuuuaucuccauauc

SEQ ID NO: 3765814 - RNA, 14 nt, Salmonella typhimurium LT2
aucauauuuucuug

SEQ ID NO: 3765815 - RNA, 24 nt, Salmonella typhimurium LT2
aucauauuuucuugcuacauaucu

SEQ ID NO: 3765816 - RNA, 18 nt, Salmonella typhimurium LT2
aucaucaaguaccgugaa

SEQ ID NO: 3765817 - RNA, 15 nt, Salmonella typhimurium LT2
aucaucaccacccgc

SEQ ID NO: 3765818 - RNA, 13 nt, Salmonella typhimurium LT2
aucaucagcagca

SEQ ID NO: 3765819 - RNA, 19 nt, Salmonella typhimurium LT2
aucaucagcaucuuuggcu

SEQ ID NO: 3765820 - RNA, 13 nt, Salmonella typhimurium LT2
aucaucaggaaca

SEQ ID NO: 3765821 - RNA, 17 nt, Salmonella typhimurium LT2
aucauccagucagcaau

SEQ ID NO: 3765822 - RNA, 14 nt, Salmonella typhimurium LT2
aucauccccaccac

SEQ ID NO: 3765823 - RNA, 16 nt, Salmonella typhimurium LT2
aucauccgcuucggac

SEQ ID NO: 3765824 - RNA, 16 nt, Salmonella typhimurium LT2
aucauccguucccucu

SEQ ID NO: 3765825 - RNA, 21 nt, Salmonella typhimurium LT2
aucaucgacaguaccagcaga

SEQ ID NO: 3765826 - RNA, 23 nt, Salmonella typhimurium LT2
aucaucgcaggcggucagcacag

SEQ ID NO: 3765827 - RNA, 23 nt, Salmonella typhimurium LT2
aauaccacaacaagaauauauuc

SEQ ID NO: 3765828 - RNA, 20 nt, Salmonella typhimurium LT2
aauaccaccugccaaagcug

SEQ ID NO: 3765829 - RNA, 16 nt, Salmonella typhimurium LT2
aauaccagaaaucgcu

SEQ ID NO: 3765830 - RNA, 12 nt, Salmonella typhimurium LT2
aauaccagcccc

SEQ ID NO: 3765831 - RNA, 14 nt, Salmonella typhimurium LT2
aauaccagcggcaa

SEQ ID NO: 3765832 - RNA, 20 nt, Salmonella typhimurium LT2
aauaccaggcacuugagaaa

SEQ ID NO: 3765833 - RNA, 17 nt, Salmonella typhimurium LT2
aauacccagcgccaacg

SEQ ID NO: 3765834 - RNA, 21 nt, Salmonella typhimurium LT2
aauacccagcuuucucacuug

SEQ ID NO: 3765835 - RNA, 18 nt, Salmonella typhimurium LT2
aauacccauuucuucuuc

SEQ ID NO: 3765836 - RNA, 21 nt, Salmonella typhimurium LT2
aauacccgccgauaaacgcgu

SEQ ID NO: 3765837 - RNA, 18 nt, Salmonella typhimurium LT2
aauacccuucacggucaa

SEQ ID NO: 3765838 - RNA, 16 nt, Salmonella typhimurium LT2
aauaccgaaauccgcu

SEQ ID NO: 3765839 - RNA, 16 nt, Salmonella typhimurium LT2
aauaccgaacaaugug

SEQ ID NO: 3765840 - RNA, 17 nt, Salmonella typhimurium LT2
aauaccggauacgcaua

SEQ ID NO: 3765841 - RNA, 21 nt, Salmonella typhimurium LT2
aauaccggcguaauugcgccu

SEQ ID NO: 3765842 - RNA, 21 nt, Salmonella typhimurium LT2
aauaccguggucuccgccugg

SEQ ID NO: 3765843 - RNA, 19 nt, Salmonella typhimurium LT2
aauaccuuaguaaaaccga

SEQ ID NO: 3765844 - RNA, 18 nt, Salmonella typhimurium LT2
aauaccuuauucagccca

SEQ ID NO: 3765845 - RNA, 20 nt, Salmonella typhimurium LT2
aauaccuuauucagcccacg

SEQ ID NO: 3765846 - RNA, 17 nt, Salmonella typhimurium LT2
aauaccuucacaaaaag

SEQ ID NO: 3765847 - RNA, 18 nt, Salmonella typhimurium LT2
aauaccuucacaaaaagu

SEQ ID NO: 3765848 - RNA, 14 nt, Salmonella typhimurium LT2
aauacgaaaauccu

SEQ ID NO: 3765849 - RNA, 16 nt, Salmonella typhimurium LT2
aauacgacucaauaca

SEQ ID NO: 3765850 - RNA, 18 nt, Salmonella typhimurium LT2
aauacgccgccagcaaua

SEQ ID NO: 3765851 - RNA, 20 nt, Salmonella typhimurium LT2
aauacgcuuguacuugauac

SEQ ID NO: 3765852 - RNA, 18 nt, Salmonella typhimurium LT2
aauacggagcaaaaaacg

SEQ ID NO: 3765853 - RNA, 24 nt, Salmonella typhimurium LT2
aauacgguuagccagugggcguca

SEQ ID NO: 3765854 - RNA, 13 nt, Salmonella typhimurium LT2
aauacguaauacc

SEQ ID NO: 3765855 - RNA, 18 nt, Salmonella typhimurium LT2
aauacguccauuugauga

SEQ ID NO: 3765856 - RNA, 20 nt, Salmonella typhimurium LT2
aauacgucgugacccacaca

SEQ ID NO: 3765857 - RNA, 18 nt, Salmonella typhimurium LT2
aauacgugagcgaaguuc

SEQ ID NO: 3765858 - RNA, 17 nt, Salmonella typhimurium LT2
aauacguuuauucuuuu

SEQ ID NO: 3765859 - RNA, 19 nt, Salmonella typhimurium LT2
aauacucaauauccugcgg

SEQ ID NO: 3765860 - RNA, 19 nt, Salmonella typhimurium LT2
aauacucccggcgcuggac

SEQ ID NO: 3765861 - RNA, 23 nt, Salmonella typhimurium LT2
aauacugaacgccgcguuuuagc

SEQ ID NO: 3765862 - RNA, 22 nt, Salmonella typhimurium LT2
aauacugagacgcgaaacgaaa

SEQ ID NO: 3765863 - RNA, 18 nt, Salmonella typhimurium LT2
aauacugcuuuuccggca

SEQ ID NO: 3765864 - RNA, 15 nt, Salmonella typhimurium LT2
aauacuuacuguuuc

SEQ ID NO: 3765865 - RNA, 15 nt, Salmonella typhimurium LT2
aauacuuuccagcug

SEQ ID NO: 3765866 - RNA, 15 nt, Salmonella typhimurium LT2
aauagaacccaaagc

SEQ ID NO: 3765867 - RNA, 17 nt, Salmonella typhimurium LT2
aauagagagaaucgggu

SEQ ID NO: 3765868 - RNA, 16 nt, Salmonella typhimurium LT2
aauagaggaaauaaca

SEQ ID NO: 3765869 - RNA, 20 nt, Salmonella typhimurium LT2
aauagagugcgauuugacau

SEQ ID NO: 3765870 - RNA, 18 nt, Salmonella typhimurium LT2
aauagauaugaaagaagg

SEQ ID NO: 3765871 - RNA, 18 nt, Salmonella typhimurium LT2
aauagcacaucagccaac

SEQ ID NO: 3765872 - RNA, 23 nt, Salmonella typhimurium LT2
aauagcaucaauuucucuuuuau

SEQ ID NO: 3765873 - RNA, 22 nt, Salmonella typhimurium LT2
aauagccccucaauuauguauu

SEQ ID NO: 3765874 - RNA, 19 nt, Salmonella typhimurium LT2
aauagccugggcaaggcug

SEQ ID NO: 3765875 - RNA, 17 nt, Salmonella typhimurium LT2
aauagcgauucaucacu

SEQ ID NO: 3765876 - RNA, 15 nt, Salmonella typhimurium LT2
aauagcgcugaugcg

SEQ ID NO: 3765877 - RNA, 17 nt, Salmonella typhimurium LT2
aauagcuggcugucuuc

SEQ ID NO: 3765878 - RNA, 16 nt, Salmonella typhimurium LT2
aauagcuuacuuucag

SEQ ID NO: 3765879 - RNA, 20 nt, Salmonella typhimurium LT2
aauagcuuuuuacucagggc

SEQ ID NO: 3765880 - RNA, 15 nt, Salmonella typhimurium LT2
aauaguagcugagag

SEQ ID NO: 3765881 - RNA, 14 nt, Salmonella typhimurium LT2
aauaguccagcagc

SEQ ID NO: 3765882 - RNA, 16 nt, Salmonella typhimurium LT2
aauaguccagcagcca

SEQ ID NO: 3765883 - RNA, 23 nt, Salmonella typhimurium LT2
aauagugauaccagccaacagua

SEQ ID NO: 3765884 - RNA, 14 nt, Salmonella typhimurium LT2
aauagugcagaaag

SEQ ID NO: 3765885 - RNA, 22 nt, Salmonella typhimurium LT2
aauaguugauaauauuaucagc

SEQ ID NO: 3765886 - RNA, 17 nt, Salmonella typhimurium LT2
aauauaaccaauuuaaa

SEQ ID NO: 3765887 - RNA, 11 nt, Salmonella typhimurium LT2
aauauaauccg

SEQ ID NO: 3765888 - RNA, 14 nt, Salmonella typhimurium LT2
aauauaaucuacca

SEQ ID NO: 3765889 - RNA, 23 nt, Salmonella typhimurium LT2
aauauaaugaguuaacuacagca

SEQ ID NO: 3765890 - RNA, 18 nt, Salmonella typhimurium LT2
aauauaccgucagcacca

SEQ ID NO: 3765891 - RNA, 14 nt, Salmonella typhimurium LT2
aauauacgccaccu

SEQ ID NO: 3765892 - RNA, 22 nt, Salmonella typhimurium LT2
aauauacuagccaguaaccaua

SEQ ID NO: 3765893 - RNA, 19 nt, Salmonella typhimurium LT2
aauauagcuaaugcaauaa

SEQ ID NO: 3765894 - RNA, 16 nt, Salmonella typhimurium LT2
aauauaugaaccaaga

SEQ ID NO: 3765895 - RNA, 12 nt, Salmonella typhimurium LT2
aauauauuacga

SEQ ID NO: 3765896 - RNA, 14 nt, Salmonella typhimurium LT2
aauauauuacgacu

SEQ ID NO: 3765897 - RNA, 15 nt, Salmonella typhimurium LT2
aauauauucucugug

SEQ ID NO: 3765898 - RNA, 17 nt, Salmonella typhimurium LT2
aauauauuucacuucau

SEQ ID NO: 3765899 - RNA, 17 nt, Salmonella typhimurium LT2
aauaucaaaccacgcug

SEQ ID NO: 3765900 - RNA, 13 nt, Salmonella typhimurium LT2
aauaucaaucagc

SEQ ID NO: 3765901 - RNA, 15 nt, Salmonella typhimurium LT2
aauaucaauuccaca

SEQ ID NO: 3765902 - RNA, 18 nt, Salmonella typhimurium LT2
aauaucauuaauuauacu

SEQ ID NO: 3765903 - RNA, 20 nt, Salmonella typhimurium LT2
aauaucauuagcgucauacu

SEQ ID NO: 3765904 - RNA, 14 nt, Salmonella typhimurium LT2
aauauccagacugu

SEQ ID NO: 3765905 - RNA, 11 nt, Salmonella typhimurium LT2
aauauccagcc

SEQ ID NO: 3765906 - RNA, 11 nt, Salmonella typhimurium LT2
aauauccauuu

SEQ ID NO: 3765907 - RNA, 16 nt, Salmonella typhimurium LT2
aauauccuccaccucg

SEQ ID NO: 3765908 - RNA, 21 nt, Salmonella typhimurium LT2
aauauccugccgcaacagaaa

SEQ ID NO: 3765909 - RNA, 18 nt, Salmonella typhimurium LT2
aauaucgauagcauuuuu

SEQ ID NO: 3765910 - RNA, 20 nt, Salmonella typhimurium LT2
aauaucgaugcuuauuauuu

SEQ ID NO: 3765911 - RNA, 18 nt, Salmonella typhimurium LT2
aauaucggcucaauaccc

SEQ ID NO: 3765912 - RNA, 17 nt, Salmonella typhimurium LT2
aauaucggguauccauu

SEQ ID NO: 3765913 - RNA, 15 nt, Salmonella typhimurium LT2
aauaucuauaucgcu

SEQ ID NO: 3765914 - RNA, 18 nt, Salmonella typhimurium LT2
aauaucugaauaaccauu

SEQ ID NO: 3765915 - RNA, 13 nt, Salmonella typhimurium LT2
aauaucuuuaugc

SEQ ID NO: 3765916 - RNA, 14 nt, Salmonella typhimurium LT2
aauaugaaagagaa

SEQ ID NO: 3765917 - RNA, 15 nt, Salmonella typhimurium LT2
aauaugaaagagaaa

SEQ ID NO: 3765918 - RNA, 11 nt, Salmonella typhimurium LT2
aauaugaaauu

SEQ ID NO: 3765919 - RNA, 13 nt, Salmonella typhimurium LT2
aauaugagcacag

SEQ ID NO: 3765920 - RNA, 15 nt, Salmonella typhimurium LT2
aauaugcaauuaaua

SEQ ID NO: 3765921 - RNA, 18 nt, Salmonella typhimurium LT2
aauaugcaauuaauauau

SEQ ID NO: 3765922 - RNA, 20 nt, Salmonella typhimurium LT2
aauaugcaauuaauauauuu

SEQ ID NO: 3765923 - RNA, 13 nt, Salmonella typhimurium LT2
aauaugccaggca

SEQ ID NO: 3765924 - RNA, 23 nt, Salmonella typhimurium LT2
aauaugccggccgcaguuuucca

SEQ ID NO: 3765925 - RNA, 15 nt, Salmonella typhimurium LT2
aauaugcgcaaucac

SEQ ID NO: 3765926 - RNA, 16 nt, Salmonella typhimurium LT2
aauaugcgucagcgcg

SEQ ID NO: 3765927 - RNA, 14 nt, Salmonella typhimurium LT2
aauaugcuggcuua

SEQ ID NO: 3765928 - RNA, 17 nt, Salmonella typhimurium LT2
aauauggcacagcacua

SEQ ID NO: 3765929 - RNA, 23 nt, Salmonella typhimurium LT2
aauauguccguuugcugcaccaa

SEQ ID NO: 3765930 - RNA, 17 nt, Salmonella typhimurium LT2
aauauguuccacaauca

SEQ ID NO: 3765931 - RNA, 18 nt, Salmonella typhimurium LT2
aauccuuaaucagcuugu

SEQ ID NO: 3765932 - RNA, 19 nt, Salmonella typhimurium LT2
aauccuuccuccaccacca

SEQ ID NO: 3765933 - RNA, 13 nt, Salmonella typhimurium LT2
aauccuuccuuuc

SEQ ID NO: 3765934 - RNA, 23 nt, Salmonella typhimurium LT2
aauccuucuaccuucacccccau

SEQ ID NO: 3765935 - RNA, 12 nt, Salmonella typhimurium LT2
aauccuucuucc

SEQ ID NO: 3765936 - RNA, 23 nt, Salmonella typhimurium LT2
aauccuuguccauguaaacucca

SEQ ID NO: 3765937 - RNA, 16 nt, Salmonella typhimurium LT2
aaucgaacacauuucc

SEQ ID NO: 3765938 - RNA, 15 nt, Salmonella typhimurium LT2
aaucgaacugacggu

SEQ ID NO: 3765939 - RNA, 15 nt, Salmonella typhimurium LT2
aaucgagccuuucac

SEQ ID NO: 3765940 - RNA, 16 nt, Salmonella typhimurium LT2
aaucgaguucgcuuuu

SEQ ID NO: 3765941 - RNA, 19 nt, Salmonella typhimurium LT2
aaucgauagcgauuuuuga

SEQ ID NO: 3765942 - RNA, 15 nt, Salmonella typhimurium LT2
aaucgcaaacgccag

SEQ ID NO: 3765943 - RNA, 19 nt, Salmonella typhimurium LT2
aaucgcaucauaaauggcu

SEQ ID NO: 3765944 - RNA, 17 nt, Salmonella typhimurium LT2
aaucgccagcagcgcga

SEQ ID NO: 3765945 - RNA, 17 nt, Salmonella typhimurium LT2
aaucgccaucagcgcga

SEQ ID NO: 3765946 - RNA, 11 nt, Salmonella typhimurium LT2
aaucgccgcuu

SEQ ID NO: 3765947 - RNA, 16 nt, Salmonella typhimurium LT2
aaucgccucaaccaac

SEQ ID NO: 3765948 - RNA, 17 nt, Salmonella typhimurium LT2
aaucgcgaauaaaugag

SEQ ID NO: 3765949 - RNA, 18 nt, Salmonella typhimurium LT2
aaucgcgagccuucaaca

SEQ ID NO: 3765950 - RNA, 14 nt, Salmonella typhimurium LT2
aaucgcuaaacaua

SEQ ID NO: 3765951 - RNA, 18 nt, Salmonella typhimurium LT2
aaucgcuaaacauauacc

SEQ ID NO: 3765952 - RNA, 19 nt, Salmonella typhimurium LT2
aaucgcuaaacauauaccg

SEQ ID NO: 3765953 - RNA, 14 nt, Salmonella typhimurium LT2
aaucgcucuugcac

SEQ ID NO: 3765954 - RNA, 13 nt, Salmonella typhimurium LT2
aaucgcugcgcca

SEQ ID NO: 3765955 - RNA, 22 nt, Salmonella typhimurium LT2
aaucgcuuuuaucugggucagg

SEQ ID NO: 3765956 - RNA, 13 nt, Salmonella typhimurium LT2
aaucggaugccau

SEQ ID NO: 3765957 - RNA, 15 nt, Salmonella typhimurium LT2
aaucggcaugcguuc

SEQ ID NO: 3765958 - RNA, 17 nt, Salmonella typhimurium LT2
aaucggccagcgacucg

SEQ ID NO: 3765959 - RNA, 18 nt, Salmonella typhimurium LT2
aaucggcgucuggagcgu

SEQ ID NO: 3765960 - RNA, 12 nt, Salmonella typhimurium LT2
aaucggcgugac

SEQ ID NO: 3765961 - RNA, 20 nt, Salmonella typhimurium LT2
aaucggcguuuugcgcgcca

SEQ ID NO: 3765962 - RNA, 16 nt, Salmonella typhimurium LT2
aaucgggccuccgcgu

SEQ ID NO: 3765963 - RNA, 14 nt, Salmonella typhimurium LT2
aaucgguacgccaa

SEQ ID NO: 3765964 - RNA, 19 nt, Salmonella typhimurium LT2
aaucguauucauugccgua

SEQ ID NO: 3765965 - RNA, 13 nt, Salmonella typhimurium LT2
aaucgucccuuuu

SEQ ID NO: 3765966 - RNA, 17 nt, Salmonella typhimurium LT2
aaucgucccuuuucccc

SEQ ID NO: 3765967 - RNA, 20 nt, Salmonella typhimurium LT2
aaucgucgccaacaccgauc

SEQ ID NO: 3765968 - RNA, 12 nt, Salmonella typhimurium LT2
aaucgugcgccc

SEQ ID NO: 3765969 - RNA, 19 nt, Salmonella typhimurium LT2
aaucuaccauugauaccaa

SEQ ID NO: 3765970 - RNA, 17 nt, Salmonella typhimurium LT2
aaucucaagagugaaca

SEQ ID NO: 3765971 - RNA, 20 nt, Salmonella typhimurium LT2
aaucucacgcucauagccgc

SEQ ID NO: 3765972 - RNA, 23 nt, Salmonella typhimurium LT2
aaucucagauaauagcugcggcu

SEQ ID NO: 3765973 - RNA, 20 nt, Salmonella typhimurium LT2
aaucucaucugcaaaauaua

SEQ ID NO: 3765974 - RNA, 22 nt, Salmonella typhimurium LT2
aaucuccuccggcuucagcaac

SEQ ID NO: 3765975 - RNA, 16 nt, Salmonella typhimurium LT2
aaucucgaaacaauag

SEQ ID NO: 3765976 - RNA, 19 nt, Salmonella typhimurium LT2
aaucucgcaagauuccaga

SEQ ID NO: 3765977 - RNA, 17 nt, Salmonella typhimurium LT2
aaucucgugaucgccaa

SEQ ID NO: 3765978 - RNA, 16 nt, Salmonella typhimurium LT2
aaucucuacgccggcg

SEQ ID NO: 3765979 - RNA, 14 nt, Salmonella typhimurium LT2
aaucugaaauaaaa

SEQ ID NO: 3765980 - RNA, 19 nt, Salmonella typhimurium LT2
aaucugaauaucaagauaa

SEQ ID NO: 3765981 - RNA, 21 nt, Salmonella typhimurium LT2
aaucugcauguaguaagccau

SEQ ID NO: 3765982 - RNA, 19 nt, Salmonella typhimurium LT2
aaucugccaucagcaccuu

SEQ ID NO: 3765983 - RNA, 22 nt, Salmonella typhimurium LT2
aaucugcucgacgcgcugcggu

SEQ ID NO: 3765984 - RNA, 16 nt, Salmonella typhimurium LT2
aaucuggauagucagg

SEQ ID NO: 3765985 - RNA, 17 nt, Salmonella typhimurium LT2
aaucuggcaguauaaga

SEQ ID NO: 3765986 - RNA, 18 nt, Salmonella typhimurium LT2
aaucuggucggugauaua

SEQ ID NO: 3765987 - RNA, 21 nt, Salmonella typhimurium LT2
aaucuggugauaaagcagacc

SEQ ID NO: 3765988 - RNA, 23 nt, Salmonella typhimurium LT2
aaucuguucuguccauguuuuau

SEQ ID NO: 3765989 - RNA, 14 nt, Salmonella typhimurium LT2
aaucuugcguacca

SEQ ID NO: 3765990 - RNA, 23 nt, Salmonella typhimurium LT2
aaucuuucuguaagagacugaca

SEQ ID NO: 3765991 - RNA, 13 nt, Salmonella typhimurium LT2
aaucuuugccgca

SEQ ID NO: 3765992 - RNA, 12 nt, Salmonella typhimurium LT2
aaugaaccacac

SEQ ID NO: 3765993 - RNA, 13 nt, Salmonella typhimurium LT2
aaugaagcauaaa

SEQ ID NO: 3765994 - RNA, 13 nt, Salmonella typhimurium LT2
aaugaagcgcguu

SEQ ID NO: 3765995 - RNA, 21 nt, Salmonella typhimurium LT2
aaugaaggauuguacuuauua

SEQ ID NO: 3765996 - RNA, 23 nt, Salmonella typhimurium LT2
aaugaagguuagcgucugcggcu

SEQ ID NO: 3765997 - RNA, 22 nt, Salmonella typhimurium LT2
aaugaaucaucgguaaaugcuu

SEQ ID NO: 3765998 - RNA, 15 nt, Salmonella typhimurium LT2
aaugaauguaggccg

SEQ ID NO: 3765999 - RNA, 15 nt, Salmonella typhimurium LT2
aaugaccagaucaac

SEQ ID NO: 3766000 - RNA, 16 nt, Salmonella typhimurium LT2
aaugaccucaagaaua

SEQ ID NO: 3766001 - RNA, 18 nt, Salmonella typhimurium LT2
aaugaccuccaaagcgcu

SEQ ID NO: 3766002 - RNA, 13 nt, Salmonella typhimurium LT2
aaugacgcccugc

SEQ ID NO: 3766003 - RNA, 18 nt, Salmonella typhimurium LT2
aaugacgcgcgagaacug

SEQ ID NO: 3766004 - RNA, 15 nt, Salmonella typhimurium LT2
aaugacggaccaaca

SEQ ID NO: 3766005 - RNA, 20 nt, Salmonella typhimurium LT2
aaugacggaccaacaaccca

SEQ ID NO: 3766006 - RNA, 16 nt, Salmonella typhimurium LT2
aaugacuucaucgcca

SEQ ID NO: 3766007 - RNA, 22 nt, Salmonella typhimurium LT2
aaugacuuuuuugccaauauau

SEQ ID NO: 3766008 - RNA, 17 nt, Salmonella typhimurium LT2
aaugagcgucgccagac

SEQ ID NO: 3766009 - RNA, 15 nt, Salmonella typhimurium LT2
aaugaguaaccagac

SEQ ID NO: 3766010 - RNA, 14 nt, Salmonella typhimurium LT2
aaugauaaugccgc

SEQ ID NO: 3766011 - RNA, 19 nt, Salmonella typhimurium LT2
aaugauaaugccgcugaua

SEQ ID NO: 3766012 - RNA, 13 nt, Salmonella typhimurium LT2
aaugauaucgcgc

SEQ ID NO: 3766013 - RNA, 17 nt, Salmonella typhimurium LT2
aaugaucacuuccgcca

SEQ ID NO: 3766014 - RNA, 18 nt, Salmonella typhimurium LT2
aaugaucagaacucacau

SEQ ID NO: 3766015 - RNA, 20 nt, Salmonella typhimurium LT2
aaugaucagaacucacauau

SEQ ID NO: 3766016 - RNA, 15 nt, Salmonella typhimurium LT2
aaugauccacggcgu

SEQ ID NO: 3766017 - RNA, 19 nt, Salmonella typhimurium LT2
aaugaucguaugcagccag

SEQ ID NO: 3766018 - RNA, 12 nt, Salmonella typhimurium LT2
aaugaugggguc

SEQ ID NO: 3766019 - RNA, 21 nt, Salmonella typhimurium LT2
aaugauguagucaucaacgcg

SEQ ID NO: 3766020 - RNA, 19 nt, Salmonella typhimurium LT2
aaugauuccgucucagagc

SEQ ID NO: 3766021 - RNA, 18 nt, Salmonella typhimurium LT2
aaugauuuuuauaaaauu

SEQ ID NO: 3766022 - RNA, 20 nt, Salmonella typhimurium LT2
aaugauuuuuauaaaauuua

SEQ ID NO: 3766023 - RNA, 20 nt, Salmonella typhimurium LT2
aaugcaauauuacaaagcag

SEQ ID NO: 3766024 - RNA, 11 nt, Salmonella typhimurium LT2
aaugcacugcu

SEQ ID NO: 3766025 - RNA, 13 nt, Salmonella typhimurium LT2
aaugcagcgcgau

SEQ ID NO: 3766026 - RNA, 21 nt, Salmonella typhimurium LT2
aaugcagcggaauucccacau

SEQ ID NO: 3766027 - RNA, 18 nt, Salmonella typhimurium LT2
aaugcauagccccagcgc

SEQ ID NO: 3766028 - RNA, 19 nt, Salmonella typhimurium LT2
aaugcaucucguaaaucaa

SEQ ID NO: 3766029 - RNA, 15 nt, Salmonella typhimurium LT2
aaugcaucuucacug

SEQ ID NO: 3766030 - RNA, 21 nt, Salmonella typhimurium LT2
aaugcauggcagauaaaccac

SEQ ID NO: 3766031 - RNA, 16 nt, Salmonella typhimurium LT2
aaugcauguggagaug

SEQ ID NO: 3766032 - RNA, 14 nt, Salmonella typhimurium LT2
aaugcauuggccag

SEQ ID NO: 3766033 - RNA, 15 nt, Salmonella typhimurium LT2
aaugccaaaauggac

SEQ ID NO: 3766034 - RNA, 20 nt, Salmonella typhimurium LT2
aaugccaaaauggacagggu

SEQ ID NO: 3766035 - RNA, 21 nt, Salmonella typhimurium LT2
aauuacucauuccugcuuuua

SEQ ID NO: 3766036 - RNA, 13 nt, Salmonella typhimurium LT2
aauuacuuaugau

SEQ ID NO: 3766037 - RNA, 17 nt, Salmonella typhimurium LT2
aauuacuuaugauauau

SEQ ID NO: 3766038 - RNA, 16 nt, Salmonella typhimurium LT2
aauuagcgcgaaauaa

SEQ ID NO: 3766039 - RNA, 11 nt, Salmonella typhimurium LT2
aauuauauacg

SEQ ID NO: 3766040 - RNA, 19 nt, Salmonella typhimurium LT2
aauuaucauguauuguuag

SEQ ID NO: 3766041 - RNA, 17 nt, Salmonella typhimurium LT2
aauuaugaccaauguua

SEQ ID NO: 3766042 - RNA, 18 nt, Salmonella typhimurium LT2
aauuaugccugucaucau

SEQ ID NO: 3766043 - RNA, 17 nt, Salmonella typhimurium LT2
aauuauguauuucucgc

SEQ ID NO: 3766044 - RNA, 14 nt, Salmonella typhimurium LT2
aauuauuaccaaug

SEQ ID NO: 3766045 - RNA, 19 nt, Salmonella typhimurium LT2
aauuauuccuugaucagga

SEQ ID NO: 3766046 - RNA, 12 nt, Salmonella typhimurium LT2
aauucaaucacu

SEQ ID NO: 3766047 - RNA, 15 nt, Salmonella typhimurium LT2
aauucaccaaauccu

SEQ ID NO: 3766048 - RNA, 18 nt, Salmonella typhimurium LT2
aauucacgcuucucuggc

SEQ ID NO: 3766049 - RNA, 22 nt, Salmonella typhimurium LT2
aauucagacugcgcauuaacac

SEQ ID NO: 3766050 - RNA, 20 nt, Salmonella typhimurium LT2
aauucaggcuaaggcgucga

SEQ ID NO: 3766051 - RNA, 15 nt, Salmonella typhimurium LT2
aauucauaacaccaa

SEQ ID NO: 3766052 - RNA, 13 nt, Salmonella typhimurium LT2
aauucaugugaaa

SEQ ID NO: 3766053 - RNA, 20 nt, Salmonella typhimurium LT2
aauucauuacgaaguuuaau

SEQ ID NO: 3766054 - RNA, 23 nt, Salmonella typhimurium LT2
aauucauuacgaaguuuaauuca

SEQ ID NO: 3766055 - RNA, 17 nt, Salmonella typhimurium LT2
aauucauuauaaaacau

SEQ ID NO: 3766056 - RNA, 18 nt, Salmonella typhimurium LT2
aauucauuauaaaacaua

SEQ ID NO: 3766057 - RNA, 19 nt, Salmonella typhimurium LT2
aauuccauuagcauucccu

SEQ ID NO: 3766058 - RNA, 20 nt, Salmonella typhimurium LT2
aauuccgcagagcugacggg

SEQ ID NO: 3766059 - RNA, 17 nt, Salmonella typhimurium LT2
aauuccgcaucauucau

SEQ ID NO: 3766060 - RNA, 17 nt, Salmonella typhimurium LT2
aauuccggcgaaaaacc

SEQ ID NO: 3766061 - RNA, 11 nt, Salmonella typhimurium LT2
aauuccuggaa

SEQ ID NO: 3766062 - RNA, 17 nt, Salmonella typhimurium LT2
aauuccuuguuuuaacg

SEQ ID NO: 3766063 - RNA, 21 nt, Salmonella typhimurium LT2
aauucgaaauaaagaaaguag

SEQ ID NO: 3766064 - RNA, 18 nt, Salmonella typhimurium LT2
aauucgcagagcgcauca

SEQ ID NO: 3766065 - RNA, 20 nt, Salmonella typhimurium LT2
aauucucacagaaucaucag

SEQ ID NO: 3766066 - RNA, 21 nt, Salmonella typhimurium LT2
aauucuggcgcagcuucugau

SEQ ID NO: 3766067 - RNA, 23 nt, Salmonella typhimurium LT2
aauucuuggaaaauugcgaggug

SEQ ID NO: 3766068 - RNA, 15 nt, Salmonella typhimurium LT2
aauugaaaaccauaa

SEQ ID NO: 3766069 - RNA, 16 nt, Salmonella typhimurium LT2
aauugaagaguuugau

SEQ ID NO: 3766070 - RNA, 18 nt, Salmonella typhimurium LT2
aauugaagaguuugauca

SEQ ID NO: 3766071 - RNA, 19 nt, Salmonella typhimurium LT2
aauugaagaguuugaucau

SEQ ID NO: 3766072 - RNA, 22 nt, Salmonella typhimurium LT2
aauugaggccguuauugucaug

SEQ ID NO: 3766073 - RNA, 18 nt, Salmonella typhimurium LT2
aauugauaauaaccgucu

SEQ ID NO: 3766074 - RNA, 23 nt, Salmonella typhimurium LT2
aauugccaggcguuacgcgccac

SEQ ID NO: 3766075 - RNA, 17 nt, Salmonella typhimurium LT2
aauugcccccuuuuuau

SEQ ID NO: 3766076 - RNA, 17 nt, Salmonella typhimurium LT2
aauugccgucgccggaa

SEQ ID NO: 3766077 - RNA, 14 nt, Salmonella typhimurium LT2
aauugcgccguuca

SEQ ID NO: 3766078 - RNA, 11 nt, Salmonella typhimurium LT2
aauugcugaag

SEQ ID NO: 3766079 - RNA, 16 nt, Salmonella typhimurium LT2
aauugcugaugucugc

SEQ ID NO: 3766080 - RNA, 15 nt, Salmonella typhimurium LT2
aauuggcauccagca

SEQ ID NO: 3766081 - RNA, 13 nt, Salmonella typhimurium LT2
aauuggcccuuca

SEQ ID NO: 3766082 - RNA, 13 nt, Salmonella typhimurium LT2
aauugguagacgc

SEQ ID NO: 3766083 - RNA, 18 nt, Salmonella typhimurium LT2
aauuguaggcaggaauuc

SEQ ID NO: 3766084 - RNA, 15 nt, Salmonella typhimurium LT2
aauuguccacccucc

SEQ ID NO: 3766085 - RNA, 17 nt, Salmonella typhimurium LT2
aauuguuccuguaaagc

SEQ ID NO: 3766086 - RNA, 16 nt, Salmonella typhimurium LT2
aauuguugcugcguuu

SEQ ID NO: 3766087 - RNA, 20 nt, Salmonella typhimurium LT2
aauuguuggucacgauccgc

SEQ ID NO: 3766088 - RNA, 16 nt, Salmonella typhimurium LT2
aauuguuuaaaaacag

SEQ ID NO: 3766089 - RNA, 16 nt, Salmonella typhimurium LT2
aauuguuucuucuuuu

SEQ ID NO: 3766090 - RNA, 17 nt, Salmonella typhimurium LT2
aauuguuugguuuugaa

SEQ ID NO: 3766091 - RNA, 17 nt, Salmonella typhimurium LT2
aauuuaaaccgcccauu

SEQ ID NO: 3766092 - RNA, 22 nt, Salmonella typhimurium LT2
aauuuaagccagacgcgcagca

SEQ ID NO: 3766093 - RNA, 14 nt, Salmonella typhimurium LT2
aauuuaagcgauuc

SEQ ID NO: 3766094 - RNA, 13 nt, Salmonella typhimurium LT2
aauuuaauaauaa

SEQ ID NO: 3766095 - RNA, 16 nt, Salmonella typhimurium LT2
aauuuaauaauaaauu

SEQ ID NO: 3766096 - RNA, 20 nt, Salmonella typhimurium LT2
aauuuaauaauaaauuuuca

SEQ ID NO: 3766097 - RNA, 11 nt, Salmonella typhimurium LT2
aauuuacaucu

SEQ ID NO: 3766098 - RNA, 17 nt, Salmonella typhimurium LT2
aauuuagagugauccac

SEQ ID NO: 3766099 - RNA, 15 nt, Salmonella typhimurium LT2
aauuuauaacguauc

SEQ ID NO: 3766100 - RNA, 22 nt, Salmonella typhimurium LT2
aauuuaucaacaaauuccggca

SEQ ID NO: 3766101 - RNA, 22 nt, Salmonella typhimurium LT2
aauuuaugauuuuaacaucacc

SEQ ID NO: 3766102 - RNA, 21 nt, Salmonella typhimurium LT2
aauuucaaucgccaguuuuug

SEQ ID NO: 3766103 - RNA, 18 nt, Salmonella typhimurium LT2
aauuucagggcuuauuca

SEQ ID NO: 3766104 - RNA, 16 nt, Salmonella typhimurium LT2
aauuucaguauuacua

SEQ ID NO: 3766105 - RNA, 18 nt, Salmonella typhimurium LT2
aauuucaguauuacuaua

SEQ ID NO: 3766106 - RNA, 14 nt, Salmonella typhimurium LT2
aauuucagugaauc

SEQ ID NO: 3766107 - RNA, 18 nt, Salmonella typhimurium LT2
aauuuccagugccaguua

SEQ ID NO: 3766108 - RNA, 13 nt, Salmonella typhimurium LT2
aauuuccaguuca

SEQ ID NO: 3766109 - RNA, 14 nt, Salmonella typhimurium LT2
aauuuccaguucaa

SEQ ID NO: 3766110 - RNA, 19 nt, Salmonella typhimurium LT2
aauuucccccacuucugac

SEQ ID NO: 3766111 - RNA, 17 nt, Salmonella typhimurium LT2
aauuuccccccagacga

SEQ ID NO: 3766112 - RNA, 20 nt, Salmonella typhimurium LT2
aauuuccucgacuucauucg

SEQ ID NO: 3766113 - RNA, 19 nt, Salmonella typhimurium LT2
aauuucgcauucgcuucga

SEQ ID NO: 3766114 - RNA, 16 nt, Salmonella typhimurium LT2
aauuucgcucagaugc

SEQ ID NO: 3766115 - RNA, 15 nt, Salmonella typhimurium LT2
aauuucggcaaugac

SEQ ID NO: 3766116 - RNA, 17 nt, Salmonella typhimurium LT2
aauuucuacugauuuaa

SEQ ID NO: 3766117 - RNA, 18 nt, Salmonella typhimurium LT2
aauuucugguaccagauc

SEQ ID NO: 3766118 - RNA, 11 nt, Salmonella typhimurium LT2
aauuugacgac

SEQ ID NO: 3766119 - RNA, 22 nt, Salmonella typhimurium LT2
aauuugcgggaacauaugcaca

SEQ ID NO: 3766120 - RNA, 22 nt, Salmonella typhimurium LT2
aauuuggucguaagaauuauua

SEQ ID NO: 3766121 - RNA, 15 nt, Salmonella typhimurium LT2
aauuugugagacaaa

SEQ ID NO: 3766122 - RNA, 15 nt, Salmonella typhimurium LT2
aauuuuaauuuaaua

SEQ ID NO: 3766123 - RNA, 19 nt, Salmonella typhimurium LT2
aauuuuccccgaugccauu

SEQ ID NO: 3766124 - RNA, 17 nt, Salmonella typhimurium LT2
aauuuucgcucaacaaa

SEQ ID NO: 3766125 - RNA, 11 nt, Salmonella typhimurium LT2
aauuuugauaa

SEQ ID NO: 3766126 - RNA, 20 nt, Salmonella typhimurium LT2
aauuuugauaagagaaaaua

SEQ ID NO: 3766127 - RNA, 15 nt, Salmonella typhimurium LT2
aauuuuugaucugcu

SEQ ID NO: 3766128 - RNA, 13 nt, Salmonella typhimurium LT2
aauuuuuugauug

SEQ ID NO: 3766129 - RNA, 16 nt, Salmonella typhimurium LT2
acaaaaaaaccgcuca

SEQ ID NO: 3766130 - RNA, 16 nt, Salmonella typhimurium LT2
acaaaaaguaguucca

SEQ ID NO: 3766131 - RNA, 16 nt, Salmonella typhimurium LT2
acaaaaagugaaaaaa

SEQ ID NO: 3766132 - RNA, 21 nt, Salmonella typhimurium LT2
acaaaaccgcuaaugaggaaa

SEQ ID NO: 3766133 - RNA, 23 nt, Salmonella typhimurium LT2
acaaaagccagauaaagcagcga

SEQ ID NO: 3766134 - RNA, 15 nt, Salmonella typhimurium LT2
acaaacaaauaaauc

SEQ ID NO: 3766135 - RNA, 19 nt, Salmonella typhimurium LT2
acaaacaaauaaauccaug

SEQ ID NO: 3766136 - RNA, 19 nt, Salmonella typhimurium LT2
acaaacaccaccaguaacc

SEQ ID NO: 3766137 - RNA, 23 nt, Salmonella typhimurium LT2
acaaacagcgccccgacaaaacg

SEQ ID NO: 3766138 - RNA, 16 nt, Salmonella typhimurium LT2
acaaaccacugcugua

SEQ ID NO: 3766139 - RNA, 22 nt, Salmonella typhimurium LT2
acacagcggaaagcaacagcaa

SEQ ID NO: 3766140 - RNA, 23 nt, Salmonella typhimurium LT2
acacagcggaaagcaacagcaag

SEQ ID NO: 3766141 - RNA, 14 nt, Salmonella typhimurium LT2
acacagcucaauau

SEQ ID NO: 3766142 - RNA, 20 nt, Salmonella typhimurium LT2
acacagcucaauaucauagu

SEQ ID NO: 3766143 - RNA, 15 nt, Salmonella typhimurium LT2
acacaggccugcauu

SEQ ID NO: 3766144 - RNA, 22 nt, Salmonella typhimurium LT2
acacagggucgucaaacuuuua

SEQ ID NO: 3766145 - RNA, 13 nt, Salmonella typhimurium LT2
acacaguugccuu

SEQ ID NO: 3766146 - RNA, 13 nt, Salmonella typhimurium LT2
acacaucaucuuu

SEQ ID NO: 3766147 - RNA, 15 nt, Salmonella typhimurium LT2
acacauccagcguca

SEQ ID NO: 3766148 - RNA, 17 nt, Salmonella typhimurium LT2
acacauucaggcuggca

SEQ ID NO: 3766149 - RNA, 16 nt, Salmonella typhimurium LT2
acacauuuuaaaccaa

SEQ ID NO: 3766150 - RNA, 13 nt, Salmonella typhimurium LT2
acaccaacaaagu

SEQ ID NO: 3766151 - RNA, 18 nt, Salmonella typhimurium LT2
acaccaaugucauauuug

SEQ ID NO: 3766152 - RNA, 23 nt, Salmonella typhimurium LT2
acaccaaugucauauuugugagc

SEQ ID NO: 3766153 - RNA, 17 nt, Salmonella typhimurium LT2
acaccacgugcggacgu

SEQ ID NO: 3766154 - RNA, 14 nt, Salmonella typhimurium LT2
acaccagccguuca

SEQ ID NO: 3766155 - RNA, 20 nt, Salmonella typhimurium LT2
acaccagcgauaaacgccag

SEQ ID NO: 3766156 - RNA, 20 nt, Salmonella typhimurium LT2
acaccagggauuuugcuuuu

SEQ ID NO: 3766157 - RNA, 22 nt, Salmonella typhimurium LT2
acaccauuucacaaauuaaaaa

SEQ ID NO: 3766158 - RNA, 13 nt, Salmonella typhimurium LT2
acacccagccccc

SEQ ID NO: 3766159 - RNA, 21 nt, Salmonella typhimurium LT2
acaccccgcgccgcugagaaa

SEQ ID NO: 3766160 - RNA, 15 nt, Salmonella typhimurium LT2
acacccgcagccgca

SEQ ID NO: 3766161 - RNA, 14 nt, Salmonella typhimurium LT2
acacccgcagccgg

SEQ ID NO: 3766162 - RNA, 13 nt, Salmonella typhimurium LT2
acaccgagacaga

SEQ ID NO: 3766163 - RNA, 14 nt, Salmonella typhimurium LT2
acaccgccagcguc

SEQ ID NO: 3766164 - RNA, 20 nt, Salmonella typhimurium LT2
acaccgggagaaaacgcggc

SEQ ID NO: 3766165 - RNA, 13 nt, Salmonella typhimurium LT2
acaccguuauccg

SEQ ID NO: 3766166 - RNA, 14 nt, Salmonella typhimurium LT2
acaccugcaucacg

SEQ ID NO: 3766167 - RNA, 16 nt, Salmonella typhimurium LT2
acaccuuauccggccu

SEQ ID NO: 3766168 - RNA, 15 nt, Salmonella typhimurium LT2
acaccuuugcccgag

SEQ ID NO: 3766169 - RNA, 20 nt, Salmonella typhimurium LT2
acaccuuuuccucuucuugc

SEQ ID NO: 3766170 - RNA, 14 nt, Salmonella typhimurium LT2
acacgauggcaaau

SEQ ID NO: 3766171 - RNA, 16 nt, Salmonella typhimurium LT2
acacgauuaaccucac

SEQ ID NO: 3766172 - RNA, 18 nt, Salmonella typhimurium LT2
acacgccacaaacugcgc

SEQ ID NO: 3766173 - RNA, 21 nt, Salmonella typhimurium LT2
acacgcgcaccaguucacucc

SEQ ID NO: 3766174 - RNA, 17 nt, Salmonella typhimurium LT2
acacgcgcgcugcgccu

SEQ ID NO: 3766175 - RNA, 16 nt, Salmonella typhimurium LT2
acacgcuuagcuugcc

SEQ ID NO: 3766176 - RNA, 21 nt, Salmonella typhimurium LT2
acacgcuuccagaugaagcgc

SEQ ID NO: 3766177 - RNA, 17 nt, Salmonella typhimurium LT2
acacggaacaacggcac

SEQ ID NO: 3766178 - RNA, 15 nt, Salmonella typhimurium LT2
acacggacagcgcgc

SEQ ID NO: 3766179 - RNA, 23 nt, Salmonella typhimurium LT2
acacggcgccaugauccagcgga

SEQ ID NO: 3766180 - RNA, 14 nt, Salmonella typhimurium LT2
acacggcgcucagg

SEQ ID NO: 3766181 - RNA, 17 nt, Salmonella typhimurium LT2
acacggcgcucaggauc

SEQ ID NO: 3766182 - RNA, 12 nt, Salmonella typhimurium LT2
acacggcggcua

SEQ ID NO: 3766183 - RNA, 20 nt, Salmonella typhimurium LT2
acacggcgugaccaccgccu

SEQ ID NO: 3766184 - RNA, 17 nt, Salmonella typhimurium LT2
acacggcugucggucag

SEQ ID NO: 3766185 - RNA, 21 nt, Salmonella typhimurium LT2
acacgguguaguacacaaucg

SEQ ID NO: 3766186 - RNA, 21 nt, Salmonella typhimurium LT2
acacguaaguucgcaacauga

SEQ ID NO: 3766187 - RNA, 15 nt, Salmonella typhimurium LT2
acacguuaauuauuc

SEQ ID NO: 3766188 - RNA, 14 nt, Salmonella typhimurium LT2
acacguugcgacaa

SEQ ID NO: 3766189 - RNA, 15 nt, Salmonella typhimurium LT2
acacuaccagacaca

SEQ ID NO: 3766190 - RNA, 19 nt, Salmonella typhimurium LT2
acacuaccgggcagcaucu

SEQ ID NO: 3766191 - RNA, 13 nt, Salmonella typhimurium LT2
acacuauauugcg

SEQ ID NO: 3766192 - RNA, 14 nt, Salmonella typhimurium LT2
acacuaucuccuuc

SEQ ID NO: 3766193 - RNA, 13 nt, Salmonella typhimurium LT2
acacuauuuuuca

SEQ ID NO: 3766194 - RNA, 16 nt, Salmonella typhimurium LT2
acacucaaggcuauua

SEQ ID NO: 3766195 - RNA, 23 nt, Salmonella typhimurium LT2
acacucgcggguaauguuuacuc

SEQ ID NO: 3766196 - RNA, 13 nt, Salmonella typhimurium LT2
acacucucuccag

SEQ ID NO: 3766197 - RNA, 15 nt, Salmonella typhimurium LT2
acacugccaccgcuc

SEQ ID NO: 3766198 - RNA, 14 nt, Salmonella typhimurium LT2
acacuggaaacagc

SEQ ID NO: 3766199 - RNA, 22 nt, Salmonella typhimurium LT2
acacuggaaacagccaaucaua

SEQ ID NO: 3766200 - RNA, 14 nt, Salmonella typhimurium LT2
acacuucagccgga

SEQ ID NO: 3766201 - RNA, 21 nt, Salmonella typhimurium LT2
acacuugcagcucgcacugau

SEQ ID NO: 3766202 - RNA, 17 nt, Salmonella typhimurium LT2
acacuuguaaguuacua

SEQ ID NO: 3766203 - RNA, 16 nt, Salmonella typhimurium LT2
acacuuucgcccggcg

SEQ ID NO: 3766204 - RNA, 17 nt, Salmonella typhimurium LT2
acacuuucgcccggcgc

SEQ ID NO: 3766205 - RNA, 23 nt, Salmonella typhimurium LT2
acacuuugcgcggauugagcgaa

SEQ ID NO: 3766206 - RNA, 13 nt, Salmonella typhimurium LT2
acagaaaaaauag

SEQ ID NO: 3766207 - RNA, 20 nt, Salmonella typhimurium LT2
acagaaaaaaugcaccgccu

SEQ ID NO: 3766208 - RNA, 16 nt, Salmonella typhimurium LT2
acagaaaaccggcaaa

SEQ ID NO: 3766209 - RNA, 23 nt, Salmonella typhimurium LT2
acagaaauagcuuacuuucagau

SEQ ID NO: 3766210 - RNA, 23 nt, Salmonella typhimurium LT2
acagaagguuauucgccuuucac

SEQ ID NO: 3766211 - RNA, 13 nt, Salmonella typhimurium LT2
acagaauaagcca

SEQ ID NO: 3766212 - RNA, 22 nt, Salmonella typhimurium LT2
acagaaucaacgccacaccgag

SEQ ID NO: 3766213 - RNA, 13 nt, Salmonella typhimurium LT2
acagaaucaucag

SEQ ID NO: 3766214 - RNA, 20 nt, Salmonella typhimurium LT2
acagaaugcugaacagccgu

SEQ ID NO: 3766215 - RNA, 16 nt, Salmonella typhimurium LT2
acagacaaugaauauu

SEQ ID NO: 3766216 - RNA, 12 nt, Salmonella typhimurium LT2
acagaccgccau

SEQ ID NO: 3766217 - RNA, 21 nt, Salmonella typhimurium LT2
acagaccugucgcaaucccga

SEQ ID NO: 3766218 - RNA, 19 nt, Salmonella typhimurium LT2
acagacgccuuucagacuu

SEQ ID NO: 3766219 - RNA, 15 nt, Salmonella typhimurium LT2
acagacggcaaacaa

SEQ ID NO: 3766220 - RNA, 21 nt, Salmonella typhimurium LT2
acagacugcuuguuuaauggc

SEQ ID NO: 3766221 - RNA, 17 nt, Salmonella typhimurium LT2
acagacuucauuuucca

SEQ ID NO: 3766222 - RNA, 16 nt, Salmonella typhimurium LT2
acagagaagcugcgcc

SEQ ID NO: 3766223 - RNA, 17 nt, Salmonella typhimurium LT2
acagagaucaggcgcau

SEQ ID NO: 3766224 - RNA, 18 nt, Salmonella typhimurium LT2
acagaggaaugaaaacga

SEQ ID NO: 3766225 - RNA, 21 nt, Salmonella typhimurium LT2
acagagucgcuuaucugcugc

SEQ ID NO: 3766226 - RNA, 18 nt, Salmonella typhimurium LT2
acagagucguuagcagaa

SEQ ID NO: 3766227 - RNA, 14 nt, Salmonella typhimurium LT2
acagauaacaccag

SEQ ID NO: 3766228 - RNA, 16 nt, Salmonella typhimurium LT2
acagauaugaaaugag

SEQ ID NO: 3766229 - RNA, 17 nt, Salmonella typhimurium LT2
acagauccagcgccguu

SEQ ID NO: 3766230 - RNA, 23 nt, Salmonella typhimurium LT2
acagauccagcgccguugcguca

SEQ ID NO: 3766231 - RNA, 21 nt, Salmonella typhimurium LT2
acagaugccuuguaagccgga

SEQ ID NO: 3766232 - RNA, 16 nt, Salmonella typhimurium LT2
acagauuccagauguc

SEQ ID NO: 3766233 - RNA, 23 nt, Salmonella typhimurium LT2
acagauucccagugcgcggucau

SEQ ID NO: 3766234 - RNA, 16 nt, Salmonella typhimurium LT2
acagcaacgggacggc

SEQ ID NO: 3766235 - RNA, 18 nt, Salmonella typhimurium LT2
acagcaauaucagccauu

SEQ ID NO: 3766236 - RNA, 15 nt, Salmonella typhimurium LT2
acagcaaugagcagg

SEQ ID NO: 3766237 - RNA, 19 nt, Salmonella typhimurium LT2
acagcaauggacaaguaaa

SEQ ID NO: 3766238 - RNA, 11 nt, Salmonella typhimurium LT2
acagcacauag

SEQ ID NO: 3766239 - RNA, 13 nt, Salmonella typhimurium LT2
acagcacauagaa

SEQ ID NO: 3766240 - RNA, 20 nt, Salmonella typhimurium LT2
acagcacuaacgaggccacc

SEQ ID NO: 3766241 - RNA, 18 nt, Salmonella typhimurium LT2
acagcagaauauugcuga

SEQ ID NO: 3766242 - RNA, 18 nt, Salmonella typhimurium LT2
acagcagacaaccgacgc

SEQ ID NO: 3766243 - RNA, 17 nt, Salmonella typhimurium LT2
acauacaccggcgccag

SEQ ID NO: 3766244 - RNA, 23 nt, Salmonella typhimurium LT2
acauacaccggcgccagcucugc

SEQ ID NO: 3766245 - RNA, 13 nt, Salmonella typhimurium LT2
acauaccgcagau

SEQ ID NO: 3766246 - RNA, 20 nt, Salmonella typhimurium LT2
acauaccgccgguaaggcca

SEQ ID NO: 3766247 - RNA, 15 nt, Salmonella typhimurium LT2
acauacgccacgcuc

SEQ ID NO: 3766248 - RNA, 19 nt, Salmonella typhimurium LT2
acauacgggaauuccaguc

SEQ ID NO: 3766249 - RNA, 20 nt, Salmonella typhimurium LT2
acauacugcaauuucuuuuc

SEQ ID NO: 3766250 - RNA, 23 nt, Salmonella typhimurium LT2
acauacugcaauuucuuuuccag

SEQ ID NO: 3766251 - RNA, 12 nt, Salmonella typhimurium LT2
acauagcaucca

SEQ ID NO: 3766252 - RNA, 18 nt, Salmonella typhimurium LT2
acauagcuaaauuaaaaa

SEQ ID NO: 3766253 - RNA, 15 nt, Salmonella typhimurium LT2
acauagcuauauuua

SEQ ID NO: 3766254 - RNA, 15 nt, Salmonella typhimurium LT2
acauagucuauguuc

SEQ ID NO: 3766255 - RNA, 22 nt, Salmonella typhimurium LT2
acauauauauccgcuauuacca

SEQ ID NO: 3766256 - RNA, 17 nt, Salmonella typhimurium LT2
acauauccaguugaccg

SEQ ID NO: 3766257 - RNA, 16 nt, Salmonella typhimurium LT2
acauaugaguuaugua

SEQ ID NO: 3766258 - RNA, 19 nt, Salmonella typhimurium LT2
acauaugaguuauguauuu

SEQ ID NO: 3766259 - RNA, 14 nt, Salmonella typhimurium LT2
acauauucaauaau

SEQ ID NO: 3766260 - RNA, 15 nt, Salmonella typhimurium LT2
acauauucaauaaua

SEQ ID NO: 3766261 - RNA, 14 nt, Salmonella typhimurium LT2
acauauuccagaag

SEQ ID NO: 3766262 - RNA, 16 nt, Salmonella typhimurium LT2
acauauugauagagca

SEQ ID NO: 3766263 - RNA, 19 nt, Salmonella typhimurium LT2
acauauuuucgaugcacgc

SEQ ID NO: 3766264 - RNA, 16 nt, Salmonella typhimurium LT2
acauauuuuucacaca

SEQ ID NO: 3766265 - RNA, 13 nt, Salmonella typhimurium LT2
acauauuuuuguu

SEQ ID NO: 3766266 - RNA, 14 nt, Salmonella typhimurium LT2
acaucaaaauuacc

SEQ ID NO: 3766267 - RNA, 23 nt, Salmonella typhimurium LT2
acaucaccgugcucuucguggaa

SEQ ID NO: 3766268 - RNA, 19 nt, Salmonella typhimurium LT2
acaucagaaaaaagccaag

SEQ ID NO: 3766269 - RNA, 16 nt, Salmonella typhimurium LT2
acaucagagguaauca

SEQ ID NO: 3766270 - RNA, 18 nt, Salmonella typhimurium LT2
acaucagccagcagcuca

SEQ ID NO: 3766271 - RNA, 18 nt, Salmonella typhimurium LT2
acaucauccguucccucu

SEQ ID NO: 3766272 - RNA, 14 nt, Salmonella typhimurium LT2
acaucaucgcuggu

SEQ ID NO: 3766273 - RNA, 16 nt, Salmonella typhimurium LT2
acaucaucuuuaucca

SEQ ID NO: 3766274 - RNA, 21 nt, Salmonella typhimurium LT2
acaucaugaugaucuucagcc

SEQ ID NO: 3766275 - RNA, 20 nt, Salmonella typhimurium LT2
acaucauuacgacgcgccag

SEQ ID NO: 3766276 - RNA, 19 nt, Salmonella typhimurium LT2
acauccagcuauagacgac

SEQ ID NO: 3766277 - RNA, 12 nt, Salmonella typhimurium LT2
acauccagcugu

SEQ ID NO: 3766278 - RNA, 21 nt, Salmonella typhimurium LT2
acauccagcuguuuaagcgcc

SEQ ID NO: 3766279 - RNA, 10 nt, Salmonella typhimurium LT2
acauccauaa

SEQ ID NO: 3766280 - RNA, 11 nt, Salmonella typhimurium LT2
acauccauaau

SEQ ID NO: 3766281 - RNA, 17 nt, Salmonella typhimurium LT2
acauccaucacuccuua

SEQ ID NO: 3766282 - RNA, 18 nt, Salmonella typhimurium LT2
acauccauguacuccugg

SEQ ID NO: 3766283 - RNA, 15 nt, Salmonella typhimurium LT2
acaucccagacaaaa

SEQ ID NO: 3766284 - RNA, 21 nt, Salmonella typhimurium LT2
acauccccgcguuaagccccu

SEQ ID NO: 3766285 - RNA, 22 nt, Salmonella typhimurium LT2
acaucccgauaauggcgccgau

SEQ ID NO: 3766286 - RNA, 21 nt, Salmonella typhimurium LT2
acauccgauuucauggucauc

SEQ ID NO: 3766287 - RNA, 24 nt, Salmonella typhimurium LT2
acauccggcaggcauuuuacaccc

SEQ ID NO: 3766288 - RNA, 17 nt, Salmonella typhimurium LT2
acauccggcguguaaac

SEQ ID NO: 3766289 - RNA, 19 nt, Salmonella typhimurium LT2
acauccgggccaacggcau

SEQ ID NO: 3766290 - RNA, 23 nt, Salmonella typhimurium LT2
acaucgccaccgcauggaaucga

SEQ ID NO: 3766291 - RNA, 20 nt, Salmonella typhimurium LT2
acaucgcccugauggcgcgc

SEQ ID NO: 3766292 - RNA, 17 nt, Salmonella typhimurium LT2
acaucgccggagccgcc

SEQ ID NO: 3766293 - RNA, 22 nt, Salmonella typhimurium LT2
acaucgccguuccauuccagaa

SEQ ID NO: 3766294 - RNA, 24 nt, Salmonella typhimurium LT2
acaucgcuuaaugucacaaugccu

SEQ ID NO: 3766295 - RNA, 13 nt, Salmonella typhimurium LT2
acaucgcuuucca

SEQ ID NO: 3766296 - RNA, 20 nt, Salmonella typhimurium LT2
acaucggagauuucauccuc

SEQ ID NO: 3766297 - RNA, 14 nt, Salmonella typhimurium LT2
acaucggcaggaac

SEQ ID NO: 3766298 - RNA, 18 nt, Salmonella typhimurium LT2
acaucggcguguuucauu

SEQ ID NO: 3766299 - RNA, 12 nt, Salmonella typhimurium LT2
acaucguaaauc

SEQ ID NO: 3766300 - RNA, 17 nt, Salmonella typhimurium LT2
acaucguaaaucagcgu

SEQ ID NO: 3766301 - RNA, 19 nt, Salmonella typhimurium LT2
acaucguguccuggguaac

SEQ ID NO: 3766302 - RNA, 20 nt, Salmonella typhimurium LT2
acaucguuacccaucaccug

SEQ ID NO: 3766303 - RNA, 17 nt, Salmonella typhimurium LT2
acaucguuggccgccag

SEQ ID NO: 3766304 - RNA, 18 nt, Salmonella typhimurium LT2
acaucuaccgcauacuga

SEQ ID NO: 3766305 - RNA, 22 nt, Salmonella typhimurium LT2
acaucucuucguguaacgcaua

SEQ ID NO: 3766306 - RNA, 15 nt, Salmonella typhimurium LT2
acaucuuauuucacc

SEQ ID NO: 3766307 - RNA, 16 nt, Salmonella typhimurium LT2
acaucuuccaugccuu

SEQ ID NO: 3766308 - RNA, 13 nt, Salmonella typhimurium LT2
acaugaaaaauag

SEQ ID NO: 3766309 - RNA, 20 nt, Salmonella typhimurium LT2
acaugaaagggaaaccgcuc

SEQ ID NO: 3766310 - RNA, 21 nt, Salmonella typhimurium LT2
acaugacacacggauuuuacu

SEQ ID NO: 3766311 - RNA, 14 nt, Salmonella typhimurium LT2
acaugaccgcacag

SEQ ID NO: 3766312 - RNA, 16 nt, Salmonella typhimurium LT2
acaugaccgcacagca

SEQ ID NO: 3766313 - RNA, 19 nt, Salmonella typhimurium LT2
acaugauaagcguggcgca

SEQ ID NO: 3766314 - RNA, 20 nt, Salmonella typhimurium LT2
acaugcaagucgaacgguaa

SEQ ID NO: 3766315 - RNA, 20 nt, Salmonella typhimurium LT2
acaugccggugcgagaaaaa

SEQ ID NO: 3766316 - RNA, 22 nt, Salmonella typhimurium LT2
acaugccggugcgagaaaaagc

SEQ ID NO: 3766317 - RNA, 20 nt, Salmonella typhimurium LT2
acaugcggaugcugcgccag

SEQ ID NO: 3766318 - RNA, 16 nt, Salmonella typhimurium LT2
acaugcugugcgcgug

SEQ ID NO: 3766319 - RNA, 16 nt, Salmonella typhimurium LT2
acauggcaauggcuuc

SEQ ID NO: 3766320 - RNA, 14 nt, Salmonella typhimurium LT2
acauggcgguaauc

SEQ ID NO: 3766321 - RNA, 17 nt, Salmonella typhimurium LT2
acaugguguuugcggca

SEQ ID NO: 3766322 - RNA, 21 nt, Salmonella typhimurium LT2
acauguagcgcggcagcgcgc

SEQ ID NO: 3766323 - RNA, 12 nt, Salmonella typhimurium LT2
acauguccagau

SEQ ID NO: 3766324 - RNA, 14 nt, Salmonella typhimurium LT2
acauguucagcgca

SEQ ID NO: 3766325 - RNA, 23 nt, Salmonella typhimurium LT2
acauguucagcgcagaagcagac

SEQ ID NO: 3766326 - RNA, 18 nt, Salmonella typhimurium LT2
acauguucgaacaugccg

SEQ ID NO: 3766327 - RNA, 18 nt, Salmonella typhimurium LT2
acauuaaucgccauugca

SEQ ID NO: 3766328 - RNA, 17 nt, Salmonella typhimurium LT2
acauuaauucaguccuu

SEQ ID NO: 3766329 - RNA, 15 nt, Salmonella typhimurium LT2
acauuacaauguaca

SEQ ID NO: 3766330 - RNA, 16 nt, Salmonella typhimurium LT2
acauuauugcacauaa

SEQ ID NO: 3766331 - RNA, 14 nt, Salmonella typhimurium LT2
acauucauugccgc

SEQ ID NO: 3766332 - RNA, 18 nt, Salmonella typhimurium LT2
acauucauugccgccagu

SEQ ID NO: 3766333 - RNA, 16 nt, Salmonella typhimurium LT2
acauuccaucauguua

SEQ ID NO: 3766334 - RNA, 19 nt, Salmonella typhimurium LT2
acauucccgccgagaaaau

SEQ ID NO: 3766335 - RNA, 14 nt, Salmonella typhimurium LT2
acauugaccagugc

SEQ ID NO: 3766336 - RNA, 22 nt, Salmonella typhimurium LT2
acauugagcgucaggccaucgc

SEQ ID NO: 3766337 - RNA, 14 nt, Salmonella typhimurium LT2
acauugccggcauc

SEQ ID NO: 3766338 - RNA, 15 nt, Salmonella typhimurium LT2
acauugcgaacaguu

SEQ ID NO: 3766339 - RNA, 20 nt, Salmonella typhimurium LT2
acauugcucauaccgccgcc

SEQ ID NO: 3766340 - RNA, 19 nt, Salmonella typhimurium LT2
acauuggcguccggauggc

SEQ ID NO: 3766341 - RNA, 20 nt, Salmonella typhimurium LT2
acauuggguaauuuuuugau

SEQ ID NO: 3766342 - RNA, 18 nt, Salmonella typhimurium LT2
acauugucagcugaacag

SEQ ID NO: 3766343 - RNA, 18 nt, Salmonella typhimurium LT2
acauugucggugcaugcg

SEQ ID NO: 3766344 - RNA, 17 nt, Salmonella typhimurium LT2
acauuuaucuuccggca

SEQ ID NO: 3766345 - RNA, 15 nt, Salmonella typhimurium LT2
acauuucagcgccaa

SEQ ID NO: 3766346 - RNA, 18 nt, Salmonella typhimurium LT2
acauuucaggcaaaaaaa

SEQ ID NO: 3766347 - RNA, 17 nt, Salmonella typhimurium LT2
accagcaccgccagcgc

SEQ ID NO: 3766348 - RNA, 13 nt, Salmonella typhimurium LT2
accagcaccgcuu

SEQ ID NO: 3766349 - RNA, 17 nt, Salmonella typhimurium LT2
accagcagcacaaaaau

SEQ ID NO: 3766350 - RNA, 12 nt, Salmonella typhimurium LT2
accagcagcaga

SEQ ID NO: 3766351 - RNA, 14 nt, Salmonella typhimurium LT2
accagcaucgcguu

SEQ ID NO: 3766352 - RNA, 16 nt, Salmonella typhimurium LT2
accagccacugcgcca

SEQ ID NO: 3766353 - RNA, 23 nt, Salmonella typhimurium LT2
accagcccagguagaaucccacc

SEQ ID NO: 3766354 - RNA, 12 nt, Salmonella typhimurium LT2
accagcccauga

SEQ ID NO: 3766355 - RNA, 18 nt, Salmonella typhimurium LT2
accagcccaugaaugagc

SEQ ID NO: 3766356 - RNA, 15 nt, Salmonella typhimurium LT2
accagccccaaaauu

SEQ ID NO: 3766357 - RNA, 14 nt, Salmonella typhimurium LT2
accagccccacggu

SEQ ID NO: 3766358 - RNA, 14 nt, Salmonella typhimurium LT2
accagcccggcgca

SEQ ID NO: 3766359 - RNA, 18 nt, Salmonella typhimurium LT2
accagcccggcgcacacc

SEQ ID NO: 3766360 - RNA, 18 nt, Salmonella typhimurium LT2
accagccgauaacucuuc

SEQ ID NO: 3766361 - RNA, 22 nt, Salmonella typhimurium LT2
accagccgauaacucuucaucg

SEQ ID NO: 3766362 - RNA, 15 nt, Salmonella typhimurium LT2
accagccgaucauca

SEQ ID NO: 3766363 - RNA, 16 nt, Salmonella typhimurium LT2
accagccgaucaucac

SEQ ID NO: 3766364 - RNA, 18 nt, Salmonella typhimurium LT2
accagccgaucaucacga

SEQ ID NO: 3766365 - RNA, 22 nt, Salmonella typhimurium LT2
accagccgcauaauagcgccag

SEQ ID NO: 3766366 - RNA, 21 nt, Salmonella typhimurium LT2
accagccggugcucgccguuc

SEQ ID NO: 3766367 - RNA, 19 nt, Salmonella typhimurium LT2
accagccuaccugccgcca

SEQ ID NO: 3766368 - RNA, 15 nt, Salmonella typhimurium LT2
accagccugccgucu

SEQ ID NO: 3766369 - RNA, 21 nt, Salmonella typhimurium LT2
accagcgaaaugacagccacc

SEQ ID NO: 3766370 - RNA, 17 nt, Salmonella typhimurium LT2
accagcgauaaacgcca

SEQ ID NO: 3766371 - RNA, 18 nt, Salmonella typhimurium LT2
accagcgauaaacgccag

SEQ ID NO: 3766372 - RNA, 23 nt, Salmonella typhimurium LT2
accagcgauaaacgccagcccuu

SEQ ID NO: 3766373 - RNA, 20 nt, Salmonella typhimurium LT2
accagcgauuuuuacgccau

SEQ ID NO: 3766374 - RNA, 15 nt, Salmonella typhimurium LT2
accagcgcaguaaac

SEQ ID NO: 3766375 - RNA, 15 nt, Salmonella typhimurium LT2
accagcgccauaauc

SEQ ID NO: 3766376 - RNA, 18 nt, Salmonella typhimurium LT2
accagcgccauaauccag

SEQ ID NO: 3766377 - RNA, 12 nt, Salmonella typhimurium LT2
accagcgcgcca

SEQ ID NO: 3766378 - RNA, 18 nt, Salmonella typhimurium LT2
accagcgcgccagcgcca

SEQ ID NO: 3766379 - RNA, 15 nt, Salmonella typhimurium LT2
accagcgcggcgcca

SEQ ID NO: 3766380 - RNA, 17 nt, Salmonella typhimurium LT2
accagcgcuucgccugc

SEQ ID NO: 3766381 - RNA, 17 nt, Salmonella typhimurium LT2
accagcggaauccccgc

SEQ ID NO: 3766382 - RNA, 22 nt, Salmonella typhimurium LT2
accagcggaauccccgccgcca

SEQ ID NO: 3766383 - RNA, 16 nt, Salmonella typhimurium LT2
accagcggcaccagca

SEQ ID NO: 3766384 - RNA, 17 nt, Salmonella typhimurium LT2
accagcggcaccagcac

SEQ ID NO: 3766385 - RNA, 18 nt, Salmonella typhimurium LT2
accagcggcgucccggca

SEQ ID NO: 3766386 - RNA, 18 nt, Salmonella typhimurium LT2
accagcgguuucaggcca

SEQ ID NO: 3766387 - RNA, 19 nt, Salmonella typhimurium LT2
accagcgugaccgguaagc

SEQ ID NO: 3766388 - RNA, 17 nt, Salmonella typhimurium LT2
accagcgugcgcucagg

SEQ ID NO: 3766389 - RNA, 15 nt, Salmonella typhimurium LT2
accagcugacgcagc

SEQ ID NO: 3766390 - RNA, 18 nt, Salmonella typhimurium LT2
accagcuuguuauccauc

SEQ ID NO: 3766391 - RNA, 21 nt, Salmonella typhimurium LT2
accagcuuguuauccaucagc

SEQ ID NO: 3766392 - RNA, 20 nt, Salmonella typhimurium LT2
accagcuuuuaugagaaaag

SEQ ID NO: 3766393 - RNA, 21 nt, Salmonella typhimurium LT2
accagcuuuuaugagaaaagu

SEQ ID NO: 3766394 - RNA, 18 nt, Salmonella typhimurium LT2
accaggaagacuauccag

SEQ ID NO: 3766395 - RNA, 17 nt, Salmonella typhimurium LT2
accaggacaugccacuc

SEQ ID NO: 3766396 - RNA, 20 nt, Salmonella typhimurium LT2
accaggauagcgccuuguuu

SEQ ID NO: 3766397 - RNA, 17 nt, Salmonella typhimurium LT2
accaggaugccaaccac

SEQ ID NO: 3766398 - RNA, 17 nt, Salmonella typhimurium LT2
accaggcaaaccagcac

SEQ ID NO: 3766399 - RNA, 13 nt, Salmonella typhimurium LT2
accaggcaacaga

SEQ ID NO: 3766400 - RNA, 13 nt, Salmonella typhimurium LT2
accaggccccugc

SEQ ID NO: 3766401 - RNA, 11 nt, Salmonella typhimurium LT2
accaggcgcac

SEQ ID NO: 3766402 - RNA, 19 nt, Salmonella typhimurium LT2
accagggauuuugcuuuuu

SEQ ID NO: 3766403 - RNA, 18 nt, Salmonella typhimurium LT2
accagguccgacuucaug

SEQ ID NO: 3766404 - RNA, 19 nt, Salmonella typhimurium LT2
accaggucuggcagggcag

SEQ ID NO: 3766405 - RNA, 16 nt, Salmonella typhimurium LT2
accagguugccagcgg

SEQ ID NO: 3766406 - RNA, 14 nt, Salmonella typhimurium LT2
accagguuuccaga

SEQ ID NO: 3766407 - RNA, 15 nt, Salmonella typhimurium LT2
accaguaacggcagu

SEQ ID NO: 3766408 - RNA, 16 nt, Salmonella typhimurium LT2
accaguaagagaacaa

SEQ ID NO: 3766409 - RNA, 21 nt, Salmonella typhimurium LT2
accaguacaauuuccugccac

SEQ ID NO: 3766410 - RNA, 22 nt, Salmonella typhimurium LT2
accagugcggcaaccaccagca

SEQ ID NO: 3766411 - RNA, 14 nt, Salmonella typhimurium LT2
accaguucacuccu

SEQ ID NO: 3766412 - RNA, 17 nt, Salmonella typhimurium LT2
accaguuuauccgccag

SEQ ID NO: 3766413 - RNA, 13 nt, Salmonella typhimurium LT2
accaguuuuuccg

SEQ ID NO: 3766414 - RNA, 20 nt, Salmonella typhimurium LT2
accaguuuuuccguuuuaau

SEQ ID NO: 3766415 - RNA, 20 nt, Salmonella typhimurium LT2
accauaaacggcaccuggaa

SEQ ID NO: 3766416 - RNA, 19 nt, Salmonella typhimurium LT2
accauaaaugaaaccucaa

SEQ ID NO: 3766417 - RNA, 13 nt, Salmonella typhimurium LT2
accauaaugaucg

SEQ ID NO: 3766418 - RNA, 23 nt, Salmonella typhimurium LT2
accauacggucgauaccaauucc

SEQ ID NO: 3766419 - RNA, 17 nt, Salmonella typhimurium LT2
accauacugacuuaaua

SEQ ID NO: 3766420 - RNA, 12 nt, Salmonella typhimurium LT2
accauagcagcc

SEQ ID NO: 3766421 - RNA, 16 nt, Salmonella typhimurium LT2
accauagcggcucagg

SEQ ID NO: 3766422 - RNA, 17 nt, Salmonella typhimurium LT2
accauagcggcucagga

SEQ ID NO: 3766423 - RNA, 11 nt, Salmonella typhimurium LT2
accauaucgca

SEQ ID NO: 3766424 - RNA, 15 nt, Salmonella typhimurium LT2
accauauucccacag

SEQ ID NO: 3766425 - RNA, 24 nt, Salmonella typhimurium LT2
accauauucgccaccgcgcgcuua

SEQ ID NO: 3766426 - RNA, 18 nt, Salmonella typhimurium LT2
accauauuuaucuaagaa

SEQ ID NO: 3766427 - RNA, 21 nt, Salmonella typhimurium LT2
accaucaauauuggugucgua

SEQ ID NO: 3766428 - RNA, 18 nt, Salmonella typhimurium LT2
accaucagcgucagcacc

SEQ ID NO: 3766429 - RNA, 19 nt, Salmonella typhimurium LT2
accaucagcgucagcacca

SEQ ID NO: 3766430 - RNA, 19 nt, Salmonella typhimurium LT2
accaucauuaauauaaucc

SEQ ID NO: 3766431 - RNA, 16 nt, Salmonella typhimurium LT2
accaucgccagccauu

SEQ ID NO: 3766432 - RNA, 23 nt, Salmonella typhimurium LT2
accaucgcguugcaaucgccuga

SEQ ID NO: 3766433 - RNA, 19 nt, Salmonella typhimurium LT2
accaucggcgcuacggcgu

SEQ ID NO: 3766434 - RNA, 21 nt, Salmonella typhimurium LT2
accaucgggucggccauaucg

SEQ ID NO: 3766435 - RNA, 14 nt, Salmonella typhimurium LT2
accaucgucgccag

SEQ ID NO: 3766436 - RNA, 17 nt, Salmonella typhimurium LT2
accaucguugccagcgg

SEQ ID NO: 3766437 - RNA, 18 nt, Salmonella typhimurium LT2
accaucguugccagcggc

SEQ ID NO: 3766438 - RNA, 16 nt, Salmonella typhimurium LT2
accaucuuuuccggca

SEQ ID NO: 3766439 - RNA, 16 nt, Salmonella typhimurium LT2
accaugauucauacgc

SEQ ID NO: 3766440 - RNA, 13 nt, Salmonella typhimurium LT2
accaugcguggua

SEQ ID NO: 3766441 - RNA, 14 nt, Salmonella typhimurium LT2
accauggcgccaag

SEQ ID NO: 3766442 - RNA, 22 nt, Salmonella typhimurium LT2
accauguauuugcauuucaacc

SEQ ID NO: 3766443 - RNA, 13 nt, Salmonella typhimurium LT2
accauguugcgca

SEQ ID NO: 3766444 - RNA, 14 nt, Salmonella typhimurium LT2
accauuaacaucag

SEQ ID NO: 3766445 - RNA, 18 nt, Salmonella typhimurium LT2
accauuaccgccaacauc

SEQ ID NO: 3766446 - RNA, 18 nt, Salmonella typhimurium LT2
accauucauguuucgaca

SEQ ID NO: 3766447 - RNA, 18 nt, Salmonella typhimurium LT2
accauucccguaaaagaa

SEQ ID NO: 3766448 - RNA, 14 nt, Salmonella typhimurium LT2
accauuccgguauc

SEQ ID NO: 3766449 - RNA, 14 nt, Salmonella typhimurium LT2
accauugauaccaa

SEQ ID NO: 3766450 - RNA, 14 nt, Salmonella typhimurium LT2
accauuggcgcguc

SEQ ID NO: 3766451 - RNA, 14 nt, Salmonella typhimurium LT2
acccuuuggccacc

SEQ ID NO: 3766452 - RNA, 16 nt, Salmonella typhimurium LT2
accgaaaaucuucuuc

SEQ ID NO: 3766453 - RNA, 19 nt, Salmonella typhimurium LT2
accgaaacagucacgcuug

SEQ ID NO: 3766454 - RNA, 21 nt, Salmonella typhimurium LT2
accgaaaggguauacaaaaaa

SEQ ID NO: 3766455 - RNA, 11 nt, Salmonella typhimurium LT2
accgaaauccg

SEQ ID NO: 3766456 - RNA, 18 nt, Salmonella typhimurium LT2
accgaaauccgcuuugag

SEQ ID NO: 3766457 - RNA, 20 nt, Salmonella typhimurium LT2
accgaaaucgguacgcgucu

SEQ ID NO: 3766458 - RNA, 15 nt, Salmonella typhimurium LT2
accgaauccuuugga

SEQ ID NO: 3766459 - RNA, 14 nt, Salmonella typhimurium LT2
accgacaaaacagu

SEQ ID NO: 3766460 - RNA, 15 nt, Salmonella typhimurium LT2
accgacaaccugaau

SEQ ID NO: 3766461 - RNA, 21 nt, Salmonella typhimurium LT2
accgacaaccugaaugccauc

SEQ ID NO: 3766462 - RNA, 19 nt, Salmonella typhimurium LT2
accgacacauucaggcuuu

SEQ ID NO: 3766463 - RNA, 17 nt, Salmonella typhimurium LT2
accgacagauagcccug

SEQ ID NO: 3766464 - RNA, 19 nt, Salmonella typhimurium LT2
accgacagauagcccugau

SEQ ID NO: 3766465 - RNA, 15 nt, Salmonella typhimurium LT2
accgacgaacaaaau

SEQ ID NO: 3766466 - RNA, 22 nt, Salmonella typhimurium LT2
accgacgcauuuuuccguauug

SEQ ID NO: 3766467 - RNA, 16 nt, Salmonella typhimurium LT2
accgacgcguggugaa

SEQ ID NO: 3766468 - RNA, 15 nt, Salmonella typhimurium LT2
accgacuaucagaaa

SEQ ID NO: 3766469 - RNA, 21 nt, Salmonella typhimurium LT2
accgacucccccagauucuga

SEQ ID NO: 3766470 - RNA, 13 nt, Salmonella typhimurium LT2
accgagacagaga

SEQ ID NO: 3766471 - RNA, 14 nt, Salmonella typhimurium LT2
accgagauacgcug

SEQ ID NO: 3766472 - RNA, 13 nt, Salmonella typhimurium LT2
accgagcagccug

SEQ ID NO: 3766473 - RNA, 14 nt, Salmonella typhimurium LT2
accgaggcaggggc

SEQ ID NO: 3766474 - RNA, 13 nt, Salmonella typhimurium LT2
accgauaaauacc

SEQ ID NO: 3766475 - RNA, 18 nt, Salmonella typhimurium LT2
accgauaaucaccagccc

SEQ ID NO: 3766476 - RNA, 19 nt, Salmonella typhimurium LT2
accgauaaucaccagcccg

SEQ ID NO: 3766477 - RNA, 16 nt, Salmonella typhimurium LT2
accgauagcgcggaau

SEQ ID NO: 3766478 - RNA, 12 nt, Salmonella typhimurium LT2
accgaucaucau

SEQ ID NO: 3766479 - RNA, 13 nt, Salmonella typhimurium LT2
accgaucaucauc

SEQ ID NO: 3766480 - RNA, 18 nt, Salmonella typhimurium LT2
accgauguuggcgacaga

SEQ ID NO: 3766481 - RNA, 17 nt, Salmonella typhimurium LT2
accgauuucaucgcuga

SEQ ID NO: 3766482 - RNA, 21 nt, Salmonella typhimurium LT2
accgcaaaccgaauucgucca

SEQ ID NO: 3766483 - RNA, 14 nt, Salmonella typhimurium LT2
accgcacugcaucg

SEQ ID NO: 3766484 - RNA, 18 nt, Salmonella typhimurium LT2
accgcagaaacagauagu

SEQ ID NO: 3766485 - RNA, 13 nt, Salmonella typhimurium LT2
accgcagccuuga

SEQ ID NO: 3766486 - RNA, 13 nt, Salmonella typhimurium LT2
accgcaggcagcg

SEQ ID NO: 3766487 - RNA, 14 nt, Salmonella typhimurium LT2
accgcauaacgcgc

SEQ ID NO: 3766488 - RNA, 23 nt, Salmonella typhimurium LT2
accgcauaacgcgcuggucagca

SEQ ID NO: 3766489 - RNA, 13 nt, Salmonella typhimurium LT2
accgcauacccga

SEQ ID NO: 3766490 - RNA, 14 nt, Salmonella typhimurium LT2
accgcauacugaac

SEQ ID NO: 3766491 - RNA, 16 nt, Salmonella typhimurium LT2
accgcaucaagcccau

SEQ ID NO: 3766492 - RNA, 21 nt, Salmonella typhimurium LT2
accgcaucaaugcccagcgca

SEQ ID NO: 3766493 - RNA, 22 nt, Salmonella typhimurium LT2
accgcauuuucucgcgcagcca

SEQ ID NO: 3766494 - RNA, 14 nt, Salmonella typhimurium LT2
accgccaauaacgg

SEQ ID NO: 3766495 - RNA, 18 nt, Salmonella typhimurium LT2
accgccaauaacgggcac

SEQ ID NO: 3766496 - RNA, 20 nt, Salmonella typhimurium LT2
accgccaaucaacgccgcca

SEQ ID NO: 3766497 - RNA, 18 nt, Salmonella typhimurium LT2
accgccacaucguuggcc

SEQ ID NO: 3766498 - RNA, 21 nt, Salmonella typhimurium LT2
accgccaccauccggcgcugu

SEQ ID NO: 3766499 - RNA, 20 nt, Salmonella typhimurium LT2
accgccacggcaagaaaaau

SEQ ID NO: 3766500 - RNA, 15 nt, Salmonella typhimurium LT2
accgccagaggcggc

SEQ ID NO: 3766501 - RNA, 19 nt, Salmonella typhimurium LT2
accgccagcaacgcgcuaa

SEQ ID NO: 3766502 - RNA, 15 nt, Salmonella typhimurium LT2
accgccagccauggc

SEQ ID NO: 3766503 - RNA, 22 nt, Salmonella typhimurium LT2
accgccagcggcguuuuuuccu

SEQ ID NO: 3766504 - RNA, 17 nt, Salmonella typhimurium LT2
accgccaugcggcgcca

SEQ ID NO: 3766505 - RNA, 14 nt, Salmonella typhimurium LT2
accgccccuggcaa

SEQ ID NO: 3766506 - RNA, 23 nt, Salmonella typhimurium LT2
accgcccgcgcuuuagggcuucc

SEQ ID NO: 3766507 - RNA, 20 nt, Salmonella typhimurium LT2
accgcccgcggcgaucacca

SEQ ID NO: 3766508 - RNA, 13 nt, Salmonella typhimurium LT2
accgcccugcagg

SEQ ID NO: 3766509 - RNA, 14 nt, Salmonella typhimurium LT2
accgcccugcaggc

SEQ ID NO: 3766510 - RNA, 14 nt, Salmonella typhimurium LT2
accgccgagcccga

SEQ ID NO: 3766511 - RNA, 18 nt, Salmonella typhimurium LT2
accgccgccaaacugcgc

SEQ ID NO: 3766512 - RNA, 13 nt, Salmonella typhimurium LT2
accgccgggcuaa

SEQ ID NO: 3766513 - RNA, 22 nt, Salmonella typhimurium LT2
accgccuaacagcgccgcgccg

SEQ ID NO: 3766514 - RNA, 20 nt, Salmonella typhimurium LT2
accgccuacacaaaaucauu

SEQ ID NO: 3766515 - RNA, 13 nt, Salmonella typhimurium LT2
accgccuccaggc

SEQ ID NO: 3766516 - RNA, 23 nt, Salmonella typhimurium LT2
accgccugcacugguagaaaaac

SEQ ID NO: 3766517 - RNA, 22 nt, Salmonella typhimurium LT2
accgccugcggcauacuuucgc

SEQ ID NO: 3766518 - RNA, 16 nt, Salmonella typhimurium LT2
accgccugcguuugcg

SEQ ID NO: 3766519 - RNA, 20 nt, Salmonella typhimurium LT2
accgccuuauccggccuaca

SEQ ID NO: 3766520 - RNA, 14 nt, Salmonella typhimurium LT2
accgccuucagcgc

SEQ ID NO: 3766521 - RNA, 18 nt, Salmonella typhimurium LT2
accgccuucagcgcgccc

SEQ ID NO: 3766522 - RNA, 17 nt, Salmonella typhimurium LT2
accgccuuccugcugcg

SEQ ID NO: 3766523 - RNA, 12 nt, Salmonella typhimurium LT2
accgccuucgca

SEQ ID NO: 3766524 - RNA, 19 nt, Salmonella typhimurium LT2
accgccuuguccggccuaa

SEQ ID NO: 3766525 - RNA, 16 nt, Salmonella typhimurium LT2
accgcgaacauuggaa

SEQ ID NO: 3766526 - RNA, 23 nt, Salmonella typhimurium LT2
accgcgaagaucguuauccagca

SEQ ID NO: 3766527 - RNA, 15 nt, Salmonella typhimurium LT2
accgcgaauauacgc

SEQ ID NO: 3766528 - RNA, 23 nt, Salmonella typhimurium LT2
accgcgaauauacgcaccugaua

SEQ ID NO: 3766529 - RNA, 21 nt, Salmonella typhimurium LT2
accgcgaucgaugugauaaau

SEQ ID NO: 3766530 - RNA, 16 nt, Salmonella typhimurium LT2
accgcgaugaccauca

SEQ ID NO: 3766531 - RNA, 16 nt, Salmonella typhimurium LT2
accgcgaugugcuggg

SEQ ID NO: 3766532 - RNA, 13 nt, Salmonella typhimurium LT2
accgcgccagccg

SEQ ID NO: 3766533 - RNA, 13 nt, Salmonella typhimurium LT2
accgcgcccgguu

SEQ ID NO: 3766534 - RNA, 19 nt, Salmonella typhimurium LT2
accgcgccggucgccagca

SEQ ID NO: 3766535 - RNA, 18 nt, Salmonella typhimurium LT2
accgcgcgcccgacgcgc

SEQ ID NO: 3766536 - RNA, 21 nt, Salmonella typhimurium LT2
accgcgcggcauaaauccggu

SEQ ID NO: 3766537 - RNA, 15 nt, Salmonella typhimurium LT2
accgcgcggcguucu

SEQ ID NO: 3766538 - RNA, 15 nt, Salmonella typhimurium LT2
accgcgcuccuggaa

SEQ ID NO: 3766539 - RNA, 13 nt, Salmonella typhimurium LT2
accgcguuugcgc

SEQ ID NO: 3766540 - RNA, 18 nt, Salmonella typhimurium LT2
accgcguuugcgcaacag

SEQ ID NO: 3766541 - RNA, 23 nt, Salmonella typhimurium LT2
accgcguuuugcugaugaagcga

SEQ ID NO: 3766542 - RNA, 23 nt, Salmonella typhimurium LT2
accgcuaucauaccuacaccaac

SEQ ID NO: 3766543 - RNA, 14 nt, Salmonella typhimurium LT2
accgcuaucgccaa

SEQ ID NO: 3766544 - RNA, 23 nt, Salmonella typhimurium LT2
accgcucacgguuucuacuucca

SEQ ID NO: 3766545 - RNA, 15 nt, Salmonella typhimurium LT2
accgcuccgcgcauc

SEQ ID NO: 3766546 - RNA, 15 nt, Salmonella typhimurium LT2
accgcucgccgccuc

SEQ ID NO: 3766547 - RNA, 19 nt, Salmonella typhimurium LT2
accgcucuccgcaauuaau

SEQ ID NO: 3766548 - RNA, 14 nt, Salmonella typhimurium LT2
accgcugaccauca

SEQ ID NO: 3766549 - RNA, 16 nt, Salmonella typhimurium LT2
accgcuucgcauugcg

SEQ ID NO: 3766550 - RNA, 16 nt, Salmonella typhimurium LT2
accgcuuuaugcgcuu

SEQ ID NO: 3766551 - RNA, 20 nt, Salmonella typhimurium LT2
accgcuuucaaaaugacaaa

SEQ ID NO: 3766552 - RNA, 16 nt, Salmonella typhimurium LT2
accgcuuucccggcau

SEQ ID NO: 3766553 - RNA, 17 nt, Salmonella typhimurium LT2
accgcuuucgccugguc

SEQ ID NO: 3766554 - RNA, 22 nt, Salmonella typhimurium LT2
accgcuuugccgcgcucuuuaa

SEQ ID NO: 3766555 - RNA, 21 nt, Salmonella typhimurium LT2
accucaccguccgccaggccc

SEQ ID NO: 3766556 - RNA, 14 nt, Salmonella typhimurium LT2
accucacggagaaa

SEQ ID NO: 3766557 - RNA, 13 nt, Salmonella typhimurium LT2
accucaucaaaca

SEQ ID NO: 3766558 - RNA, 13 nt, Salmonella typhimurium LT2
accucauccauca

SEQ ID NO: 3766559 - RNA, 17 nt, Salmonella typhimurium LT2
accucauccaucagcgc

SEQ ID NO: 3766560 - RNA, 13 nt, Salmonella typhimurium LT2
accucaucgcuac

SEQ ID NO: 3766561 - RNA, 15 nt, Salmonella typhimurium LT2
accucaugcuuaucg

SEQ ID NO: 3766562 - RNA, 23 nt, Salmonella typhimurium LT2
accucauuucucaaaaacaccau

SEQ ID NO: 3766563 - RNA, 15 nt, Salmonella typhimurium LT2
accuccaaagcgcua

SEQ ID NO: 3766564 - RNA, 14 nt, Salmonella typhimurium LT2
accuccgccaccag

SEQ ID NO: 3766565 - RNA, 19 nt, Salmonella typhimurium LT2
accuccgccaccagcgcuu

SEQ ID NO: 3766566 - RNA, 14 nt, Salmonella typhimurium LT2
accuccucucuucc

SEQ ID NO: 3766567 - RNA, 18 nt, Salmonella typhimurium LT2
accuccucucuuccuccu

SEQ ID NO: 3766568 - RNA, 13 nt, Salmonella typhimurium LT2
accuccugcaucg

SEQ ID NO: 3766569 - RNA, 16 nt, Salmonella typhimurium LT2
accucgccacauucaa

SEQ ID NO: 3766570 - RNA, 13 nt, Salmonella typhimurium LT2
accucuaaaugga

SEQ ID NO: 3766571 - RNA, 14 nt, Salmonella typhimurium LT2
accucugcuuuuau

SEQ ID NO: 3766572 - RNA, 22 nt, Salmonella typhimurium LT2
accucuuccagcgucagcgaaa

SEQ ID NO: 3766573 - RNA, 15 nt, Salmonella typhimurium LT2
accucuuccccgguc

SEQ ID NO: 3766574 - RNA, 18 nt, Salmonella typhimurium LT2
accucuucguucauccgu

SEQ ID NO: 3766575 - RNA, 22 nt, Salmonella typhimurium LT2
accucuugcuggguuaacgcgc

SEQ ID NO: 3766576 - RNA, 23 nt, Salmonella typhimurium LT2
accucuuugcggccuuuauccag

SEQ ID NO: 3766577 - RNA, 21 nt, Salmonella typhimurium LT2
accucuuuuaacgaacgcgcg

SEQ ID NO: 3766578 - RNA, 13 nt, Salmonella typhimurium LT2
accucuuuuuccg

SEQ ID NO: 3766579 - RNA, 18 nt, Salmonella typhimurium LT2
accugaaaccaggcgcga

SEQ ID NO: 3766580 - RNA, 19 nt, Salmonella typhimurium LT2
accugaacgccuaccgcuu

SEQ ID NO: 3766581 - RNA, 18 nt, Salmonella typhimurium LT2
accugaauccagacuuuu

SEQ ID NO: 3766582 - RNA, 19 nt, Salmonella typhimurium LT2
accugaccacgacgaccgc

SEQ ID NO: 3766583 - RNA, 15 nt, Salmonella typhimurium LT2
accugagucuggaca

SEQ ID NO: 3766584 - RNA, 23 nt, Salmonella typhimurium LT2
accugauauugcguaagcagcug

SEQ ID NO: 3766585 - RNA, 21 nt, Salmonella typhimurium LT2
accugauccagcucuucuucg

SEQ ID NO: 3766586 - RNA, 18 nt, Salmonella typhimurium LT2
accugauuaaucagcuca

SEQ ID NO: 3766587 - RNA, 21 nt, Salmonella typhimurium LT2
accugauuaaucagcucagca

SEQ ID NO: 3766588 - RNA, 23 nt, Salmonella typhimurium LT2
accugauugauacgcgcccgauc

SEQ ID NO: 3766589 - RNA, 19 nt, Salmonella typhimurium LT2
accugauugccgguuguug

SEQ ID NO: 3766590 - RNA, 16 nt, Salmonella typhimurium LT2
accugauuugucgcgc

SEQ ID NO: 3766591 - RNA, 13 nt, Salmonella typhimurium LT2
accugcagcagcu

SEQ ID NO: 3766592 - RNA, 14 nt, Salmonella typhimurium LT2
accugcauggggaa

SEQ ID NO: 3766593 - RNA, 12 nt, Salmonella typhimurium LT2
accugccaggcu

SEQ ID NO: 3766594 - RNA, 14 nt, Salmonella typhimurium LT2
accugccaggcuuc

SEQ ID NO: 3766595 - RNA, 23 nt, Salmonella typhimurium LT2
accugccccauaagcaaaggcgg

SEQ ID NO: 3766596 - RNA, 15 nt, Salmonella typhimurium LT2
accugcccuuucaga

SEQ ID NO: 3766597 - RNA, 17 nt, Salmonella typhimurium LT2
accugccugaucgccac

SEQ ID NO: 3766598 - RNA, 14 nt, Salmonella typhimurium LT2
accugccugucuuu

SEQ ID NO: 3766599 - RNA, 22 nt, Salmonella typhimurium LT2
accugcgaaaagcgugcgccuu

SEQ ID NO: 3766600 - RNA, 19 nt, Salmonella typhimurium LT2
accugcgcaaucaugacag

SEQ ID NO: 3766601 - RNA, 23 nt, Salmonella typhimurium LT2
accugcgcccgcguugcgccaag

SEQ ID NO: 3766602 - RNA, 15 nt, Salmonella typhimurium LT2
accugcgcugacggc

SEQ ID NO: 3766603 - RNA, 21 nt, Salmonella typhimurium LT2
accugcgcugacggcggcaga

SEQ ID NO: 3766604 - RNA, 17 nt, Salmonella typhimurium LT2
accugcggacuguucgg

SEQ ID NO: 3766605 - RNA, 20 nt, Salmonella typhimurium LT2
accugcucgcccuguugcgc

SEQ ID NO: 3766606 - RNA, 21 nt, Salmonella typhimurium LT2
accugcucggcuaucgccacu

SEQ ID NO: 3766607 - RNA, 20 nt, Salmonella typhimurium LT2
accuggaaaggcuuuuuaau

SEQ ID NO: 3766608 - RNA, 20 nt, Salmonella typhimurium LT2
accuggaugcugccugccug

SEQ ID NO: 3766609 - RNA, 19 nt, Salmonella typhimurium LT2
accuggccguugauaaagu

SEQ ID NO: 3766610 - RNA, 18 nt, Salmonella typhimurium LT2
accuggcguaguacgcgc

SEQ ID NO: 3766611 - RNA, 20 nt, Salmonella typhimurium LT2
accuggcguaguacgcgcgc

SEQ ID NO: 3766612 - RNA, 14 nt, Salmonella typhimurium LT2
accuggcuugaugu

SEQ ID NO: 3766613 - RNA, 19 nt, Salmonella typhimurium LT2
accugggucagcgucaucg

SEQ ID NO: 3766614 - RNA, 15 nt, Salmonella typhimurium LT2
accuggugcucaauc

SEQ ID NO: 3766615 - RNA, 14 nt, Salmonella typhimurium LT2
accuguacccggua

SEQ ID NO: 3766616 - RNA, 14 nt, Salmonella typhimurium LT2
accuguuaucagga

SEQ ID NO: 3766617 - RNA, 20 nt, Salmonella typhimurium LT2
accuguugcacgcauggcac

SEQ ID NO: 3766618 - RNA, 20 nt, Salmonella typhimurium LT2
accuuaaaaggcgcucgccu

SEQ ID NO: 3766619 - RNA, 18 nt, Salmonella typhimurium LT2
accuuaagcgcgaaauuu

SEQ ID NO: 3766620 - RNA, 17 nt, Salmonella typhimurium LT2
accuuaaggccuacgga

SEQ ID NO: 3766621 - RNA, 21 nt, Salmonella typhimurium LT2
accuuaauuugugauugcaga

SEQ ID NO: 3766622 - RNA, 20 nt, Salmonella typhimurium LT2
accuuacguuucucacuaau

SEQ ID NO: 3766623 - RNA, 17 nt, Salmonella typhimurium LT2
accuuauccggccuaca

SEQ ID NO: 3766624 - RNA, 17 nt, Salmonella typhimurium LT2
accuuaucgagaauacu

SEQ ID NO: 3766625 - RNA, 18 nt, Salmonella typhimurium LT2
accuucacacagugcgcg

SEQ ID NO: 3766626 - RNA, 17 nt, Salmonella typhimurium LT2
accuucacccccaucgc

SEQ ID NO: 3766627 - RNA, 15 nt, Salmonella typhimurium LT2
accuucaccggauac

SEQ ID NO: 3766628 - RNA, 15 nt, Salmonella typhimurium LT2
accuucaccugaaua

SEQ ID NO: 3766629 - RNA, 16 nt, Salmonella typhimurium LT2
accuucauccugauaa

SEQ ID NO: 3766630 - RNA, 21 nt, Salmonella typhimurium LT2
accuucauccugauaauccag

SEQ ID NO: 3766631 - RNA, 21 nt, Salmonella typhimurium LT2
accuucaucucuuugcccguc

SEQ ID NO: 3766632 - RNA, 19 nt, Salmonella typhimurium LT2
accuuccauuaugaugagu

SEQ ID NO: 3766633 - RNA, 12 nt, Salmonella typhimurium LT2
accuuccggcac

SEQ ID NO: 3766634 - RNA, 12 nt, Salmonella typhimurium LT2
accuucgcggau

SEQ ID NO: 3766635 - RNA, 14 nt, Salmonella typhimurium LT2
accuucuucacuaa

SEQ ID NO: 3766636 - RNA, 13 nt, Salmonella typhimurium LT2
accuucuucgcuc

SEQ ID NO: 3766637 - RNA, 19 nt, Salmonella typhimurium LT2
accuucuugcucaaaaagc

SEQ ID NO: 3766638 - RNA, 18 nt, Salmonella typhimurium LT2
accuugccgggccuggca

SEQ ID NO: 3766639 - RNA, 17 nt, Salmonella typhimurium LT2
accuugugaauauauug

SEQ ID NO: 3766640 - RNA, 14 nt, Salmonella typhimurium LT2
accuuguucuucca

SEQ ID NO: 3766641 - RNA, 20 nt, Salmonella typhimurium LT2
accuuuaaccucuuuuucau

SEQ ID NO: 3766642 - RNA, 12 nt, Salmonella typhimurium LT2
accuuuccaguc

SEQ ID NO: 3766643 - RNA, 18 nt, Salmonella typhimurium LT2
accuuugacgccugcauc

SEQ ID NO: 3766644 - RNA, 14 nt, Salmonella typhimurium LT2
accuuuugccgccc

SEQ ID NO: 3766645 - RNA, 20 nt, Salmonella typhimurium LT2
accuuuuuuuccagcgucug

SEQ ID NO: 3766646 - RNA, 20 nt, Salmonella typhimurium LT2
acgaaacauuauggcgugau

SEQ ID NO: 3766647 - RNA, 14 nt, Salmonella typhimurium LT2
acgaaacgcaucgu

SEQ ID NO: 3766648 - RNA, 23 nt, Salmonella typhimurium LT2
acgaaagcggcgaauauagcuaa

SEQ ID NO: 3766649 - RNA, 16 nt, Salmonella typhimurium LT2
acgaacaaaauagugc

SEQ ID NO: 3766650 - RNA, 19 nt, Salmonella typhimurium LT2
acgaacaguucggucaacg

SEQ ID NO: 3766651 - RNA, 19 nt, Salmonella typhimurium LT2
acgaaccauuugccugccg

SEQ ID NO: 3766652 - RNA, 22 nt, Salmonella typhimurium LT2
acgaacgcgcgucgcuaaucag

SEQ ID NO: 3766653 - RNA, 16 nt, Salmonella typhimurium LT2
acgaacugcggcuuuu

SEQ ID NO: 3766654 - RNA, 24 nt, Salmonella typhimurium LT2
acgaagauugucgaucacgguggu

SEQ ID NO: 3766655 - RNA, 16 nt, Salmonella typhimurium LT2
acgaaggggacaaaau

SEQ ID NO: 3766656 - RNA, 16 nt, Salmonella typhimurium LT2
acgaagucuggcugca

SEQ ID NO: 3766657 - RNA, 12 nt, Salmonella typhimurium LT2
acgaaguuuaau

SEQ ID NO: 3766658 - RNA, 17 nt, Salmonella typhimurium LT2
acgaauaagaaucagau

SEQ ID NO: 3766659 - RNA, 18 nt, Salmonella typhimurium LT2
acgaauauucauuuccag

SEQ ID NO: 3766660 - RNA, 17 nt, Salmonella typhimurium LT2
acgaaucucgcugccgg

SEQ ID NO: 3766661 - RNA, 23 nt, Salmonella typhimurium LT2
acgaaugccgauagucuccgcca

SEQ ID NO: 3766662 - RNA, 19 nt, Salmonella typhimurium LT2
acgaauggcggcguuuucc

SEQ ID NO: 3766663 - RNA, 20 nt, Salmonella typhimurium LT2
acgaaugucuuaaugcgguu

SEQ ID NO: 3766664 - RNA, 19 nt, Salmonella typhimurium LT2
acgaauuuacucgccaaua

SEQ ID NO: 3766665 - RNA, 21 nt, Salmonella typhimurium LT2
acgaauuuacucgccaauauc

SEQ ID NO: 3766666 - RNA, 15 nt, Salmonella typhimurium LT2
acgacacauaaagcc

SEQ ID NO: 3766667 - RNA, 21 nt, Salmonella typhimurium LT2
acgacacccgauacacgccga

SEQ ID NO: 3766668 - RNA, 17 nt, Salmonella typhimurium LT2
acgacacuuuuugccga

SEQ ID NO: 3766669 - RNA, 13 nt, Salmonella typhimurium LT2
acgacagaauaug

SEQ ID NO: 3766670 - RNA, 14 nt, Salmonella typhimurium LT2
acgacagaauaugc

SEQ ID NO: 3766671 - RNA, 18 nt, Salmonella typhimurium LT2
acgacagcgccaucagca

SEQ ID NO: 3766672 - RNA, 13 nt, Salmonella typhimurium LT2
acgacagcgcugg

SEQ ID NO: 3766673 - RNA, 18 nt, Salmonella typhimurium LT2
acgacaggcagcgucagc

SEQ ID NO: 3766674 - RNA, 20 nt, Salmonella typhimurium LT2
acgacaggcagcgucagccc

SEQ ID NO: 3766675 - RNA, 24 nt, Salmonella typhimurium LT2
acgaccagaaucaucaugucguca

SEQ ID NO: 3766676 - RNA, 12 nt, Salmonella typhimurium LT2
acgaccagccaa

SEQ ID NO: 3766677 - RNA, 23 nt, Salmonella typhimurium LT2
acgaccaugguucccgccacuga

SEQ ID NO: 3766678 - RNA, 22 nt, Salmonella typhimurium LT2
acgacccccaccaugucaaggu

SEQ ID NO: 3766679 - RNA, 18 nt, Salmonella typhimurium LT2
acgaccccgccgagaauu

SEQ ID NO: 3766680 - RNA, 23 nt, Salmonella typhimurium LT2
acgacccuuuuuugguuauccag

SEQ ID NO: 3766681 - RNA, 20 nt, Salmonella typhimurium LT2
acgaccgccgacaaucguca

SEQ ID NO: 3766682 - RNA, 15 nt, Salmonella typhimurium LT2
acgaccgcgcucacc

SEQ ID NO: 3766683 - RNA, 22 nt, Salmonella typhimurium LT2
acgaccggcacgguuaaugaaa

SEQ ID NO: 3766684 - RNA, 19 nt, Salmonella typhimurium LT2
acgacggcuaaguuaaccg

SEQ ID NO: 3766685 - RNA, 21 nt, Salmonella typhimurium LT2
acgacggugcuauacaguaaa

SEQ ID NO: 3766686 - RNA, 14 nt, Salmonella typhimurium LT2
acgacguccacacc

SEQ ID NO: 3766687 - RNA, 15 nt, Salmonella typhimurium LT2
acgacguccacaccu

SEQ ID NO: 3766688 - RNA, 22 nt, Salmonella typhimurium LT2
acgacgugggcuacggcucccu

SEQ ID NO: 3766689 - RNA, 14 nt, Salmonella typhimurium LT2
acgacuacugaaaa

SEQ ID NO: 3766690 - RNA, 13 nt, Salmonella typhimurium LT2
acgacucaauaca

SEQ ID NO: 3766691 - RNA, 16 nt, Salmonella typhimurium LT2
acgacuuauucaauca

SEQ ID NO: 3766692 - RNA, 19 nt, Salmonella typhimurium LT2
acgagaacccacuuugcuu

SEQ ID NO: 3766693 - RNA, 17 nt, Salmonella typhimurium LT2
acgagauucaauaacgu

SEQ ID NO: 3766694 - RNA, 17 nt, Salmonella typhimurium LT2
acgagcgacgaggcaug

SEQ ID NO: 3766695 - RNA, 18 nt, Salmonella typhimurium LT2
acgagcgcggcauaccga

SEQ ID NO: 3766696 - RNA, 20 nt, Salmonella typhimurium LT2
acgagcgcgucagcgccucc

SEQ ID NO: 3766697 - RNA, 19 nt, Salmonella typhimurium LT2
acgaguacguaaugcgaaa

SEQ ID NO: 3766698 - RNA, 18 nt, Salmonella typhimurium LT2
acgagugccagccccgua

SEQ ID NO: 3766699 - RNA, 18 nt, Salmonella typhimurium LT2
acgagugcguucuuccac

SEQ ID NO: 3766700 - RNA, 18 nt, Salmonella typhimurium LT2
acgagugcucaccgacag

SEQ ID NO: 3766701 - RNA, 15 nt, Salmonella typhimurium LT2
acgaguggcgcggaa

SEQ ID NO: 3766702 - RNA, 23 nt, Salmonella typhimurium LT2
acgaguggcggacgggugaguaa

SEQ ID NO: 3766703 - RNA, 23 nt, Salmonella typhimurium LT2
acgaguucucgccggauggcgac

SEQ ID NO: 3766704 - RNA, 19 nt, Salmonella typhimurium LT2
acgauaaagcugggucagg

SEQ ID NO: 3766705 - RNA, 14 nt, Salmonella typhimurium LT2
acgauaaauuucac

SEQ ID NO: 3766706 - RNA, 22 nt, Salmonella typhimurium LT2
acgauaauaucgucaccaggau

SEQ ID NO: 3766707 - RNA, 22 nt, Salmonella typhimurium LT2
acgauacagcacggcaguacac

SEQ ID NO: 3766708 - RNA, 12 nt, Salmonella typhimurium LT2
acgauaccagcg

SEQ ID NO: 3766709 - RNA, 18 nt, Salmonella typhimurium LT2
acgauacccaccagcgug

SEQ ID NO: 3766710 - RNA, 21 nt, Salmonella typhimurium LT2
acgauacggcccagaccccag

SEQ ID NO: 3766711 - RNA, 12 nt, Salmonella typhimurium LT2
acgauacgucau

SEQ ID NO: 3766712 - RNA, 19 nt, Salmonella typhimurium LT2
acgauacucaaaccugcgc

SEQ ID NO: 3766713 - RNA, 14 nt, Salmonella typhimurium LT2
acgauaucaucuug

SEQ ID NO: 3766714 - RNA, 23 nt, Salmonella typhimurium LT2
acgauaucgccuggugugaacau

SEQ ID NO: 3766715 - RNA, 15 nt, Salmonella typhimurium LT2
acgauaugcugccga

SEQ ID NO: 3766716 - RNA, 14 nt, Salmonella typhimurium LT2
acgauauucaagcu

SEQ ID NO: 3766717 - RNA, 22 nt, Salmonella typhimurium LT2
acgaucaaccgguuugucauuc

SEQ ID NO: 3766718 - RNA, 12 nt, Salmonella typhimurium LT2
acgaucagcgcc

SEQ ID NO: 3766719 - RNA, 17 nt, Salmonella typhimurium LT2
acgaucaugaaucgcgc

SEQ ID NO: 3766720 - RNA, 14 nt, Salmonella typhimurium LT2
acgaucauuucacu

SEQ ID NO: 3766721 - RNA, 17 nt, Salmonella typhimurium LT2
acgaucccuaauaaaau

SEQ ID NO: 3766722 - RNA, 22 nt, Salmonella typhimurium LT2
acgaucccuucaauaucaagau

SEQ ID NO: 3766723 - RNA, 16 nt, Salmonella typhimurium LT2
acgaucgagucaggcg

SEQ ID NO: 3766724 - RNA, 15 nt, Salmonella typhimurium LT2
acgaucgauaaagcg

SEQ ID NO: 3766725 - RNA, 20 nt, Salmonella typhimurium LT2
acgaucguuguuuggguaac

SEQ ID NO: 3766726 - RNA, 15 nt, Salmonella typhimurium LT2
acgaucguuugccca

SEQ ID NO: 3766727 - RNA, 22 nt, Salmonella typhimurium LT2
acgaugagcaaaguaaaacaag

SEQ ID NO: 3766728 - RNA, 22 nt, Salmonella typhimurium LT2
acgaugauaauacauugccgca

SEQ ID NO: 3766729 - RNA, 15 nt, Salmonella typhimurium LT2
acgauggggaaaauu

SEQ ID NO: 3766730 - RNA, 22 nt, Salmonella typhimurium LT2
acgauguucgucccugcaacgc

SEQ ID NO: 3766731 - RNA, 23 nt, Salmonella typhimurium LT2
acgauuacugugauuacgacuua

SEQ ID NO: 3766732 - RNA, 19 nt, Salmonella typhimurium LT2
acgauuggccgucucuuuc

SEQ ID NO: 3766733 - RNA, 17 nt, Salmonella typhimurium LT2
acgauuucaucagcgac

SEQ ID NO: 3766734 - RNA, 19 nt, Salmonella typhimurium LT2
acgauuuugguagcgcuga

SEQ ID NO: 3766735 - RNA, 20 nt, Salmonella typhimurium LT2
acgcaaaggcguugugcugc

SEQ ID NO: 3766736 - RNA, 12 nt, Salmonella typhimurium LT2
acgcaacaacag

SEQ ID NO: 3766737 - RNA, 19 nt, Salmonella typhimurium LT2
acgcaacaacaggccagaa

SEQ ID NO: 3766738 - RNA, 13 nt, Salmonella typhimurium LT2
acgcaacaacagu

SEQ ID NO: 3766739 - RNA, 14 nt, Salmonella typhimurium LT2
acgcaacaccaucc

SEQ ID NO: 3766740 - RNA, 18 nt, Salmonella typhimurium LT2
acgcaacaccaucccgcu

SEQ ID NO: 3766741 - RNA, 17 nt, Salmonella typhimurium LT2
acgcaacaggccgcauc

SEQ ID NO: 3766742 - RNA, 19 nt, Salmonella typhimurium LT2
acgcaacaggccgcaucgg

SEQ ID NO: 3766743 - RNA, 22 nt, Salmonella typhimurium LT2
acgcaacucacgccauuccgcu

SEQ ID NO: 3766744 - RNA, 17 nt, Salmonella typhimurium LT2
acgcaagagagcaacau

SEQ ID NO: 3766745 - RNA, 22 nt, Salmonella typhimurium LT2
acgcaauacuguaagccucgcu

SEQ ID NO: 3766746 - RNA, 23 nt, Salmonella typhimurium LT2
acgcaaucucuuccgcccagaua

SEQ ID NO: 3766747 - RNA, 13 nt, Salmonella typhimurium LT2
acgcacacggcgu

SEQ ID NO: 3766748 - RNA, 16 nt, Salmonella typhimurium LT2
acgcacaguacgcccg

SEQ ID NO: 3766749 - RNA, 21 nt, Salmonella typhimurium LT2
acgcaccgccaaacgcgguca

SEQ ID NO: 3766750 - RNA, 18 nt, Salmonella typhimurium LT2
acgcaccguggaagcgga

SEQ ID NO: 3766751 - RNA, 13 nt, Salmonella typhimurium LT2
acgcacuaacacc

SEQ ID NO: 3766752 - RNA, 22 nt, Salmonella typhimurium LT2
acgcacucucaaacuauuuuua

SEQ ID NO: 3766753 - RNA, 14 nt, Salmonella typhimurium LT2
acgcacuguuggcg

SEQ ID NO: 3766754 - RNA, 19 nt, Salmonella typhimurium LT2
acgcacuguuggcguugau

SEQ ID NO: 3766755 - RNA, 13 nt, Salmonella typhimurium LT2
acgcagaccaaaa

SEQ ID NO: 3766756 - RNA, 21 nt, Salmonella typhimurium LT2
acgcagacgauaccagggcga

SEQ ID NO: 3766757 - RNA, 12 nt, Salmonella typhimurium LT2
acgcagcaagaa

SEQ ID NO: 3766758 - RNA, 15 nt, Salmonella typhimurium LT2
acgcagcaagaacag

SEQ ID NO: 3766759 - RNA, 17 nt, Salmonella typhimurium LT2
acgcagcaagaacagag

SEQ ID NO: 3766760 - RNA, 17 nt, Salmonella typhimurium LT2
acgcagcaggcagacgc

SEQ ID NO: 3766761 - RNA, 15 nt, Salmonella typhimurium LT2
acgcagcaucgccau

SEQ ID NO: 3766762 - RNA, 16 nt, Salmonella typhimurium LT2
aucgccgcaaugacca

SEQ ID NO: 3766763 - RNA, 15 nt, Salmonella typhimurium LT2
aucgccgccagcuca

SEQ ID NO: 3766764 - RNA, 12 nt, Salmonella typhimurium LT2
aucgccgccauc

SEQ ID NO: 3766765 - RNA, 21 nt, Salmonella typhimurium LT2
aucgccgccccagcgguacca

SEQ ID NO: 3766766 - RNA, 23 nt, Salmonella typhimurium LT2
aucgccgcccgcaugguaaacgc

SEQ ID NO: 3766767 - RNA, 21 nt, Salmonella typhimurium LT2
aucgccgcgaggaaaaucgcu

SEQ ID NO: 3766768 - RNA, 17 nt, Salmonella typhimurium LT2
aucgccgcuaugcaauu

SEQ ID NO: 3766769 - RNA, 13 nt, Salmonella typhimurium LT2
aucgccgcugcga

SEQ ID NO: 3766770 - RNA, 16 nt, Salmonella typhimurium LT2
aucgccggacggcgca

SEQ ID NO: 3766771 - RNA, 22 nt, Salmonella typhimurium LT2
aucgccggagccgccuggccug

SEQ ID NO: 3766772 - RNA, 16 nt, Salmonella typhimurium LT2
aucgccgggaacagaa

SEQ ID NO: 3766773 - RNA, 22 nt, Salmonella typhimurium LT2
aucgccgugaucgaggcgcugg

SEQ ID NO: 3766774 - RNA, 13 nt, Salmonella typhimurium LT2
aucgccucaacca

SEQ ID NO: 3766775 - RNA, 14 nt, Salmonella typhimurium LT2
aucgccucaacgcu

SEQ ID NO: 3766776 - RNA, 15 nt, Salmonella typhimurium LT2
aucgccugacugaag

SEQ ID NO: 3766777 - RNA, 15 nt, Salmonella typhimurium LT2
aucgccugauggcga

SEQ ID NO: 3766778 - RNA, 15 nt, Salmonella typhimurium LT2
aucgccugcgcgccu

SEQ ID NO: 3766779 - RNA, 13 nt, Salmonella typhimurium LT2
aucgccuucaucc

SEQ ID NO: 3766780 - RNA, 22 nt, Salmonella typhimurium LT2
aucgccuuugccaagaaacgca

SEQ ID NO: 3766781 - RNA, 17 nt, Salmonella typhimurium LT2
aucgcgacggaccggca

SEQ ID NO: 3766782 - RNA, 14 nt, Salmonella typhimurium LT2
aucgcgacuucaau

SEQ ID NO: 3766783 - RNA, 15 nt, Salmonella typhimurium LT2
aucgcgaggcaacag

SEQ ID NO: 3766784 - RNA, 19 nt, Salmonella typhimurium LT2
aucgcgauacugccgccca

SEQ ID NO: 3766785 - RNA, 16 nt, Salmonella typhimurium LT2
aucgcgauccagcccc

SEQ ID NO: 3766786 - RNA, 18 nt, Salmonella typhimurium LT2
aucgcgauccugaaaugc

SEQ ID NO: 3766787 - RNA, 14 nt, Salmonella typhimurium LT2
aucgcgaucgccaa

SEQ ID NO: 3766788 - RNA, 16 nt, Salmonella typhimurium LT2
aucgcgaugauaccgu

SEQ ID NO: 3766789 - RNA, 20 nt, Salmonella typhimurium LT2
aucgcgcacaugcugugcgc

SEQ ID NO: 3766790 - RNA, 16 nt, Salmonella typhimurium LT2
aucgcgcagacagugg

SEQ ID NO: 3766791 - RNA, 14 nt, Salmonella typhimurium LT2
aucgcgcagcaggc

SEQ ID NO: 3766792 - RNA, 13 nt, Salmonella typhimurium LT2
aucgcgccaggcu

SEQ ID NO: 3766793 - RNA, 16 nt, Salmonella typhimurium LT2
aucgcgccaugauuca

SEQ ID NO: 3766794 - RNA, 22 nt, Salmonella typhimurium LT2
aucgcgccaugauucaucccgc

SEQ ID NO: 3766795 - RNA, 17 nt, Salmonella typhimurium LT2
aucgcgccuccccugcc

SEQ ID NO: 3766796 - RNA, 12 nt, Salmonella typhimurium LT2
aucgcgcggauu

SEQ ID NO: 3766797 - RNA, 17 nt, Salmonella typhimurium LT2
aucgcggauggcggcau

SEQ ID NO: 3766798 - RNA, 20 nt, Salmonella typhimurium LT2
aucgcggcgcaaaucgccau

SEQ ID NO: 3766799 - RNA, 11 nt, Salmonella typhimurium LT2
aucgcggcugu

SEQ ID NO: 3766800 - RNA, 23 nt, Salmonella typhimurium LT2
aucgcgggcaaucaaaugcgcau

SEQ ID NO: 3766801 - RNA, 17 nt, Salmonella typhimurium LT2
aucgcgucucccagaug

SEQ ID NO: 3766802 - RNA, 19 nt, Salmonella typhimurium LT2
aucgcgucucccagaugaa

SEQ ID NO: 3766803 - RNA, 17 nt, Salmonella typhimurium LT2
aucgcgucugacagcgc

SEQ ID NO: 3766804 - RNA, 19 nt, Salmonella typhimurium LT2
aucgcgucugacagcgcgc

SEQ ID NO: 3766805 - RNA, 12 nt, Salmonella typhimurium LT2
aucgcguuggcu

SEQ ID NO: 3766806 - RNA, 17 nt, Salmonella typhimurium LT2
aucgcuaaacauauacc

SEQ ID NO: 3766807 - RNA, 21 nt, Salmonella typhimurium LT2
aucgcuaaccaggccagaugc

SEQ ID NO: 3766808 - RNA, 13 nt, Salmonella typhimurium LT2
aucgcuaaucagg

SEQ ID NO: 3766809 - RNA, 21 nt, Salmonella typhimurium LT2
aucgcuaugaugacugguaaa

SEQ ID NO: 3766810 - RNA, 13 nt, Salmonella typhimurium LT2
aucgcucaaaaca

SEQ ID NO: 3766811 - RNA, 18 nt, Salmonella typhimurium LT2
aucgcucuugccuggcga

SEQ ID NO: 3766812 - RNA, 15 nt, Salmonella typhimurium LT2
aucgcugcgccagca

SEQ ID NO: 3766813 - RNA, 17 nt, Salmonella typhimurium LT2
aucgcugcgccagcagc

SEQ ID NO: 3766814 - RNA, 18 nt, Salmonella typhimurium LT2
aucgcugcgccagcagcg

SEQ ID NO: 3766815 - RNA, 13 nt, Salmonella typhimurium LT2
aucgcuuaacaac

SEQ ID NO: 3766816 - RNA, 17 nt, Salmonella typhimurium LT2
aucgcuuaacggcccag

SEQ ID NO: 3766817 - RNA, 19 nt, Salmonella typhimurium LT2
aucgcuuacagcauacgcc

SEQ ID NO: 3766818 - RNA, 22 nt, Salmonella typhimurium LT2
aucgcuucaaucagcguggcgu

SEQ ID NO: 3766819 - RNA, 14 nt, Salmonella typhimurium LT2
aucgcuuccagcgc

SEQ ID NO: 3766820 - RNA, 19 nt, Salmonella typhimurium LT2
aucgcuuucgcuuucucuu

SEQ ID NO: 3766821 - RNA, 17 nt, Salmonella typhimurium LT2
aucgcuuugagcagcgc

SEQ ID NO: 3766822 - RNA, 19 nt, Salmonella typhimurium LT2
aucgcuuugagcagcgcca

SEQ ID NO: 3766823 - RNA, 17 nt, Salmonella typhimurium LT2
aucgcuuugcagaaaau

SEQ ID NO: 3766824 - RNA, 13 nt, Salmonella typhimurium LT2
aucggaaaaauag

SEQ ID NO: 3766825 - RNA, 21 nt, Salmonella typhimurium LT2
aucggaaaaauaguggcuggc

SEQ ID NO: 3766826 - RNA, 20 nt, Salmonella typhimurium LT2
aucggaagacuggcgcagca

SEQ ID NO: 3766827 - RNA, 13 nt, Salmonella typhimurium LT2
aucggauccaucg

SEQ ID NO: 3766828 - RNA, 17 nt, Salmonella typhimurium LT2
aucggauuuacagggga

SEQ ID NO: 3766829 - RNA, 17 nt, Salmonella typhimurium LT2
aucggcaaacgccgccu

SEQ ID NO: 3766830 - RNA, 17 nt, Salmonella typhimurium LT2
aucggcaauaucccgcc

SEQ ID NO: 3766831 - RNA, 22 nt, Salmonella typhimurium LT2
aucggcaucuuuaaccgccugc

SEQ ID NO: 3766832 - RNA, 13 nt, Salmonella typhimurium LT2
aucggccagcagg

SEQ ID NO: 3766833 - RNA, 14 nt, Salmonella typhimurium LT2
aucggccugaaugc

SEQ ID NO: 3766834 - RNA, 23 nt, Salmonella typhimurium LT2
aucggcgcguaaguuugcguacu

SEQ ID NO: 3766835 - RNA, 12 nt, Salmonella typhimurium LT2
aucggcguaccg

SEQ ID NO: 3766836 - RNA, 15 nt, Salmonella typhimurium LT2
aucggcgucuggagc

SEQ ID NO: 3766837 - RNA, 19 nt, Salmonella typhimurium LT2
aucggcguuuugcgcgcca

SEQ ID NO: 3766838 - RNA, 22 nt, Salmonella typhimurium LT2
aucggcuauuagcguuuuuacc

SEQ ID NO: 3766839 - RNA, 13 nt, Salmonella typhimurium LT2
aucggcuugccuu

SEQ ID NO: 3766840 - RNA, 16 nt, Salmonella typhimurium LT2
aucggcuugccuucau

SEQ ID NO: 3766841 - RNA, 13 nt, Salmonella typhimurium LT2
aucgggaaucauc

SEQ ID NO: 3766842 - RNA, 14 nt, Salmonella typhimurium LT2
aucgggaucagcgc

SEQ ID NO: 3766843 - RNA, 20 nt, Salmonella typhimurium LT2
aucgggccgcucagcaucgc

SEQ ID NO: 3766844 - RNA, 14 nt, Salmonella typhimurium LT2
aucgggccuccgcg

SEQ ID NO: 3766845 - RNA, 13 nt, Salmonella typhimurium LT2
aucgggccugcuc

SEQ ID NO: 3766846 - RNA, 21 nt, Salmonella typhimurium LT2
aucgggcgggcauuauacgcc

SEQ ID NO: 3766847 - RNA, 23 nt, Salmonella typhimurium LT2
aucgguaggccggauaaggcauu

SEQ ID NO: 3766848 - RNA, 18 nt, Salmonella typhimurium LT2
aucgguaguguuaucgcc

SEQ ID NO: 3766849 - RNA, 21 nt, Salmonella typhimurium LT2
aucgguaguguuaucgccgau

SEQ ID NO: 3766850 - RNA, 22 nt, Salmonella typhimurium LT2
aucggucagagcauaaaaauca

SEQ ID NO: 3766851 - RNA, 22 nt, Salmonella typhimurium LT2
aucggucuccagcaacagcgcg

SEQ ID NO: 3766852 - RNA, 20 nt, Salmonella typhimurium LT2
aucggucugcuucagccacu

SEQ ID NO: 3766853 - RNA, 14 nt, Salmonella typhimurium LT2
aucgguuaauugcc

SEQ ID NO: 3766854 - RNA, 14 nt, Salmonella typhimurium LT2
aucgguuacaauau

SEQ ID NO: 3766855 - RNA, 16 nt, Salmonella typhimurium LT2
aucgguucucugccau

SEQ ID NO: 3766856 - RNA, 13 nt, Salmonella typhimurium LT2
aucguaaaucaaa

SEQ ID NO: 3766857 - RNA, 17 nt, Salmonella typhimurium LT2
aucguauaaauuuuuac

SEQ ID NO: 3766858 - RNA, 23 nt, Salmonella typhimurium LT2
aucguauccggcggcaaaggcau

SEQ ID NO: 3766859 - RNA, 18 nt, Salmonella typhimurium LT2
aucguaugcagccaggcc

SEQ ID NO: 3766860 - RNA, 23 nt, Salmonella typhimurium LT2
aucgucaaaaccaaacagcgaca

SEQ ID NO: 3766861 - RNA, 18 nt, Salmonella typhimurium LT2
aucgucaccaggaugcca

SEQ ID NO: 3766862 - RNA, 16 nt, Salmonella typhimurium LT2
aucgucagccgccagu

SEQ ID NO: 3766863 - RNA, 20 nt, Salmonella typhimurium LT2
aucgucauccauccacggca

SEQ ID NO: 3766864 - RNA, 22 nt, Salmonella typhimurium LT2
aucgucaucggucaguuugccc

SEQ ID NO: 3766865 - RNA, 13 nt, Salmonella typhimurium LT2
aucguccagccau

SEQ ID NO: 3766866 - RNA, 21 nt, Salmonella typhimurium LT2
aucuucaaaaccgcacugcau

SEQ ID NO: 3766867 - RNA, 19 nt, Salmonella typhimurium LT2
aucuucaccgaugcccagc

SEQ ID NO: 3766868 - RNA, 15 nt, Salmonella typhimurium LT2
aucuucagcccguuc

SEQ ID NO: 3766869 - RNA, 14 nt, Salmonella typhimurium LT2
aucuucaucccauc

SEQ ID NO: 3766870 - RNA, 14 nt, Salmonella typhimurium LT2
aucuucauccgcuc

SEQ ID NO: 3766871 - RNA, 21 nt, Salmonella typhimurium LT2
aucuucaucguuacgcagaua

SEQ ID NO: 3766872 - RNA, 16 nt, Salmonella typhimurium LT2
aucuuccacuucauca

SEQ ID NO: 3766873 - RNA, 22 nt, Salmonella typhimurium LT2
aucuuccagcgucgggccgcgc

SEQ ID NO: 3766874 - RNA, 14 nt, Salmonella typhimurium LT2
aucuuccaguugcu

SEQ ID NO: 3766875 - RNA, 12 nt, Salmonella typhimurium LT2
aucuuccgccac

SEQ ID NO: 3766876 - RNA, 21 nt, Salmonella typhimurium LT2
aucuuccguuuuacacggcgu

SEQ ID NO: 3766877 - RNA, 17 nt, Salmonella typhimurium LT2
aucuuccuggcgcugac

SEQ ID NO: 3766878 - RNA, 20 nt, Salmonella typhimurium LT2
aucuucgccaaacacccagc

SEQ ID NO: 3766879 - RNA, 22 nt, Salmonella typhimurium LT2
aucuucgcgguagauucuaucu

SEQ ID NO: 3766880 - RNA, 13 nt, Salmonella typhimurium LT2
aucuucugcugcu

SEQ ID NO: 3766881 - RNA, 11 nt, Salmonella typhimurium LT2
aucuucuuccg

SEQ ID NO: 3766882 - RNA, 22 nt, Salmonella typhimurium LT2
aucuucuuccggcugccagcca

SEQ ID NO: 3766883 - RNA, 17 nt, Salmonella typhimurium LT2
aucuugauaucaucauc

SEQ ID NO: 3766884 - RNA, 17 nt, Salmonella typhimurium LT2
aucuugcuuuauuuuua

SEQ ID NO: 3766885 - RNA, 13 nt, Salmonella typhimurium LT2
aucuuguccucau

SEQ ID NO: 3766886 - RNA, 22 nt, Salmonella typhimurium LT2
aucuuguccucaucauucgguu

SEQ ID NO: 3766887 - RNA, 18 nt, Salmonella typhimurium LT2
aucuuuaaacuuuuuuau

SEQ ID NO: 3766888 - RNA, 21 nt, Salmonella typhimurium LT2
aucuuuacccggcgcaaacuu

SEQ ID NO: 3766889 - RNA, 14 nt, Salmonella typhimurium LT2
aucuuuauccugca

SEQ ID NO: 3766890 - RNA, 14 nt, Salmonella typhimurium LT2
aucuuuccggaacg

SEQ ID NO: 3766891 - RNA, 13 nt, Salmonella typhimurium LT2
aucuuuccuuuuu

SEQ ID NO: 3766892 - RNA, 15 nt, Salmonella typhimurium LT2
aucuuuuaaaaucag

SEQ ID NO: 3766893 - RNA, 14 nt, Salmonella typhimurium LT2
aucuuuuccugaag

SEQ ID NO: 3766894 - RNA, 18 nt, Salmonella typhimurium LT2
aucuuuugcgccuuccag

SEQ ID NO: 3766895 - RNA, 11 nt, Salmonella typhimurium LT2
aucuuuuuccc

SEQ ID NO: 3766896 - RNA, 10 nt, Salmonella typhimurium LT2
augaaaaaaa

SEQ ID NO: 3766897 - RNA, 11 nt, Salmonella typhimurium LT2
augaaaaaaac

SEQ ID NO: 3766898 - RNA, 12 nt, Salmonella typhimurium LT2
augaaaaaaacg

SEQ ID NO: 3766899 - RNA, 15 nt, Salmonella typhimurium LT2
augaaaaauccggca

SEQ ID NO: 3766900 - RNA, 15 nt, Salmonella typhimurium LT2
augaaaauaugaugc

SEQ ID NO: 3766901 - RNA, 22 nt, Salmonella typhimurium LT2
augaaaauaugaugcuaucuuu

SEQ ID NO: 3766902 - RNA, 19 nt, Salmonella typhimurium LT2
augaaaccgcccugcaggc

SEQ ID NO: 3766903 - RNA, 14 nt, Salmonella typhimurium LT2
augaaacgacacag

SEQ ID NO: 3766904 - RNA, 17 nt, Salmonella typhimurium LT2
augaaacgcauccagcc

SEQ ID NO: 3766905 - RNA, 11 nt, Salmonella typhimurium LT2
augaaauaauc

SEQ ID NO: 3766906 - RNA, 15 nt, Salmonella typhimurium LT2
augaaaucacccaga

SEQ ID NO: 3766907 - RNA, 22 nt, Salmonella typhimurium LT2
augaaaucgccuguuaauggua

SEQ ID NO: 3766908 - RNA, 21 nt, Salmonella typhimurium LT2
augaaauucuugcccgcugag

SEQ ID NO: 3766909 - RNA, 15 nt, Salmonella typhimurium LT2
augaacucaauccau

SEQ ID NO: 3766910 - RNA, 14 nt, Salmonella typhimurium LT2
augaagaaaauacu

SEQ ID NO: 3766911 - RNA, 15 nt, Salmonella typhimurium LT2
augaagcauaaaaag

SEQ ID NO: 3766912 - RNA, 16 nt, Salmonella typhimurium LT2
augaagcauaaaaaga

SEQ ID NO: 3766913 - RNA, 11 nt, Salmonella typhimurium LT2
augaagccuua

SEQ ID NO: 3766914 - RNA, 23 nt, Salmonella typhimurium LT2
augaagccuuagcgggaggcggu

SEQ ID NO: 3766915 - RNA, 21 nt, Salmonella typhimurium LT2
augaagcuacagggaauaugc

SEQ ID NO: 3766916 - RNA, 14 nt, Salmonella typhimurium LT2
augaagcucaacau

SEQ ID NO: 3766917 - RNA, 19 nt, Salmonella typhimurium LT2
augaaggagagcauuuuuu

SEQ ID NO: 3766918 - RNA, 19 nt, Salmonella typhimurium LT2
augaaggauuguacuuauu

SEQ ID NO: 3766919 - RNA, 17 nt, Salmonella typhimurium LT2
augaauaaaaaacaaga

SEQ ID NO: 3766920 - RNA, 21 nt, Salmonella typhimurium LT2
augaauaaaaaacaagauuaa

SEQ ID NO: 3766921 - RNA, 15 nt, Salmonella typhimurium LT2
augaauaaucucugc

SEQ ID NO: 3766922 - RNA, 23 nt, Salmonella typhimurium LT2
augaauaccaaaucucaagagug

SEQ ID NO: 3766923 - RNA, 23 nt, Salmonella typhimurium LT2
augaauaccaagucucaagagug

SEQ ID NO: 3766924 - RNA, 18 nt, Salmonella typhimurium LT2
augaauacgcuccagcug

SEQ ID NO: 3766925 - RNA, 14 nt, Salmonella typhimurium LT2
augaauaucaaacc

SEQ ID NO: 3766926 - RNA, 17 nt, Salmonella typhimurium LT2
augaaugacgagcaggu

SEQ ID NO: 3766927 - RNA, 11 nt, Salmonella typhimurium LT2
augaaugacug

SEQ ID NO: 3766928 - RNA, 20 nt, Salmonella typhimurium LT2
augaauuccugcggugguaa

SEQ ID NO: 3766929 - RNA, 19 nt, Salmonella typhimurium LT2
augaauuucuucaucccag

SEQ ID NO: 3766930 - RNA, 12 nt, Salmonella typhimurium LT2
augacaaauaaa

SEQ ID NO: 3766931 - RNA, 13 nt, Salmonella typhimurium LT2
augacaacauaaa

SEQ ID NO: 3766932 - RNA, 20 nt, Salmonella typhimurium LT2
augacacaucaccuccagcg

SEQ ID NO: 3766933 - RNA, 15 nt, Salmonella typhimurium LT2
augacacuuuauucu

SEQ ID NO: 3766934 - RNA, 21 nt, Salmonella typhimurium LT2
augacagaguccacagcccgg

SEQ ID NO: 3766935 - RNA, 14 nt, Salmonella typhimurium LT2
augacauucccauu

SEQ ID NO: 3766936 - RNA, 19 nt, Salmonella typhimurium LT2
augaccaccgcaucggcau

SEQ ID NO: 3766937 - RNA, 13 nt, Salmonella typhimurium LT2
augaccagaacau

SEQ ID NO: 3766938 - RNA, 13 nt, Salmonella typhimurium LT2
augaccagcgccg

SEQ ID NO: 3766939 - RNA, 18 nt, Salmonella typhimurium LT2
augacccccagauagccc

SEQ ID NO: 3766940 - RNA, 19 nt, Salmonella typhimurium LT2
augaccgcuuucgccuggu

SEQ ID NO: 3766941 - RNA, 20 nt, Salmonella typhimurium LT2
augaccguugauucagcguc

SEQ ID NO: 3766942 - RNA, 13 nt, Salmonella typhimurium LT2
augacgaacagga

SEQ ID NO: 3766943 - RNA, 14 nt, Salmonella typhimurium LT2
augacgaccucauc

SEQ ID NO: 3766944 - RNA, 14 nt, Salmonella typhimurium LT2
augacgcaggcgca

SEQ ID NO: 3766945 - RNA, 17 nt, Salmonella typhimurium LT2
augacgcuauuguugau

SEQ ID NO: 3766946 - RNA, 16 nt, Salmonella typhimurium LT2
augacgcuugagcgcc

SEQ ID NO: 3766947 - RNA, 14 nt, Salmonella typhimurium LT2
augacggaagaguu

SEQ ID NO: 3766948 - RNA, 20 nt, Salmonella typhimurium LT2
augacggacgcagaccaaaa

SEQ ID NO: 3766949 - RNA, 14 nt, Salmonella typhimurium LT2
augacggcaaagcc

SEQ ID NO: 3766950 - RNA, 18 nt, Salmonella typhimurium LT2
augacggcgcguuaucgu

SEQ ID NO: 3766951 - RNA, 13 nt, Salmonella typhimurium LT2
augacgggggcga

SEQ ID NO: 3766952 - RNA, 19 nt, Salmonella typhimurium LT2
augacgggggcgaucagca

SEQ ID NO: 3766953 - RNA, 19 nt, Salmonella typhimurium LT2
augacgucuaccagcucuc

SEQ ID NO: 3766954 - RNA, 13 nt, Salmonella typhimurium LT2
augacguucaauu

SEQ ID NO: 3766955 - RNA, 14 nt, Salmonella typhimurium LT2
augacguucaauuc

SEQ ID NO: 3766956 - RNA, 14 nt, Salmonella typhimurium LT2
augacuucaucgcc

SEQ ID NO: 3766957 - RNA, 22 nt, Salmonella typhimurium LT2
augacuuuuuauauaagcauau

SEQ ID NO: 3766958 - RNA, 13 nt, Salmonella typhimurium LT2
augagaaaaggaa

SEQ ID NO: 3766959 - RNA, 18 nt, Salmonella typhimurium LT2
augagaaaaggaagaaua

SEQ ID NO: 3766960 - RNA, 12 nt, Salmonella typhimurium LT2
augagaagaaaa

SEQ ID NO: 3766961 - RNA, 12 nt, Salmonella typhimurium LT2
augagacaaaac

SEQ ID NO: 3766962 - RNA, 14 nt, Salmonella typhimurium LT2
augagauaauaaau

SEQ ID NO: 3766963 - RNA, 19 nt, Salmonella typhimurium LT2
augagaugcaggccaagca

SEQ ID NO: 3766964 - RNA, 14 nt, Salmonella typhimurium LT2
augagcaaaaugcu

SEQ ID NO: 3766965 - RNA, 18 nt, Salmonella typhimurium LT2
augagcaaaaugcucauu

SEQ ID NO: 3766966 - RNA, 22 nt, Salmonella typhimurium LT2
augagcaaaguaaaacaagccg

SEQ ID NO: 3766967 - RNA, 22 nt, Salmonella typhimurium LT2
augagcgcgaaaucaaagaccu

SEQ ID NO: 3766968 - RNA, 18 nt, Salmonella typhimurium LT2
augagcgguaagucaacc

SEQ ID NO: 3766969 - RNA, 17 nt, Salmonella typhimurium LT2
augagcucaaauaugau

SEQ ID NO: 3766970 - RNA, 12 nt, Salmonella typhimurium LT2
augaguaaaauu

SEQ ID NO: 3766971 - RNA, 17 nt, Salmonella typhimurium LT2
augccgcgucaggagcg

SEQ ID NO: 3766972 - RNA, 20 nt, Salmonella typhimurium LT2
augccggccugauauccacg

SEQ ID NO: 3766973 - RNA, 16 nt, Salmonella typhimurium LT2
augccgggcagacgac

SEQ ID NO: 3766974 - RNA, 23 nt, Salmonella typhimurium LT2
augccggggcgcuucgcuugccc

SEQ ID NO: 3766975 - RNA, 23 nt, Salmonella typhimurium LT2
augccggguggcggcugcgccuu

SEQ ID NO: 3766976 - RNA, 16 nt, Salmonella typhimurium LT2
augccguaccugcuga

SEQ ID NO: 3766977 - RNA, 19 nt, Salmonella typhimurium LT2
augccgucauucugguagu

SEQ ID NO: 3766978 - RNA, 14 nt, Salmonella typhimurium LT2
augccgugaguaau

SEQ ID NO: 3766979 - RNA, 15 nt, Salmonella typhimurium LT2
augccuaacccuuuu

SEQ ID NO: 3766980 - RNA, 20 nt, Salmonella typhimurium LT2
augccuaacguguuaucgcu

SEQ ID NO: 3766981 - RNA, 18 nt, Salmonella typhimurium LT2
augccugaaagcaaguau

SEQ ID NO: 3766982 - RNA, 16 nt, Salmonella typhimurium LT2
augccugacgccacca

SEQ ID NO: 3766983 - RNA, 14 nt, Salmonella typhimurium LT2
augccugccgggcc

SEQ ID NO: 3766984 - RNA, 20 nt, Salmonella typhimurium LT2
augccugcgcauccucuuuc

SEQ ID NO: 3766985 - RNA, 17 nt, Salmonella typhimurium LT2
augccuggggucgucag

SEQ ID NO: 3766986 - RNA, 17 nt, Salmonella typhimurium LT2
augccugucaucaucaa

SEQ ID NO: 3766987 - RNA, 19 nt, Salmonella typhimurium LT2
augccuguguaucgcccug

SEQ ID NO: 3766988 - RNA, 21 nt, Salmonella typhimurium LT2
augccuguguaucgcccugcc

SEQ ID NO: 3766989 - RNA, 21 nt, Salmonella typhimurium LT2
augccuuauccggccugcagg

SEQ ID NO: 3766990 - RNA, 22 nt, Salmonella typhimurium LT2
augccuuauccggccugcaggc

SEQ ID NO: 3766991 - RNA, 21 nt, Salmonella typhimurium LT2
augccuucauaaugaauacgc

SEQ ID NO: 3766992 - RNA, 23 nt, Salmonella typhimurium LT2
augccuugcgaauggagaagcgc

SEQ ID NO: 3766993 - RNA, 18 nt, Salmonella typhimurium LT2
augccuuugguuuccccg

SEQ ID NO: 3766994 - RNA, 17 nt, Salmonella typhimurium LT2
augccuuuuucaacagc

SEQ ID NO: 3766995 - RNA, 19 nt, Salmonella typhimurium LT2
augccuuuuucaacagcac

SEQ ID NO: 3766996 - RNA, 15 nt, Salmonella typhimurium LT2
augcgaacgauacca

SEQ ID NO: 3766997 - RNA, 14 nt, Salmonella typhimurium LT2
augcgaagguggcg

SEQ ID NO: 3766998 - RNA, 16 nt, Salmonella typhimurium LT2
augcgaauaacaucau

SEQ ID NO: 3766999 - RNA, 14 nt, Salmonella typhimurium LT2
augcgaauccggcg

SEQ ID NO: 3767000 - RNA, 16 nt, Salmonella typhimurium LT2
augcgacgcccaacca

SEQ ID NO: 3767001 - RNA, 13 nt, Salmonella typhimurium LT2
augcgacgcgcac

SEQ ID NO: 3767002 - RNA, 23 nt, Salmonella typhimurium LT2
augcgacgcgcucaccuccgcca

SEQ ID NO: 3767003 - RNA, 15 nt, Salmonella typhimurium LT2
augcgacugaaaauc

SEQ ID NO: 3767004 - RNA, 16 nt, Salmonella typhimurium LT2
augcgauaaucggcgu

SEQ ID NO: 3767005 - RNA, 21 nt, Salmonella typhimurium LT2
augcgauacguaggccugaua

SEQ ID NO: 3767006 - RNA, 14 nt, Salmonella typhimurium LT2
augcgaugaucuug

SEQ ID NO: 3767007 - RNA, 14 nt, Salmonella typhimurium LT2
augcgcaaaucaaa

SEQ ID NO: 3767008 - RNA, 24 nt, Salmonella typhimurium LT2
augcgcaaggccguuauccagucg

SEQ ID NO: 3767009 - RNA, 19 nt, Salmonella typhimurium LT2
augcgccagccagucgcca

SEQ ID NO: 3767010 - RNA, 12 nt, Salmonella typhimurium LT2
augcgccaggca

SEQ ID NO: 3767011 - RNA, 18 nt, Salmonella typhimurium LT2
augcgccaguucagcguc

SEQ ID NO: 3767012 - RNA, 13 nt, Salmonella typhimurium LT2
augcgccauccca

SEQ ID NO: 3767013 - RNA, 19 nt, Salmonella typhimurium LT2
augcgccaucccaugcacc

SEQ ID NO: 3767014 - RNA, 13 nt, Salmonella typhimurium LT2
augcgccugcaau

SEQ ID NO: 3767015 - RNA, 21 nt, Salmonella typhimurium LT2
augcgcgcgugaccccaggca

SEQ ID NO: 3767016 - RNA, 12 nt, Salmonella typhimurium LT2
augcgcggcugc

SEQ ID NO: 3767017 - RNA, 18 nt, Salmonella typhimurium LT2
augcgcgucaggccaggg

SEQ ID NO: 3767018 - RNA, 21 nt, Salmonella typhimurium LT2
augcgcgucccggcagugcau

SEQ ID NO: 3767019 - RNA, 16 nt, Salmonella typhimurium LT2
augcgcguugccgcca

SEQ ID NO: 3767020 - RNA, 16 nt, Salmonella typhimurium LT2
augcgcguuuagcgcc

SEQ ID NO: 3767021 - RNA, 20 nt, Salmonella typhimurium LT2
augcgcguuuagcgccagca

SEQ ID NO: 3767022 - RNA, 16 nt, Salmonella typhimurium LT2
augcgcuagcuggcag

SEQ ID NO: 3767023 - RNA, 23 nt, Salmonella typhimurium LT2
augcgcuccagcuucaucaucag

SEQ ID NO: 3767024 - RNA, 17 nt, Salmonella typhimurium LT2
augcgcugcacaaucgc

SEQ ID NO: 3767025 - RNA, 13 nt, Salmonella typhimurium LT2
augcgcuuuccgc

SEQ ID NO: 3767026 - RNA, 23 nt, Salmonella typhimurium LT2
augcggaagguucgccuuccgca

SEQ ID NO: 3767027 - RNA, 16 nt, Salmonella typhimurium LT2
augcggacgcugacgc

SEQ ID NO: 3767028 - RNA, 21 nt, Salmonella typhimurium LT2
augcggcugacgauacucagc

SEQ ID NO: 3767029 - RNA, 18 nt, Salmonella typhimurium LT2
augcgggagaucggcugu

SEQ ID NO: 3767030 - RNA, 18 nt, Salmonella typhimurium LT2
augcggggguuguuuuac

SEQ ID NO: 3767031 - RNA, 21 nt, Salmonella typhimurium LT2
augcgguuguucuuccagcgu

SEQ ID NO: 3767032 - RNA, 21 nt, Salmonella typhimurium LT2
augcguaccgcuaucgccaaa

SEQ ID NO: 3767033 - RNA, 22 nt, Salmonella typhimurium LT2
augcgucagcgcggcuuccagu

SEQ ID NO: 3767034 - RNA, 21 nt, Salmonella typhimurium LT2
augcgucggcaccauucccac

SEQ ID NO: 3767035 - RNA, 17 nt, Salmonella typhimurium LT2
augcgucucaagcuuuu

SEQ ID NO: 3767036 - RNA, 15 nt, Salmonella typhimurium LT2
augcgugcgccgcga

SEQ ID NO: 3767037 - RNA, 20 nt, Salmonella typhimurium LT2
augcgugcgccgcgagugca

SEQ ID NO: 3767038 - RNA, 21 nt, Salmonella typhimurium LT2
augcguguucagguuggcgac

SEQ ID NO: 3767039 - RNA, 12 nt, Salmonella typhimurium LT2
augcguucaaaa

SEQ ID NO: 3767040 - RNA, 19 nt, Salmonella typhimurium LT2
augcguuggcucgcugcca

SEQ ID NO: 3767041 - RNA, 17 nt, Salmonella typhimurium LT2
augcguuguaccguuuu

SEQ ID NO: 3767042 - RNA, 22 nt, Salmonella typhimurium LT2
augcguuguaccguuuuccaga

SEQ ID NO: 3767043 - RNA, 18 nt, Salmonella typhimurium LT2
augcuaacgcccucucuc

SEQ ID NO: 3767044 - RNA, 18 nt, Salmonella typhimurium LT2
augcuacacgccccuuuc

SEQ ID NO: 3767045 - RNA, 22 nt, Salmonella typhimurium LT2
augcuaucgguaguguuaucgc

SEQ ID NO: 3767046 - RNA, 14 nt, Salmonella typhimurium LT2
augcuauucagcag

SEQ ID NO: 3767047 - RNA, 16 nt, Salmonella typhimurium LT2
augcucaacuuccaga

SEQ ID NO: 3767048 - RNA, 19 nt, Salmonella typhimurium LT2
augcucaccgcgaauauac

SEQ ID NO: 3767049 - RNA, 15 nt, Salmonella typhimurium LT2
augcucauuauuugg

SEQ ID NO: 3767050 - RNA, 23 nt, Salmonella typhimurium LT2
augcucauugccuuucaauacuu

SEQ ID NO: 3767051 - RNA, 17 nt, Salmonella typhimurium LT2
augcucauuuugauaaa

SEQ ID NO: 3767052 - RNA, 21 nt, Salmonella typhimurium LT2
augcuccaguuguuccagcag

SEQ ID NO: 3767053 - RNA, 14 nt, Salmonella typhimurium LT2
augcuccuuccguc

SEQ ID NO: 3767054 - RNA, 13 nt, Salmonella typhimurium LT2
augcugaauagcc

SEQ ID NO: 3767055 - RNA, 15 nt, Salmonella typhimurium LT2
augcugaauagccag

SEQ ID NO: 3767056 - RNA, 21 nt, Salmonella typhimurium LT2
augcugacgacauucagcaca

SEQ ID NO: 3767057 - RNA, 19 nt, Salmonella typhimurium LT2
augcugacgcguuuuuuca

SEQ ID NO: 3767058 - RNA, 18 nt, Salmonella typhimurium LT2
augcugacggauucuucc

SEQ ID NO: 3767059 - RNA, 19 nt, Salmonella typhimurium LT2
augcugauacaaagccgac

SEQ ID NO: 3767060 - RNA, 17 nt, Salmonella typhimurium LT2
augcugauuugccagau

SEQ ID NO: 3767061 - RNA, 17 nt, Salmonella typhimurium LT2
augcugcaccacaccgg

SEQ ID NO: 3767062 - RNA, 12 nt, Salmonella typhimurium LT2
augcugccagca

SEQ ID NO: 3767063 - RNA, 18 nt, Salmonella typhimurium LT2
augcugcgccagccauaa

SEQ ID NO: 3767064 - RNA, 21 nt, Salmonella typhimurium LT2
augcugcguacaaucgcguuu

SEQ ID NO: 3767065 - RNA, 20 nt, Salmonella typhimurium LT2
augcuggugaagacgcugca

SEQ ID NO: 3767066 - RNA, 15 nt, Salmonella typhimurium LT2
augcuguuguagaau

SEQ ID NO: 3767067 - RNA, 16 nt, Salmonella typhimurium LT2
augcuuccggcagguu

SEQ ID NO: 3767068 - RNA, 15 nt, Salmonella typhimurium LT2
augcuuuaaaugccu

SEQ ID NO: 3767069 - RNA, 22 nt, Salmonella typhimurium LT2
augcuuuccagccaugccagca

SEQ ID NO: 3767070 - RNA, 12 nt, Salmonella typhimurium LT2
augcuuuccggg

SEQ ID NO: 3767071 - RNA, 18 nt, Salmonella typhimurium LT2
augcuuucgcgauaauca

SEQ ID NO: 3767072 - RNA, 14 nt, Salmonella typhimurium LT2
augcuuuuuacauu

SEQ ID NO: 3767073 - RNA, 17 nt, Salmonella typhimurium LT2
auggaacuuauccacaa

SEQ ID NO: 3767074 - RNA, 22 nt, Salmonella typhimurium LT2
auguacgaaagcgcgaucaauu

SEQ ID NO: 3767075 - RNA, 18 nt, Salmonella typhimurium LT2
auguacggcgguuucaug

SEQ ID NO: 3767076 - RNA, 18 nt, Salmonella typhimurium LT2
auguacucauccauuucc

SEQ ID NO: 3767077 - RNA, 20 nt, Salmonella typhimurium LT2
auguagagcggauaagcgca

SEQ ID NO: 3767078 - RNA, 18 nt, Salmonella typhimurium LT2
auguagcgcggcagcgcg

SEQ ID NO: 3767079 - RNA, 15 nt, Salmonella typhimurium LT2
auguaggguggcgcc

SEQ ID NO: 3767080 - RNA, 14 nt, Salmonella typhimurium LT2
auguaguaaauagg

SEQ ID NO: 3767081 - RNA, 20 nt, Salmonella typhimurium LT2
auguaucgcgcggauuccgc

SEQ ID NO: 3767082 - RNA, 17 nt, Salmonella typhimurium LT2
auguauuuaauuuuucc

SEQ ID NO: 3767083 - RNA, 18 nt, Salmonella typhimurium LT2
auguauuuaauuuuuccu

SEQ ID NO: 3767084 - RNA, 15 nt, Salmonella typhimurium LT2
auguauuucagacuu

SEQ ID NO: 3767085 - RNA, 18 nt, Salmonella typhimurium LT2
augucaagguggugcucu

SEQ ID NO: 3767086 - RNA, 16 nt, Salmonella typhimurium LT2
augucauauuugugag

SEQ ID NO: 3767087 - RNA, 17 nt, Salmonella typhimurium LT2
augucaucaagauuuug

SEQ ID NO: 3767088 - RNA, 20 nt, Salmonella typhimurium LT2
augucccaucguaacgccgu

SEQ ID NO: 3767089 - RNA, 13 nt, Salmonella typhimurium LT2
auguccccugaca

SEQ ID NO: 3767090 - RNA, 14 nt, Salmonella typhimurium LT2
augucccgauauug

SEQ ID NO: 3767091 - RNA, 15 nt, Salmonella typhimurium LT2
auguccgccaauucc

SEQ ID NO: 3767092 - RNA, 19 nt, Salmonella typhimurium LT2
auguccgccuaccagcaca

SEQ ID NO: 3767093 - RNA, 20 nt, Salmonella typhimurium LT2
auguccgccuaccagcacau

SEQ ID NO: 3767094 - RNA, 20 nt, Salmonella typhimurium LT2
auguccguuuuuucugucgu

SEQ ID NO: 3767095 - RNA, 20 nt, Salmonella typhimurium LT2
auguccugccgcaaacgccu

SEQ ID NO: 3767096 - RNA, 16 nt, Salmonella typhimurium LT2
augucugcgucgggug

SEQ ID NO: 3767097 - RNA, 18 nt, Salmonella typhimurium LT2
augucuggugcagcaagc

SEQ ID NO: 3767098 - RNA, 20 nt, Salmonella typhimurium LT2
augucuuuuucagucaucau

SEQ ID NO: 3767099 - RNA, 13 nt, Salmonella typhimurium LT2
augugaauccagg

SEQ ID NO: 3767100 - RNA, 16 nt, Salmonella typhimurium LT2
augugaauccaggcca

SEQ ID NO: 3767101 - RNA, 13 nt, Salmonella typhimurium LT2
augugacauuuuc

SEQ ID NO: 3767102 - RNA, 14 nt, Salmonella typhimurium LT2
augugagcgcaucc

SEQ ID NO: 3767103 - RNA, 17 nt, Salmonella typhimurium LT2
augugcaggcuuuuuca

SEQ ID NO: 3767104 - RNA, 14 nt, Salmonella typhimurium LT2
augugcaucggcac

SEQ ID NO: 3767105 - RNA, 14 nt, Salmonella typhimurium LT2
augugcgccagccu

SEQ ID NO: 3767106 - RNA, 23 nt, Salmonella typhimurium LT2
augugcggagaagacgccgccgc

SEQ ID NO: 3767107 - RNA, 17 nt, Salmonella typhimurium LT2
augugcucguuggccug

SEQ ID NO: 3767108 - RNA, 11 nt, Salmonella typhimurium LT2
augugcugggg

SEQ ID NO: 3767109 - RNA, 21 nt, Salmonella typhimurium LT2
augugcuuucaucgccgcgac

SEQ ID NO: 3767110 - RNA, 20 nt, Salmonella typhimurium LT2
auguggguauccacgccugg

SEQ ID NO: 3767111 - RNA, 13 nt, Salmonella typhimurium LT2
augugguauuuuc

SEQ ID NO: 3767112 - RNA, 16 nt, Salmonella typhimurium LT2
auguguaucuugcuuu

SEQ ID NO: 3767113 - RNA, 17 nt, Salmonella typhimurium LT2
auguuaaaagagaaaaa

SEQ ID NO: 3767114 - RNA, 22 nt, Salmonella typhimurium LT2
auguuaaauacgccgccagcaa

SEQ ID NO: 3767115 - RNA, 19 nt, Salmonella typhimurium LT2
auguuaacgucgucauuca

SEQ ID NO: 3767116 - RNA, 18 nt, Salmonella typhimurium LT2
auguuagcauuauuuuua

SEQ ID NO: 3767117 - RNA, 23 nt, Salmonella typhimurium LT2
auguucagcgaccugcagcucca

SEQ ID NO: 3767118 - RNA, 17 nt, Salmonella typhimurium LT2
auguucauaccggauau

SEQ ID NO: 3767119 - RNA, 23 nt, Salmonella typhimurium LT2
auguuccuggacguggguuucaa

SEQ ID NO: 3767120 - RNA, 14 nt, Salmonella typhimurium LT2
auguucgaacaugc

SEQ ID NO: 3767121 - RNA, 20 nt, Salmonella typhimurium LT2
auguucgcguucuucuuccc

SEQ ID NO: 3767122 - RNA, 21 nt, Salmonella typhimurium LT2
auguucggguaaacgcugcgc

SEQ ID NO: 3767123 - RNA, 14 nt, Salmonella typhimurium LT2
auguucuaacagau

SEQ ID NO: 3767124 - RNA, 21 nt, Salmonella typhimurium LT2
auguucuccucugaaaaauau

SEQ ID NO: 3767125 - RNA, 17 nt, Salmonella typhimurium LT2
auguugagcaaugggaa

SEQ ID NO: 3767126 - RNA, 21 nt, Salmonella typhimurium LT2
auguugauacagaaaaccggc

SEQ ID NO: 3767127 - RNA, 21 nt, Salmonella typhimurium LT2
auguugaucguaaaaugaaaa

SEQ ID NO: 3767128 - RNA, 21 nt, Salmonella typhimurium LT2
auguugccaugauccaucucg

SEQ ID NO: 3767129 - RNA, 17 nt, Salmonella typhimurium LT2
auguugcguaaauaaau

SEQ ID NO: 3767130 - RNA, 19 nt, Salmonella typhimurium LT2
auguugcguaaauaaaugc

SEQ ID NO: 3767131 - RNA, 14 nt, Salmonella typhimurium LT2
auguugcugcugcg

SEQ ID NO: 3767132 - RNA, 20 nt, Salmonella typhimurium LT2
auguuggauugcauccaacu

SEQ ID NO: 3767133 - RNA, 15 nt, Salmonella typhimurium LT2
auguuguuccagagu

SEQ ID NO: 3767134 - RNA, 17 nt, Salmonella typhimurium LT2
auguuucuguauuuucu

SEQ ID NO: 3767135 - RNA, 15 nt, Salmonella typhimurium LT2
auguuugccacgcca

SEQ ID NO: 3767136 - RNA, 15 nt, Salmonella typhimurium LT2
auguuugccgucauc

SEQ ID NO: 3767137 - RNA, 17 nt, Salmonella typhimurium LT2
auguuuucagcauuaau

SEQ ID NO: 3767138 - RNA, 18 nt, Salmonella typhimurium LT2
auguuuuuaucagcuugc

SEQ ID NO: 3767139 - RNA, 17 nt, Salmonella typhimurium LT2
auguuuuuaucaugcug

SEQ ID NO: 3767140 - RNA, 20 nt, Salmonella typhimurium LT2
auuaaaaccauugcuaaaaa

SEQ ID NO: 3767141 - RNA, 19 nt, Salmonella typhimurium LT2
auuaaaacucuccaugcca

SEQ ID NO: 3767142 - RNA, 17 nt, Salmonella typhimurium LT2
auuaaaauuauccacaa

SEQ ID NO: 3767143 - RNA, 16 nt, Salmonella typhimurium LT2
auuaaaauuguaauaa

SEQ ID NO: 3767144 - RNA, 16 nt, Salmonella typhimurium LT2
auuaaacuuucaugaa

SEQ ID NO: 3767145 - RNA, 17 nt, Salmonella typhimurium LT2
auuaaauaacaaaugaa

SEQ ID NO: 3767146 - RNA, 21 nt, Salmonella typhimurium LT2
auuaaaucagaugacaaugac

SEQ ID NO: 3767147 - RNA, 11 nt, Salmonella typhimurium LT2
auuaaaucauc

SEQ ID NO: 3767148 - RNA, 22 nt, Salmonella typhimurium LT2
auuaaaugacgcccugcgccag

SEQ ID NO: 3767149 - RNA, 18 nt, Salmonella typhimurium LT2
auuaaaugcgccagcggc

SEQ ID NO: 3767150 - RNA, 16 nt, Salmonella typhimurium LT2
auuaaauguuugcuuu

SEQ ID NO: 3767151 - RNA, 16 nt, Salmonella typhimurium LT2
auuaaauuuauacuca

SEQ ID NO: 3767152 - RNA, 17 nt, Salmonella typhimurium LT2
auuaacgacauuuuugc

SEQ ID NO: 3767153 - RNA, 19 nt, Salmonella typhimurium LT2
auuaacgggcguugcucaa

SEQ ID NO: 3767154 - RNA, 23 nt, Salmonella typhimurium LT2
auuaacguuuguagaugaacucg

SEQ ID NO: 3767155 - RNA, 22 nt, Salmonella typhimurium LT2
auuaacuauugacgaauagcug

SEQ ID NO: 3767156 - RNA, 12 nt, Salmonella typhimurium LT2
auuaacugcacu

SEQ ID NO: 3767157 - RNA, 21 nt, Salmonella typhimurium LT2
auuaacugcacuuucugcacu

SEQ ID NO: 3767158 - RNA, 14 nt, Salmonella typhimurium LT2
auuaagcagacugc

SEQ ID NO: 3767159 - RNA, 13 nt, Salmonella typhimurium LT2
auuaagcaggccg

SEQ ID NO: 3767160 - RNA, 16 nt, Salmonella typhimurium LT2
auuaagccuuuuuaaa

SEQ ID NO: 3767161 - RNA, 19 nt, Salmonella typhimurium LT2
auuaagccuuuuuaaauau

SEQ ID NO: 3767162 - RNA, 22 nt, Salmonella typhimurium LT2
auuaagccuuuuuaaauauuaa

SEQ ID NO: 3767163 - RNA, 22 nt, Salmonella typhimurium LT2
auuaaggccggcauuuuauuca

SEQ ID NO: 3767164 - RNA, 17 nt, Salmonella typhimurium LT2
auuaagggacgguaaau

SEQ ID NO: 3767165 - RNA, 14 nt, Salmonella typhimurium LT2
auuaaguugaugaa

SEQ ID NO: 3767166 - RNA, 17 nt, Salmonella typhimurium LT2
auuaaguuuuuuuaaaa

SEQ ID NO: 3767167 - RNA, 20 nt, Salmonella typhimurium LT2
auuaauaaccaauaauugcc

SEQ ID NO: 3767168 - RNA, 23 nt, Salmonella typhimurium LT2
auuaauaaccccagcugcggcau

SEQ ID NO: 3767169 - RNA, 22 nt, Salmonella typhimurium LT2
auuaauacaggccagcauugau

SEQ ID NO: 3767170 - RNA, 13 nt, Salmonella typhimurium LT2
auuaauauaaucc

SEQ ID NO: 3767171 - RNA, 22 nt, Salmonella typhimurium LT2
auuaaucacaaugucaucaaga

SEQ ID NO: 3767172 - RNA, 23 nt, Salmonella typhimurium LT2
auuaaucacaaugucaucaagau

SEQ ID NO: 3767173 - RNA, 18 nt, Salmonella typhimurium LT2
auuaaucccaacccgacc

SEQ ID NO: 3767174 - RNA, 14 nt, Salmonella typhimurium LT2
auuaauccugcgcu

SEQ ID NO: 3767175 - RNA, 12 nt, Salmonella typhimurium LT2
auuaaucgccag

SEQ ID NO: 3767176 - RNA, 19 nt, Salmonella typhimurium LT2
auuaaugccgcaauguccc

SEQ ID NO: 3767177 - RNA, 18 nt, Salmonella typhimurium LT2
auuaaugcuccaauaaau

SEQ ID NO: 3767178 - RNA, 12 nt, Salmonella typhimurium LT2
auucauauugcc

SEQ ID NO: 3767179 - RNA, 19 nt, Salmonella typhimurium LT2
auucauauugcccaucgcg

SEQ ID NO: 3767180 - RNA, 15 nt, Salmonella typhimurium LT2
auucaucaucuuguc

SEQ ID NO: 3767181 - RNA, 16 nt, Salmonella typhimurium LT2
auucaucaucuugucc

SEQ ID NO: 3767182 - RNA, 18 nt, Salmonella typhimurium LT2
auucaucgacaaauacua

SEQ ID NO: 3767183 - RNA, 19 nt, Salmonella typhimurium LT2
auucaugauacccagcguc

SEQ ID NO: 3767184 - RNA, 19 nt, Salmonella typhimurium LT2
auucaugguacucaacauc

SEQ ID NO: 3767185 - RNA, 20 nt, Salmonella typhimurium LT2
auucaugguacucaacauca

SEQ ID NO: 3767186 - RNA, 21 nt, Salmonella typhimurium LT2
auucaugguacucaacaucau

SEQ ID NO: 3767187 - RNA, 20 nt, Salmonella typhimurium LT2
auucaugguuccgccguuaa

SEQ ID NO: 3767188 - RNA, 14 nt, Salmonella typhimurium LT2
auucauuauaaaac

SEQ ID NO: 3767189 - RNA, 15 nt, Salmonella typhimurium LT2
auucauuauaaaaca

SEQ ID NO: 3767190 - RNA, 20 nt, Salmonella typhimurium LT2
auucauuauaaaacauaaag

SEQ ID NO: 3767191 - RNA, 15 nt, Salmonella typhimurium LT2
auucauucccauacu

SEQ ID NO: 3767192 - RNA, 19 nt, Salmonella typhimurium LT2
auucauugucuuuuucuca

SEQ ID NO: 3767193 - RNA, 21 nt, Salmonella typhimurium LT2
auuccagaagcgcuuugccaa

SEQ ID NO: 3767194 - RNA, 16 nt, Salmonella typhimurium LT2
auuccagauagcgcug

SEQ ID NO: 3767195 - RNA, 22 nt, Salmonella typhimurium LT2
auuccagauagcgcugcgccag

SEQ ID NO: 3767196 - RNA, 19 nt, Salmonella typhimurium LT2
auuccagaugucaguaaca

SEQ ID NO: 3767197 - RNA, 23 nt, Salmonella typhimurium LT2
auuccagccacacgacgguauug

SEQ ID NO: 3767198 - RNA, 18 nt, Salmonella typhimurium LT2
auuccagggcauuuuuuc

SEQ ID NO: 3767199 - RNA, 22 nt, Salmonella typhimurium LT2
auuccagggcauuuuuuccagu

SEQ ID NO: 3767200 - RNA, 19 nt, Salmonella typhimurium LT2
auuccaguagcgcgcccau

SEQ ID NO: 3767201 - RNA, 14 nt, Salmonella typhimurium LT2
auuccaucaaaagc

SEQ ID NO: 3767202 - RNA, 23 nt, Salmonella typhimurium LT2
auuccaucauguuaaugauuccg

SEQ ID NO: 3767203 - RNA, 19 nt, Salmonella typhimurium LT2
auucccagauguugagcaa

SEQ ID NO: 3767204 - RNA, 12 nt, Salmonella typhimurium LT2
auucccaggcaa

SEQ ID NO: 3767205 - RNA, 19 nt, Salmonella typhimurium LT2
auucccauccgugcgauaa

SEQ ID NO: 3767206 - RNA, 15 nt, Salmonella typhimurium LT2
auucccauugagcag

SEQ ID NO: 3767207 - RNA, 17 nt, Salmonella typhimurium LT2
auuccccaaucccacca

SEQ ID NO: 3767208 - RNA, 16 nt, Salmonella typhimurium LT2
auucccccauccgcgc

SEQ ID NO: 3767209 - RNA, 16 nt, Salmonella typhimurium LT2
auuccccguccugaau

SEQ ID NO: 3767210 - RNA, 22 nt, Salmonella typhimurium LT2
auuccccugaugcguauccagc

SEQ ID NO: 3767211 - RNA, 23 nt, Salmonella typhimurium LT2
auucccgccugcggacacggcgu

SEQ ID NO: 3767212 - RNA, 18 nt, Salmonella typhimurium LT2
auucccguaaaagaagaa

SEQ ID NO: 3767213 - RNA, 17 nt, Salmonella typhimurium LT2
auucccguaucuucaug

SEQ ID NO: 3767214 - RNA, 16 nt, Salmonella typhimurium LT2
auucccgucccugcau

SEQ ID NO: 3767215 - RNA, 14 nt, Salmonella typhimurium LT2
auucccugcauguc

SEQ ID NO: 3767216 - RNA, 22 nt, Salmonella typhimurium LT2
auucccugcgcauacgucaugc

SEQ ID NO: 3767217 - RNA, 19 nt, Salmonella typhimurium LT2
auucccugguucgaaucca

SEQ ID NO: 3767218 - RNA, 21 nt, Salmonella typhimurium LT2
auucccugguucgaauccagg

SEQ ID NO: 3767219 - RNA, 21 nt, Salmonella typhimurium LT2
auuccgacgugacucagcggc

SEQ ID NO: 3767220 - RNA, 14 nt, Salmonella typhimurium LT2
auuccgagucgauc

SEQ ID NO: 3767221 - RNA, 15 nt, Salmonella typhimurium LT2
auuccgcagaagccg

SEQ ID NO: 3767222 - RNA, 20 nt, Salmonella typhimurium LT2
auuccgcagaagccggucau

SEQ ID NO: 3767223 - RNA, 19 nt, Salmonella typhimurium LT2
auuccgcagagcugacggg

SEQ ID NO: 3767224 - RNA, 11 nt, Salmonella typhimurium LT2
auuccgccaua

SEQ ID NO: 3767225 - RNA, 15 nt, Salmonella typhimurium LT2
auuccgcucagauaa

SEQ ID NO: 3767226 - RNA, 23 nt, Salmonella typhimurium LT2
auuccgcucagauaacauaugag

SEQ ID NO: 3767227 - RNA, 16 nt, Salmonella typhimurium LT2
auuccgcuucuuccau

SEQ ID NO: 3767228 - RNA, 14 nt, Salmonella typhimurium LT2
auuccggcacaacc

SEQ ID NO: 3767229 - RNA, 13 nt, Salmonella typhimurium LT2
auuccggcgcugg

SEQ ID NO: 3767230 - RNA, 20 nt, Salmonella typhimurium LT2
auuccgguaucgugcgggcg

SEQ ID NO: 3767231 - RNA, 15 nt, Salmonella typhimurium LT2
auuccguaauccaau

SEQ ID NO: 3767232 - RNA, 18 nt, Salmonella typhimurium LT2
auuccuaucaguacgacc

SEQ ID NO: 3767233 - RNA, 16 nt, Salmonella typhimurium LT2
auuccugacgcacagu

SEQ ID NO: 3767234 - RNA, 14 nt, Salmonella typhimurium LT2
auuccugacugcgc

SEQ ID NO: 3767235 - RNA, 14 nt, Salmonella typhimurium LT2
auuccugccgccgc

SEQ ID NO: 3767236 - RNA, 20 nt, Salmonella typhimurium LT2
auuccugccgccgcaccacu

SEQ ID NO: 3767237 - RNA, 14 nt, Salmonella typhimurium LT2
auuccuggauuaaa

SEQ ID NO: 3767238 - RNA, 20 nt, Salmonella typhimurium LT2
auuccuggcguaugcuuuca

SEQ ID NO: 3767239 - RNA, 20 nt, Salmonella typhimurium LT2
auuccuuuuaauuuucugua

SEQ ID NO: 3767240 - RNA, 20 nt, Salmonella typhimurium LT2
auuccuuuuuccgccaccug

SEQ ID NO: 3767241 - RNA, 21 nt, Salmonella typhimurium LT2
auuccuuuuuccgccaccugu

SEQ ID NO: 3767242 - RNA, 14 nt, Salmonella typhimurium LT2
auucgaauucugau

SEQ ID NO: 3767243 - RNA, 16 nt, Salmonella typhimurium LT2
auucgagaugcauaaa

SEQ ID NO: 3767244 - RNA, 15 nt, Salmonella typhimurium LT2
auucgccccagcaua

SEQ ID NO: 3767245 - RNA, 20 nt, Salmonella typhimurium LT2
auucgccuuucacgcguuca

SEQ ID NO: 3767246 - RNA, 20 nt, Salmonella typhimurium LT2
auucgcgaauagugcagaaa

SEQ ID NO: 3767247 - RNA, 20 nt, Salmonella typhimurium LT2
auucgcgcuaaaugacaaau

SEQ ID NO: 3767248 - RNA, 14 nt, Salmonella typhimurium LT2
auucgcuaauaaau

SEQ ID NO: 3767249 - RNA, 15 nt, Salmonella typhimurium LT2
auucgcuacgcacga

SEQ ID NO: 3767250 - RNA, 17 nt, Salmonella typhimurium LT2
auucgcuccucagcgcu

SEQ ID NO: 3767251 - RNA, 19 nt, Salmonella typhimurium LT2
auucgcuggccguuaugca

SEQ ID NO: 3767252 - RNA, 19 nt, Salmonella typhimurium LT2
auucggccuucgguuuuau

SEQ ID NO: 3767253 - RNA, 16 nt, Salmonella typhimurium LT2
auucggcgagaaaacc

SEQ ID NO: 3767254 - RNA, 22 nt, Salmonella typhimurium LT2
auucggcgcuucgcagcgauau

SEQ ID NO: 3767255 - RNA, 14 nt, Salmonella typhimurium LT2
auucggcuccagau

SEQ ID NO: 3767256 - RNA, 21 nt, Salmonella typhimurium LT2
auucgggacaaacccccagcc

SEQ ID NO: 3767257 - RNA, 17 nt, Salmonella typhimurium LT2
auucgguaguuccagaa

SEQ ID NO: 3767258 - RNA, 15 nt, Salmonella typhimurium LT2
auucguauugacaac

SEQ ID NO: 3767259 - RNA, 17 nt, Salmonella typhimurium LT2
auucgucagcggcugcu

SEQ ID NO: 3767260 - RNA, 17 nt, Salmonella typhimurium LT2
auucguccuuuaucaga

SEQ ID NO: 3767261 - RNA, 14 nt, Salmonella typhimurium LT2
auucgucuucaucu

SEQ ID NO: 3767262 - RNA, 15 nt, Salmonella typhimurium LT2
auucgucuucaucuu

SEQ ID NO: 3767263 - RNA, 21 nt, Salmonella typhimurium LT2
auucguggcucaaggauauug

SEQ ID NO: 3767264 - RNA, 15 nt, Salmonella typhimurium LT2
auucguuaaagccga

SEQ ID NO: 3767265 - RNA, 17 nt, Salmonella typhimurium LT2
auucguuaaagccgaug

SEQ ID NO: 3767266 - RNA, 17 nt, Salmonella typhimurium LT2
auucguuagcguuucga

SEQ ID NO: 3767267 - RNA, 19 nt, Salmonella typhimurium LT2
auucuaacauaaugaaucc

SEQ ID NO: 3767268 - RNA, 19 nt, Salmonella typhimurium LT2
auucuacaguuugucauca

SEQ ID NO: 3767269 - RNA, 12 nt, Salmonella typhimurium LT2
auucuaugccaa

SEQ ID NO: 3767270 - RNA, 14 nt, Salmonella typhimurium LT2
auucuauucuugug

SEQ ID NO: 3767271 - RNA, 22 nt, Salmonella typhimurium LT2
auucucaacccggacauccauc

SEQ ID NO: 3767272 - RNA, 14 nt, Salmonella typhimurium LT2
auucucccaaauuu

SEQ ID NO: 3767273 - RNA, 17 nt, Salmonella typhimurium LT2
auucucccaaauuuuuu

SEQ ID NO: 3767274 - RNA, 17 nt, Salmonella typhimurium LT2
auucucccugccaggcc

SEQ ID NO: 3767275 - RNA, 22 nt, Salmonella typhimurium LT2
auucucccugccaggccaucug

SEQ ID NO: 3767276 - RNA, 14 nt, Salmonella typhimurium LT2
auucucgcacuuua

SEQ ID NO: 3767277 - RNA, 13 nt, Salmonella typhimurium LT2
auucucuucuucu

SEQ ID NO: 3767278 - RNA, 22 nt, Salmonella typhimurium LT2
auucugaaaaggggauaacaac

SEQ ID NO: 3767279 - RNA, 22 nt, Salmonella typhimurium LT2
auucugcauggcgcuaaacauc

SEQ ID NO: 3767280 - RNA, 14 nt, Salmonella typhimurium LT2
auucugccaguuca

SEQ ID NO: 3767281 - RNA, 15 nt, Salmonella typhimurium LT2
auucugcgaaagccu

SEQ ID NO: 3767282 - RNA, 16 nt, Salmonella typhimurium LT2
auuguagguuuuccuc

SEQ ID NO: 3767283 - RNA, 18 nt, Salmonella typhimurium LT2
auugucaccguaauauaa

SEQ ID NO: 3767284 - RNA, 18 nt, Salmonella typhimurium LT2
auugucacuauucuuauc

SEQ ID NO: 3767285 - RNA, 14 nt, Salmonella typhimurium LT2
auugucagaauuuc

SEQ ID NO: 3767286 - RNA, 20 nt, Salmonella typhimurium LT2
auugucauaaugucccugcc

SEQ ID NO: 3767287 - RNA, 20 nt, Salmonella typhimurium LT2
auugucaugcuaaaacagau

SEQ ID NO: 3767288 - RNA, 23 nt, Salmonella typhimurium LT2
auuguccccaucuuuaaaucccu

SEQ ID NO: 3767289 - RNA, 17 nt, Salmonella typhimurium LT2
auugucuuaaauaugaa

SEQ ID NO: 3767290 - RNA, 18 nt, Salmonella typhimurium LT2
auugugagaaaagcagag

SEQ ID NO: 3767291 - RNA, 21 nt, Salmonella typhimurium LT2
auugugagccagacgccgcgc

SEQ ID NO: 3767292 - RNA, 19 nt, Salmonella typhimurium LT2
auugugccccgcgcgccug

SEQ ID NO: 3767293 - RNA, 15 nt, Salmonella typhimurium LT2
auugugccgcgccug

SEQ ID NO: 3767294 - RNA, 20 nt, Salmonella typhimurium LT2
auugugcgcaagaaaaguuu

SEQ ID NO: 3767295 - RNA, 16 nt, Salmonella typhimurium LT2
auuguguuacauguac

SEQ ID NO: 3767296 - RNA, 18 nt, Salmonella typhimurium LT2
auuguuccugcuggcaaa

SEQ ID NO: 3767297 - RNA, 22 nt, Salmonella typhimurium LT2
auuguugcguuggaaauacguu

SEQ ID NO: 3767298 - RNA, 20 nt, Salmonella typhimurium LT2
auuguuuaacguuucaugga

SEQ ID NO: 3767299 - RNA, 12 nt, Salmonella typhimurium LT2
auuguuuacuuu

SEQ ID NO: 3767300 - RNA, 16 nt, Salmonella typhimurium LT2
auuguuugaaaaggaa

SEQ ID NO: 3767301 - RNA, 18 nt, Salmonella typhimurium LT2
auuguuugaaaaggaaaa

SEQ ID NO: 3767302 - RNA, 17 nt, Salmonella typhimurium LT2
auuuaaaauccggcugc

SEQ ID NO: 3767303 - RNA, 18 nt, Salmonella typhimurium LT2
auuuaaacgggguaaacu

SEQ ID NO: 3767304 - RNA, 14 nt, Salmonella typhimurium LT2
auuuaacuuaaaua

SEQ ID NO: 3767305 - RNA, 21 nt, Salmonella typhimurium LT2
auuuaagccagacgcgcagca

SEQ ID NO: 3767306 - RNA, 19 nt, Salmonella typhimurium LT2
auuuaagccagauguaauc

SEQ ID NO: 3767307 - RNA, 14 nt, Salmonella typhimurium LT2
auuuaauaauaaau

SEQ ID NO: 3767308 - RNA, 17 nt, Salmonella typhimurium LT2
auuuaaugucgacauaa

SEQ ID NO: 3767309 - RNA, 23 nt, Salmonella typhimurium LT2
auuuaauugauaucgcaacagau

SEQ ID NO: 3767310 - RNA, 13 nt, Salmonella typhimurium LT2
auuuaauuuuucc

SEQ ID NO: 3767311 - RNA, 15 nt, Salmonella typhimurium LT2
auuuaauuuuuccuu

SEQ ID NO: 3767312 - RNA, 22 nt, Salmonella typhimurium LT2
auuuacaaaugaccucaagaau

SEQ ID NO: 3767313 - RNA, 15 nt, Salmonella typhimurium LT2
auuuacgcagcccca

SEQ ID NO: 3767314 - RNA, 17 nt, Salmonella typhimurium LT2
auuuacucaguuugcug

SEQ ID NO: 3767315 - RNA, 17 nt, Salmonella typhimurium LT2
auuuacugugauccacc

SEQ ID NO: 3767316 - RNA, 22 nt, Salmonella typhimurium LT2
auuuagcgcaguacgcgccaug

SEQ ID NO: 3767317 - RNA, 15 nt, Salmonella typhimurium LT2
auuuaggucuuguca

SEQ ID NO: 3767318 - RNA, 17 nt, Salmonella typhimurium LT2
auuuauagcaaauauga

SEQ ID NO: 3767319 - RNA, 14 nt, Salmonella typhimurium LT2
auuuauccagcagg

SEQ ID NO: 3767320 - RNA, 19 nt, Salmonella typhimurium LT2
auuuaucuaagaauuuaau

SEQ ID NO: 3767321 - RNA, 20 nt, Salmonella typhimurium LT2
auuuaugauuuuaacaucac

SEQ ID NO: 3767322 - RNA, 14 nt, Salmonella typhimurium LT2
auuuaugccgccau

SEQ ID NO: 3767323 - RNA, 17 nt, Salmonella typhimurium LT2
auuuaugcgccagccgc

SEQ ID NO: 3767324 - RNA, 16 nt, Salmonella typhimurium LT2
auuuauugauuauuuu

SEQ ID NO: 3767325 - RNA, 14 nt, Salmonella typhimurium LT2
auuucaaucaucau

SEQ ID NO: 3767326 - RNA, 16 nt, Salmonella typhimurium LT2
auuucacccagaguuu

SEQ ID NO: 3767327 - RNA, 18 nt, Salmonella typhimurium LT2
auuucaccgccaauaacg

SEQ ID NO: 3767328 - RNA, 21 nt, Salmonella typhimurium LT2
auuucaccgggccaaugccgc

SEQ ID NO: 3767329 - RNA, 21 nt, Salmonella typhimurium LT2
auuucacgaacgaguacguaa

SEQ ID NO: 3767330 - RNA, 15 nt, Salmonella typhimurium LT2
auuucacgaauaucg

SEQ ID NO: 3767331 - RNA, 17 nt, Salmonella typhimurium LT2
auuucacgcugcaguuu

SEQ ID NO: 3767332 - RNA, 18 nt, Salmonella typhimurium LT2
auuucacgcugcaguuua

SEQ ID NO: 3767333 - RNA, 23 nt, Salmonella typhimurium LT2
auuucacgucacguucauccugg

SEQ ID NO: 3767334 - RNA, 20 nt, Salmonella typhimurium LT2
auuucacuggccguuuuccc

SEQ ID NO: 3767335 - RNA, 15 nt, Salmonella typhimurium LT2
auuucacuucaucau

SEQ ID NO: 3767336 - RNA, 19 nt, Salmonella typhimurium LT2
auuucaggcaaaaaaaacc

SEQ ID NO: 3767337 - RNA, 17 nt, Salmonella typhimurium LT2
auuucaggcaaaggaau

SEQ ID NO: 3767338 - RNA, 17 nt, Salmonella typhimurium LT2
auuucagggcuuauuca

SEQ ID NO: 3767339 - RNA, 20 nt, Salmonella typhimurium LT2
auuucaggguagcauugccg

SEQ ID NO: 3767340 - RNA, 13 nt, Salmonella typhimurium LT2
auuucaguauuac

SEQ ID NO: 3767341 - RNA, 17 nt, Salmonella typhimurium LT2
auuucagugaaucgacg

SEQ ID NO: 3767342 - RNA, 19 nt, Salmonella typhimurium LT2
auuucauaacuugccgccu

SEQ ID NO: 3767343 - RNA, 14 nt, Salmonella typhimurium LT2
auuucauaauaagc

SEQ ID NO: 3767344 - RNA, 15 nt, Salmonella typhimurium LT2
auuucaucuaucugc

SEQ ID NO: 3767345 - RNA, 23 nt, Salmonella typhimurium LT2
auuucaugcggugcaugaauauc

SEQ ID NO: 3767346 - RNA, 15 nt, Salmonella typhimurium LT2
auuuccaauguaaau

SEQ ID NO: 3767347 - RNA, 19 nt, Salmonella typhimurium LT2
auuuccaauguaaauuaau

SEQ ID NO: 3767348 - RNA, 17 nt, Salmonella typhimurium LT2
auuuccagugccaguua

SEQ ID NO: 3767349 - RNA, 13 nt, Salmonella typhimurium LT2
auuuccauuuuuc

SEQ ID NO: 3767350 - RNA, 14 nt, Salmonella typhimurium LT2
auuuccauuuuuca

SEQ ID NO: 3767351 - RNA, 13 nt, Salmonella typhimurium LT2
auuuccccaguua

SEQ ID NO: 3767352 - RNA, 15 nt, Salmonella typhimurium LT2
auuucccccacuucu

SEQ ID NO: 3767353 - RNA, 16 nt, Salmonella typhimurium LT2
auuucccuucccagcc

SEQ ID NO: 3767354 - RNA, 21 nt, Salmonella typhimurium LT2
auuucccuuccccuuucacca

SEQ ID NO: 3767355 - RNA, 12 nt, Salmonella typhimurium LT2
auuuccgcagcc

SEQ ID NO: 3767356 - RNA, 16 nt, Salmonella typhimurium LT2
auuuccgccauuuuuc

SEQ ID NO: 3767357 - RNA, 21 nt, Salmonella typhimurium LT2
auuuccggaccguuaucaaaa

SEQ ID NO: 3767358 - RNA, 15 nt, Salmonella typhimurium LT2
auuuccggcgacgua

SEQ ID NO: 3767359 - RNA, 21 nt, Salmonella typhimurium LT2
auuuccgguuccagcggccgc

SEQ ID NO: 3767360 - RNA, 15 nt, Salmonella typhimurium LT2
auuuccguggcgaua

SEQ ID NO: 3767361 - RNA, 13 nt, Salmonella typhimurium LT2
auuucgcacccug

SEQ ID NO: 3767362 - RNA, 17 nt, Salmonella typhimurium LT2
auuucgcauugucauaa

SEQ ID NO: 3767363 - RNA, 14 nt, Salmonella typhimurium LT2
auuucgccaguucc

SEQ ID NO: 3767364 - RNA, 13 nt, Salmonella typhimurium LT2
auuucgccgccgc

SEQ ID NO: 3767365 - RNA, 22 nt, Salmonella typhimurium LT2
auuucgcuacucagcgucauca

SEQ ID NO: 3767366 - RNA, 17 nt, Salmonella typhimurium LT2
auuucgcuccacuggcc

SEQ ID NO: 3767367 - RNA, 21 nt, Salmonella typhimurium LT2
auuucgcuccacuggcccccu

SEQ ID NO: 3767368 - RNA, 20 nt, Salmonella typhimurium LT2
auuucgcuggcggccccucu

SEQ ID NO: 3767369 - RNA, 22 nt, Salmonella typhimurium LT2
auuucgcuggcggccccucuuc

SEQ ID NO: 3767370 - RNA, 13 nt, Salmonella typhimurium LT2
auuucggcaauga

SEQ ID NO: 3767371 - RNA, 15 nt, Salmonella typhimurium LT2
auuucguagccgcgc

SEQ ID NO: 3767372 - RNA, 20 nt, Salmonella typhimurium LT2
auuucgucgauauuacgacc

SEQ ID NO: 3767373 - RNA, 20 nt, Salmonella typhimurium LT2
auuucucaaaaacaccauuu

SEQ ID NO: 3767374 - RNA, 14 nt, Salmonella typhimurium LT2
auuucucaggcauc

SEQ ID NO: 3767375 - RNA, 17 nt, Salmonella typhimurium LT2
auuucuccgcccaucca

SEQ ID NO: 3767376 - RNA, 13 nt, Salmonella typhimurium LT2
auuucuccugcau

SEQ ID NO: 3767377 - RNA, 15 nt, Salmonella typhimurium LT2
auuucuccugcgcca

SEQ ID NO: 3767378 - RNA, 18 nt, Salmonella typhimurium LT2
auuucuccugcgccagcc

SEQ ID NO: 3767379 - RNA, 20 nt, Salmonella typhimurium LT2
auuucuccugcgccagccgg

SEQ ID NO: 3767380 - RNA, 22 nt, Salmonella typhimurium LT2
auuucuccugcgccagccggau

SEQ ID NO: 3767381 - RNA, 21 nt, Salmonella typhimurium LT2
auuucucgcguccccagccga

SEQ ID NO: 3767382 - RNA, 21 nt, Salmonella typhimurium LT2
auuucucgcucgcccaucacu

SEQ ID NO: 3767383 - RNA, 17 nt, Salmonella typhimurium LT2
auuucugccugcuucag

SEQ ID NO: 3767384 - RNA, 22 nt, Salmonella typhimurium LT2
auuucugccugcuucagacaac

SEQ ID NO: 3767385 - RNA, 18 nt, Salmonella typhimurium LT2
auuucuguauaauuauuu

SEQ ID NO: 3767386 - RNA, 14 nt, Salmonella typhimurium LT2
caaaaaaugacacc

SEQ ID NO: 3767387 - RNA, 12 nt, Salmonella typhimurium LT2
caaaaacgccag

SEQ ID NO: 3767388 - RNA, 13 nt, Salmonella typhimurium LT2
caaaaacgccaga

SEQ ID NO: 3767389 - RNA, 20 nt, Salmonella typhimurium LT2
caaaaagaacucacucagug

SEQ ID NO: 3767390 - RNA, 14 nt, Salmonella typhimurium LT2
caaaaagaggaaag

SEQ ID NO: 3767391 - RNA, 15 nt, Salmonella typhimurium LT2
caaaaagauauuaua

SEQ ID NO: 3767392 - RNA, 18 nt, Salmonella typhimurium LT2
caaaaagccuugcugaau

SEQ ID NO: 3767393 - RNA, 21 nt, Salmonella typhimurium LT2
caaaaagcgcgccgaaaauau

SEQ ID NO: 3767394 - RNA, 18 nt, Salmonella typhimurium LT2
caaaaaguaguuccagca

SEQ ID NO: 3767395 - RNA, 19 nt, Salmonella typhimurium LT2
caaaaaguaguuccagcau

SEQ ID NO: 3767396 - RNA, 20 nt, Salmonella typhimurium LT2
caaaaaguauuguuuuuaug

SEQ ID NO: 3767397 - RNA, 21 nt, Salmonella typhimurium LT2
caaaaagugaaaaaacggaac

SEQ ID NO: 3767398 - RNA, 12 nt, Salmonella typhimurium LT2
caaaaauaccac

SEQ ID NO: 3767399 - RNA, 15 nt, Salmonella typhimurium LT2
caaaaauaucgccgu

SEQ ID NO: 3767400 - RNA, 20 nt, Salmonella typhimurium LT2
caaaaauauggucgaaaaua

SEQ ID NO: 3767401 - RNA, 21 nt, Salmonella typhimurium LT2
caaaaauauggucgaaaauau

SEQ ID NO: 3767402 - RNA, 14 nt, Salmonella typhimurium LT2
caaaaauccuucuu

SEQ ID NO: 3767403 - RNA, 23 nt, Salmonella typhimurium LT2
caaaaauggcuucggcaauuucc

SEQ ID NO: 3767404 - RNA, 22 nt, Salmonella typhimurium LT2
caaaaauucuuuuacgaucgcc

SEQ ID NO: 3767405 - RNA, 22 nt, Salmonella typhimurium LT2
caaaacaaccgucgauuuuaau

SEQ ID NO: 3767406 - RNA, 14 nt, Salmonella typhimurium LT2
caaaacacagcuca

SEQ ID NO: 3767407 - RNA, 18 nt, Salmonella typhimurium LT2
caaaacagauuaaaaagc

SEQ ID NO: 3767408 - RNA, 15 nt, Salmonella typhimurium LT2
caaaacccaccagca

SEQ ID NO: 3767409 - RNA, 18 nt, Salmonella typhimurium LT2
caaaacccaccagcaggg

SEQ ID NO: 3767410 - RNA, 19 nt, Salmonella typhimurium LT2
caaaaccuucauaaauacg

SEQ ID NO: 3767411 - RNA, 16 nt, Salmonella typhimurium LT2
caaaacgcauccagcg

SEQ ID NO: 3767412 - RNA, 20 nt, Salmonella typhimurium LT2
caaaacgcauccagcgcaaa

SEQ ID NO: 3767413 - RNA, 12 nt, Salmonella typhimurium LT2
caaaacgccggu

SEQ ID NO: 3767414 - RNA, 21 nt, Salmonella typhimurium LT2
caaaacgccgguacuggagac

SEQ ID NO: 3767415 - RNA, 16 nt, Salmonella typhimurium LT2
caaaacgcgccaggua

SEQ ID NO: 3767416 - RNA, 23 nt, Salmonella typhimurium LT2
caaaacggcuuuaaucacccgcg

SEQ ID NO: 3767417 - RNA, 16 nt, Salmonella typhimurium LT2
caaaacgggcuuccag

SEQ ID NO: 3767418 - RNA, 22 nt, Salmonella typhimurium LT2
caaaacguagagugcuucuuca

SEQ ID NO: 3767419 - RNA, 21 nt, Salmonella typhimurium LT2
caaaacgucgugaguggcggc

SEQ ID NO: 3767420 - RNA, 18 nt, Salmonella typhimurium LT2
caaaacgugguaaaaagc

SEQ ID NO: 3767421 - RNA, 19 nt, Salmonella typhimurium LT2
caaaacgugguaaaaagcu

SEQ ID NO: 3767422 - RNA, 20 nt, Salmonella typhimurium LT2
caaaacuacgcguauuuauu

SEQ ID NO: 3767423 - RNA, 21 nt, Salmonella typhimurium LT2
caaaacugagucguaggcuca

SEQ ID NO: 3767424 - RNA, 17 nt, Salmonella typhimurium LT2
caaaagaggcuaauuau

SEQ ID NO: 3767425 - RNA, 22 nt, Salmonella typhimurium LT2
caaaagauuuaucaauuuuuaa

SEQ ID NO: 3767426 - RNA, 17 nt, Salmonella typhimurium LT2
caaaagccuguuuacca

SEQ ID NO: 3767427 - RNA, 23 nt, Salmonella typhimurium LT2
caaaagcgguuaagauacauauc

SEQ ID NO: 3767428 - RNA, 14 nt, Salmonella typhimurium LT2
caaaagcguuuuau

SEQ ID NO: 3767429 - RNA, 23 nt, Salmonella typhimurium LT2
caaaagcuuuucgcuugcggcug

SEQ ID NO: 3767430 - RNA, 19 nt, Salmonella typhimurium LT2
caaaaggauacagcgccgc

SEQ ID NO: 3767431 - RNA, 22 nt, Salmonella typhimurium LT2
caaaaggccuuuuuuuuaugcg

SEQ ID NO: 3767432 - RNA, 14 nt, Salmonella typhimurium LT2
caaaaggcgacaua

SEQ ID NO: 3767433 - RNA, 20 nt, Salmonella typhimurium LT2
caaaaggcgccgcuuccccc

SEQ ID NO: 3767434 - RNA, 21 nt, Salmonella typhimurium LT2
caaaaggcuggaacagauguu

SEQ ID NO: 3767435 - RNA, 23 nt, Salmonella typhimurium LT2
caaaaggucgauuaaacgccugg

SEQ ID NO: 3767436 - RNA, 18 nt, Salmonella typhimurium LT2
caaaaguaucaacgggaa

SEQ ID NO: 3767437 - RNA, 20 nt, Salmonella typhimurium LT2
caaaauaaaauuauauucua

SEQ ID NO: 3767438 - RNA, 14 nt, Salmonella typhimurium LT2
caaaauaagcaccg

SEQ ID NO: 3767439 - RNA, 19 nt, Salmonella typhimurium LT2
caaaauaauacguuuauuc

SEQ ID NO: 3767440 - RNA, 15 nt, Salmonella typhimurium LT2
caaaauaauaucgcg

SEQ ID NO: 3767441 - RNA, 14 nt, Salmonella typhimurium LT2
caaaauacuggccg

SEQ ID NO: 3767442 - RNA, 15 nt, Salmonella typhimurium LT2
caaaauauauaauuu

SEQ ID NO: 3767443 - RNA, 12 nt, Salmonella typhimurium LT2
caaaaucaaacu

SEQ ID NO: 3767444 - RNA, 14 nt, Salmonella typhimurium LT2
caaaaucacgcaca

SEQ ID NO: 3767445 - RNA, 20 nt, Salmonella typhimurium LT2
caaaaucacgcacacgucug

SEQ ID NO: 3767446 - RNA, 12 nt, Salmonella typhimurium LT2
caaaaucacgcg

SEQ ID NO: 3767447 - RNA, 23 nt, Salmonella typhimurium LT2
caaaaucauucgagaugcauaaa

SEQ ID NO: 3767448 - RNA, 22 nt, Salmonella typhimurium LT2
caaaaucccacauccggcugaa

SEQ ID NO: 3767449 - RNA, 19 nt, Salmonella typhimurium LT2
caaaaucccggcuggguuc

SEQ ID NO: 3767450 - RNA, 18 nt, Salmonella typhimurium LT2
caaaaucguaauaaagag

SEQ ID NO: 3767451 - RNA, 19 nt, Salmonella typhimurium LT2
caaaaucuuuccagcucca

SEQ ID NO: 3767452 - RNA, 16 nt, Salmonella typhimurium LT2
caaaaugauguccaca

SEQ ID NO: 3767453 - RNA, 18 nt, Salmonella typhimurium LT2
caaaaugcccuucuaccg

SEQ ID NO: 3767454 - RNA, 16 nt, Salmonella typhimurium LT2
caaaaugcggcauccg

SEQ ID NO: 3767455 - RNA, 19 nt, Salmonella typhimurium LT2
caaaauggcaaguaaaaua

SEQ ID NO: 3767456 - RNA, 21 nt, Salmonella typhimurium LT2
caaaauguucauguacgccgc

SEQ ID NO: 3767457 - RNA, 13 nt, Salmonella typhimurium LT2
caaaauuaaucgc

SEQ ID NO: 3767458 - RNA, 16 nt, Salmonella typhimurium LT2
caaaauuaaucgccag

SEQ ID NO: 3767459 - RNA, 13 nt, Salmonella typhimurium LT2
caaacaaauaaau

SEQ ID NO: 3767460 - RNA, 16 nt, Salmonella typhimurium LT2
caaacaaauaaaucca

SEQ ID NO: 3767461 - RNA, 15 nt, Salmonella typhimurium LT2
caaacaaaucaucag

SEQ ID NO: 3767462 - RNA, 16 nt, Salmonella typhimurium LT2
caaacaaggcaucuau

SEQ ID NO: 3767463 - RNA, 23 nt, Salmonella typhimurium LT2
caaacacaaauuucgagcagaac

SEQ ID NO: 3767464 - RNA, 17 nt, Salmonella typhimurium LT2
caaacacaaucacaacg

SEQ ID NO: 3767465 - RNA, 18 nt, Salmonella typhimurium LT2
caaacacaaucacaccca

SEQ ID NO: 3767466 - RNA, 20 nt, Salmonella typhimurium LT2
caaacaccaccaguaaccgc

SEQ ID NO: 3767467 - RNA, 13 nt, Salmonella typhimurium LT2
caaacaccagauc

SEQ ID NO: 3767468 - RNA, 14 nt, Salmonella typhimurium LT2
caaacaccagauca

SEQ ID NO: 3767469 - RNA, 19 nt, Salmonella typhimurium LT2
caaacacccagccccccua

SEQ ID NO: 3767470 - RNA, 13 nt, Salmonella typhimurium LT2
caaacaccgccug

SEQ ID NO: 3767471 - RNA, 13 nt, Salmonella typhimurium LT2
caaacacggcugu

SEQ ID NO: 3767472 - RNA, 17 nt, Salmonella typhimurium LT2
caaacacggcugucggu

SEQ ID NO: 3767473 - RNA, 22 nt, Salmonella typhimurium LT2
caaacacuaccgggcagcaucu

SEQ ID NO: 3767474 - RNA, 12 nt, Salmonella typhimurium LT2
caaacagaauau

SEQ ID NO: 3767475 - RNA, 15 nt, Salmonella typhimurium LT2
caaacagagcgccgg

SEQ ID NO: 3767476 - RNA, 12 nt, Salmonella typhimurium LT2
caaacagcagaa

SEQ ID NO: 3767477 - RNA, 19 nt, Salmonella typhimurium LT2
caaacagccucaucaccgc

SEQ ID NO: 3767478 - RNA, 18 nt, Salmonella typhimurium LT2
caaacagcgacucgcugg

SEQ ID NO: 3767479 - RNA, 14 nt, Salmonella typhimurium LT2
caaacagggcguga

SEQ ID NO: 3767480 - RNA, 16 nt, Salmonella typhimurium LT2
caaacagggggaagca

SEQ ID NO: 3767481 - RNA, 14 nt, Salmonella typhimurium LT2
caaacaucgcgcuc

SEQ ID NO: 3767482 - RNA, 17 nt, Salmonella typhimurium LT2
caaacaucgcgcuccag

SEQ ID NO: 3767483 - RNA, 12 nt, Salmonella typhimurium LT2
caaaccacugcu

SEQ ID NO: 3767484 - RNA, 21 nt, Salmonella typhimurium LT2
caaaccccagauuacugcccu

SEQ ID NO: 3767485 - RNA, 23 nt, Salmonella typhimurium LT2
caaacccgaccucuucuuugagc

SEQ ID NO: 3767486 - RNA, 15 nt, Salmonella typhimurium LT2
caaacccgccacagg

SEQ ID NO: 3767487 - RNA, 21 nt, Salmonella typhimurium LT2
caaacccgccacaggccaaca

SEQ ID NO: 3767488 - RNA, 20 nt, Salmonella typhimurium LT2
caaaccgaauucguccacac

SEQ ID NO: 3767489 - RNA, 16 nt, Salmonella typhimurium LT2
caaaccgacccaaaaa

SEQ ID NO: 3767490 - RNA, 15 nt, Salmonella typhimurium LT2
caaauugcuguucca

SEQ ID NO: 3767491 - RNA, 18 nt, Salmonella typhimurium LT2
caaauuugcugccaucgc

SEQ ID NO: 3767492 - RNA, 15 nt, Salmonella typhimurium LT2
caaauuuggcucaau

SEQ ID NO: 3767493 - RNA, 15 nt, Salmonella typhimurium LT2
caacaaacuuaauua

SEQ ID NO: 3767494 - RNA, 16 nt, Salmonella typhimurium LT2
caacaaauuccggcac

SEQ ID NO: 3767495 - RNA, 22 nt, Salmonella typhimurium LT2
caacaacaggccagaauaacgu

SEQ ID NO: 3767496 - RNA, 15 nt, Salmonella typhimurium LT2
caacaaccggcuggc

SEQ ID NO: 3767497 - RNA, 19 nt, Salmonella typhimurium LT2
caacaaccucuuuuuccgc

SEQ ID NO: 3767498 - RNA, 16 nt, Salmonella typhimurium LT2
caacaagaauauauuc

SEQ ID NO: 3767499 - RNA, 23 nt, Salmonella typhimurium LT2
caacaaugucgccucccgauggu

SEQ ID NO: 3767500 - RNA, 11 nt, Salmonella typhimurium LT2
caacaauuucu

SEQ ID NO: 3767501 - RNA, 17 nt, Salmonella typhimurium LT2
caacacauccagcguca

SEQ ID NO: 3767502 - RNA, 21 nt, Salmonella typhimurium LT2
caacacaucgacaugcagauc

SEQ ID NO: 3767503 - RNA, 14 nt, Salmonella typhimurium LT2
caacaccagcacug

SEQ ID NO: 3767504 - RNA, 14 nt, Salmonella typhimurium LT2
caacaccagcagcg

SEQ ID NO: 3767505 - RNA, 12 nt, Salmonella typhimurium LT2
caacaccauccc

SEQ ID NO: 3767506 - RNA, 19 nt, Salmonella typhimurium LT2
caacaccgauccgaagaac

SEQ ID NO: 3767507 - RNA, 15 nt, Salmonella typhimurium LT2
caacacgauccccau

SEQ ID NO: 3767508 - RNA, 18 nt, Salmonella typhimurium LT2
caacacgcgcaccaguuc

SEQ ID NO: 3767509 - RNA, 20 nt, Salmonella typhimurium LT2
caacacgcggucgucaucgg

SEQ ID NO: 3767510 - RNA, 17 nt, Salmonella typhimurium LT2
caacacggcgcucagga

SEQ ID NO: 3767511 - RNA, 22 nt, Salmonella typhimurium LT2
caacacggcggcuagcgcaguu

SEQ ID NO: 3767512 - RNA, 20 nt, Salmonella typhimurium LT2
caacacuuagaacgcggaag

SEQ ID NO: 3767513 - RNA, 21 nt, Salmonella typhimurium LT2
caacacuuugcgcugcgcauu

SEQ ID NO: 3767514 - RNA, 14 nt, Salmonella typhimurium LT2
caacagaccgcugu

SEQ ID NO: 3767515 - RNA, 12 nt, Salmonella typhimurium LT2
caacagcaaugu

SEQ ID NO: 3767516 - RNA, 15 nt, Salmonella typhimurium LT2
caacagcgagcuaug

SEQ ID NO: 3767517 - RNA, 15 nt, Salmonella typhimurium LT2
caacagcggagagac

SEQ ID NO: 3767518 - RNA, 17 nt, Salmonella typhimurium LT2
caacagcggcggcagua

SEQ ID NO: 3767519 - RNA, 15 nt, Salmonella typhimurium LT2
caacagcucgccaug

SEQ ID NO: 3767520 - RNA, 14 nt, Salmonella typhimurium LT2
caacaggccgcgaa

SEQ ID NO: 3767521 - RNA, 21 nt, Salmonella typhimurium LT2
caacaggggccuuuuuuucuc

SEQ ID NO: 3767522 - RNA, 20 nt, Salmonella typhimurium LT2
caacagugugccgucaucca

SEQ ID NO: 3767523 - RNA, 16 nt, Salmonella typhimurium LT2
caacauaaauaaacag

SEQ ID NO: 3767524 - RNA, 23 nt, Salmonella typhimurium LT2
caacauagcggcaaggaaaacca

SEQ ID NO: 3767525 - RNA, 17 nt, Salmonella typhimurium LT2
caacauauuuuucacac

SEQ ID NO: 3767526 - RNA, 17 nt, Salmonella typhimurium LT2
caacaucaucggaucca

SEQ ID NO: 3767527 - RNA, 18 nt, Salmonella typhimurium LT2
caacaucauguccccagg

SEQ ID NO: 3767528 - RNA, 19 nt, Salmonella typhimurium LT2
caacaucauguccccaggu

SEQ ID NO: 3767529 - RNA, 15 nt, Salmonella typhimurium LT2
caacaugaaagggaa

SEQ ID NO: 3767530 - RNA, 21 nt, Salmonella typhimurium LT2
caacaugacauuaauucaguc

SEQ ID NO: 3767531 - RNA, 15 nt, Salmonella typhimurium LT2
caacaugaccagcgc

SEQ ID NO: 3767532 - RNA, 23 nt, Salmonella typhimurium LT2
caacaugcugaccgaaccgcugu

SEQ ID NO: 3767533 - RNA, 14 nt, Salmonella typhimurium LT2
caaccaaugcagcg

SEQ ID NO: 3767534 - RNA, 14 nt, Salmonella typhimurium LT2
caaccaccagcagu

SEQ ID NO: 3767535 - RNA, 16 nt, Salmonella typhimurium LT2
caaccagaacacccag

SEQ ID NO: 3767536 - RNA, 12 nt, Salmonella typhimurium LT2
caaccagcaaug

SEQ ID NO: 3767537 - RNA, 18 nt, Salmonella typhimurium LT2
caaccagcaaugagacaa

SEQ ID NO: 3767538 - RNA, 18 nt, Salmonella typhimurium LT2
caaccagcccaugaauga

SEQ ID NO: 3767539 - RNA, 17 nt, Salmonella typhimurium LT2
caaccagcgaaaugaca

SEQ ID NO: 3767540 - RNA, 20 nt, Salmonella typhimurium LT2
caaccagcgaaaugacagcc

SEQ ID NO: 3767541 - RNA, 12 nt, Salmonella typhimurium LT2
caaccaggcaaa

SEQ ID NO: 3767542 - RNA, 17 nt, Salmonella typhimurium LT2
caaccaggcaaaccagc

SEQ ID NO: 3767543 - RNA, 16 nt, Salmonella typhimurium LT2
caaccagugcaacgcc

SEQ ID NO: 3767544 - RNA, 19 nt, Salmonella typhimurium LT2
caaccaguuaauuucuuuc

SEQ ID NO: 3767545 - RNA, 18 nt, Salmonella typhimurium LT2
caaccauauuuaugcagc

SEQ ID NO: 3767546 - RNA, 14 nt, Salmonella typhimurium LT2
caacccaaaggcca

SEQ ID NO: 3767547 - RNA, 22 nt, Salmonella typhimurium LT2
caacccauauucgucuucaucu

SEQ ID NO: 3767548 - RNA, 12 nt, Salmonella typhimurium LT2
caaccccugacg

SEQ ID NO: 3767549 - RNA, 18 nt, Salmonella typhimurium LT2
caacccgacgacguucga

SEQ ID NO: 3767550 - RNA, 21 nt, Salmonella typhimurium LT2
caacccgauaagcuuccgcca

SEQ ID NO: 3767551 - RNA, 20 nt, Salmonella typhimurium LT2
caacccgcaagcauaaaaaa

SEQ ID NO: 3767552 - RNA, 21 nt, Salmonella typhimurium LT2
caacccgcuccagaagcacuu

SEQ ID NO: 3767553 - RNA, 22 nt, Salmonella typhimurium LT2
caacccuaaaagcgcggcgccc

SEQ ID NO: 3767554 - RNA, 16 nt, Salmonella typhimurium LT2
caacccuuuggccacc

SEQ ID NO: 3767555 - RNA, 19 nt, Salmonella typhimurium LT2
caaccgcaggcucuuuuuc

SEQ ID NO: 3767556 - RNA, 15 nt, Salmonella typhimurium LT2
caaccgcaucacgcg

SEQ ID NO: 3767557 - RNA, 18 nt, Salmonella typhimurium LT2
caaccgcgccaaagauaa

SEQ ID NO: 3767558 - RNA, 21 nt, Salmonella typhimurium LT2
caaccgcugaccaucaacaau

SEQ ID NO: 3767559 - RNA, 18 nt, Salmonella typhimurium LT2
caaccgguacucuuccag

SEQ ID NO: 3767560 - RNA, 17 nt, Salmonella typhimurium LT2
caaccguauccagacca

SEQ ID NO: 3767561 - RNA, 19 nt, Salmonella typhimurium LT2
caaccgugucugcugaucg

SEQ ID NO: 3767562 - RNA, 15 nt, Salmonella typhimurium LT2
caaccguuucuuuuu

SEQ ID NO: 3767563 - RNA, 21 nt, Salmonella typhimurium LT2
caaccguuucuuuuucgauca

SEQ ID NO: 3767564 - RNA, 17 nt, Salmonella typhimurium LT2
caaccguuuugcaaugc

SEQ ID NO: 3767565 - RNA, 17 nt, Salmonella typhimurium LT2
caaccucacuguugaua

SEQ ID NO: 3767566 - RNA, 17 nt, Salmonella typhimurium LT2
caaccucggcuugcuuc

SEQ ID NO: 3767567 - RNA, 18 nt, Salmonella typhimurium LT2
caaccucggcuugcuuca

SEQ ID NO: 3767568 - RNA, 20 nt, Salmonella typhimurium LT2
caaccugagauggcacaaua

SEQ ID NO: 3767569 - RNA, 15 nt, Salmonella typhimurium LT2
caaccugagcgcgaa

SEQ ID NO: 3767570 - RNA, 17 nt, Salmonella typhimurium LT2
caaccugcgcugacggc

SEQ ID NO: 3767571 - RNA, 15 nt, Salmonella typhimurium LT2
caacgacccccacca

SEQ ID NO: 3767572 - RNA, 16 nt, Salmonella typhimurium LT2
caacgacccccaccau

SEQ ID NO: 3767573 - RNA, 17 nt, Salmonella typhimurium LT2
caacgacccccaccaug

SEQ ID NO: 3767574 - RNA, 23 nt, Salmonella typhimurium LT2
caacgacgucuuucuucgcugca

SEQ ID NO: 3767575 - RNA, 15 nt, Salmonella typhimurium LT2
caacgcaacacaggc

SEQ ID NO: 3767576 - RNA, 20 nt, Salmonella typhimurium LT2
caacgcacuguaacgcacug

SEQ ID NO: 3767577 - RNA, 23 nt, Salmonella typhimurium LT2
caacgcaggcgaaaucaaaaggc

SEQ ID NO: 3767578 - RNA, 14 nt, Salmonella typhimurium LT2
caacgcaggcugga

SEQ ID NO: 3767579 - RNA, 16 nt, Salmonella typhimurium LT2
caacgcaggcuggaga

SEQ ID NO: 3767580 - RNA, 17 nt, Salmonella typhimurium LT2
caacgcaggcuggagag

SEQ ID NO: 3767581 - RNA, 19 nt, Salmonella typhimurium LT2
caacgcaggcuggagagcg

SEQ ID NO: 3767582 - RNA, 14 nt, Salmonella typhimurium LT2
caacgccaacauag

SEQ ID NO: 3767583 - RNA, 19 nt, Salmonella typhimurium LT2
caacgccaagcgcggcagc

SEQ ID NO: 3767584 - RNA, 17 nt, Salmonella typhimurium LT2
caacgccaucagccgcg

SEQ ID NO: 3767585 - RNA, 20 nt, Salmonella typhimurium LT2
caacgcccagauauccgcgc

SEQ ID NO: 3767586 - RNA, 14 nt, Salmonella typhimurium LT2
caacgccgccuggc

SEQ ID NO: 3767587 - RNA, 18 nt, Salmonella typhimurium LT2
caacgccgcuuuaccgcc

SEQ ID NO: 3767588 - RNA, 16 nt, Salmonella typhimurium LT2
caacgccggcaacacc

SEQ ID NO: 3767589 - RNA, 16 nt, Salmonella typhimurium LT2
caacgcgaagcagcuu

SEQ ID NO: 3767590 - RNA, 22 nt, Salmonella typhimurium LT2
caacgcgaagcagcuuauccgg

SEQ ID NO: 3767591 - RNA, 14 nt, Salmonella typhimurium LT2
caacgcgaucuuca

SEQ ID NO: 3767592 - RNA, 21 nt, Salmonella typhimurium LT2
caacgcgcaucaacgccaggc

SEQ ID NO: 3767593 - RNA, 17 nt, Salmonella typhimurium LT2
caacgcgugauccacag

SEQ ID NO: 3767594 - RNA, 22 nt, Salmonella typhimurium LT2
caagguuauuaaaaagccagcg

SEQ ID NO: 3767595 - RNA, 17 nt, Salmonella typhimurium LT2
caagguuuggcucaaua

SEQ ID NO: 3767596 - RNA, 17 nt, Salmonella typhimurium LT2
caaguaaaccggucagg

SEQ ID NO: 3767597 - RNA, 21 nt, Salmonella typhimurium LT2
caaguaaaccggucaggcagc

SEQ ID NO: 3767598 - RNA, 16 nt, Salmonella typhimurium LT2
caaguagaacuuccaa

SEQ ID NO: 3767599 - RNA, 14 nt, Salmonella typhimurium LT2
caaguaguuguuau

SEQ ID NO: 3767600 - RNA, 22 nt, Salmonella typhimurium LT2
caaguaguuguuauagcgcgac

SEQ ID NO: 3767601 - RNA, 23 nt, Salmonella typhimurium LT2
caaguaguuguuauagcgcgacc

SEQ ID NO: 3767602 - RNA, 15 nt, Salmonella typhimurium LT2
caaguauaugucuga

SEQ ID NO: 3767603 - RNA, 19 nt, Salmonella typhimurium LT2
caaguauaugucugauucu

SEQ ID NO: 3767604 - RNA, 22 nt, Salmonella typhimurium LT2
caagugucgauaaccuggauga

SEQ ID NO: 3767605 - RNA, 19 nt, Salmonella typhimurium LT2
caagugugggaagggcgaa

SEQ ID NO: 3767606 - RNA, 13 nt, Salmonella typhimurium LT2
caaguucagcagg

SEQ ID NO: 3767607 - RNA, 21 nt, Salmonella typhimurium LT2
caaguuuggcaaucaaaucca

SEQ ID NO: 3767608 - RNA, 13 nt, Salmonella typhimurium LT2
caauaaaauaucc

SEQ ID NO: 3767609 - RNA, 16 nt, Salmonella typhimurium LT2
caauaaacauuuuuuu

SEQ ID NO: 3767610 - RNA, 14 nt, Salmonella typhimurium LT2
caauaaacgggcag

SEQ ID NO: 3767611 - RNA, 12 nt, Salmonella typhimurium LT2
caauaaacuggc

SEQ ID NO: 3767612 - RNA, 14 nt, Salmonella typhimurium LT2
caauaaagccgcau

SEQ ID NO: 3767613 - RNA, 15 nt, Salmonella typhimurium LT2
caauaaaguuuauuu

SEQ ID NO: 3767614 - RNA, 16 nt, Salmonella typhimurium LT2
caauaaauugaaauuc

SEQ ID NO: 3767615 - RNA, 14 nt, Salmonella typhimurium LT2
caauaacagccagc

SEQ ID NO: 3767616 - RNA, 15 nt, Salmonella typhimurium LT2
caauaacagccagcg

SEQ ID NO: 3767617 - RNA, 18 nt, Salmonella typhimurium LT2
caauaaccaccuguucgc

SEQ ID NO: 3767618 - RNA, 14 nt, Salmonella typhimurium LT2
caauaaccgccagc

SEQ ID NO: 3767619 - RNA, 20 nt, Salmonella typhimurium LT2
caauaaccgugguggcgaaa

SEQ ID NO: 3767620 - RNA, 20 nt, Salmonella typhimurium LT2
caauaacgaccccaauagcg

SEQ ID NO: 3767621 - RNA, 17 nt, Salmonella typhimurium LT2
caauaagcuugcuuucc

SEQ ID NO: 3767622 - RNA, 19 nt, Salmonella typhimurium LT2
caauaagggucgcgcugua

SEQ ID NO: 3767623 - RNA, 18 nt, Salmonella typhimurium LT2
caauaauaaaacggcuca

SEQ ID NO: 3767624 - RNA, 13 nt, Salmonella typhimurium LT2
caauaauaagaau

SEQ ID NO: 3767625 - RNA, 13 nt, Salmonella typhimurium LT2
caauaauauuguc

SEQ ID NO: 3767626 - RNA, 12 nt, Salmonella typhimurium LT2
caauaaucagau

SEQ ID NO: 3767627 - RNA, 18 nt, Salmonella typhimurium LT2
caauaaucccuucuuuua

SEQ ID NO: 3767628 - RNA, 18 nt, Salmonella typhimurium LT2
caauaaucgcgagaaaau

SEQ ID NO: 3767629 - RNA, 21 nt, Salmonella typhimurium LT2
caauaaugcaaauuauuuuau

SEQ ID NO: 3767630 - RNA, 15 nt, Salmonella typhimurium LT2
caauaaugcaggcua

SEQ ID NO: 3767631 - RNA, 23 nt, Salmonella typhimurium LT2
caauacaggcgaccgggcagaca

SEQ ID NO: 3767632 - RNA, 16 nt, Salmonella typhimurium LT2
caauaccaauaucgcc

SEQ ID NO: 3767633 - RNA, 14 nt, Salmonella typhimurium LT2
caauaccacgcccg

SEQ ID NO: 3767634 - RNA, 14 nt, Salmonella typhimurium LT2
caauaccagggcga

SEQ ID NO: 3767635 - RNA, 16 nt, Salmonella typhimurium LT2
caauaccguccagcgc

SEQ ID NO: 3767636 - RNA, 15 nt, Salmonella typhimurium LT2
caauacgccagccua

SEQ ID NO: 3767637 - RNA, 18 nt, Salmonella typhimurium LT2
caauacguccauuugaug

SEQ ID NO: 3767638 - RNA, 18 nt, Salmonella typhimurium LT2
caauacugauuuugccga

SEQ ID NO: 3767639 - RNA, 22 nt, Salmonella typhimurium LT2
caauacuuuuugacuccugaca

SEQ ID NO: 3767640 - RNA, 17 nt, Salmonella typhimurium LT2
caauagaccagcggccc

SEQ ID NO: 3767641 - RNA, 17 nt, Salmonella typhimurium LT2
caauagagucuaccgcc

SEQ ID NO: 3767642 - RNA, 21 nt, Salmonella typhimurium LT2
caauagagugcgauuugacau

SEQ ID NO: 3767643 - RNA, 16 nt, Salmonella typhimurium LT2
caauagcaaucuguaa

SEQ ID NO: 3767644 - RNA, 17 nt, Salmonella typhimurium LT2
caauagcaaucuguaac

SEQ ID NO: 3767645 - RNA, 19 nt, Salmonella typhimurium LT2
caauagccaauaacgucug

SEQ ID NO: 3767646 - RNA, 17 nt, Salmonella typhimurium LT2
caauagcgauucaucac

SEQ ID NO: 3767647 - RNA, 20 nt, Salmonella typhimurium LT2
caauagcgcuaaacagcgcc

SEQ ID NO: 3767648 - RNA, 22 nt, Salmonella typhimurium LT2
caauagguuggcuuuuuuaugc

SEQ ID NO: 3767649 - RNA, 20 nt, Salmonella typhimurium LT2
caauauacucccgaauggcu

SEQ ID NO: 3767650 - RNA, 12 nt, Salmonella typhimurium LT2
caauauacuuau

SEQ ID NO: 3767651 - RNA, 16 nt, Salmonella typhimurium LT2
caauauagccguggcu

SEQ ID NO: 3767652 - RNA, 15 nt, Salmonella typhimurium LT2
caauauaguuuuuac

SEQ ID NO: 3767653 - RNA, 15 nt, Salmonella typhimurium LT2
caauauccccagccc

SEQ ID NO: 3767654 - RNA, 19 nt, Salmonella typhimurium LT2
caauauccucgcauccucc

SEQ ID NO: 3767655 - RNA, 20 nt, Salmonella typhimurium LT2
caauaugaaaccgcccugca

SEQ ID NO: 3767656 - RNA, 19 nt, Salmonella typhimurium LT2
caauaugcagaucgacggu

SEQ ID NO: 3767657 - RNA, 12 nt, Salmonella typhimurium LT2
caauaugcgcau

SEQ ID NO: 3767658 - RNA, 22 nt, Salmonella typhimurium LT2
caauaugguauucgugcaucag

SEQ ID NO: 3767659 - RNA, 17 nt, Salmonella typhimurium LT2
caauaugucuuaaacag

SEQ ID NO: 3767660 - RNA, 22 nt, Salmonella typhimurium LT2
caauaugucuuaaacagcgauc

SEQ ID NO: 3767661 - RNA, 17 nt, Salmonella typhimurium LT2
caauaugugcaucggca

SEQ ID NO: 3767662 - RNA, 19 nt, Salmonella typhimurium LT2
caauauuaaagaugccuga

SEQ ID NO: 3767663 - RNA, 14 nt, Salmonella typhimurium LT2
caauauuaaaugac

SEQ ID NO: 3767664 - RNA, 20 nt, Salmonella typhimurium LT2
caauauuaaugcugcguuua

SEQ ID NO: 3767665 - RNA, 20 nt, Salmonella typhimurium LT2
caauauuacaaagcaguaaa

SEQ ID NO: 3767666 - RNA, 20 nt, Salmonella typhimurium LT2
caauauucacacgaauuccu

SEQ ID NO: 3767667 - RNA, 23 nt, Salmonella typhimurium LT2
caauauugaacauuuuuucagcc

SEQ ID NO: 3767668 - RNA, 20 nt, Salmonella typhimurium LT2
caauauuuaagcccaaccgc

SEQ ID NO: 3767669 - RNA, 22 nt, Salmonella typhimurium LT2
caauauuuuguaggccuaaaaa

SEQ ID NO: 3767670 - RNA, 20 nt, Salmonella typhimurium LT2
caaucaaauccaacucaguu

SEQ ID NO: 3767671 - RNA, 22 nt, Salmonella typhimurium LT2
caaucaacaccagcagcgcggc

SEQ ID NO: 3767672 - RNA, 11 nt, Salmonella typhimurium LT2
caaucaaccgc

SEQ ID NO: 3767673 - RNA, 13 nt, Salmonella typhimurium LT2
caaucaaccgcau

SEQ ID NO: 3767674 - RNA, 17 nt, Salmonella typhimurium LT2
caaucaacgcauuauau

SEQ ID NO: 3767675 - RNA, 16 nt, Salmonella typhimurium LT2
caaucaacuccauaau

SEQ ID NO: 3767676 - RNA, 21 nt, Salmonella typhimurium LT2
caaucacccacgucaguaaga

SEQ ID NO: 3767677 - RNA, 15 nt, Salmonella typhimurium LT2
caaucacgcagagua

SEQ ID NO: 3767678 - RNA, 21 nt, Salmonella typhimurium LT2
caaucacuuauguacaaccuc

SEQ ID NO: 3767679 - RNA, 15 nt, Salmonella typhimurium LT2
caaucagaaucagau

SEQ ID NO: 3767680 - RNA, 17 nt, Salmonella typhimurium LT2
caaucagaugcugacuc

SEQ ID NO: 3767681 - RNA, 17 nt, Salmonella typhimurium LT2
caaucagcgcggcgaag

SEQ ID NO: 3767682 - RNA, 22 nt, Salmonella typhimurium LT2
caaucaggcgcaaacgcgugcu

SEQ ID NO: 3767683 - RNA, 15 nt, Salmonella typhimurium LT2
caaucaguacgcgcg

SEQ ID NO: 3767684 - RNA, 17 nt, Salmonella typhimurium LT2
caaucaguucacgcgcc

SEQ ID NO: 3767685 - RNA, 13 nt, Salmonella typhimurium LT2
caaucauaauaaa

SEQ ID NO: 3767686 - RNA, 16 nt, Salmonella typhimurium LT2
caaucauauaaucuga

SEQ ID NO: 3767687 - RNA, 13 nt, Salmonella typhimurium LT2
caaucaucaccac

SEQ ID NO: 3767688 - RNA, 21 nt, Salmonella typhimurium LT2
caaucaucagaccgauaaaua

SEQ ID NO: 3767689 - RNA, 19 nt, Salmonella typhimurium LT2
caaucaucgacaguaccag

SEQ ID NO: 3767690 - RNA, 18 nt, Salmonella typhimurium LT2
caaucaugcgcaguugca

SEQ ID NO: 3767691 - RNA, 20 nt, Salmonella typhimurium LT2
caaucauugugguuucccug

SEQ ID NO: 3767692 - RNA, 17 nt, Salmonella typhimurium LT2
caauccacggguuacaa

SEQ ID NO: 3767693 - RNA, 16 nt, Salmonella typhimurium LT2
caauccgcggcaaauc

SEQ ID NO: 3767694 - RNA, 20 nt, Salmonella typhimurium LT2
caauccuggcgcacauugcu

SEQ ID NO: 3767695 - RNA, 20 nt, Salmonella typhimurium LT2
caauccugucgucaccagca

SEQ ID NO: 3767696 - RNA, 22 nt, Salmonella typhimurium LT2
caauccugucgucaccagcagg

SEQ ID NO: 3767697 - RNA, 20 nt, Salmonella typhimurium LT2
caauccuucuaccuucaccc

SEQ ID NO: 3767698 - RNA, 19 nt, Salmonella typhimurium LT2
cacaaccuccacgcccagc

SEQ ID NO: 3767699 - RNA, 15 nt, Salmonella typhimurium LT2
cacaacgcaccaacc

SEQ ID NO: 3767700 - RNA, 22 nt, Salmonella typhimurium LT2
cacaacgugccagaaacaagaa

SEQ ID NO: 3767701 - RNA, 16 nt, Salmonella typhimurium LT2
cacaagagcagcaacc

SEQ ID NO: 3767702 - RNA, 21 nt, Salmonella typhimurium LT2
cacaagauucacucugaaaaa

SEQ ID NO: 3767703 - RNA, 17 nt, Salmonella typhimurium LT2
cacaagccccacgcccg

SEQ ID NO: 3767704 - RNA, 20 nt, Salmonella typhimurium LT2
cacaagccccacgcccgcca

SEQ ID NO: 3767705 - RNA, 23 nt, Salmonella typhimurium LT2
cacaagcugugccauauucucug

SEQ ID NO: 3767706 - RNA, 15 nt, Salmonella typhimurium LT2
cacaagcuguuucuc

SEQ ID NO: 3767707 - RNA, 17 nt, Salmonella typhimurium LT2
cacaagcuguuucuccg

SEQ ID NO: 3767708 - RNA, 15 nt, Salmonella typhimurium LT2
cacaaguuuauccgg

SEQ ID NO: 3767709 - RNA, 19 nt, Salmonella typhimurium LT2
cacaauauacaguucgccg

SEQ ID NO: 3767710 - RNA, 13 nt, Salmonella typhimurium LT2
cacaaucagcgcg

SEQ ID NO: 3767711 - RNA, 20 nt, Salmonella typhimurium LT2
cacaaucgcgccugccagga

SEQ ID NO: 3767712 - RNA, 19 nt, Salmonella typhimurium LT2
cacaaucgucgugccuucc

SEQ ID NO: 3767713 - RNA, 18 nt, Salmonella typhimurium LT2
cacaaugccgcccaggau

SEQ ID NO: 3767714 - RNA, 22 nt, Salmonella typhimurium LT2
cacaaugcgacuuaucagaacu

SEQ ID NO: 3767715 - RNA, 16 nt, Salmonella typhimurium LT2
cacaauggucagcgcc

SEQ ID NO: 3767716 - RNA, 21 nt, Salmonella typhimurium LT2
cacaaugguugccuggugucc

SEQ ID NO: 3767717 - RNA, 14 nt, Salmonella typhimurium LT2
cacaaugucaucaa

SEQ ID NO: 3767718 - RNA, 13 nt, Salmonella typhimurium LT2
cacaauuacgcaa

SEQ ID NO: 3767719 - RNA, 17 nt, Salmonella typhimurium LT2
cacaauucugauuuuuu

SEQ ID NO: 3767720 - RNA, 14 nt, Salmonella typhimurium LT2
cacaccaucgucgc

SEQ ID NO: 3767721 - RNA, 18 nt, Salmonella typhimurium LT2
cacaccauuucacaaauu

SEQ ID NO: 3767722 - RNA, 19 nt, Salmonella typhimurium LT2
cacaccccgcgccgcugag

SEQ ID NO: 3767723 - RNA, 14 nt, Salmonella typhimurium LT2
cacacccugcagac

SEQ ID NO: 3767724 - RNA, 21 nt, Salmonella typhimurium LT2
cacaccggguucguaauaagg

SEQ ID NO: 3767725 - RNA, 15 nt, Salmonella typhimurium LT2
cacaccguuauccgg

SEQ ID NO: 3767726 - RNA, 20 nt, Salmonella typhimurium LT2
cacacgaauuccuuuuuccg

SEQ ID NO: 3767727 - RNA, 14 nt, Salmonella typhimurium LT2
cacacgcaaaaaag

SEQ ID NO: 3767728 - RNA, 20 nt, Salmonella typhimurium LT2
cacacgccuggccaggcuuu

SEQ ID NO: 3767729 - RNA, 21 nt, Salmonella typhimurium LT2
cacacgcuuauccagccacug

SEQ ID NO: 3767730 - RNA, 17 nt, Salmonella typhimurium LT2
cacacgcuucugguugu

SEQ ID NO: 3767731 - RNA, 21 nt, Salmonella typhimurium LT2
cacacgcuucugguugucacg

SEQ ID NO: 3767732 - RNA, 18 nt, Salmonella typhimurium LT2
cacacgucugagcagacg

SEQ ID NO: 3767733 - RNA, 14 nt, Salmonella typhimurium LT2
cacacucucuccag

SEQ ID NO: 3767734 - RNA, 17 nt, Salmonella typhimurium LT2
cacacugauggcagacc

SEQ ID NO: 3767735 - RNA, 18 nt, Salmonella typhimurium LT2
cacacugcgccgccagcg

SEQ ID NO: 3767736 - RNA, 18 nt, Salmonella typhimurium LT2
cacacugcuguguccagg

SEQ ID NO: 3767737 - RNA, 22 nt, Salmonella typhimurium LT2
cacacuuaccgacgcgugguga

SEQ ID NO: 3767738 - RNA, 15 nt, Salmonella typhimurium LT2
cacacuuucaucagc

SEQ ID NO: 3767739 - RNA, 24 nt, Salmonella typhimurium LT2
cacacuuucgcccggcgccagcuc

SEQ ID NO: 3767740 - RNA, 16 nt, Salmonella typhimurium LT2
cacagacccaguacaa

SEQ ID NO: 3767741 - RNA, 16 nt, Salmonella typhimurium LT2
cacagauuacaaggaa

SEQ ID NO: 3767742 - RNA, 20 nt, Salmonella typhimurium LT2
cacagcaauggacaaguaaa

SEQ ID NO: 3767743 - RNA, 20 nt, Salmonella typhimurium LT2
cacagcacaaugccuucugc

SEQ ID NO: 3767744 - RNA, 22 nt, Salmonella typhimurium LT2
cacagcacauagaagcucaugu

SEQ ID NO: 3767745 - RNA, 15 nt, Salmonella typhimurium LT2
cacagccacacugcu

SEQ ID NO: 3767746 - RNA, 17 nt, Salmonella typhimurium LT2
cacagccaggccgcgcc

SEQ ID NO: 3767747 - RNA, 19 nt, Salmonella typhimurium LT2
cacagccaguaagaacgag

SEQ ID NO: 3767748 - RNA, 22 nt, Salmonella typhimurium LT2
cacagcccauaccagcgcggca

SEQ ID NO: 3767749 - RNA, 14 nt, Salmonella typhimurium LT2
cacagccccagcac

SEQ ID NO: 3767750 - RNA, 16 nt, Salmonella typhimurium LT2
cacagccccagcacca

SEQ ID NO: 3767751 - RNA, 23 nt, Salmonella typhimurium LT2
cacagcccggcgcaaacacggcu

SEQ ID NO: 3767752 - RNA, 14 nt, Salmonella typhimurium LT2
cacagcggaaagca

SEQ ID NO: 3767753 - RNA, 21 nt, Salmonella typhimurium LT2
cacagcggaaagcaacagcaa

SEQ ID NO: 3767754 - RNA, 14 nt, Salmonella typhimurium LT2
cacagcggaauaga

SEQ ID NO: 3767755 - RNA, 21 nt, Salmonella typhimurium LT2
cacagcggacacccgcagccg

SEQ ID NO: 3767756 - RNA, 17 nt, Salmonella typhimurium LT2
cacagcguacaauggca

SEQ ID NO: 3767757 - RNA, 18 nt, Salmonella typhimurium LT2
cacagcucaauaucauag

SEQ ID NO: 3767758 - RNA, 15 nt, Salmonella typhimurium LT2
cacaggcagccaggu

SEQ ID NO: 3767759 - RNA, 13 nt, Salmonella typhimurium LT2
cacaggccaacau

SEQ ID NO: 3767760 - RNA, 20 nt, Salmonella typhimurium LT2
cacaggcggguauggcgcca

SEQ ID NO: 3767761 - RNA, 15 nt, Salmonella typhimurium LT2
cacaggcgucccggu

SEQ ID NO: 3767762 - RNA, 22 nt, Salmonella typhimurium LT2
cacaggcgucccggucggcgca

SEQ ID NO: 3767763 - RNA, 21 nt, Salmonella typhimurium LT2
cacagguacaggccgccgccu

SEQ ID NO: 3767764 - RNA, 15 nt, Salmonella typhimurium LT2
cacaguacgcccggc

SEQ ID NO: 3767765 - RNA, 13 nt, Salmonella typhimurium LT2
cacaguacgcggc

SEQ ID NO: 3767766 - RNA, 16 nt, Salmonella typhimurium LT2
cacagucaucgcgcca

SEQ ID NO: 3767767 - RNA, 14 nt, Salmonella typhimurium LT2
cacagugcgcgacc

SEQ ID NO: 3767768 - RNA, 21 nt, Salmonella typhimurium LT2
cacauaaagcccagaauagug

SEQ ID NO: 3767769 - RNA, 17 nt, Salmonella typhimurium LT2
cacauaagcacaccauu

SEQ ID NO: 3767770 - RNA, 13 nt, Salmonella typhimurium LT2
cacauacuucugu

SEQ ID NO: 3767771 - RNA, 18 nt, Salmonella typhimurium LT2
cacauagcauccagaccc

SEQ ID NO: 3767772 - RNA, 16 nt, Salmonella typhimurium LT2
cacauagcugagacuc

SEQ ID NO: 3767773 - RNA, 13 nt, Salmonella typhimurium LT2
cacauauacccgc

SEQ ID NO: 3767774 - RNA, 11 nt, Salmonella typhimurium LT2
cacauaucgca

SEQ ID NO: 3767775 - RNA, 17 nt, Salmonella typhimurium LT2
cacauauugcgcuucac

SEQ ID NO: 3767776 - RNA, 21 nt, Salmonella typhimurium LT2
cacaucaaagccccauaaccg

SEQ ID NO: 3767777 - RNA, 20 nt, Salmonella typhimurium LT2
cacaucaugaugaucuucag

SEQ ID NO: 3767778 - RNA, 20 nt, Salmonella typhimurium LT2
cacaucaugccagccgacag

SEQ ID NO: 3767779 - RNA, 20 nt, Salmonella typhimurium LT2
cacauccagacagccgacgg

SEQ ID NO: 3767780 - RNA, 13 nt, Salmonella typhimurium LT2
cacauccagcccc

SEQ ID NO: 3767781 - RNA, 16 nt, Salmonella typhimurium LT2
cacaucccagcagaga

SEQ ID NO: 3767782 - RNA, 15 nt, Salmonella typhimurium LT2
cacauccgccagcgc

SEQ ID NO: 3767783 - RNA, 16 nt, Salmonella typhimurium LT2
cacauccgccagcgcc

SEQ ID NO: 3767784 - RNA, 20 nt, Salmonella typhimurium LT2
cacauccggcguguaaaccg

SEQ ID NO: 3767785 - RNA, 20 nt, Salmonella typhimurium LT2
cacaucgacaugcagaucgc

SEQ ID NO: 3767786 - RNA, 15 nt, Salmonella typhimurium LT2
cacaucgccguucca

SEQ ID NO: 3767787 - RNA, 21 nt, Salmonella typhimurium LT2
cacaucguaaaucagcgugau

SEQ ID NO: 3767788 - RNA, 17 nt, Salmonella typhimurium LT2
cacaucguuggccgcca

SEQ ID NO: 3767789 - RNA, 14 nt, Salmonella typhimurium LT2
cacaugaccagcgc

SEQ ID NO: 3767790 - RNA, 17 nt, Salmonella typhimurium LT2
cacaugauguuuuaaca

SEQ ID NO: 3767791 - RNA, 16 nt, Salmonella typhimurium LT2
cacaugcggaagcaaa

SEQ ID NO: 3767792 - RNA, 17 nt, Salmonella typhimurium LT2
cacauuggaaaacccca

SEQ ID NO: 3767793 - RNA, 12 nt, Salmonella typhimurium LT2
cacauuggcaaa

SEQ ID NO: 3767794 - RNA, 16 nt, Salmonella typhimurium LT2
cacauuuagcgcagua

SEQ ID NO: 3767795 - RNA, 23 nt, Salmonella typhimurium LT2
cacauuuuauccggcgucacacc

SEQ ID NO: 3767796 - RNA, 17 nt, Salmonella typhimurium LT2
caccaaaaauucuuuua

SEQ ID NO: 3767797 - RNA, 15 nt, Salmonella typhimurium LT2
caccaaaucccccaa

SEQ ID NO: 3767798 - RNA, 14 nt, Salmonella typhimurium LT2
caccaacgaggcga

SEQ ID NO: 3767799 - RNA, 16 nt, Salmonella typhimurium LT2
caccaacgcuggucag

SEQ ID NO: 3767800 - RNA, 21 nt, Salmonella typhimurium LT2
caccaacggcgacgcccgcca

SEQ ID NO: 3767801 - RNA, 17 nt, Salmonella typhimurium LT2
caccaauacgugagcga

SEQ ID NO: 3767802 - RNA, 12 nt, Salmonella typhimurium LT2
aaaaaacaucau

SEQ ID NO: 3767803 - RNA, 11 nt, Salmonella typhimurium LT2
aaaaaaccaga

SEQ ID NO: 3767804 - RNA, 19 nt, Salmonella typhimurium LT2
aaaaaaccggcaacucgcc

SEQ ID NO: 3767805 - RNA, 20 nt, Salmonella typhimurium LT2
aaaaaacgcccagaucgacc

SEQ ID NO: 3767806 - RNA, 11 nt, Salmonella typhimurium LT2
aaaaaagagaa

SEQ ID NO: 3767807 - RNA, 11 nt, Salmonella typhimurium LT2
aaaaaagccau

SEQ ID NO: 3767808 - RNA, 18 nt, Salmonella typhimurium LT2
aaaaaagcgcccagcgcc

SEQ ID NO: 3767809 - RNA, 13 nt, Salmonella typhimurium LT2
aaaaaaggcagcc

SEQ ID NO: 3767810 - RNA, 17 nt, Salmonella typhimurium LT2
aaaaaauaguaaaguuu

SEQ ID NO: 3767811 - RNA, 23 nt, Salmonella typhimurium LT2
aaaaaauaugcaauuaauauauu

SEQ ID NO: 3767812 - RNA, 12 nt, Salmonella typhimurium LT2
aaaaaaucagca

SEQ ID NO: 3767813 - RNA, 13 nt, Salmonella typhimurium LT2
aaaaaauccagua

SEQ ID NO: 3767814 - RNA, 14 nt, Salmonella typhimurium LT2
aaaaacagccauaa

SEQ ID NO: 3767815 - RNA, 20 nt, Salmonella typhimurium LT2
aaaaacagccauaaugcugc

SEQ ID NO: 3767816 - RNA, 19 nt, Salmonella typhimurium LT2
aaaaacagcgcaauaugca

SEQ ID NO: 3767817 - RNA, 21 nt, Salmonella typhimurium LT2
aaaaacaggcgcaggcauuaa

SEQ ID NO: 3767818 - RNA, 13 nt, Salmonella typhimurium LT2
aaaaaccccuggu

SEQ ID NO: 3767819 - RNA, 12 nt, Salmonella typhimurium LT2
aaaaaccuccgg

SEQ ID NO: 3767820 - RNA, 18 nt, Salmonella typhimurium LT2
aaaaacggcgcuuuuaaa

SEQ ID NO: 3767821 - RNA, 15 nt, Salmonella typhimurium LT2
aaaaacucaggaaau

SEQ ID NO: 3767822 - RNA, 13 nt, Salmonella typhimurium LT2
aaaaagaaaaaua

SEQ ID NO: 3767823 - RNA, 15 nt, Salmonella typhimurium LT2
aaaaagaaagcugcc

SEQ ID NO: 3767824 - RNA, 15 nt, Salmonella typhimurium LT2
aaaaagaagaaaaaa

SEQ ID NO: 3767825 - RNA, 17 nt, Salmonella typhimurium LT2
aaaaagaagaaaaaauu

SEQ ID NO: 3767826 - RNA, 21 nt, Salmonella typhimurium LT2
aaaaagaggccggauggcggu

SEQ ID NO: 3767827 - RNA, 19 nt, Salmonella typhimurium LT2
aaaaagccaagcacaaaaa

SEQ ID NO: 3767828 - RNA, 18 nt, Salmonella typhimurium LT2
aaaaagcccguccgucag

SEQ ID NO: 3767829 - RNA, 22 nt, Salmonella typhimurium LT2
aaaaagccgcucgccagaacau

SEQ ID NO: 3767830 - RNA, 17 nt, Salmonella typhimurium LT2
aaaaagcguacaaaaaa

SEQ ID NO: 3767831 - RNA, 15 nt, Salmonella typhimurium LT2
aaaaagggaauaaua

SEQ ID NO: 3767832 - RNA, 18 nt, Salmonella typhimurium LT2
aaaaagugaaaaaacgga

SEQ ID NO: 3767833 - RNA, 11 nt, Salmonella typhimurium LT2
aaaaauaaaaa

SEQ ID NO: 3767834 - RNA, 13 nt, Salmonella typhimurium LT2
aaaaauaaaaaaa

SEQ ID NO: 3767835 - RNA, 21 nt, Salmonella typhimurium LT2
aaaaauaauuacuaucuucaa

SEQ ID NO: 3767836 - RNA, 20 nt, Salmonella typhimurium LT2
aaaaauacugauaaaaaaca

SEQ ID NO: 3767837 - RNA, 13 nt, Salmonella typhimurium LT2
aaaaauaucugaa

SEQ ID NO: 3767838 - RNA, 12 nt, Salmonella typhimurium LT2
aaaaauccagua

SEQ ID NO: 3767839 - RNA, 23 nt, Salmonella typhimurium LT2
aaaaaucccccauugccccaugu

SEQ ID NO: 3767840 - RNA, 15 nt, Salmonella typhimurium LT2
aaaaauccccccucc

SEQ ID NO: 3767841 - RNA, 22 nt, Salmonella typhimurium LT2
aaaaauggguaugcgacugaaa

SEQ ID NO: 3767842 - RNA, 18 nt, Salmonella typhimurium LT2
aaaaauuaaaacaaguca

SEQ ID NO: 3767843 - RNA, 13 nt, Salmonella typhimurium LT2
aaaaauuuaagcc

SEQ ID NO: 3767844 - RNA, 22 nt, Salmonella typhimurium LT2
aaaaauuuaagccagauguaau

SEQ ID NO: 3767845 - RNA, 19 nt, Salmonella typhimurium LT2
aaaaauuuuugaucugcuu

SEQ ID NO: 3767846 - RNA, 22 nt, Salmonella typhimurium LT2
aaaacagaaccccaucgccuga

SEQ ID NO: 3767847 - RNA, 13 nt, Salmonella typhimurium LT2
aaaacagcauaau

SEQ ID NO: 3767848 - RNA, 13 nt, Salmonella typhimurium LT2
aaaacagcauggu

SEQ ID NO: 3767849 - RNA, 17 nt, Salmonella typhimurium LT2
aaaacagccauaaugcu

SEQ ID NO: 3767850 - RNA, 19 nt, Salmonella typhimurium LT2
aaaacagugauuacaaaau

SEQ ID NO: 3767851 - RNA, 23 nt, Salmonella typhimurium LT2
aaaacauaaagauaaauaaaaaa

SEQ ID NO: 3767852 - RNA, 18 nt, Salmonella typhimurium LT2
aaaaccaagcgcauggua

SEQ ID NO: 3767853 - RNA, 14 nt, Salmonella typhimurium LT2
aaaaccagaacuuc

SEQ ID NO: 3767854 - RNA, 13 nt, Salmonella typhimurium LT2
aaaaccaggcaac

SEQ ID NO: 3767855 - RNA, 18 nt, Salmonella typhimurium LT2
aaaaccaggcgaaaauag

SEQ ID NO: 3767856 - RNA, 14 nt, Salmonella typhimurium LT2
aaaacccaauaacu

SEQ ID NO: 3767857 - RNA, 20 nt, Salmonella typhimurium LT2
aaaaccgaucgccuaaaauc

SEQ ID NO: 3767858 - RNA, 15 nt, Salmonella typhimurium LT2
aaaaccgaucuccca

SEQ ID NO: 3767859 - RNA, 20 nt, Salmonella typhimurium LT2
aaaaccguagcuuugcgcca

SEQ ID NO: 3767860 - RNA, 20 nt, Salmonella typhimurium LT2
aaaaccuaaauaaauaccaa

SEQ ID NO: 3767861 - RNA, 14 nt, Salmonella typhimurium LT2
aaaaccugaaagca

SEQ ID NO: 3767862 - RNA, 18 nt, Salmonella typhimurium LT2
aaaaccuucauaaauacg

SEQ ID NO: 3767863 - RNA, 21 nt, Salmonella typhimurium LT2
aaaacgccgccuugcggcggc

SEQ ID NO: 3767864 - RNA, 12 nt, Salmonella typhimurium LT2
aaaacgccugcc

SEQ ID NO: 3767865 - RNA, 18 nt, Salmonella typhimurium LT2
aaaacgcgcucgccagcg

SEQ ID NO: 3767866 - RNA, 19 nt, Salmonella typhimurium LT2
aaaacgcgcucgccagcgc

SEQ ID NO: 3767867 - RNA, 23 nt, Salmonella typhimurium LT2
aaaacgcgcugauacuuauuacg

SEQ ID NO: 3767868 - RNA, 21 nt, Salmonella typhimurium LT2
aaaacgcuaugccuggaugua

SEQ ID NO: 3767869 - RNA, 16 nt, Salmonella typhimurium LT2
aaaacgcucgcgcugu

SEQ ID NO: 3767870 - RNA, 13 nt, Salmonella typhimurium LT2
aaaacggaacggc

SEQ ID NO: 3767871 - RNA, 18 nt, Salmonella typhimurium LT2
aaaacggauaauaucuuu

SEQ ID NO: 3767872 - RNA, 18 nt, Salmonella typhimurium LT2
aaaacgggagauuguuau

SEQ ID NO: 3767873 - RNA, 17 nt, Salmonella typhimurium LT2
aaaacgguauaaaaaac

SEQ ID NO: 3767874 - RNA, 22 nt, Salmonella typhimurium LT2
aaaacguaacguacgggugucc

SEQ ID NO: 3767875 - RNA, 22 nt, Salmonella typhimurium LT2
aaaacguagagugcuucuucaa

SEQ ID NO: 3767876 - RNA, 15 nt, Salmonella typhimurium LT2
aaaacgugguaaaaa

SEQ ID NO: 3767877 - RNA, 14 nt, Salmonella typhimurium LT2
aaaacguugcugga

SEQ ID NO: 3767878 - RNA, 13 nt, Salmonella typhimurium LT2
aaaacuacaacaa

SEQ ID NO: 3767879 - RNA, 14 nt, Salmonella typhimurium LT2
aaaacuacaacaau

SEQ ID NO: 3767880 - RNA, 16 nt, Salmonella typhimurium LT2
aaaacuaccgcgccag

SEQ ID NO: 3767881 - RNA, 21 nt, Salmonella typhimurium LT2
aaaacucuccaugccaucggc

SEQ ID NO: 3767882 - RNA, 14 nt, Salmonella typhimurium LT2
aaaacucugagcau

SEQ ID NO: 3767883 - RNA, 20 nt, Salmonella typhimurium LT2
aaaacucugagcauacacau

SEQ ID NO: 3767884 - RNA, 16 nt, Salmonella typhimurium LT2
aaaacugaguucgcca

SEQ ID NO: 3767885 - RNA, 17 nt, Salmonella typhimurium LT2
aaaacugucccugaugu

SEQ ID NO: 3767886 - RNA, 22 nt, Salmonella typhimurium LT2
aaaacuuauuuuauuuuuauau

SEQ ID NO: 3767887 - RNA, 19 nt, Salmonella typhimurium LT2
aaaacuucgauaauaaaau

SEQ ID NO: 3767888 - RNA, 21 nt, Salmonella typhimurium LT2
aaaacuucgauaauaaaauau

SEQ ID NO: 3767889 - RNA, 15 nt, Salmonella typhimurium LT2
aaaagaacucacuca

SEQ ID NO: 3767890 - RNA, 13 nt, Salmonella typhimurium LT2
aaaagaagaaaaa

SEQ ID NO: 3767891 - RNA, 16 nt, Salmonella typhimurium LT2
aaaagaaucgccaggc

SEQ ID NO: 3767892 - RNA, 17 nt, Salmonella typhimurium LT2
aaaagaaucgccaggcg

SEQ ID NO: 3767893 - RNA, 22 nt, Salmonella typhimurium LT2
aaaagaccuggggguaacacaa

SEQ ID NO: 3767894 - RNA, 17 nt, Salmonella typhimurium LT2
aaaagagcuuauuuuga

SEQ ID NO: 3767895 - RNA, 12 nt, Salmonella typhimurium LT2
aaaagaggaaag

SEQ ID NO: 3767896 - RNA, 16 nt, Salmonella typhimurium LT2
aaaagcacaucaggaa

SEQ ID NO: 3767897 - RNA, 17 nt, Salmonella typhimurium LT2
aaaagcagaggccugaa

SEQ ID NO: 3767898 - RNA, 15 nt, Salmonella typhimurium LT2
aaaagccaugccgaa

SEQ ID NO: 3767899 - RNA, 23 nt, Salmonella typhimurium LT2
aaaagcccccaucaccugaccga

SEQ ID NO: 3767900 - RNA, 16 nt, Salmonella typhimurium LT2
aaaagccgugaauaaa

SEQ ID NO: 3767901 - RNA, 14 nt, Salmonella typhimurium LT2
aaaagcgacgcugu

SEQ ID NO: 3767902 - RNA, 19 nt, Salmonella typhimurium LT2
aaaagcgauuuauucuuug

SEQ ID NO: 3767903 - RNA, 20 nt, Salmonella typhimurium LT2
aaaagcgcgcccuuucaguu

SEQ ID NO: 3767904 - RNA, 23 nt, Salmonella typhimurium LT2
aaaagcgcgcccuuucaguucaa

SEQ ID NO: 3767905 - RNA, 18 nt, Salmonella typhimurium LT2
aaaagcgguaauaacuga

SEQ ID NO: 3767906 - RNA, 21 nt, Salmonella typhimurium LT2
aaaagcucgucuguuguucuu

SEQ ID NO: 3767907 - RNA, 19 nt, Salmonella typhimurium LT2
aaaagcugcgaucaaguuu

SEQ ID NO: 3767908 - RNA, 16 nt, Salmonella typhimurium LT2
aaaaggauacagcgcc

SEQ ID NO: 3767909 - RNA, 22 nt, Salmonella typhimurium LT2
aaaaggcagagcgcgcucugcc

SEQ ID NO: 3767910 - RNA, 14 nt, Salmonella typhimurium LT2
aaaaggcagccgaa

SEQ ID NO: 3767911 - RNA, 13 nt, Salmonella typhimurium LT2
aaaaggccacgca

SEQ ID NO: 3767912 - RNA, 15 nt, Salmonella typhimurium LT2
aaaaggcucgcauuc

SEQ ID NO: 3767913 - RNA, 18 nt, Salmonella typhimurium LT2
aaaagggaauaauacacg

SEQ ID NO: 3767914 - RNA, 14 nt, Salmonella typhimurium LT2
aaaagggaguauua

SEQ ID NO: 3767915 - RNA, 21 nt, Salmonella typhimurium LT2
aaaaggguggugaaucagaag

SEQ ID NO: 3767916 - RNA, 23 nt, Salmonella typhimurium LT2
aaaaguacaaugcaaagaaaaac

SEQ ID NO: 3767917 - RNA, 19 nt, Salmonella typhimurium LT2
aaaaguguguaccagcaac

SEQ ID NO: 3767918 - RNA, 13 nt, Salmonella typhimurium LT2
aaaauaaaaaagg

SEQ ID NO: 3767919 - RNA, 13 nt, Salmonella typhimurium LT2
aaaauaaaauuau

SEQ ID NO: 3767920 - RNA, 18 nt, Salmonella typhimurium LT2
aaaauaaaauuauauucu

SEQ ID NO: 3767921 - RNA, 14 nt, Salmonella typhimurium LT2
aaaauaaaucggca

SEQ ID NO: 3767922 - RNA, 23 nt, Salmonella typhimurium LT2
aaaauaagagggcgccaugcuga

SEQ ID NO: 3767923 - RNA, 21 nt, Salmonella typhimurium LT2
aaaauaagcaauuacuauucc

SEQ ID NO: 3767924 - RNA, 16 nt, Salmonella typhimurium LT2
aaaauaaugccucauu

SEQ ID NO: 3767925 - RNA, 23 nt, Salmonella typhimurium LT2
aaaauaaugccucauuaaaaaaa

SEQ ID NO: 3767926 - RNA, 14 nt, Salmonella typhimurium LT2
aaaauaauugauaa

SEQ ID NO: 3767927 - RNA, 16 nt, Salmonella typhimurium LT2
aaaauaccgcacauca

SEQ ID NO: 3767928 - RNA, 17 nt, Salmonella typhimurium LT2
aaaauacuuccauuccc

SEQ ID NO: 3767929 - RNA, 12 nt, Salmonella typhimurium LT2
aaaauagccuga

SEQ ID NO: 3767930 - RNA, 18 nt, Salmonella typhimurium LT2
aaaauauaacuucuuaau

SEQ ID NO: 3767931 - RNA, 19 nt, Salmonella typhimurium LT2
aaaauauccgccaucgaca

SEQ ID NO: 3767932 - RNA, 20 nt, Salmonella typhimurium LT2
aaaauaucgaugcuuauuau

SEQ ID NO: 3767933 - RNA, 13 nt, Salmonella typhimurium LT2
aaaauaucugaau

SEQ ID NO: 3767934 - RNA, 16 nt, Salmonella typhimurium LT2
aaaauaucugaauaac

SEQ ID NO: 3767935 - RNA, 20 nt, Salmonella typhimurium LT2
aaaauaugcaauuaauauau

SEQ ID NO: 3767936 - RNA, 21 nt, Salmonella typhimurium LT2
aaaauauuacgccaucagcau

SEQ ID NO: 3767937 - RNA, 23 nt, Salmonella typhimurium LT2
aaaauauuuaacuuaaauaaaaa

SEQ ID NO: 3767938 - RNA, 13 nt, Salmonella typhimurium LT2
aaaaucagcaauc

SEQ ID NO: 3767939 - RNA, 19 nt, Salmonella typhimurium LT2
aaaaucauucgaccacaac

SEQ ID NO: 3767940 - RNA, 11 nt, Salmonella typhimurium LT2
aaaauccaggg

SEQ ID NO: 3767941 - RNA, 16 nt, Salmonella typhimurium LT2
aaaauccaguaaugcc

SEQ ID NO: 3767942 - RNA, 19 nt, Salmonella typhimurium LT2
aaaauccggaucaucuuuu

SEQ ID NO: 3767943 - RNA, 21 nt, Salmonella typhimurium LT2
aaaauccucuaccggaaaaca

SEQ ID NO: 3767944 - RNA, 23 nt, Salmonella typhimurium LT2
aaaauccucuaccggaaaacagc

SEQ ID NO: 3767945 - RNA, 11 nt, Salmonella typhimurium LT2
aaaaucgacug

SEQ ID NO: 3767946 - RNA, 16 nt, Salmonella typhimurium LT2
aaaaucgucaucagau

SEQ ID NO: 3767947 - RNA, 19 nt, Salmonella typhimurium LT2
aaaaucgucccuuuucccc

SEQ ID NO: 3767948 - RNA, 17 nt, Salmonella typhimurium LT2
aaaaucugaauucgcca

SEQ ID NO: 3767949 - RNA, 18 nt, Salmonella typhimurium LT2
aaaaucugguguaaauaa

SEQ ID NO: 3767950 - RNA, 16 nt, Salmonella typhimurium LT2
aaaaucuucuucagcu

SEQ ID NO: 3767951 - RNA, 12 nt, Salmonella typhimurium LT2
aaaaugaaaaau

SEQ ID NO: 3767952 - RNA, 15 nt, Salmonella typhimurium LT2
aaaaugaauaccaaa

SEQ ID NO: 3767953 - RNA, 14 nt, Salmonella typhimurium LT2
aaaaugacacccag

SEQ ID NO: 3767954 - RNA, 13 nt, Salmonella typhimurium LT2
aaaaugaccgucg

SEQ ID NO: 3767955 - RNA, 21 nt, Salmonella typhimurium LT2
aaaaugagauugauaaucagc

SEQ ID NO: 3767956 - RNA, 20 nt, Salmonella typhimurium LT2
aaaaugaucagaccaucggc

SEQ ID NO: 3767957 - RNA, 16 nt, Salmonella typhimurium LT2
aaaaugaugcaacaug

SEQ ID NO: 3767958 - RNA, 18 nt, Salmonella typhimurium LT2
aaaaugcucaguauggcc

SEQ ID NO: 3767959 - RNA, 20 nt, Salmonella typhimurium LT2
aaaauggucggucacgcgau

SEQ ID NO: 3767960 - RNA, 13 nt, Salmonella typhimurium LT2
aaaauguucaugu

SEQ ID NO: 3767961 - RNA, 23 nt, Salmonella typhimurium LT2
aaaauuacuucguagacucaggc

SEQ ID NO: 3767962 - RNA, 20 nt, Salmonella typhimurium LT2
aaaauuauccacaaacucca

SEQ ID NO: 3767963 - RNA, 20 nt, Salmonella typhimurium LT2
aaaauuauuggcuuuguaaa

SEQ ID NO: 3767964 - RNA, 15 nt, Salmonella typhimurium LT2
aaaauuauuuuaaau

SEQ ID NO: 3767965 - RNA, 18 nt, Salmonella typhimurium LT2
aaaauucauuauaaaaca

SEQ ID NO: 3767966 - RNA, 17 nt, Salmonella typhimurium LT2
aaaauugacaauaagau

SEQ ID NO: 3767967 - RNA, 18 nt, Salmonella typhimurium LT2
aaaauuuugcauaaauaa

SEQ ID NO: 3767968 - RNA, 17 nt, Salmonella typhimurium LT2
aaacaaacauugcugga

SEQ ID NO: 3767969 - RNA, 16 nt, Salmonella typhimurium LT2
aaacaaauaaauccau

SEQ ID NO: 3767970 - RNA, 12 nt, Salmonella typhimurium LT2
aaacaacacacg

SEQ ID NO: 3767971 - RNA, 13 nt, Salmonella typhimurium LT2
aaacaagaucgcc

SEQ ID NO: 3767972 - RNA, 16 nt, Salmonella typhimurium LT2
aaacaagauuaauuua

SEQ ID NO: 3767973 - RNA, 20 nt, Salmonella typhimurium LT2
aaacaaggcgcuaccaggau

SEQ ID NO: 3767974 - RNA, 15 nt, Salmonella typhimurium LT2
aaacaagucagcguu

SEQ ID NO: 3767975 - RNA, 15 nt, Salmonella typhimurium LT2
aaacaauuuccccca

SEQ ID NO: 3767976 - RNA, 22 nt, Salmonella typhimurium LT2
aaacacaaucacaacgucaucc

SEQ ID NO: 3767977 - RNA, 12 nt, Salmonella typhimurium LT2
aaacaccaacaa

SEQ ID NO: 3767978 - RNA, 11 nt, Salmonella typhimurium LT2
aaacaccagaa

SEQ ID NO: 3767979 - RNA, 14 nt, Salmonella typhimurium LT2
aaacaccagaaugc

SEQ ID NO: 3767980 - RNA, 20 nt, Salmonella typhimurium LT2
aaacacgauggcaaauaaua

SEQ ID NO: 3767981 - RNA, 16 nt, Salmonella typhimurium LT2
aaacacgccgcgcugg

SEQ ID NO: 3767982 - RNA, 15 nt, Salmonella typhimurium LT2
aaacacgucuggaaa

SEQ ID NO: 3767983 - RNA, 14 nt, Salmonella typhimurium LT2
aaacagacaauuag

SEQ ID NO: 3767984 - RNA, 20 nt, Salmonella typhimurium LT2
aaacagauaagcgucugcaa

SEQ ID NO: 3767985 - RNA, 22 nt, Salmonella typhimurium LT2
aaacagcacuacagcccuuuca

SEQ ID NO: 3767986 - RNA, 15 nt, Salmonella typhimurium LT2
aaacagcagaacaac

SEQ ID NO: 3767987 - RNA, 16 nt, Salmonella typhimurium LT2
aaacagccaaucauaa

SEQ ID NO: 3767988 - RNA, 15 nt, Salmonella typhimurium LT2
aaacagccgccaugg

SEQ ID NO: 3767989 - RNA, 18 nt, Salmonella typhimurium LT2
aaacagccugucgccguc

SEQ ID NO: 3767990 - RNA, 18 nt, Salmonella typhimurium LT2
aaacagcgccaguuuuuc

SEQ ID NO: 3767991 - RNA, 23 nt, Salmonella typhimurium LT2
aaacagcgccaguuuuuccuguu

SEQ ID NO: 3767992 - RNA, 14 nt, Salmonella typhimurium LT2
aaacagcuguaaau

SEQ ID NO: 3767993 - RNA, 21 nt, Salmonella typhimurium LT2
aaacaggcgcaggcauuaaaa

SEQ ID NO: 3767994 - RNA, 15 nt, Salmonella typhimurium LT2
aaacagguaaaacaa

SEQ ID NO: 3767995 - RNA, 19 nt, Salmonella typhimurium LT2
aaacagguaaaacaaaaaa

SEQ ID NO: 3767996 - RNA, 20 nt, Salmonella typhimurium LT2
aaacaggucuguaugacaac

SEQ ID NO: 3767997 - RNA, 19 nt, Salmonella typhimurium LT2
aaacaguccggcgaaaaaa

SEQ ID NO: 3767998 - RNA, 22 nt, Salmonella typhimurium LT2
aaacaguuccgcaaagcccauc

SEQ ID NO: 3767999 - RNA, 23 nt, Salmonella typhimurium LT2
aaacaguuuaguugccguuuuuc

SEQ ID NO: 3768000 - RNA, 13 nt, Salmonella typhimurium LT2
aaacauaagcaaa

SEQ ID NO: 3768001 - RNA, 16 nt, Salmonella typhimurium LT2
aaacauaagcaaaucc

SEQ ID NO: 3768002 - RNA, 22 nt, Salmonella typhimurium LT2
aaacauaccgccgguaaggcca

SEQ ID NO: 3768003 - RNA, 15 nt, Salmonella typhimurium LT2
aaacauaucacgaaa

SEQ ID NO: 3768004 - RNA, 14 nt, Salmonella typhimurium LT2
aaacaucagccauu

SEQ ID NO: 3768005 - RNA, 13 nt, Salmonella typhimurium LT2
aaacaucagcgcg

SEQ ID NO: 3768006 - RNA, 16 nt, Salmonella typhimurium LT2
aaacaucauaauaauu

SEQ ID NO: 3768007 - RNA, 15 nt, Salmonella typhimurium LT2
aaacaucaugcccaa

SEQ ID NO: 3768008 - RNA, 14 nt, Salmonella typhimurium LT2
aaacaucccgauaa

SEQ ID NO: 3768009 - RNA, 17 nt, Salmonella typhimurium LT2
aaacaucgcccuccagc

SEQ ID NO: 3768010 - RNA, 18 nt, Salmonella typhimurium LT2
aaacaucgguaauagcgg

SEQ ID NO: 3768011 - RNA, 16 nt, Salmonella typhimurium LT2
aaacaucugcuccagc

SEQ ID NO: 3768012 - RNA, 16 nt, Salmonella typhimurium LT2
aaaccaaacaccagau

SEQ ID NO: 3768013 - RNA, 13 nt, Salmonella typhimurium LT2
aaaccaacagccg

SEQ ID NO: 3768014 - RNA, 19 nt, Salmonella typhimurium LT2
aaaccaacguugaagagcu

SEQ ID NO: 3768015 - RNA, 19 nt, Salmonella typhimurium LT2
aaaccacaaucacagcgca

SEQ ID NO: 3768016 - RNA, 21 nt, Salmonella typhimurium LT2
aaaccaccauacccaacagca

SEQ ID NO: 3768017 - RNA, 22 nt, Salmonella typhimurium LT2
aaaccaccauacccaacagcag

SEQ ID NO: 3768018 - RNA, 18 nt, Salmonella typhimurium LT2
aaaccacuuaacguuacc

SEQ ID NO: 3768019 - RNA, 15 nt, Salmonella typhimurium LT2
aaaccagaacuucca

SEQ ID NO: 3768020 - RNA, 17 nt, Salmonella typhimurium LT2
aaaccagaauuuguugg

SEQ ID NO: 3768021 - RNA, 14 nt, Salmonella typhimurium LT2
aaaccagcauaaua

SEQ ID NO: 3768022 - RNA, 17 nt, Salmonella typhimurium LT2
aaaccaggcauuuucuu

SEQ ID NO: 3768023 - RNA, 22 nt, Salmonella typhimurium LT2
aaaccaggcuuagccgccgugg

SEQ ID NO: 3768024 - RNA, 17 nt, Salmonella typhimurium LT2
aaaccaguugccagggu

SEQ ID NO: 3768025 - RNA, 13 nt, Salmonella typhimurium LT2
aaaccaguuuuuc

SEQ ID NO: 3768026 - RNA, 20 nt, Salmonella typhimurium LT2
aaaccauaauaaugccaaaa

SEQ ID NO: 3768027 - RNA, 21 nt, Salmonella typhimurium LT2
aaaccauaauaaugccaaaau

SEQ ID NO: 3768028 - RNA, 22 nt, Salmonella typhimurium LT2
aaaccauaauaaugccaaaaug

SEQ ID NO: 3768029 - RNA, 20 nt, Salmonella typhimurium LT2
aaaccauguugaucguaaaa

SEQ ID NO: 3768030 - RNA, 21 nt, Salmonella typhimurium LT2
aaaccauucaaauucaauaaa

SEQ ID NO: 3768031 - RNA, 18 nt, Salmonella typhimurium LT2
aaaccauuucuccugcau

SEQ ID NO: 3768032 - RNA, 15 nt, Salmonella typhimurium LT2
aaacccaccagcagg

SEQ ID NO: 3768033 - RNA, 18 nt, Salmonella typhimurium LT2
aaaccccagauuacugcc

SEQ ID NO: 3768034 - RNA, 19 nt, Salmonella typhimurium LT2
aaacccgauucugccaguu

SEQ ID NO: 3768035 - RNA, 18 nt, Salmonella typhimurium LT2
aaacccguuaaauaccag

SEQ ID NO: 3768036 - RNA, 13 nt, Salmonella typhimurium LT2
aaacccugcgcca

SEQ ID NO: 3768037 - RNA, 23 nt, Salmonella typhimurium LT2
aaaccgaaaggguauacaaaaaa

SEQ ID NO: 3768038 - RNA, 16 nt, Salmonella typhimurium LT2
aaaccgacagcaauau

SEQ ID NO: 3768039 - RNA, 16 nt, Salmonella typhimurium LT2
aaaccgacccaaaaau

SEQ ID NO: 3768040 - RNA, 17 nt, Salmonella typhimurium LT2
aaaccgauaaucaccag

SEQ ID NO: 3768041 - RNA, 11 nt, Salmonella typhimurium LT2
aaaccgaucuc

SEQ ID NO: 3768042 - RNA, 15 nt, Salmonella typhimurium LT2
aaaccgaucucccag

SEQ ID NO: 3768043 - RNA, 16 nt, Salmonella typhimurium LT2
aaaccgaucucccagc

SEQ ID NO: 3768044 - RNA, 20 nt, Salmonella typhimurium LT2
aaaccgcccccagucugcug

SEQ ID NO: 3768045 - RNA, 15 nt, Salmonella typhimurium LT2
aaaccgccgcccauc

SEQ ID NO: 3768046 - RNA, 19 nt, Salmonella typhimurium LT2
aaaccgccguuuugauuug

SEQ ID NO: 3768047 - RNA, 22 nt, Salmonella typhimurium LT2
aaaccgcucgccgccucccccu

SEQ ID NO: 3768048 - RNA, 20 nt, Salmonella typhimurium LT2
aaaccggguaacagcauuga

SEQ ID NO: 3768049 - RNA, 19 nt, Salmonella typhimurium LT2
aaaccggucaggcagcaga

SEQ ID NO: 3768050 - RNA, 20 nt, Salmonella typhimurium LT2
aaaccggucaggcagcagac

SEQ ID NO: 3768051 - RNA, 18 nt, Salmonella typhimurium LT2
aaaccgucucgccgcggu

SEQ ID NO: 3768052 - RNA, 18 nt, Salmonella typhimurium LT2
aaaccuaaauaaauacca

SEQ ID NO: 3768053 - RNA, 16 nt, Salmonella typhimurium LT2
aaaccugagcauauaa

SEQ ID NO: 3768054 - RNA, 18 nt, Salmonella typhimurium LT2
aaaccugcaaaaaaagaa

SEQ ID NO: 3768055 - RNA, 13 nt, Salmonella typhimurium LT2
aaaccuuucuucu

SEQ ID NO: 3768056 - RNA, 16 nt, Salmonella typhimurium LT2
aaacgaaaacugggca

SEQ ID NO: 3768057 - RNA, 13 nt, Salmonella typhimurium LT2
aaacgacagcgcc

SEQ ID NO: 3768058 - RNA, 21 nt, Salmonella typhimurium LT2
aaacgaccaggaucagaccga

SEQ ID NO: 3768059 - RNA, 19 nt, Salmonella typhimurium LT2
aaacgacguccacaccuuc

SEQ ID NO: 3768060 - RNA, 12 nt, Salmonella typhimurium LT2
aaacgacgugga

SEQ ID NO: 3768061 - RNA, 14 nt, Salmonella typhimurium LT2
aaacgagcgcggca

SEQ ID NO: 3768062 - RNA, 20 nt, Salmonella typhimurium LT2
aaacgauauugccuuauuca

SEQ ID NO: 3768063 - RNA, 19 nt, Salmonella typhimurium LT2
aaacgauuaauaaccaaua

SEQ ID NO: 3768064 - RNA, 13 nt, Salmonella typhimurium LT2
aaacgcacccgcg

SEQ ID NO: 3768065 - RNA, 23 nt, Salmonella typhimurium LT2
aaacgcacgcugucgccgguuag

SEQ ID NO: 3768066 - RNA, 20 nt, Salmonella typhimurium LT2
aaacgcauacgcagcacuuu

SEQ ID NO: 3768067 - RNA, 15 nt, Salmonella typhimurium LT2
aaacgccaagaauga

SEQ ID NO: 3768068 - RNA, 18 nt, Salmonella typhimurium LT2
aaacgccacgauuaaccc

SEQ ID NO: 3768069 - RNA, 12 nt, Salmonella typhimurium LT2
aaacgccagcga

SEQ ID NO: 3768070 - RNA, 15 nt, Salmonella typhimurium LT2
aaacgcccauccugc

SEQ ID NO: 3768071 - RNA, 17 nt, Salmonella typhimurium LT2
aaacgcccgcaaaagcg

SEQ ID NO: 3768072 - RNA, 20 nt, Salmonella typhimurium LT2
aaacgccgaagccaacgcag

SEQ ID NO: 3768073 - RNA, 16 nt, Salmonella typhimurium LT2
aaacgccgcagaaaau

SEQ ID NO: 3768074 - RNA, 15 nt, Salmonella typhimurium LT2
aaacgccgccuuagc

SEQ ID NO: 3768075 - RNA, 15 nt, Salmonella typhimurium LT2
aaacgccgucacaaa

SEQ ID NO: 3768076 - RNA, 16 nt, Salmonella typhimurium LT2
aaacgccucauccggc

SEQ ID NO: 3768077 - RNA, 17 nt, Salmonella typhimurium LT2
aaacgccugaauaaucg

SEQ ID NO: 3768078 - RNA, 17 nt, Salmonella typhimurium LT2
aaacgccugcaucaaca

SEQ ID NO: 3768079 - RNA, 18 nt, Salmonella typhimurium LT2
aaacgccugcaucaacag

SEQ ID NO: 3768080 - RNA, 14 nt, Salmonella typhimurium LT2
aaacgccuuauccg

SEQ ID NO: 3768081 - RNA, 14 nt, Salmonella typhimurium LT2
aaacgcgccaggua

SEQ ID NO: 3768082 - RNA, 17 nt, Salmonella typhimurium LT2
aaacgcggacauauuuu

SEQ ID NO: 3768083 - RNA, 13 nt, Salmonella typhimurium LT2
aaacgcguuaucg

SEQ ID NO: 3768084 - RNA, 13 nt, Salmonella typhimurium LT2
aaacgcugcgcaa

SEQ ID NO: 3768085 - RNA, 14 nt, Salmonella typhimurium LT2
aaacgcuuucuggg

SEQ ID NO: 3768086 - RNA, 23 nt, Salmonella typhimurium LT2
aaacggcagccgccaccacaaag

SEQ ID NO: 3768087 - RNA, 18 nt, Salmonella typhimurium LT2
aaacggccagugaaauaa

SEQ ID NO: 3768088 - RNA, 22 nt, Salmonella typhimurium LT2
aaacggcgccagcucaucgggc

SEQ ID NO: 3768089 - RNA, 15 nt, Salmonella typhimurium LT2
aaacggcgguuuuuu

SEQ ID NO: 3768090 - RNA, 19 nt, Salmonella typhimurium LT2
aaacggcucgguuuauccc

SEQ ID NO: 3768091 - RNA, 14 nt, Salmonella typhimurium LT2
aaacgguauuucca

SEQ ID NO: 3768092 - RNA, 16 nt, Salmonella typhimurium LT2
aaacggugcgauuauc

SEQ ID NO: 3768093 - RNA, 22 nt, Salmonella typhimurium LT2
aaacguaccuggauaaaucgcc

SEQ ID NO: 3768094 - RNA, 19 nt, Salmonella typhimurium LT2
aaacguagcguucauuccc

SEQ ID NO: 3768095 - RNA, 13 nt, Salmonella typhimurium LT2
aaacgucaugcug

SEQ ID NO: 3768096 - RNA, 23 nt, Salmonella typhimurium LT2
aaacgucccgacgaauaacaaaa

SEQ ID NO: 3768097 - RNA, 17 nt, Salmonella typhimurium LT2
aaacgucguaaaaccug

SEQ ID NO: 3768098 - RNA, 22 nt, Salmonella typhimurium LT2
aaacuaccgcgccagccguagc

SEQ ID NO: 3768099 - RNA, 23 nt, Salmonella typhimurium LT2
aaacuaccgcgccagccguagcu

SEQ ID NO: 3768100 - RNA, 15 nt, Salmonella typhimurium LT2
aaacuauccuggccu

SEQ ID NO: 3768101 - RNA, 22 nt, Salmonella typhimurium LT2
aaacucaaagcguuauuugcau

SEQ ID NO: 3768102 - RNA, 24 nt, Salmonella typhimurium LT2
aaacucaaagcguuauuugcauuu

SEQ ID NO: 3768103 - RNA, 22 nt, Salmonella typhimurium LT2
aaacucagagagauccugagaa

SEQ ID NO: 3768104 - RNA, 13 nt, Salmonella typhimurium LT2
aaacucagcaaua

SEQ ID NO: 3768105 - RNA, 13 nt, Salmonella typhimurium LT2
aaacucaucuuua

SEQ ID NO: 3768106 - RNA, 13 nt, Salmonella typhimurium LT2
aaacuccagcacg

SEQ ID NO: 3768107 - RNA, 14 nt, Salmonella typhimurium LT2
aaacuccauuaaau

SEQ ID NO: 3768108 - RNA, 17 nt, Salmonella typhimurium LT2
aaacuccauuaaauuac

SEQ ID NO: 3768109 - RNA, 22 nt, Salmonella typhimurium LT2
aaacuccauuaaauuacuuguu

SEQ ID NO: 3768110 - RNA, 22 nt, Salmonella typhimurium LT2
aaacucccgcacgcuggcauca

SEQ ID NO: 3768111 - RNA, 15 nt, Salmonella typhimurium LT2
aaacuccgcgcuggc

SEQ ID NO: 3768112 - RNA, 19 nt, Salmonella typhimurium LT2
aaacucuguguuaugaaug

SEQ ID NO: 3768113 - RNA, 21 nt, Salmonella typhimurium LT2
aaacucuguguuaugaaugac

SEQ ID NO: 3768114 - RNA, 21 nt, Salmonella typhimurium LT2
aaacucuuuuucaauaaacgg

SEQ ID NO: 3768115 - RNA, 17 nt, Salmonella typhimurium LT2
aaacugaaucaauagcu

SEQ ID NO: 3768116 - RNA, 14 nt, Salmonella typhimurium LT2
aaacugagucguag

SEQ ID NO: 3768117 - RNA, 19 nt, Salmonella typhimurium LT2
aaacugcauccccugcagg

SEQ ID NO: 3768118 - RNA, 13 nt, Salmonella typhimurium LT2
aaacugccagggc

SEQ ID NO: 3768119 - RNA, 15 nt, Salmonella typhimurium LT2
aaacugcugccgcag

SEQ ID NO: 3768120 - RNA, 23 nt, Salmonella typhimurium LT2
aaacugcuggcgagcagaaaaag

SEQ ID NO: 3768121 - RNA, 15 nt, Salmonella typhimurium LT2
aaacuggcuaucgcc

SEQ ID NO: 3768122 - RNA, 18 nt, Salmonella typhimurium LT2
aaacugugaugccguuag

SEQ ID NO: 3768123 - RNA, 20 nt, Salmonella typhimurium LT2
aaacuuaucauuuuuucuaa

SEQ ID NO: 3768124 - RNA, 23 nt, Salmonella typhimurium LT2
aaacuuaucauuuuuucuaagau

SEQ ID NO: 3768125 - RNA, 13 nt, Salmonella typhimurium LT2
aaacuuuuaaauu

SEQ ID NO: 3768126 - RNA, 14 nt, Salmonella typhimurium LT2
aaagaaaacaucag

SEQ ID NO: 3768127 - RNA, 21 nt, Salmonella typhimurium LT2
aaagaacacaggcagccaggu

SEQ ID NO: 3768128 - RNA, 16 nt, Salmonella typhimurium LT2
aaagaaccaacaccag

SEQ ID NO: 3768129 - RNA, 22 nt, Salmonella typhimurium LT2
aaagaacgacgaauaagcugaa

SEQ ID NO: 3768130 - RNA, 18 nt, Salmonella typhimurium LT2
aaagaacguguuuuucca

SEQ ID NO: 3768131 - RNA, 23 nt, Salmonella typhimurium LT2
aaagaacguguuuuuccagcaac

SEQ ID NO: 3768132 - RNA, 19 nt, Salmonella typhimurium LT2
aaagaagaaaaaauuaaaa

SEQ ID NO: 3768133 - RNA, 23 nt, Salmonella typhimurium LT2
aaagaagaaaccgcagaaaaagc

SEQ ID NO: 3768134 - RNA, 12 nt, Salmonella typhimurium LT2
aaagaagaauaa

SEQ ID NO: 3768135 - RNA, 18 nt, Salmonella typhimurium LT2
aaagaaggcuugguuguu

SEQ ID NO: 3768136 - RNA, 18 nt, Salmonella typhimurium LT2
aaagaccaacagaaggcc

SEQ ID NO: 3768137 - RNA, 12 nt, Salmonella typhimurium LT2
aaagaccaauac

SEQ ID NO: 3768138 - RNA, 19 nt, Salmonella typhimurium LT2
aaagaccauccgguuuuaa

SEQ ID NO: 3768139 - RNA, 13 nt, Salmonella typhimurium LT2
aaagacgccaugg

SEQ ID NO: 3768140 - RNA, 21 nt, Salmonella typhimurium LT2
aaagacgcgcucggcagcagc

SEQ ID NO: 3768141 - RNA, 17 nt, Salmonella typhimurium LT2
aaagacggcagcgccau

SEQ ID NO: 3768142 - RNA, 12 nt, Salmonella typhimurium LT2
aaagagaaaaaa

SEQ ID NO: 3768143 - RNA, 14 nt, Salmonella typhimurium LT2
aaagagaaaaagaa

SEQ ID NO: 3768144 - RNA, 18 nt, Salmonella typhimurium LT2
aaagagaaaagccagucg

SEQ ID NO: 3768145 - RNA, 23 nt, Salmonella typhimurium LT2
aaagagaacgacgcauaaaaaau

SEQ ID NO: 3768146 - RNA, 16 nt, Salmonella typhimurium LT2
aaagagaucgaacaau

SEQ ID NO: 3768147 - RNA, 23 nt, Salmonella typhimurium LT2
aaagagcaauauucuggcuuucu

SEQ ID NO: 3768148 - RNA, 19 nt, Salmonella typhimurium LT2
aaagagcguaucgccggcg

SEQ ID NO: 3768149 - RNA, 12 nt, Salmonella typhimurium LT2
aaagaggaaagc

SEQ ID NO: 3768150 - RNA, 16 nt, Salmonella typhimurium LT2
aaagaggaauguccag

SEQ ID NO: 3768151 - RNA, 23 nt, Salmonella typhimurium LT2
aaagagggugaaccaaagcaaaa

SEQ ID NO: 3768152 - RNA, 22 nt, Salmonella typhimurium LT2
aaagagguugacgcuucaaggc

SEQ ID NO: 3768153 - RNA, 17 nt, Salmonella typhimurium LT2
aaagagugccagaaaca

SEQ ID NO: 3768154 - RNA, 14 nt, Salmonella typhimurium LT2
aaagauaaacgaca

SEQ ID NO: 3768155 - RNA, 15 nt, Salmonella typhimurium LT2
aaagauaaauaaaaa

SEQ ID NO: 3768156 - RNA, 17 nt, Salmonella typhimurium LT2
aaagauaaauaaaaaau

SEQ ID NO: 3768157 - RNA, 23 nt, Salmonella typhimurium LT2
aaagauaauauccccuaaauaac

SEQ ID NO: 3768158 - RNA, 14 nt, Salmonella typhimurium LT2
aaagauaaucugaa

SEQ ID NO: 3768159 - RNA, 22 nt, Salmonella typhimurium LT2
aaagauuauuuuaucaucagca

SEQ ID NO: 3768160 - RNA, 22 nt, Salmonella typhimurium LT2
aaagauuuaucaauuuuuaaaa

SEQ ID NO: 3768161 - RNA, 19 nt, Salmonella typhimurium LT2
aaagauuuguuucaucgcc

SEQ ID NO: 3768162 - RNA, 23 nt, Salmonella typhimurium LT2
aaagauuuuuuucugacuauauc

SEQ ID NO: 3768163 - RNA, 23 nt, Salmonella typhimurium LT2
aaagcaaccagaaugcccaggcc

SEQ ID NO: 3768164 - RNA, 17 nt, Salmonella typhimurium LT2
aaagcaaucgccagcgc

SEQ ID NO: 3768165 - RNA, 18 nt, Salmonella typhimurium LT2
aaagcacagccccagcac

SEQ ID NO: 3768166 - RNA, 15 nt, Salmonella typhimurium LT2
aaagcacuucucgcg

SEQ ID NO: 3768167 - RNA, 17 nt, Salmonella typhimurium LT2
aaagcacuucucgcgca

SEQ ID NO: 3768168 - RNA, 16 nt, Salmonella typhimurium LT2
aaagcagauagagcau

SEQ ID NO: 3768169 - RNA, 14 nt, Salmonella typhimurium LT2
aaagcagcugcugg

SEQ ID NO: 3768170 - RNA, 17 nt, Salmonella typhimurium LT2
aaagcagggcggcacau

SEQ ID NO: 3768171 - RNA, 13 nt, Salmonella typhimurium LT2
aaagcaguaacgc

SEQ ID NO: 3768172 - RNA, 23 nt, Salmonella typhimurium LT2
aaagcagugaauccccagaauuu

SEQ ID NO: 3768173 - RNA, 12 nt, Salmonella typhimurium LT2
aaagcagugcag

SEQ ID NO: 3768174 - RNA, 14 nt, Salmonella typhimurium LT2
aaagcaucugccgg

SEQ ID NO: 3768175 - RNA, 16 nt, Salmonella typhimurium LT2
aaagcaucugccggca

SEQ ID NO: 3768176 - RNA, 23 nt, Salmonella typhimurium LT2
aaagcauggcuggcgguuuuugu

SEQ ID NO: 3768177 - RNA, 16 nt, Salmonella typhimurium LT2
aaagccaucaauccau

SEQ ID NO: 3768178 - RNA, 13 nt, Salmonella typhimurium LT2
aaagcccaucagc

SEQ ID NO: 3768179 - RNA, 15 nt, Salmonella typhimurium LT2
aaagcccaucagcgc

SEQ ID NO: 3768180 - RNA, 13 nt, Salmonella typhimurium LT2
aaagccgaccugg

SEQ ID NO: 3768181 - RNA, 14 nt, Salmonella typhimurium LT2
aaagccgcagcggu

SEQ ID NO: 3768182 - RNA, 14 nt, Salmonella typhimurium LT2
aaagccgcccaucc

SEQ ID NO: 3768183 - RNA, 19 nt, Salmonella typhimurium LT2
aaagccggaugugagcgca

SEQ ID NO: 3768184 - RNA, 15 nt, Salmonella typhimurium LT2
aaagccggcgccauu

SEQ ID NO: 3768185 - RNA, 23 nt, Salmonella typhimurium LT2
aaagccgugaauaaaaccggcau

SEQ ID NO: 3768186 - RNA, 19 nt, Salmonella typhimurium LT2
aaagccuguuuaccaagca

SEQ ID NO: 3768187 - RNA, 14 nt, Salmonella typhimurium LT2
aaagcgaaaauaaa

SEQ ID NO: 3768188 - RNA, 15 nt, Salmonella typhimurium LT2
aaagcgaaaauaaag

SEQ ID NO: 3768189 - RNA, 13 nt, Salmonella typhimurium LT2
aaagcgaagcggc

SEQ ID NO: 3768190 - RNA, 17 nt, Salmonella typhimurium LT2
aaagcgaccggcacuca

SEQ ID NO: 3768191 - RNA, 19 nt, Salmonella typhimurium LT2
aaagcgacucauccacaua

SEQ ID NO: 3768192 - RNA, 11 nt, Salmonella typhimurium LT2
aaagcgcaucc

SEQ ID NO: 3768193 - RNA, 14 nt, Salmonella typhimurium LT2
aaagcgccacgcgu

SEQ ID NO: 3768194 - RNA, 20 nt, Salmonella typhimurium LT2
aaagcgccagauaugaucga

SEQ ID NO: 3768195 - RNA, 15 nt, Salmonella typhimurium LT2
aaagcgccauccggc

SEQ ID NO: 3768196 - RNA, 16 nt, Salmonella typhimurium LT2
aaagcgccauccggca

SEQ ID NO: 3768197 - RNA, 17 nt, Salmonella typhimurium LT2
aaagcgccauccggcaa

SEQ ID NO: 3768198 - RNA, 19 nt, Salmonella typhimurium LT2
aaagcgcccagcgccggau

SEQ ID NO: 3768199 - RNA, 22 nt, Salmonella typhimurium LT2
aaagcgcgagggauuaucuuua

SEQ ID NO: 3768200 - RNA, 15 nt, Salmonella typhimurium LT2
aaagcgcgcccuuuc

SEQ ID NO: 3768201 - RNA, 22 nt, Salmonella typhimurium LT2
aaagcgcucguuauaauugccc

SEQ ID NO: 3768202 - RNA, 20 nt, Salmonella typhimurium LT2
aaagcggauggccugcucga

SEQ ID NO: 3768203 - RNA, 14 nt, Salmonella typhimurium LT2
aaagcggcuguagc

SEQ ID NO: 3768204 - RNA, 17 nt, Salmonella typhimurium LT2
aaagcgguaauaacuga

SEQ ID NO: 3768205 - RNA, 17 nt, Salmonella typhimurium LT2
aaagcgguccggcaucc

SEQ ID NO: 3768206 - RNA, 23 nt, Salmonella typhimurium LT2
aaagcguaugcugauaaagagca

SEQ ID NO: 3768207 - RNA, 17 nt, Salmonella typhimurium LT2
aaagcuauucacaccuu

SEQ ID NO: 3768208 - RNA, 16 nt, Salmonella typhimurium LT2
aaagcucgucuguugu

SEQ ID NO: 3768209 - RNA, 15 nt, Salmonella typhimurium LT2
aaagcugcaccagga

SEQ ID NO: 3768210 - RNA, 17 nt, Salmonella typhimurium LT2
aaagcugcgaucaaguu

SEQ ID NO: 3768211 - RNA, 13 nt, Salmonella typhimurium LT2
aaagcugcugcuu

SEQ ID NO: 3768212 - RNA, 13 nt, Salmonella typhimurium LT2
aaagcugguggcg

SEQ ID NO: 3768213 - RNA, 15 nt, Salmonella typhimurium LT2
aaaggaaagggacga

SEQ ID NO: 3768214 - RNA, 18 nt, Salmonella typhimurium LT2
aaaggaauaccugcgcuu

SEQ ID NO: 3768215 - RNA, 12 nt, Salmonella typhimurium LT2
aaaggaucgauu

SEQ ID NO: 3768216 - RNA, 13 nt, Salmonella typhimurium LT2
aaaggcagaagaa

SEQ ID NO: 3768217 - RNA, 13 nt, Salmonella typhimurium LT2
aaaggcagccagg

SEQ ID NO: 3768218 - RNA, 20 nt, Salmonella typhimurium LT2
aaaggcagcgcgcugucuuu

SEQ ID NO: 3768219 - RNA, 21 nt, Salmonella typhimurium LT2
aaaggcauuucuaccggcaga

SEQ ID NO: 3768220 - RNA, 14 nt, Salmonella typhimurium LT2
aaaggcccggugug

SEQ ID NO: 3768221 - RNA, 18 nt, Salmonella typhimurium LT2
aaaggccuggcugagaaa

SEQ ID NO: 3768222 - RNA, 17 nt, Salmonella typhimurium LT2
aaaggcgaacuccagcg

SEQ ID NO: 3768223 - RNA, 18 nt, Salmonella typhimurium LT2
aaaggcggaaaucagcac

SEQ ID NO: 3768224 - RNA, 16 nt, Salmonella typhimurium LT2
aaaggcuugacucaaa

SEQ ID NO: 3768225 - RNA, 16 nt, Salmonella typhimurium LT2
aaagggaaaagccauu

SEQ ID NO: 3768226 - RNA, 15 nt, Salmonella typhimurium LT2
aaagggaauaauaca

SEQ ID NO: 3768227 - RNA, 14 nt, Salmonella typhimurium LT2
aaaggggagggcaa

SEQ ID NO: 3768228 - RNA, 19 nt, Salmonella typhimurium LT2
aaaggggggcuagcugugg

SEQ ID NO: 3768229 - RNA, 16 nt, Salmonella typhimurium LT2
aaagggugaaaucacg

SEQ ID NO: 3768230 - RNA, 19 nt, Salmonella typhimurium LT2
aaagguaauaucauccggu

SEQ ID NO: 3768231 - RNA, 20 nt, Salmonella typhimurium LT2
aaaggucaucacaucccagc

SEQ ID NO: 3768232 - RNA, 22 nt, Salmonella typhimurium LT2
aaaggucuuucuguguugcuca

SEQ ID NO: 3768233 - RNA, 19 nt, Salmonella typhimurium LT2
aaagguggguuccagcgcc

SEQ ID NO: 3768234 - RNA, 19 nt, Salmonella typhimurium LT2
aaagguuucgauacagccu

SEQ ID NO: 3768235 - RNA, 13 nt, Salmonella typhimurium LT2
aaaguaaaacaag

SEQ ID NO: 3768236 - RNA, 17 nt, Salmonella typhimurium LT2
aaaguaaauaagaaaau

SEQ ID NO: 3768237 - RNA, 17 nt, Salmonella typhimurium LT2
aaaguacaaugcaaaga

SEQ ID NO: 3768238 - RNA, 22 nt, Salmonella typhimurium LT2
aaaguacaucauuggcccggcg

SEQ ID NO: 3768239 - RNA, 23 nt, Salmonella typhimurium LT2
aaaguaccagcgcgaacauuaca

SEQ ID NO: 3768240 - RNA, 17 nt, Salmonella typhimurium LT2
aaaguacuggaauaucu

SEQ ID NO: 3768241 - RNA, 22 nt, Salmonella typhimurium LT2
aaaguacuucacaaucagcgca

SEQ ID NO: 3768242 - RNA, 19 nt, Salmonella typhimurium LT2
aaaguaguuggugggugau

SEQ ID NO: 3768243 - RNA, 13 nt, Salmonella typhimurium LT2
aaaguaucaacgg

SEQ ID NO: 3768244 - RNA, 17 nt, Salmonella typhimurium LT2
aaaguauguuuugaaug

SEQ ID NO: 3768245 - RNA, 16 nt, Salmonella typhimurium LT2
aaagucaaaauaaaau

SEQ ID NO: 3768246 - RNA, 20 nt, Salmonella typhimurium LT2
aaagucaacugcucuaccaa

SEQ ID NO: 3768247 - RNA, 14 nt, Salmonella typhimurium LT2
aaagucaguuuuca

SEQ ID NO: 3768248 - RNA, 18 nt, Salmonella typhimurium LT2
aaagucaucugccaguua

SEQ ID NO: 3768249 - RNA, 15 nt, Salmonella typhimurium LT2
aaagucgauaaaugc

SEQ ID NO: 3768250 - RNA, 18 nt, Salmonella typhimurium LT2
aaagugaaaaaacggaac

SEQ ID NO: 3768251 - RNA, 19 nt, Salmonella typhimurium LT2
aaagugaaggccagacuua

SEQ ID NO: 3768252 - RNA, 20 nt, Salmonella typhimurium LT2
aaagugaccguaauagaguu

SEQ ID NO: 3768253 - RNA, 20 nt, Salmonella typhimurium LT2
aaagugauaaauaucgcguu

SEQ ID NO: 3768254 - RNA, 21 nt, Salmonella typhimurium LT2
aaagugauuauaaaucaauag

SEQ ID NO: 3768255 - RNA, 22 nt, Salmonella typhimurium LT2
aaagugccagggcggaagcaga

SEQ ID NO: 3768256 - RNA, 23 nt, Salmonella typhimurium LT2
aaagugccagggcggaagcagau

SEQ ID NO: 3768257 - RNA, 18 nt, Salmonella typhimurium LT2
aaagugcgcacucagaaa

SEQ ID NO: 3768258 - RNA, 15 nt, Salmonella typhimurium LT2
aaagugcgccgccag

SEQ ID NO: 3768259 - RNA, 22 nt, Salmonella typhimurium LT2
aaaguuaaacauaccgccggua

SEQ ID NO: 3768260 - RNA, 14 nt, Salmonella typhimurium LT2
aaaguuaaucagcg

SEQ ID NO: 3768261 - RNA, 19 nt, Salmonella typhimurium LT2
aaaguuagccccuuaucaa

SEQ ID NO: 3768262 - RNA, 13 nt, Salmonella typhimurium LT2
aaaguuauucacg

SEQ ID NO: 3768263 - RNA, 16 nt, Salmonella typhimurium LT2
aaaguuuauuugaaua

SEQ ID NO: 3768264 - RNA, 16 nt, Salmonella typhimurium LT2
aaaguuugaccagcaa

SEQ ID NO: 3768265 - RNA, 11 nt, Salmonella typhimurium LT2
aaauaaaaacc

SEQ ID NO: 3768266 - RNA, 12 nt, Salmonella typhimurium LT2
aaauaaaaacca

SEQ ID NO: 3768267 - RNA, 13 nt, Salmonella typhimurium LT2
aaauaaaaaccau

SEQ ID NO: 3768268 - RNA, 19 nt, Salmonella typhimurium LT2
aaauaaaaaccauuuauaa

SEQ ID NO: 3768269 - RNA, 17 nt, Salmonella typhimurium LT2
aaauaaaaggggccugc

SEQ ID NO: 3768270 - RNA, 12 nt, Salmonella typhimurium LT2
aaauaaaauacg

SEQ ID NO: 3768271 - RNA, 12 nt, Salmonella typhimurium LT2
aaauaaaauuau

SEQ ID NO: 3768272 - RNA, 13 nt, Salmonella typhimurium LT2
aaauaaaauuaua

SEQ ID NO: 3768273 - RNA, 15 nt, Salmonella typhimurium LT2
aaauaaaauuguuau

SEQ ID NO: 3768274 - RNA, 18 nt, Salmonella typhimurium LT2
aaauaaaauuguuauuua

SEQ ID NO: 3768275 - RNA, 17 nt, Salmonella typhimurium LT2
aaauaaagguucauauu

SEQ ID NO: 3768276 - RNA, 21 nt, Salmonella typhimurium LT2
aaauaacaagacgucucuuuc

SEQ ID NO: 3768277 - RNA, 14 nt, Salmonella typhimurium LT2
aaauaaccagagua

SEQ ID NO: 3768278 - RNA, 17 nt, Salmonella typhimurium LT2
aaauaacccgccuggcg

SEQ ID NO: 3768279 - RNA, 21 nt, Salmonella typhimurium LT2
aaauaacgccuuucaccauuc

SEQ ID NO: 3768280 - RNA, 17 nt, Salmonella typhimurium LT2
aaauaacgguagagaau

SEQ ID NO: 3768281 - RNA, 18 nt, Salmonella typhimurium LT2
aaauaacucuggaucagu

SEQ ID NO: 3768282 - RNA, 16 nt, Salmonella typhimurium LT2
aaauaagaaaaugccu

SEQ ID NO: 3768283 - RNA, 18 nt, Salmonella typhimurium LT2
aaauaagaauccagucag

SEQ ID NO: 3768284 - RNA, 12 nt, Salmonella typhimurium LT2
aaauaauaccac

SEQ ID NO: 3768285 - RNA, 23 nt, Salmonella typhimurium LT2
aaauaaugccucauuaaaaaaac

SEQ ID NO: 3768286 - RNA, 13 nt, Salmonella typhimurium LT2
aaauaauugauaa

SEQ ID NO: 3768287 - RNA, 17 nt, Salmonella typhimurium LT2
aaauaauuuuguuaaag

SEQ ID NO: 3768288 - RNA, 23 nt, Salmonella typhimurium LT2
aaauacagagucgcuuaucugcu

SEQ ID NO: 3768289 - RNA, 13 nt, Salmonella typhimurium LT2
aaauacaucgcca

SEQ ID NO: 3768290 - RNA, 12 nt, Salmonella typhimurium LT2
aaauaccacauc

SEQ ID NO: 3768291 - RNA, 16 nt, Salmonella typhimurium LT2
aaauaccagcaccuga

SEQ ID NO: 3768292 - RNA, 13 nt, Salmonella typhimurium LT2
aaauaccgcacau

SEQ ID NO: 3768293 - RNA, 21 nt, Salmonella typhimurium LT2
aaauaccugccgaccucacug

SEQ ID NO: 3768294 - RNA, 20 nt, Salmonella typhimurium LT2
aaauacgcucaauauacuua

SEQ ID NO: 3768295 - RNA, 12 nt, Salmonella typhimurium LT2
aaauacggaacu

SEQ ID NO: 3768296 - RNA, 17 nt, Salmonella typhimurium LT2
aaauacggaccuggcgu

SEQ ID NO: 3768297 - RNA, 17 nt, Salmonella typhimurium LT2
aaauacggacgccagau

SEQ ID NO: 3768298 - RNA, 21 nt, Salmonella typhimurium LT2
aaauagacgagcgaaaaacug

SEQ ID NO: 3768299 - RNA, 12 nt, Salmonella typhimurium LT2
aaauagcacgug

SEQ ID NO: 3768300 - RNA, 14 nt, Salmonella typhimurium LT2
aaauagcuggcugu

SEQ ID NO: 3768301 - RNA, 14 nt, Salmonella typhimurium LT2
aaauaggagaugca

SEQ ID NO: 3768302 - RNA, 17 nt, Salmonella typhimurium LT2
aaauaggcgccgccgac

SEQ ID NO: 3768303 - RNA, 19 nt, Salmonella typhimurium LT2
aaauagucaguuaacgcgu

SEQ ID NO: 3768304 - RNA, 15 nt, Salmonella typhimurium LT2
aaauaguccagcagc

SEQ ID NO: 3768305 - RNA, 13 nt, Salmonella typhimurium LT2
aaauauagccauu

SEQ ID NO: 3768306 - RNA, 21 nt, Salmonella typhimurium LT2
aaauaucauuagcgucauacu

SEQ ID NO: 3768307 - RNA, 10 nt, Salmonella typhimurium LT2
aaauauccua

SEQ ID NO: 3768308 - RNA, 14 nt, Salmonella typhimurium LT2
aaauauccuccacc

SEQ ID NO: 3768309 - RNA, 17 nt, Salmonella typhimurium LT2
aaauaucgcugcccaga

SEQ ID NO: 3768310 - RNA, 16 nt, Salmonella typhimurium LT2
aaauaugaaagagaaa

SEQ ID NO: 3768311 - RNA, 19 nt, Salmonella typhimurium LT2
aaauaugaugcuaucuuug

SEQ ID NO: 3768312 - RNA, 16 nt, Salmonella typhimurium LT2
aaauaugcaauuaaua

SEQ ID NO: 3768313 - RNA, 22 nt, Salmonella typhimurium LT2
aaauaugcaauuaauauauuua

SEQ ID NO: 3768314 - RNA, 12 nt, Salmonella typhimurium LT2
aaauauuaagau

SEQ ID NO: 3768315 - RNA, 14 nt, Salmonella typhimurium LT2
aaauauuccaucaa

SEQ ID NO: 3768316 - RNA, 14 nt, Salmonella typhimurium LT2
aaauauuucuuugu

SEQ ID NO: 3768317 - RNA, 16 nt, Salmonella typhimurium LT2
aaaucaaacagaauau

SEQ ID NO: 3768318 - RNA, 18 nt, Salmonella typhimurium LT2
aaaucaaagaccuccgcc

SEQ ID NO: 3768319 - RNA, 13 nt, Salmonella typhimurium LT2
aaaucaaauaaga

SEQ ID NO: 3768320 - RNA, 17 nt, Salmonella typhimurium LT2
aaaucaacaaccggcug

SEQ ID NO: 3768321 - RNA, 22 nt, Salmonella typhimurium LT2
aaaucaacgaaaucagagacaa

SEQ ID NO: 3768322 - RNA, 16 nt, Salmonella typhimurium LT2
aaaucaacggcauuca

SEQ ID NO: 3768323 - RNA, 17 nt, Salmonella typhimurium LT2
aaaucaauuuuaauuua

SEQ ID NO: 3768324 - RNA, 15 nt, Salmonella typhimurium LT2
aaaucacaucgccgg

SEQ ID NO: 3768325 - RNA, 16 nt, Salmonella typhimurium LT2
aaaucacaucgccgga

SEQ ID NO: 3768326 - RNA, 18 nt, Salmonella typhimurium LT2
aaaucacccaacguucau

SEQ ID NO: 3768327 - RNA, 21 nt, Salmonella typhimurium LT2
aaaucacuggagcgcauuuua

SEQ ID NO: 3768328 - RNA, 12 nt, Salmonella typhimurium LT2
aaaucagacuaa

SEQ ID NO: 3768329 - RNA, 12 nt, Salmonella typhimurium LT2
aaaucagcacaa

SEQ ID NO: 3768330 - RNA, 11 nt, Salmonella typhimurium LT2
aaaucagcgcg

SEQ ID NO: 3768331 - RNA, 17 nt, Salmonella typhimurium LT2
aaaucagugauggauuu

SEQ ID NO: 3768332 - RNA, 13 nt, Salmonella typhimurium LT2
aaaucauaccagc

SEQ ID NO: 3768333 - RNA, 24 nt, Salmonella typhimurium LT2
aaaucaucaaucgcuaucugacag

SEQ ID NO: 3768334 - RNA, 19 nt, Salmonella typhimurium LT2
aaaucaucaauggcgauuu

SEQ ID NO: 3768335 - RNA, 16 nt, Salmonella typhimurium LT2
aaaucauccugcggga

SEQ ID NO: 3768336 - RNA, 21 nt, Salmonella typhimurium LT2
aaaucaucgccaugaccacaa

SEQ ID NO: 3768337 - RNA, 21 nt, Salmonella typhimurium LT2
aaaucaugcccaacugccagc

SEQ ID NO: 3768338 - RNA, 14 nt, Salmonella typhimurium LT2
aaaucaugcucaua

SEQ ID NO: 3768339 - RNA, 20 nt, Salmonella typhimurium LT2
aaaucaugcucauaauggac

SEQ ID NO: 3768340 - RNA, 21 nt, Salmonella typhimurium LT2
aaaucaugcucauaauggacc

SEQ ID NO: 3768341 - RNA, 21 nt, Salmonella typhimurium LT2
aaaucauucgaccacaaccca

SEQ ID NO: 3768342 - RNA, 19 nt, Salmonella typhimurium LT2
aaaucauuuguacaaaaaa

SEQ ID NO: 3768343 - RNA, 20 nt, Salmonella typhimurium LT2
aaaucauuuguacaaaaaau

SEQ ID NO: 3768344 - RNA, 22 nt, Salmonella typhimurium LT2
aaauccaacauagcuaaauuaa

SEQ ID NO: 3768345 - RNA, 14 nt, Salmonella typhimurium LT2
aaauccaacucagu

SEQ ID NO: 3768346 - RNA, 14 nt, Salmonella typhimurium LT2
aaauccagcgcgcu

SEQ ID NO: 3768347 - RNA, 18 nt, Salmonella typhimurium LT2
aaauccagcuguccggcu

SEQ ID NO: 3768348 - RNA, 19 nt, Salmonella typhimurium LT2
aaauccagggaaaccaugu

SEQ ID NO: 3768349 - RNA, 19 nt, Salmonella typhimurium LT2
aaauccaugagaagaaaaa

SEQ ID NO: 3768350 - RNA, 22 nt, Salmonella typhimurium LT2
aaaucccauugcccgcugcgca

SEQ ID NO: 3768351 - RNA, 23 nt, Salmonella typhimurium LT2
aaaucccccaacgucaccaucaa

SEQ ID NO: 3768352 - RNA, 19 nt, Salmonella typhimurium LT2
aaaucccggacacauaacc

SEQ ID NO: 3768353 - RNA, 17 nt, Salmonella typhimurium LT2
aaaucccggaggcgaua

SEQ ID NO: 3768354 - RNA, 13 nt, Salmonella typhimurium LT2
aaauccgccagug

SEQ ID NO: 3768355 - RNA, 22 nt, Salmonella typhimurium LT2
aaauccgcgcucagucacuuca

SEQ ID NO: 3768356 - RNA, 17 nt, Salmonella typhimurium LT2
aaauccggaucaucuuu

SEQ ID NO: 3768357 - RNA, 23 nt, Salmonella typhimurium LT2
aaauccggcccagcgacagccag

SEQ ID NO: 3768358 - RNA, 14 nt, Salmonella typhimurium LT2
aaauccggccucca

SEQ ID NO: 3768359 - RNA, 19 nt, Salmonella typhimurium LT2
aaauccggcugccugccgg

SEQ ID NO: 3768360 - RNA, 18 nt, Salmonella typhimurium LT2
aaauccucccaucgagcc

SEQ ID NO: 3768361 - RNA, 16 nt, Salmonella typhimurium LT2
aaauccugcacuucca

SEQ ID NO: 3768362 - RNA, 23 nt, Salmonella typhimurium LT2
aaauccuggauacguuccagcag

SEQ ID NO: 3768363 - RNA, 17 nt, Salmonella typhimurium LT2
aaaucgaacacauuucc

SEQ ID NO: 3768364 - RNA, 18 nt, Salmonella typhimurium LT2
aaaucgacuggugauuuu

SEQ ID NO: 3768365 - RNA, 13 nt, Salmonella typhimurium LT2
aaaucgcccaggu

SEQ ID NO: 3768366 - RNA, 13 nt, Salmonella typhimurium LT2
aaaucgcgagccu

SEQ ID NO: 3768367 - RNA, 17 nt, Salmonella typhimurium LT2
aaaucgcgagccuucaa

SEQ ID NO: 3768368 - RNA, 17 nt, Salmonella typhimurium LT2
aaaucgcggcgauuaau

SEQ ID NO: 3768369 - RNA, 14 nt, Salmonella typhimurium LT2
aaaucggcuccggc

SEQ ID NO: 3768370 - RNA, 15 nt, Salmonella typhimurium LT2
aaaucggcuccggca

SEQ ID NO: 3768371 - RNA, 16 nt, Salmonella typhimurium LT2
aaaucggcuccggcaa

SEQ ID NO: 3768372 - RNA, 16 nt, Salmonella typhimurium LT2
aaaucgggccuccgcg

SEQ ID NO: 3768373 - RNA, 22 nt, Salmonella typhimurium LT2
aaaucgguaaucaugucguaga

SEQ ID NO: 3768374 - RNA, 22 nt, Salmonella typhimurium LT2
aaaucggucauuaauccccggc

SEQ ID NO: 3768375 - RNA, 22 nt, Salmonella typhimurium LT2
aaaucgucagccgccaguucaa

SEQ ID NO: 3768376 - RNA, 11 nt, Salmonella typhimurium LT2
aaaucguccgc

SEQ ID NO: 3768377 - RNA, 17 nt, Salmonella typhimurium LT2
aaaucucaagagugaac

SEQ ID NO: 3768378 - RNA, 12 nt, Salmonella typhimurium LT2
aaaucuccggcg

SEQ ID NO: 3768379 - RNA, 19 nt, Salmonella typhimurium LT2
aaaucugaaauaaaagcaa

SEQ ID NO: 3768380 - RNA, 22 nt, Salmonella typhimurium LT2
aaaucugaaauaaaagcaaugu

SEQ ID NO: 3768381 - RNA, 15 nt, Salmonella typhimurium LT2
aaaucugguuuuccg

SEQ ID NO: 3768382 - RNA, 13 nt, Salmonella typhimurium LT2
aaaucuucauuuc

SEQ ID NO: 3768383 - RNA, 13 nt, Salmonella typhimurium LT2
aaaucuuccaguu

SEQ ID NO: 3768384 - RNA, 21 nt, Salmonella typhimurium LT2
aaaugaaaaacgguauuucca

SEQ ID NO: 3768385 - RNA, 12 nt, Salmonella typhimurium LT2
aaaugaaaaauc

SEQ ID NO: 3768386 - RNA, 18 nt, Salmonella typhimurium LT2
aaaugacgcccugcgcca

SEQ ID NO: 3768387 - RNA, 16 nt, Salmonella typhimurium LT2
aaaugacgccggguaa

SEQ ID NO: 3768388 - RNA, 15 nt, Salmonella typhimurium LT2
aaaugagauugauaa

SEQ ID NO: 3768389 - RNA, 22 nt, Salmonella typhimurium LT2
aaaugagauugauaaucagcaa

SEQ ID NO: 3768390 - RNA, 18 nt, Salmonella typhimurium LT2
aaaugauguccacacuga

SEQ ID NO: 3768391 - RNA, 13 nt, Salmonella typhimurium LT2
aaaugauguguuu

SEQ ID NO: 3768392 - RNA, 18 nt, Salmonella typhimurium LT2
aaaugauuuuuauaaaau

SEQ ID NO: 3768393 - RNA, 21 nt, Salmonella typhimurium LT2
aaaugcccgauggcguaagcu

SEQ ID NO: 3768394 - RNA, 16 nt, Salmonella typhimurium LT2
aaaugcccgucccauu

SEQ ID NO: 3768395 - RNA, 16 nt, Salmonella typhimurium LT2
aaaugccgcccaucca

SEQ ID NO: 3768396 - RNA, 16 nt, Salmonella typhimurium LT2
aaaugccuuauccggc

SEQ ID NO: 3768397 - RNA, 18 nt, Salmonella typhimurium LT2
aaaugcgacaucucaggc

SEQ ID NO: 3768398 - RNA, 16 nt, Salmonella typhimurium LT2
aaaugcgaugaacauc

SEQ ID NO: 3768399 - RNA, 11 nt, Salmonella typhimurium LT2
aaaugcgcaug

SEQ ID NO: 3768400 - RNA, 16 nt, Salmonella typhimurium LT2
aaaugcgcuuugauag

SEQ ID NO: 3768401 - RNA, 17 nt, Salmonella typhimurium LT2
aaaugcggguccugauc

SEQ ID NO: 3768402 - RNA, 13 nt, Salmonella typhimurium LT2
aaaugcugggcuu

SEQ ID NO: 3768403 - RNA, 15 nt, Salmonella typhimurium LT2
aaaugcuuaucugau

SEQ ID NO: 3768404 - RNA, 10 nt, Salmonella typhimurium LT2
aaaugcuuug

SEQ ID NO: 3768405 - RNA, 14 nt, Salmonella typhimurium LT2
aaauggauacuggu

SEQ ID NO: 3768406 - RNA, 21 nt, Salmonella typhimurium LT2
aaauggcaaguaaaauaaccc

SEQ ID NO: 3768407 - RNA, 14 nt, Salmonella typhimurium LT2
aaauggcaugagca

SEQ ID NO: 3768408 - RNA, 11 nt, Salmonella typhimurium LT2
aaauggccauc

SEQ ID NO: 3768409 - RNA, 16 nt, Salmonella typhimurium LT2
aaauggguaucgccuu

SEQ ID NO: 3768410 - RNA, 15 nt, Salmonella typhimurium LT2
aaaugggucgcggca

SEQ ID NO: 3768411 - RNA, 19 nt, Salmonella typhimurium LT2
aaauggucccugauauaca

SEQ ID NO: 3768412 - RNA, 16 nt, Salmonella typhimurium LT2
aaauggucggucacgc

SEQ ID NO: 3768413 - RNA, 18 nt, Salmonella typhimurium LT2
aaauggucggucacgcga

SEQ ID NO: 3768414 - RNA, 18 nt, Salmonella typhimurium LT2
aaaugucccgauauuggu

SEQ ID NO: 3768415 - RNA, 22 nt, Salmonella typhimurium LT2
aaauguucagcgaccugcagcu

SEQ ID NO: 3768416 - RNA, 18 nt, Salmonella typhimurium LT2
aaauguuugcuuuagcuu

SEQ ID NO: 3768417 - RNA, 21 nt, Salmonella typhimurium LT2
aaauuaacgacauuuuugccc

SEQ ID NO: 3768418 - RNA, 13 nt, Salmonella typhimurium LT2
aaauuaaucgcca

SEQ ID NO: 3768419 - RNA, 13 nt, Salmonella typhimurium LT2
aaauuaccuuuac

SEQ ID NO: 3768420 - RNA, 23 nt, Salmonella typhimurium LT2
aaauuaccuuuacaugaaaaaua

SEQ ID NO: 3768421 - RNA, 15 nt, Salmonella typhimurium LT2
aaauuagcgcgaaau

SEQ ID NO: 3768422 - RNA, 19 nt, Salmonella typhimurium LT2
aaauuauccacaaacucca

SEQ ID NO: 3768423 - RNA, 17 nt, Salmonella typhimurium LT2
aaauuauccguuuucag

SEQ ID NO: 3768424 - RNA, 21 nt, Salmonella typhimurium LT2
aaauuauccguuuucaguaaa

SEQ ID NO: 3768425 - RNA, 23 nt, Salmonella typhimurium LT2
aaauuauuccuugaucaggaaau

SEQ ID NO: 3768426 - RNA, 18 nt, Salmonella typhimurium LT2
aaauuauuggcuuuguaa

SEQ ID NO: 3768427 - RNA, 23 nt, Salmonella typhimurium LT2
aaauuauugugagaaaagcagag

SEQ ID NO: 3768428 - RNA, 14 nt, Salmonella typhimurium LT2
aaauuauuuuaaau

SEQ ID NO: 3768429 - RNA, 12 nt, Salmonella typhimurium LT2
aaauucaacgua

SEQ ID NO: 3768430 - RNA, 19 nt, Salmonella typhimurium LT2
aaauucaacguauuaacau

SEQ ID NO: 3768431 - RNA, 16 nt, Salmonella typhimurium LT2
aaauucacaccaaugu

SEQ ID NO: 3768432 - RNA, 13 nt, Salmonella typhimurium LT2
aaauucagacugc

SEQ ID NO: 3768433 - RNA, 19 nt, Salmonella typhimurium LT2
aaauuccccauaaucgacc

SEQ ID NO: 3768434 - RNA, 17 nt, Salmonella typhimurium LT2
aaauuccgcagagcuga

SEQ ID NO: 3768435 - RNA, 16 nt, Salmonella typhimurium LT2
aaauuccuggauuaaa

SEQ ID NO: 3768436 - RNA, 17 nt, Salmonella typhimurium LT2
aaauuccuuguuuuaac

SEQ ID NO: 3768437 - RNA, 17 nt, Salmonella typhimurium LT2
aaauucgcagcguucga

SEQ ID NO: 3768438 - RNA, 17 nt, Salmonella typhimurium LT2
aaauucgcgccaguccg

SEQ ID NO: 3768439 - RNA, 19 nt, Salmonella typhimurium LT2
aaauucgcuaauccccccu

SEQ ID NO: 3768440 - RNA, 17 nt, Salmonella typhimurium LT2
aaauucuaugccaagcg

SEQ ID NO: 3768441 - RNA, 22 nt, Salmonella typhimurium LT2
aaauugaccucaugcuuaucgc

SEQ ID NO: 3768442 - RNA, 23 nt, Salmonella typhimurium LT2
aaauugccugauggcgcugcgcu

SEQ ID NO: 3768443 - RNA, 20 nt, Salmonella typhimurium LT2
aaauugcuauaccgcuuuau

SEQ ID NO: 3768444 - RNA, 12 nt, Salmonella typhimurium LT2
aaauugcuuucu

SEQ ID NO: 3768445 - RNA, 19 nt, Salmonella typhimurium LT2
aaauuggugauauaaacgg

SEQ ID NO: 3768446 - RNA, 18 nt, Salmonella typhimurium LT2
aaauugguuauauuacug

SEQ ID NO: 3768447 - RNA, 18 nt, Salmonella typhimurium LT2
aaauuguuuaaaaacagg

SEQ ID NO: 3768448 - RNA, 22 nt, Salmonella typhimurium LT2
aaauuucaacccgaucgccauc

SEQ ID NO: 3768449 - RNA, 17 nt, Salmonella typhimurium LT2
aaauuucaguauuacua

SEQ ID NO: 3768450 - RNA, 20 nt, Salmonella typhimurium LT2
aaauuuccgcagccagaauc

SEQ ID NO: 3768451 - RNA, 19 nt, Salmonella typhimurium LT2
aaauuuccuccgccgauaa

SEQ ID NO: 3768452 - RNA, 21 nt, Salmonella typhimurium LT2
aaauuugcugccaucgcacag

SEQ ID NO: 3768453 - RNA, 22 nt, Salmonella typhimurium LT2
aaauuugcugccaucgcacagu

SEQ ID NO: 3768454 - RNA, 16 nt, Salmonella typhimurium LT2
aaauuuguuuaaucau

SEQ ID NO: 3768455 - RNA, 22 nt, Salmonella typhimurium LT2
aaauuuguuuaaucauaaaacc

SEQ ID NO: 3768456 - RNA, 22 nt, Salmonella typhimurium LT2
aaauuuucaauacgucauauca

SEQ ID NO: 3768457 - RNA, 12 nt, Salmonella typhimurium LT2
aaauuuucauua

SEQ ID NO: 3768458 - RNA, 22 nt, Salmonella typhimurium LT2
aacaaaaagauauuauaaaaua

SEQ ID NO: 3768459 - RNA, 19 nt, Salmonella typhimurium LT2
aacaaaccgauaaucacca

SEQ ID NO: 3768460 - RNA, 15 nt, Salmonella typhimurium LT2
aacaaacuccagcac

SEQ ID NO: 3768461 - RNA, 16 nt, Salmonella typhimurium LT2
aacaaacuuaauuauu

SEQ ID NO: 3768462 - RNA, 14 nt, Salmonella typhimurium LT2
aacaaauaaaucca

SEQ ID NO: 3768463 - RNA, 17 nt, Salmonella typhimurium LT2
aacaaauaaauccauga

SEQ ID NO: 3768464 - RNA, 11 nt, Salmonella typhimurium LT2
aacaaaugaag

SEQ ID NO: 3768465 - RNA, 14 nt, Salmonella typhimurium LT2
aacaacaggccaga

SEQ ID NO: 3768466 - RNA, 13 nt, Salmonella typhimurium LT2
aacaacccauucg

SEQ ID NO: 3768467 - RNA, 14 nt, Salmonella typhimurium LT2
aacaacggcacaca

SEQ ID NO: 3768468 - RNA, 16 nt, Salmonella typhimurium LT2
aacaacguuacgccag

SEQ ID NO: 3768469 - RNA, 18 nt, Salmonella typhimurium LT2
aacaacucuauuaaaaua

SEQ ID NO: 3768470 - RNA, 17 nt, Salmonella typhimurium LT2
aacaagacgucucuuuc

SEQ ID NO: 3768471 - RNA, 15 nt, Salmonella typhimurium LT2
aacaagcaaaccuau

SEQ ID NO: 3768472 - RNA, 14 nt, Salmonella typhimurium LT2
aacaaggauauccg

SEQ ID NO: 3768473 - RNA, 19 nt, Salmonella typhimurium LT2
aacaaggcgcuaccaggau

SEQ ID NO: 3768474 - RNA, 16 nt, Salmonella typhimurium LT2
aacaauaaaguuauac

SEQ ID NO: 3768475 - RNA, 17 nt, Salmonella typhimurium LT2
aacaaucgccugacuga

SEQ ID NO: 3768476 - RNA, 17 nt, Salmonella typhimurium LT2
aacaaucgggaacagcc

SEQ ID NO: 3768477 - RNA, 16 nt, Salmonella typhimurium LT2
aacaaugauaucgcgc

SEQ ID NO: 3768478 - RNA, 17 nt, Salmonella typhimurium LT2
aacaaugggauaaaaug

SEQ ID NO: 3768479 - RNA, 11 nt, Salmonella typhimurium LT2
aacaauuauau

SEQ ID NO: 3768480 - RNA, 15 nt, Salmonella typhimurium LT2
aacaauuuacgcagc

SEQ ID NO: 3768481 - RNA, 17 nt, Salmonella typhimurium LT2
aacaauuugcccagcgc

SEQ ID NO: 3768482 - RNA, 16 nt, Salmonella typhimurium LT2
aacacaaucaggcgca

SEQ ID NO: 3768483 - RNA, 17 nt, Salmonella typhimurium LT2
aacacacaguugccuuc

SEQ ID NO: 3768484 - RNA, 18 nt, Salmonella typhimurium LT2
aacacacccuucucaggg

SEQ ID NO: 3768485 - RNA, 19 nt, Salmonella typhimurium LT2
aacacacgcuuagcuugcc

SEQ ID NO: 3768486 - RNA, 17 nt, Salmonella typhimurium LT2
aacacaggcggcgcuau

SEQ ID NO: 3768487 - RNA, 22 nt, Salmonella typhimurium LT2
aacacauaacgcccgacaaucg

SEQ ID NO: 3768488 - RNA, 16 nt, Salmonella typhimurium LT2
aacacaucagcaacuu

SEQ ID NO: 3768489 - RNA, 12 nt, Salmonella typhimurium LT2
aacacauccagc

SEQ ID NO: 3768490 - RNA, 16 nt, Salmonella typhimurium LT2
aacacauccagcguca

SEQ ID NO: 3768491 - RNA, 19 nt, Salmonella typhimurium LT2
aacaccacaaagucgccuu

SEQ ID NO: 3768492 - RNA, 15 nt, Salmonella typhimurium LT2
aacaccaccgcccgc

SEQ ID NO: 3768493 - RNA, 14 nt, Salmonella typhimurium LT2
aacaccagcagcgc

SEQ ID NO: 3768494 - RNA, 19 nt, Salmonella typhimurium LT2
aacaccagggauuuugcuu

SEQ ID NO: 3768495 - RNA, 23 nt, Salmonella typhimurium LT2
aacaccagggauuuugcuuuuuc

SEQ ID NO: 3768496 - RNA, 11 nt, Salmonella typhimurium LT2
aacaccuccag

SEQ ID NO: 3768497 - RNA, 20 nt, Salmonella typhimurium LT2
aacaccugcaucacgcccgg

SEQ ID NO: 3768498 - RNA, 16 nt, Salmonella typhimurium LT2
aacaccuuauccggcc

SEQ ID NO: 3768499 - RNA, 20 nt, Salmonella typhimurium LT2
aacaccuuauccggccuaca

SEQ ID NO: 3768500 - RNA, 18 nt, Salmonella typhimurium LT2
aacacgauggcaaauaau

SEQ ID NO: 3768501 - RNA, 22 nt, Salmonella typhimurium LT2
aacacgauggcaaauaauacca

SEQ ID NO: 3768502 - RNA, 16 nt, Salmonella typhimurium LT2
aacacgccgcgcugga

SEQ ID NO: 3768503 - RNA, 21 nt, Salmonella typhimurium LT2
aacacgccguugauaauaaau

SEQ ID NO: 3768504 - RNA, 19 nt, Salmonella typhimurium LT2
aacacggcaugaagcagca

SEQ ID NO: 3768505 - RNA, 23 nt, Salmonella typhimurium LT2
aacacggcgcucaggaucgccgg

SEQ ID NO: 3768506 - RNA, 19 nt, Salmonella typhimurium LT2
aacacggcggcuagcgcag

SEQ ID NO: 3768507 - RNA, 14 nt, Salmonella typhimurium LT2
aacacggcugucgg

SEQ ID NO: 3768508 - RNA, 20 nt, Salmonella typhimurium LT2
aacacguaauucauuacgaa

SEQ ID NO: 3768509 - RNA, 15 nt, Salmonella typhimurium LT2
aacacgucgauuuuc

SEQ ID NO: 3768510 - RNA, 20 nt, Salmonella typhimurium LT2
aacacguuaucugaccuaca

SEQ ID NO: 3768511 - RNA, 15 nt, Salmonella typhimurium LT2
aacacuaaccagcgc

SEQ ID NO: 3768512 - RNA, 13 nt, Salmonella typhimurium LT2
aacacucuccacc

SEQ ID NO: 3768513 - RNA, 14 nt, Salmonella typhimurium LT2
aacacucuccacca

SEQ ID NO: 3768514 - RNA, 17 nt, Salmonella typhimurium LT2
aacagaaaaaaugcacc

SEQ ID NO: 3768515 - RNA, 21 nt, Salmonella typhimurium LT2
aacagaaaaaaugcaccgccu

SEQ ID NO: 3768516 - RNA, 11 nt, Salmonella typhimurium LT2
aacagaauaag

SEQ ID NO: 3768517 - RNA, 17 nt, Salmonella typhimurium LT2
aacagaauuaccugggu

SEQ ID NO: 3768518 - RNA, 17 nt, Salmonella typhimurium LT2
aacagacaauaccaggg

SEQ ID NO: 3768519 - RNA, 23 nt, Salmonella typhimurium LT2
aacagaccgccaugcggcgccau

SEQ ID NO: 3768520 - RNA, 17 nt, Salmonella typhimurium LT2
aacagacgccuuucaga

SEQ ID NO: 3768521 - RNA, 22 nt, Salmonella typhimurium LT2
aacagagcgccggcaaagccau

SEQ ID NO: 3768522 - RNA, 20 nt, Salmonella typhimurium LT2
aacagauaagcgucugcaau

SEQ ID NO: 3768523 - RNA, 13 nt, Salmonella typhimurium LT2
aacagauacugga

SEQ ID NO: 3768524 - RNA, 12 nt, Salmonella typhimurium LT2
aacagcaccagc

SEQ ID NO: 3768525 - RNA, 14 nt, Salmonella typhimurium LT2
aacagcaccagcag

SEQ ID NO: 3768526 - RNA, 20 nt, Salmonella typhimurium LT2
aacagcacguuauucuccag

SEQ ID NO: 3768527 - RNA, 17 nt, Salmonella typhimurium LT2
aacagcagacagccgau

SEQ ID NO: 3768528 - RNA, 12 nt, Salmonella typhimurium LT2
aacagcaggacc

SEQ ID NO: 3768529 - RNA, 18 nt, Salmonella typhimurium LT2
aacagcauaauaaagcag

SEQ ID NO: 3768530 - RNA, 14 nt, Salmonella typhimurium LT2
aacagccagaagcc

SEQ ID NO: 3768531 - RNA, 22 nt, Salmonella typhimurium LT2
aacagccauaaugcugccagca

SEQ ID NO: 3768532 - RNA, 19 nt, Salmonella typhimurium LT2
aacagcgaucacgccgucc

SEQ ID NO: 3768533 - RNA, 23 nt, Salmonella typhimurium LT2
aacagcgaucacgccguccagca

SEQ ID NO: 3768534 - RNA, 13 nt, Salmonella typhimurium LT2
aacagcgccauca

SEQ ID NO: 3768535 - RNA, 16 nt, Salmonella typhimurium LT2
aacagcgcgaccagga

SEQ ID NO: 3768536 - RNA, 16 nt, Salmonella typhimurium LT2
aacagcgcggcaggcc

SEQ ID NO: 3768537 - RNA, 12 nt, Salmonella typhimurium LT2
aacagcgcucca

SEQ ID NO: 3768538 - RNA, 19 nt, Salmonella typhimurium LT2
aacagcgcuccacgcgucc

SEQ ID NO: 3768539 - RNA, 21 nt, Salmonella typhimurium LT2
aacagcguaccuuuaucuuga

SEQ ID NO: 3768540 - RNA, 14 nt, Salmonella typhimurium LT2
aacagcuugaucau

SEQ ID NO: 3768541 - RNA, 16 nt, Salmonella typhimurium LT2
aacagcuuuauggcga

SEQ ID NO: 3768542 - RNA, 20 nt, Salmonella typhimurium LT2
aacaggccaaacccugcgcc

SEQ ID NO: 3768543 - RNA, 15 nt, Salmonella typhimurium LT2
aacaggccagaauaa

SEQ ID NO: 3768544 - RNA, 14 nt, Salmonella typhimurium LT2
aacaggccgcgaaa

SEQ ID NO: 3768545 - RNA, 13 nt, Salmonella typhimurium LT2
aacaggcgaaaac

SEQ ID NO: 3768546 - RNA, 19 nt, Salmonella typhimurium LT2
aacaggcgcaggcauuaaa

SEQ ID NO: 3768547 - RNA, 23 nt, Salmonella typhimurium LT2
aacaggcgcaggcauuaaaaaaa

SEQ ID NO: 3768548 - RNA, 20 nt, Salmonella typhimurium LT2
aacaggcuauaacgcaccac

SEQ ID NO: 3768549 - RNA, 23 nt, Salmonella typhimurium LT2
aacaggcugcguaacgcgccgga

SEQ ID NO: 3768550 - RNA, 16 nt, Salmonella typhimurium LT2
aacaggcuuuucaggc

SEQ ID NO: 3768551 - RNA, 19 nt, Salmonella typhimurium LT2
aacagggccgcauccccau

SEQ ID NO: 3768552 - RNA, 20 nt, Salmonella typhimurium LT2
aacagggcggccuccuggcu

SEQ ID NO: 3768553 - RNA, 16 nt, Salmonella typhimurium LT2
aacagggguuccggca

SEQ ID NO: 3768554 - RNA, 17 nt, Salmonella typhimurium LT2
aacagggguuccggcaa

SEQ ID NO: 3768555 - RNA, 21 nt, Salmonella typhimurium LT2
aacagggugacucauuucaac

SEQ ID NO: 3768556 - RNA, 18 nt, Salmonella typhimurium LT2
aacaggguuucucgggag

SEQ ID NO: 3768557 - RNA, 17 nt, Salmonella typhimurium LT2
aacagguugcguaacgc

SEQ ID NO: 3768558 - RNA, 15 nt, Salmonella typhimurium LT2
aacaguaccugauaa

SEQ ID NO: 3768559 - RNA, 22 nt, Salmonella typhimurium LT2
aacaguccaggaaagagggcag

SEQ ID NO: 3768560 - RNA, 19 nt, Salmonella typhimurium LT2
aacagucccaccagcgcgg

SEQ ID NO: 3768561 - RNA, 22 nt, Salmonella typhimurium LT2
aacagucgcgccgugcccagca

SEQ ID NO: 3768562 - RNA, 20 nt, Salmonella typhimurium LT2
aacagugaguacgcaggagg

SEQ ID NO: 3768563 - RNA, 23 nt, Salmonella typhimurium LT2
aacagugauuacaaaaugugcaa

SEQ ID NO: 3768564 - RNA, 17 nt, Salmonella typhimurium LT2
aacaguguaaacgccag

SEQ ID NO: 3768565 - RNA, 22 nt, Salmonella typhimurium LT2
aacaguucauuucaggcaaagg

SEQ ID NO: 3768566 - RNA, 23 nt, Salmonella typhimurium LT2
aacauacgggcaugaagaaaaua

SEQ ID NO: 3768567 - RNA, 16 nt, Salmonella typhimurium LT2
aacauagagaucacgc

SEQ ID NO: 3768568 - RNA, 23 nt, Salmonella typhimurium LT2
aacauagcggcaaggaaaaccag

SEQ ID NO: 3768569 - RNA, 22 nt, Salmonella typhimurium LT2
aacauagcuaaauuaaaaauaa

SEQ ID NO: 3768570 - RNA, 18 nt, Salmonella typhimurium LT2
aacauauccgcgcaaagg

SEQ ID NO: 3768571 - RNA, 17 nt, Salmonella typhimurium LT2
aacauaucuccucugcc

SEQ ID NO: 3768572 - RNA, 20 nt, Salmonella typhimurium LT2
aacauaucuccucugccaug

SEQ ID NO: 3768573 - RNA, 18 nt, Salmonella typhimurium LT2
aacauauggcccauuacu

SEQ ID NO: 3768574 - RNA, 22 nt, Salmonella typhimurium LT2
aacauauuuuuaugcacgcuau

SEQ ID NO: 3768575 - RNA, 15 nt, Salmonella typhimurium LT2
aacauauuuuucaca

SEQ ID NO: 3768576 - RNA, 19 nt, Salmonella typhimurium LT2
aacaucagaaaaaagccaa

SEQ ID NO: 3768577 - RNA, 22 nt, Salmonella typhimurium LT2
aacaucagaaaaaagccaagca

SEQ ID NO: 3768578 - RNA, 12 nt, Salmonella typhimurium LT2
aacaucagcgcu

SEQ ID NO: 3768579 - RNA, 14 nt, Salmonella typhimurium LT2
aacaucagcgcuac

SEQ ID NO: 3768580 - RNA, 22 nt, Salmonella typhimurium LT2
aacaucauucccguaucuucau

SEQ ID NO: 3768581 - RNA, 23 nt, Salmonella typhimurium LT2
aacaucauucccguaucuucaug

SEQ ID NO: 3768582 - RNA, 21 nt, Salmonella typhimurium LT2
aacaucauugccugauggcgc

SEQ ID NO: 3768583 - RNA, 14 nt, Salmonella typhimurium LT2
aacaucauuucuac

SEQ ID NO: 3768584 - RNA, 15 nt, Salmonella typhimurium LT2
aacaucgccccggca

SEQ ID NO: 3768585 - RNA, 12 nt, Salmonella typhimurium LT2
aacaucggcaaa

SEQ ID NO: 3768586 - RNA, 16 nt, Salmonella typhimurium LT2
aacaucguaaaucaaa

SEQ ID NO: 3768587 - RNA, 14 nt, Salmonella typhimurium LT2
aacaucucacuagc

SEQ ID NO: 3768588 - RNA, 21 nt, Salmonella typhimurium LT2
aacaucucacuagcauaagca

SEQ ID NO: 3768589 - RNA, 16 nt, Salmonella typhimurium LT2
aacaugaaauggcaug

SEQ ID NO: 3768590 - RNA, 18 nt, Salmonella typhimurium LT2
aacaugacggcagucgcu

SEQ ID NO: 3768591 - RNA, 22 nt, Salmonella typhimurium LT2
aacaugcccggacgaugucuga

SEQ ID NO: 3768592 - RNA, 14 nt, Salmonella typhimurium LT2
aacaugcuggauga

SEQ ID NO: 3768593 - RNA, 14 nt, Salmonella typhimurium LT2
aacauggggagcag

SEQ ID NO: 3768594 - RNA, 16 nt, Salmonella typhimurium LT2
aacauggggagcagca

SEQ ID NO: 3768595 - RNA, 16 nt, Salmonella typhimurium LT2
aacauggguuucuugc

SEQ ID NO: 3768596 - RNA, 20 nt, Salmonella typhimurium LT2
aacauggguuugacccauuu

SEQ ID NO: 3768597 - RNA, 22 nt, Salmonella typhimurium LT2
aacaugguggagucuaaaaaua

SEQ ID NO: 3768598 - RNA, 18 nt, Salmonella typhimurium LT2
aacauguuuuguauuaau

SEQ ID NO: 3768599 - RNA, 16 nt, Salmonella typhimurium LT2
aaccguuggggaaaau

SEQ ID NO: 3768600 - RNA, 12 nt, Salmonella typhimurium LT2
aaccuaaaaacc

SEQ ID NO: 3768601 - RNA, 13 nt, Salmonella typhimurium LT2
aaccuaaccaaac

SEQ ID NO: 3768602 - RNA, 15 nt, Salmonella typhimurium LT2
aaccuaacgccugca

SEQ ID NO: 3768603 - RNA, 16 nt, Salmonella typhimurium LT2
aaccuauuuugcaaaa

SEQ ID NO: 3768604 - RNA, 15 nt, Salmonella typhimurium LT2
aaccucacggagaaa

SEQ ID NO: 3768605 - RNA, 16 nt, Salmonella typhimurium LT2
aaccucacggagaaaa

SEQ ID NO: 3768606 - RNA, 21 nt, Salmonella typhimurium LT2
aaccucacggagaaaagcgaa

SEQ ID NO: 3768607 - RNA, 19 nt, Salmonella typhimurium LT2
aaccucaucccggcuuaaa

SEQ ID NO: 3768608 - RNA, 19 nt, Salmonella typhimurium LT2
aaccuccgcaccuucauca

SEQ ID NO: 3768609 - RNA, 19 nt, Salmonella typhimurium LT2
aaccuccggcuaugccgga

SEQ ID NO: 3768610 - RNA, 20 nt, Salmonella typhimurium LT2
aaccuccggcuaugccggag

SEQ ID NO: 3768611 - RNA, 20 nt, Salmonella typhimurium LT2
aaccucggcuugcuucaucu

SEQ ID NO: 3768612 - RNA, 12 nt, Salmonella typhimurium LT2
aaccugaacaau

SEQ ID NO: 3768613 - RNA, 13 nt, Salmonella typhimurium LT2
aaccugagcgcga

SEQ ID NO: 3768614 - RNA, 14 nt, Salmonella typhimurium LT2
aaccugagcgcgaa

SEQ ID NO: 3768615 - RNA, 14 nt, Salmonella typhimurium LT2
aaccugauauugcg

SEQ ID NO: 3768616 - RNA, 13 nt, Salmonella typhimurium LT2
aaccugcgaaaag

SEQ ID NO: 3768617 - RNA, 19 nt, Salmonella typhimurium LT2
aaccugcgccgguuccggc

SEQ ID NO: 3768618 - RNA, 13 nt, Salmonella typhimurium LT2
aaccugcgcugac

SEQ ID NO: 3768619 - RNA, 21 nt, Salmonella typhimurium LT2
aaccugcguuacggucgauuu

SEQ ID NO: 3768620 - RNA, 21 nt, Salmonella typhimurium LT2
aaccugcucggcuaucgccac

SEQ ID NO: 3768621 - RNA, 23 nt, Salmonella typhimurium LT2
aaccuuacucgcuguacuucccu

SEQ ID NO: 3768622 - RNA, 14 nt, Salmonella typhimurium LT2
aaccuuauauaugu

SEQ ID NO: 3768623 - RNA, 20 nt, Salmonella typhimurium LT2
aaccuucaagaaucaauaua

SEQ ID NO: 3768624 - RNA, 16 nt, Salmonella typhimurium LT2
aaccuucaaguuuuag

SEQ ID NO: 3768625 - RNA, 13 nt, Salmonella typhimurium LT2
aaccuuccggcac

SEQ ID NO: 3768626 - RNA, 12 nt, Salmonella typhimurium LT2
aaccuugcgccu

SEQ ID NO: 3768627 - RNA, 20 nt, Salmonella typhimurium LT2
aaccuugguuuucaagaacc

SEQ ID NO: 3768628 - RNA, 22 nt, Salmonella typhimurium LT2
aaccuuugucgcguacuuucgc

SEQ ID NO: 3768629 - RNA, 19 nt, Salmonella typhimurium LT2
aacgaaccauuugccugcc

SEQ ID NO: 3768630 - RNA, 22 nt, Salmonella typhimurium LT2
aacgaaucgcugcgccagcagc

SEQ ID NO: 3768631 - RNA, 17 nt, Salmonella typhimurium LT2
aacgacaaaaauaccac

SEQ ID NO: 3768632 - RNA, 14 nt, Salmonella typhimurium LT2
aacgaccagguaau

SEQ ID NO: 3768633 - RNA, 14 nt, Salmonella typhimurium LT2
aacgacccccacca

SEQ ID NO: 3768634 - RNA, 19 nt, Salmonella typhimurium LT2
aacgaccgcgcucaccgcc

SEQ ID NO: 3768635 - RNA, 17 nt, Salmonella typhimurium LT2
aacgacgaauauccaga

SEQ ID NO: 3768636 - RNA, 19 nt, Salmonella typhimurium LT2
aacgacgcuccagaaucuc

SEQ ID NO: 3768637 - RNA, 21 nt, Salmonella typhimurium LT2
aacgacuacguucaucaggca

SEQ ID NO: 3768638 - RNA, 14 nt, Salmonella typhimurium LT2
aacgacucacgcgc

SEQ ID NO: 3768639 - RNA, 13 nt, Salmonella typhimurium LT2
aacgagauucaau

SEQ ID NO: 3768640 - RNA, 21 nt, Salmonella typhimurium LT2
aacgagccgucgcuaucaaua

SEQ ID NO: 3768641 - RNA, 14 nt, Salmonella typhimurium LT2
aacgagcgcggcau

SEQ ID NO: 3768642 - RNA, 15 nt, Salmonella typhimurium LT2
aacgauaacgucagc

SEQ ID NO: 3768643 - RNA, 20 nt, Salmonella typhimurium LT2
aacgauaauaucgucaccag

SEQ ID NO: 3768644 - RNA, 15 nt, Salmonella typhimurium LT2
aacgauagacgugca

SEQ ID NO: 3768645 - RNA, 18 nt, Salmonella typhimurium LT2
aacgaucccuaauaaaau

SEQ ID NO: 3768646 - RNA, 23 nt, Salmonella typhimurium LT2
aacgaugcuugccauauugccgc

SEQ ID NO: 3768647 - RNA, 19 nt, Salmonella typhimurium LT2
aacgauguaucgcgcggau

SEQ ID NO: 3768648 - RNA, 15 nt, Salmonella typhimurium LT2
aacgaugucaucgcc

SEQ ID NO: 3768649 - RNA, 23 nt, Salmonella typhimurium LT2
aacgaugugacuggggugagcga

SEQ ID NO: 3768650 - RNA, 18 nt, Salmonella typhimurium LT2
aacgauuucaucagcgac

SEQ ID NO: 3768651 - RNA, 17 nt, Salmonella typhimurium LT2
aacgcaacacaggccgc

SEQ ID NO: 3768652 - RNA, 18 nt, Salmonella typhimurium LT2
aacgcaacucaucgucau

SEQ ID NO: 3768653 - RNA, 19 nt, Salmonella typhimurium LT2
aacgcacguacggaaggua

SEQ ID NO: 3768654 - RNA, 16 nt, Salmonella typhimurium LT2
aacgcagcauccacgc

SEQ ID NO: 3768655 - RNA, 14 nt, Salmonella typhimurium LT2
aacgcagcaucgcc

SEQ ID NO: 3768656 - RNA, 13 nt, Salmonella typhimurium LT2
aacgcaggcugga

SEQ ID NO: 3768657 - RNA, 18 nt, Salmonella typhimurium LT2
aacgcauacgcagcacuu

SEQ ID NO: 3768658 - RNA, 22 nt, Salmonella typhimurium LT2
aacgcaucaaauaccuuuucau

SEQ ID NO: 3768659 - RNA, 13 nt, Salmonella typhimurium LT2
aacgcaucacaug

SEQ ID NO: 3768660 - RNA, 13 nt, Salmonella typhimurium LT2
aacgcauccagcc

SEQ ID NO: 3768661 - RNA, 13 nt, Salmonella typhimurium LT2
aacgcaucgcgga

SEQ ID NO: 3768662 - RNA, 14 nt, Salmonella typhimurium LT2
aacgcaucgcggau

SEQ ID NO: 3768663 - RNA, 15 nt, Salmonella typhimurium LT2
aacgccaacgcccgg

SEQ ID NO: 3768664 - RNA, 16 nt, Salmonella typhimurium LT2
aacgccaagcgcggca

SEQ ID NO: 3768665 - RNA, 17 nt, Salmonella typhimurium LT2
aacgccaagcgcggcag

SEQ ID NO: 3768666 - RNA, 23 nt, Salmonella typhimurium LT2
aacgccaagcgcggcagcagcuu

SEQ ID NO: 3768667 - RNA, 18 nt, Salmonella typhimurium LT2
aacgccaaucacuuuacu

SEQ ID NO: 3768668 - RNA, 22 nt, Salmonella typhimurium LT2
aacgccaggccguugugucccu

SEQ ID NO: 3768669 - RNA, 20 nt, Salmonella typhimurium LT2
aacgccaguggaugcgcuau

SEQ ID NO: 3768670 - RNA, 21 nt, Salmonella typhimurium LT2
aacgccaguuccgccacggcg

SEQ ID NO: 3768671 - RNA, 13 nt, Salmonella typhimurium LT2
aacgccaucagcc

SEQ ID NO: 3768672 - RNA, 23 nt, Salmonella typhimurium LT2
aacgccaugacgccaagcugcag

SEQ ID NO: 3768673 - RNA, 19 nt, Salmonella typhimurium LT2
aacgcccaaaaugcggcau

SEQ ID NO: 3768674 - RNA, 12 nt, Salmonella typhimurium LT2
aacgcccaacug

SEQ ID NO: 3768675 - RNA, 20 nt, Salmonella typhimurium LT2
aacgccccucgguuuauccc

SEQ ID NO: 3768676 - RNA, 19 nt, Salmonella typhimurium LT2
aacgccccuucaucagcca

SEQ ID NO: 3768677 - RNA, 22 nt, Salmonella typhimurium LT2
aacgcccgccgcgaccaacagc

SEQ ID NO: 3768678 - RNA, 15 nt, Salmonella typhimurium LT2
aacgcccucucuccg

SEQ ID NO: 3768679 - RNA, 19 nt, Salmonella typhimurium LT2
aacgccgcaaccaaagccg

SEQ ID NO: 3768680 - RNA, 13 nt, Salmonella typhimurium LT2
aacgccgccaucc

SEQ ID NO: 3768681 - RNA, 17 nt, Salmonella typhimurium LT2
aacgccgccgcaaggcg

SEQ ID NO: 3768682 - RNA, 16 nt, Salmonella typhimurium LT2
aacgccgccugcgcca

SEQ ID NO: 3768683 - RNA, 23 nt, Salmonella typhimurium LT2
aacgccgcgcaaagcaauaccac

SEQ ID NO: 3768684 - RNA, 15 nt, Salmonella typhimurium LT2
aacgccgcgccauca

SEQ ID NO: 3768685 - RNA, 20 nt, Salmonella typhimurium LT2
aacgccgcuuuaccgccuuc

SEQ ID NO: 3768686 - RNA, 17 nt, Salmonella typhimurium LT2
aacgccgguacgcagca

SEQ ID NO: 3768687 - RNA, 19 nt, Salmonella typhimurium LT2
aacgccguacuccagccca

SEQ ID NO: 3768688 - RNA, 22 nt, Salmonella typhimurium LT2
aacgccgucacaaagcccaccg

SEQ ID NO: 3768689 - RNA, 23 nt, Salmonella typhimurium LT2
aacgccgucgacaaagccaacgc

SEQ ID NO: 3768690 - RNA, 14 nt, Salmonella typhimurium LT2
aacgccgugaacgc

SEQ ID NO: 3768691 - RNA, 16 nt, Salmonella typhimurium LT2
aacgccguuaccagca

SEQ ID NO: 3768692 - RNA, 17 nt, Salmonella typhimurium LT2
aacgccguuaccagcau

SEQ ID NO: 3768693 - RNA, 18 nt, Salmonella typhimurium LT2
aacgccguuaccagcauc

SEQ ID NO: 3768694 - RNA, 13 nt, Salmonella typhimurium LT2
aacgccuccaccg

SEQ ID NO: 3768695 - RNA, 18 nt, Salmonella typhimurium LT2
aacgccugaugcugcgca

SEQ ID NO: 3768696 - RNA, 20 nt, Salmonella typhimurium LT2
aacgccugaugcugcgcauc

SEQ ID NO: 3768697 - RNA, 13 nt, Salmonella typhimurium LT2
aacgccugcacca

SEQ ID NO: 3768698 - RNA, 19 nt, Salmonella typhimurium LT2
aacgccugccgcgcccagu

SEQ ID NO: 3768699 - RNA, 22 nt, Salmonella typhimurium LT2
aacgccugccgcgcccaguuuc

SEQ ID NO: 3768700 - RNA, 11 nt, Salmonella typhimurium LT2
aacgccuguag

SEQ ID NO: 3768701 - RNA, 16 nt, Salmonella typhimurium LT2
aacgccuuauccggcc

SEQ ID NO: 3768702 - RNA, 20 nt, Salmonella typhimurium LT2
aacgccuuauccggccuaca

SEQ ID NO: 3768703 - RNA, 21 nt, Salmonella typhimurium LT2
aacuauugcugcccccggcgc

SEQ ID NO: 3768704 - RNA, 20 nt, Salmonella typhimurium LT2
aacuauuugccugaacgguu

SEQ ID NO: 3768705 - RNA, 15 nt, Salmonella typhimurium LT2
aacucaauccauucc

SEQ ID NO: 3768706 - RNA, 15 nt, Salmonella typhimurium LT2
aacucacgcaacaac

SEQ ID NO: 3768707 - RNA, 24 nt, Salmonella typhimurium LT2
aacucagagagauccugagaaauc

SEQ ID NO: 3768708 - RNA, 13 nt, Salmonella typhimurium LT2
aacucagaggcgg

SEQ ID NO: 3768709 - RNA, 12 nt, Salmonella typhimurium LT2
aacucagcaaua

SEQ ID NO: 3768710 - RNA, 12 nt, Salmonella typhimurium LT2
aacucagcgcca

SEQ ID NO: 3768711 - RNA, 16 nt, Salmonella typhimurium LT2
aacucagcgccagcgc

SEQ ID NO: 3768712 - RNA, 14 nt, Salmonella typhimurium LT2
aacucaguuuccag

SEQ ID NO: 3768713 - RNA, 14 nt, Salmonella typhimurium LT2
aacucaucgccagc

SEQ ID NO: 3768714 - RNA, 14 nt, Salmonella typhimurium LT2
aacuccagcggcag

SEQ ID NO: 3768715 - RNA, 16 nt, Salmonella typhimurium LT2
aacucccggcggaaau

SEQ ID NO: 3768716 - RNA, 21 nt, Salmonella typhimurium LT2
aacuccggacguacccaggcg

SEQ ID NO: 3768717 - RNA, 15 nt, Salmonella typhimurium LT2
aacuccucuuccgac

SEQ ID NO: 3768718 - RNA, 16 nt, Salmonella typhimurium LT2
aacucggcagcgcgac

SEQ ID NO: 3768719 - RNA, 20 nt, Salmonella typhimurium LT2
aacucgugaagaucagcaga

SEQ ID NO: 3768720 - RNA, 19 nt, Salmonella typhimurium LT2
aacucuauaucgacaggcg

SEQ ID NO: 3768721 - RNA, 15 nt, Salmonella typhimurium LT2
aacucuauuaaaaua

SEQ ID NO: 3768722 - RNA, 18 nt, Salmonella typhimurium LT2
aacucuauuaaaauaaau

SEQ ID NO: 3768723 - RNA, 20 nt, Salmonella typhimurium LT2
aacucuccaugccaucggcc

SEQ ID NO: 3768724 - RNA, 12 nt, Salmonella typhimurium LT2
aacucugaaaac

SEQ ID NO: 3768725 - RNA, 14 nt, Salmonella typhimurium LT2
aacucugcucuuug

SEQ ID NO: 3768726 - RNA, 14 nt, Salmonella typhimurium LT2
aacucugcuuuuau

SEQ ID NO: 3768727 - RNA, 23 nt, Salmonella typhimurium LT2
aacucugugagcgucauauugcc

SEQ ID NO: 3768728 - RNA, 13 nt, Salmonella typhimurium LT2
aacucuucaacgg

SEQ ID NO: 3768729 - RNA, 21 nt, Salmonella typhimurium LT2
aacucuuccgggcugacauaa

SEQ ID NO: 3768730 - RNA, 23 nt, Salmonella typhimurium LT2
aacucuuguaggcccgauaagca

SEQ ID NO: 3768731 - RNA, 22 nt, Salmonella typhimurium LT2
aacucuuucuugaauauggcgg

SEQ ID NO: 3768732 - RNA, 19 nt, Salmonella typhimurium LT2
aacucuuuugcagcaaaua

SEQ ID NO: 3768733 - RNA, 21 nt, Salmonella typhimurium LT2
aacucuuuugcagcaaauaca

SEQ ID NO: 3768734 - RNA, 21 nt, Salmonella typhimurium LT2
aacugaacccaucgccccgaa

SEQ ID NO: 3768735 - RNA, 13 nt, Salmonella typhimurium LT2
aacugaauuucau

SEQ ID NO: 3768736 - RNA, 18 nt, Salmonella typhimurium LT2
aacugacccgccagugcu

SEQ ID NO: 3768737 - RNA, 16 nt, Salmonella typhimurium LT2
aacugacgaucguggc

SEQ ID NO: 3768738 - RNA, 15 nt, Salmonella typhimurium LT2
aacugaguucgccau

SEQ ID NO: 3768739 - RNA, 21 nt, Salmonella typhimurium LT2
aacugauaacgauaagugaag

SEQ ID NO: 3768740 - RNA, 22 nt, Salmonella typhimurium LT2
aacugauccugcguuaacgacc

SEQ ID NO: 3768741 - RNA, 20 nt, Salmonella typhimurium LT2
aacugauggcgcuaagccag

SEQ ID NO: 3768742 - RNA, 15 nt, Salmonella typhimurium LT2
aacugaugugacauu

SEQ ID NO: 3768743 - RNA, 18 nt, Salmonella typhimurium LT2
aacugauucaaaagguga

SEQ ID NO: 3768744 - RNA, 21 nt, Salmonella typhimurium LT2
aacugcccggagccaauguug

SEQ ID NO: 3768745 - RNA, 13 nt, Salmonella typhimurium LT2
aacugccggggaa

SEQ ID NO: 3768746 - RNA, 17 nt, Salmonella typhimurium LT2
aacugccggggaaguac

SEQ ID NO: 3768747 - RNA, 17 nt, Salmonella typhimurium LT2
aacugcgaaaucaccga

SEQ ID NO: 3768748 - RNA, 16 nt, Salmonella typhimurium LT2
aacugcgccaaaucgg

SEQ ID NO: 3768749 - RNA, 15 nt, Salmonella typhimurium LT2
aacugcgccugcuca

SEQ ID NO: 3768750 - RNA, 17 nt, Salmonella typhimurium LT2
aacugcgcgccgcccug

SEQ ID NO: 3768751 - RNA, 15 nt, Salmonella typhimurium LT2
aacugcgcguauccg

SEQ ID NO: 3768752 - RNA, 14 nt, Salmonella typhimurium LT2
aacugcggccagac

SEQ ID NO: 3768753 - RNA, 17 nt, Salmonella typhimurium LT2
aacugcgggaaguagca

SEQ ID NO: 3768754 - RNA, 18 nt, Salmonella typhimurium LT2
aacugcgguaaauaaugc

SEQ ID NO: 3768755 - RNA, 16 nt, Salmonella typhimurium LT2
aacugcucuaccaacu

SEQ ID NO: 3768756 - RNA, 11 nt, Salmonella typhimurium LT2
aacugcugcuc

SEQ ID NO: 3768757 - RNA, 22 nt, Salmonella typhimurium LT2
aacugcuggcgagcagaaaaag

SEQ ID NO: 3768758 - RNA, 14 nt, Salmonella typhimurium LT2
aacuggaaggcuuc

SEQ ID NO: 3768759 - RNA, 17 nt, Salmonella typhimurium LT2
aacuggccacagcaaau

SEQ ID NO: 3768760 - RNA, 15 nt, Salmonella typhimurium LT2
aacuggcggcgcacg

SEQ ID NO: 3768761 - RNA, 23 nt, Salmonella typhimurium LT2
aacugggcuugcauugcuuuuag

SEQ ID NO: 3768762 - RNA, 15 nt, Salmonella typhimurium LT2
aacugggugccauga

SEQ ID NO: 3768763 - RNA, 19 nt, Salmonella typhimurium LT2
aacugggugugaucgccgc

SEQ ID NO: 3768764 - RNA, 17 nt, Salmonella typhimurium LT2
aacugguacguccaucc

SEQ ID NO: 3768765 - RNA, 15 nt, Salmonella typhimurium LT2
aacuggucaaacaaa

SEQ ID NO: 3768766 - RNA, 13 nt, Salmonella typhimurium LT2
aacuggugaaaca

SEQ ID NO: 3768767 - RNA, 14 nt, Salmonella typhimurium LT2
aacugucugaauca

SEQ ID NO: 3768768 - RNA, 22 nt, Salmonella typhimurium LT2
aacuguguacgccaagcugcaa

SEQ ID NO: 3768769 - RNA, 13 nt, Salmonella typhimurium LT2
aacuguuaucaua

SEQ ID NO: 3768770 - RNA, 16 nt, Salmonella typhimurium LT2
aacuguucagccagca

SEQ ID NO: 3768771 - RNA, 12 nt, Salmonella typhimurium LT2
aacuuaaauaaa

SEQ ID NO: 3768772 - RNA, 13 nt, Salmonella typhimurium LT2
aacuuaaauaaaa

SEQ ID NO: 3768773 - RNA, 17 nt, Salmonella typhimurium LT2
aacuuaaauaaaaauga

SEQ ID NO: 3768774 - RNA, 21 nt, Salmonella typhimurium LT2
aacuuaccaguuauagcgcag

SEQ ID NO: 3768775 - RNA, 22 nt, Salmonella typhimurium LT2
aacuuaucauuuuuucuaagau

SEQ ID NO: 3768776 - RNA, 18 nt, Salmonella typhimurium LT2
aacuuauuuuauuuuuau

SEQ ID NO: 3768777 - RNA, 20 nt, Salmonella typhimurium LT2
aacuucaugguacagaucca

SEQ ID NO: 3768778 - RNA, 13 nt, Salmonella typhimurium LT2
aacuuccuuugcc

SEQ ID NO: 3768779 - RNA, 13 nt, Salmonella typhimurium LT2
aacuucgauaaua

SEQ ID NO: 3768780 - RNA, 15 nt, Salmonella typhimurium LT2
aacuucgauaauaaa

SEQ ID NO: 3768781 - RNA, 13 nt, Salmonella typhimurium LT2
aacuucugcaggg

SEQ ID NO: 3768782 - RNA, 13 nt, Salmonella typhimurium LT2
aacuuguaaaaau

SEQ ID NO: 3768783 - RNA, 22 nt, Salmonella typhimurium LT2
aacuuguaaaaaugccugugcc

SEQ ID NO: 3768784 - RNA, 16 nt, Salmonella typhimurium LT2
aacuuguguucccacu

SEQ ID NO: 3768785 - RNA, 15 nt, Salmonella typhimurium LT2
aacuuuacuuaguau

SEQ ID NO: 3768786 - RNA, 11 nt, Salmonella typhimurium LT2
aacuuuccaac

SEQ ID NO: 3768787 - RNA, 14 nt, Salmonella typhimurium LT2
aacuuugcgaaaaa

SEQ ID NO: 3768788 - RNA, 20 nt, Salmonella typhimurium LT2
aacuuugcgccauuucaaua

SEQ ID NO: 3768789 - RNA, 18 nt, Salmonella typhimurium LT2
aacuuuuggugcccaucg

SEQ ID NO: 3768790 - RNA, 15 nt, Salmonella typhimurium LT2
aagaaaaaauuaaaa

SEQ ID NO: 3768791 - RNA, 18 nt, Salmonella typhimurium LT2
aagaaaccgcagaaaaag

SEQ ID NO: 3768792 - RNA, 15 nt, Salmonella typhimurium LT2
aagaaacugugguua

SEQ ID NO: 3768793 - RNA, 15 nt, Salmonella typhimurium LT2
aagaaagauaaaaua

SEQ ID NO: 3768794 - RNA, 11 nt, Salmonella typhimurium LT2
aagaaauccca

SEQ ID NO: 3768795 - RNA, 18 nt, Salmonella typhimurium LT2
aagaaauugggcuuccac

SEQ ID NO: 3768796 - RNA, 18 nt, Salmonella typhimurium LT2
aagaacacaggcagccag

SEQ ID NO: 3768797 - RNA, 22 nt, Salmonella typhimurium LT2
aagaaccgacugucgaaaccag

SEQ ID NO: 3768798 - RNA, 20 nt, Salmonella typhimurium LT2
aagaacgccgcaaacgccga

SEQ ID NO: 3768799 - RNA, 15 nt, Salmonella typhimurium LT2
aagaacguguuuuuc

SEQ ID NO: 3768800 - RNA, 19 nt, Salmonella typhimurium LT2
aagaacguucauggguuag

SEQ ID NO: 3768801 - RNA, 22 nt, Salmonella typhimurium LT2
aagaacugcaaauaccacauca

SEQ ID NO: 3768802 - RNA, 19 nt, Salmonella typhimurium LT2
aagaaguaaacagaaucaa

SEQ ID NO: 3768803 - RNA, 17 nt, Salmonella typhimurium LT2
aagaauaccuaucggcu

SEQ ID NO: 3768804 - RNA, 12 nt, Salmonella typhimurium LT2
aagaauaugaga

SEQ ID NO: 3768805 - RNA, 17 nt, Salmonella typhimurium LT2
aagaaucacgccgauga

SEQ ID NO: 3768806 - RNA, 16 nt, Salmonella typhimurium LT2
aagaaucgccaggcgc

SEQ ID NO: 3768807 - RNA, 16 nt, Salmonella typhimurium LT2
aagaaugaaaaaaaau

SEQ ID NO: 3768808 - RNA, 18 nt, Salmonella typhimurium LT2
aagcauugugcagccaug

SEQ ID NO: 3768809 - RNA, 16 nt, Salmonella typhimurium LT2
aagccaacguugaaaa

SEQ ID NO: 3768810 - RNA, 17 nt, Salmonella typhimurium LT2
aagccaauacucagggu

SEQ ID NO: 3768811 - RNA, 15 nt, Salmonella typhimurium LT2
aagccacugcccaga

SEQ ID NO: 3768812 - RNA, 19 nt, Salmonella typhimurium LT2
aagccagccaaauagcgcc

SEQ ID NO: 3768813 - RNA, 20 nt, Salmonella typhimurium LT2
aagccagguugcgcccggcg

SEQ ID NO: 3768814 - RNA, 21 nt, Salmonella typhimurium LT2
aagccauugccgauuucacga

SEQ ID NO: 3768815 - RNA, 19 nt, Salmonella typhimurium LT2
aagccauugccgcgacaaa

SEQ ID NO: 3768816 - RNA, 22 nt, Salmonella typhimurium LT2
aagccauuggucaucaucagga

SEQ ID NO: 3768817 - RNA, 21 nt, Salmonella typhimurium LT2
aagcccaccgcgaacauugga

SEQ ID NO: 3768818 - RNA, 12 nt, Salmonella typhimurium LT2
aagcccacgccc

SEQ ID NO: 3768819 - RNA, 16 nt, Salmonella typhimurium LT2
aagcccaucagcgcca

SEQ ID NO: 3768820 - RNA, 12 nt, Salmonella typhimurium LT2
aagcccauggca

SEQ ID NO: 3768821 - RNA, 19 nt, Salmonella typhimurium LT2
aagcccauggcaggcagca

SEQ ID NO: 3768822 - RNA, 18 nt, Salmonella typhimurium LT2
aagccccuggcgcgccag

SEQ ID NO: 3768823 - RNA, 16 nt, Salmonella typhimurium LT2
aagcccggccacagcg

SEQ ID NO: 3768824 - RNA, 19 nt, Salmonella typhimurium LT2
aagcccggccacagcgcca

SEQ ID NO: 3768825 - RNA, 16 nt, Salmonella typhimurium LT2
aagcccuuacaaaaau

SEQ ID NO: 3768826 - RNA, 18 nt, Salmonella typhimurium LT2
aagcccuuuaguaaaguu

SEQ ID NO: 3768827 - RNA, 19 nt, Salmonella typhimurium LT2
aagcccuuucuuuuuuugu

SEQ ID NO: 3768828 - RNA, 19 nt, Salmonella typhimurium LT2
aagccggcaggcagcgcca

SEQ ID NO: 3768829 - RNA, 22 nt, Salmonella typhimurium LT2
aagccggcaggcagcgccagcg

SEQ ID NO: 3768830 - RNA, 18 nt, Salmonella typhimurium LT2
aagccggcgccauuucgc

SEQ ID NO: 3768831 - RNA, 22 nt, Salmonella typhimurium LT2
aagccgggucagcccccaguuu

SEQ ID NO: 3768832 - RNA, 15 nt, Salmonella typhimurium LT2
aagccgucggcgcca

SEQ ID NO: 3768833 - RNA, 19 nt, Salmonella typhimurium LT2
aagccugauacuuuuacuc

SEQ ID NO: 3768834 - RNA, 15 nt, Salmonella typhimurium LT2
aagccuuuaugcagu

SEQ ID NO: 3768835 - RNA, 12 nt, Salmonella typhimurium LT2
aagccuuucugu

SEQ ID NO: 3768836 - RNA, 23 nt, Salmonella typhimurium LT2
aagccuuucuguucuuugauuag

SEQ ID NO: 3768837 - RNA, 15 nt, Salmonella typhimurium LT2
aagcgaaaaaauaau

SEQ ID NO: 3768838 - RNA, 12 nt, Salmonella typhimurium LT2
aagcgaaaauaa

SEQ ID NO: 3768839 - RNA, 22 nt, Salmonella typhimurium LT2
aagcgaagcgucauccggcaau

SEQ ID NO: 3768840 - RNA, 20 nt, Salmonella typhimurium LT2
aagcgaauaauuaacccaca

SEQ ID NO: 3768841 - RNA, 14 nt, Salmonella typhimurium LT2
aagcgacagcgcca

SEQ ID NO: 3768842 - RNA, 17 nt, Salmonella typhimurium LT2
aagcgacagcgccaucc

SEQ ID NO: 3768843 - RNA, 15 nt, Salmonella typhimurium LT2
aagcgauaaagacag

SEQ ID NO: 3768844 - RNA, 18 nt, Salmonella typhimurium LT2
aagcgauguaagaggccg

SEQ ID NO: 3768845 - RNA, 23 nt, Salmonella typhimurium LT2
aagcgauguauuuauccacgccg

SEQ ID NO: 3768846 - RNA, 17 nt, Salmonella typhimurium LT2
aagcgcaaacuuccaca

SEQ ID NO: 3768847 - RNA, 13 nt, Salmonella typhimurium LT2
aagcgcagcgcca

SEQ ID NO: 3768848 - RNA, 22 nt, Salmonella typhimurium LT2
aagcgcauccagcucuuucaau

SEQ ID NO: 3768849 - RNA, 18 nt, Salmonella typhimurium LT2
aagcgcaugguagaaguu

SEQ ID NO: 3768850 - RNA, 19 nt, Salmonella typhimurium LT2
aagcgccagauaugaucga

SEQ ID NO: 3768851 - RNA, 16 nt, Salmonella typhimurium LT2
aagcgccgcugacggc

SEQ ID NO: 3768852 - RNA, 16 nt, Salmonella typhimurium LT2
aagcgccuguucaaca

SEQ ID NO: 3768853 - RNA, 19 nt, Salmonella typhimurium LT2
aagcgccuugucugaccgg

SEQ ID NO: 3768854 - RNA, 15 nt, Salmonella typhimurium LT2
aagcgcgaaucgccu

SEQ ID NO: 3768855 - RNA, 15 nt, Salmonella typhimurium LT2
aagcgcgccgaaaau

SEQ ID NO: 3768856 - RNA, 14 nt, Salmonella typhimurium LT2
aagcgcggcagcag

SEQ ID NO: 3768857 - RNA, 19 nt, Salmonella typhimurium LT2
aagcgcucaugccacgcca

SEQ ID NO: 3768858 - RNA, 23 nt, Salmonella typhimurium LT2
aagcggaaaggacguucuucucc

SEQ ID NO: 3768859 - RNA, 16 nt, Salmonella typhimurium LT2
aagcggaccaaugcug

SEQ ID NO: 3768860 - RNA, 20 nt, Salmonella typhimurium LT2
aagcggaccaaugcuggcag

SEQ ID NO: 3768861 - RNA, 23 nt, Salmonella typhimurium LT2
aagcggauucuucgaugaugccg

SEQ ID NO: 3768862 - RNA, 15 nt, Salmonella typhimurium LT2
aagcggcaaucgccu

SEQ ID NO: 3768863 - RNA, 20 nt, Salmonella typhimurium LT2
aagcggcgucacguucgucg

SEQ ID NO: 3768864 - RNA, 13 nt, Salmonella typhimurium LT2
aagcgguaaaucg

SEQ ID NO: 3768865 - RNA, 17 nt, Salmonella typhimurium LT2
aagcggugcaggaaggc

SEQ ID NO: 3768866 - RNA, 21 nt, Salmonella typhimurium LT2
aagcgguguaaaagccagcaa

SEQ ID NO: 3768867 - RNA, 17 nt, Salmonella typhimurium LT2
aagcgguugcaacucca

SEQ ID NO: 3768868 - RNA, 16 nt, Salmonella typhimurium LT2
aagcguaacagcgcua

SEQ ID NO: 3768869 - RNA, 23 nt, Salmonella typhimurium LT2
aagcguaacagcgcuaucaggaa

SEQ ID NO: 3768870 - RNA, 16 nt, Salmonella typhimurium LT2
aagcguagcgccauca

SEQ ID NO: 3768871 - RNA, 22 nt, Salmonella typhimurium LT2
aagcguagcgccaucaggcaac

SEQ ID NO: 3768872 - RNA, 14 nt, Salmonella typhimurium LT2
aagcgucagcgcca

SEQ ID NO: 3768873 - RNA, 14 nt, Salmonella typhimurium LT2
aagcgucgccagcg

SEQ ID NO: 3768874 - RNA, 18 nt, Salmonella typhimurium LT2
aagcguuacggaaaaaau

SEQ ID NO: 3768875 - RNA, 20 nt, Salmonella typhimurium LT2
aagcguuacggaaaaaauac

SEQ ID NO: 3768876 - RNA, 21 nt, Salmonella typhimurium LT2
aagcguuacggaaaaaauacu

SEQ ID NO: 3768877 - RNA, 14 nt, Salmonella typhimurium LT2
aagcguuagcgcca

SEQ ID NO: 3768878 - RNA, 15 nt, Salmonella typhimurium LT2
aagcguucaucaggc

SEQ ID NO: 3768879 - RNA, 12 nt, Salmonella typhimurium LT2
aagcguuccagu

SEQ ID NO: 3768880 - RNA, 22 nt, Salmonella typhimurium LT2
aagcguugaauuccaucggcau

SEQ ID NO: 3768881 - RNA, 21 nt, Salmonella typhimurium LT2
aagcguuguacggauggggua

SEQ ID NO: 3768882 - RNA, 15 nt, Salmonella typhimurium LT2
aagcguuucucuugu

SEQ ID NO: 3768883 - RNA, 23 nt, Salmonella typhimurium LT2
aagcguuucucuugugcuuccag

SEQ ID NO: 3768884 - RNA, 24 nt, Salmonella typhimurium LT2
aagcguuuuauacaccugaucggc

SEQ ID NO: 3768885 - RNA, 22 nt, Salmonella typhimurium LT2
aagcuaaaaaccgcaaucaguu

SEQ ID NO: 3768886 - RNA, 19 nt, Salmonella typhimurium LT2
aagcuaauccccagcgcuc

SEQ ID NO: 3768887 - RNA, 17 nt, Salmonella typhimurium LT2
aagcuaauccccgucac

SEQ ID NO: 3768888 - RNA, 22 nt, Salmonella typhimurium LT2
aagcuaauccccgucaccacgc

SEQ ID NO: 3768889 - RNA, 13 nt, Salmonella typhimurium LT2
aagcuacagggaa

SEQ ID NO: 3768890 - RNA, 22 nt, Salmonella typhimurium LT2
aagcuacaggucgacgugaacu

SEQ ID NO: 3768891 - RNA, 20 nt, Salmonella typhimurium LT2
aagcuauccucuuuuaucac

SEQ ID NO: 3768892 - RNA, 19 nt, Salmonella typhimurium LT2
aagcuaucgccaucaacgc

SEQ ID NO: 3768893 - RNA, 22 nt, Salmonella typhimurium LT2
aagcuaucuggccugacgacgg

SEQ ID NO: 3768894 - RNA, 17 nt, Salmonella typhimurium LT2
aagcuauuucuguauaa

SEQ ID NO: 3768895 - RNA, 20 nt, Salmonella typhimurium LT2
aagcucaggccaaucacccc

SEQ ID NO: 3768896 - RNA, 23 nt, Salmonella typhimurium LT2
aagcucugcgguaacaaucucuu

SEQ ID NO: 3768897 - RNA, 14 nt, Salmonella typhimurium LT2
aagcucuucaugca

SEQ ID NO: 3768898 - RNA, 16 nt, Salmonella typhimurium LT2
aagcucuucuuacucc

SEQ ID NO: 3768899 - RNA, 22 nt, Salmonella typhimurium LT2
aagcugaauaccugccccauaa

SEQ ID NO: 3768900 - RNA, 16 nt, Salmonella typhimurium LT2
aagcugaccagacagu

SEQ ID NO: 3768901 - RNA, 15 nt, Salmonella typhimurium LT2
aagcugacgcgccug

SEQ ID NO: 3768902 - RNA, 21 nt, Salmonella typhimurium LT2
aagcugcaucccggucaacgu

SEQ ID NO: 3768903 - RNA, 16 nt, Salmonella typhimurium LT2
aagcugcgcagcacuu

SEQ ID NO: 3768904 - RNA, 17 nt, Salmonella typhimurium LT2
aagcugcgccauacccc

SEQ ID NO: 3768905 - RNA, 24 nt, Salmonella typhimurium LT2
aagcugcggcagaaucacggccga

SEQ ID NO: 3768906 - RNA, 22 nt, Salmonella typhimurium LT2
aagcugggcgucaacgugaaaa

SEQ ID NO: 3768907 - RNA, 14 nt, Salmonella typhimurium LT2
aagcugguaaaugc

SEQ ID NO: 3768908 - RNA, 19 nt, Salmonella typhimurium LT2
aagcuggucgagauacugc

SEQ ID NO: 3768909 - RNA, 14 nt, Salmonella typhimurium LT2
aagcuguuccggcu

SEQ ID NO: 3768910 - RNA, 21 nt, Salmonella typhimurium LT2
aagcuucuuauuauccaggcg

SEQ ID NO: 3768911 - RNA, 23 nt, Salmonella typhimurium LT2
aagugaaaaaacggaaccaaaau

SEQ ID NO: 3768912 - RNA, 19 nt, Salmonella typhimurium LT2
aagugcaggauagaaaaca

SEQ ID NO: 3768913 - RNA, 14 nt, Salmonella typhimurium LT2
aagugcaucgccag

SEQ ID NO: 3768914 - RNA, 23 nt, Salmonella typhimurium LT2
aagugccaguaacucaucgccag

SEQ ID NO: 3768915 - RNA, 17 nt, Salmonella typhimurium LT2
aagugccuguucgugcg

SEQ ID NO: 3768916 - RNA, 18 nt, Salmonella typhimurium LT2
aagugcgaaauuuaauau

SEQ ID NO: 3768917 - RNA, 14 nt, Salmonella typhimurium LT2
aagugcgcacucag

SEQ ID NO: 3768918 - RNA, 17 nt, Salmonella typhimurium LT2
aagugcgcacucagaaa

SEQ ID NO: 3768919 - RNA, 18 nt, Salmonella typhimurium LT2
aagugcgcugucagcaca

SEQ ID NO: 3768920 - RNA, 18 nt, Salmonella typhimurium LT2
aagugguucguccaucag

SEQ ID NO: 3768921 - RNA, 21 nt, Salmonella typhimurium LT2
aaguguaaguucauuuaggcg

SEQ ID NO: 3768922 - RNA, 15 nt, Salmonella typhimurium LT2
aagugugaacuaugc

SEQ ID NO: 3768923 - RNA, 21 nt, Salmonella typhimurium LT2
aaguguguaccagcaacgcca

SEQ ID NO: 3768924 - RNA, 22 nt, Salmonella typhimurium LT2
aaguguguaccagcaacgccag

SEQ ID NO: 3768925 - RNA, 12 nt, Salmonella typhimurium LT2
aaguuaaacgga

SEQ ID NO: 3768926 - RNA, 18 nt, Salmonella typhimurium LT2
aaguuaccgcgccaggcg

SEQ ID NO: 3768927 - RNA, 16 nt, Salmonella typhimurium LT2
aaguuacuaaaaguaa

SEQ ID NO: 3768928 - RNA, 20 nt, Salmonella typhimurium LT2
aaguuagccccuuaucaaag

SEQ ID NO: 3768929 - RNA, 15 nt, Salmonella typhimurium LT2
aaguucauaaaugua

SEQ ID NO: 3768930 - RNA, 19 nt, Salmonella typhimurium LT2
aaguucccagcgguggaua

SEQ ID NO: 3768931 - RNA, 15 nt, Salmonella typhimurium LT2
aaguugaaaggaaag

SEQ ID NO: 3768932 - RNA, 22 nt, Salmonella typhimurium LT2
aaguugacuuuuacgccacggu

SEQ ID NO: 3768933 - RNA, 15 nt, Salmonella typhimurium LT2
aaguuuauccggcac

SEQ ID NO: 3768934 - RNA, 18 nt, Salmonella typhimurium LT2
aaguuuuuuuaaaaaacc

SEQ ID NO: 3768935 - RNA, 12 nt, Salmonella typhimurium LT2
aauaaaaaaacc

SEQ ID NO: 3768936 - RNA, 22 nt, Salmonella typhimurium LT2
aauaaaaaacaacucuauuaaa

SEQ ID NO: 3768937 - RNA, 15 nt, Salmonella typhimurium LT2
aauaaaaaacaagau

SEQ ID NO: 3768938 - RNA, 14 nt, Salmonella typhimurium LT2
aauaaaaaccauuu

SEQ ID NO: 3768939 - RNA, 19 nt, Salmonella typhimurium LT2
aauaaaaaccauuuauaaa

SEQ ID NO: 3768940 - RNA, 22 nt, Salmonella typhimurium LT2
aauaaaaaccauuuauaaaaua

SEQ ID NO: 3768941 - RNA, 17 nt, Salmonella typhimurium LT2
aauaaaacggcucauca

SEQ ID NO: 3768942 - RNA, 12 nt, Salmonella typhimurium LT2
aauaaaaggaau

SEQ ID NO: 3768943 - RNA, 13 nt, Salmonella typhimurium LT2
aauaaaauaacua

SEQ ID NO: 3768944 - RNA, 12 nt, Salmonella typhimurium LT2
aauaaaauaucc

SEQ ID NO: 3768945 - RNA, 15 nt, Salmonella typhimurium LT2
aauaaaauucagcgc

SEQ ID NO: 3768946 - RNA, 15 nt, Salmonella typhimurium LT2
aauaaagacuggccc

SEQ ID NO: 3768947 - RNA, 19 nt, Salmonella typhimurium LT2
aauaaagcagcggcgguua

SEQ ID NO: 3768948 - RNA, 15 nt, Salmonella typhimurium LT2
aauaaagccgcccau

SEQ ID NO: 3768949 - RNA, 21 nt, Salmonella typhimurium LT2
aauaaagcggucuuucaacau

SEQ ID NO: 3768950 - RNA, 20 nt, Salmonella typhimurium LT2
aauaaaggcgcuguuggcau

SEQ ID NO: 3768951 - RNA, 14 nt, Salmonella typhimurium LT2
aauaaauaccaaag

SEQ ID NO: 3768952 - RNA, 13 nt, Salmonella typhimurium LT2
aauaaauccauga

SEQ ID NO: 3768953 - RNA, 18 nt, Salmonella typhimurium LT2
aauaaaucguguggcuga

SEQ ID NO: 3768954 - RNA, 14 nt, Salmonella typhimurium LT2
aauaaaugccgcaa

SEQ ID NO: 3768955 - RNA, 20 nt, Salmonella typhimurium LT2
aauaaauucuucaucaugau

SEQ ID NO: 3768956 - RNA, 23 nt, Salmonella typhimurium LT2
aauaaauugaauucgcuaauaaa

SEQ ID NO: 3768957 - RNA, 17 nt, Salmonella typhimurium LT2
aauaacacaggcggcgc

SEQ ID NO: 3768958 - RNA, 12 nt, Salmonella typhimurium LT2
aauaacaucuuc

SEQ ID NO: 3768959 - RNA, 13 nt, Salmonella typhimurium LT2
aauaaccagagua

SEQ ID NO: 3768960 - RNA, 18 nt, Salmonella typhimurium LT2
aauaaccagccccagaaa

SEQ ID NO: 3768961 - RNA, 19 nt, Salmonella typhimurium LT2
aauaaccccagcugcggca

SEQ ID NO: 3768962 - RNA, 16 nt, Salmonella typhimurium LT2
aauaacccggauuguc

SEQ ID NO: 3768963 - RNA, 12 nt, Salmonella typhimurium LT2
aauaaccgccag

SEQ ID NO: 3768964 - RNA, 17 nt, Salmonella typhimurium LT2
aauaaccgccagcagca

SEQ ID NO: 3768965 - RNA, 18 nt, Salmonella typhimurium LT2
aauaaccgccagcagcag

SEQ ID NO: 3768966 - RNA, 14 nt, Salmonella typhimurium LT2
aauaaccgccgauu

SEQ ID NO: 3768967 - RNA, 20 nt, Salmonella typhimurium LT2
aauaaccucuacacauuuua

SEQ ID NO: 3768968 - RNA, 20 nt, Salmonella typhimurium LT2
aauaacgaacugauggcgcu

SEQ ID NO: 3768969 - RNA, 20 nt, Salmonella typhimurium LT2
aauaacgccagaucucacaa

SEQ ID NO: 3768970 - RNA, 17 nt, Salmonella typhimurium LT2
aauaacgccgauaacca

SEQ ID NO: 3768971 - RNA, 20 nt, Salmonella typhimurium LT2
aauaacgguagagaaugguc

SEQ ID NO: 3768972 - RNA, 14 nt, Salmonella typhimurium LT2
aauaacgucaccgc

SEQ ID NO: 3768973 - RNA, 21 nt, Salmonella typhimurium LT2
aauaacuauaauugcuuuuuu

SEQ ID NO: 3768974 - RNA, 15 nt, Salmonella typhimurium LT2
aauaacugacagacu

SEQ ID NO: 3768975 - RNA, 11 nt, Salmonella typhimurium LT2
aauaagaacuu

SEQ ID NO: 3768976 - RNA, 16 nt, Salmonella typhimurium LT2
acgccggugccugccg

SEQ ID NO: 3768977 - RNA, 18 nt, Salmonella typhimurium LT2
acgccguaauaaggcgga

SEQ ID NO: 3768978 - RNA, 17 nt, Salmonella typhimurium LT2
acgccguacuccagccc

SEQ ID NO: 3768979 - RNA, 16 nt, Salmonella typhimurium LT2
acgccgucacaaagcc

SEQ ID NO: 3768980 - RNA, 21 nt, Salmonella typhimurium LT2
acgccgucacaaagcccaccg

SEQ ID NO: 3768981 - RNA, 14 nt, Salmonella typhimurium LT2
acgccgucucuuuu

SEQ ID NO: 3768982 - RNA, 19 nt, Salmonella typhimurium LT2
acgccgucugguacggcca

SEQ ID NO: 3768983 - RNA, 19 nt, Salmonella typhimurium LT2
acgccgugaacgccaaaua

SEQ ID NO: 3768984 - RNA, 23 nt, Salmonella typhimurium LT2
acgccgugcucauccaacugcgc

SEQ ID NO: 3768985 - RNA, 16 nt, Salmonella typhimurium LT2
acgccguuaccagcau

SEQ ID NO: 3768986 - RNA, 16 nt, Salmonella typhimurium LT2
acgccuaaugaagcgc

SEQ ID NO: 3768987 - RNA, 19 nt, Salmonella typhimurium LT2
acgccuaccgcuucccaca

SEQ ID NO: 3768988 - RNA, 17 nt, Salmonella typhimurium LT2
acgccuauuuucugcuc

SEQ ID NO: 3768989 - RNA, 20 nt, Salmonella typhimurium LT2
acgccucauccggccuggcg

SEQ ID NO: 3768990 - RNA, 15 nt, Salmonella typhimurium LT2
acgccuccaggcuac

SEQ ID NO: 3768991 - RNA, 13 nt, Salmonella typhimurium LT2
acgccuccugccg

SEQ ID NO: 3768992 - RNA, 23 nt, Salmonella typhimurium LT2
acgccucguuugcugagcagcca

SEQ ID NO: 3768993 - RNA, 20 nt, Salmonella typhimurium LT2
acgccugaugcugcgaggcc

SEQ ID NO: 3768994 - RNA, 15 nt, Salmonella typhimurium LT2
acgccugcaucaaca

SEQ ID NO: 3768995 - RNA, 14 nt, Salmonella typhimurium LT2
acgccugccagaua

SEQ ID NO: 3768996 - RNA, 18 nt, Salmonella typhimurium LT2
acgccugcgucuaaccag

SEQ ID NO: 3768997 - RNA, 12 nt, Salmonella typhimurium LT2
acgccuggagug

SEQ ID NO: 3768998 - RNA, 21 nt, Salmonella typhimurium LT2
acgccuguaaugccgccuguu

SEQ ID NO: 3768999 - RNA, 21 nt, Salmonella typhimurium LT2
acgccuguagcgcuuuuucca

SEQ ID NO: 3769000 - RNA, 21 nt, Salmonella typhimurium LT2
acgccuuacccggccuacauc

SEQ ID NO: 3769001 - RNA, 22 nt, Salmonella typhimurium LT2
acgccuuacccggccuacaucg

SEQ ID NO: 3769002 - RNA, 13 nt, Salmonella typhimurium LT2
acgccuuauccgg

SEQ ID NO: 3769003 - RNA, 15 nt, Salmonella typhimurium LT2
acgccuuauccggcc

SEQ ID NO: 3769004 - RNA, 19 nt, Salmonella typhimurium LT2
acgccuuauccggccuaca

SEQ ID NO: 3769005 - RNA, 21 nt, Salmonella typhimurium LT2
acgccuuauccugccuacagg

SEQ ID NO: 3769006 - RNA, 21 nt, Salmonella typhimurium LT2
acgccuucauauuaaauuccg

SEQ ID NO: 3769007 - RNA, 19 nt, Salmonella typhimurium LT2
acgccuuccugccagcaca

SEQ ID NO: 3769008 - RNA, 14 nt, Salmonella typhimurium LT2
acgccuuuaagcug

SEQ ID NO: 3769009 - RNA, 21 nt, Salmonella typhimurium LT2
acgccuuuacccuuacggcca

SEQ ID NO: 3769010 - RNA, 13 nt, Salmonella typhimurium LT2
acgccuuucacgc

SEQ ID NO: 3769011 - RNA, 18 nt, Salmonella typhimurium LT2
acgccuuucacgccgaag

SEQ ID NO: 3769012 - RNA, 15 nt, Salmonella typhimurium LT2
acgccuuugcccggu

SEQ ID NO: 3769013 - RNA, 16 nt, Salmonella typhimurium LT2
acgccuuugcccggug

SEQ ID NO: 3769014 - RNA, 20 nt, Salmonella typhimurium LT2
acgcgaaacgaaacccaaau

SEQ ID NO: 3769015 - RNA, 17 nt, Salmonella typhimurium LT2
acgcgaaauagugggga

SEQ ID NO: 3769016 - RNA, 16 nt, Salmonella typhimurium LT2
acgcgaagcggcgcca

SEQ ID NO: 3769017 - RNA, 23 nt, Salmonella typhimurium LT2
acgcgaagcggcgccauccggca

SEQ ID NO: 3769018 - RNA, 15 nt, Salmonella typhimurium LT2
acgcgaaggccagca

SEQ ID NO: 3769019 - RNA, 17 nt, Salmonella typhimurium LT2
acgcgaaggccagcacc

SEQ ID NO: 3769020 - RNA, 18 nt, Salmonella typhimurium LT2
acgcgaaggccagcacca

SEQ ID NO: 3769021 - RNA, 17 nt, Salmonella typhimurium LT2
acgcgaauagccagaca

SEQ ID NO: 3769022 - RNA, 19 nt, Salmonella typhimurium LT2
acgcgacucccaggcgcgc

SEQ ID NO: 3769023 - RNA, 15 nt, Salmonella typhimurium LT2
acgcgagaagcccgg

SEQ ID NO: 3769024 - RNA, 21 nt, Salmonella typhimurium LT2
acgcgauaaaaaacgcccaga

SEQ ID NO: 3769025 - RNA, 16 nt, Salmonella typhimurium LT2
acgcgaucuucauagu

SEQ ID NO: 3769026 - RNA, 15 nt, Salmonella typhimurium LT2
acgcgaugagauaau

SEQ ID NO: 3769027 - RNA, 15 nt, Salmonella typhimurium LT2
acgcgaugccaguag

SEQ ID NO: 3769028 - RNA, 20 nt, Salmonella typhimurium LT2
acgcgcagagauagccagcg

SEQ ID NO: 3769029 - RNA, 14 nt, Salmonella typhimurium LT2
acgcgcagcaccga

SEQ ID NO: 3769030 - RNA, 14 nt, Salmonella typhimurium LT2
acgcgcauaccgcu

SEQ ID NO: 3769031 - RNA, 15 nt, Salmonella typhimurium LT2
acgcgccacgcgcca

SEQ ID NO: 3769032 - RNA, 19 nt, Salmonella typhimurium LT2
acgcgccaucgucaccgga

SEQ ID NO: 3769033 - RNA, 21 nt, Salmonella typhimurium LT2
acgcgcccaacggaugcgcca

SEQ ID NO: 3769034 - RNA, 14 nt, Salmonella typhimurium LT2
acgcgccggaaggc

SEQ ID NO: 3769035 - RNA, 21 nt, Salmonella typhimurium LT2
acgcgccggaugagggcauaa

SEQ ID NO: 3769036 - RNA, 23 nt, Salmonella typhimurium LT2
acgcgccugcucccgcugcggcg

SEQ ID NO: 3769037 - RNA, 17 nt, Salmonella typhimurium LT2
acgcgcgauaucagcga

SEQ ID NO: 3769038 - RNA, 18 nt, Salmonella typhimurium LT2
acgcgcgccgccugcucc

SEQ ID NO: 3769039 - RNA, 18 nt, Salmonella typhimurium LT2
acgcgcgcgcgucaacgc

SEQ ID NO: 3769040 - RNA, 18 nt, Salmonella typhimurium LT2
acgcgcgcggcgucaacg

SEQ ID NO: 3769041 - RNA, 13 nt, Salmonella typhimurium LT2
acgcgcguucguu

SEQ ID NO: 3769042 - RNA, 16 nt, Salmonella typhimurium LT2
acgcgcuaucaauauu

SEQ ID NO: 3769043 - RNA, 21 nt, Salmonella typhimurium LT2
acgcgcucaccuccgccacca

SEQ ID NO: 3769044 - RNA, 15 nt, Salmonella typhimurium LT2
acgcgcucgccagcg

SEQ ID NO: 3769045 - RNA, 21 nt, Salmonella typhimurium LT2
acgcgcugcgguuuacgccau

SEQ ID NO: 3769046 - RNA, 14 nt, Salmonella typhimurium LT2
acgcgcuggcgcgc

SEQ ID NO: 3769047 - RNA, 21 nt, Salmonella typhimurium LT2
acgcgcuguaacuucacgcca

SEQ ID NO: 3769048 - RNA, 23 nt, Salmonella typhimurium LT2
acgcggaaucgucacagaccccg

SEQ ID NO: 3769049 - RNA, 19 nt, Salmonella typhimurium LT2
acgcggacgccaccacagu

SEQ ID NO: 3769050 - RNA, 16 nt, Salmonella typhimurium LT2
acgcggaucagacggc

SEQ ID NO: 3769051 - RNA, 16 nt, Salmonella typhimurium LT2
acgcggauugccgccc

SEQ ID NO: 3769052 - RNA, 21 nt, Salmonella typhimurium LT2
acgcggcacaaaguccgccgu

SEQ ID NO: 3769053 - RNA, 22 nt, Salmonella typhimurium LT2
acgcggccaaaacccaccagca

SEQ ID NO: 3769054 - RNA, 20 nt, Salmonella typhimurium LT2
acgcggccaucacgcugcgg

SEQ ID NO: 3769055 - RNA, 12 nt, Salmonella typhimurium LT2
acgcggcccuga

SEQ ID NO: 3769056 - RNA, 18 nt, Salmonella typhimurium LT2
acgcggcgcuacggcgca

SEQ ID NO: 3769057 - RNA, 19 nt, Salmonella typhimurium LT2
acgcgggguaaaauggacu

SEQ ID NO: 3769058 - RNA, 16 nt, Salmonella typhimurium LT2
acgcggguccgcggag

SEQ ID NO: 3769059 - RNA, 13 nt, Salmonella typhimurium LT2
acgcgggucgaga

SEQ ID NO: 3769060 - RNA, 16 nt, Salmonella typhimurium LT2
acgcgguaugauuaua

SEQ ID NO: 3769061 - RNA, 18 nt, Salmonella typhimurium LT2
acgcggucuuuuaaaaga

SEQ ID NO: 3769062 - RNA, 20 nt, Salmonella typhimurium LT2
acgcggucuuuuaaaagacc

SEQ ID NO: 3769063 - RNA, 23 nt, Salmonella typhimurium LT2
acgcggucuuuuaaaagaccugg

SEQ ID NO: 3769064 - RNA, 18 nt, Salmonella typhimurium LT2
acgcggugacuuuggccg

SEQ ID NO: 3769065 - RNA, 23 nt, Salmonella typhimurium LT2
acgcguaauacgauccucgccau

SEQ ID NO: 3769066 - RNA, 21 nt, Salmonella typhimurium LT2
acgcguagguguuacgcgggu

SEQ ID NO: 3769067 - RNA, 18 nt, Salmonella typhimurium LT2
acgcgucagaaauccgcg

SEQ ID NO: 3769068 - RNA, 17 nt, Salmonella typhimurium LT2
acgcgucagguuacgca

SEQ ID NO: 3769069 - RNA, 14 nt, Salmonella typhimurium LT2
acgcgucccagaua

SEQ ID NO: 3769070 - RNA, 20 nt, Salmonella typhimurium LT2
acgcgucccagauaauccac

SEQ ID NO: 3769071 - RNA, 17 nt, Salmonella typhimurium LT2
acgcgucugaaugacgc

SEQ ID NO: 3769072 - RNA, 20 nt, Salmonella typhimurium LT2
acgcgucugaaugacgccgu

SEQ ID NO: 3769073 - RNA, 18 nt, Salmonella typhimurium LT2
acgcgugaacauggguuu

SEQ ID NO: 3769074 - RNA, 13 nt, Salmonella typhimurium LT2
acgcgugcgcggc

SEQ ID NO: 3769075 - RNA, 14 nt, Salmonella typhimurium LT2
acgcgugcgcggca

SEQ ID NO: 3769076 - RNA, 18 nt, Salmonella typhimurium LT2
acgcguucacaacggcga

SEQ ID NO: 3769077 - RNA, 15 nt, Salmonella typhimurium LT2
acgcguucugaauaa

SEQ ID NO: 3769078 - RNA, 17 nt, Salmonella typhimurium LT2
acgcguucugaauaaau

SEQ ID NO: 3769079 - RNA, 20 nt, Salmonella typhimurium LT2
acgcguugccugaaaagggg

SEQ ID NO: 3769080 - RNA, 16 nt, Salmonella typhimurium LT2
acgcuaaaaaaggcag

SEQ ID NO: 3769081 - RNA, 17 nt, Salmonella typhimurium LT2
acgcuaaagucagcaua

SEQ ID NO: 3769082 - RNA, 22 nt, Salmonella typhimurium LT2
acgcuaaccucuauaguaaauu

SEQ ID NO: 3769083 - RNA, 13 nt, Salmonella typhimurium LT2
acgcuaacgcgca

SEQ ID NO: 3769084 - RNA, 22 nt, Salmonella typhimurium LT2
acgcuaacgcguuuuggcgagc

SEQ ID NO: 3769085 - RNA, 21 nt, Salmonella typhimurium LT2
acgcuaaucccgccuaaccca

SEQ ID NO: 3769086 - RNA, 23 nt, Salmonella typhimurium LT2
acgcuaaucccgcucgccaggug

SEQ ID NO: 3769087 - RNA, 18 nt, Salmonella typhimurium LT2
acgcuaccgucgacgucu

SEQ ID NO: 3769088 - RNA, 23 nt, Salmonella typhimurium LT2
acgcuaugccuggauguauaagu

SEQ ID NO: 3769089 - RNA, 18 nt, Salmonella typhimurium LT2
acgcucacgcgcagacgc

SEQ ID NO: 3769090 - RNA, 23 nt, Salmonella typhimurium LT2
acgcucacuuuucuuuccugcaa

SEQ ID NO: 3769091 - RNA, 14 nt, Salmonella typhimurium LT2
acgcucauaaaaaa

SEQ ID NO: 3769092 - RNA, 22 nt, Salmonella typhimurium LT2
acgcucauaccuggcuugaugu

SEQ ID NO: 3769093 - RNA, 22 nt, Salmonella typhimurium LT2
acgcucauuaacgacaacuucu

SEQ ID NO: 3769094 - RNA, 12 nt, Salmonella typhimurium LT2
acgcuccagcag

SEQ ID NO: 3769095 - RNA, 21 nt, Salmonella typhimurium LT2
acgcuccagcuggcuggcauu

SEQ ID NO: 3769096 - RNA, 13 nt, Salmonella typhimurium LT2
acgcuccuggauu

SEQ ID NO: 3769097 - RNA, 21 nt, Salmonella typhimurium LT2
acgcucgcggaagcgaccggc

SEQ ID NO: 3769098 - RNA, 14 nt, Salmonella typhimurium LT2
acgcucgucgguaa

SEQ ID NO: 3769099 - RNA, 14 nt, Salmonella typhimurium LT2
acgcucuccuacac

SEQ ID NO: 3769100 - RNA, 13 nt, Salmonella typhimurium LT2
acgcucuuccuca

SEQ ID NO: 3769101 - RNA, 13 nt, Salmonella typhimurium LT2
acgcucuucgcca

SEQ ID NO: 3769102 - RNA, 17 nt, Salmonella typhimurium LT2
acgcugaaaaccgcauc

SEQ ID NO: 3769103 - RNA, 18 nt, Salmonella typhimurium LT2
acgcugaaaaccgcauca

SEQ ID NO: 3769104 - RNA, 19 nt, Salmonella typhimurium LT2
acgcugaaaaccgcaucaa

SEQ ID NO: 3769105 - RNA, 15 nt, Salmonella typhimurium LT2
acgcugaacaacccc

SEQ ID NO: 3769106 - RNA, 19 nt, Salmonella typhimurium LT2
acgcugaccacgccgccgc

SEQ ID NO: 3769107 - RNA, 21 nt, Salmonella typhimurium LT2
acgcugaccuuuuucauccuc

SEQ ID NO: 3769108 - RNA, 19 nt, Salmonella typhimurium LT2
acgcugacgcgaucgccgu

SEQ ID NO: 3769109 - RNA, 13 nt, Salmonella typhimurium LT2
acgcugaggcgcc

SEQ ID NO: 3769110 - RNA, 16 nt, Salmonella typhimurium LT2
acgcugagucagaaac

SEQ ID NO: 3769111 - RNA, 22 nt, Salmonella typhimurium LT2
acgcugauacugacacgccagu

SEQ ID NO: 3769112 - RNA, 13 nt, Salmonella typhimurium LT2
acgcugauagcca

SEQ ID NO: 3769113 - RNA, 20 nt, Salmonella typhimurium LT2
acgcugcaacccgccgccau

SEQ ID NO: 3769114 - RNA, 11 nt, Salmonella typhimurium LT2
acgcugcaguu

SEQ ID NO: 3769115 - RNA, 20 nt, Salmonella typhimurium LT2
acgcugccauccucauuuug

SEQ ID NO: 3769116 - RNA, 15 nt, Salmonella typhimurium LT2
acgcugcgcaacagc

SEQ ID NO: 3769117 - RNA, 15 nt, Salmonella typhimurium LT2
acgcugcgccgcgcc

SEQ ID NO: 3769118 - RNA, 19 nt, Salmonella typhimurium LT2
acgcugcgcuuauccggcc

SEQ ID NO: 3769119 - RNA, 20 nt, Salmonella typhimurium LT2
acgcugcuauuuugcgcuuu

SEQ ID NO: 3769120 - RNA, 20 nt, Salmonella typhimurium LT2
acgcugcuccggcuuaaugc

SEQ ID NO: 3769121 - RNA, 17 nt, Salmonella typhimurium LT2
acgcuggcacuggcagc

SEQ ID NO: 3769122 - RNA, 20 nt, Salmonella typhimurium LT2
acgcuggcgcaaagaaggca

SEQ ID NO: 3769123 - RNA, 21 nt, Salmonella typhimurium LT2
acgcuggcggcaggccuaaca

SEQ ID NO: 3769124 - RNA, 17 nt, Salmonella typhimurium LT2
acgcugguuucggcauc

SEQ ID NO: 3769125 - RNA, 19 nt, Salmonella typhimurium LT2
acgcugguuugugugcagg

SEQ ID NO: 3769126 - RNA, 22 nt, Salmonella typhimurium LT2
acgcugguuugugugcaggagc

SEQ ID NO: 3769127 - RNA, 15 nt, Salmonella typhimurium LT2
acgcuguaaaccggc

SEQ ID NO: 3769128 - RNA, 23 nt, Salmonella typhimurium LT2
acgcuguaguuccuguagcguga

SEQ ID NO: 3769129 - RNA, 14 nt, Salmonella typhimurium LT2
acgcuguugccgcu

SEQ ID NO: 3769130 - RNA, 21 nt, Salmonella typhimurium LT2
acgcuuaaucaguugcaggaa

SEQ ID NO: 3769131 - RNA, 19 nt, Salmonella typhimurium LT2
acgcuuaucagcccuacaa

SEQ ID NO: 3769132 - RNA, 20 nt, Salmonella typhimurium LT2
acgcuuaucaggccuacaac

SEQ ID NO: 3769133 - RNA, 14 nt, Salmonella typhimurium LT2
acgcuuauccggcu

SEQ ID NO: 3769134 - RNA, 16 nt, Salmonella typhimurium LT2
acgcuucauaucgccc

SEQ ID NO: 3769135 - RNA, 22 nt, Salmonella typhimurium LT2
acgcuucauugguuaauucaaa

SEQ ID NO: 3769136 - RNA, 22 nt, Salmonella typhimurium LT2
acgcuucccagcgucgccagua

SEQ ID NO: 3769137 - RNA, 20 nt, Salmonella typhimurium LT2
acgcuuccggcgaggcguaa

SEQ ID NO: 3769138 - RNA, 20 nt, Salmonella typhimurium LT2
acgcuucggcuccagcgccu

SEQ ID NO: 3769139 - RNA, 20 nt, Salmonella typhimurium LT2
acgcuucggugaucuccucg

SEQ ID NO: 3769140 - RNA, 14 nt, Salmonella typhimurium LT2
acgcuugagcaggc

SEQ ID NO: 3769141 - RNA, 16 nt, Salmonella typhimurium LT2
acgcuuguacuugaua

SEQ ID NO: 3769142 - RNA, 21 nt, Salmonella typhimurium LT2
acgcuuguuagcuuucugcca

SEQ ID NO: 3769143 - RNA, 19 nt, Salmonella typhimurium LT2
acgcuuuagugccgccauu

SEQ ID NO: 3769144 - RNA, 23 nt, Salmonella typhimurium LT2
acgcuuuauucugucgccaccac

SEQ ID NO: 3769145 - RNA, 21 nt, Salmonella typhimurium LT2
acgcuuuccaguugcggcauc

SEQ ID NO: 3769146 - RNA, 16 nt, Salmonella typhimurium LT2
acgcuuugccagcauc

SEQ ID NO: 3769147 - RNA, 23 nt, Salmonella typhimurium LT2
acgcuuugcgauagcccggcaug

SEQ ID NO: 3769148 - RNA, 23 nt, Salmonella typhimurium LT2
acgcuuuggcaggccucuaucuu

SEQ ID NO: 3769149 - RNA, 15 nt, Salmonella typhimurium LT2
acgcuuuuccuucca

SEQ ID NO: 3769150 - RNA, 16 nt, Salmonella typhimurium LT2
acgcuuuuuaccggcg

SEQ ID NO: 3769151 - RNA, 15 nt, Salmonella typhimurium LT2
acggaacaaaacgga

SEQ ID NO: 3769152 - RNA, 19 nt, Salmonella typhimurium LT2
acggaacaaaacggaaugu

SEQ ID NO: 3769153 - RNA, 22 nt, Salmonella typhimurium LT2
acggaaccaaaugcccagcuca

SEQ ID NO: 3769154 - RNA, 14 nt, Salmonella typhimurium LT2
acggaagguaauaa

SEQ ID NO: 3769155 - RNA, 19 nt, Salmonella typhimurium LT2
acggaauaucccgcaagaa

SEQ ID NO: 3769156 - RNA, 14 nt, Salmonella typhimurium LT2
acggaauaugcgcu

SEQ ID NO: 3769157 - RNA, 14 nt, Salmonella typhimurium LT2
acggacagaaaaaa

SEQ ID NO: 3769158 - RNA, 16 nt, Salmonella typhimurium LT2
acggacagcgcgcaaa

SEQ ID NO: 3769159 - RNA, 18 nt, Salmonella typhimurium LT2
acggacgcagaccaaaau

SEQ ID NO: 3769160 - RNA, 11 nt, Salmonella typhimurium LT2
acggacguggg

SEQ ID NO: 3769161 - RNA, 11 nt, Salmonella typhimurium LT2
acggagaaaag

SEQ ID NO: 3769162 - RNA, 17 nt, Salmonella typhimurium LT2
acggagagacaguucag

SEQ ID NO: 3769163 - RNA, 22 nt, Salmonella typhimurium LT2
acggagaugaucguuuccagca

SEQ ID NO: 3769164 - RNA, 15 nt, Salmonella typhimurium LT2
acggagauuaacagc

SEQ ID NO: 3769165 - RNA, 19 nt, Salmonella typhimurium LT2
acggagcauaauuuuccug

SEQ ID NO: 3769166 - RNA, 12 nt, Salmonella typhimurium LT2
acggauaagcca

SEQ ID NO: 3769167 - RNA, 22 nt, Salmonella typhimurium LT2
acggauaccguccaccagcaca

SEQ ID NO: 3769168 - RNA, 16 nt, Salmonella typhimurium LT2
acggauagcgucaacg

SEQ ID NO: 3769169 - RNA, 16 nt, Salmonella typhimurium LT2
acggaucagccugagc

SEQ ID NO: 3769170 - RNA, 13 nt, Salmonella typhimurium LT2
acggauccagaac

SEQ ID NO: 3769171 - RNA, 15 nt, Salmonella typhimurium LT2
acggauccagaacug

SEQ ID NO: 3769172 - RNA, 14 nt, Salmonella typhimurium LT2
acggaugcgccauc

SEQ ID NO: 3769173 - RNA, 20 nt, Salmonella typhimurium LT2
acggauuuuacuugucggaa

SEQ ID NO: 3769174 - RNA, 19 nt, Salmonella typhimurium LT2
acggcaaaaagcauaugcg

SEQ ID NO: 3769175 - RNA, 20 nt, Salmonella typhimurium LT2
acggcaaaacgugguaaaaa

SEQ ID NO: 3769176 - RNA, 16 nt, Salmonella typhimurium LT2
acggcaacgccuuccu

SEQ ID NO: 3769177 - RNA, 22 nt, Salmonella typhimurium LT2
acggcaacggcgacaagaauau

SEQ ID NO: 3769178 - RNA, 19 nt, Salmonella typhimurium LT2
acggcaaguauacuuauug

SEQ ID NO: 3769179 - RNA, 14 nt, Salmonella typhimurium LT2
acggcaaugaccgc

SEQ ID NO: 3769180 - RNA, 15 nt, Salmonella typhimurium LT2
acggcagcaccgcug

SEQ ID NO: 3769181 - RNA, 16 nt, Salmonella typhimurium LT2
acggcagccacgccga

SEQ ID NO: 3769182 - RNA, 21 nt, Salmonella typhimurium LT2
acggcagccgccaccacaaag

SEQ ID NO: 3769183 - RNA, 17 nt, Salmonella typhimurium LT2
acggcagcucuuucaac

SEQ ID NO: 3769184 - RNA, 23 nt, Salmonella typhimurium LT2
acggcaguguuucccaacaaugc

SEQ ID NO: 3769185 - RNA, 19 nt, Salmonella typhimurium LT2
acggcauaagccagcccug

SEQ ID NO: 3769186 - RNA, 18 nt, Salmonella typhimurium LT2
acggcaucugcggcauga

SEQ ID NO: 3769187 - RNA, 14 nt, Salmonella typhimurium LT2
acggcccaggcauc

SEQ ID NO: 3769188 - RNA, 17 nt, Salmonella typhimurium LT2
acggcccauaucaauca

SEQ ID NO: 3769189 - RNA, 17 nt, Salmonella typhimurium LT2
acggccuaagaccagca

SEQ ID NO: 3769190 - RNA, 13 nt, Salmonella typhimurium LT2
acggccugacggu

SEQ ID NO: 3769191 - RNA, 20 nt, Salmonella typhimurium LT2
acggccugcaaacgaaucac

SEQ ID NO: 3769192 - RNA, 22 nt, Salmonella typhimurium LT2
acggccugcaaacgaaucaccu

SEQ ID NO: 3769193 - RNA, 14 nt, Salmonella typhimurium LT2
acggccugucuccg

SEQ ID NO: 3769194 - RNA, 22 nt, Salmonella typhimurium LT2
acggcgacaggcacaacaauau

SEQ ID NO: 3769195 - RNA, 16 nt, Salmonella typhimurium LT2
acggcgagaccaccgu

SEQ ID NO: 3769196 - RNA, 22 nt, Salmonella typhimurium LT2
acggcgcacacgaaauccaaac

SEQ ID NO: 3769197 - RNA, 23 nt, Salmonella typhimurium LT2
acggcgcagauauuuuccaucac

SEQ ID NO: 3769198 - RNA, 11 nt, Salmonella typhimurium LT2
acggcgccaug

SEQ ID NO: 3769199 - RNA, 14 nt, Salmonella typhimurium LT2
acggcgcgaaaggg

SEQ ID NO: 3769200 - RNA, 11 nt, Salmonella typhimurium LT2
acggcgcgcca

SEQ ID NO: 3769201 - RNA, 19 nt, Salmonella typhimurium LT2
acggcgcgccaaacggcag

SEQ ID NO: 3769202 - RNA, 14 nt, Salmonella typhimurium LT2
acggcgcugaaagg

SEQ ID NO: 3769203 - RNA, 16 nt, Salmonella typhimurium LT2
acggcggaaagggccg

SEQ ID NO: 3769204 - RNA, 19 nt, Salmonella typhimurium LT2
acggcggcugcgaugccau

SEQ ID NO: 3769205 - RNA, 23 nt, Salmonella typhimurium LT2
acggcgguaccauaccugcggcc

SEQ ID NO: 3769206 - RNA, 15 nt, Salmonella typhimurium LT2
acggcggucgccgca

SEQ ID NO: 3769207 - RNA, 21 nt, Salmonella typhimurium LT2
acggcgucgccugugccguug

SEQ ID NO: 3769208 - RNA, 16 nt, Salmonella typhimurium LT2
acggcgugaccaccgc

SEQ ID NO: 3769209 - RNA, 19 nt, Salmonella typhimurium LT2
acggcgugaccaccgccuu

SEQ ID NO: 3769210 - RNA, 13 nt, Salmonella typhimurium LT2
acggcuccuuuuu

SEQ ID NO: 3769211 - RNA, 22 nt, Salmonella typhimurium LT2
acggcucgguuuauccccgcug

SEQ ID NO: 3769212 - RNA, 19 nt, Salmonella typhimurium LT2
acggcugcacaaaauacug

SEQ ID NO: 3769213 - RNA, 15 nt, Salmonella typhimurium LT2
acggcuggcaaugcg

SEQ ID NO: 3769214 - RNA, 18 nt, Salmonella typhimurium LT2
acggcuggcaaugcgcug

SEQ ID NO: 3769215 - RNA, 19 nt, Salmonella typhimurium LT2
acggcuuccacugcggcau

SEQ ID NO: 3769216 - RNA, 16 nt, Salmonella typhimurium LT2
acggcuuuccagcagc

SEQ ID NO: 3769217 - RNA, 13 nt, Salmonella typhimurium LT2
acggcuuuucuuc

SEQ ID NO: 3769218 - RNA, 14 nt, Salmonella typhimurium LT2
acggcuuuucuuca

SEQ ID NO: 3769219 - RNA, 14 nt, Salmonella typhimurium LT2
acgggaacggcgua

SEQ ID NO: 3769220 - RNA, 15 nt, Salmonella typhimurium LT2
acgggaaguaaggca

SEQ ID NO: 3769221 - RNA, 17 nt, Salmonella typhimurium LT2
acgggaaguaaggcaua

SEQ ID NO: 3769222 - RNA, 18 nt, Salmonella typhimurium LT2
acgggaaucuccgggaaa

SEQ ID NO: 3769223 - RNA, 13 nt, Salmonella typhimurium LT2
acgggauuuucac

SEQ ID NO: 3769224 - RNA, 11 nt, Salmonella typhimurium LT2
acgggcaaagc

SEQ ID NO: 3769225 - RNA, 18 nt, Salmonella typhimurium LT2
acgggcaagguuaugcag

SEQ ID NO: 3769226 - RNA, 15 nt, Salmonella typhimurium LT2
acgggcacccgguca

SEQ ID NO: 3769227 - RNA, 19 nt, Salmonella typhimurium LT2
acgggcagcggcuucaaua

SEQ ID NO: 3769228 - RNA, 22 nt, Salmonella typhimurium LT2
acgggcaguccggcggcagccg

SEQ ID NO: 3769229 - RNA, 19 nt, Salmonella typhimurium LT2
acgggcauucccagaaagg

SEQ ID NO: 3769230 - RNA, 19 nt, Salmonella typhimurium LT2
acgggcauuguuaauccag

SEQ ID NO: 3769231 - RNA, 17 nt, Salmonella typhimurium LT2
acgggcgcgcgcguuaa

SEQ ID NO: 3769232 - RNA, 13 nt, Salmonella typhimurium LT2
acgggcgcugucg

SEQ ID NO: 3769233 - RNA, 22 nt, Salmonella typhimurium LT2
acgggcggaaaacauucgcccg

SEQ ID NO: 3769234 - RNA, 16 nt, Salmonella typhimurium LT2
acgggcggaggggagg

SEQ ID NO: 3769235 - RNA, 16 nt, Salmonella typhimurium LT2
acgggucugaauagcg

SEQ ID NO: 3769236 - RNA, 20 nt, Salmonella typhimurium LT2
acggguucuuguguugaaau

SEQ ID NO: 3769237 - RNA, 14 nt, Salmonella typhimurium LT2
acgguaaaccucuu

SEQ ID NO: 3769238 - RNA, 19 nt, Salmonella typhimurium LT2
acgguaaacgugccacagu

SEQ ID NO: 3769239 - RNA, 14 nt, Salmonella typhimurium LT2
acgguaaguugaaa

SEQ ID NO: 3769240 - RNA, 16 nt, Salmonella typhimurium LT2
acgguaauugacgcgu

SEQ ID NO: 3769241 - RNA, 20 nt, Salmonella typhimurium LT2
acgguacgcaucaccaggca

SEQ ID NO: 3769242 - RNA, 21 nt, Salmonella typhimurium LT2
acgguaugaaacauauauauc

SEQ ID NO: 3769243 - RNA, 21 nt, Salmonella typhimurium LT2
acgguauucguuaccagcauc

SEQ ID NO: 3769244 - RNA, 23 nt, Salmonella typhimurium LT2
acgguggccagacgcaguagcgc

SEQ ID NO: 3769245 - RNA, 22 nt, Salmonella typhimurium LT2
acgguggccgccagcgcgguuu

SEQ ID NO: 3769246 - RNA, 12 nt, Salmonella typhimurium LT2
acggugugccug

SEQ ID NO: 3769247 - RNA, 15 nt, Salmonella typhimurium LT2
acggugugccugcgu

SEQ ID NO: 3769248 - RNA, 17 nt, Salmonella typhimurium LT2
acgguuggccagcaugg

SEQ ID NO: 3769249 - RNA, 19 nt, Salmonella typhimurium LT2
acgguuggcuauacgcggc

SEQ ID NO: 3769250 - RNA, 22 nt, Salmonella typhimurium LT2
acgguuuacgauacguuugaaa

SEQ ID NO: 3769251 - RNA, 15 nt, Salmonella typhimurium LT2
acgguuuauccccgc

SEQ ID NO: 3769252 - RNA, 15 nt, Salmonella typhimurium LT2
acgguuuuacaguua

SEQ ID NO: 3769253 - RNA, 23 nt, Salmonella typhimurium LT2
acgguuuuauccccuucaggaau

SEQ ID NO: 3769254 - RNA, 13 nt, Salmonella typhimurium LT2
acguaaagcuggc

SEQ ID NO: 3769255 - RNA, 17 nt, Salmonella typhimurium LT2
acguaaauacccaggcc

SEQ ID NO: 3769256 - RNA, 19 nt, Salmonella typhimurium LT2
acguaaaucugaaauaaaa

SEQ ID NO: 3769257 - RNA, 17 nt, Salmonella typhimurium LT2
acguaaauuacuuauga

SEQ ID NO: 3769258 - RNA, 20 nt, Salmonella typhimurium LT2
acguaaauuacuuaugauau

SEQ ID NO: 3769259 - RNA, 18 nt, Salmonella typhimurium LT2
acguaacgcaaucccgcg

SEQ ID NO: 3769260 - RNA, 17 nt, Salmonella typhimurium LT2
acguaacuaucuguucu

SEQ ID NO: 3769261 - RNA, 20 nt, Salmonella typhimurium LT2
acguaacugcgguaaauaau

SEQ ID NO: 3769262 - RNA, 19 nt, Salmonella typhimurium LT2
acguaacuggauuccuggc

SEQ ID NO: 3769263 - RNA, 22 nt, Salmonella typhimurium LT2
acguaauaaccaccggcgcgcc

SEQ ID NO: 3769264 - RNA, 12 nt, Salmonella typhimurium LT2
acguaauaccug

SEQ ID NO: 3769265 - RNA, 14 nt, Salmonella typhimurium LT2
acguaauauuaagc

SEQ ID NO: 3769266 - RNA, 22 nt, Salmonella typhimurium LT2
acguaauugccauuacgauaaa

SEQ ID NO: 3769267 - RNA, 14 nt, Salmonella typhimurium LT2
acguaccggcgucu

SEQ ID NO: 3769268 - RNA, 16 nt, Salmonella typhimurium LT2
acguagcccauuguca

SEQ ID NO: 3769269 - RNA, 18 nt, Salmonella typhimurium LT2
acguagccgcaaaugcca

SEQ ID NO: 3769270 - RNA, 14 nt, Salmonella typhimurium LT2
acguagcgcauugc

SEQ ID NO: 3769271 - RNA, 18 nt, Salmonella typhimurium LT2
acguagcucgcccagcac

SEQ ID NO: 3769272 - RNA, 19 nt, Salmonella typhimurium LT2
acguagcuuauaaaucagc

SEQ ID NO: 3769273 - RNA, 21 nt, Salmonella typhimurium LT2
acguagcuuauaaaucagcuu

SEQ ID NO: 3769274 - RNA, 20 nt, Salmonella typhimurium LT2
acguaggccugauaagcgca

SEQ ID NO: 3769275 - RNA, 21 nt, Salmonella typhimurium LT2
acguaggccugauaagcgcag

SEQ ID NO: 3769276 - RNA, 15 nt, Salmonella typhimurium LT2
acgucaacaccucca

SEQ ID NO: 3769277 - RNA, 16 nt, Salmonella typhimurium LT2
acgucaacaccuccag

SEQ ID NO: 3769278 - RNA, 21 nt, Salmonella typhimurium LT2
acgucaacaccuccaguucag

SEQ ID NO: 3769279 - RNA, 18 nt, Salmonella typhimurium LT2
acgucaacucgcggccca

SEQ ID NO: 3769280 - RNA, 22 nt, Salmonella typhimurium LT2
acgucaauguaauucaccaaau

SEQ ID NO: 3769281 - RNA, 17 nt, Salmonella typhimurium LT2
acgucaccaucagcguc

SEQ ID NO: 3769282 - RNA, 18 nt, Salmonella typhimurium LT2
acgucaccgcuuuuuuau

SEQ ID NO: 3769283 - RNA, 19 nt, Salmonella typhimurium LT2
acgucagacgaggguaaua

SEQ ID NO: 3769284 - RNA, 19 nt, Salmonella typhimurium LT2
acgucagccgggauaauca

SEQ ID NO: 3769285 - RNA, 21 nt, Salmonella typhimurium LT2
acgucaggaaacgcgccggaa

SEQ ID NO: 3769286 - RNA, 16 nt, Salmonella typhimurium LT2
acuagcauaagcacag

SEQ ID NO: 3769287 - RNA, 15 nt, Salmonella typhimurium LT2
acuagccauauauga

SEQ ID NO: 3769288 - RNA, 19 nt, Salmonella typhimurium LT2
acuagcgaaucacauccgc

SEQ ID NO: 3769289 - RNA, 18 nt, Salmonella typhimurium LT2
acuagcgccgccagcucg

SEQ ID NO: 3769290 - RNA, 22 nt, Salmonella typhimurium LT2
acuagcucagcuggauagagca

SEQ ID NO: 3769291 - RNA, 16 nt, Salmonella typhimurium LT2
acuauaacgcgcugcu

SEQ ID NO: 3769292 - RNA, 20 nt, Salmonella typhimurium LT2
acuauaauugcuuuuuucca

SEQ ID NO: 3769293 - RNA, 13 nt, Salmonella typhimurium LT2
acuauagauauua

SEQ ID NO: 3769294 - RNA, 14 nt, Salmonella typhimurium LT2
acuauagauauuaa

SEQ ID NO: 3769295 - RNA, 16 nt, Salmonella typhimurium LT2
acuauaggaaaauaau

SEQ ID NO: 3769296 - RNA, 22 nt, Salmonella typhimurium LT2
acuaucaguuuuggcaaucaca

SEQ ID NO: 3769297 - RNA, 16 nt, Salmonella typhimurium LT2
acuauccuggccugau

SEQ ID NO: 3769298 - RNA, 17 nt, Salmonella typhimurium LT2
acuaucuucaaaaccgc

SEQ ID NO: 3769299 - RNA, 19 nt, Salmonella typhimurium LT2
acuaucuuuaugucaguaa

SEQ ID NO: 3769300 - RNA, 22 nt, Salmonella typhimurium LT2
acuauuccgcaaacgccgugaa

SEQ ID NO: 3769301 - RNA, 23 nt, Salmonella typhimurium LT2
acuauuuuuccggcgucaaaaau

SEQ ID NO: 3769302 - RNA, 23 nt, Salmonella typhimurium LT2
acucaaaccccagauuacugccc

SEQ ID NO: 3769303 - RNA, 23 nt, Salmonella typhimurium LT2
acucaaaccugcgccgcgauaaa

SEQ ID NO: 3769304 - RNA, 15 nt, Salmonella typhimurium LT2
acucaacaucauuaa

SEQ ID NO: 3769305 - RNA, 16 nt, Salmonella typhimurium LT2
acucaagcgaauccag

SEQ ID NO: 3769306 - RNA, 17 nt, Salmonella typhimurium LT2
acucaagcgaauccaga

SEQ ID NO: 3769307 - RNA, 21 nt, Salmonella typhimurium LT2
acucaauaaccucuacacauu

SEQ ID NO: 3769308 - RNA, 23 nt, Salmonella typhimurium LT2
acucaauacauucaguacaauac

SEQ ID NO: 3769309 - RNA, 14 nt, Salmonella typhimurium LT2
acucaaucaggcua

SEQ ID NO: 3769310 - RNA, 22 nt, Salmonella typhimurium LT2
acucaaugacuuuaaugcccuc

SEQ ID NO: 3769311 - RNA, 19 nt, Salmonella typhimurium LT2
acucacgacuuucaccaga

SEQ ID NO: 3769312 - RNA, 15 nt, Salmonella typhimurium LT2
acucacgcaacaaca

SEQ ID NO: 3769313 - RNA, 21 nt, Salmonella typhimurium LT2
acucacgcgcgcuuuucgcca

SEQ ID NO: 3769314 - RNA, 16 nt, Salmonella typhimurium LT2
acucacguucagcgcg

SEQ ID NO: 3769315 - RNA, 22 nt, Salmonella typhimurium LT2
acucagaaaauuauuuuaaauu

SEQ ID NO: 3769316 - RNA, 21 nt, Salmonella typhimurium LT2
acucagagagauccugagaaa

SEQ ID NO: 3769317 - RNA, 13 nt, Salmonella typhimurium LT2
acucagccagaua

SEQ ID NO: 3769318 - RNA, 15 nt, Salmonella typhimurium LT2
acucagccagauacc

SEQ ID NO: 3769319 - RNA, 14 nt, Salmonella typhimurium LT2
acucagccaggucu

SEQ ID NO: 3769320 - RNA, 15 nt, Salmonella typhimurium LT2
acucagccaggucug

SEQ ID NO: 3769321 - RNA, 17 nt, Salmonella typhimurium LT2
acucagcgccagcgcug

SEQ ID NO: 3769322 - RNA, 17 nt, Salmonella typhimurium LT2
acucagcgucaucacag

SEQ ID NO: 3769323 - RNA, 17 nt, Salmonella typhimurium LT2
acucagcuaaaaacagc

SEQ ID NO: 3769324 - RNA, 17 nt, Salmonella typhimurium LT2
acucaggcgcaucugac

SEQ ID NO: 3769325 - RNA, 14 nt, Salmonella typhimurium LT2
acucaguuuccagc

SEQ ID NO: 3769326 - RNA, 15 nt, Salmonella typhimurium LT2
acucauauuuaaacc

SEQ ID NO: 3769327 - RNA, 15 nt, Salmonella typhimurium LT2
acucauccauuuccg

SEQ ID NO: 3769328 - RNA, 21 nt, Salmonella typhimurium LT2
acucauccauuuccguuuuca

SEQ ID NO: 3769329 - RNA, 14 nt, Salmonella typhimurium LT2
acucaucggaacag

SEQ ID NO: 3769330 - RNA, 13 nt, Salmonella typhimurium LT2
acucaucuuuauu

SEQ ID NO: 3769331 - RNA, 13 nt, Salmonella typhimurium LT2
acucaugcgccuu

SEQ ID NO: 3769332 - RNA, 15 nt, Salmonella typhimurium LT2
acucauuucaacaua

SEQ ID NO: 3769333 - RNA, 23 nt, Salmonella typhimurium LT2
acuccagacgaugauaauacauu

SEQ ID NO: 3769334 - RNA, 16 nt, Salmonella typhimurium LT2
acuccagcaaaucaau

SEQ ID NO: 3769335 - RNA, 20 nt, Salmonella typhimurium LT2
acuccagcaacgccgcaucc

SEQ ID NO: 3769336 - RNA, 14 nt, Salmonella typhimurium LT2
acuccagcccauca

SEQ ID NO: 3769337 - RNA, 17 nt, Salmonella typhimurium LT2
acuccagcggcaggauc

SEQ ID NO: 3769338 - RNA, 14 nt, Salmonella typhimurium LT2
acuccaggaacagg

SEQ ID NO: 3769339 - RNA, 16 nt, Salmonella typhimurium LT2
acuccauuaaauuacu

SEQ ID NO: 3769340 - RNA, 21 nt, Salmonella typhimurium LT2
acuccauucccagcucuuuca

SEQ ID NO: 3769341 - RNA, 22 nt, Salmonella typhimurium LT2
acucccaggcgcgcagcugcca

SEQ ID NO: 3769342 - RNA, 21 nt, Salmonella typhimurium LT2
acucccaggugugacguccca

SEQ ID NO: 3769343 - RNA, 12 nt, Salmonella typhimurium LT2
acucccaguccg

SEQ ID NO: 3769344 - RNA, 20 nt, Salmonella typhimurium LT2
acuccccugcagaugcugcu

SEQ ID NO: 3769345 - RNA, 23 nt, Salmonella typhimurium LT2
acuccccuguuugcaucacgcgc

SEQ ID NO: 3769346 - RNA, 14 nt, Salmonella typhimurium LT2
acuccccuuuuuuc

SEQ ID NO: 3769347 - RNA, 16 nt, Salmonella typhimurium LT2
acucccgaauggcuuc

SEQ ID NO: 3769348 - RNA, 18 nt, Salmonella typhimurium LT2
acucccgucgccuguuuc

SEQ ID NO: 3769349 - RNA, 21 nt, Salmonella typhimurium LT2
acucccuauaaugcgccacca

SEQ ID NO: 3769350 - RNA, 14 nt, Salmonella typhimurium LT2
acuccgcccuaauc

SEQ ID NO: 3769351 - RNA, 19 nt, Salmonella typhimurium LT2
acuccgcgauagagcgcgg

SEQ ID NO: 3769352 - RNA, 17 nt, Salmonella typhimurium LT2
acuccggcgcggcgcgc

SEQ ID NO: 3769353 - RNA, 14 nt, Salmonella typhimurium LT2
acuccggugcccau

SEQ ID NO: 3769354 - RNA, 15 nt, Salmonella typhimurium LT2
acuccuaagagaaaa

SEQ ID NO: 3769355 - RNA, 18 nt, Salmonella typhimurium LT2
acuccuaagagaaaaccc

SEQ ID NO: 3769356 - RNA, 18 nt, Salmonella typhimurium LT2
acuccuauuaucggcacc

SEQ ID NO: 3769357 - RNA, 11 nt, Salmonella typhimurium LT2
acuccugcaac

SEQ ID NO: 3769358 - RNA, 15 nt, Salmonella typhimurium LT2
acuccugcaacagaa

SEQ ID NO: 3769359 - RNA, 15 nt, Salmonella typhimurium LT2
acuccugcgccggac

SEQ ID NO: 3769360 - RNA, 17 nt, Salmonella typhimurium LT2
acuccuuagauuaauca

SEQ ID NO: 3769361 - RNA, 16 nt, Salmonella typhimurium LT2
acuccuucuaauucca

SEQ ID NO: 3769362 - RNA, 15 nt, Salmonella typhimurium LT2
acucgacuuuuuccg

SEQ ID NO: 3769363 - RNA, 22 nt, Salmonella typhimurium LT2
acucgaugagcaaugcagaagu

SEQ ID NO: 3769364 - RNA, 16 nt, Salmonella typhimurium LT2
acucgcauucuucagc

SEQ ID NO: 3769365 - RNA, 13 nt, Salmonella typhimurium LT2
acucgccugcgcu

SEQ ID NO: 3769366 - RNA, 19 nt, Salmonella typhimurium LT2
acucgcgcagaaucagcgu

SEQ ID NO: 3769367 - RNA, 21 nt, Salmonella typhimurium LT2
acucgcuaaagccauugccga

SEQ ID NO: 3769368 - RNA, 16 nt, Salmonella typhimurium LT2
acucgcuacgcucgcc

SEQ ID NO: 3769369 - RNA, 22 nt, Salmonella typhimurium LT2
acucgcuccuugauugcaagaa

SEQ ID NO: 3769370 - RNA, 18 nt, Salmonella typhimurium LT2
acucgcuucacgcggauu

SEQ ID NO: 3769371 - RNA, 13 nt, Salmonella typhimurium LT2
acucggugccgcu

SEQ ID NO: 3769372 - RNA, 15 nt, Salmonella typhimurium LT2
acucguaagaggcgu

SEQ ID NO: 3769373 - RNA, 20 nt, Salmonella typhimurium LT2
acucuacgcgcugaccuuca

SEQ ID NO: 3769374 - RNA, 14 nt, Salmonella typhimurium LT2
acucuccaccaaau

SEQ ID NO: 3769375 - RNA, 21 nt, Salmonella typhimurium LT2
acucucccaacuguuuucgug

SEQ ID NO: 3769376 - RNA, 19 nt, Salmonella typhimurium LT2
acucuccucccccagcacg

SEQ ID NO: 3769377 - RNA, 16 nt, Salmonella typhimurium LT2
acucucgcagcgaaua

SEQ ID NO: 3769378 - RNA, 16 nt, Salmonella typhimurium LT2
acucucuccaguuugc

SEQ ID NO: 3769379 - RNA, 19 nt, Salmonella typhimurium LT2
acucucuuuaaucacccgu

SEQ ID NO: 3769380 - RNA, 19 nt, Salmonella typhimurium LT2
acucugaaaaauuuuccug

SEQ ID NO: 3769381 - RNA, 13 nt, Salmonella typhimurium LT2
acucugaaaacgg

SEQ ID NO: 3769382 - RNA, 17 nt, Salmonella typhimurium LT2
acucugauccuacccgc

SEQ ID NO: 3769383 - RNA, 20 nt, Salmonella typhimurium LT2
acucugauccuacccgcgua

SEQ ID NO: 3769384 - RNA, 16 nt, Salmonella typhimurium LT2
acucugcucuuugaca

SEQ ID NO: 3769385 - RNA, 19 nt, Salmonella typhimurium LT2
acucugcuuuuauuuucag

SEQ ID NO: 3769386 - RNA, 15 nt, Salmonella typhimurium LT2
acucuucacccuucu

SEQ ID NO: 3769387 - RNA, 13 nt, Salmonella typhimurium LT2
acucuuccaccac

SEQ ID NO: 3769388 - RNA, 14 nt, Salmonella typhimurium LT2
acucuuccaccauu

SEQ ID NO: 3769389 - RNA, 12 nt, Salmonella typhimurium LT2
acucuuccagca

SEQ ID NO: 3769390 - RNA, 16 nt, Salmonella typhimurium LT2
acuguagcugagcggc

SEQ ID NO: 3769391 - RNA, 12 nt, Salmonella typhimurium LT2
acugucagaaau

SEQ ID NO: 3769392 - RNA, 15 nt, Salmonella typhimurium LT2
acugucagcaucagu

SEQ ID NO: 3769393 - RNA, 20 nt, Salmonella typhimurium LT2
acugucauggcuauuuugau

SEQ ID NO: 3769394 - RNA, 22 nt, Salmonella typhimurium LT2
acugucauuacugggucgcguu

SEQ ID NO: 3769395 - RNA, 22 nt, Salmonella typhimurium LT2
acuguccagaucuucccaguua

SEQ ID NO: 3769396 - RNA, 16 nt, Salmonella typhimurium LT2
acuguccugacggcga

SEQ ID NO: 3769397 - RNA, 14 nt, Salmonella typhimurium LT2
acugucgaaaccag

SEQ ID NO: 3769398 - RNA, 18 nt, Salmonella typhimurium LT2
acugucgaaaccagcaua

SEQ ID NO: 3769399 - RNA, 17 nt, Salmonella typhimurium LT2
acugucgacaaagccgc

SEQ ID NO: 3769400 - RNA, 14 nt, Salmonella typhimurium LT2
acugucgccaggcc

SEQ ID NO: 3769401 - RNA, 13 nt, Salmonella typhimurium LT2
acugucgcuggau

SEQ ID NO: 3769402 - RNA, 18 nt, Salmonella typhimurium LT2
acugucugaaucaaugca

SEQ ID NO: 3769403 - RNA, 15 nt, Salmonella typhimurium LT2
acugugacgacaguu

SEQ ID NO: 3769404 - RNA, 15 nt, Salmonella typhimurium LT2
acugugauuacgacu

SEQ ID NO: 3769405 - RNA, 18 nt, Salmonella typhimurium LT2
acugugcgccgcguucgc

SEQ ID NO: 3769406 - RNA, 16 nt, Salmonella typhimurium LT2
acugugggauuuuugg

SEQ ID NO: 3769407 - RNA, 21 nt, Salmonella typhimurium LT2
acugugguuaugguugccgca

SEQ ID NO: 3769408 - RNA, 14 nt, Salmonella typhimurium LT2
acuguucagcugac

SEQ ID NO: 3769409 - RNA, 15 nt, Salmonella typhimurium LT2
acuguucggggauua

SEQ ID NO: 3769410 - RNA, 17 nt, Salmonella typhimurium LT2
acuguugcaguuuacga

SEQ ID NO: 3769411 - RNA, 20 nt, Salmonella typhimurium LT2
acuguugccccgcuuucagc

SEQ ID NO: 3769412 - RNA, 18 nt, Salmonella typhimurium LT2
acuguuuaaugcuuucaa

SEQ ID NO: 3769413 - RNA, 15 nt, Salmonella typhimurium LT2
acuguuugcugacaa

SEQ ID NO: 3769414 - RNA, 20 nt, Salmonella typhimurium LT2
acuguuuugucggucugaua

SEQ ID NO: 3769415 - RNA, 13 nt, Salmonella typhimurium LT2
acuuaaaaacaaa

SEQ ID NO: 3769416 - RNA, 20 nt, Salmonella typhimurium LT2
acuuaaaguacuucacaauc

SEQ ID NO: 3769417 - RNA, 15 nt, Salmonella typhimurium LT2
acuuaaauaaaaaug

SEQ ID NO: 3769418 - RNA, 19 nt, Salmonella typhimurium LT2
acuuaauuauuaauccaau

SEQ ID NO: 3769419 - RNA, 14 nt, Salmonella typhimurium LT2
acuuaccaccgugc

SEQ ID NO: 3769420 - RNA, 12 nt, Salmonella typhimurium LT2
acuuacuuagua

SEQ ID NO: 3769421 - RNA, 17 nt, Salmonella typhimurium LT2
acuuaguaucauauuuu

SEQ ID NO: 3769422 - RNA, 19 nt, Salmonella typhimurium LT2
acuuaucaaaccaguuuuu

SEQ ID NO: 3769423 - RNA, 22 nt, Salmonella typhimurium LT2
acuuaucagcguguuucaucuc

SEQ ID NO: 3769424 - RNA, 12 nt, Salmonella typhimurium LT2
acuuaucauuuu

SEQ ID NO: 3769425 - RNA, 16 nt, Salmonella typhimurium LT2
acuuaucauuuuuucu

SEQ ID NO: 3769426 - RNA, 21 nt, Salmonella typhimurium LT2
acuuaucccacaacuguucuu

SEQ ID NO: 3769427 - RNA, 13 nt, Salmonella typhimurium LT2
acuuauguaagcu

SEQ ID NO: 3769428 - RNA, 17 nt, Salmonella typhimurium LT2
acuuauuaccacaguca

SEQ ID NO: 3769429 - RNA, 16 nt, Salmonella typhimurium LT2
acuuauugauccacgg

SEQ ID NO: 3769430 - RNA, 17 nt, Salmonella typhimurium LT2
acuuauuuuauuuuuau

SEQ ID NO: 3769431 - RNA, 17 nt, Salmonella typhimurium LT2
acuucaaaaauggcuuc

SEQ ID NO: 3769432 - RNA, 23 nt, Salmonella typhimurium LT2
acuucaaucaacaccagcagcgc

SEQ ID NO: 3769433 - RNA, 12 nt, Salmonella typhimurium LT2
acuucaaucacu

SEQ ID NO: 3769434 - RNA, 14 nt, Salmonella typhimurium LT2
acuucaaugccgca

SEQ ID NO: 3769435 - RNA, 17 nt, Salmonella typhimurium LT2
acuucaaugggaaaaau

SEQ ID NO: 3769436 - RNA, 20 nt, Salmonella typhimurium LT2
acuucaaugucguuaucgcc

SEQ ID NO: 3769437 - RNA, 17 nt, Salmonella typhimurium LT2
acuucaauuuuccagau

SEQ ID NO: 3769438 - RNA, 20 nt, Salmonella typhimurium LT2
acuucacaaacaauuucccc

SEQ ID NO: 3769439 - RNA, 20 nt, Salmonella typhimurium LT2
acuucacaaucagcgcaaua

SEQ ID NO: 3769440 - RNA, 15 nt, Salmonella typhimurium LT2
acuucacacgaacuu

SEQ ID NO: 3769441 - RNA, 16 nt, Salmonella typhimurium LT2
acuucacgccauucca

SEQ ID NO: 3769442 - RNA, 12 nt, Salmonella typhimurium LT2
acuucacgcugg

SEQ ID NO: 3769443 - RNA, 12 nt, Salmonella typhimurium LT2
acuucagauacc

SEQ ID NO: 3769444 - RNA, 13 nt, Salmonella typhimurium LT2
acuucagcagcag

SEQ ID NO: 3769445 - RNA, 15 nt, Salmonella typhimurium LT2
acuucauccggauaa

SEQ ID NO: 3769446 - RNA, 13 nt, Salmonella typhimurium LT2
acuucaucgccac

SEQ ID NO: 3769447 - RNA, 21 nt, Salmonella typhimurium LT2
acuucaucgccacagacgaag

SEQ ID NO: 3769448 - RNA, 18 nt, Salmonella typhimurium LT2
acuucaugcguuagccua

SEQ ID NO: 3769449 - RNA, 16 nt, Salmonella typhimurium LT2
acuucauuuuccacaa

SEQ ID NO: 3769450 - RNA, 20 nt, Salmonella typhimurium LT2
acuuccaacuaaagcgaauu

SEQ ID NO: 3769451 - RNA, 20 nt, Salmonella typhimurium LT2
acuuccauucccgccgcaau

SEQ ID NO: 3769452 - RNA, 13 nt, Salmonella typhimurium LT2
acuucccacugua

SEQ ID NO: 3769453 - RNA, 14 nt, Salmonella typhimurium LT2
acuucccacuguaa

SEQ ID NO: 3769454 - RNA, 18 nt, Salmonella typhimurium LT2
acuuccgcacgcgcgccc

SEQ ID NO: 3769455 - RNA, 15 nt, Salmonella typhimurium LT2
acuuccgcaucaaua

SEQ ID NO: 3769456 - RNA, 16 nt, Salmonella typhimurium LT2
acuuccgguauccguu

SEQ ID NO: 3769457 - RNA, 20 nt, Salmonella typhimurium LT2
acuuccgguauccguucauc

SEQ ID NO: 3769458 - RNA, 19 nt, Salmonella typhimurium LT2
acuuccuggaugcuuaaaa

SEQ ID NO: 3769459 - RNA, 20 nt, Salmonella typhimurium LT2
acuucgaacugguuugucga

SEQ ID NO: 3769460 - RNA, 16 nt, Salmonella typhimurium LT2
acuucgccucagccaa

SEQ ID NO: 3769461 - RNA, 20 nt, Salmonella typhimurium LT2
acuucgcgguugcgcccuuc

SEQ ID NO: 3769462 - RNA, 15 nt, Salmonella typhimurium LT2
acuucgcugaaaaug

SEQ ID NO: 3769463 - RNA, 17 nt, Salmonella typhimurium LT2
acuucgcugaaaaugac

SEQ ID NO: 3769464 - RNA, 14 nt, Salmonella typhimurium LT2
acuucuccuccauc

SEQ ID NO: 3769465 - RNA, 18 nt, Salmonella typhimurium LT2
acuucucgaaguucucaa

SEQ ID NO: 3769466 - RNA, 20 nt, Salmonella typhimurium LT2
acuucugacagugacggcaa

SEQ ID NO: 3769467 - RNA, 21 nt, Salmonella typhimurium LT2
acuucuugguaccaaacagca

SEQ ID NO: 3769468 - RNA, 22 nt, Salmonella typhimurium LT2
acuucuugguaccaaacagcag

SEQ ID NO: 3769469 - RNA, 21 nt, Salmonella typhimurium LT2
acuugaaguaugaaggguaug

SEQ ID NO: 3769470 - RNA, 20 nt, Salmonella typhimurium LT2
acuugagaaauuauuuuaaa

SEQ ID NO: 3769471 - RNA, 23 nt, Salmonella typhimurium LT2
acuugaucgugccguccggcauc

SEQ ID NO: 3769472 - RNA, 22 nt, Salmonella typhimurium LT2
acuugccguuuuucucaucaag

SEQ ID NO: 3769473 - RNA, 13 nt, Salmonella typhimurium LT2
acuuggcuuccua

SEQ ID NO: 3769474 - RNA, 23 nt, Salmonella typhimurium LT2
acuugggaaacuuaucauuuuuu

SEQ ID NO: 3769475 - RNA, 16 nt, Salmonella typhimurium LT2
acuuguugcuggcagg

SEQ ID NO: 3769476 - RNA, 14 nt, Salmonella typhimurium LT2
acuuuaaacgucau

SEQ ID NO: 3769477 - RNA, 22 nt, Salmonella typhimurium LT2
acuuuaagcgagagcgucuuag

SEQ ID NO: 3769478 - RNA, 17 nt, Salmonella typhimurium LT2
acuuuaccggcccuucc

SEQ ID NO: 3769479 - RNA, 13 nt, Salmonella typhimurium LT2
acuuuauuuuucg

SEQ ID NO: 3769480 - RNA, 11 nt, Salmonella typhimurium LT2
acuuucaaaau

SEQ ID NO: 3769481 - RNA, 16 nt, Salmonella typhimurium LT2
acuuucaccugcauac

SEQ ID NO: 3769482 - RNA, 23 nt, Salmonella typhimurium LT2
acuuucagauaccaaauuacgca

SEQ ID NO: 3769483 - RNA, 17 nt, Salmonella typhimurium LT2
acuuucagauuuuuaau

SEQ ID NO: 3769484 - RNA, 11 nt, Salmonella typhimurium LT2
acuuucaucag

SEQ ID NO: 3769485 - RNA, 15 nt, Salmonella typhimurium LT2
acuuucauuccuuua

SEQ ID NO: 3769486 - RNA, 16 nt, Salmonella typhimurium LT2
acuuuccaaaauccag

SEQ ID NO: 3769487 - RNA, 20 nt, Salmonella typhimurium LT2
acuuucgcccugaugauuua

SEQ ID NO: 3769488 - RNA, 14 nt, Salmonella typhimurium LT2
acuuucgcuucacg

SEQ ID NO: 3769489 - RNA, 19 nt, Salmonella typhimurium LT2
acuuucucggcuuuccagc

SEQ ID NO: 3769490 - RNA, 18 nt, Salmonella typhimurium LT2
acuuucuugccacuggcc

SEQ ID NO: 3769491 - RNA, 17 nt, Salmonella typhimurium LT2
acuuugaccagcaucgc

SEQ ID NO: 3769492 - RNA, 20 nt, Salmonella typhimurium LT2
acuuugaccagcaucgccgg

SEQ ID NO: 3769493 - RNA, 15 nt, Salmonella typhimurium LT2
acuuugauuuaauuc

SEQ ID NO: 3769494 - RNA, 20 nt, Salmonella typhimurium LT2
agaaucagcaacacaaucag

SEQ ID NO: 3769495 - RNA, 19 nt, Salmonella typhimurium LT2
agaauccagucaggcucaa

SEQ ID NO: 3769496 - RNA, 14 nt, Salmonella typhimurium LT2
agaaucccgauaau

SEQ ID NO: 3769497 - RNA, 15 nt, Salmonella typhimurium LT2
agaaugaaaaaaaau

SEQ ID NO: 3769498 - RNA, 15 nt, Salmonella typhimurium LT2
agaaugcccagcaag

SEQ ID NO: 3769499 - RNA, 16 nt, Salmonella typhimurium LT2
agaaugcccaggccca

SEQ ID NO: 3769500 - RNA, 14 nt, Salmonella typhimurium LT2
agaaugcuauaugc

SEQ ID NO: 3769501 - RNA, 22 nt, Salmonella typhimurium LT2
agaauggccagcacaauaacga

SEQ ID NO: 3769502 - RNA, 22 nt, Salmonella typhimurium LT2
agaauggucgguauuaucaaug

SEQ ID NO: 3769503 - RNA, 14 nt, Salmonella typhimurium LT2
agaauguccccaua

SEQ ID NO: 3769504 - RNA, 23 nt, Salmonella typhimurium LT2
agaauguccuggguaucaauggu

SEQ ID NO: 3769505 - RNA, 20 nt, Salmonella typhimurium LT2
agaauguggguauccacgcc

SEQ ID NO: 3769506 - RNA, 23 nt, Salmonella typhimurium LT2
agaauguuauaaccgaugcagcc

SEQ ID NO: 3769507 - RNA, 22 nt, Salmonella typhimurium LT2
agaauuauuaccaaugagcugc

SEQ ID NO: 3769508 - RNA, 13 nt, Salmonella typhimurium LT2
agaauuccaccuu

SEQ ID NO: 3769509 - RNA, 18 nt, Salmonella typhimurium LT2
agaauucuugucagucug

SEQ ID NO: 3769510 - RNA, 14 nt, Salmonella typhimurium LT2
agaauuucaaucau

SEQ ID NO: 3769511 - RNA, 17 nt, Salmonella typhimurium LT2
agaauuuccccaguuau

SEQ ID NO: 3769512 - RNA, 19 nt, Salmonella typhimurium LT2
agaauuucuacacagcgcg

SEQ ID NO: 3769513 - RNA, 16 nt, Salmonella typhimurium LT2
agaauuuguugguuua

SEQ ID NO: 3769514 - RNA, 20 nt, Salmonella typhimurium LT2
agaauuuguugguuuaaacu

SEQ ID NO: 3769515 - RNA, 16 nt, Salmonella typhimurium LT2
agaauuuuuagcgugc

SEQ ID NO: 3769516 - RNA, 15 nt, Salmonella typhimurium LT2
agacaaaauucagac

SEQ ID NO: 3769517 - RNA, 18 nt, Salmonella typhimurium LT2
agacaaaauucagacuca

SEQ ID NO: 3769518 - RNA, 11 nt, Salmonella typhimurium LT2
agacaaacagc

SEQ ID NO: 3769519 - RNA, 10 nt, Salmonella typhimurium LT2
agacaacauc

SEQ ID NO: 3769520 - RNA, 16 nt, Salmonella typhimurium LT2
agacaaccagcagggc

SEQ ID NO: 3769521 - RNA, 14 nt, Salmonella typhimurium LT2
agacaacccgucac

SEQ ID NO: 3769522 - RNA, 18 nt, Salmonella typhimurium LT2
agacaacccgucaccgcc

SEQ ID NO: 3769523 - RNA, 18 nt, Salmonella typhimurium LT2
agacaaccgggcaucacc

SEQ ID NO: 3769524 - RNA, 17 nt, Salmonella typhimurium LT2
agacaauaccagggcga

SEQ ID NO: 3769525 - RNA, 22 nt, Salmonella typhimurium LT2
agacaaucugugugggcacucg

SEQ ID NO: 3769526 - RNA, 21 nt, Salmonella typhimurium LT2
agacaaugcugacacugauau

SEQ ID NO: 3769527 - RNA, 21 nt, Salmonella typhimurium LT2
agacacaacgugccagaaaca

SEQ ID NO: 3769528 - RNA, 18 nt, Salmonella typhimurium LT2
agacacuggaaacagcca

SEQ ID NO: 3769529 - RNA, 19 nt, Salmonella typhimurium LT2
agacacuggaaacagccaa

SEQ ID NO: 3769530 - RNA, 22 nt, Salmonella typhimurium LT2
agacacuggaaacagccaauca

SEQ ID NO: 3769531 - RNA, 12 nt, Salmonella typhimurium LT2
agacacuuuccg

SEQ ID NO: 3769532 - RNA, 11 nt, Salmonella typhimurium LT2
agacagaacag

SEQ ID NO: 3769533 - RNA, 18 nt, Salmonella typhimurium LT2
agacagaacaggaugcuu

SEQ ID NO: 3769534 - RNA, 15 nt, Salmonella typhimurium LT2
agacagaaucaggcc

SEQ ID NO: 3769535 - RNA, 22 nt, Salmonella typhimurium LT2
agacagagaaccugaacaauaa

SEQ ID NO: 3769536 - RNA, 16 nt, Salmonella typhimurium LT2
agacagauaacaccag

SEQ ID NO: 3769537 - RNA, 20 nt, Salmonella typhimurium LT2
agacagauaacaccagcgau

SEQ ID NO: 3769538 - RNA, 17 nt, Salmonella typhimurium LT2
agacagcagaugaaaac

SEQ ID NO: 3769539 - RNA, 19 nt, Salmonella typhimurium LT2
agacagcccuauaacagcg

SEQ ID NO: 3769540 - RNA, 17 nt, Salmonella typhimurium LT2
agacagccucucccgaa

SEQ ID NO: 3769541 - RNA, 21 nt, Salmonella typhimurium LT2
agacagcgcgcccagcagggc

SEQ ID NO: 3769542 - RNA, 14 nt, Salmonella typhimurium LT2
agacaguggccauc

SEQ ID NO: 3769543 - RNA, 15 nt, Salmonella typhimurium LT2
agacauauuuucucu

SEQ ID NO: 3769544 - RNA, 11 nt, Salmonella typhimurium LT2
agacaucaaaa

SEQ ID NO: 3769545 - RNA, 15 nt, Salmonella typhimurium LT2
agacauuauugucuu

SEQ ID NO: 3769546 - RNA, 21 nt, Salmonella typhimurium LT2
agacauucccgccgagaaaau

SEQ ID NO: 3769547 - RNA, 19 nt, Salmonella typhimurium LT2
agacauuugcgcacggcgc

SEQ ID NO: 3769548 - RNA, 23 nt, Salmonella typhimurium LT2
agacauuuuuugugaccagcuuc

SEQ ID NO: 3769549 - RNA, 23 nt, Salmonella typhimurium LT2
agaccaauaagucccaucgagcc

SEQ ID NO: 3769550 - RNA, 15 nt, Salmonella typhimurium LT2
agaccaccagcgaca

SEQ ID NO: 3769551 - RNA, 18 nt, Salmonella typhimurium LT2
agaccaccccacagcaau

SEQ ID NO: 3769552 - RNA, 18 nt, Salmonella typhimurium LT2
agaccaccguuauuucca

SEQ ID NO: 3769553 - RNA, 15 nt, Salmonella typhimurium LT2
agaccacgaaucagg

SEQ ID NO: 3769554 - RNA, 23 nt, Salmonella typhimurium LT2
agaccacgaaucaggauauucgc

SEQ ID NO: 3769555 - RNA, 20 nt, Salmonella typhimurium LT2
agaccacgccaucaacagcg

SEQ ID NO: 3769556 - RNA, 20 nt, Salmonella typhimurium LT2
agaccagauuaaucagcaga

SEQ ID NO: 3769557 - RNA, 21 nt, Salmonella typhimurium LT2
agaccagauuaaucagcagau

SEQ ID NO: 3769558 - RNA, 16 nt, Salmonella typhimurium LT2
agaccagcgccggagc

SEQ ID NO: 3769559 - RNA, 17 nt, Salmonella typhimurium LT2
agaccauauucacgcag

SEQ ID NO: 3769560 - RNA, 16 nt, Salmonella typhimurium LT2
agaccauccaugaaau

SEQ ID NO: 3769561 - RNA, 19 nt, Salmonella typhimurium LT2
agaccauucaaccagccga

SEQ ID NO: 3769562 - RNA, 23 nt, Salmonella typhimurium LT2
agacccaaaggaggaaaagcgac

SEQ ID NO: 3769563 - RNA, 21 nt, Salmonella typhimurium LT2
agacccacauauugcgcuuca

SEQ ID NO: 3769564 - RNA, 14 nt, Salmonella typhimurium LT2
agacccagacgcgu

SEQ ID NO: 3769565 - RNA, 18 nt, Salmonella typhimurium LT2
agacccaguacaaacaaa

SEQ ID NO: 3769566 - RNA, 15 nt, Salmonella typhimurium LT2
agaccccgcaucgcc

SEQ ID NO: 3769567 - RNA, 15 nt, Salmonella typhimurium LT2
agaccccgccaggcg

SEQ ID NO: 3769568 - RNA, 15 nt, Salmonella typhimurium LT2
agacccgacaguaaa

SEQ ID NO: 3769569 - RNA, 17 nt, Salmonella typhimurium LT2
agacccgcaauaacgcc

SEQ ID NO: 3769570 - RNA, 21 nt, Salmonella typhimurium LT2
agacccgcaauaacgccgaua

SEQ ID NO: 3769571 - RNA, 13 nt, Salmonella typhimurium LT2
agacccggcauug

SEQ ID NO: 3769572 - RNA, 19 nt, Salmonella typhimurium LT2
agaccgaaccugcgccggu

SEQ ID NO: 3769573 - RNA, 17 nt, Salmonella typhimurium LT2
agaccgacaucgccagu

SEQ ID NO: 3769574 - RNA, 13 nt, Salmonella typhimurium LT2
agaccgauaaaua

SEQ ID NO: 3769575 - RNA, 16 nt, Salmonella typhimurium LT2
agaccgauuuggucag

SEQ ID NO: 3769576 - RNA, 16 nt, Salmonella typhimurium LT2
agaccgccaagcgcgg

SEQ ID NO: 3769577 - RNA, 18 nt, Salmonella typhimurium LT2
agaccgcuuaacuccggc

SEQ ID NO: 3769578 - RNA, 18 nt, Salmonella typhimurium LT2
agaccggcaaucaauaca

SEQ ID NO: 3769579 - RNA, 15 nt, Salmonella typhimurium LT2
agaccggcaucucau

SEQ ID NO: 3769580 - RNA, 14 nt, Salmonella typhimurium LT2
agaccggggcaggc

SEQ ID NO: 3769581 - RNA, 15 nt, Salmonella typhimurium LT2
agaccguaugccagc

SEQ ID NO: 3769582 - RNA, 12 nt, Salmonella typhimurium LT2
agaccuaaacca

SEQ ID NO: 3769583 - RNA, 11 nt, Salmonella typhimurium LT2
agaccugagcc

SEQ ID NO: 3769584 - RNA, 21 nt, Salmonella typhimurium LT2
agaccuggcucucggcaacaa

SEQ ID NO: 3769585 - RNA, 19 nt, Salmonella typhimurium LT2
agaccugucgcaaucccga

SEQ ID NO: 3769586 - RNA, 13 nt, Salmonella typhimurium LT2
agaccuuuccagg

SEQ ID NO: 3769587 - RNA, 17 nt, Salmonella typhimurium LT2
agacgaaaaugcgccuu

SEQ ID NO: 3769588 - RNA, 14 nt, Salmonella typhimurium LT2
agacgaccagggaa

SEQ ID NO: 3769589 - RNA, 23 nt, Salmonella typhimurium LT2
agacgacguugugauaauacugg

SEQ ID NO: 3769590 - RNA, 17 nt, Salmonella typhimurium LT2
agacgauaccagggcga

SEQ ID NO: 3769591 - RNA, 13 nt, Salmonella typhimurium LT2
agacgaucagcgc

SEQ ID NO: 3769592 - RNA, 14 nt, Salmonella typhimurium LT2
agacgaugauaaua

SEQ ID NO: 3769593 - RNA, 21 nt, Salmonella typhimurium LT2
agacgcaguagcgcuuugaca

SEQ ID NO: 3769594 - RNA, 20 nt, Salmonella typhimurium LT2
agacgcaucuuuuucccggu

SEQ ID NO: 3769595 - RNA, 14 nt, Salmonella typhimurium LT2
agacgcauuaaaau

SEQ ID NO: 3769596 - RNA, 22 nt, Salmonella typhimurium LT2
agacgccaacgucgacagacgc

SEQ ID NO: 3769597 - RNA, 23 nt, Salmonella typhimurium LT2
agacgcgaaacgaaacccaaaua

SEQ ID NO: 3769598 - RNA, 19 nt, Salmonella typhimurium LT2
agagugacgacgccaggcg

SEQ ID NO: 3769599 - RNA, 18 nt, Salmonella typhimurium LT2
agagugacgguuuucacu

SEQ ID NO: 3769600 - RNA, 20 nt, Salmonella typhimurium LT2
agagugacgguuuucacugg

SEQ ID NO: 3769601 - RNA, 15 nt, Salmonella typhimurium LT2
agagugccagaaaca

SEQ ID NO: 3769602 - RNA, 20 nt, Salmonella typhimurium LT2
agaguucaacgccgaacagg

SEQ ID NO: 3769603 - RNA, 18 nt, Salmonella typhimurium LT2
agaguucacguagcucaa

SEQ ID NO: 3769604 - RNA, 16 nt, Salmonella typhimurium LT2
agaguugagccagaua

SEQ ID NO: 3769605 - RNA, 15 nt, Salmonella typhimurium LT2
agauaaaacaaaagg

SEQ ID NO: 3769606 - RNA, 20 nt, Salmonella typhimurium LT2
agauaaaauacgugcggagu

SEQ ID NO: 3769607 - RNA, 14 nt, Salmonella typhimurium LT2
agauaaacacacac

SEQ ID NO: 3769608 - RNA, 15 nt, Salmonella typhimurium LT2
agauaaacagcagcg

SEQ ID NO: 3769609 - RNA, 17 nt, Salmonella typhimurium LT2
agauaaacagcagcgcg

SEQ ID NO: 3769610 - RNA, 14 nt, Salmonella typhimurium LT2
agauaaagcagcga

SEQ ID NO: 3769611 - RNA, 13 nt, Salmonella typhimurium LT2
agauaaauguccg

SEQ ID NO: 3769612 - RNA, 17 nt, Salmonella typhimurium LT2
agauaaccaauaaugca

SEQ ID NO: 3769613 - RNA, 23 nt, Salmonella typhimurium LT2
agauaacuuccuuugccuuucuu

SEQ ID NO: 3769614 - RNA, 16 nt, Salmonella typhimurium LT2
agauaagaaguaaaca

SEQ ID NO: 3769615 - RNA, 12 nt, Salmonella typhimurium LT2
agauaagaucuu

SEQ ID NO: 3769616 - RNA, 19 nt, Salmonella typhimurium LT2
agauaagcaccugcauuua

SEQ ID NO: 3769617 - RNA, 23 nt, Salmonella typhimurium LT2
agauaagcaccugcauuuaucuu

SEQ ID NO: 3769618 - RNA, 18 nt, Salmonella typhimurium LT2
agauaagccuccggauga

SEQ ID NO: 3769619 - RNA, 19 nt, Salmonella typhimurium LT2
agauaaggagaaagaccuu

SEQ ID NO: 3769620 - RNA, 12 nt, Salmonella typhimurium LT2
agauaauagcug

SEQ ID NO: 3769621 - RNA, 17 nt, Salmonella typhimurium LT2
agauaauagcugcggcu

SEQ ID NO: 3769622 - RNA, 16 nt, Salmonella typhimurium LT2
agauaaucaaacgcgc

SEQ ID NO: 3769623 - RNA, 18 nt, Salmonella typhimurium LT2
agauaaugcuuucgccag

SEQ ID NO: 3769624 - RNA, 23 nt, Salmonella typhimurium LT2
agauaauuuucccaguucaucca

SEQ ID NO: 3769625 - RNA, 22 nt, Salmonella typhimurium LT2
agauacauucccuuugguggag

SEQ ID NO: 3769626 - RNA, 15 nt, Salmonella typhimurium LT2
agauaccaaauuacg

SEQ ID NO: 3769627 - RNA, 17 nt, Salmonella typhimurium LT2
agauaccuaucggaaga

SEQ ID NO: 3769628 - RNA, 21 nt, Salmonella typhimurium LT2
agauaccuaucggaagaaaac

SEQ ID NO: 3769629 - RNA, 17 nt, Salmonella typhimurium LT2
agauacggcuccagcac

SEQ ID NO: 3769630 - RNA, 19 nt, Salmonella typhimurium LT2
agauacugcgcguggcaaa

SEQ ID NO: 3769631 - RNA, 16 nt, Salmonella typhimurium LT2
agauagagcauaauaa

SEQ ID NO: 3769632 - RNA, 21 nt, Salmonella typhimurium LT2
agauagccugccagcaccagc

SEQ ID NO: 3769633 - RNA, 23 nt, Salmonella typhimurium LT2
agauagccugccagcaccagcag

SEQ ID NO: 3769634 - RNA, 18 nt, Salmonella typhimurium LT2
agauagcuaaguguugga

SEQ ID NO: 3769635 - RNA, 17 nt, Salmonella typhimurium LT2
agauagcuuccaugccg

SEQ ID NO: 3769636 - RNA, 20 nt, Salmonella typhimurium LT2
agauaggcgcgaaauguccc

SEQ ID NO: 3769637 - RNA, 15 nt, Salmonella typhimurium LT2
agauagggccaggcg

SEQ ID NO: 3769638 - RNA, 22 nt, Salmonella typhimurium LT2
agauaguauuucccuucccagc

SEQ ID NO: 3769639 - RNA, 20 nt, Salmonella typhimurium LT2
agauagucacgauaguuugc

SEQ ID NO: 3769640 - RNA, 16 nt, Salmonella typhimurium LT2
agauagucgaucccca

SEQ ID NO: 3769641 - RNA, 17 nt, Salmonella typhimurium LT2
agauagugaucgggcug

SEQ ID NO: 3769642 - RNA, 18 nt, Salmonella typhimurium LT2
agauaguuuuuaauucca

SEQ ID NO: 3769643 - RNA, 14 nt, Salmonella typhimurium LT2
agauauagaccagc

SEQ ID NO: 3769644 - RNA, 14 nt, Salmonella typhimurium LT2
agauauaguuuuuc

SEQ ID NO: 3769645 - RNA, 21 nt, Salmonella typhimurium LT2
agauauaguuuuucaagaauu

SEQ ID NO: 3769646 - RNA, 15 nt, Salmonella typhimurium LT2
agauaucaaacacaa

SEQ ID NO: 3769647 - RNA, 18 nt, Salmonella typhimurium LT2
agauaucaaacacaaauu

SEQ ID NO: 3769648 - RNA, 22 nt, Salmonella typhimurium LT2
agauaucuguauaaauaaaauu

SEQ ID NO: 3769649 - RNA, 20 nt, Salmonella typhimurium LT2
agauaugaaaugagaccaau

SEQ ID NO: 3769650 - RNA, 16 nt, Salmonella typhimurium LT2
agauauuuuccaucac

SEQ ID NO: 3769651 - RNA, 21 nt, Salmonella typhimurium LT2
agauauuuuguuuuaaauuca

SEQ ID NO: 3769652 - RNA, 13 nt, Salmonella typhimurium LT2
agaucaaaaaucu

SEQ ID NO: 3769653 - RNA, 13 nt, Salmonella typhimurium LT2
agaucaaagcgua

SEQ ID NO: 3769654 - RNA, 23 nt, Salmonella typhimurium LT2
agaucacgcugggcgaauaccca

SEQ ID NO: 3769655 - RNA, 20 nt, Salmonella typhimurium LT2
agaucagcagaacaaaggcu

SEQ ID NO: 3769656 - RNA, 19 nt, Salmonella typhimurium LT2
agaucaggaguaaauaaca

SEQ ID NO: 3769657 - RNA, 21 nt, Salmonella typhimurium LT2
agaucaggaguaaauaacaaa

SEQ ID NO: 3769658 - RNA, 18 nt, Salmonella typhimurium LT2
agaucaggcgaccaucca

SEQ ID NO: 3769659 - RNA, 17 nt, Salmonella typhimurium LT2
agauccaccagguccga

SEQ ID NO: 3769660 - RNA, 20 nt, Salmonella typhimurium LT2
agauccaucgccugcggcgu

SEQ ID NO: 3769661 - RNA, 21 nt, Salmonella typhimurium LT2
agauccauuaaaugcgccagc

SEQ ID NO: 3769662 - RNA, 17 nt, Salmonella typhimurium LT2
agaucccagggcggcgu

SEQ ID NO: 3769663 - RNA, 13 nt, Salmonella typhimurium LT2
agauccgcaagag

SEQ ID NO: 3769664 - RNA, 15 nt, Salmonella typhimurium LT2
agauccugacucacc

SEQ ID NO: 3769665 - RNA, 16 nt, Salmonella typhimurium LT2
agauccugagaaauca

SEQ ID NO: 3769666 - RNA, 22 nt, Salmonella typhimurium LT2
agauccugcgagcuuuccacca

SEQ ID NO: 3769667 - RNA, 13 nt, Salmonella typhimurium LT2
agauccuggcgcu

SEQ ID NO: 3769668 - RNA, 17 nt, Salmonella typhimurium LT2
agauccuuaacgucaaa

SEQ ID NO: 3769669 - RNA, 17 nt, Salmonella typhimurium LT2
agaucgaacaauuaccg

SEQ ID NO: 3769670 - RNA, 23 nt, Salmonella typhimurium LT2
agaucgcaggccaaaaaaacgaa

SEQ ID NO: 3769671 - RNA, 23 nt, Salmonella typhimurium LT2
agaucgcaggguaugaauuuuuu

SEQ ID NO: 3769672 - RNA, 18 nt, Salmonella typhimurium LT2
agaucgccagcguuagca

SEQ ID NO: 3769673 - RNA, 16 nt, Salmonella typhimurium LT2
agaucgcuuuccagcg

SEQ ID NO: 3769674 - RNA, 15 nt, Salmonella typhimurium LT2
agaucggacaucggc

SEQ ID NO: 3769675 - RNA, 21 nt, Salmonella typhimurium LT2
agaucggagggggaggcaggc

SEQ ID NO: 3769676 - RNA, 23 nt, Salmonella typhimurium LT2
agaucguaagaauaaucauccgc

SEQ ID NO: 3769677 - RNA, 18 nt, Salmonella typhimurium LT2
agaucguaugcgccuguu

SEQ ID NO: 3769678 - RNA, 20 nt, Salmonella typhimurium LT2
agaucguuauuaaacagaca

SEQ ID NO: 3769679 - RNA, 21 nt, Salmonella typhimurium LT2
agaucuggcgaaaguaaccaa

SEQ ID NO: 3769680 - RNA, 17 nt, Salmonella typhimurium LT2
agaucugucgccaugac

SEQ ID NO: 3769681 - RNA, 15 nt, Salmonella typhimurium LT2
agaucuucccaguua

SEQ ID NO: 3769682 - RNA, 16 nt, Salmonella typhimurium LT2
agaucuucccaguuau

SEQ ID NO: 3769683 - RNA, 14 nt, Salmonella typhimurium LT2
agaucuuccggcgu

SEQ ID NO: 3769684 - RNA, 22 nt, Salmonella typhimurium LT2
agaucuucuuuccgcuacuacc

SEQ ID NO: 3769685 - RNA, 20 nt, Salmonella typhimurium LT2
agaucuuuugcgccuuccag

SEQ ID NO: 3769686 - RNA, 22 nt, Salmonella typhimurium LT2
agaucuuuugcgccuuccaguu

SEQ ID NO: 3769687 - RNA, 14 nt, Salmonella typhimurium LT2
agaucuuuuugcuc

SEQ ID NO: 3769688 - RNA, 17 nt, Salmonella typhimurium LT2
agaucuuuuugcuccug

SEQ ID NO: 3769689 - RNA, 14 nt, Salmonella typhimurium LT2
agaugaaugacugu

SEQ ID NO: 3769690 - RNA, 21 nt, Salmonella typhimurium LT2
agaugaccaaagcuauucaca

SEQ ID NO: 3769691 - RNA, 17 nt, Salmonella typhimurium LT2
agaugaccgaguuccag

SEQ ID NO: 3769692 - RNA, 21 nt, Salmonella typhimurium LT2
agaugaccgaguuccagucca

SEQ ID NO: 3769693 - RNA, 22 nt, Salmonella typhimurium LT2
agaugaccguuaguaaucggau

SEQ ID NO: 3769694 - RNA, 23 nt, Salmonella typhimurium LT2
agaugacgccauuggcucggcgu

SEQ ID NO: 3769695 - RNA, 21 nt, Salmonella typhimurium LT2
agaugagcaaaccgcaaauaa

SEQ ID NO: 3769696 - RNA, 19 nt, Salmonella typhimurium LT2
agaugaugauuuaugaaua

SEQ ID NO: 3769697 - RNA, 15 nt, Salmonella typhimurium LT2
agaugcaggccaagc

SEQ ID NO: 3769698 - RNA, 13 nt, Salmonella typhimurium LT2
agaugcauaaaaa

SEQ ID NO: 3769699 - RNA, 15 nt, Salmonella typhimurium LT2
agaugcauaaaaaaa

SEQ ID NO: 3769700 - RNA, 16 nt, Salmonella typhimurium LT2
agaugcauaaaaaaac

SEQ ID NO: 3769701 - RNA, 12 nt, Salmonella typhimurium LT2
agcaccagcagu

SEQ ID NO: 3769702 - RNA, 13 nt, Salmonella typhimurium LT2
agcaccagcagug

SEQ ID NO: 3769703 - RNA, 17 nt, Salmonella typhimurium LT2
agcaccagcgagauaau

SEQ ID NO: 3769704 - RNA, 13 nt, Salmonella typhimurium LT2
agcaccaggccaa

SEQ ID NO: 3769705 - RNA, 21 nt, Salmonella typhimurium LT2
agcaccaguacaauuuccugc

SEQ ID NO: 3769706 - RNA, 12 nt, Salmonella typhimurium LT2
agcaccaguacc

SEQ ID NO: 3769707 - RNA, 17 nt, Salmonella typhimurium LT2
agcaccauuagcggcau

SEQ ID NO: 3769708 - RNA, 16 nt, Salmonella typhimurium LT2
agcaccauucuucaac

SEQ ID NO: 3769709 - RNA, 13 nt, Salmonella typhimurium LT2
agcacccagagua

SEQ ID NO: 3769710 - RNA, 18 nt, Salmonella typhimurium LT2
agcaccgauccaauauua

SEQ ID NO: 3769711 - RNA, 18 nt, Salmonella typhimurium LT2
agcaccgccagcgcauuc

SEQ ID NO: 3769712 - RNA, 15 nt, Salmonella typhimurium LT2
agcaccgccagcgcc

SEQ ID NO: 3769713 - RNA, 16 nt, Salmonella typhimurium LT2
agcaccgccgggaaga

SEQ ID NO: 3769714 - RNA, 14 nt, Salmonella typhimurium LT2
agcaccgguuuuuc

SEQ ID NO: 3769715 - RNA, 20 nt, Salmonella typhimurium LT2
agcaccucaucccccagccg

SEQ ID NO: 3769716 - RNA, 21 nt, Salmonella typhimurium LT2
agcaccucgguauguccugcc

SEQ ID NO: 3769717 - RNA, 18 nt, Salmonella typhimurium LT2
agcaccugcgacgcauga

SEQ ID NO: 3769718 - RNA, 20 nt, Salmonella typhimurium LT2
agcaccugcucaggcugacc

SEQ ID NO: 3769719 - RNA, 20 nt, Salmonella typhimurium LT2
agcaccuggcggagcugcgc

SEQ ID NO: 3769720 - RNA, 16 nt, Salmonella typhimurium LT2
agcaccuuauccggcc

SEQ ID NO: 3769721 - RNA, 17 nt, Salmonella typhimurium LT2
agcaccuuauccggccu

SEQ ID NO: 3769722 - RNA, 22 nt, Salmonella typhimurium LT2
agcaccuuugaacgucgcugau

SEQ ID NO: 3769723 - RNA, 13 nt, Salmonella typhimurium LT2
agcacgacacaaa

SEQ ID NO: 3769724 - RNA, 18 nt, Salmonella typhimurium LT2
agcacgcaggcauccggu

SEQ ID NO: 3769725 - RNA, 17 nt, Salmonella typhimurium LT2
agcacgccuuccugguu

SEQ ID NO: 3769726 - RNA, 17 nt, Salmonella typhimurium LT2
agcacgcuuacccagca

SEQ ID NO: 3769727 - RNA, 24 nt, Salmonella typhimurium LT2
agcacguagcuuauaaaucagcuu

SEQ ID NO: 3769728 - RNA, 17 nt, Salmonella typhimurium LT2
agcacguaggccagaug

SEQ ID NO: 3769729 - RNA, 19 nt, Salmonella typhimurium LT2
agcacguaggccagaugau

SEQ ID NO: 3769730 - RNA, 13 nt, Salmonella typhimurium LT2
agcacguccugga

SEQ ID NO: 3769731 - RNA, 15 nt, Salmonella typhimurium LT2
agcacgugcauggga

SEQ ID NO: 3769732 - RNA, 16 nt, Salmonella typhimurium LT2
agcacuaacagcagca

SEQ ID NO: 3769733 - RNA, 18 nt, Salmonella typhimurium LT2
agcacuacggcaaacaca

SEQ ID NO: 3769734 - RNA, 15 nt, Salmonella typhimurium LT2
agcacucggcgccuu

SEQ ID NO: 3769735 - RNA, 14 nt, Salmonella typhimurium LT2
agcacuguggcggc

SEQ ID NO: 3769736 - RNA, 15 nt, Salmonella typhimurium LT2
agcacuucagaacgg

SEQ ID NO: 3769737 - RNA, 22 nt, Salmonella typhimurium LT2
agcacuuccugaaucaccagcc

SEQ ID NO: 3769738 - RNA, 22 nt, Salmonella typhimurium LT2
agcacuucgcugauaccgcccu

SEQ ID NO: 3769739 - RNA, 13 nt, Salmonella typhimurium LT2
agcacuucuccac

SEQ ID NO: 3769740 - RNA, 12 nt, Salmonella typhimurium LT2
agcagaaacugg

SEQ ID NO: 3769741 - RNA, 13 nt, Salmonella typhimurium LT2
agcagaaacuggc

SEQ ID NO: 3769742 - RNA, 19 nt, Salmonella typhimurium LT2
agcagaaacuggcggcgca

SEQ ID NO: 3769743 - RNA, 23 nt, Salmonella typhimurium LT2
agcagaacaaacagaccgccaug

SEQ ID NO: 3769744 - RNA, 21 nt, Salmonella typhimurium LT2
agcagaacuggcgcgaugacu

SEQ ID NO: 3769745 - RNA, 16 nt, Salmonella typhimurium LT2
agcagaagacggaaac

SEQ ID NO: 3769746 - RNA, 14 nt, Salmonella typhimurium LT2
agcagacaggugaa

SEQ ID NO: 3769747 - RNA, 22 nt, Salmonella typhimurium LT2
agcagaccaccccacagcaaug

SEQ ID NO: 3769748 - RNA, 13 nt, Salmonella typhimurium LT2
agcagacgagaaa

SEQ ID NO: 3769749 - RNA, 22 nt, Salmonella typhimurium LT2
agcagacguuuaagcaugguga

SEQ ID NO: 3769750 - RNA, 15 nt, Salmonella typhimurium LT2
agcagagcggggaga

SEQ ID NO: 3769751 - RNA, 20 nt, Salmonella typhimurium LT2
agcagauaccagccuucgga

SEQ ID NO: 3769752 - RNA, 20 nt, Salmonella typhimurium LT2
agcagauaccgaccgugaga

SEQ ID NO: 3769753 - RNA, 22 nt, Salmonella typhimurium LT2
agcagaucgcggcaauggcuua

SEQ ID NO: 3769754 - RNA, 19 nt, Salmonella typhimurium LT2
agcagauuuucauccgucg

SEQ ID NO: 3769755 - RNA, 20 nt, Salmonella typhimurium LT2
agcagauuuuucgccaggua

SEQ ID NO: 3769756 - RNA, 12 nt, Salmonella typhimurium LT2
agcagcaauaau

SEQ ID NO: 3769757 - RNA, 10 nt, Salmonella typhimurium LT2
agcagcagaa

SEQ ID NO: 3769758 - RNA, 14 nt, Salmonella typhimurium LT2
agcagcagacucaa

SEQ ID NO: 3769759 - RNA, 13 nt, Salmonella typhimurium LT2
agcagcagcacac

SEQ ID NO: 3769760 - RNA, 16 nt, Salmonella typhimurium LT2
agcagcagcagcgcuu

SEQ ID NO: 3769761 - RNA, 21 nt, Salmonella typhimurium LT2
agcagcagcguaauggccacc

SEQ ID NO: 3769762 - RNA, 20 nt, Salmonella typhimurium LT2
agcagcaggacguugccgcc

SEQ ID NO: 3769763 - RNA, 20 nt, Salmonella typhimurium LT2
agcagcauacgacaucgcca

SEQ ID NO: 3769764 - RNA, 21 nt, Salmonella typhimurium LT2
agcagcauacgacaucgccaa

SEQ ID NO: 3769765 - RNA, 15 nt, Salmonella typhimurium LT2
agcagccagaaaaag

SEQ ID NO: 3769766 - RNA, 11 nt, Salmonella typhimurium LT2
agcagccagcc

SEQ ID NO: 3769767 - RNA, 21 nt, Salmonella typhimurium LT2
agcagccagcccagcgcaacc

SEQ ID NO: 3769768 - RNA, 15 nt, Salmonella typhimurium LT2
agcagccagguaauc

SEQ ID NO: 3769769 - RNA, 17 nt, Salmonella typhimurium LT2
agcagccagguaauccg

SEQ ID NO: 3769770 - RNA, 14 nt, Salmonella typhimurium LT2
agcagcgagauggc

SEQ ID NO: 3769771 - RNA, 14 nt, Salmonella typhimurium LT2
agcagcgcaucaug

SEQ ID NO: 3769772 - RNA, 17 nt, Salmonella typhimurium LT2
agcagcgcaucaugguc

SEQ ID NO: 3769773 - RNA, 16 nt, Salmonella typhimurium LT2
agcagcgccagcgaca

SEQ ID NO: 3769774 - RNA, 23 nt, Salmonella typhimurium LT2
agcagcggcgggauacucggcac

SEQ ID NO: 3769775 - RNA, 18 nt, Salmonella typhimurium LT2
agcagcuccccgccgcgg

SEQ ID NO: 3769776 - RNA, 17 nt, Salmonella typhimurium LT2
agcagcucgauaauccc

SEQ ID NO: 3769777 - RNA, 16 nt, Salmonella typhimurium LT2
agcagcugcugguacc

SEQ ID NO: 3769778 - RNA, 13 nt, Salmonella typhimurium LT2
agcagcugcugua

SEQ ID NO: 3769779 - RNA, 14 nt, Salmonella typhimurium LT2
agcagcuucaugca

SEQ ID NO: 3769780 - RNA, 14 nt, Salmonella typhimurium LT2
agcaggaaccacau

SEQ ID NO: 3769781 - RNA, 15 nt, Salmonella typhimurium LT2
agcaggaacggcagg

SEQ ID NO: 3769782 - RNA, 23 nt, Salmonella typhimurium LT2
agcaggaaucccauuaagcggga

SEQ ID NO: 3769783 - RNA, 17 nt, Salmonella typhimurium LT2
agcaggauauccugcgg

SEQ ID NO: 3769784 - RNA, 22 nt, Salmonella typhimurium LT2
agcaggaucuccagaucgccac

SEQ ID NO: 3769785 - RNA, 14 nt, Salmonella typhimurium LT2
agcaggcaaaaaag

SEQ ID NO: 3769786 - RNA, 20 nt, Salmonella typhimurium LT2
agcaggccaaaaaagccgcu

SEQ ID NO: 3769787 - RNA, 21 nt, Salmonella typhimurium LT2
agcaggccaaaaaagccgcuc

SEQ ID NO: 3769788 - RNA, 16 nt, Salmonella typhimurium LT2
agcaggccauaaugca

SEQ ID NO: 3769789 - RNA, 12 nt, Salmonella typhimurium LT2
agcaggcggaga

SEQ ID NO: 3769790 - RNA, 13 nt, Salmonella typhimurium LT2
agcaggcgggcuu

SEQ ID NO: 3769791 - RNA, 14 nt, Salmonella typhimurium LT2
agcagggucaggaa

SEQ ID NO: 3769792 - RNA, 15 nt, Salmonella typhimurium LT2
agcagggucaggaac

SEQ ID NO: 3769793 - RNA, 16 nt, Salmonella typhimurium LT2
agcagguaaacagaca

SEQ ID NO: 3769794 - RNA, 21 nt, Salmonella typhimurium LT2
agcaggugcggacugggcuga

SEQ ID NO: 3769795 - RNA, 14 nt, Salmonella typhimurium LT2
agcaguacgccaaa

SEQ ID NO: 3769796 - RNA, 21 nt, Salmonella typhimurium LT2
agcaguacgccugucgcaacc

SEQ ID NO: 3769797 - RNA, 18 nt, Salmonella typhimurium LT2
agcaguccugcgggaaca

SEQ ID NO: 3769798 - RNA, 23 nt, Salmonella typhimurium LT2
agcaguguaucgaagaucaguga

SEQ ID NO: 3769799 - RNA, 14 nt, Salmonella typhimurium LT2
agcaguucguaauu

SEQ ID NO: 3769800 - RNA, 15 nt, Salmonella typhimurium LT2
agcaguugcauuccc

SEQ ID NO: 3769801 - RNA, 21 nt, Salmonella typhimurium LT2
agcaguuuuaucuaugugugg

SEQ ID NO: 3769802 - RNA, 17 nt, Salmonella typhimurium LT2
agcauaaaaaacaucau

SEQ ID NO: 3769803 - RNA, 15 nt, Salmonella typhimurium LT2
agcauaaaaaucauu

SEQ ID NO: 3769804 - RNA, 21 nt, Salmonella typhimurium LT2
agcauaaaaccgccgcccauc

SEQ ID NO: 3769805 - RNA, 14 nt, Salmonella typhimurium LT2
agccauuaaccaga

SEQ ID NO: 3769806 - RNA, 16 nt, Salmonella typhimurium LT2
agccauuaaugcaggc

SEQ ID NO: 3769807 - RNA, 20 nt, Salmonella typhimurium LT2
agccauucccgauaaugacc

SEQ ID NO: 3769808 - RNA, 14 nt, Salmonella typhimurium LT2
agccauuucugccu

SEQ ID NO: 3769809 - RNA, 20 nt, Salmonella typhimurium LT2
agccauuucugccugauggc

SEQ ID NO: 3769810 - RNA, 18 nt, Salmonella typhimurium LT2
agcccacgcccugcaaug

SEQ ID NO: 3769811 - RNA, 23 nt, Salmonella typhimurium LT2
agcccacuggcaaguaugaaaag

SEQ ID NO: 3769812 - RNA, 14 nt, Salmonella typhimurium LT2
agcccagcgccgca

SEQ ID NO: 3769813 - RNA, 18 nt, Salmonella typhimurium LT2
agcccagguagaauccca

SEQ ID NO: 3769814 - RNA, 14 nt, Salmonella typhimurium LT2
agcccaucagcgcc

SEQ ID NO: 3769815 - RNA, 17 nt, Salmonella typhimurium LT2
agcccaucaguccccag

SEQ ID NO: 3769816 - RNA, 14 nt, Salmonella typhimurium LT2
agcccaucccuggg

SEQ ID NO: 3769817 - RNA, 14 nt, Salmonella typhimurium LT2
agcccauggcaggc

SEQ ID NO: 3769818 - RNA, 21 nt, Salmonella typhimurium LT2
agcccauggcaggcagcacaa

SEQ ID NO: 3769819 - RNA, 14 nt, Salmonella typhimurium LT2
agcccauuucggua

SEQ ID NO: 3769820 - RNA, 13 nt, Salmonella typhimurium LT2
agccccagcacca

SEQ ID NO: 3769821 - RNA, 21 nt, Salmonella typhimurium LT2
agccccagcaccaacgccgcu

SEQ ID NO: 3769822 - RNA, 20 nt, Salmonella typhimurium LT2
agccccagcccugugccgcu

SEQ ID NO: 3769823 - RNA, 12 nt, Salmonella typhimurium LT2
agccccagcgcc

SEQ ID NO: 3769824 - RNA, 12 nt, Salmonella typhimurium LT2
agccccaggcua

SEQ ID NO: 3769825 - RNA, 15 nt, Salmonella typhimurium LT2
agcccccagccgauc

SEQ ID NO: 3769826 - RNA, 13 nt, Salmonella typhimurium LT2
agccccccgcaca

SEQ ID NO: 3769827 - RNA, 23 nt, Salmonella typhimurium LT2
agccccccuuugcauuacggcga

SEQ ID NO: 3769828 - RNA, 22 nt, Salmonella typhimurium LT2
agccccgaaagucaucugccag

SEQ ID NO: 3769829 - RNA, 21 nt, Salmonella typhimurium LT2
agccccucgcuaaugcccggc

SEQ ID NO: 3769830 - RNA, 22 nt, Salmonella typhimurium LT2
agccccucgcuaaugcccggcg

SEQ ID NO: 3769831 - RNA, 21 nt, Salmonella typhimurium LT2
agccccuggcgcgccagcucu

SEQ ID NO: 3769832 - RNA, 14 nt, Salmonella typhimurium LT2
agcccgaggcgaaa

SEQ ID NO: 3769833 - RNA, 14 nt, Salmonella typhimurium LT2
agcccgccagcaua

SEQ ID NO: 3769834 - RNA, 23 nt, Salmonella typhimurium LT2
agcccgccagcauacaaagcaga

SEQ ID NO: 3769835 - RNA, 18 nt, Salmonella typhimurium LT2
agcccggccacagcgcca

SEQ ID NO: 3769836 - RNA, 22 nt, Salmonella typhimurium LT2
agcccggccacagcgccagaca

SEQ ID NO: 3769837 - RNA, 17 nt, Salmonella typhimurium LT2
agcccggcgcacacccu

SEQ ID NO: 3769838 - RNA, 21 nt, Salmonella typhimurium LT2
agcccggcgcacacccugcag

SEQ ID NO: 3769839 - RNA, 23 nt, Salmonella typhimurium LT2
agcccggcggcgcaucgcucacc

SEQ ID NO: 3769840 - RNA, 16 nt, Salmonella typhimurium LT2
agcccgucccuuccgc

SEQ ID NO: 3769841 - RNA, 18 nt, Salmonella typhimurium LT2
agcccgucccuuccgcca

SEQ ID NO: 3769842 - RNA, 17 nt, Salmonella typhimurium LT2
agcccuauaacagcgcc

SEQ ID NO: 3769843 - RNA, 22 nt, Salmonella typhimurium LT2
agcccucaacauugccggcauc

SEQ ID NO: 3769844 - RNA, 20 nt, Salmonella typhimurium LT2
agcccuuaggggcucuuuuu

SEQ ID NO: 3769845 - RNA, 18 nt, Salmonella typhimurium LT2
agcccuugucgacugcgg

SEQ ID NO: 3769846 - RNA, 19 nt, Salmonella typhimurium LT2
agcccuuucauuucugccu

SEQ ID NO: 3769847 - RNA, 20 nt, Salmonella typhimurium LT2
agcccuuucauuucugccug

SEQ ID NO: 3769848 - RNA, 23 nt, Salmonella typhimurium LT2
agcccuuugagaaagcugcgccc

SEQ ID NO: 3769849 - RNA, 16 nt, Salmonella typhimurium LT2
agcccuuugcccucaa

SEQ ID NO: 3769850 - RNA, 19 nt, Salmonella typhimurium LT2
agccgaccaauugcaggca

SEQ ID NO: 3769851 - RNA, 14 nt, Salmonella typhimurium LT2
agccgaccaccauc

SEQ ID NO: 3769852 - RNA, 13 nt, Salmonella typhimurium LT2
agccgaccgccga

SEQ ID NO: 3769853 - RNA, 14 nt, Salmonella typhimurium LT2
agccgauacgcggg

SEQ ID NO: 3769854 - RNA, 13 nt, Salmonella typhimurium LT2
agccgaucaggcc

SEQ ID NO: 3769855 - RNA, 15 nt, Salmonella typhimurium LT2
agccgcaaaugccau

SEQ ID NO: 3769856 - RNA, 17 nt, Salmonella typhimurium LT2
agccgcagccaccccgg

SEQ ID NO: 3769857 - RNA, 18 nt, Salmonella typhimurium LT2
agccgcaguugccaggcc

SEQ ID NO: 3769858 - RNA, 17 nt, Salmonella typhimurium LT2
agccgcaucuuauauuu

SEQ ID NO: 3769859 - RNA, 15 nt, Salmonella typhimurium LT2
agccgccaccacaaa

SEQ ID NO: 3769860 - RNA, 17 nt, Salmonella typhimurium LT2
agccgccacccggcaaa

SEQ ID NO: 3769861 - RNA, 16 nt, Salmonella typhimurium LT2
agccgccauccggcaa

SEQ ID NO: 3769862 - RNA, 16 nt, Salmonella typhimurium LT2
agccgccauccggcac

SEQ ID NO: 3769863 - RNA, 18 nt, Salmonella typhimurium LT2
agccgccauccggcauuu

SEQ ID NO: 3769864 - RNA, 14 nt, Salmonella typhimurium LT2
agccgcccacaacc

SEQ ID NO: 3769865 - RNA, 23 nt, Salmonella typhimurium LT2
agccgccguguugugugccgcgc

SEQ ID NO: 3769866 - RNA, 21 nt, Salmonella typhimurium LT2
agccgcgccaucuccuccuca

SEQ ID NO: 3769867 - RNA, 14 nt, Salmonella typhimurium LT2
agccgcgcgccgcc

SEQ ID NO: 3769868 - RNA, 15 nt, Salmonella typhimurium LT2
agccgcgcgucagcg

SEQ ID NO: 3769869 - RNA, 15 nt, Salmonella typhimurium LT2
agccgcgcugguugg

SEQ ID NO: 3769870 - RNA, 20 nt, Salmonella typhimurium LT2
agccgcggcgcuuucgccac

SEQ ID NO: 3769871 - RNA, 20 nt, Salmonella typhimurium LT2
agccgcguugcgcugaagua

SEQ ID NO: 3769872 - RNA, 16 nt, Salmonella typhimurium LT2
agccgcucaauaauau

SEQ ID NO: 3769873 - RNA, 21 nt, Salmonella typhimurium LT2
agccgcucaauaauauccugc

SEQ ID NO: 3769874 - RNA, 20 nt, Salmonella typhimurium LT2
agccgcucaggguaaucacc

SEQ ID NO: 3769875 - RNA, 19 nt, Salmonella typhimurium LT2
agccgcugauauucgccug

SEQ ID NO: 3769876 - RNA, 13 nt, Salmonella typhimurium LT2
agccgcugggauu

SEQ ID NO: 3769877 - RNA, 16 nt, Salmonella typhimurium LT2
agccgcuuuccgccgc

SEQ ID NO: 3769878 - RNA, 15 nt, Salmonella typhimurium LT2
agccggaacagaagu

SEQ ID NO: 3769879 - RNA, 19 nt, Salmonella typhimurium LT2
agccggaaucauucuacaa

SEQ ID NO: 3769880 - RNA, 13 nt, Salmonella typhimurium LT2
agccggagccggu

SEQ ID NO: 3769881 - RNA, 16 nt, Salmonella typhimurium LT2
agccggauaucgcuau

SEQ ID NO: 3769882 - RNA, 16 nt, Salmonella typhimurium LT2
agccggauggcgaggc

SEQ ID NO: 3769883 - RNA, 21 nt, Salmonella typhimurium LT2
agccggcgauagcgccccaaa

SEQ ID NO: 3769884 - RNA, 16 nt, Salmonella typhimurium LT2
agccggcgccauuucg

SEQ ID NO: 3769885 - RNA, 13 nt, Salmonella typhimurium LT2
agccgggcaggaa

SEQ ID NO: 3769886 - RNA, 16 nt, Salmonella typhimurium LT2
agccgggccagacgcu

SEQ ID NO: 3769887 - RNA, 14 nt, Salmonella typhimurium LT2
agccgggguaauau

SEQ ID NO: 3769888 - RNA, 20 nt, Salmonella typhimurium LT2
agccgguaaucgaucccgcc

SEQ ID NO: 3769889 - RNA, 20 nt, Salmonella typhimurium LT2
agccgguauccagcgcguaa

SEQ ID NO: 3769890 - RNA, 16 nt, Salmonella typhimurium LT2
agccguaaacggaacc

SEQ ID NO: 3769891 - RNA, 13 nt, Salmonella typhimurium LT2
agccguaaauaau

SEQ ID NO: 3769892 - RNA, 18 nt, Salmonella typhimurium LT2
agccguacacaaucaucg

SEQ ID NO: 3769893 - RNA, 16 nt, Salmonella typhimurium LT2
agccguagcagaagac

SEQ ID NO: 3769894 - RNA, 21 nt, Salmonella typhimurium LT2
agccgucgauaaaauccucua

SEQ ID NO: 3769895 - RNA, 22 nt, Salmonella typhimurium LT2
agccgucgcuaucaauaccgcu

SEQ ID NO: 3769896 - RNA, 22 nt, Salmonella typhimurium LT2
agccgucggcgccaucaugcag

SEQ ID NO: 3769897 - RNA, 23 nt, Salmonella typhimurium LT2
agccguucaccagccacugcgcc

SEQ ID NO: 3769898 - RNA, 17 nt, Salmonella typhimurium LT2
agccuaaucucgccggu

SEQ ID NO: 3769899 - RNA, 22 nt, Salmonella typhimurium LT2
agccuaaugacggacgcagacc

SEQ ID NO: 3769900 - RNA, 14 nt, Salmonella typhimurium LT2
agccuaccugccgc

SEQ ID NO: 3769901 - RNA, 23 nt, Salmonella typhimurium LT2
agccucauuuuugaguuugucau

SEQ ID NO: 3769902 - RNA, 18 nt, Salmonella typhimurium LT2
agccugaacgccggaacc

SEQ ID NO: 3769903 - RNA, 18 nt, Salmonella typhimurium LT2
agccugaagccagcaauc

SEQ ID NO: 3769904 - RNA, 22 nt, Salmonella typhimurium LT2
agccugaagccagcaaucagcc

SEQ ID NO: 3769905 - RNA, 15 nt, Salmonella typhimurium LT2
agccugaaucagcau

SEQ ID NO: 3769906 - RNA, 17 nt, Salmonella typhimurium LT2
agccugcaaugugcagg

SEQ ID NO: 3769907 - RNA, 15 nt, Salmonella typhimurium LT2
agccugccagcaacc

SEQ ID NO: 3769908 - RNA, 22 nt, Salmonella typhimurium LT2
agccugccagcaacccaccugc

SEQ ID NO: 3769909 - RNA, 22 nt, Salmonella typhimurium LT2
agcgccagcgguuucauauggg

SEQ ID NO: 3769910 - RNA, 11 nt, Salmonella typhimurium LT2
agcgccaguaa

SEQ ID NO: 3769911 - RNA, 16 nt, Salmonella typhimurium LT2
agcgccauauugcugu

SEQ ID NO: 3769912 - RNA, 21 nt, Salmonella typhimurium LT2
agcgccaucaggcaugccaaa

SEQ ID NO: 3769913 - RNA, 14 nt, Salmonella typhimurium LT2
agcgccauccggca

SEQ ID NO: 3769914 - RNA, 17 nt, Salmonella typhimurium LT2
agcgccauccggcaauc

SEQ ID NO: 3769915 - RNA, 20 nt, Salmonella typhimurium LT2
agcgccauccggcacacaga

SEQ ID NO: 3769916 - RNA, 15 nt, Salmonella typhimurium LT2
agcgccauccggcag

SEQ ID NO: 3769917 - RNA, 20 nt, Salmonella typhimurium LT2
agcgccaugcggaaucacgc

SEQ ID NO: 3769918 - RNA, 14 nt, Salmonella typhimurium LT2
agcgccccaguaac

SEQ ID NO: 3769919 - RNA, 14 nt, Salmonella typhimurium LT2
agcgcccccagcaa

SEQ ID NO: 3769920 - RNA, 15 nt, Salmonella typhimurium LT2
agcgcccccagcaaa

SEQ ID NO: 3769921 - RNA, 15 nt, Salmonella typhimurium LT2
agcgccccggcauaa

SEQ ID NO: 3769922 - RNA, 23 nt, Salmonella typhimurium LT2
agcgcccgcuguccgcccaacac

SEQ ID NO: 3769923 - RNA, 22 nt, Salmonella typhimurium LT2
agcgcccgguucaucggcucga

SEQ ID NO: 3769924 - RNA, 16 nt, Salmonella typhimurium LT2
agcgcccguccaugag

SEQ ID NO: 3769925 - RNA, 13 nt, Salmonella typhimurium LT2
agcgccgcagggc

SEQ ID NO: 3769926 - RNA, 14 nt, Salmonella typhimurium LT2
agcgccgcagggcg

SEQ ID NO: 3769927 - RNA, 15 nt, Salmonella typhimurium LT2
agcgccgcgcaggcg

SEQ ID NO: 3769928 - RNA, 16 nt, Salmonella typhimurium LT2
agcgccgcgcaggcga

SEQ ID NO: 3769929 - RNA, 13 nt, Salmonella typhimurium LT2
agcgccgcgcuau

SEQ ID NO: 3769930 - RNA, 19 nt, Salmonella typhimurium LT2
agcgccgcguggcguucca

SEQ ID NO: 3769931 - RNA, 22 nt, Salmonella typhimurium LT2
agcgccgcguggcguuccaguu

SEQ ID NO: 3769932 - RNA, 14 nt, Salmonella typhimurium LT2
agcgccgcuuccag

SEQ ID NO: 3769933 - RNA, 12 nt, Salmonella typhimurium LT2
agcgccggaaug

SEQ ID NO: 3769934 - RNA, 18 nt, Salmonella typhimurium LT2
agcgccggauaauccaga

SEQ ID NO: 3769935 - RNA, 19 nt, Salmonella typhimurium LT2
agcgccggaucgggcuucc

SEQ ID NO: 3769936 - RNA, 16 nt, Salmonella typhimurium LT2
agcgccggcaaagcca

SEQ ID NO: 3769937 - RNA, 15 nt, Salmonella typhimurium LT2
agcgccgucacuccc

SEQ ID NO: 3769938 - RNA, 21 nt, Salmonella typhimurium LT2
agcgccguuaaacugcgcgau

SEQ ID NO: 3769939 - RNA, 23 nt, Salmonella typhimurium LT2
agcgccuccgcguagcccagcgc

SEQ ID NO: 3769940 - RNA, 17 nt, Salmonella typhimurium LT2
agcgccucguccagggu

SEQ ID NO: 3769941 - RNA, 19 nt, Salmonella typhimurium LT2
agcgccugaccgcgaucgc

SEQ ID NO: 3769942 - RNA, 13 nt, Salmonella typhimurium LT2
agcgccugacggc

SEQ ID NO: 3769943 - RNA, 18 nt, Salmonella typhimurium LT2
agcgccugacggcgcugu

SEQ ID NO: 3769944 - RNA, 14 nt, Salmonella typhimurium LT2
agcgccuguagcgu

SEQ ID NO: 3769945 - RNA, 20 nt, Salmonella typhimurium LT2
agcgccugugcuuucgccac

SEQ ID NO: 3769946 - RNA, 13 nt, Salmonella typhimurium LT2
agcgccuuaucca

SEQ ID NO: 3769947 - RNA, 16 nt, Salmonella typhimurium LT2
agcgccuuauccggcc

SEQ ID NO: 3769948 - RNA, 23 nt, Salmonella typhimurium LT2
agcgccuucaggcaucagauaaa

SEQ ID NO: 3769949 - RNA, 21 nt, Salmonella typhimurium LT2
agcgccuuguuuucaucugcu

SEQ ID NO: 3769950 - RNA, 15 nt, Salmonella typhimurium LT2
agcgcgaaauaauca

SEQ ID NO: 3769951 - RNA, 16 nt, Salmonella typhimurium LT2
agcgcgaacaggcugg

SEQ ID NO: 3769952 - RNA, 22 nt, Salmonella typhimurium LT2
agcgcgaacauuacauccucaa

SEQ ID NO: 3769953 - RNA, 23 nt, Salmonella typhimurium LT2
agcgcgaauuuuauuaagcaggc

SEQ ID NO: 3769954 - RNA, 23 nt, Salmonella typhimurium LT2
agcgcgaccaggaaaccgguaaa

SEQ ID NO: 3769955 - RNA, 13 nt, Salmonella typhimurium LT2
agcgcgaccugca

SEQ ID NO: 3769956 - RNA, 18 nt, Salmonella typhimurium LT2
agcgcgacgccaaacccg

SEQ ID NO: 3769957 - RNA, 17 nt, Salmonella typhimurium LT2
agcgcgagcgugaucuc

SEQ ID NO: 3769958 - RNA, 17 nt, Salmonella typhimurium LT2
agcgcgcaaucgggccu

SEQ ID NO: 3769959 - RNA, 20 nt, Salmonella typhimurium LT2
agcgcgcaaucgggccugcu

SEQ ID NO: 3769960 - RNA, 21 nt, Salmonella typhimurium LT2
agcgcgccaauccaugccggc

SEQ ID NO: 3769961 - RNA, 19 nt, Salmonella typhimurium LT2
agcgcgcccagcagggcca

SEQ ID NO: 3769962 - RNA, 18 nt, Salmonella typhimurium LT2
agcgcgcccgccaccagc

SEQ ID NO: 3769963 - RNA, 17 nt, Salmonella typhimurium LT2
agcgcgccgcagcgccg

SEQ ID NO: 3769964 - RNA, 18 nt, Salmonella typhimurium LT2
agcgcgccgcagcgccga

SEQ ID NO: 3769965 - RNA, 19 nt, Salmonella typhimurium LT2
agcgcgccgccaacgccaa

SEQ ID NO: 3769966 - RNA, 18 nt, Salmonella typhimurium LT2
agcgcgcgacccagcgca

SEQ ID NO: 3769967 - RNA, 21 nt, Salmonella typhimurium LT2
agcgcgcgacccagcgcauga

SEQ ID NO: 3769968 - RNA, 13 nt, Salmonella typhimurium LT2
agcgcgcgcgcaa

SEQ ID NO: 3769969 - RNA, 23 nt, Salmonella typhimurium LT2
agcgcgcgcuaauuuucagggug

SEQ ID NO: 3769970 - RNA, 16 nt, Salmonella typhimurium LT2
agcgcgcguagcagca

SEQ ID NO: 3769971 - RNA, 16 nt, Salmonella typhimurium LT2
agcgcgcuccagacca

SEQ ID NO: 3769972 - RNA, 21 nt, Salmonella typhimurium LT2
agcgcgcugucuuugaauaac

SEQ ID NO: 3769973 - RNA, 23 nt, Salmonella typhimurium LT2
agcgcgcugucuuugaauaacgc

SEQ ID NO: 3769974 - RNA, 23 nt, Salmonella typhimurium LT2
agcgcggacagcagaauauugcu

SEQ ID NO: 3769975 - RNA, 15 nt, Salmonella typhimurium LT2
agcgcggcacaggcg

SEQ ID NO: 3769976 - RNA, 14 nt, Salmonella typhimurium LT2
agcgcggcaggccg

SEQ ID NO: 3769977 - RNA, 23 nt, Salmonella typhimurium LT2
agcgcggcgcccauuccgccugc

SEQ ID NO: 3769978 - RNA, 19 nt, Salmonella typhimurium LT2
agcgcggcgugaucaaauu

SEQ ID NO: 3769979 - RNA, 17 nt, Salmonella typhimurium LT2
agcgcgggcuggcuggc

SEQ ID NO: 3769980 - RNA, 19 nt, Salmonella typhimurium LT2
agcgcgguaucauugcugc

SEQ ID NO: 3769981 - RNA, 21 nt, Salmonella typhimurium LT2
agcgcgguggcuuuuuccugc

SEQ ID NO: 3769982 - RNA, 19 nt, Salmonella typhimurium LT2
agcgcgguuucuauuaaau

SEQ ID NO: 3769983 - RNA, 21 nt, Salmonella typhimurium LT2
agcgcguaaauaccuuccggc

SEQ ID NO: 3769984 - RNA, 18 nt, Salmonella typhimurium LT2
agcgcgucagcgccuccg

SEQ ID NO: 3769985 - RNA, 17 nt, Salmonella typhimurium LT2
agcgcguccccgguaag

SEQ ID NO: 3769986 - RNA, 20 nt, Salmonella typhimurium LT2
agcgcgucguugucuuugcg

SEQ ID NO: 3769987 - RNA, 22 nt, Salmonella typhimurium LT2
agcgcguucgccgucacgccga

SEQ ID NO: 3769988 - RNA, 14 nt, Salmonella typhimurium LT2
agcgcuaagcaaca

SEQ ID NO: 3769989 - RNA, 16 nt, Salmonella typhimurium LT2
agcgcuaagcaacagu

SEQ ID NO: 3769990 - RNA, 14 nt, Salmonella typhimurium LT2
agcgcuauccaggc

SEQ ID NO: 3769991 - RNA, 22 nt, Salmonella typhimurium LT2
agcgcuccaccaaccaggcaaa

SEQ ID NO: 3769992 - RNA, 16 nt, Salmonella typhimurium LT2
agcgcugaugcaggca

SEQ ID NO: 3769993 - RNA, 19 nt, Salmonella typhimurium LT2
agcgcugcgccagauccgg

SEQ ID NO: 3769994 - RNA, 20 nt, Salmonella typhimurium LT2
agcgcuggcauuccccaucg

SEQ ID NO: 3769995 - RNA, 16 nt, Salmonella typhimurium LT2
agcgcugucgccauca

SEQ ID NO: 3769996 - RNA, 15 nt, Salmonella typhimurium LT2
agcgcuuaucccagu

SEQ ID NO: 3769997 - RNA, 15 nt, Salmonella typhimurium LT2
agcgcuucaccggcg

SEQ ID NO: 3769998 - RNA, 16 nt, Salmonella typhimurium LT2
agcgcuucgccugccg

SEQ ID NO: 3769999 - RNA, 14 nt, Salmonella typhimurium LT2
agcgcuugauccag

SEQ ID NO: 3770000 - RNA, 17 nt, Salmonella typhimurium LT2
agcgcuugucgcgcuau

SEQ ID NO: 3770001 - RNA, 14 nt, Salmonella typhimurium LT2
agcgcuuucuucuu

SEQ ID NO: 3770002 - RNA, 20 nt, Salmonella typhimurium LT2
agcggaaucgcuuccugggu

SEQ ID NO: 3770003 - RNA, 18 nt, Salmonella typhimurium LT2
agcggaauuaacugcacu

SEQ ID NO: 3770004 - RNA, 15 nt, Salmonella typhimurium LT2
agcggacacccgcag

SEQ ID NO: 3770005 - RNA, 16 nt, Salmonella typhimurium LT2
agcggauaauccgcca

SEQ ID NO: 3770006 - RNA, 20 nt, Salmonella typhimurium LT2
agcggaucgcguccauuacu

SEQ ID NO: 3770007 - RNA, 22 nt, Salmonella typhimurium LT2
agcggaucgcguccauuacucu

SEQ ID NO: 3770008 - RNA, 13 nt, Salmonella typhimurium LT2
agcggaugacgcu

SEQ ID NO: 3770009 - RNA, 20 nt, Salmonella typhimurium LT2
agcggcaaugagcggccagc

SEQ ID NO: 3770010 - RNA, 20 nt, Salmonella typhimurium LT2
agcggcaccccgagcgacaa

SEQ ID NO: 3770011 - RNA, 18 nt, Salmonella typhimurium LT2
agcggcacguacugcacc

SEQ ID NO: 3770012 - RNA, 22 nt, Salmonella typhimurium LT2
agcuaucgccaucaacgccaua

SEQ ID NO: 3770013 - RNA, 19 nt, Salmonella typhimurium LT2
agcuaucgcgccggacagc

SEQ ID NO: 3770014 - RNA, 18 nt, Salmonella typhimurium LT2
agcuauguuuaagccaga

SEQ ID NO: 3770015 - RNA, 22 nt, Salmonella typhimurium LT2
agcucaaaucgcggcgcugagu

SEQ ID NO: 3770016 - RNA, 18 nt, Salmonella typhimurium LT2
agcucaaccgcgcggcgu

SEQ ID NO: 3770017 - RNA, 13 nt, Salmonella typhimurium LT2
agcucaagcgccg

SEQ ID NO: 3770018 - RNA, 16 nt, Salmonella typhimurium LT2
agcucaccaccaccaa

SEQ ID NO: 3770019 - RNA, 15 nt, Salmonella typhimurium LT2
agcucacgccaaaau

SEQ ID NO: 3770020 - RNA, 21 nt, Salmonella typhimurium LT2
agcucacggauauugcccggc

SEQ ID NO: 3770021 - RNA, 22 nt, Salmonella typhimurium LT2
agcucacggauauugcccggcc

SEQ ID NO: 3770022 - RNA, 17 nt, Salmonella typhimurium LT2
agcucagccaggcgcgg

SEQ ID NO: 3770023 - RNA, 14 nt, Salmonella typhimurium LT2
agcucagcgcccca

SEQ ID NO: 3770024 - RNA, 17 nt, Salmonella typhimurium LT2
agcucagcgccccagcc

SEQ ID NO: 3770025 - RNA, 23 nt, Salmonella typhimurium LT2
agcucagcuuuaaugcuuuccag

SEQ ID NO: 3770026 - RNA, 20 nt, Salmonella typhimurium LT2
agcucaggccuuauuuauag

SEQ ID NO: 3770027 - RNA, 22 nt, Salmonella typhimurium LT2
agcucaggccuuauuuauagca

SEQ ID NO: 3770028 - RNA, 21 nt, Salmonella typhimurium LT2
agcucaggguccccauauccc

SEQ ID NO: 3770029 - RNA, 22 nt, Salmonella typhimurium LT2
agcucaggguccccauaucccg

SEQ ID NO: 3770030 - RNA, 21 nt, Salmonella typhimurium LT2
agcucauguagucauauugcg

SEQ ID NO: 3770031 - RNA, 21 nt, Salmonella typhimurium LT2
agcucauuaauaacccagguu

SEQ ID NO: 3770032 - RNA, 13 nt, Salmonella typhimurium LT2
agcucauuuuuac

SEQ ID NO: 3770033 - RNA, 17 nt, Salmonella typhimurium LT2
agcuccagccgcugccu

SEQ ID NO: 3770034 - RNA, 16 nt, Salmonella typhimurium LT2
agcuccagcucagggu

SEQ ID NO: 3770035 - RNA, 22 nt, Salmonella typhimurium LT2
agcuccccacgaaagucuguuc

SEQ ID NO: 3770036 - RNA, 22 nt, Salmonella typhimurium LT2
agcuccgcguauucucaaccag

SEQ ID NO: 3770037 - RNA, 18 nt, Salmonella typhimurium LT2
agcuccuccgauuugcuu

SEQ ID NO: 3770038 - RNA, 22 nt, Salmonella typhimurium LT2
agcuccucgcgaaucucaaugc

SEQ ID NO: 3770039 - RNA, 17 nt, Salmonella typhimurium LT2
agcuccugcgggagcug

SEQ ID NO: 3770040 - RNA, 24 nt, Salmonella typhimurium LT2
agcuccugcgggagcuguucuuau

SEQ ID NO: 3770041 - RNA, 20 nt, Salmonella typhimurium LT2
agcucgcaggccauaaaacg

SEQ ID NO: 3770042 - RNA, 15 nt, Salmonella typhimurium LT2
agcucgcccagcacu

SEQ ID NO: 3770043 - RNA, 20 nt, Salmonella typhimurium LT2
agcucggcaaagcccaucac

SEQ ID NO: 3770044 - RNA, 21 nt, Salmonella typhimurium LT2
agcucggcaaagcccaucacc

SEQ ID NO: 3770045 - RNA, 15 nt, Salmonella typhimurium LT2
agcucuccuggaugc

SEQ ID NO: 3770046 - RNA, 22 nt, Salmonella typhimurium LT2
agcucucgccgguuggcaugau

SEQ ID NO: 3770047 - RNA, 19 nt, Salmonella typhimurium LT2
agcucuggaaaaauuguuu

SEQ ID NO: 3770048 - RNA, 23 nt, Salmonella typhimurium LT2
agcucuguggggggaacggcaga

SEQ ID NO: 3770049 - RNA, 16 nt, Salmonella typhimurium LT2
agcucuucaugcagcg

SEQ ID NO: 3770050 - RNA, 15 nt, Salmonella typhimurium LT2
agcucuucgcuuuga

SEQ ID NO: 3770051 - RNA, 20 nt, Salmonella typhimurium LT2
agcucuucgcuuugaaucuc

SEQ ID NO: 3770052 - RNA, 19 nt, Salmonella typhimurium LT2
agcucuuucaacugaccgg

SEQ ID NO: 3770053 - RNA, 18 nt, Salmonella typhimurium LT2
agcugaauaaaaaaucuc

SEQ ID NO: 3770054 - RNA, 18 nt, Salmonella typhimurium LT2
agcugaaugcuucgccac

SEQ ID NO: 3770055 - RNA, 15 nt, Salmonella typhimurium LT2
agcugagaguaaauu

SEQ ID NO: 3770056 - RNA, 17 nt, Salmonella typhimurium LT2
agcugagcggcaaugag

SEQ ID NO: 3770057 - RNA, 19 nt, Salmonella typhimurium LT2
agcugagcuaaucacccac

SEQ ID NO: 3770058 - RNA, 18 nt, Salmonella typhimurium LT2
agcugaugauuggccucc

SEQ ID NO: 3770059 - RNA, 15 nt, Salmonella typhimurium LT2
agcugauugaugcuu

SEQ ID NO: 3770060 - RNA, 18 nt, Salmonella typhimurium LT2
agcugauugauuuuguaa

SEQ ID NO: 3770061 - RNA, 16 nt, Salmonella typhimurium LT2
agcugcaccaggagca

SEQ ID NO: 3770062 - RNA, 22 nt, Salmonella typhimurium LT2
agcugcauccgggguucgaauc

SEQ ID NO: 3770063 - RNA, 23 nt, Salmonella typhimurium LT2
agcugcccuguucggcgcggaaa

SEQ ID NO: 3770064 - RNA, 15 nt, Salmonella typhimurium LT2
agcugccgcccggcg

SEQ ID NO: 3770065 - RNA, 16 nt, Salmonella typhimurium LT2
agcugcgcagcacuuc

SEQ ID NO: 3770066 - RNA, 20 nt, Salmonella typhimurium LT2
agcugcgcuuuuucaucauc

SEQ ID NO: 3770067 - RNA, 16 nt, Salmonella typhimurium LT2
agcugcggcagaauca

SEQ ID NO: 3770068 - RNA, 22 nt, Salmonella typhimurium LT2
agcugcugacguaaauucugau

SEQ ID NO: 3770069 - RNA, 20 nt, Salmonella typhimurium LT2
agcugcuggcgaugauaauc

SEQ ID NO: 3770070 - RNA, 21 nt, Salmonella typhimurium LT2
agcuggcaagaccgauagaga

SEQ ID NO: 3770071 - RNA, 17 nt, Salmonella typhimurium LT2
agcuggcauaaccgcag

SEQ ID NO: 3770072 - RNA, 13 nt, Salmonella typhimurium LT2
agcuggcugacag

SEQ ID NO: 3770073 - RNA, 14 nt, Salmonella typhimurium LT2
agcugggucaggac

SEQ ID NO: 3770074 - RNA, 19 nt, Salmonella typhimurium LT2
agcuggucggaucggcggu

SEQ ID NO: 3770075 - RNA, 21 nt, Salmonella typhimurium LT2
agcugguggcgaguccugccg

SEQ ID NO: 3770076 - RNA, 23 nt, Salmonella typhimurium LT2
agcuguaccaucaccugaugucc

SEQ ID NO: 3770077 - RNA, 13 nt, Salmonella typhimurium LT2
agcuguagcauaa

SEQ ID NO: 3770078 - RNA, 22 nt, Salmonella typhimurium LT2
agcugucgccaccuuguaucau

SEQ ID NO: 3770079 - RNA, 23 nt, Salmonella typhimurium LT2
agcugucgccugcugcuggacag

SEQ ID NO: 3770080 - RNA, 12 nt, Salmonella typhimurium LT2
agcugugagaau

SEQ ID NO: 3770081 - RNA, 16 nt, Salmonella typhimurium LT2
agcugugagaauucug

SEQ ID NO: 3770082 - RNA, 20 nt, Salmonella typhimurium LT2
agcuguucguucgcaacauu

SEQ ID NO: 3770083 - RNA, 18 nt, Salmonella typhimurium LT2
agcuuaaaaaauccugca

SEQ ID NO: 3770084 - RNA, 19 nt, Salmonella typhimurium LT2
agcuuaaaaaauccugcac

SEQ ID NO: 3770085 - RNA, 18 nt, Salmonella typhimurium LT2
agcuuaggauucgccauu

SEQ ID NO: 3770086 - RNA, 14 nt, Salmonella typhimurium LT2
agcuuauccugccc

SEQ ID NO: 3770087 - RNA, 23 nt, Salmonella typhimurium LT2
agcuuaucgaacugugagccuaa

SEQ ID NO: 3770088 - RNA, 20 nt, Salmonella typhimurium LT2
agcuuaucgccaaagauaua

SEQ ID NO: 3770089 - RNA, 22 nt, Salmonella typhimurium LT2
agcuuaucgccaaagauauagu

SEQ ID NO: 3770090 - RNA, 23 nt, Salmonella typhimurium LT2
agcuuaucugaccaugccagcaa

SEQ ID NO: 3770091 - RNA, 22 nt, Salmonella typhimurium LT2
agcuuauuggcaaucgcgguau

SEQ ID NO: 3770092 - RNA, 13 nt, Salmonella typhimurium LT2
agcuucaucauca

SEQ ID NO: 3770093 - RNA, 14 nt, Salmonella typhimurium LT2
agcuucaucaucag

SEQ ID NO: 3770094 - RNA, 12 nt, Salmonella typhimurium LT2
agcuucgccaga

SEQ ID NO: 3770095 - RNA, 14 nt, Salmonella typhimurium LT2
agcuucggcggcau

SEQ ID NO: 3770096 - RNA, 20 nt, Salmonella typhimurium LT2
agcuucugucugcgugaaga

SEQ ID NO: 3770097 - RNA, 16 nt, Salmonella typhimurium LT2
agcuugaucucucccu

SEQ ID NO: 3770098 - RNA, 21 nt, Salmonella typhimurium LT2
agcuuguuguuuauccugcaa

SEQ ID NO: 3770099 - RNA, 21 nt, Salmonella typhimurium LT2
agcuuguuuacgcccucaucg

SEQ ID NO: 3770100 - RNA, 16 nt, Salmonella typhimurium LT2
agcuuucuguuaucag

SEQ ID NO: 3770101 - RNA, 16 nt, Salmonella typhimurium LT2
agcuuugccacuggcu

SEQ ID NO: 3770102 - RNA, 18 nt, Salmonella typhimurium LT2
agcuuugcgccagauaac

SEQ ID NO: 3770103 - RNA, 20 nt, Salmonella typhimurium LT2
agcuuuucauauagucauaa

SEQ ID NO: 3770104 - RNA, 20 nt, Salmonella typhimurium LT2
agcuuuuccaccccagcauu

SEQ ID NO: 3770105 - RNA, 15 nt, Salmonella typhimurium LT2
agcuuuuccuguucg

SEQ ID NO: 3770106 - RNA, 22 nt, Salmonella typhimurium LT2
agcuuuugcgcguuccccaaca

SEQ ID NO: 3770107 - RNA, 20 nt, Salmonella typhimurium LT2
agcuuuugcugcgccagcca

SEQ ID NO: 3770108 - RNA, 19 nt, Salmonella typhimurium LT2
agcuuuuuauuacuuucua

SEQ ID NO: 3770109 - RNA, 12 nt, Salmonella typhimurium LT2
agcuuuuucuuu

SEQ ID NO: 3770110 - RNA, 13 nt, Salmonella typhimurium LT2
aggaaaaacauau

SEQ ID NO: 3770111 - RNA, 13 nt, Salmonella typhimurium LT2
aggaaaacgcuuc

SEQ ID NO: 3770112 - RNA, 15 nt, Salmonella typhimurium LT2
aggaaaauaaugccu

SEQ ID NO: 3770113 - RNA, 23 nt, Salmonella typhimurium LT2
aggaaacauaaggguaagcaaua

SEQ ID NO: 3770114 - RNA, 20 nt, Salmonella typhimurium LT2
aggaaacucgugaagaucag

SEQ ID NO: 3770115 - RNA, 21 nt, Salmonella typhimurium LT2
gacgccaauuccuaucaguac

SEQ ID NO: 3770116 - RNA, 13 nt, Salmonella typhimurium LT2
gacgccagauaau

SEQ ID NO: 3770117 - RNA, 18 nt, Salmonella typhimurium LT2
gacgccagauaaucacgc

SEQ ID NO: 3770118 - RNA, 22 nt, Salmonella typhimurium LT2
gacgccagaugauagagcaccu

SEQ ID NO: 3770119 - RNA, 12 nt, Salmonella typhimurium LT2
gacgccagccga

SEQ ID NO: 3770120 - RNA, 18 nt, Salmonella typhimurium LT2
gacgccauuccccagcua

SEQ ID NO: 3770121 - RNA, 14 nt, Salmonella typhimurium LT2
gacgcccaucagca

SEQ ID NO: 3770122 - RNA, 17 nt, Salmonella typhimurium LT2
gacgcccaucagcaucc

SEQ ID NO: 3770123 - RNA, 16 nt, Salmonella typhimurium LT2
gacgcccucaauaucu

SEQ ID NO: 3770124 - RNA, 15 nt, Salmonella typhimurium LT2
gacgcccugcgccag

SEQ ID NO: 3770125 - RNA, 16 nt, Salmonella typhimurium LT2
gacgccgauaaagccu

SEQ ID NO: 3770126 - RNA, 16 nt, Salmonella typhimurium LT2
gacgccgccauccggu

SEQ ID NO: 3770127 - RNA, 18 nt, Salmonella typhimurium LT2
gacgccgggaaauuuuuc

SEQ ID NO: 3770128 - RNA, 21 nt, Salmonella typhimurium LT2
gacgccggguaaacgcagcgu

SEQ ID NO: 3770129 - RNA, 20 nt, Salmonella typhimurium LT2
gacgccguucaaagccgcca

SEQ ID NO: 3770130 - RNA, 21 nt, Salmonella typhimurium LT2
gacgccguucaaagccgccau

SEQ ID NO: 3770131 - RNA, 18 nt, Salmonella typhimurium LT2
gacgccuguaaugccgcc

SEQ ID NO: 3770132 - RNA, 18 nt, Salmonella typhimurium LT2
gacgccuuucuucacgau

SEQ ID NO: 3770133 - RNA, 22 nt, Salmonella typhimurium LT2
gacgcgaauugcgaguaaccuu

SEQ ID NO: 3770134 - RNA, 13 nt, Salmonella typhimurium LT2
gacucaaagaaaa

SEQ ID NO: 3770135 - RNA, 19 nt, Salmonella typhimurium LT2
gacucaccagcacgcaggc

SEQ ID NO: 3770136 - RNA, 21 nt, Salmonella typhimurium LT2
gacucaccagcacgcaggcau

SEQ ID NO: 3770137 - RNA, 20 nt, Salmonella typhimurium LT2
gacucaccccuucuuuaucu

SEQ ID NO: 3770138 - RNA, 23 nt, Salmonella typhimurium LT2
gacucaccgcuaaucccagcgcg

SEQ ID NO: 3770139 - RNA, 20 nt, Salmonella typhimurium LT2
gacucaguucgcgacccaga

SEQ ID NO: 3770140 - RNA, 16 nt, Salmonella typhimurium LT2
gacucauaaugucucc

SEQ ID NO: 3770141 - RNA, 16 nt, Salmonella typhimurium LT2
gacucauccacauacu

SEQ ID NO: 3770142 - RNA, 17 nt, Salmonella typhimurium LT2
gacucauucagcaacug

SEQ ID NO: 3770143 - RNA, 20 nt, Salmonella typhimurium LT2
gacucauucagcaacugcgu

SEQ ID NO: 3770144 - RNA, 22 nt, Salmonella typhimurium LT2
gacucccaggcgcgcagcugcc

SEQ ID NO: 3770145 - RNA, 22 nt, Salmonella typhimurium LT2
gacuccggauagagaucuuccg

SEQ ID NO: 3770146 - RNA, 23 nt, Salmonella typhimurium LT2
gacuccugacagguauggugcuc

SEQ ID NO: 3770147 - RNA, 22 nt, Salmonella typhimurium LT2
gacucgaaccaucgacccccac

SEQ ID NO: 3770148 - RNA, 21 nt, Salmonella typhimurium LT2
gacucgcgccuucgccggguu

SEQ ID NO: 3770149 - RNA, 18 nt, Salmonella typhimurium LT2
gacucgcuacgcucgccc

SEQ ID NO: 3770150 - RNA, 23 nt, Salmonella typhimurium LT2
gacucugaagcgggaaagcguaa

SEQ ID NO: 3770151 - RNA, 19 nt, Salmonella typhimurium LT2
gacucuguggccgcgcaug

SEQ ID NO: 3770152 - RNA, 16 nt, Salmonella typhimurium LT2
gacugaaaaaagcgau

SEQ ID NO: 3770153 - RNA, 14 nt, Salmonella typhimurium LT2
gacugaaaaucaaa

SEQ ID NO: 3770154 - RNA, 14 nt, Salmonella typhimurium LT2
gacugacaaugacg

SEQ ID NO: 3770155 - RNA, 14 nt, Salmonella typhimurium LT2
gacugaccagaccg

SEQ ID NO: 3770156 - RNA, 20 nt, Salmonella typhimurium LT2
gacugaguauuggcaagaau

SEQ ID NO: 3770157 - RNA, 15 nt, Salmonella typhimurium LT2
gacugcccaacagca

SEQ ID NO: 3770158 - RNA, 19 nt, Salmonella typhimurium LT2
gacugccguauaauccagc

SEQ ID NO: 3770159 - RNA, 21 nt, Salmonella typhimurium LT2
gacugccuaacuggaaaaaga

SEQ ID NO: 3770160 - RNA, 19 nt, Salmonella typhimurium LT2
gacugccuacgcggccaaa

SEQ ID NO: 3770161 - RNA, 15 nt, Salmonella typhimurium LT2
gacugcgcauuaaca

SEQ ID NO: 3770162 - RNA, 16 nt, Salmonella typhimurium LT2
gacugcggggagcgaa

SEQ ID NO: 3770163 - RNA, 17 nt, Salmonella typhimurium LT2
gacugcgugagcgugga

SEQ ID NO: 3770164 - RNA, 13 nt, Salmonella typhimurium LT2
gacugcguuaucg

SEQ ID NO: 3770165 - RNA, 18 nt, Salmonella typhimurium LT2
gacugcuaacagucgauc

SEQ ID NO: 3770166 - RNA, 15 nt, Salmonella typhimurium LT2
gacugcugccggaaa

SEQ ID NO: 3770167 - RNA, 14 nt, Salmonella typhimurium LT2
gacugcuucgcugg

SEQ ID NO: 3770168 - RNA, 14 nt, Salmonella typhimurium LT2
gacuggcccugccg

SEQ ID NO: 3770169 - RNA, 22 nt, Salmonella typhimurium LT2
gacuggcugagcucacuuuuug

SEQ ID NO: 3770170 - RNA, 14 nt, Salmonella typhimurium LT2
gacuggucgcccgg

SEQ ID NO: 3770171 - RNA, 20 nt, Salmonella typhimurium LT2
gacugguggcaagauaagcc

SEQ ID NO: 3770172 - RNA, 11 nt, Salmonella typhimurium LT2
gacuguccacg

SEQ ID NO: 3770173 - RNA, 14 nt, Salmonella typhimurium LT2
gacuguccacgacg

SEQ ID NO: 3770174 - RNA, 20 nt, Salmonella typhimurium LT2
gacuguccacgacgcuauau

SEQ ID NO: 3770175 - RNA, 16 nt, Salmonella typhimurium LT2
gacugucgaaaccagc

SEQ ID NO: 3770176 - RNA, 14 nt, Salmonella typhimurium LT2
gacugucgagaugc

SEQ ID NO: 3770177 - RNA, 16 nt, Salmonella typhimurium LT2
gacugugauggcgguc

SEQ ID NO: 3770178 - RNA, 15 nt, Salmonella typhimurium LT2
gacuguucacaucca

SEQ ID NO: 3770179 - RNA, 13 nt, Salmonella typhimurium LT2
gacuuaaaagaau

SEQ ID NO: 3770180 - RNA, 23 nt, Salmonella typhimurium LT2
gacuuacgcacuguuggcguuga

SEQ ID NO: 3770181 - RNA, 19 nt, Salmonella typhimurium LT2
gacuuacgcagcauuagcc

SEQ ID NO: 3770182 - RNA, 13 nt, Salmonella typhimurium LT2
gacuuaucaggcc

SEQ ID NO: 3770183 - RNA, 17 nt, Salmonella typhimurium LT2
gacuuaucaggccuacg

SEQ ID NO: 3770184 - RNA, 18 nt, Salmonella typhimurium LT2
gacuuaucaggccuacgg

SEQ ID NO: 3770185 - RNA, 14 nt, Salmonella typhimurium LT2
gacuuauucaauca

SEQ ID NO: 3770186 - RNA, 20 nt, Salmonella typhimurium LT2
gacuuccgcacgcgcgcccu

SEQ ID NO: 3770187 - RNA, 14 nt, Salmonella typhimurium LT2
gacuucgccucagc

SEQ ID NO: 3770188 - RNA, 17 nt, Salmonella typhimurium LT2
gacuucgcuuccugcau

SEQ ID NO: 3770189 - RNA, 17 nt, Salmonella typhimurium LT2
gacuucgucaaagaucu

SEQ ID NO: 3770190 - RNA, 21 nt, Salmonella typhimurium LT2
gacuucuuagguuuguagcgc

SEQ ID NO: 3770191 - RNA, 22 nt, Salmonella typhimurium LT2
gacuucuuagguuuguagcgca

SEQ ID NO: 3770192 - RNA, 17 nt, Salmonella typhimurium LT2
gacuuuacaccccacua

SEQ ID NO: 3770193 - RNA, 16 nt, Salmonella typhimurium LT2
gacuuugaccagcauc

SEQ ID NO: 3770194 - RNA, 18 nt, Salmonella typhimurium LT2
gacuuuuuccccgcgcug

SEQ ID NO: 3770195 - RNA, 20 nt, Salmonella typhimurium LT2
gacuuuuuugccuuucagau

SEQ ID NO: 3770196 - RNA, 17 nt, Salmonella typhimurium LT2
gagaaaaacaucauggc

SEQ ID NO: 3770197 - RNA, 22 nt, Salmonella typhimurium LT2
gagaaaaacgaccaggaucaga

SEQ ID NO: 3770198 - RNA, 14 nt, Salmonella typhimurium LT2
gagaaaaagcgaag

SEQ ID NO: 3770199 - RNA, 22 nt, Salmonella typhimurium LT2
gagaaaaauacgccagauaacg

SEQ ID NO: 3770200 - RNA, 19 nt, Salmonella typhimurium LT2
gagaaaauaccgcacauca

SEQ ID NO: 3770201 - RNA, 15 nt, Salmonella typhimurium LT2
gagaaaauagaggaa

SEQ ID NO: 3770202 - RNA, 13 nt, Salmonella typhimurium LT2
gagaaagcugcgc

SEQ ID NO: 3770203 - RNA, 12 nt, Salmonella typhimurium LT2
gagaaaguggug

SEQ ID NO: 3770204 - RNA, 17 nt, Salmonella typhimurium LT2
gagaaagugguggguga

SEQ ID NO: 3770205 - RNA, 11 nt, Salmonella typhimurium LT2
gagaaaucaac

SEQ ID NO: 3770206 - RNA, 23 nt, Salmonella typhimurium LT2
gagaaauuuaggucaaaaaagcg

SEQ ID NO: 3770207 - RNA, 16 nt, Salmonella typhimurium LT2
gagaacagguaguuac

SEQ ID NO: 3770208 - RNA, 14 nt, Salmonella typhimurium LT2
gagaacgagaaacu

SEQ ID NO: 3770209 - RNA, 17 nt, Salmonella typhimurium LT2
gagaacugcugcauccg

SEQ ID NO: 3770210 - RNA, 18 nt, Salmonella typhimurium LT2
gagaagccuuuuuucacc

SEQ ID NO: 3770211 - RNA, 16 nt, Salmonella typhimurium LT2
gagaagcgcgccugcc

SEQ ID NO: 3770212 - RNA, 15 nt, Salmonella typhimurium LT2
gagaagcuuuuucuu

SEQ ID NO: 3770213 - RNA, 15 nt, Salmonella typhimurium LT2
gagaaggucagucca

SEQ ID NO: 3770214 - RNA, 19 nt, Salmonella typhimurium LT2
gagaaucaccuggcagccg

SEQ ID NO: 3770215 - RNA, 15 nt, Salmonella typhimurium LT2
gagaaucgaucagcu

SEQ ID NO: 3770216 - RNA, 15 nt, Salmonella typhimurium LT2
gagaaucgccaggau

SEQ ID NO: 3770217 - RNA, 17 nt, Salmonella typhimurium LT2
gagaauggaugugaaug

SEQ ID NO: 3770218 - RNA, 16 nt, Salmonella typhimurium LT2
gagaauggccagcaca

SEQ ID NO: 3770219 - RNA, 23 nt, Salmonella typhimurium LT2
gagaauggucgguauuaucaaug

SEQ ID NO: 3770220 - RNA, 21 nt, Salmonella typhimurium LT2
gagaauugacgauaucaucuu

SEQ ID NO: 3770221 - RNA, 16 nt, Salmonella typhimurium LT2
gagaauuuccaguuca

SEQ ID NO: 3770222 - RNA, 16 nt, Salmonella typhimurium LT2
gagacagagaaccuga

SEQ ID NO: 3770223 - RNA, 17 nt, Salmonella typhimurium LT2
gagacagagaaccugaa

SEQ ID NO: 3770224 - RNA, 21 nt, Salmonella typhimurium LT2
gagacagagaaccugaacaau

SEQ ID NO: 3770225 - RNA, 21 nt, Salmonella typhimurium LT2
gagacauugguuucaugcauc

SEQ ID NO: 3770226 - RNA, 16 nt, Salmonella typhimurium LT2
gagacgcgaaacgaaa

SEQ ID NO: 3770227 - RNA, 22 nt, Salmonella typhimurium LT2
gagacguucauuucuuccagca

SEQ ID NO: 3770228 - RNA, 13 nt, Salmonella typhimurium LT2
gagacugccgccg

SEQ ID NO: 3770229 - RNA, 20 nt, Salmonella typhimurium LT2
gagacuguuugacacuauau

SEQ ID NO: 3770230 - RNA, 14 nt, Salmonella typhimurium LT2
gagagaaacaacac

SEQ ID NO: 3770231 - RNA, 23 nt, Salmonella typhimurium LT2
gagagaguugagccagauaguga

SEQ ID NO: 3770232 - RNA, 20 nt, Salmonella typhimurium LT2
gagagcaguacgccaaaaaa

SEQ ID NO: 3770233 - RNA, 13 nt, Salmonella typhimurium LT2
gagagcaucaucu

SEQ ID NO: 3770234 - RNA, 21 nt, Salmonella typhimurium LT2
gagagcgauaaacucagcgcc

SEQ ID NO: 3770235 - RNA, 20 nt, Salmonella typhimurium LT2
gagagcgcuucuaacaaaac

SEQ ID NO: 3770236 - RNA, 16 nt, Salmonella typhimurium LT2
gagagcgggccguggc

SEQ ID NO: 3770237 - RNA, 18 nt, Salmonella typhimurium LT2
gagagcguauccagcacc

SEQ ID NO: 3770238 - RNA, 12 nt, Salmonella typhimurium LT2
gagcuaaauauc

SEQ ID NO: 3770239 - RNA, 18 nt, Salmonella typhimurium LT2
gagcuaaucacccacuuc

SEQ ID NO: 3770240 - RNA, 18 nt, Salmonella typhimurium LT2
gagcucccgguucgccgc

SEQ ID NO: 3770241 - RNA, 13 nt, Salmonella typhimurium LT2
gagcucucuucca

SEQ ID NO: 3770242 - RNA, 14 nt, Salmonella typhimurium LT2
gagcuggcggcgga

SEQ ID NO: 3770243 - RNA, 16 nt, Salmonella typhimurium LT2
gagcuggugcgcgacu

SEQ ID NO: 3770244 - RNA, 18 nt, Salmonella typhimurium LT2
gagcugugguucguucaa

SEQ ID NO: 3770245 - RNA, 18 nt, Salmonella typhimurium LT2
gagcuuugacgacccgcu

SEQ ID NO: 3770246 - RNA, 12 nt, Salmonella typhimurium LT2
gagcuuuuccug

SEQ ID NO: 3770247 - RNA, 14 nt, Salmonella typhimurium LT2
gagcuuuuuuuugc

SEQ ID NO: 3770248 - RNA, 18 nt, Salmonella typhimurium LT2
gaggaaaccuuucuucuc

SEQ ID NO: 3770249 - RNA, 15 nt, Salmonella typhimurium LT2
gaggaacaucagcca

SEQ ID NO: 3770250 - RNA, 17 nt, Salmonella typhimurium LT2
gaggaacuguucagcca

SEQ ID NO: 3770251 - RNA, 24 nt, Salmonella typhimurium LT2
gaggaacuguucagccagcaaggc

SEQ ID NO: 3770252 - RNA, 21 nt, Salmonella typhimurium LT2
gaggacgcacucucaaacuau

SEQ ID NO: 3770253 - RNA, 18 nt, Salmonella typhimurium LT2
gaggacgucugucagaac

SEQ ID NO: 3770254 - RNA, 20 nt, Salmonella typhimurium LT2
gaggaguaguuaaaaaaggu

SEQ ID NO: 3770255 - RNA, 21 nt, Salmonella typhimurium LT2
gaggagucauugcuaugccug

SEQ ID NO: 3770256 - RNA, 21 nt, Salmonella typhimurium LT2
gaggaugaaaaguauggcggu

SEQ ID NO: 3770257 - RNA, 23 nt, Salmonella typhimurium LT2
gaggauugccgccuugguugccg

SEQ ID NO: 3770258 - RNA, 16 nt, Salmonella typhimurium LT2
gaggcaaaaugccagc

SEQ ID NO: 3770259 - RNA, 19 nt, Salmonella typhimurium LT2
gaggcaacagauacggcgc

SEQ ID NO: 3770260 - RNA, 21 nt, Salmonella typhimurium LT2
gaggcauggcgauuacccagu

SEQ ID NO: 3770261 - RNA, 16 nt, Salmonella typhimurium LT2
gaggccaccagcgcca

SEQ ID NO: 3770262 - RNA, 18 nt, Salmonella typhimurium LT2
gaggccagauucaccacc

SEQ ID NO: 3770263 - RNA, 16 nt, Salmonella typhimurium LT2
gaggccggauggcggu

SEQ ID NO: 3770264 - RNA, 23 nt, Salmonella typhimurium LT2
gaggccuuaacccccauuuccgu

SEQ ID NO: 3770265 - RNA, 23 nt, Salmonella typhimurium LT2
gaggcgcagccgccauccggcaa

SEQ ID NO: 3770266 - RNA, 15 nt, Salmonella typhimurium LT2
gaggcggucuggauu

SEQ ID NO: 3770267 - RNA, 17 nt, Salmonella typhimurium LT2
gaggcuaaucaggaaga

SEQ ID NO: 3770268 - RNA, 14 nt, Salmonella typhimurium LT2
gaggcugccgauga

SEQ ID NO: 3770269 - RNA, 15 nt, Salmonella typhimurium LT2
gaggcuugcagcauu

SEQ ID NO: 3770270 - RNA, 15 nt, Salmonella typhimurium LT2
gagggauuaucuuua

SEQ ID NO: 3770271 - RNA, 20 nt, Salmonella typhimurium LT2
gagggcgcgccguugaaauc

SEQ ID NO: 3770272 - RNA, 23 nt, Salmonella typhimurium LT2
gaggggcacgcccgcauucauaa

SEQ ID NO: 3770273 - RNA, 22 nt, Salmonella typhimurium LT2
gagggguuucaauuccacaggc

SEQ ID NO: 3770274 - RNA, 15 nt, Salmonella typhimurium LT2
gaggguugauaaccc

SEQ ID NO: 3770275 - RNA, 17 nt, Salmonella typhimurium LT2
gaggucguccucuggcc

SEQ ID NO: 3770276 - RNA, 16 nt, Salmonella typhimurium LT2
gaggugaauaaauccu

SEQ ID NO: 3770277 - RNA, 20 nt, Salmonella typhimurium LT2
gaggugcucucccagcugag

SEQ ID NO: 3770278 - RNA, 21 nt, Salmonella typhimurium LT2
gagguggaauacaaacccagg

SEQ ID NO: 3770279 - RNA, 16 nt, Salmonella typhimurium LT2
gagguguauguaacug

SEQ ID NO: 3770280 - RNA, 17 nt, Salmonella typhimurium LT2
gagguuuccggcgggag

SEQ ID NO: 3770281 - RNA, 13 nt, Salmonella typhimurium LT2
gagguuucuucau

SEQ ID NO: 3770282 - RNA, 16 nt, Salmonella typhimurium LT2
gagguuucuucaucaa

SEQ ID NO: 3770283 - RNA, 18 nt, Salmonella typhimurium LT2
gagguuuucucauccagc

SEQ ID NO: 3770284 - RNA, 12 nt, Salmonella typhimurium LT2
gaguaaauaaaa

SEQ ID NO: 3770285 - RNA, 16 nt, Salmonella typhimurium LT2
gaguaaauaaaucagc

SEQ ID NO: 3770286 - RNA, 20 nt, Salmonella typhimurium LT2
gaguaaguuucgcugcacuu

SEQ ID NO: 3770287 - RNA, 17 nt, Salmonella typhimurium LT2
gaguaaucacuaacuag

SEQ ID NO: 3770288 - RNA, 18 nt, Salmonella typhimurium LT2
gaguaauccguagccaac

SEQ ID NO: 3770289 - RNA, 18 nt, Salmonella typhimurium LT2
gaguaaugacaaaaauua

SEQ ID NO: 3770290 - RNA, 20 nt, Salmonella typhimurium LT2
gaguaauguucaguuuuucc

SEQ ID NO: 3770291 - RNA, 23 nt, Salmonella typhimurium LT2
gaguaauguucaguuuuuccagc

SEQ ID NO: 3770292 - RNA, 21 nt, Salmonella typhimurium LT2
gaguaccgccuuguccggccu

SEQ ID NO: 3770293 - RNA, 16 nt, Salmonella typhimurium LT2
gaguacgccgauagcg

SEQ ID NO: 3770294 - RNA, 16 nt, Salmonella typhimurium LT2
gaguacggaacaaaac

SEQ ID NO: 3770295 - RNA, 19 nt, Salmonella typhimurium LT2
gaguacggaacaaaacgga

SEQ ID NO: 3770296 - RNA, 12 nt, Salmonella typhimurium LT2
gaguagauguag

SEQ ID NO: 3770297 - RNA, 16 nt, Salmonella typhimurium LT2
gaguaguuaaaaaagg

SEQ ID NO: 3770298 - RNA, 17 nt, Salmonella typhimurium LT2
gaguauacagacagcag

SEQ ID NO: 3770299 - RNA, 18 nt, Salmonella typhimurium LT2
gaguaugaacaggcagcg

SEQ ID NO: 3770300 - RNA, 21 nt, Salmonella typhimurium LT2
gaguaugcccgcgagagauua

SEQ ID NO: 3770301 - RNA, 18 nt, Salmonella typhimurium LT2
gagucaaaagauugauuu

SEQ ID NO: 3770302 - RNA, 14 nt, Salmonella typhimurium LT2
gagucaccagcacu

SEQ ID NO: 3770303 - RNA, 18 nt, Salmonella typhimurium LT2
gagucagaaacggccagg

SEQ ID NO: 3770304 - RNA, 14 nt, Salmonella typhimurium LT2
gaguccagcggcag

SEQ ID NO: 3770305 - RNA, 15 nt, Salmonella typhimurium LT2
gaguccagcggcagc

SEQ ID NO: 3770306 - RNA, 14 nt, Salmonella typhimurium LT2
gaguccauuuccuc

SEQ ID NO: 3770307 - RNA, 18 nt, Salmonella typhimurium LT2
gagucgauaaaucgccac

SEQ ID NO: 3770308 - RNA, 16 nt, Salmonella typhimurium LT2
gagucgcagcggcggu

SEQ ID NO: 3770309 - RNA, 14 nt, Salmonella typhimurium LT2
gagucgcuuaucug

SEQ ID NO: 3770310 - RNA, 13 nt, Salmonella typhimurium LT2
gagucuaaaaaua

SEQ ID NO: 3770311 - RNA, 14 nt, Salmonella typhimurium LT2
gagucuacaucaag

SEQ ID NO: 3770312 - RNA, 22 nt, Salmonella typhimurium LT2
gagugacgcagacgucaacacc

SEQ ID NO: 3770313 - RNA, 17 nt, Salmonella typhimurium LT2
gagugacgggcuggcgc

SEQ ID NO: 3770314 - RNA, 18 nt, Salmonella typhimurium LT2
gagugacgguuuucacug

SEQ ID NO: 3770315 - RNA, 15 nt, Salmonella typhimurium LT2
gagugccagaaacau

SEQ ID NO: 3770316 - RNA, 13 nt, Salmonella typhimurium LT2
gagugccagcccc

SEQ ID NO: 3770317 - RNA, 15 nt, Salmonella typhimurium LT2
gagugcguucuucca

SEQ ID NO: 3770318 - RNA, 20 nt, Salmonella typhimurium LT2
gagugcuuauguaggccuga

SEQ ID NO: 3770319 - RNA, 17 nt, Salmonella typhimurium LT2
gaguggagcggucgaca

SEQ ID NO: 3770320 - RNA, 13 nt, Salmonella typhimurium LT2
gaguuaucuuuua

SEQ ID NO: 3770321 - RNA, 15 nt, Salmonella typhimurium LT2
gaguucaauaagcga

SEQ ID NO: 3770322 - RNA, 12 nt, Salmonella typhimurium LT2
gaguuccggaua

SEQ ID NO: 3770323 - RNA, 17 nt, Salmonella typhimurium LT2
gaguuccugugcggcau

SEQ ID NO: 3770324 - RNA, 17 nt, Salmonella typhimurium LT2
gaguucgccaugagcgu

SEQ ID NO: 3770325 - RNA, 15 nt, Salmonella typhimurium LT2
gaguucgguuaacug

SEQ ID NO: 3770326 - RNA, 14 nt, Salmonella typhimurium LT2
gaguugaaaccgcg

SEQ ID NO: 3770327 - RNA, 19 nt, Salmonella typhimurium LT2
gaguugaagcgauguaaga

SEQ ID NO: 3770328 - RNA, 14 nt, Salmonella typhimurium LT2
gaguugaauaacgu

SEQ ID NO: 3770329 - RNA, 23 nt, Salmonella typhimurium LT2
gaguuggcauucgaauccuccug

SEQ ID NO: 3770330 - RNA, 15 nt, Salmonella typhimurium LT2
gaguuguuucaacau

SEQ ID NO: 3770331 - RNA, 18 nt, Salmonella typhimurium LT2
gauaaaaacacccgcacc

SEQ ID NO: 3770332 - RNA, 16 nt, Salmonella typhimurium LT2
gauaaaaagacagaua

SEQ ID NO: 3770333 - RNA, 18 nt, Salmonella typhimurium LT2
gauaaaaagacagauaaa

SEQ ID NO: 3770334 - RNA, 16 nt, Salmonella typhimurium LT2
gauaaaacgcaggcag

SEQ ID NO: 3770335 - RNA, 15 nt, Salmonella typhimurium LT2
gauaaaaucgccaaa

SEQ ID NO: 3770336 - RNA, 16 nt, Salmonella typhimurium LT2
gauaaacaccggaauu

SEQ ID NO: 3770337 - RNA, 15 nt, Salmonella typhimurium LT2
gauaaaccaacagcc

SEQ ID NO: 3770338 - RNA, 22 nt, Salmonella typhimurium LT2
gauaaaccaacagccgccuguu

SEQ ID NO: 3770339 - RNA, 18 nt, Salmonella typhimurium LT2
gauaaacgacagcgccau

SEQ ID NO: 3770340 - RNA, 14 nt, Salmonella typhimurium LT2
gauaaacgccagcc

SEQ ID NO: 3770341 - RNA, 19 nt, Salmonella typhimurium LT2
gauaaacgccccuucauca

SEQ ID NO: 3770342 - RNA, 12 nt, Salmonella typhimurium LT2
gauaccagauua

SEQ ID NO: 3770343 - RNA, 22 nt, Salmonella typhimurium LT2
gauaccagccuucggacugcug

SEQ ID NO: 3770344 - RNA, 15 nt, Salmonella typhimurium LT2
gauaccaguacaaca

SEQ ID NO: 3770345 - RNA, 19 nt, Salmonella typhimurium LT2
gauacccagcgucccggcg

SEQ ID NO: 3770346 - RNA, 17 nt, Salmonella typhimurium LT2
gauacccgcccagauca

SEQ ID NO: 3770347 - RNA, 13 nt, Salmonella typhimurium LT2
gauacccugaauc

SEQ ID NO: 3770348 - RNA, 22 nt, Salmonella typhimurium LT2
gauaccgccuuaccgcgguauu

SEQ ID NO: 3770349 - RNA, 22 nt, Salmonella typhimurium LT2
gauaccggaggagugcgccagu

SEQ ID NO: 3770350 - RNA, 21 nt, Salmonella typhimurium LT2
gauaccggcgcagcaucugcg

SEQ ID NO: 3770351 - RNA, 20 nt, Salmonella typhimurium LT2
gauaccuaaucccuggcgaa

SEQ ID NO: 3770352 - RNA, 22 nt, Salmonella typhimurium LT2
gauaccuguugcacgcauggca

SEQ ID NO: 3770353 - RNA, 14 nt, Salmonella typhimurium LT2
gauacgcagaaccg

SEQ ID NO: 3770354 - RNA, 21 nt, Salmonella typhimurium LT2
gauacgcagaaccgccgcgau

SEQ ID NO: 3770355 - RNA, 14 nt, Salmonella typhimurium LT2
gauacgccagcaga

SEQ ID NO: 3770356 - RNA, 15 nt, Salmonella typhimurium LT2
gauacgccagcagac

SEQ ID NO: 3770357 - RNA, 14 nt, Salmonella typhimurium LT2
gauacgccagguua

SEQ ID NO: 3770358 - RNA, 14 nt, Salmonella typhimurium LT2
gauacgccuggaua

SEQ ID NO: 3770359 - RNA, 16 nt, Salmonella typhimurium LT2
gauacgcggcugaugc

SEQ ID NO: 3770360 - RNA, 19 nt, Salmonella typhimurium LT2
gauacgcguugccaucgca

SEQ ID NO: 3770361 - RNA, 20 nt, Salmonella typhimurium LT2
gauacgcuguaguuccugua

SEQ ID NO: 3770362 - RNA, 16 nt, Salmonella typhimurium LT2
gauacggcccagaccc

SEQ ID NO: 3770363 - RNA, 15 nt, Salmonella typhimurium LT2
gauacggcgagacca

SEQ ID NO: 3770364 - RNA, 15 nt, Salmonella typhimurium LT2
gauacggcuccagca

SEQ ID NO: 3770365 - RNA, 17 nt, Salmonella typhimurium LT2
gauacggcuccagcaca

SEQ ID NO: 3770366 - RNA, 14 nt, Salmonella typhimurium LT2
gauacgucaucaug

SEQ ID NO: 3770367 - RNA, 15 nt, Salmonella typhimurium LT2
gauacguuccagcag

SEQ ID NO: 3770368 - RNA, 19 nt, Salmonella typhimurium LT2
gauacugacacgccaguuc

SEQ ID NO: 3770369 - RNA, 17 nt, Salmonella typhimurium LT2
gauacugcaacgccaga

SEQ ID NO: 3770370 - RNA, 21 nt, Salmonella typhimurium LT2
gauacugcaacgccagaugcg

SEQ ID NO: 3770371 - RNA, 21 nt, Salmonella typhimurium LT2
gauacugccgcccaucgccac

SEQ ID NO: 3770372 - RNA, 18 nt, Salmonella typhimurium LT2
gauacugcuccggcgcga

SEQ ID NO: 3770373 - RNA, 21 nt, Salmonella typhimurium LT2
gauacuggaagugaucuuuca

SEQ ID NO: 3770374 - RNA, 12 nt, Salmonella typhimurium LT2
gauacugugucg

SEQ ID NO: 3770375 - RNA, 13 nt, Salmonella typhimurium LT2
gauagaaaacaua

SEQ ID NO: 3770376 - RNA, 19 nt, Salmonella typhimurium LT2
gauagaaccacgcaaaggc

SEQ ID NO: 3770377 - RNA, 16 nt, Salmonella typhimurium LT2
gauagaaguuaugcau

SEQ ID NO: 3770378 - RNA, 17 nt, Salmonella typhimurium LT2
gauagaccacgccauca

SEQ ID NO: 3770379 - RNA, 20 nt, Salmonella typhimurium LT2
gauagagcgcggucagguuc

SEQ ID NO: 3770380 - RNA, 22 nt, Salmonella typhimurium LT2
gauagagguuaccgggcuaaac

SEQ ID NO: 3770381 - RNA, 12 nt, Salmonella typhimurium LT2
gauagcauuuuu

SEQ ID NO: 3770382 - RNA, 15 nt, Salmonella typhimurium LT2
gauagccagaaugac

SEQ ID NO: 3770383 - RNA, 17 nt, Salmonella typhimurium LT2
gauagcccauccagcac

SEQ ID NO: 3770384 - RNA, 17 nt, Salmonella typhimurium LT2
gauagccguucuccagc

SEQ ID NO: 3770385 - RNA, 18 nt, Salmonella typhimurium LT2
gauagccguucuccagcg

SEQ ID NO: 3770386 - RNA, 22 nt, Salmonella typhimurium LT2
gauagccguugucauggcgcca

SEQ ID NO: 3770387 - RNA, 15 nt, Salmonella typhimurium LT2
gauagccuuccaccg

SEQ ID NO: 3770388 - RNA, 14 nt, Salmonella typhimurium LT2
gauagcgaaccauc

SEQ ID NO: 3770389 - RNA, 21 nt, Salmonella typhimurium LT2
gauagcgaccugcggacuguu

SEQ ID NO: 3770390 - RNA, 16 nt, Salmonella typhimurium LT2
gauagcgagcaagacu

SEQ ID NO: 3770391 - RNA, 16 nt, Salmonella typhimurium LT2
gauagcgagcgauaga

SEQ ID NO: 3770392 - RNA, 15 nt, Salmonella typhimurium LT2
gauagcgaggcagca

SEQ ID NO: 3770393 - RNA, 21 nt, Salmonella typhimurium LT2
gauagcgccuuguuuaucaga

SEQ ID NO: 3770394 - RNA, 15 nt, Salmonella typhimurium LT2
gauagcgcgccagca

SEQ ID NO: 3770395 - RNA, 18 nt, Salmonella typhimurium LT2
gauagcgcggaauaucaa

SEQ ID NO: 3770396 - RNA, 14 nt, Salmonella typhimurium LT2
gauagcgcuuucca

SEQ ID NO: 3770397 - RNA, 15 nt, Salmonella typhimurium LT2
gauagcguuuuccag

SEQ ID NO: 3770398 - RNA, 22 nt, Salmonella typhimurium LT2
gauagcugguaaauaacgggcg

SEQ ID NO: 3770399 - RNA, 23 nt, Salmonella typhimurium LT2
gauagcuuguuguuuauccugca

SEQ ID NO: 3770400 - RNA, 17 nt, Salmonella typhimurium LT2
gauaggagacgccgccc

SEQ ID NO: 3770401 - RNA, 13 nt, Salmonella typhimurium LT2
gauaggccgcuau

SEQ ID NO: 3770402 - RNA, 21 nt, Salmonella typhimurium LT2
gauaggcucaauaugccaggc

SEQ ID NO: 3770403 - RNA, 22 nt, Salmonella typhimurium LT2
gauaggcucaauaugccaggca

SEQ ID NO: 3770404 - RNA, 23 nt, Salmonella typhimurium LT2
gauaggcucaauaugccaggcau

SEQ ID NO: 3770405 - RNA, 18 nt, Salmonella typhimurium LT2
gauagucauugacagcaa

SEQ ID NO: 3770406 - RNA, 19 nt, Salmonella typhimurium LT2
gauaguguaaacgcgccau

SEQ ID NO: 3770407 - RNA, 19 nt, Salmonella typhimurium LT2
gauaguguucgcggcuggu

SEQ ID NO: 3770408 - RNA, 18 nt, Salmonella typhimurium LT2
gauaguugagcagcgcga

SEQ ID NO: 3770409 - RNA, 20 nt, Salmonella typhimurium LT2
gauaguuuaaauccagcgcg

SEQ ID NO: 3770410 - RNA, 22 nt, Salmonella typhimurium LT2
gauauaaaacgggccacugcug

SEQ ID NO: 3770411 - RNA, 17 nt, Salmonella typhimurium LT2
gauauaacccucauccc

SEQ ID NO: 3770412 - RNA, 17 nt, Salmonella typhimurium LT2
gauauaaccgucuucau

SEQ ID NO: 3770413 - RNA, 20 nt, Salmonella typhimurium LT2
gauauaaccgucuucaucca

SEQ ID NO: 3770414 - RNA, 17 nt, Salmonella typhimurium LT2
gauauagaccagcgccg

SEQ ID NO: 3770415 - RNA, 23 nt, Salmonella typhimurium LT2
gauauagaguccagccauaauca

SEQ ID NO: 3770416 - RNA, 16 nt, Salmonella typhimurium LT2
gauauagcgccaugcg

SEQ ID NO: 3770417 - RNA, 19 nt, Salmonella typhimurium LT2
gauauagcggugcguuucc

SEQ ID NO: 3770418 - RNA, 21 nt, Salmonella typhimurium LT2
gauauagcugcgauccagguc

SEQ ID NO: 3770419 - RNA, 19 nt, Salmonella typhimurium LT2
gauauaggguggucacgcc

SEQ ID NO: 3770420 - RNA, 23 nt, Salmonella typhimurium LT2
gauauaucuucaucguuucugcc

SEQ ID NO: 3770421 - RNA, 13 nt, Salmonella typhimurium LT2
gauauaugcaaaa

SEQ ID NO: 3770422 - RNA, 19 nt, Salmonella typhimurium LT2
gauaucaacgucuugccau

SEQ ID NO: 3770423 - RNA, 19 nt, Salmonella typhimurium LT2
gauaucaggacuuuuuccc

SEQ ID NO: 3770424 - RNA, 13 nt, Salmonella typhimurium LT2
gauauccacguuc

SEQ ID NO: 3770425 - RNA, 18 nt, Salmonella typhimurium LT2
gauauccgcgcucaacac

SEQ ID NO: 3770426 - RNA, 14 nt, Salmonella typhimurium LT2
gauaucgccccaga

SEQ ID NO: 3770427 - RNA, 23 nt, Salmonella typhimurium LT2
gauaucgccugcuuugaccuguu

SEQ ID NO: 3770428 - RNA, 18 nt, Salmonella typhimurium LT2
gauaucgcuaaccaggcc

SEQ ID NO: 3770429 - RNA, 13 nt, Salmonella typhimurium LT2
gauaucgcuggcc

SEQ ID NO: 3770430 - RNA, 23 nt, Salmonella typhimurium LT2
gauaucuguauaaauaaaauugu

SEQ ID NO: 3770431 - RNA, 12 nt, Salmonella typhimurium LT2
gauaucuuccag

SEQ ID NO: 3770432 - RNA, 23 nt, Salmonella typhimurium LT2
gauaugaauaauuucggcggcgc

SEQ ID NO: 3770433 - RNA, 24 nt, Salmonella typhimurium LT2
gauaugacccgggcgugacagggg

SEQ ID NO: 3770434 - RNA, 13 nt, Salmonella typhimurium LT2
gauaugcagcagc

SEQ ID NO: 3770435 - RNA, 14 nt, Salmonella typhimurium LT2
gauaugcagcagcc

SEQ ID NO: 3770436 - RNA, 18 nt, Salmonella typhimurium LT2
gauaugcgacgaaagcgg

SEQ ID NO: 3770437 - RNA, 19 nt, Salmonella typhimurium LT2
gauaugcgacgaaagcggc

SEQ ID NO: 3770438 - RNA, 18 nt, Salmonella typhimurium LT2
gauaugcuugccggaugc

SEQ ID NO: 3770439 - RNA, 14 nt, Salmonella typhimurium LT2
gauauuauuaaaau

SEQ ID NO: 3770440 - RNA, 15 nt, Salmonella typhimurium LT2
gauauucaagcuguu

SEQ ID NO: 3770441 - RNA, 18 nt, Salmonella typhimurium LT2
gauauucccguuccagcu

SEQ ID NO: 3770442 - RNA, 12 nt, Salmonella typhimurium LT2
gauauuccgcgc

SEQ ID NO: 3770443 - RNA, 13 nt, Salmonella typhimurium LT2
gauauucgcuggu

SEQ ID NO: 3770444 - RNA, 17 nt, Salmonella typhimurium LT2
gauauugcauaggggca

SEQ ID NO: 3770445 - RNA, 18 nt, Salmonella typhimurium LT2
gauauugccuuauucaca

SEQ ID NO: 3770446 - RNA, 13 nt, Salmonella typhimurium LT2
gaucguccaucga

SEQ ID NO: 3770447 - RNA, 23 nt, Salmonella typhimurium LT2
gaucguccaucgaauaaagacaa

SEQ ID NO: 3770448 - RNA, 22 nt, Salmonella typhimurium LT2
gaucgucgcgaucgcgccagcc

SEQ ID NO: 3770449 - RNA, 24 nt, Salmonella typhimurium LT2
gaucgugccaugaccauucgcacu

SEQ ID NO: 3770450 - RNA, 19 nt, Salmonella typhimurium LT2
gaucguuauccagcagcca

SEQ ID NO: 3770451 - RNA, 19 nt, Salmonella typhimurium LT2
gaucguuauuaaacagaca

SEQ ID NO: 3770452 - RNA, 21 nt, Salmonella typhimurium LT2
gaucguuauuaagcagacugc

SEQ ID NO: 3770453 - RNA, 21 nt, Salmonella typhimurium LT2
gaucguucaccgcacugacgu

SEQ ID NO: 3770454 - RNA, 11 nt, Salmonella typhimurium LT2
gaucguucggg

SEQ ID NO: 3770455 - RNA, 19 nt, Salmonella typhimurium LT2
gaucguuuucggcuggagu

SEQ ID NO: 3770456 - RNA, 18 nt, Salmonella typhimurium LT2
gaucuaacgaaaccggcg

SEQ ID NO: 3770457 - RNA, 21 nt, Salmonella typhimurium LT2
gaucuauuucauaauaagcgc

SEQ ID NO: 3770458 - RNA, 22 nt, Salmonella typhimurium LT2
gaucucaagcgccgccgcauuu

SEQ ID NO: 3770459 - RNA, 15 nt, Salmonella typhimurium LT2
gaucucacaagauuc

SEQ ID NO: 3770460 - RNA, 16 nt, Salmonella typhimurium LT2
gaucucauggagcugc

SEQ ID NO: 3770461 - RNA, 17 nt, Salmonella typhimurium LT2
gaucucgauauucacac

SEQ ID NO: 3770462 - RNA, 20 nt, Salmonella typhimurium LT2
gaucugcuugagcaggcaga

SEQ ID NO: 3770463 - RNA, 19 nt, Salmonella typhimurium LT2
gaucuuauaugagcgggcc

SEQ ID NO: 3770464 - RNA, 19 nt, Salmonella typhimurium LT2
gaucuuaucuuucagcgcc

SEQ ID NO: 3770465 - RNA, 17 nt, Salmonella typhimurium LT2
gaucuuauuagcgauuu

SEQ ID NO: 3770466 - RNA, 18 nt, Salmonella typhimurium LT2
gaucuucaucccauccgg

SEQ ID NO: 3770467 - RNA, 16 nt, Salmonella typhimurium LT2
gaucuucuuuaaccgc

SEQ ID NO: 3770468 - RNA, 14 nt, Salmonella typhimurium LT2
gaucuuuuugcucc

SEQ ID NO: 3770469 - RNA, 20 nt, Salmonella typhimurium LT2
gaugaaacaguccggcgaaa

SEQ ID NO: 3770470 - RNA, 22 nt, Salmonella typhimurium LT2
gaugaaauaaacgaccacucuu

SEQ ID NO: 3770471 - RNA, 19 nt, Salmonella typhimurium LT2
gaugacacaucaccuccag

SEQ ID NO: 3770472 - RNA, 20 nt, Salmonella typhimurium LT2
gaugaccaguuaagcaaaaa

SEQ ID NO: 3770473 - RNA, 21 nt, Salmonella typhimurium LT2
gaugacccauuuauuuucgga

SEQ ID NO: 3770474 - RNA, 20 nt, Salmonella typhimurium LT2
gaugacccccagauagcccu

SEQ ID NO: 3770475 - RNA, 21 nt, Salmonella typhimurium LT2
gaugacccccagauagcccuc

SEQ ID NO: 3770476 - RNA, 18 nt, Salmonella typhimurium LT2
gaugaccgaagcaggcgg

SEQ ID NO: 3770477 - RNA, 17 nt, Salmonella typhimurium LT2
gaugaccgcuuucgccu

SEQ ID NO: 3770478 - RNA, 16 nt, Salmonella typhimurium LT2
gaugacuaaaucagca

SEQ ID NO: 3770479 - RNA, 20 nt, Salmonella typhimurium LT2
gaugagaaauagcgcgccau

SEQ ID NO: 3770480 - RNA, 21 nt, Salmonella typhimurium LT2
gaugagaaauagcgcgccaua

SEQ ID NO: 3770481 - RNA, 14 nt, Salmonella typhimurium LT2
gaugagcaaaguaa

SEQ ID NO: 3770482 - RNA, 23 nt, Salmonella typhimurium LT2
gaugagcaaaguaaaacaagccg

SEQ ID NO: 3770483 - RNA, 17 nt, Salmonella typhimurium LT2
gaugagcgccagcaaca

SEQ ID NO: 3770484 - RNA, 21 nt, Salmonella typhimurium LT2
gaugagcgugacgaccggcac

SEQ ID NO: 3770485 - RNA, 18 nt, Salmonella typhimurium LT2
gaugagcucaaauaugau

SEQ ID NO: 3770486 - RNA, 19 nt, Salmonella typhimurium LT2
gaugaggcgcagccgccau

SEQ ID NO: 3770487 - RNA, 21 nt, Salmonella typhimurium LT2
gaugaggcgcagccgccaucc

SEQ ID NO: 3770488 - RNA, 14 nt, Salmonella typhimurium LT2
gaugauaggucagc

SEQ ID NO: 3770489 - RNA, 22 nt, Salmonella typhimurium LT2
gaugaucagcauagcgccuuca

SEQ ID NO: 3770490 - RNA, 16 nt, Salmonella typhimurium LT2
gaugaucgaggucagc

SEQ ID NO: 3770491 - RNA, 17 nt, Salmonella typhimurium LT2
gaugaucgccucuucgg

SEQ ID NO: 3770492 - RNA, 15 nt, Salmonella typhimurium LT2
gaugaucuucagccc

SEQ ID NO: 3770493 - RNA, 13 nt, Salmonella typhimurium LT2
gaugauggcggcu

SEQ ID NO: 3770494 - RNA, 23 nt, Salmonella typhimurium LT2
gaugaugucauaaucgccgucgg

SEQ ID NO: 3770495 - RNA, 21 nt, Salmonella typhimurium LT2
gaugauguuuaccugcaaaaa

SEQ ID NO: 3770496 - RNA, 23 nt, Salmonella typhimurium LT2
gaugcaaaugucagaucguaugc

SEQ ID NO: 3770497 - RNA, 19 nt, Salmonella typhimurium LT2
gaugcacgccacauugacc

SEQ ID NO: 3770498 - RNA, 21 nt, Salmonella typhimurium LT2
gaugcagccuggagagcagcg

SEQ ID NO: 3770499 - RNA, 15 nt, Salmonella typhimurium LT2
gaugcauaaaaaaac

SEQ ID NO: 3770500 - RNA, 16 nt, Salmonella typhimurium LT2
gaugcaucagaacaaa

SEQ ID NO: 3770501 - RNA, 22 nt, Salmonella typhimurium LT2
gaugcauuuuguccagucgaac

SEQ ID NO: 3770502 - RNA, 11 nt, Salmonella typhimurium LT2
gaugccagaug

SEQ ID NO: 3770503 - RNA, 16 nt, Salmonella typhimurium LT2
gaugccaucagagccg

SEQ ID NO: 3770504 - RNA, 19 nt, Salmonella typhimurium LT2
gaugcccagguuagcagcc

SEQ ID NO: 3770505 - RNA, 20 nt, Salmonella typhimurium LT2
gaugccgaccgucggcgcaa

SEQ ID NO: 3770506 - RNA, 13 nt, Salmonella typhimurium LT2
gaugccugaaggc

SEQ ID NO: 3770507 - RNA, 15 nt, Salmonella typhimurium LT2
gaugcgaaucuucau

SEQ ID NO: 3770508 - RNA, 20 nt, Salmonella typhimurium LT2
gaugcgaaucuucaucgucg

SEQ ID NO: 3770509 - RNA, 15 nt, Salmonella typhimurium LT2
gaugcgacucggugc

SEQ ID NO: 3770510 - RNA, 18 nt, Salmonella typhimurium LT2
gaugcgaguagcaaaucc

SEQ ID NO: 3770511 - RNA, 15 nt, Salmonella typhimurium LT2
gaugcgcaacguuuc

SEQ ID NO: 3770512 - RNA, 16 nt, Salmonella typhimurium LT2
gaugcgccauccacca

SEQ ID NO: 3770513 - RNA, 22 nt, Salmonella typhimurium LT2
gaugcgcguuuagcgccagcag

SEQ ID NO: 3770514 - RNA, 20 nt, Salmonella typhimurium LT2
gaugcgcucacgcuuauccg

SEQ ID NO: 3770515 - RNA, 14 nt, Salmonella typhimurium LT2
gaugcgcuuuucca

SEQ ID NO: 3770516 - RNA, 14 nt, Salmonella typhimurium LT2
gaugcggacgcuga

SEQ ID NO: 3770517 - RNA, 21 nt, Salmonella typhimurium LT2
gaugcggcaaaaauccuucuu

SEQ ID NO: 3770518 - RNA, 19 nt, Salmonella typhimurium LT2
gaugcgggagaucggcugu

SEQ ID NO: 3770519 - RNA, 18 nt, Salmonella typhimurium LT2
gaugcgggccgacaaaaa

SEQ ID NO: 3770520 - RNA, 17 nt, Salmonella typhimurium LT2
gaugcguaauccggccu

SEQ ID NO: 3770521 - RNA, 16 nt, Salmonella typhimurium LT2
gaugcguaccgcgcug

SEQ ID NO: 3770522 - RNA, 23 nt, Salmonella typhimurium LT2
gaugcguaccgcgcugugcgugg

SEQ ID NO: 3770523 - RNA, 14 nt, Salmonella typhimurium LT2
gaugcguucaaaga

SEQ ID NO: 3770524 - RNA, 22 nt, Salmonella typhimurium LT2
gaugcguuggcucgcugccaaa

SEQ ID NO: 3770525 - RNA, 16 nt, Salmonella typhimurium LT2
gaugcuaacgcccucu

SEQ ID NO: 3770526 - RNA, 21 nt, Salmonella typhimurium LT2
gaugcuaacgcccucucuccg

SEQ ID NO: 3770527 - RNA, 12 nt, Salmonella typhimurium LT2
gaugcucgaacc

SEQ ID NO: 3770528 - RNA, 17 nt, Salmonella typhimurium LT2
gaugcugaauagccagc

SEQ ID NO: 3770529 - RNA, 22 nt, Salmonella typhimurium LT2
gaugcugauguccgcagccgca

SEQ ID NO: 3770530 - RNA, 18 nt, Salmonella typhimurium LT2
gaugcugccugccugaag

SEQ ID NO: 3770531 - RNA, 16 nt, Salmonella typhimurium LT2
gaugcuguaccgcccg

SEQ ID NO: 3770532 - RNA, 23 nt, Salmonella typhimurium LT2
gauggacguuuccugcgccagca

SEQ ID NO: 3770533 - RNA, 19 nt, Salmonella typhimurium LT2
gauggagauaagcugggcg

SEQ ID NO: 3770534 - RNA, 16 nt, Salmonella typhimurium LT2
gauggagcggcgcuua

SEQ ID NO: 3770535 - RNA, 21 nt, Salmonella typhimurium LT2
gauggcgcuaaugcuuauccg

SEQ ID NO: 3770536 - RNA, 19 nt, Salmonella typhimurium LT2
gauggcgcuacgccugaac

SEQ ID NO: 3770537 - RNA, 20 nt, Salmonella typhimurium LT2
gauggcgcuacgcuuaucag

SEQ ID NO: 3770538 - RNA, 19 nt, Salmonella typhimurium LT2
gauggcgcuacgcuuaucg

SEQ ID NO: 3770539 - RNA, 19 nt, Salmonella typhimurium LT2
gauggcgcucgcuuaucug

SEQ ID NO: 3770540 - RNA, 15 nt, Salmonella typhimurium LT2
gauggcgcugcgcuu

SEQ ID NO: 3770541 - RNA, 21 nt, Salmonella typhimurium LT2
gauggcgcugucgcuuauucg

SEQ ID NO: 3770542 - RNA, 20 nt, Salmonella typhimurium LT2
gauggcgcuucgcuuaucag

SEQ ID NO: 3770543 - RNA, 19 nt, Salmonella typhimurium LT2
gauggcgcuucgcuuaucg

SEQ ID NO: 3770544 - RNA, 20 nt, Salmonella typhimurium LT2
gauggcgcuucguuuccugu

SEQ ID NO: 3770545 - RNA, 18 nt, Salmonella typhimurium LT2
gauggcgcuugcuuaucg

SEQ ID NO: 3770546 - RNA, 18 nt, Salmonella typhimurium LT2
gauggcggcgucgccugu

SEQ ID NO: 3770547 - RNA, 16 nt, Salmonella typhimurium LT2
gauggcggcugaugcc

SEQ ID NO: 3770548 - RNA, 21 nt, Salmonella typhimurium LT2
gauggcggcugcgccuuauca

SEQ ID NO: 3770549 - RNA, 17 nt, Salmonella typhimurium LT2
gauuuuuaagcugcgca

SEQ ID NO: 3770550 - RNA, 22 nt, Salmonella typhimurium LT2
gauuuuucgcgucaaaacuuau

SEQ ID NO: 3770551 - RNA, 18 nt, Salmonella typhimurium LT2
gauuuuucggcgcgcugg

SEQ ID NO: 3770552 - RNA, 18 nt, Salmonella typhimurium LT2
gauuuuuuaauucauaua

SEQ ID NO: 3770553 - RNA, 15 nt, Salmonella typhimurium LT2
gcaaaaaauauagcc

SEQ ID NO: 3770554 - RNA, 21 nt, Salmonella typhimurium LT2
gcaaaaacggcgcuuuuaaaa

SEQ ID NO: 3770555 - RNA, 17 nt, Salmonella typhimurium LT2
gcaaaaagaaucgccag

SEQ ID NO: 3770556 - RNA, 12 nt, Salmonella typhimurium LT2
gcaaaacauggc

SEQ ID NO: 3770557 - RNA, 18 nt, Salmonella typhimurium LT2
gcaaaaccuucauaaaua

SEQ ID NO: 3770558 - RNA, 19 nt, Salmonella typhimurium LT2
gcaaaacgcauccagcgca

SEQ ID NO: 3770559 - RNA, 21 nt, Salmonella typhimurium LT2
gcaaaacgcguauaacgccgc

SEQ ID NO: 3770560 - RNA, 20 nt, Salmonella typhimurium LT2
gcaaaacuaaacccggccug

SEQ ID NO: 3770561 - RNA, 16 nt, Salmonella typhimurium LT2
gcaaaacucugagcau

SEQ ID NO: 3770562 - RNA, 17 nt, Salmonella typhimurium LT2
gcaaaacucugagcaua

SEQ ID NO: 3770563 - RNA, 18 nt, Salmonella typhimurium LT2
gcaaaagcgguaauaacu

SEQ ID NO: 3770564 - RNA, 19 nt, Salmonella typhimurium LT2
gcaaaaguuugaccagcaa

SEQ ID NO: 3770565 - RNA, 21 nt, Salmonella typhimurium LT2
gcaaaaugcucauuauggacg

SEQ ID NO: 3770566 - RNA, 14 nt, Salmonella typhimurium LT2
gcaaaaugcuucuu

SEQ ID NO: 3770567 - RNA, 13 nt, Salmonella typhimurium LT2
gcaaaauuacuuc

SEQ ID NO: 3770568 - RNA, 15 nt, Salmonella typhimurium LT2
gcaaaauucacacca

SEQ ID NO: 3770569 - RNA, 20 nt, Salmonella typhimurium LT2
gcaaacaaggcaucuaucag

SEQ ID NO: 3770570 - RNA, 21 nt, Salmonella typhimurium LT2
gcaaacacaaaaugcccuucu

SEQ ID NO: 3770571 - RNA, 22 nt, Salmonella typhimurium LT2
gcaaacacaaucacacccagcg

SEQ ID NO: 3770572 - RNA, 18 nt, Salmonella typhimurium LT2
gcaaacagagcgccggca

SEQ ID NO: 3770573 - RNA, 18 nt, Salmonella typhimurium LT2
gcaaacagcacuacagcc

SEQ ID NO: 3770574 - RNA, 14 nt, Salmonella typhimurium LT2
gcaaacaucugcuc

SEQ ID NO: 3770575 - RNA, 20 nt, Salmonella typhimurium LT2
gcaaacaucugcuccagcgu

SEQ ID NO: 3770576 - RNA, 13 nt, Salmonella typhimurium LT2
gcaaaccagcacc

SEQ ID NO: 3770577 - RNA, 19 nt, Salmonella typhimurium LT2
gcaaacccaucucaggccg

SEQ ID NO: 3770578 - RNA, 11 nt, Salmonella typhimurium LT2
gcaaaccgcaa

SEQ ID NO: 3770579 - RNA, 15 nt, Salmonella typhimurium LT2
gcaaaccggcaugaa

SEQ ID NO: 3770580 - RNA, 18 nt, Salmonella typhimurium LT2
gcaaaccggcaugaagac

SEQ ID NO: 3770581 - RNA, 20 nt, Salmonella typhimurium LT2
gcaaaccggguaacagcauu

SEQ ID NO: 3770582 - RNA, 15 nt, Salmonella typhimurium LT2
gcaaacgauaaaagc

SEQ ID NO: 3770583 - RNA, 18 nt, Salmonella typhimurium LT2
gcaaacgauaaaagcucu

SEQ ID NO: 3770584 - RNA, 18 nt, Salmonella typhimurium LT2
gcaaacgccgaagccaac

SEQ ID NO: 3770585 - RNA, 19 nt, Salmonella typhimurium LT2
gcaaacgcggugaaggcaa

SEQ ID NO: 3770586 - RNA, 16 nt, Salmonella typhimurium LT2
gcaaacgguuaauacu

SEQ ID NO: 3770587 - RNA, 18 nt, Salmonella typhimurium LT2
gcaaacgguuaauacuga

SEQ ID NO: 3770588 - RNA, 16 nt, Salmonella typhimurium LT2
gcaaacgucagcgaua

SEQ ID NO: 3770589 - RNA, 17 nt, Salmonella typhimurium LT2
gcaaacuaaacgacgug

SEQ ID NO: 3770590 - RNA, 18 nt, Salmonella typhimurium LT2
gcaaacucaccugauuac

SEQ ID NO: 3770591 - RNA, 10 nt, Salmonella typhimurium LT2
gcaaacugcc

SEQ ID NO: 3770592 - RNA, 15 nt, Salmonella typhimurium LT2
gcaaacugccaggca

SEQ ID NO: 3770593 - RNA, 16 nt, Salmonella typhimurium LT2
gcaaacuguguacgcc

SEQ ID NO: 3770594 - RNA, 14 nt, Salmonella typhimurium LT2
gcaaagaaggcauu

SEQ ID NO: 3770595 - RNA, 16 nt, Salmonella typhimurium LT2
gcaaagauaaucugaa

SEQ ID NO: 3770596 - RNA, 15 nt, Salmonella typhimurium LT2
gcaaagcaauaccac

SEQ ID NO: 3770597 - RNA, 19 nt, Salmonella typhimurium LT2
gcaaagcaggugagauaac

SEQ ID NO: 3770598 - RNA, 20 nt, Salmonella typhimurium LT2
gcaaagcaucugccggcacg

SEQ ID NO: 3770599 - RNA, 19 nt, Salmonella typhimurium LT2
gcaaagcccacgcccugca

SEQ ID NO: 3770600 - RNA, 22 nt, Salmonella typhimurium LT2
gcaaagcccacgcccugcaaug

SEQ ID NO: 3770601 - RNA, 16 nt, Salmonella typhimurium LT2
gcaaagcgccauccgg

SEQ ID NO: 3770602 - RNA, 15 nt, Salmonella typhimurium LT2
gcaaagcucaacgca

SEQ ID NO: 3770603 - RNA, 20 nt, Salmonella typhimurium LT2
gcaaagcucacucuaucaag

SEQ ID NO: 3770604 - RNA, 18 nt, Salmonella typhimurium LT2
gcaaaggaaugcuuuaca

SEQ ID NO: 3770605 - RNA, 19 nt, Salmonella typhimurium LT2
gcaaaguacgggugaagca

SEQ ID NO: 3770606 - RNA, 22 nt, Salmonella typhimurium LT2
gcaaagucgaacgacugaguau

SEQ ID NO: 3770607 - RNA, 14 nt, Salmonella typhimurium LT2
gcaaaguuccaggu

SEQ ID NO: 3770608 - RNA, 14 nt, Salmonella typhimurium LT2
gcaaaguuguuuua

SEQ ID NO: 3770609 - RNA, 18 nt, Salmonella typhimurium LT2
gcaaaguuguuuuaacgu

SEQ ID NO: 3770610 - RNA, 15 nt, Salmonella typhimurium LT2
gcaaauaccacauca

SEQ ID NO: 3770611 - RNA, 19 nt, Salmonella typhimurium LT2
gcaaauaccggacagacuu

SEQ ID NO: 3770612 - RNA, 19 nt, Salmonella typhimurium LT2
gcaaauacugcuuuuccgg

SEQ ID NO: 3770613 - RNA, 11 nt, Salmonella typhimurium LT2
gcaaauauccu

SEQ ID NO: 3770614 - RNA, 15 nt, Salmonella typhimurium LT2
gcaaauauuccauca

SEQ ID NO: 3770615 - RNA, 13 nt, Salmonella typhimurium LT2
gcaaaucaaaagg

SEQ ID NO: 3770616 - RNA, 23 nt, Salmonella typhimurium LT2
gcaaaucaaaaggcaaugccuuu

SEQ ID NO: 3770617 - RNA, 13 nt, Salmonella typhimurium LT2
gcaaaucaccaca

SEQ ID NO: 3770618 - RNA, 18 nt, Salmonella typhimurium LT2
gcaaaucaucgccaugac

SEQ ID NO: 3770619 - RNA, 20 nt, Salmonella typhimurium LT2
gcaaaucccugaucggccag

SEQ ID NO: 3770620 - RNA, 20 nt, Salmonella typhimurium LT2
gcaaaucgcccaucacaugu

SEQ ID NO: 3770621 - RNA, 20 nt, Salmonella typhimurium LT2
gcaaaugaccagaucaacau

SEQ ID NO: 3770622 - RNA, 21 nt, Salmonella typhimurium LT2
gcaaaugauuaucuccaucuu

SEQ ID NO: 3770623 - RNA, 16 nt, Salmonella typhimurium LT2
gcaaaugccaucccau

SEQ ID NO: 3770624 - RNA, 15 nt, Salmonella typhimurium LT2
gcaaauuaugauuca

SEQ ID NO: 3770625 - RNA, 19 nt, Salmonella typhimurium LT2
gcaaauucgucgccgccaa

SEQ ID NO: 3770626 - RNA, 19 nt, Salmonella typhimurium LT2
gcaaauucuuugugcuccg

SEQ ID NO: 3770627 - RNA, 14 nt, Salmonella typhimurium LT2
gcaacaacaggcca

SEQ ID NO: 3770628 - RNA, 17 nt, Salmonella typhimurium LT2
gcaacaagcaucauuaa

SEQ ID NO: 3770629 - RNA, 23 nt, Salmonella typhimurium LT2
gcaacaauaaaguuauacagcac

SEQ ID NO: 3770630 - RNA, 21 nt, Salmonella typhimurium LT2
gcaacacagacuuugcacagu

SEQ ID NO: 3770631 - RNA, 16 nt, Salmonella typhimurium LT2
gcaacagacuauccag

SEQ ID NO: 3770632 - RNA, 17 nt, Salmonella typhimurium LT2
gcaacagacuauccagg

SEQ ID NO: 3770633 - RNA, 20 nt, Salmonella typhimurium LT2
gcaacagauacggcgcgucg

SEQ ID NO: 3770634 - RNA, 12 nt, Salmonella typhimurium LT2
gcaacagcacca

SEQ ID NO: 3770635 - RNA, 16 nt, Salmonella typhimurium LT2
gcaacagcaccagcag

SEQ ID NO: 3770636 - RNA, 22 nt, Salmonella typhimurium LT2
gcaacaggccgcgaaagcggcc

SEQ ID NO: 3770637 - RNA, 19 nt, Salmonella typhimurium LT2
gcaacagggcuuccgcauu

SEQ ID NO: 3770638 - RNA, 16 nt, Salmonella typhimurium LT2
gcaacagggugauuuc

SEQ ID NO: 3770639 - RNA, 19 nt, Salmonella typhimurium LT2
gcaacagguuaaccaugcc

SEQ ID NO: 3770640 - RNA, 21 nt, Salmonella typhimurium LT2
gcaacagguuaaccaugcccg

SEQ ID NO: 3770641 - RNA, 17 nt, Salmonella typhimurium LT2
gcaacauaaauaaacag

SEQ ID NO: 3770642 - RNA, 18 nt, Salmonella typhimurium LT2
gcaacaugaaagggaaac

SEQ ID NO: 3770643 - RNA, 15 nt, Salmonella typhimurium LT2
gcaacaugacauuaa

SEQ ID NO: 3770644 - RNA, 16 nt, Salmonella typhimurium LT2
gcaacaugcccaccgg

SEQ ID NO: 3770645 - RNA, 13 nt, Salmonella typhimurium LT2
gcaacauugcgcc

SEQ ID NO: 3770646 - RNA, 16 nt, Salmonella typhimurium LT2
gcaaccaacgcccaac

SEQ ID NO: 3770647 - RNA, 19 nt, Salmonella typhimurium LT2
gcaaccagaaugcccaggc

SEQ ID NO: 3770648 - RNA, 13 nt, Salmonella typhimurium LT2
gcaaccaggucac

SEQ ID NO: 3770649 - RNA, 16 nt, Salmonella typhimurium LT2
gcaaccauuaccgcca

SEQ ID NO: 3770650 - RNA, 16 nt, Salmonella typhimurium LT2
gcaaccauuccacagg

SEQ ID NO: 3770651 - RNA, 13 nt, Salmonella typhimurium LT2
gcaacccauacag

SEQ ID NO: 3770652 - RNA, 15 nt, Salmonella typhimurium LT2
gcaaccccucaucgg

SEQ ID NO: 3770653 - RNA, 19 nt, Salmonella typhimurium LT2
gcaauggacaaguaaaccg

SEQ ID NO: 3770654 - RNA, 18 nt, Salmonella typhimurium LT2
gcaauggccgcagcgcca

SEQ ID NO: 3770655 - RNA, 20 nt, Salmonella typhimurium LT2
gcaauggccgcagcgccaua

SEQ ID NO: 3770656 - RNA, 19 nt, Salmonella typhimurium LT2
gcaauggguaggccggaua

SEQ ID NO: 3770657 - RNA, 16 nt, Salmonella typhimurium LT2
gcaauguaagaauaac

SEQ ID NO: 3770658 - RNA, 19 nt, Salmonella typhimurium LT2
gcaaugucugcgucgggug

SEQ ID NO: 3770659 - RNA, 20 nt, Salmonella typhimurium LT2
gcaauguggacaaucaggcu

SEQ ID NO: 3770660 - RNA, 18 nt, Salmonella typhimurium LT2
gcaauguucaauaucaaa

SEQ ID NO: 3770661 - RNA, 20 nt, Salmonella typhimurium LT2
gcaauguucaauaucaaauu

SEQ ID NO: 3770662 - RNA, 16 nt, Salmonella typhimurium LT2
gcaauuaacaaauaaa

SEQ ID NO: 3770663 - RNA, 19 nt, Salmonella typhimurium LT2
gcaauuaauauauuuauau

SEQ ID NO: 3770664 - RNA, 22 nt, Salmonella typhimurium LT2
gcaauuaauauauuuauauaua

SEQ ID NO: 3770665 - RNA, 19 nt, Salmonella typhimurium LT2
gcaauuacggacagaaaaa

SEQ ID NO: 3770666 - RNA, 20 nt, Salmonella typhimurium LT2
gcaauuacggacagaaaaaa

SEQ ID NO: 3770667 - RNA, 13 nt, Salmonella typhimurium LT2
gcaauuagguuau

SEQ ID NO: 3770668 - RNA, 17 nt, Salmonella typhimurium LT2
gcaauuccgccaucuca

SEQ ID NO: 3770669 - RNA, 23 nt, Salmonella typhimurium LT2
gcaauucgagauuuuucugcgcc

SEQ ID NO: 3770670 - RNA, 16 nt, Salmonella typhimurium LT2
gcaauucgcguucaga

SEQ ID NO: 3770671 - RNA, 22 nt, Salmonella typhimurium LT2
gcaauuuacaucuuauuucacc

SEQ ID NO: 3770672 - RNA, 14 nt, Salmonella typhimurium LT2
gcaauuuauaccgc

SEQ ID NO: 3770673 - RNA, 22 nt, Salmonella typhimurium LT2
gcaauuuaucgugccggauggc

SEQ ID NO: 3770674 - RNA, 21 nt, Salmonella typhimurium LT2
gcaauuucacugucgccaggc

SEQ ID NO: 3770675 - RNA, 23 nt, Salmonella typhimurium LT2
gcaauuucacugucgccaggcca

SEQ ID NO: 3770676 - RNA, 18 nt, Salmonella typhimurium LT2
gcaauuucauucaccacc

SEQ ID NO: 3770677 - RNA, 15 nt, Salmonella typhimurium LT2
gcaauuucucgcucg

SEQ ID NO: 3770678 - RNA, 21 nt, Salmonella typhimurium LT2
gcaauuucucgcucgcccauc

SEQ ID NO: 3770679 - RNA, 17 nt, Salmonella typhimurium LT2
gcacaaaaaaaccgcuc

SEQ ID NO: 3770680 - RNA, 19 nt, Salmonella typhimurium LT2
gcacaaaaaguaguuccag

SEQ ID NO: 3770681 - RNA, 20 nt, Salmonella typhimurium LT2
gcacaaaaaguaguuccagc

SEQ ID NO: 3770682 - RNA, 18 nt, Salmonella typhimurium LT2
gcacaaaaggcuggaaca

SEQ ID NO: 3770683 - RNA, 20 nt, Salmonella typhimurium LT2
gcacaaagcguucggccugc

SEQ ID NO: 3770684 - RNA, 14 nt, Salmonella typhimurium LT2
gcacaacacgcuuu

SEQ ID NO: 3770685 - RNA, 14 nt, Salmonella typhimurium LT2
gcacaaccagcggc

SEQ ID NO: 3770686 - RNA, 15 nt, Salmonella typhimurium LT2
gcacaacccaaaggc

SEQ ID NO: 3770687 - RNA, 11 nt, Salmonella typhimurium LT2
gcacaagccau

SEQ ID NO: 3770688 - RNA, 12 nt, Salmonella typhimurium LT2
gcacaauaccaa

SEQ ID NO: 3770689 - RNA, 20 nt, Salmonella typhimurium LT2
gcacaauaccaauaagaacu

SEQ ID NO: 3770690 - RNA, 23 nt, Salmonella typhimurium LT2
gcacaauagcgcuaaacagcgcc

SEQ ID NO: 3770691 - RNA, 20 nt, Salmonella typhimurium LT2
gcacaaucccggcaccgauc

SEQ ID NO: 3770692 - RNA, 18 nt, Salmonella typhimurium LT2
gcacaauggucagcgccg

SEQ ID NO: 3770693 - RNA, 21 nt, Salmonella typhimurium LT2
gcacacagcggaaagcaacag

SEQ ID NO: 3770694 - RNA, 13 nt, Salmonella typhimurium LT2
gcacaccauuuca

SEQ ID NO: 3770695 - RNA, 19 nt, Salmonella typhimurium LT2
gcacaccgccguaaaggga

SEQ ID NO: 3770696 - RNA, 14 nt, Salmonella typhimurium LT2
gcacaccggccauu

SEQ ID NO: 3770697 - RNA, 20 nt, Salmonella typhimurium LT2
gcacacgcccagggcacgcu

SEQ ID NO: 3770698 - RNA, 19 nt, Salmonella typhimurium LT2
gcacacguauaaacgccgc

SEQ ID NO: 3770699 - RNA, 22 nt, Salmonella typhimurium LT2
gcacacguauaaacgccgccgc

SEQ ID NO: 3770700 - RNA, 18 nt, Salmonella typhimurium LT2
gcacacucauuuugccgu

SEQ ID NO: 3770701 - RNA, 13 nt, Salmonella typhimurium LT2
gcacagaagcgcc

SEQ ID NO: 3770702 - RNA, 21 nt, Salmonella typhimurium LT2
gcacagauuacaaggaaugau

SEQ ID NO: 3770703 - RNA, 17 nt, Salmonella typhimurium LT2
gcacagcagacaaccga

SEQ ID NO: 3770704 - RNA, 15 nt, Salmonella typhimurium LT2
gcacagccaguaaga

SEQ ID NO: 3770705 - RNA, 19 nt, Salmonella typhimurium LT2
gcacagccaguaagaacga

SEQ ID NO: 3770706 - RNA, 15 nt, Salmonella typhimurium LT2
gcacagccccagcac

SEQ ID NO: 3770707 - RNA, 14 nt, Salmonella typhimurium LT2
gcacagcgccauga

SEQ ID NO: 3770708 - RNA, 23 nt, Salmonella typhimurium LT2
gcacagcgguagcaucucacgcu

SEQ ID NO: 3770709 - RNA, 11 nt, Salmonella typhimurium LT2
gcacaggccug

SEQ ID NO: 3770710 - RNA, 21 nt, Salmonella typhimurium LT2
gcacaggcggguauggcgcca

SEQ ID NO: 3770711 - RNA, 23 nt, Salmonella typhimurium LT2
gcacaggcggguauggcgccaau

SEQ ID NO: 3770712 - RNA, 15 nt, Salmonella typhimurium LT2
gcacagguacaggcc

SEQ ID NO: 3770713 - RNA, 20 nt, Salmonella typhimurium LT2
gcacagguacaggccgccgc

SEQ ID NO: 3770714 - RNA, 21 nt, Salmonella typhimurium LT2
gcacagguacaggccgccgcc

SEQ ID NO: 3770715 - RNA, 18 nt, Salmonella typhimurium LT2
gcacaguacgcccggcgg

SEQ ID NO: 3770716 - RNA, 16 nt, Salmonella typhimurium LT2
gcacaguauuaccgcu

SEQ ID NO: 3770717 - RNA, 18 nt, Salmonella typhimurium LT2
gcacaguuuuccccccuc

SEQ ID NO: 3770718 - RNA, 14 nt, Salmonella typhimurium LT2
gcacaucaggaaau

SEQ ID NO: 3770719 - RNA, 14 nt, Salmonella typhimurium LT2
gcacaucggcagga

SEQ ID NO: 3770720 - RNA, 18 nt, Salmonella typhimurium LT2
gcacauguuucagcaccu

SEQ ID NO: 3770721 - RNA, 19 nt, Salmonella typhimurium LT2
gcacauguuucagcaccuc

SEQ ID NO: 3770722 - RNA, 14 nt, Salmonella typhimurium LT2
gcacauucagagcg

SEQ ID NO: 3770723 - RNA, 23 nt, Salmonella typhimurium LT2
gcacauugcugccuuauccggcc

SEQ ID NO: 3770724 - RNA, 20 nt, Salmonella typhimurium LT2
gcacauuggcgagcaggaac

SEQ ID NO: 3770725 - RNA, 17 nt, Salmonella typhimurium LT2
gcaccaaaguuaaucag

SEQ ID NO: 3770726 - RNA, 22 nt, Salmonella typhimurium LT2
gcaccaaaguuaaucagcgcug

SEQ ID NO: 3770727 - RNA, 13 nt, Salmonella typhimurium LT2
gcaccaacgccgc

SEQ ID NO: 3770728 - RNA, 15 nt, Salmonella typhimurium LT2
gcaccaacgccgcuu

SEQ ID NO: 3770729 - RNA, 14 nt, Salmonella typhimurium LT2
gcaccaaucaucac

SEQ ID NO: 3770730 - RNA, 16 nt, Salmonella typhimurium LT2
gcaccaccugcuguug

SEQ ID NO: 3770731 - RNA, 18 nt, Salmonella typhimurium LT2
gcaccagauagcguauua

SEQ ID NO: 3770732 - RNA, 21 nt, Salmonella typhimurium LT2
gcaccagauagcguauuauaa

SEQ ID NO: 3770733 - RNA, 16 nt, Salmonella typhimurium LT2
gcaccagcaacacauc

SEQ ID NO: 3770734 - RNA, 15 nt, Salmonella typhimurium LT2
gcaccagcaaugaua

SEQ ID NO: 3770735 - RNA, 15 nt, Salmonella typhimurium LT2
gcaccagcagguggu

SEQ ID NO: 3770736 - RNA, 17 nt, Salmonella typhimurium LT2
gcaccagcaggugguac

SEQ ID NO: 3770737 - RNA, 14 nt, Salmonella typhimurium LT2
gcaccagccccagc

SEQ ID NO: 3770738 - RNA, 22 nt, Salmonella typhimurium LT2
gcaccagcgaguagccugcgaa

SEQ ID NO: 3770739 - RNA, 20 nt, Salmonella typhimurium LT2
gcaccagcucuacaucgccg

SEQ ID NO: 3770740 - RNA, 18 nt, Salmonella typhimurium LT2
gcaccaggagcaaaccga

SEQ ID NO: 3770741 - RNA, 22 nt, Salmonella typhimurium LT2
gcaccaggauaaccuuccggca

SEQ ID NO: 3770742 - RNA, 16 nt, Salmonella typhimurium LT2
gcaccaguucacuccu

SEQ ID NO: 3770743 - RNA, 20 nt, Salmonella typhimurium LT2
gcaccaguucacuccuaaga

SEQ ID NO: 3770744 - RNA, 15 nt, Salmonella typhimurium LT2
gcaccaguuccccau

SEQ ID NO: 3770745 - RNA, 20 nt, Salmonella typhimurium LT2
gcaccaguuccccauacuga

SEQ ID NO: 3770746 - RNA, 16 nt, Salmonella typhimurium LT2
gcaccauaaacggcac

SEQ ID NO: 3770747 - RNA, 15 nt, Salmonella typhimurium LT2
gcaccauagcagcca

SEQ ID NO: 3770748 - RNA, 14 nt, Salmonella typhimurium LT2
gcaccauggcggcg

SEQ ID NO: 3770749 - RNA, 21 nt, Salmonella typhimurium LT2
gcaccccucuucuuuaagaac

SEQ ID NO: 3770750 - RNA, 12 nt, Salmonella typhimurium LT2
gcacccgccauc

SEQ ID NO: 3770751 - RNA, 15 nt, Salmonella typhimurium LT2
gcacccggagagaaa

SEQ ID NO: 3770752 - RNA, 16 nt, Salmonella typhimurium LT2
gcacccggagagaaac

SEQ ID NO: 3770753 - RNA, 23 nt, Salmonella typhimurium LT2
gcacccggcuuacaacauuguua

SEQ ID NO: 3770754 - RNA, 17 nt, Salmonella typhimurium LT2
gcacccugucaaagcau

SEQ ID NO: 3770755 - RNA, 18 nt, Salmonella typhimurium LT2
gcacccuucgcuauccau

SEQ ID NO: 3770756 - RNA, 15 nt, Salmonella typhimurium LT2
gcagauccuggcgcu

SEQ ID NO: 3770757 - RNA, 14 nt, Salmonella typhimurium LT2
gcagaucgccugga

SEQ ID NO: 3770758 - RNA, 18 nt, Salmonella typhimurium LT2
gcagaucgcgggcaauca

SEQ ID NO: 3770759 - RNA, 18 nt, Salmonella typhimurium LT2
gcagaucugucgccauga

SEQ ID NO: 3770760 - RNA, 20 nt, Salmonella typhimurium LT2
gcagaucugucgccaugacc

SEQ ID NO: 3770761 - RNA, 22 nt, Salmonella typhimurium LT2
gcagaugcccgcagaucugucg

SEQ ID NO: 3770762 - RNA, 17 nt, Salmonella typhimurium LT2
gcagaugguauaaauca

SEQ ID NO: 3770763 - RNA, 22 nt, Salmonella typhimurium LT2
gcagaugguauaaaucacgcug

SEQ ID NO: 3770764 - RNA, 17 nt, Salmonella typhimurium LT2
gcagauuacugagcagu

SEQ ID NO: 3770765 - RNA, 13 nt, Salmonella typhimurium LT2
gcagauugaggcu

SEQ ID NO: 3770766 - RNA, 22 nt, Salmonella typhimurium LT2
gcagauuuaacgcuuucgccag

SEQ ID NO: 3770767 - RNA, 16 nt, Salmonella typhimurium LT2
gcagauuuuucgccag

SEQ ID NO: 3770768 - RNA, 15 nt, Salmonella typhimurium LT2
gcagcaacaaaccga

SEQ ID NO: 3770769 - RNA, 15 nt, Salmonella typhimurium LT2
gcagcaacccugccg

SEQ ID NO: 3770770 - RNA, 23 nt, Salmonella typhimurium LT2
gcagcaacguuuguaacagcagg

SEQ ID NO: 3770771 - RNA, 14 nt, Salmonella typhimurium LT2
gcagcaagaacaga

SEQ ID NO: 3770772 - RNA, 15 nt, Salmonella typhimurium LT2
gcagcaagaacagag

SEQ ID NO: 3770773 - RNA, 16 nt, Salmonella typhimurium LT2
gcagcaagcggcuguc

SEQ ID NO: 3770774 - RNA, 23 nt, Salmonella typhimurium LT2
gcagcaauaauuacagccgcguu

SEQ ID NO: 3770775 - RNA, 20 nt, Salmonella typhimurium LT2
gcagcaauacgcccgcccgc

SEQ ID NO: 3770776 - RNA, 17 nt, Salmonella typhimurium LT2
gcagcaaugugcgccag

SEQ ID NO: 3770777 - RNA, 19 nt, Salmonella typhimurium LT2
gcagcaaugugcgccagga

SEQ ID NO: 3770778 - RNA, 18 nt, Salmonella typhimurium LT2
gcagcaccucaauaugaa

SEQ ID NO: 3770779 - RNA, 18 nt, Salmonella typhimurium LT2
gcagcagaaucaggcaca

SEQ ID NO: 3770780 - RNA, 18 nt, Salmonella typhimurium LT2
gcagcagcuccccgccgc

SEQ ID NO: 3770781 - RNA, 16 nt, Salmonella typhimurium LT2
gcagcaggcaaggcau

SEQ ID NO: 3770782 - RNA, 14 nt, Salmonella typhimurium LT2
gcagcaggcgggcu

SEQ ID NO: 3770783 - RNA, 21 nt, Salmonella typhimurium LT2
gcagcagggauauacaaauau

SEQ ID NO: 3770784 - RNA, 12 nt, Salmonella typhimurium LT2
gcagcaggucga

SEQ ID NO: 3770785 - RNA, 20 nt, Salmonella typhimurium LT2
gcagcauacgacaucgccaa

SEQ ID NO: 3770786 - RNA, 14 nt, Salmonella typhimurium LT2
gcagcauaucgccg

SEQ ID NO: 3770787 - RNA, 18 nt, Salmonella typhimurium LT2
gcagcauaucgccguuca

SEQ ID NO: 3770788 - RNA, 13 nt, Salmonella typhimurium LT2
gcagcauccagcu

SEQ ID NO: 3770789 - RNA, 22 nt, Salmonella typhimurium LT2
gcagcauugggucaugcggaug

SEQ ID NO: 3770790 - RNA, 12 nt, Salmonella typhimurium LT2
gcagccacagaa

SEQ ID NO: 3770791 - RNA, 19 nt, Salmonella typhimurium LT2
gcagccacagccuguguca

SEQ ID NO: 3770792 - RNA, 13 nt, Salmonella typhimurium LT2
gcagccacgccga

SEQ ID NO: 3770793 - RNA, 13 nt, Salmonella typhimurium LT2
gcagccacucccg

SEQ ID NO: 3770794 - RNA, 23 nt, Salmonella typhimurium LT2
gcagccagaaaaagggaaaagcc

SEQ ID NO: 3770795 - RNA, 16 nt, Salmonella typhimurium LT2
gcagccagaacucauc

SEQ ID NO: 3770796 - RNA, 14 nt, Salmonella typhimurium LT2
gcagccagcccagc

SEQ ID NO: 3770797 - RNA, 17 nt, Salmonella typhimurium LT2
gcagccagcccagcgca

SEQ ID NO: 3770798 - RNA, 21 nt, Salmonella typhimurium LT2
gcagccagcccagcgcaaccu

SEQ ID NO: 3770799 - RNA, 13 nt, Salmonella typhimurium LT2
gcagccagcgccc

SEQ ID NO: 3770800 - RNA, 13 nt, Salmonella typhimurium LT2
gcagccaggccau

SEQ ID NO: 3770801 - RNA, 17 nt, Salmonella typhimurium LT2
gcagccaugccagcgcg

SEQ ID NO: 3770802 - RNA, 15 nt, Salmonella typhimurium LT2
gcagccccggcaucc

SEQ ID NO: 3770803 - RNA, 18 nt, Salmonella typhimurium LT2
gcagccccggcauccagu

SEQ ID NO: 3770804 - RNA, 18 nt, Salmonella typhimurium LT2
gcagcccgcccacaggcu

SEQ ID NO: 3770805 - RNA, 11 nt, Salmonella typhimurium LT2
gcagcccugcg

SEQ ID NO: 3770806 - RNA, 23 nt, Salmonella typhimurium LT2
gcagcccuuacgcuuuauucugu

SEQ ID NO: 3770807 - RNA, 14 nt, Salmonella typhimurium LT2
gcagccgacagcgu

SEQ ID NO: 3770808 - RNA, 12 nt, Salmonella typhimurium LT2
gcagccgccacc

SEQ ID NO: 3770809 - RNA, 14 nt, Salmonella typhimurium LT2
gcagccgcucaaua

SEQ ID NO: 3770810 - RNA, 12 nt, Salmonella typhimurium LT2
gcagccggaauc

SEQ ID NO: 3770811 - RNA, 20 nt, Salmonella typhimurium LT2
gcagccggauagacaugacc

SEQ ID NO: 3770812 - RNA, 15 nt, Salmonella typhimurium LT2
gcagccgggccagac

SEQ ID NO: 3770813 - RNA, 17 nt, Salmonella typhimurium LT2
gcagccgguauccagcg

SEQ ID NO: 3770814 - RNA, 19 nt, Salmonella typhimurium LT2
gcagccuaguucugcgcca

SEQ ID NO: 3770815 - RNA, 20 nt, Salmonella typhimurium LT2
gcagccuaguucugcgccag

SEQ ID NO: 3770816 - RNA, 23 nt, Salmonella typhimurium LT2
gcagccuaguucugcgccaguga

SEQ ID NO: 3770817 - RNA, 14 nt, Salmonella typhimurium LT2
gcagccucguccug

SEQ ID NO: 3770818 - RNA, 17 nt, Salmonella typhimurium LT2
gcagccucguccugcaa

SEQ ID NO: 3770819 - RNA, 13 nt, Salmonella typhimurium LT2
gcagccugccgca

SEQ ID NO: 3770820 - RNA, 15 nt, Salmonella typhimurium LT2
gcagccuggcggcuu

SEQ ID NO: 3770821 - RNA, 21 nt, Salmonella typhimurium LT2
gcagcgaaacgacguccacac

SEQ ID NO: 3770822 - RNA, 15 nt, Salmonella typhimurium LT2
gcagcgaaacgcgcu

SEQ ID NO: 3770823 - RNA, 16 nt, Salmonella typhimurium LT2
gcagcgaaacgcgcua

SEQ ID NO: 3770824 - RNA, 17 nt, Salmonella typhimurium LT2
gcagcgaagaucaggag

SEQ ID NO: 3770825 - RNA, 20 nt, Salmonella typhimurium LT2
gcagcgacguaaugaucagc

SEQ ID NO: 3770826 - RNA, 16 nt, Salmonella typhimurium LT2
gcagcgagcaccgauc

SEQ ID NO: 3770827 - RNA, 16 nt, Salmonella typhimurium LT2
gcagcgaugacagcag

SEQ ID NO: 3770828 - RNA, 21 nt, Salmonella typhimurium LT2
gcagcgccaccgggcaacaca

SEQ ID NO: 3770829 - RNA, 13 nt, Salmonella typhimurium LT2
gcagcgccaucca

SEQ ID NO: 3770830 - RNA, 13 nt, Salmonella typhimurium LT2
gcagcgcccagca

SEQ ID NO: 3770831 - RNA, 13 nt, Salmonella typhimurium LT2
gcagcgccgccug

SEQ ID NO: 3770832 - RNA, 18 nt, Salmonella typhimurium LT2
gcagcgcggaaggaccgu

SEQ ID NO: 3770833 - RNA, 15 nt, Salmonella typhimurium LT2
gcagcgcggcacaca

SEQ ID NO: 3770834 - RNA, 18 nt, Salmonella typhimurium LT2
gcagcgcggccagcgccu

SEQ ID NO: 3770835 - RNA, 16 nt, Salmonella typhimurium LT2
gcagcgcggccugcgu

SEQ ID NO: 3770836 - RNA, 14 nt, Salmonella typhimurium LT2
gcagcggcauuggc

SEQ ID NO: 3770837 - RNA, 19 nt, Salmonella typhimurium LT2
gcagcggcgaagcggugca

SEQ ID NO: 3770838 - RNA, 11 nt, Salmonella typhimurium LT2
gcagcggcggu

SEQ ID NO: 3770839 - RNA, 21 nt, Salmonella typhimurium LT2
gcagcgggaccauacuggcga

SEQ ID NO: 3770840 - RNA, 15 nt, Salmonella typhimurium LT2
gcagcgggauauccc

SEQ ID NO: 3770841 - RNA, 16 nt, Salmonella typhimurium LT2
gcagcgggugcuccag

SEQ ID NO: 3770842 - RNA, 17 nt, Salmonella typhimurium LT2
gcagcguaauacaggcg

SEQ ID NO: 3770843 - RNA, 19 nt, Salmonella typhimurium LT2
gcagcguaauggccaccag

SEQ ID NO: 3770844 - RNA, 19 nt, Salmonella typhimurium LT2
gcagcgucagcccaagcug

SEQ ID NO: 3770845 - RNA, 18 nt, Salmonella typhimurium LT2
gcagcgucugcccuccug

SEQ ID NO: 3770846 - RNA, 16 nt, Salmonella typhimurium LT2
gcagcguuggccgccu

SEQ ID NO: 3770847 - RNA, 15 nt, Salmonella typhimurium LT2
gcagcguuuccagcc

SEQ ID NO: 3770848 - RNA, 23 nt, Salmonella typhimurium LT2
gcagcguuugacggauuuuuuuc

SEQ ID NO: 3770849 - RNA, 18 nt, Salmonella typhimurium LT2
gcagcuccacaaauagca

SEQ ID NO: 3770850 - RNA, 14 nt, Salmonella typhimurium LT2
gcagcuccagagcg

SEQ ID NO: 3770851 - RNA, 17 nt, Salmonella typhimurium LT2
gcagcuccccgccgcgg

SEQ ID NO: 3770852 - RNA, 19 nt, Salmonella typhimurium LT2
gcagcucgauaaucccggc

SEQ ID NO: 3770853 - RNA, 16 nt, Salmonella typhimurium LT2
gcagcucuccccacac

SEQ ID NO: 3770854 - RNA, 16 nt, Salmonella typhimurium LT2
gcagcugccacaccac

SEQ ID NO: 3770855 - RNA, 20 nt, Salmonella typhimurium LT2
gcagcugcuuaacuucugca

SEQ ID NO: 3770856 - RNA, 19 nt, Salmonella typhimurium LT2
gcagcuuacugugccgccg

SEQ ID NO: 3770857 - RNA, 19 nt, Salmonella typhimurium LT2
gcagcuucaggauccaggu

SEQ ID NO: 3770858 - RNA, 21 nt, Salmonella typhimurium LT2
gcagcuucaucauucauccag

SEQ ID NO: 3770859 - RNA, 15 nt, Salmonella typhimurium LT2
gcaggaaauccagca

SEQ ID NO: 3770860 - RNA, 19 nt, Salmonella typhimurium LT2
gcaggaaauccagcagaau

SEQ ID NO: 3770861 - RNA, 18 nt, Salmonella typhimurium LT2
gcauaagccagcccugcc

SEQ ID NO: 3770862 - RNA, 18 nt, Salmonella typhimurium LT2
gcauaauaaagcagcggc

SEQ ID NO: 3770863 - RNA, 23 nt, Salmonella typhimurium LT2
gcauaauacggggccauuauuua

SEQ ID NO: 3770864 - RNA, 17 nt, Salmonella typhimurium LT2
gcauaaugaaccacacu

SEQ ID NO: 3770865 - RNA, 16 nt, Salmonella typhimurium LT2
gcauacaaagcagaua

SEQ ID NO: 3770866 - RNA, 17 nt, Salmonella typhimurium LT2
gcauacaccgccagcgu

SEQ ID NO: 3770867 - RNA, 21 nt, Salmonella typhimurium LT2
gcauacacgccgggcacgcug

SEQ ID NO: 3770868 - RNA, 23 nt, Salmonella typhimurium LT2
gcauacagcgauaaccgccgccg

SEQ ID NO: 3770869 - RNA, 15 nt, Salmonella typhimurium LT2
gcauacagcuuuuac

SEQ ID NO: 3770870 - RNA, 24 nt, Salmonella typhimurium LT2
gcauacauaaauccggaucggauu

SEQ ID NO: 3770871 - RNA, 23 nt, Salmonella typhimurium LT2
gcauaccaaguuuggcaaucaaa

SEQ ID NO: 3770872 - RNA, 13 nt, Salmonella typhimurium LT2
gcauaccuucaca

SEQ ID NO: 3770873 - RNA, 16 nt, Salmonella typhimurium LT2
gcauacgacaucgcca

SEQ ID NO: 3770874 - RNA, 14 nt, Salmonella typhimurium LT2
gcauacguuucacc

SEQ ID NO: 3770875 - RNA, 20 nt, Salmonella typhimurium LT2
gcauacucuccuccauaccu

SEQ ID NO: 3770876 - RNA, 14 nt, Salmonella typhimurium LT2
gcauagaaaaagaa

SEQ ID NO: 3770877 - RNA, 18 nt, Salmonella typhimurium LT2
gcauauaagagacgccaa

SEQ ID NO: 3770878 - RNA, 17 nt, Salmonella typhimurium LT2
gcauauagugcgugaca

SEQ ID NO: 3770879 - RNA, 14 nt, Salmonella typhimurium LT2
gcauauccagcgcc

SEQ ID NO: 3770880 - RNA, 15 nt, Salmonella typhimurium LT2
gcauauccagcgccu

SEQ ID NO: 3770881 - RNA, 19 nt, Salmonella typhimurium LT2
gcauauccagcgccugcgc

SEQ ID NO: 3770882 - RNA, 23 nt, Salmonella typhimurium LT2
gcauauccauugaaacggugccu

SEQ ID NO: 3770883 - RNA, 20 nt, Salmonella typhimurium LT2
gcauaucccacugcacgcca

SEQ ID NO: 3770884 - RNA, 13 nt, Salmonella typhimurium LT2
gcauaucgcccug

SEQ ID NO: 3770885 - RNA, 14 nt, Salmonella typhimurium LT2
gcauaucuggcgag

SEQ ID NO: 3770886 - RNA, 16 nt, Salmonella typhimurium LT2
gcauaugcacagcgcu

SEQ ID NO: 3770887 - RNA, 22 nt, Salmonella typhimurium LT2
gcauauucauaucgaagcccag

SEQ ID NO: 3770888 - RNA, 18 nt, Salmonella typhimurium LT2
gcauauucuggcggcggg

SEQ ID NO: 3770889 - RNA, 12 nt, Salmonella typhimurium LT2
gcauauuuuucu

SEQ ID NO: 3770890 - RNA, 13 nt, Salmonella typhimurium LT2
gcaucaaacuuuu

SEQ ID NO: 3770891 - RNA, 16 nt, Salmonella typhimurium LT2
gcaucaaacuuuuaaa

SEQ ID NO: 3770892 - RNA, 21 nt, Salmonella typhimurium LT2
gcaucaaacuuuuaaauugaa

SEQ ID NO: 3770893 - RNA, 13 nt, Salmonella typhimurium LT2
gcaucaacgccag

SEQ ID NO: 3770894 - RNA, 19 nt, Salmonella typhimurium LT2
gcaucaauggcgucaaaca

SEQ ID NO: 3770895 - RNA, 23 nt, Salmonella typhimurium LT2
gcaucacaaaccagacgcguaac

SEQ ID NO: 3770896 - RNA, 18 nt, Salmonella typhimurium LT2
gcaucacaucaaagcccc

SEQ ID NO: 3770897 - RNA, 15 nt, Salmonella typhimurium LT2
gcaucacggcagcac

SEQ ID NO: 3770898 - RNA, 17 nt, Salmonella typhimurium LT2
gcaucaggaucuucauc

SEQ ID NO: 3770899 - RNA, 22 nt, Salmonella typhimurium LT2
gcaucaggauugcugugaagca

SEQ ID NO: 3770900 - RNA, 23 nt, Salmonella typhimurium LT2
gcaucauacauauauuccggguc

SEQ ID NO: 3770901 - RNA, 14 nt, Salmonella typhimurium LT2
gcaucauccccacc

SEQ ID NO: 3770902 - RNA, 16 nt, Salmonella typhimurium LT2
gcaucauccccaccac

SEQ ID NO: 3770903 - RNA, 20 nt, Salmonella typhimurium LT2
gcaucaucuaccuucacaca

SEQ ID NO: 3770904 - RNA, 17 nt, Salmonella typhimurium LT2
gcaucaucucccaggcc

SEQ ID NO: 3770905 - RNA, 22 nt, Salmonella typhimurium LT2
gcaucaugggcucaucaaacag

SEQ ID NO: 3770906 - RNA, 15 nt, Salmonella typhimurium LT2
gcaucauucugcagg

SEQ ID NO: 3770907 - RNA, 16 nt, Salmonella typhimurium LT2
gcaucauucugucagc

SEQ ID NO: 3770908 - RNA, 17 nt, Salmonella typhimurium LT2
gcaucauucugucagca

SEQ ID NO: 3770909 - RNA, 22 nt, Salmonella typhimurium LT2
gcaucauuuucuuucaucaaac

SEQ ID NO: 3770910 - RNA, 16 nt, Salmonella typhimurium LT2
gcauccaccgcggagu

SEQ ID NO: 3770911 - RNA, 13 nt, Salmonella typhimurium LT2
gcauccagcucau

SEQ ID NO: 3770912 - RNA, 14 nt, Salmonella typhimurium LT2
gcauccccugcagg

SEQ ID NO: 3770913 - RNA, 22 nt, Salmonella typhimurium LT2
gcaucccgcuccguaggccgga

SEQ ID NO: 3770914 - RNA, 21 nt, Salmonella typhimurium LT2
gcaucccggugucaaagcgcc

SEQ ID NO: 3770915 - RNA, 23 nt, Salmonella typhimurium LT2
gcaucccggugucaaagcgccag

SEQ ID NO: 3770916 - RNA, 18 nt, Salmonella typhimurium LT2
gcauccgcaagacacgcu

SEQ ID NO: 3770917 - RNA, 16 nt, Salmonella typhimurium LT2
gcauccggccagcgac

SEQ ID NO: 3770918 - RNA, 13 nt, Salmonella typhimurium LT2
gcauccggcgguc

SEQ ID NO: 3770919 - RNA, 10 nt, Salmonella typhimurium LT2
gcauccggcu

SEQ ID NO: 3770920 - RNA, 20 nt, Salmonella typhimurium LT2
gcauccgguucaaggcagga

SEQ ID NO: 3770921 - RNA, 18 nt, Salmonella typhimurium LT2
gcauccgugaccugcuga

SEQ ID NO: 3770922 - RNA, 17 nt, Salmonella typhimurium LT2
gcauccuaacuggguca

SEQ ID NO: 3770923 - RNA, 18 nt, Salmonella typhimurium LT2
gcauccuccauccaggua

SEQ ID NO: 3770924 - RNA, 13 nt, Salmonella typhimurium LT2
gcauccucuuucc

SEQ ID NO: 3770925 - RNA, 23 nt, Salmonella typhimurium LT2
gcauccuguggguucaucgccac

SEQ ID NO: 3770926 - RNA, 18 nt, Salmonella typhimurium LT2
gcaucgacauccgauuuc

SEQ ID NO: 3770927 - RNA, 20 nt, Salmonella typhimurium LT2
gcaucgacauccgauuucau

SEQ ID NO: 3770928 - RNA, 13 nt, Salmonella typhimurium LT2
gcaucgacgccag

SEQ ID NO: 3770929 - RNA, 16 nt, Salmonella typhimurium LT2
gcaucgacgccagcgg

SEQ ID NO: 3770930 - RNA, 16 nt, Salmonella typhimurium LT2
gcaucgacguucagca

SEQ ID NO: 3770931 - RNA, 19 nt, Salmonella typhimurium LT2
gcaucgacguucagcauau

SEQ ID NO: 3770932 - RNA, 17 nt, Salmonella typhimurium LT2
gcaucgcauuaacgucc

SEQ ID NO: 3770933 - RNA, 17 nt, Salmonella typhimurium LT2
gcaucgcccgcccccaa

SEQ ID NO: 3770934 - RNA, 19 nt, Salmonella typhimurium LT2
gcaucgcccugccagugaa

SEQ ID NO: 3770935 - RNA, 21 nt, Salmonella typhimurium LT2
gcaucgccgguagcuucagcg

SEQ ID NO: 3770936 - RNA, 18 nt, Salmonella typhimurium LT2
gcaucgcgccgccgggcu

SEQ ID NO: 3770937 - RNA, 18 nt, Salmonella typhimurium LT2
gcaucgcgcgagauacgc

SEQ ID NO: 3770938 - RNA, 13 nt, Salmonella typhimurium LT2
gcaucgcggucag

SEQ ID NO: 3770939 - RNA, 15 nt, Salmonella typhimurium LT2
gcaucgcuccccaac

SEQ ID NO: 3770940 - RNA, 18 nt, Salmonella typhimurium LT2
gcaucgggccguccggca

SEQ ID NO: 3770941 - RNA, 20 nt, Salmonella typhimurium LT2
gcaucggguugacuacuccc

SEQ ID NO: 3770942 - RNA, 19 nt, Salmonella typhimurium LT2
gcaucggucuccagcaaca

SEQ ID NO: 3770943 - RNA, 16 nt, Salmonella typhimurium LT2
gcaucgguucugcgac

SEQ ID NO: 3770944 - RNA, 17 nt, Salmonella typhimurium LT2
gcaucgguucugcgaca

SEQ ID NO: 3770945 - RNA, 17 nt, Salmonella typhimurium LT2
gcaucguagucaggcag

SEQ ID NO: 3770946 - RNA, 15 nt, Salmonella typhimurium LT2
gcaucgugagcgcgu

SEQ ID NO: 3770947 - RNA, 14 nt, Salmonella typhimurium LT2
gcaucguuugcucg

SEQ ID NO: 3770948 - RNA, 15 nt, Salmonella typhimurium LT2
gcaucuaauuaaaaa

SEQ ID NO: 3770949 - RNA, 22 nt, Salmonella typhimurium LT2
gcaucuaauuaaaaagagaaaa

SEQ ID NO: 3770950 - RNA, 14 nt, Salmonella typhimurium LT2
gcaucuccagcgca

SEQ ID NO: 3770951 - RNA, 16 nt, Salmonella typhimurium LT2
gcaucucguaaaucaa

SEQ ID NO: 3770952 - RNA, 21 nt, Salmonella typhimurium LT2
gcaucucuucguucaggcgua

SEQ ID NO: 3770953 - RNA, 15 nt, Salmonella typhimurium LT2
gcaucugccggcacg

SEQ ID NO: 3770954 - RNA, 15 nt, Salmonella typhimurium LT2
gcaucugggcugaca

SEQ ID NO: 3770955 - RNA, 21 nt, Salmonella typhimurium LT2
gcaucugggcugacaaaaauu

SEQ ID NO: 3770956 - RNA, 12 nt, Salmonella typhimurium LT2
gcaucugucauc

SEQ ID NO: 3770957 - RNA, 17 nt, Salmonella typhimurium LT2
gcaucuuaagaaaauuc

SEQ ID NO: 3770958 - RNA, 17 nt, Salmonella typhimurium LT2
gcaucuuacugaccggc

SEQ ID NO: 3770959 - RNA, 13 nt, Salmonella typhimurium LT2
gcaucuucagaca

SEQ ID NO: 3770960 - RNA, 19 nt, Salmonella typhimurium LT2
gcaucuuuggcuuuaugaa

SEQ ID NO: 3770961 - RNA, 21 nt, Salmonella typhimurium LT2
gcaugaaaauaugaugcuauc

SEQ ID NO: 3770962 - RNA, 16 nt, Salmonella typhimurium LT2
gcaugaagcagcaggc

SEQ ID NO: 3770963 - RNA, 20 nt, Salmonella typhimurium LT2
gcaugaauaauuucuucuuu

SEQ ID NO: 3770964 - RNA, 13 nt, Salmonella typhimurium LT2
gcaugaauaucaa

SEQ ID NO: 3770965 - RNA, 13 nt, Salmonella typhimurium LT2
gccaaccagaccg

SEQ ID NO: 3770966 - RNA, 14 nt, Salmonella typhimurium LT2
gccaaccccggcaa

SEQ ID NO: 3770967 - RNA, 14 nt, Salmonella typhimurium LT2
gccaacuuauccga

SEQ ID NO: 3770968 - RNA, 18 nt, Salmonella typhimurium LT2
gccaagcagcgccacgcc

SEQ ID NO: 3770969 - RNA, 14 nt, Salmonella typhimurium LT2
gccaagcgccucgc

SEQ ID NO: 3770970 - RNA, 17 nt, Salmonella typhimurium LT2
gccaagcgcggacagca

SEQ ID NO: 3770971 - RNA, 19 nt, Salmonella typhimurium LT2
gccaagcggcaucucgcca

SEQ ID NO: 3770972 - RNA, 21 nt, Salmonella typhimurium LT2
gccaaguaauaaagagaacga

SEQ ID NO: 3770973 - RNA, 18 nt, Salmonella typhimurium LT2
gccaauaaccaccuguuc

SEQ ID NO: 3770974 - RNA, 19 nt, Salmonella typhimurium LT2
gccaauaacgucuggugau

SEQ ID NO: 3770975 - RNA, 15 nt, Salmonella typhimurium LT2
gccaauaaugccgcc

SEQ ID NO: 3770976 - RNA, 14 nt, Salmonella typhimurium LT2
gccaauaugcgcaa

SEQ ID NO: 3770977 - RNA, 15 nt, Salmonella typhimurium LT2
gccaaucaaccgcau

SEQ ID NO: 3770978 - RNA, 16 nt, Salmonella typhimurium LT2
gccaaucaaccgcauc

SEQ ID NO: 3770979 - RNA, 13 nt, Salmonella typhimurium LT2
gccaaucacugcg

SEQ ID NO: 3770980 - RNA, 14 nt, Salmonella typhimurium LT2
gccaaucgccgccg

SEQ ID NO: 3770981 - RNA, 18 nt, Salmonella typhimurium LT2
gccaaugccgaucaccag

SEQ ID NO: 3770982 - RNA, 18 nt, Salmonella typhimurium LT2
gccaaugcguuguuccug

SEQ ID NO: 3770983 - RNA, 21 nt, Salmonella typhimurium LT2
gccaauguacguaaaaccagc

SEQ ID NO: 3770984 - RNA, 15 nt, Salmonella typhimurium LT2
gccaauuccgccaua

SEQ ID NO: 3770985 - RNA, 21 nt, Salmonella typhimurium LT2
gccacaaccgcccccaacuga

SEQ ID NO: 3770986 - RNA, 17 nt, Salmonella typhimurium LT2
gccacaauggcaggcag

SEQ ID NO: 3770987 - RNA, 14 nt, Salmonella typhimurium LT2
gccacaauugccag

SEQ ID NO: 3770988 - RNA, 16 nt, Salmonella typhimurium LT2
gccacaauugccagca

SEQ ID NO: 3770989 - RNA, 18 nt, Salmonella typhimurium LT2
gccacaccacaugcgagc

SEQ ID NO: 3770990 - RNA, 16 nt, Salmonella typhimurium LT2
gccacacucucuccag

SEQ ID NO: 3770991 - RNA, 13 nt, Salmonella typhimurium LT2
gccacagaaugcc

SEQ ID NO: 3770992 - RNA, 21 nt, Salmonella typhimurium LT2
gccacagauuaugcagcucuu

SEQ ID NO: 3770993 - RNA, 12 nt, Salmonella typhimurium LT2
gccacagcaaau

SEQ ID NO: 3770994 - RNA, 18 nt, Salmonella typhimurium LT2
gccacagccaggccgcgc

SEQ ID NO: 3770995 - RNA, 20 nt, Salmonella typhimurium LT2
gccacagcgccagacacugg

SEQ ID NO: 3770996 - RNA, 14 nt, Salmonella typhimurium LT2
gccacaggaccacg

SEQ ID NO: 3770997 - RNA, 18 nt, Salmonella typhimurium LT2
gccacaggcggcaugggu

SEQ ID NO: 3770998 - RNA, 20 nt, Salmonella typhimurium LT2
gccacaggcggcauggguaa

SEQ ID NO: 3770999 - RNA, 12 nt, Salmonella typhimurium LT2
gccacaggcguc

SEQ ID NO: 3771000 - RNA, 18 nt, Salmonella typhimurium LT2
gccacaucguuacccauc

SEQ ID NO: 3771001 - RNA, 22 nt, Salmonella typhimurium LT2
gccacaugauguuguucgucuu

SEQ ID NO: 3771002 - RNA, 23 nt, Salmonella typhimurium LT2
gccaccaaaaacgcccccagaua

SEQ ID NO: 3771003 - RNA, 13 nt, Salmonella typhimurium LT2
gccaccacaaagc

SEQ ID NO: 3771004 - RNA, 15 nt, Salmonella typhimurium LT2
gccaccacauaccgu

SEQ ID NO: 3771005 - RNA, 17 nt, Salmonella typhimurium LT2
gccaccacgccgagaaa

SEQ ID NO: 3771006 - RNA, 15 nt, Salmonella typhimurium LT2
gccaccagcacaaug

SEQ ID NO: 3771007 - RNA, 14 nt, Salmonella typhimurium LT2
gccaccaucacuac

SEQ ID NO: 3771008 - RNA, 14 nt, Salmonella typhimurium LT2
gccaccaucgucgc

SEQ ID NO: 3771009 - RNA, 21 nt, Salmonella typhimurium LT2
gccaccaugaucaccugaagc

SEQ ID NO: 3771010 - RNA, 17 nt, Salmonella typhimurium LT2
gccacccacuucgccgg

SEQ ID NO: 3771011 - RNA, 15 nt, Salmonella typhimurium LT2
gccacccuccgggcc

SEQ ID NO: 3771012 - RNA, 13 nt, Salmonella typhimurium LT2
gccaccgccagcc

SEQ ID NO: 3771013 - RNA, 16 nt, Salmonella typhimurium LT2
gccaccgccagccaug

SEQ ID NO: 3771014 - RNA, 17 nt, Salmonella typhimurium LT2
gccaccggcacauccag

SEQ ID NO: 3771015 - RNA, 11 nt, Salmonella typhimurium LT2
gccaccggcag

SEQ ID NO: 3771016 - RNA, 21 nt, Salmonella typhimurium LT2
gccaccggcagcgucguccag

SEQ ID NO: 3771017 - RNA, 20 nt, Salmonella typhimurium LT2
gccaccgggcaacacacgcu

SEQ ID NO: 3771018 - RNA, 17 nt, Salmonella typhimurium LT2
gccaccgggcaacccgg

SEQ ID NO: 3771019 - RNA, 16 nt, Salmonella typhimurium LT2
gccaccgguggcauca

SEQ ID NO: 3771020 - RNA, 22 nt, Salmonella typhimurium LT2
gccaccgguuuuuuccugcaca

SEQ ID NO: 3771021 - RNA, 15 nt, Salmonella typhimurium LT2
gccaccguaacuaaa

SEQ ID NO: 3771022 - RNA, 20 nt, Salmonella typhimurium LT2
gccaccuguuucgccaggcc

SEQ ID NO: 3771023 - RNA, 16 nt, Salmonella typhimurium LT2
gccacgaccugcaguu

SEQ ID NO: 3771024 - RNA, 17 nt, Salmonella typhimurium LT2
gccacgacuaucguuac

SEQ ID NO: 3771025 - RNA, 20 nt, Salmonella typhimurium LT2
gccacgagaaauccacauua

SEQ ID NO: 3771026 - RNA, 21 nt, Salmonella typhimurium LT2
gccacgagaaauccacauuag

SEQ ID NO: 3771027 - RNA, 19 nt, Salmonella typhimurium LT2
gccacgaguggcgcggaaa

SEQ ID NO: 3771028 - RNA, 20 nt, Salmonella typhimurium LT2
gccacgcagauaucuuccag

SEQ ID NO: 3771029 - RNA, 21 nt, Salmonella typhimurium LT2
gccacgcagauaucuuccagc

SEQ ID NO: 3771030 - RNA, 20 nt, Salmonella typhimurium LT2
gccacgccccuaaggcagcg

SEQ ID NO: 3771031 - RNA, 22 nt, Salmonella typhimurium LT2
gccacgccgaggcauucagcca

SEQ ID NO: 3771032 - RNA, 12 nt, Salmonella typhimurium LT2
gccacgccgccc

SEQ ID NO: 3771033 - RNA, 16 nt, Salmonella typhimurium LT2
gccacgccgcccgcgu

SEQ ID NO: 3771034 - RNA, 23 nt, Salmonella typhimurium LT2
gccacgccguagcugcgcgccgc

SEQ ID NO: 3771035 - RNA, 14 nt, Salmonella typhimurium LT2
gccacgcgacgcca

SEQ ID NO: 3771036 - RNA, 21 nt, Salmonella typhimurium LT2
gccacgcucgcuggugccaau

SEQ ID NO: 3771037 - RNA, 20 nt, Salmonella typhimurium LT2
gccacggagcauaauuuucc

SEQ ID NO: 3771038 - RNA, 22 nt, Salmonella typhimurium LT2
gccacggauggccucugccagu

SEQ ID NO: 3771039 - RNA, 21 nt, Salmonella typhimurium LT2
gccacggcguguugaaguccu

SEQ ID NO: 3771040 - RNA, 16 nt, Salmonella typhimurium LT2
gccacgguacggcuuu

SEQ ID NO: 3771041 - RNA, 15 nt, Salmonella typhimurium LT2
gccacgguuggccca

SEQ ID NO: 3771042 - RNA, 17 nt, Salmonella typhimurium LT2
gccacgguuggcccagc

SEQ ID NO: 3771043 - RNA, 20 nt, Salmonella typhimurium LT2
gccacgucacgcaacaggcc

SEQ ID NO: 3771044 - RNA, 22 nt, Salmonella typhimurium LT2
gccacguugucggcucauccag

SEQ ID NO: 3771045 - RNA, 21 nt, Salmonella typhimurium LT2
gccacuaccagcguaccgaua

SEQ ID NO: 3771046 - RNA, 16 nt, Salmonella typhimurium LT2
gccacuacgccgauga

SEQ ID NO: 3771047 - RNA, 16 nt, Salmonella typhimurium LT2
gccacuagcucagcug

SEQ ID NO: 3771048 - RNA, 12 nt, Salmonella typhimurium LT2
gccacuauccag

SEQ ID NO: 3771049 - RNA, 12 nt, Salmonella typhimurium LT2
gccacucuccag

SEQ ID NO: 3771050 - RNA, 22 nt, Salmonella typhimurium LT2
gccacucuuccacuucaaucaa

SEQ ID NO: 3771051 - RNA, 19 nt, Salmonella typhimurium LT2
gccacugcauuacucgccu

SEQ ID NO: 3771052 - RNA, 16 nt, Salmonella typhimurium LT2
gccacugcgccauuaa

SEQ ID NO: 3771053 - RNA, 11 nt, Salmonella typhimurium LT2
gccacuguucg

SEQ ID NO: 3771054 - RNA, 18 nt, Salmonella typhimurium LT2
gccacuucacuggcggca

SEQ ID NO: 3771055 - RNA, 14 nt, Salmonella typhimurium LT2
gccacuuccagcgc

SEQ ID NO: 3771056 - RNA, 18 nt, Salmonella typhimurium LT2
gccagaaaaaaaagcgcc

SEQ ID NO: 3771057 - RNA, 14 nt, Salmonella typhimurium LT2
gccagaaaagaacc

SEQ ID NO: 3771058 - RNA, 18 nt, Salmonella typhimurium LT2
gccagaagagaagcuuuu

SEQ ID NO: 3771059 - RNA, 13 nt, Salmonella typhimurium LT2
gccagaagcccgg

SEQ ID NO: 3771060 - RNA, 17 nt, Salmonella typhimurium LT2
gccagaaugcccagcaa

SEQ ID NO: 3771061 - RNA, 22 nt, Salmonella typhimurium LT2
gccagacagcccuauaacagcg

SEQ ID NO: 3771062 - RNA, 12 nt, Salmonella typhimurium LT2
gccagacaggcu

SEQ ID NO: 3771063 - RNA, 17 nt, Salmonella typhimurium LT2
gccagacccagcgcuaa

SEQ ID NO: 3771064 - RNA, 13 nt, Salmonella typhimurium LT2
gccagacccgcgc

SEQ ID NO: 3771065 - RNA, 15 nt, Salmonella typhimurium LT2
gccagacgcgcagca

SEQ ID NO: 3771066 - RNA, 20 nt, Salmonella typhimurium LT2
gccagacggcgcccagccug

SEQ ID NO: 3771067 - RNA, 17 nt, Salmonella typhimurium LT2
gccagacgggccaggcg

SEQ ID NO: 3771068 - RNA, 13 nt, Salmonella typhimurium LT2
gccagagcgcgcu

SEQ ID NO: 3771069 - RNA, 15 nt, Salmonella typhimurium LT2
gccaggcacgccggc

SEQ ID NO: 3771070 - RNA, 18 nt, Salmonella typhimurium LT2
gccaggcauaccuccucu

SEQ ID NO: 3771071 - RNA, 16 nt, Salmonella typhimurium LT2
gccaggccacggcugu

SEQ ID NO: 3771072 - RNA, 21 nt, Salmonella typhimurium LT2
gccaggccaucgccgccauca

SEQ ID NO: 3771073 - RNA, 16 nt, Salmonella typhimurium LT2
gccaggcccaugauca

SEQ ID NO: 3771074 - RNA, 22 nt, Salmonella typhimurium LT2
gccaggcccgguggcgccgcgc

SEQ ID NO: 3771075 - RNA, 20 nt, Salmonella typhimurium LT2
gccaggcccguuccuuaguu

SEQ ID NO: 3771076 - RNA, 17 nt, Salmonella typhimurium LT2
gccaggccgcgccgcgc

SEQ ID NO: 3771077 - RNA, 19 nt, Salmonella typhimurium LT2
gccaggcgcuaucuucaau

SEQ ID NO: 3771078 - RNA, 18 nt, Salmonella typhimurium LT2
gccaggcggcaauauccu

SEQ ID NO: 3771079 - RNA, 21 nt, Salmonella typhimurium LT2
gccaggcuaagaucgccuucg

SEQ ID NO: 3771080 - RNA, 20 nt, Salmonella typhimurium LT2
gccagggaacuccagcaggg

SEQ ID NO: 3771081 - RNA, 21 nt, Salmonella typhimurium LT2
gccagggaacuccagcagggc

SEQ ID NO: 3771082 - RNA, 22 nt, Salmonella typhimurium LT2
gccagggccaaucagaaucaga

SEQ ID NO: 3771083 - RNA, 17 nt, Salmonella typhimurium LT2
gccagggcgcagguuuu

SEQ ID NO: 3771084 - RNA, 17 nt, Salmonella typhimurium LT2
gccaggggaugauuuuc

SEQ ID NO: 3771085 - RNA, 21 nt, Salmonella typhimurium LT2
gccaggggaugauuuucaggc

SEQ ID NO: 3771086 - RNA, 21 nt, Salmonella typhimurium LT2
gccaggguucaaccugauauu

SEQ ID NO: 3771087 - RNA, 21 nt, Salmonella typhimurium LT2
gccagguacaucgcgcuuaac

SEQ ID NO: 3771088 - RNA, 18 nt, Salmonella typhimurium LT2
gccaggucucauagcgcc

SEQ ID NO: 3771089 - RNA, 20 nt, Salmonella typhimurium LT2
gccaggucucauagcgcccc

SEQ ID NO: 3771090 - RNA, 16 nt, Salmonella typhimurium LT2
gccaggugccgagguu

SEQ ID NO: 3771091 - RNA, 15 nt, Salmonella typhimurium LT2
gccagguuauccagu

SEQ ID NO: 3771092 - RNA, 18 nt, Salmonella typhimurium LT2
gccagguugcgcccggcg

SEQ ID NO: 3771093 - RNA, 20 nt, Salmonella typhimurium LT2
gccagguugcgcccggcgca

SEQ ID NO: 3771094 - RNA, 22 nt, Salmonella typhimurium LT2
gccagguugcgcccggcgcauc

SEQ ID NO: 3771095 - RNA, 18 nt, Salmonella typhimurium LT2
gccaguaagcucaggcca

SEQ ID NO: 3771096 - RNA, 22 nt, Salmonella typhimurium LT2
gccaguaaucccggucgcgcca

SEQ ID NO: 3771097 - RNA, 18 nt, Salmonella typhimurium LT2
gccaguacagcacgccgg

SEQ ID NO: 3771098 - RNA, 18 nt, Salmonella typhimurium LT2
gccaguagauggcgcuaa

SEQ ID NO: 3771099 - RNA, 22 nt, Salmonella typhimurium LT2
gccaguagcgggggccggccgc

SEQ ID NO: 3771100 - RNA, 15 nt, Salmonella typhimurium LT2
gccaguagcucgccg

SEQ ID NO: 3771101 - RNA, 14 nt, Salmonella typhimurium LT2
gccaguagcugcuc

SEQ ID NO: 3771102 - RNA, 23 nt, Salmonella typhimurium LT2
gccaguauagcguuuuuuauucg

SEQ ID NO: 3771103 - RNA, 20 nt, Salmonella typhimurium LT2
gccaguauuggccucggggc

SEQ ID NO: 3771104 - RNA, 23 nt, Salmonella typhimurium LT2
gccagucaauaagcuugcuuucc

SEQ ID NO: 3771105 - RNA, 15 nt, Salmonella typhimurium LT2
gccagucaccagcag

SEQ ID NO: 3771106 - RNA, 13 nt, Salmonella typhimurium LT2
gccagucaucgcc

SEQ ID NO: 3771107 - RNA, 14 nt, Salmonella typhimurium LT2
gccaguccgcccgc

SEQ ID NO: 3771108 - RNA, 23 nt, Salmonella typhimurium LT2
gccaguccgguggcgaaaacgcu

SEQ ID NO: 3771109 - RNA, 22 nt, Salmonella typhimurium LT2
gccaguccuccggcugaagccc

SEQ ID NO: 3771110 - RNA, 15 nt, Salmonella typhimurium LT2
gccagucgccaggca

SEQ ID NO: 3771111 - RNA, 18 nt, Salmonella typhimurium LT2
gccagucuuccauuacaa

SEQ ID NO: 3771112 - RNA, 20 nt, Salmonella typhimurium LT2
gccagugcauagcagcgccc

SEQ ID NO: 3771113 - RNA, 14 nt, Salmonella typhimurium LT2
gccaguggggcugc

SEQ ID NO: 3771114 - RNA, 21 nt, Salmonella typhimurium LT2
gccaguuaagcaacugauuaa

SEQ ID NO: 3771115 - RNA, 15 nt, Salmonella typhimurium LT2
gccaguucacgccgc

SEQ ID NO: 3771116 - RNA, 23 nt, Salmonella typhimurium LT2
gccaguucauucgccaccaggcu

SEQ ID NO: 3771117 - RNA, 15 nt, Salmonella typhimurium LT2
gccaguuccgccacg

SEQ ID NO: 3771118 - RNA, 18 nt, Salmonella typhimurium LT2
gccaguugcgcaggguau

SEQ ID NO: 3771119 - RNA, 21 nt, Salmonella typhimurium LT2
gccaguuguccgcuggucagc

SEQ ID NO: 3771120 - RNA, 17 nt, Salmonella typhimurium LT2
gccaguuuagggaucau

SEQ ID NO: 3771121 - RNA, 15 nt, Salmonella typhimurium LT2
gccaguuuccugacc

SEQ ID NO: 3771122 - RNA, 21 nt, Salmonella typhimurium LT2
gccaguuucucgucauaguga

SEQ ID NO: 3771123 - RNA, 18 nt, Salmonella typhimurium LT2
gccauaacaacuauuuuu

SEQ ID NO: 3771124 - RNA, 21 nt, Salmonella typhimurium LT2
gccauaacaucacggguuuua

SEQ ID NO: 3771125 - RNA, 18 nt, Salmonella typhimurium LT2
gccauaacgccggcgcuu

SEQ ID NO: 3771126 - RNA, 22 nt, Salmonella typhimurium LT2
gccauaagcgaacaggccgaaa

SEQ ID NO: 3771127 - RNA, 23 nt, Salmonella typhimurium LT2
gccauaaucaguacugcgcccgc

SEQ ID NO: 3771128 - RNA, 17 nt, Salmonella typhimurium LT2
gccauaauggauuaggu

SEQ ID NO: 3771129 - RNA, 16 nt, Salmonella typhimurium LT2
gccauaauggcccagc

SEQ ID NO: 3771130 - RNA, 17 nt, Salmonella typhimurium LT2
gccauacuuacugcugu

SEQ ID NO: 3771131 - RNA, 13 nt, Salmonella typhimurium LT2
gccauagcgggca

SEQ ID NO: 3771132 - RNA, 18 nt, Salmonella typhimurium LT2
gccauaggucagcgcuuc

SEQ ID NO: 3771133 - RNA, 16 nt, Salmonella typhimurium LT2
gccauaucgccggcaa

SEQ ID NO: 3771134 - RNA, 17 nt, Salmonella typhimurium LT2
gccaucaacagcaggca

SEQ ID NO: 3771135 - RNA, 13 nt, Salmonella typhimurium LT2
gccaucaacgcca

SEQ ID NO: 3771136 - RNA, 22 nt, Salmonella typhimurium LT2
gccaucaacuucucgcaggcca

SEQ ID NO: 3771137 - RNA, 21 nt, Salmonella typhimurium LT2
gccaucaauccauuucgccag

SEQ ID NO: 3771138 - RNA, 20 nt, Salmonella typhimurium LT2
gccaucaccaucguugccag

SEQ ID NO: 3771139 - RNA, 17 nt, Salmonella typhimurium LT2
gccaucagacaggcaug

SEQ ID NO: 3771140 - RNA, 14 nt, Salmonella typhimurium LT2
gccaucagcaccuu

SEQ ID NO: 3771141 - RNA, 13 nt, Salmonella typhimurium LT2
gccaucagcgcga

SEQ ID NO: 3771142 - RNA, 17 nt, Salmonella typhimurium LT2
gccaucaggcaaugucu

SEQ ID NO: 3771143 - RNA, 16 nt, Salmonella typhimurium LT2
gccaucaggcaugacc

SEQ ID NO: 3771144 - RNA, 23 nt, Salmonella typhimurium LT2
gccaucaggccccccuuguuauc

SEQ ID NO: 3771145 - RNA, 16 nt, Salmonella typhimurium LT2
gccaucaggccuacga

SEQ ID NO: 3771146 - RNA, 19 nt, Salmonella typhimurium LT2
gccaucaugcagccggcga

SEQ ID NO: 3771147 - RNA, 21 nt, Salmonella typhimurium LT2
gccaucaugcccacaggcagg

SEQ ID NO: 3771148 - RNA, 15 nt, Salmonella typhimurium LT2
gccaucauuaccaac

SEQ ID NO: 3771149 - RNA, 19 nt, Salmonella typhimurium LT2
gccauccacggccccgggc

SEQ ID NO: 3771150 - RNA, 20 nt, Salmonella typhimurium LT2
gccauccagcaccaggcgag

SEQ ID NO: 3771151 - RNA, 17 nt, Salmonella typhimurium LT2
gccauccauugcgccac

SEQ ID NO: 3771152 - RNA, 21 nt, Salmonella typhimurium LT2
gccauccauugcgccacggau

SEQ ID NO: 3771153 - RNA, 22 nt, Salmonella typhimurium LT2
gccaucccaugcaccagcccca

SEQ ID NO: 3771154 - RNA, 22 nt, Salmonella typhimurium LT2
gccaucccggcgacagcgacca

SEQ ID NO: 3771155 - RNA, 16 nt, Salmonella typhimurium LT2
gccaucccugacaaua

SEQ ID NO: 3771156 - RNA, 16 nt, Salmonella typhimurium LT2
gccauccggcaacaaa

SEQ ID NO: 3771157 - RNA, 12 nt, Salmonella typhimurium LT2
gccauccggcac

SEQ ID NO: 3771158 - RNA, 13 nt, Salmonella typhimurium LT2
gccauccggcaga

SEQ ID NO: 3771159 - RNA, 20 nt, Salmonella typhimurium LT2
gccauccggcaucacaggcu

SEQ ID NO: 3771160 - RNA, 14 nt, Salmonella typhimurium LT2
gccauccucacgca

SEQ ID NO: 3771161 - RNA, 14 nt, Salmonella typhimurium LT2
gccauccugcaccg

SEQ ID NO: 3771162 - RNA, 22 nt, Salmonella typhimurium LT2
gccauccuguucaagcaauaau

SEQ ID NO: 3771163 - RNA, 13 nt, Salmonella typhimurium LT2
gccaucgacagcg

SEQ ID NO: 3771164 - RNA, 16 nt, Salmonella typhimurium LT2
gccaucgacagcgcca

SEQ ID NO: 3771165 - RNA, 14 nt, Salmonella typhimurium LT2
gccaucgccgccau

SEQ ID NO: 3771166 - RNA, 16 nt, Salmonella typhimurium LT2
gccaucgcgcacuucg

SEQ ID NO: 3771167 - RNA, 22 nt, Salmonella typhimurium LT2
gccaucgcuuugagcagcgcca

SEQ ID NO: 3771168 - RNA, 23 nt, Salmonella typhimurium LT2
gccaucggaaacuauccuggccu

SEQ ID NO: 3771169 - RNA, 20 nt, Salmonella typhimurium LT2
gccaucggcaaacgccgccu

SEQ ID NO: 3771170 - RNA, 11 nt, Salmonella typhimurium LT2
gccaucggcau

SEQ ID NO: 3771171 - RNA, 21 nt, Salmonella typhimurium LT2
gccaucggcauaacccgccgc

SEQ ID NO: 3771172 - RNA, 14 nt, Salmonella typhimurium LT2
gccccaaaauucac

SEQ ID NO: 3771173 - RNA, 18 nt, Salmonella typhimurium LT2
gccccaaccguuuugcaa

SEQ ID NO: 3771174 - RNA, 13 nt, Salmonella typhimurium LT2
gccccaauaccac

SEQ ID NO: 3771175 - RNA, 14 nt, Salmonella typhimurium LT2
gccccaaucgccag

SEQ ID NO: 3771176 - RNA, 16 nt, Salmonella typhimurium LT2
gccccacauuggaaaa

SEQ ID NO: 3771177 - RNA, 14 nt, Salmonella typhimurium LT2
gccccaccgccaga

SEQ ID NO: 3771178 - RNA, 12 nt, Salmonella typhimurium LT2
gccccagcacca

SEQ ID NO: 3771179 - RNA, 13 nt, Salmonella typhimurium LT2
gccccagcaccag

SEQ ID NO: 3771180 - RNA, 18 nt, Salmonella typhimurium LT2
gccccagcagcagccggu

SEQ ID NO: 3771181 - RNA, 18 nt, Salmonella typhimurium LT2
gccccagcaugagccagc

SEQ ID NO: 3771182 - RNA, 21 nt, Salmonella typhimurium LT2
gccccagcaugagccagcccu

SEQ ID NO: 3771183 - RNA, 17 nt, Salmonella typhimurium LT2
gccccagcgccagccgc

SEQ ID NO: 3771184 - RNA, 17 nt, Salmonella typhimurium LT2
gccccagcgccagcugc

SEQ ID NO: 3771185 - RNA, 21 nt, Salmonella typhimurium LT2
gccccagcgccagcugcguca

SEQ ID NO: 3771186 - RNA, 20 nt, Salmonella typhimurium LT2
gccccagcgguaccaccagc

SEQ ID NO: 3771187 - RNA, 21 nt, Salmonella typhimurium LT2
gccccaggccaauuccgccau

SEQ ID NO: 3771188 - RNA, 21 nt, Salmonella typhimurium LT2
gcccccaaauugaccucaugc

SEQ ID NO: 3771189 - RNA, 13 nt, Salmonella typhimurium LT2
gcccccaguuccu

SEQ ID NO: 3771190 - RNA, 16 nt, Salmonella typhimurium LT2
gcccccaguuccugcu

SEQ ID NO: 3771191 - RNA, 15 nt, Salmonella typhimurium LT2
gcccccaugccgccu

SEQ ID NO: 3771192 - RNA, 17 nt, Salmonella typhimurium LT2
gcccccaugccgccugc

SEQ ID NO: 3771193 - RNA, 19 nt, Salmonella typhimurium LT2
gcccccaugccgccugccg

SEQ ID NO: 3771194 - RNA, 17 nt, Salmonella typhimurium LT2
gcccccgaucacggcga

SEQ ID NO: 3771195 - RNA, 19 nt, Salmonella typhimurium LT2
gcccccgauucaaucuggu

SEQ ID NO: 3771196 - RNA, 14 nt, Salmonella typhimurium LT2
gcccccgcgcaggc

SEQ ID NO: 3771197 - RNA, 15 nt, Salmonella typhimurium LT2
gcccccuccagccag

SEQ ID NO: 3771198 - RNA, 15 nt, Salmonella typhimurium LT2
gccccgccauccggc

SEQ ID NO: 3771199 - RNA, 16 nt, Salmonella typhimurium LT2
gccccgccauccggca

SEQ ID NO: 3771200 - RNA, 16 nt, Salmonella typhimurium LT2
gccccgcgcgccugca

SEQ ID NO: 3771201 - RNA, 14 nt, Salmonella typhimurium LT2
gccccggcgcgcgc

SEQ ID NO: 3771202 - RNA, 12 nt, Salmonella typhimurium LT2
gccccggcggcg

SEQ ID NO: 3771203 - RNA, 15 nt, Salmonella typhimurium LT2
gccccggcuuaccgc

SEQ ID NO: 3771204 - RNA, 20 nt, Salmonella typhimurium LT2
gccccggucaacgcgccgcc

SEQ ID NO: 3771205 - RNA, 16 nt, Salmonella typhimurium LT2
gccccggugagcgccg

SEQ ID NO: 3771206 - RNA, 14 nt, Salmonella typhimurium LT2
gccccuaaggcagc

SEQ ID NO: 3771207 - RNA, 15 nt, Salmonella typhimurium LT2
gccccuaaggcagcg

SEQ ID NO: 3771208 - RNA, 20 nt, Salmonella typhimurium LT2
gccccucaauuauguauuuc

SEQ ID NO: 3771209 - RNA, 20 nt, Salmonella typhimurium LT2
gccccucgcuaaugcccggc

SEQ ID NO: 3771210 - RNA, 15 nt, Salmonella typhimurium LT2
gccccuggcaacuug

SEQ ID NO: 3771211 - RNA, 18 nt, Salmonella typhimurium LT2
gccccuggcgcgccagcu

SEQ ID NO: 3771212 - RNA, 20 nt, Salmonella typhimurium LT2
gccccuggcgcgccagcucu

SEQ ID NO: 3771213 - RNA, 22 nt, Salmonella typhimurium LT2
gccccuggcugaaagcaaccag

SEQ ID NO: 3771214 - RNA, 15 nt, Salmonella typhimurium LT2
gccccugggcgaaaa

SEQ ID NO: 3771215 - RNA, 17 nt, Salmonella typhimurium LT2
gccccuuccgccacggc

SEQ ID NO: 3771216 - RNA, 14 nt, Salmonella typhimurium LT2
gcccgaaaggacau

SEQ ID NO: 3771217 - RNA, 11 nt, Salmonella typhimurium LT2
gcccgaaucgc

SEQ ID NO: 3771218 - RNA, 13 nt, Salmonella typhimurium LT2
gcccgaaucgccg

SEQ ID NO: 3771219 - RNA, 23 nt, Salmonella typhimurium LT2
gcccgacaggguuugccagcacc

SEQ ID NO: 3771220 - RNA, 21 nt, Salmonella typhimurium LT2
gcccgaccacgcccagcuauu

SEQ ID NO: 3771221 - RNA, 21 nt, Salmonella typhimurium LT2
gcccgaccagagauaccuuug

SEQ ID NO: 3771222 - RNA, 15 nt, Salmonella typhimurium LT2
gcccgacgccgcggc

SEQ ID NO: 3771223 - RNA, 21 nt, Salmonella typhimurium LT2
gcccgacgcgccacuuccagc

SEQ ID NO: 3771224 - RNA, 23 nt, Salmonella typhimurium LT2
gcccgacuaccggcaccagcaau

SEQ ID NO: 3771225 - RNA, 18 nt, Salmonella typhimurium LT2
gcccgagcgacgcccugc

SEQ ID NO: 3771226 - RNA, 20 nt, Salmonella typhimurium LT2
gcccgauaagcaaagcgcca

SEQ ID NO: 3771227 - RNA, 20 nt, Salmonella typhimurium LT2
gcccgauaagcaagcgccau

SEQ ID NO: 3771228 - RNA, 14 nt, Salmonella typhimurium LT2
gcccgauaagcgcc

SEQ ID NO: 3771229 - RNA, 20 nt, Salmonella typhimurium LT2
gcccgauaagcgccgcgcca

SEQ ID NO: 3771230 - RNA, 14 nt, Salmonella typhimurium LT2
gcccgauaagcgcu

SEQ ID NO: 3771231 - RNA, 21 nt, Salmonella typhimurium LT2
gcccgauaagcgcuggcuugc

SEQ ID NO: 3771232 - RNA, 13 nt, Salmonella typhimurium LT2
gcccgcaaaagcg

SEQ ID NO: 3771233 - RNA, 21 nt, Salmonella typhimurium LT2
gcccgcaaacagagcgccggc

SEQ ID NO: 3771234 - RNA, 14 nt, Salmonella typhimurium LT2
gcccgcacucgcgc

SEQ ID NO: 3771235 - RNA, 16 nt, Salmonella typhimurium LT2
gcccgcagcaaaaaau

SEQ ID NO: 3771236 - RNA, 22 nt, Salmonella typhimurium LT2
gcccgcagcaaaaaauaccccg

SEQ ID NO: 3771237 - RNA, 19 nt, Salmonella typhimurium LT2
gcccgcaugguaaacgcau

SEQ ID NO: 3771238 - RNA, 23 nt, Salmonella typhimurium LT2
gcccgccaccagcacagcccagu

SEQ ID NO: 3771239 - RNA, 16 nt, Salmonella typhimurium LT2
gcccgccagcacagca

SEQ ID NO: 3771240 - RNA, 14 nt, Salmonella typhimurium LT2
gcccgccagcacca

SEQ ID NO: 3771241 - RNA, 15 nt, Salmonella typhimurium LT2
gcccgccgccaccau

SEQ ID NO: 3771242 - RNA, 12 nt, Salmonella typhimurium LT2
gcccgccgccag

SEQ ID NO: 3771243 - RNA, 13 nt, Salmonella typhimurium LT2
gcccgccgccagc

SEQ ID NO: 3771244 - RNA, 15 nt, Salmonella typhimurium LT2
gcccgccucaaacca

SEQ ID NO: 3771245 - RNA, 13 nt, Salmonella typhimurium LT2
gcccgcgcguuca

SEQ ID NO: 3771246 - RNA, 13 nt, Salmonella typhimurium LT2
gcccgcgcucugg

SEQ ID NO: 3771247 - RNA, 23 nt, Salmonella typhimurium LT2
gcccgcgcuucgcuauuccagag

SEQ ID NO: 3771248 - RNA, 11 nt, Salmonella typhimurium LT2
gcccgcggcga

SEQ ID NO: 3771249 - RNA, 21 nt, Salmonella typhimurium LT2
gcccgcggcgaucaccacgcc

SEQ ID NO: 3771250 - RNA, 20 nt, Salmonella typhimurium LT2
gcccgcguucugcugugccg

SEQ ID NO: 3771251 - RNA, 19 nt, Salmonella typhimurium LT2
gcccgcguuuaccaccgga

SEQ ID NO: 3771252 - RNA, 14 nt, Salmonella typhimurium LT2
gcccgcucguuuca

SEQ ID NO: 3771253 - RNA, 15 nt, Salmonella typhimurium LT2
gcccgcucugcgcca

SEQ ID NO: 3771254 - RNA, 21 nt, Salmonella typhimurium LT2
gcccgcuugcaccauggcggc

SEQ ID NO: 3771255 - RNA, 18 nt, Salmonella typhimurium LT2
gcccggacgaaccuggcg

SEQ ID NO: 3771256 - RNA, 22 nt, Salmonella typhimurium LT2
gcccggauaaccgcccgcggcg

SEQ ID NO: 3771257 - RNA, 17 nt, Salmonella typhimurium LT2
gcccggaucgcggccuu

SEQ ID NO: 3771258 - RNA, 17 nt, Salmonella typhimurium LT2
gcccggccacagcgcca

SEQ ID NO: 3771259 - RNA, 21 nt, Salmonella typhimurium LT2
gcccggcgcacacccugcaga

SEQ ID NO: 3771260 - RNA, 14 nt, Salmonella typhimurium LT2
gcccggcgccagcu

SEQ ID NO: 3771261 - RNA, 19 nt, Salmonella typhimurium LT2
gcccggcgccauccggcag

SEQ ID NO: 3771262 - RNA, 14 nt, Salmonella typhimurium LT2
gcccggcuccguca

SEQ ID NO: 3771263 - RNA, 23 nt, Salmonella typhimurium LT2
gcccggcuggacgucaugccgcc

SEQ ID NO: 3771264 - RNA, 11 nt, Salmonella typhimurium LT2
gcccggcuggc

SEQ ID NO: 3771265 - RNA, 22 nt, Salmonella typhimurium LT2
gcccgggagaacgccgggccug

SEQ ID NO: 3771266 - RNA, 11 nt, Salmonella typhimurium LT2
gcccgggcgcu

SEQ ID NO: 3771267 - RNA, 19 nt, Salmonella typhimurium LT2
gcccgggucguugacguga

SEQ ID NO: 3771268 - RNA, 19 nt, Salmonella typhimurium LT2
gcccgguaauuuugauaua

SEQ ID NO: 3771269 - RNA, 18 nt, Salmonella typhimurium LT2
gcccgguacguuaaccgg

SEQ ID NO: 3771270 - RNA, 23 nt, Salmonella typhimurium LT2
gcccgguagcgcaaacuaccggg

SEQ ID NO: 3771271 - RNA, 15 nt, Salmonella typhimurium LT2
gcccggugauggugc

SEQ ID NO: 3771272 - RNA, 23 nt, Salmonella typhimurium LT2
gcccggugauggugcagccccgg

SEQ ID NO: 3771273 - RNA, 19 nt, Salmonella typhimurium LT2
gcccgguggcgccgcgcca

SEQ ID NO: 3771274 - RNA, 15 nt, Salmonella typhimurium LT2
gcccgguggcgcugc

SEQ ID NO: 3771275 - RNA, 17 nt, Salmonella typhimurium LT2
gcccgguggcgcugcgc

SEQ ID NO: 3771276 - RNA, 18 nt, Salmonella typhimurium LT2
gccgcaaacgccugcucc

SEQ ID NO: 3771277 - RNA, 23 nt, Salmonella typhimurium LT2
gccgcaaaugaccagaucaacau

SEQ ID NO: 3771278 - RNA, 21 nt, Salmonella typhimurium LT2
gccgcaacacggugcggcauu

SEQ ID NO: 3771279 - RNA, 11 nt, Salmonella typhimurium LT2
gccgcaacaga

SEQ ID NO: 3771280 - RNA, 17 nt, Salmonella typhimurium LT2
gccgcacagaaucgccg

SEQ ID NO: 3771281 - RNA, 11 nt, Salmonella typhimurium LT2
gccgcagcgcc

SEQ ID NO: 3771282 - RNA, 15 nt, Salmonella typhimurium LT2
gccgcagcgccauaa

SEQ ID NO: 3771283 - RNA, 17 nt, Salmonella typhimurium LT2
gccgcagcuccaugucu

SEQ ID NO: 3771284 - RNA, 16 nt, Salmonella typhimurium LT2
gccgcaggacagcgac

SEQ ID NO: 3771285 - RNA, 12 nt, Salmonella typhimurium LT2
gccgcaggccau

SEQ ID NO: 3771286 - RNA, 20 nt, Salmonella typhimurium LT2
gccgcagugaagaauggcgc

SEQ ID NO: 3771287 - RNA, 19 nt, Salmonella typhimurium LT2
gccgcauaauagcgccaga

SEQ ID NO: 3771288 - RNA, 21 nt, Salmonella typhimurium LT2
gccgcauccccauagacagua

SEQ ID NO: 3771289 - RNA, 22 nt, Salmonella typhimurium LT2
gccgcauggagcaucagcgccg

SEQ ID NO: 3771290 - RNA, 13 nt, Salmonella typhimurium LT2
gccgcauuuuucc

SEQ ID NO: 3771291 - RNA, 17 nt, Salmonella typhimurium LT2
gccgcauuuuuccagcc

SEQ ID NO: 3771292 - RNA, 20 nt, Salmonella typhimurium LT2
gccgcauuuuuucuucaguu

SEQ ID NO: 3771293 - RNA, 18 nt, Salmonella typhimurium LT2
gccgccaaacuccaccug

SEQ ID NO: 3771294 - RNA, 20 nt, Salmonella typhimurium LT2
gccgccaaacugcgcgccgc

SEQ ID NO: 3771295 - RNA, 23 nt, Salmonella typhimurium LT2
gccgccaaacugcgcgccgcccu

SEQ ID NO: 3771296 - RNA, 13 nt, Salmonella typhimurium LT2
gccgccaaagcgg

SEQ ID NO: 3771297 - RNA, 13 nt, Salmonella typhimurium LT2
gccgccaacgcca

SEQ ID NO: 3771298 - RNA, 15 nt, Salmonella typhimurium LT2
gccgccaacgccggc

SEQ ID NO: 3771299 - RNA, 17 nt, Salmonella typhimurium LT2
gccgccaccacaaagcg

SEQ ID NO: 3771300 - RNA, 14 nt, Salmonella typhimurium LT2
gccgccaccgccuc

SEQ ID NO: 3771301 - RNA, 18 nt, Salmonella typhimurium LT2
gccgccacgaccugcagu

SEQ ID NO: 3771302 - RNA, 21 nt, Salmonella typhimurium LT2
gccgccagaucgugccagaua

SEQ ID NO: 3771303 - RNA, 11 nt, Salmonella typhimurium LT2
gccgccagcgu

SEQ ID NO: 3771304 - RNA, 21 nt, Salmonella typhimurium LT2
gccgccagcucgucggccagc

SEQ ID NO: 3771305 - RNA, 17 nt, Salmonella typhimurium LT2
gccgccagguuauccag

SEQ ID NO: 3771306 - RNA, 22 nt, Salmonella typhimurium LT2
gccgccaguaauuuuucuccca

SEQ ID NO: 3771307 - RNA, 20 nt, Salmonella typhimurium LT2
gccgccaucaggcaugaccu

SEQ ID NO: 3771308 - RNA, 13 nt, Salmonella typhimurium LT2
gccgccauccggc

SEQ ID NO: 3771309 - RNA, 16 nt, Salmonella typhimurium LT2
gccgccauccggcaca

SEQ ID NO: 3771310 - RNA, 16 nt, Salmonella typhimurium LT2
gccgccauccggccug

SEQ ID NO: 3771311 - RNA, 12 nt, Salmonella typhimurium LT2
gccgccauggcg

SEQ ID NO: 3771312 - RNA, 15 nt, Salmonella typhimurium LT2
gccgccauggcgaau

SEQ ID NO: 3771313 - RNA, 23 nt, Salmonella typhimurium LT2
gccgccauucgcuuccgccggga

SEQ ID NO: 3771314 - RNA, 14 nt, Salmonella typhimurium LT2
gccgcccaaccagc

SEQ ID NO: 3771315 - RNA, 18 nt, Salmonella typhimurium LT2
gccgcccaaccagcccag

SEQ ID NO: 3771316 - RNA, 17 nt, Salmonella typhimurium LT2
gccgcccaccugcagca

SEQ ID NO: 3771317 - RNA, 15 nt, Salmonella typhimurium LT2
gccgcccagcgaacu

SEQ ID NO: 3771318 - RNA, 11 nt, Salmonella typhimurium LT2
gccgcccaucc

SEQ ID NO: 3771319 - RNA, 17 nt, Salmonella typhimurium LT2
gccgcccaucgccacag

SEQ ID NO: 3771320 - RNA, 18 nt, Salmonella typhimurium LT2
gccgcccaucgccacagc

SEQ ID NO: 3771321 - RNA, 15 nt, Salmonella typhimurium LT2
gccgccccaaaucuc

SEQ ID NO: 3771322 - RNA, 17 nt, Salmonella typhimurium LT2
gccgcccccaugccgcc

SEQ ID NO: 3771323 - RNA, 18 nt, Salmonella typhimurium LT2
gccgcccggcuuccaucg

SEQ ID NO: 3771324 - RNA, 20 nt, Salmonella typhimurium LT2
gccgcccguuuuuuccagug

SEQ ID NO: 3771325 - RNA, 14 nt, Salmonella typhimurium LT2
gccgcccugcauca

SEQ ID NO: 3771326 - RNA, 14 nt, Salmonella typhimurium LT2
gccgccgacaggau

SEQ ID NO: 3771327 - RNA, 15 nt, Salmonella typhimurium LT2
gccgccgacaggaug

SEQ ID NO: 3771328 - RNA, 14 nt, Salmonella typhimurium LT2
gccgccgacgccga

SEQ ID NO: 3771329 - RNA, 12 nt, Salmonella typhimurium LT2
gccgccgagcgc

SEQ ID NO: 3771330 - RNA, 19 nt, Salmonella typhimurium LT2
gccgccgaggaucaguaac

SEQ ID NO: 3771331 - RNA, 18 nt, Salmonella typhimurium LT2
gccgccgcaccacugcug

SEQ ID NO: 3771332 - RNA, 23 nt, Salmonella typhimurium LT2
gccgccgcauuuugcuucacgug

SEQ ID NO: 3771333 - RNA, 18 nt, Salmonella typhimurium LT2
gccgccgggaucagcggc

SEQ ID NO: 3771334 - RNA, 18 nt, Salmonella typhimurium LT2
gccgccggugucuccguc

SEQ ID NO: 3771335 - RNA, 16 nt, Salmonella typhimurium LT2
gccgccguccaggccu

SEQ ID NO: 3771336 - RNA, 18 nt, Salmonella typhimurium LT2
gccgccuccagcauacug

SEQ ID NO: 3771337 - RNA, 16 nt, Salmonella typhimurium LT2
gccgccucgcgauccg

SEQ ID NO: 3771338 - RNA, 14 nt, Salmonella typhimurium LT2
gccgccucgcgcac

SEQ ID NO: 3771339 - RNA, 15 nt, Salmonella typhimurium LT2
gccgccucgcguagc

SEQ ID NO: 3771340 - RNA, 17 nt, Salmonella typhimurium LT2
gccgccugccagaucca

SEQ ID NO: 3771341 - RNA, 13 nt, Salmonella typhimurium LT2
gccgccuugcugc

SEQ ID NO: 3771342 - RNA, 23 nt, Salmonella typhimurium LT2
gccgccuuuuugaccgucaucca

SEQ ID NO: 3771343 - RNA, 20 nt, Salmonella typhimurium LT2
gccgcgagaacuuccgccac

SEQ ID NO: 3771344 - RNA, 19 nt, Salmonella typhimurium LT2
gccgcgagaaucgccagga

SEQ ID NO: 3771345 - RNA, 23 nt, Salmonella typhimurium LT2
gccgcgauacauugucgcagcgc

SEQ ID NO: 3771346 - RNA, 14 nt, Salmonella typhimurium LT2
gccgcgaucgcggc

SEQ ID NO: 3771347 - RNA, 16 nt, Salmonella typhimurium LT2
gccgcgcccagcgccg

SEQ ID NO: 3771348 - RNA, 13 nt, Salmonella typhimurium LT2
gccgcgccgcgca

SEQ ID NO: 3771349 - RNA, 12 nt, Salmonella typhimurium LT2
gccgcgccuuac

SEQ ID NO: 3771350 - RNA, 21 nt, Salmonella typhimurium LT2
gccgcgcgacagagccaacag

SEQ ID NO: 3771351 - RNA, 13 nt, Salmonella typhimurium LT2
gccgcgcgccgcc

SEQ ID NO: 3771352 - RNA, 15 nt, Salmonella typhimurium LT2
gccgcgcgccgccuc

SEQ ID NO: 3771353 - RNA, 13 nt, Salmonella typhimurium LT2
gccgcgggcagca

SEQ ID NO: 3771354 - RNA, 15 nt, Salmonella typhimurium LT2
gccgcgggcagcagc

SEQ ID NO: 3771355 - RNA, 20 nt, Salmonella typhimurium LT2
gccgcggugauccuccugca

SEQ ID NO: 3771356 - RNA, 13 nt, Salmonella typhimurium LT2
gccgcgugcucgc

SEQ ID NO: 3771357 - RNA, 16 nt, Salmonella typhimurium LT2
gccgcgugcucgcggc

SEQ ID NO: 3771358 - RNA, 17 nt, Salmonella typhimurium LT2
gccgcgugcucgcggcg

SEQ ID NO: 3771359 - RNA, 18 nt, Salmonella typhimurium LT2
gccgcguugcgcugaagu

SEQ ID NO: 3771360 - RNA, 19 nt, Salmonella typhimurium LT2
gccgcguuuuaaaccgcga

SEQ ID NO: 3771361 - RNA, 15 nt, Salmonella typhimurium LT2
gccgcuauccggcaa

SEQ ID NO: 3771362 - RNA, 15 nt, Salmonella typhimurium LT2
gccgcuaucgaccag

SEQ ID NO: 3771363 - RNA, 22 nt, Salmonella typhimurium LT2
gccgcuaucgaccagcaccugc

SEQ ID NO: 3771364 - RNA, 15 nt, Salmonella typhimurium LT2
gccgcuaucugcucc

SEQ ID NO: 3771365 - RNA, 19 nt, Salmonella typhimurium LT2
gccgcuaucugcuccgcca

SEQ ID NO: 3771366 - RNA, 20 nt, Salmonella typhimurium LT2
gccgcuaucugcuccgccag

SEQ ID NO: 3771367 - RNA, 19 nt, Salmonella typhimurium LT2
gccgcucagcucgacgacg

SEQ ID NO: 3771368 - RNA, 20 nt, Salmonella typhimurium LT2
gccgcucaucaccagcagca

SEQ ID NO: 3771369 - RNA, 14 nt, Salmonella typhimurium LT2
gccgcucccgcaug

SEQ ID NO: 3771370 - RNA, 16 nt, Salmonella typhimurium LT2
gccgcucccgcaugga

SEQ ID NO: 3771371 - RNA, 18 nt, Salmonella typhimurium LT2
gccgcucgaaucgccaug

SEQ ID NO: 3771372 - RNA, 18 nt, Salmonella typhimurium LT2
gccgcugaccgccggaaa

SEQ ID NO: 3771373 - RNA, 20 nt, Salmonella typhimurium LT2
gccgcugagaaaaagcgaag

SEQ ID NO: 3771374 - RNA, 14 nt, Salmonella typhimurium LT2
gccgcuggcgucuu

SEQ ID NO: 3771375 - RNA, 20 nt, Salmonella typhimurium LT2
gccgcuugugccgacgucgc

SEQ ID NO: 3771376 - RNA, 20 nt, Salmonella typhimurium LT2
gccgcuuugcgaacagcgca

SEQ ID NO: 3771377 - RNA, 17 nt, Salmonella typhimurium LT2
gccgcuuuugcauuaac

SEQ ID NO: 3771378 - RNA, 20 nt, Salmonella typhimurium LT2
gccgcuuuuuccgccgccgu

SEQ ID NO: 3771379 - RNA, 14 nt, Salmonella typhimurium LT2
gccggaaaaaggcc

SEQ ID NO: 3771380 - RNA, 20 nt, Salmonella typhimurium LT2
gccggaaaccuguucccggc

SEQ ID NO: 3771381 - RNA, 15 nt, Salmonella typhimurium LT2
gccgucgacaaagcc

SEQ ID NO: 3771382 - RNA, 15 nt, Salmonella typhimurium LT2
gccgucgcaggcggc

SEQ ID NO: 3771383 - RNA, 13 nt, Salmonella typhimurium LT2
gccgucggcagcc

SEQ ID NO: 3771384 - RNA, 18 nt, Salmonella typhimurium LT2
gccgucucuuucauggaa

SEQ ID NO: 3771385 - RNA, 18 nt, Salmonella typhimurium LT2
gccgucuggagcgaugac

SEQ ID NO: 3771386 - RNA, 21 nt, Salmonella typhimurium LT2
gccgucugguacggccaccag

SEQ ID NO: 3771387 - RNA, 14 nt, Salmonella typhimurium LT2
gccgugaacgccaa

SEQ ID NO: 3771388 - RNA, 15 nt, Salmonella typhimurium LT2
gccgugaacgccaaa

SEQ ID NO: 3771389 - RNA, 13 nt, Salmonella typhimurium LT2
gccgugaucccaa

SEQ ID NO: 3771390 - RNA, 19 nt, Salmonella typhimurium LT2
gccgugcgccgacaucgcc

SEQ ID NO: 3771391 - RNA, 19 nt, Salmonella typhimurium LT2
gccgugcucauccaacugc

SEQ ID NO: 3771392 - RNA, 17 nt, Salmonella typhimurium LT2
gccguggcgagccggaa

SEQ ID NO: 3771393 - RNA, 12 nt, Salmonella typhimurium LT2
gccguggcuggc

SEQ ID NO: 3771394 - RNA, 19 nt, Salmonella typhimurium LT2
gccgugggauugcagcaga

SEQ ID NO: 3771395 - RNA, 19 nt, Salmonella typhimurium LT2
gccguguugugugccgcgc

SEQ ID NO: 3771396 - RNA, 13 nt, Salmonella typhimurium LT2
gccguuaccagca

SEQ ID NO: 3771397 - RNA, 22 nt, Salmonella typhimurium LT2
gccguuacugcucguagcguuu

SEQ ID NO: 3771398 - RNA, 14 nt, Salmonella typhimurium LT2
gccguuaucuacgg

SEQ ID NO: 3771399 - RNA, 16 nt, Salmonella typhimurium LT2
gccguucaccagccac

SEQ ID NO: 3771400 - RNA, 19 nt, Salmonella typhimurium LT2
gccguucaugcacucgcga

SEQ ID NO: 3771401 - RNA, 22 nt, Salmonella typhimurium LT2
gccguucauucgccccagcaua

SEQ ID NO: 3771402 - RNA, 21 nt, Salmonella typhimurium LT2
gccguucauuugcaauggccc

SEQ ID NO: 3771403 - RNA, 12 nt, Salmonella typhimurium LT2
gccguuccgcua

SEQ ID NO: 3771404 - RNA, 19 nt, Salmonella typhimurium LT2
gccguugaccauaucgucg

SEQ ID NO: 3771405 - RNA, 16 nt, Salmonella typhimurium LT2
gccguuucaacccccu

SEQ ID NO: 3771406 - RNA, 22 nt, Salmonella typhimurium LT2
gccguuuuaaccaguucaggau

SEQ ID NO: 3771407 - RNA, 19 nt, Salmonella typhimurium LT2
gccguuuuaacgucaucac

SEQ ID NO: 3771408 - RNA, 22 nt, Salmonella typhimurium LT2
gccguuuuaacgucaucaccag

SEQ ID NO: 3771409 - RNA, 18 nt, Salmonella typhimurium LT2
gccguuuuagguucuuca

SEQ ID NO: 3771410 - RNA, 16 nt, Salmonella typhimurium LT2
gccguuuuaucgcccg

SEQ ID NO: 3771411 - RNA, 14 nt, Salmonella typhimurium LT2
gccguuuuccagcc

SEQ ID NO: 3771412 - RNA, 13 nt, Salmonella typhimurium LT2
gccguuuuccggu

SEQ ID NO: 3771413 - RNA, 13 nt, Salmonella typhimurium LT2
gccguuuugucua

SEQ ID NO: 3771414 - RNA, 19 nt, Salmonella typhimurium LT2
gccguuuuuaacaccggca

SEQ ID NO: 3771415 - RNA, 14 nt, Salmonella typhimurium LT2
gccuaaauuuaacu

SEQ ID NO: 3771416 - RNA, 13 nt, Salmonella typhimurium LT2
gccuaacagcgcc

SEQ ID NO: 3771417 - RNA, 12 nt, Salmonella typhimurium LT2
gccuaacuggaa

SEQ ID NO: 3771418 - RNA, 12 nt, Salmonella typhimurium LT2
gccuaagcccac

SEQ ID NO: 3771419 - RNA, 21 nt, Salmonella typhimurium LT2
gccuaaguggauagaguuaaa

SEQ ID NO: 3771420 - RNA, 15 nt, Salmonella typhimurium LT2
gccuaaugagccaga

SEQ ID NO: 3771421 - RNA, 21 nt, Salmonella typhimurium LT2
gccuacaacucagcguaacug

SEQ ID NO: 3771422 - RNA, 12 nt, Salmonella typhimurium LT2
gccuacaagaau

SEQ ID NO: 3771423 - RNA, 21 nt, Salmonella typhimurium LT2
gccuacaagaucgcaacgugc

SEQ ID NO: 3771424 - RNA, 15 nt, Salmonella typhimurium LT2
gccuacacaucaucu

SEQ ID NO: 3771425 - RNA, 20 nt, Salmonella typhimurium LT2
gccuacaccguuucugaucu

SEQ ID NO: 3771426 - RNA, 14 nt, Salmonella typhimurium LT2
gccuacagcugauu

SEQ ID NO: 3771427 - RNA, 22 nt, Salmonella typhimurium LT2
gccuacaggacugcacgaaaug

SEQ ID NO: 3771428 - RNA, 14 nt, Salmonella typhimurium LT2
gccuaccagcacau

SEQ ID NO: 3771429 - RNA, 19 nt, Salmonella typhimurium LT2
gccuaccagcgcuauccag

SEQ ID NO: 3771430 - RNA, 15 nt, Salmonella typhimurium LT2
gccuaccagucgacu

SEQ ID NO: 3771431 - RNA, 17 nt, Salmonella typhimurium LT2
gccuacccuuucacccg

SEQ ID NO: 3771432 - RNA, 20 nt, Salmonella typhimurium LT2
gccuacccuuucacccgcgc

SEQ ID NO: 3771433 - RNA, 19 nt, Salmonella typhimurium LT2
gccuaccggaauacacaau

SEQ ID NO: 3771434 - RNA, 16 nt, Salmonella typhimurium LT2
gccuaccugccgccau

SEQ ID NO: 3771435 - RNA, 17 nt, Salmonella typhimurium LT2
gccuaccugccgccaua

SEQ ID NO: 3771436 - RNA, 18 nt, Salmonella typhimurium LT2
gccuacgugcucacggca

SEQ ID NO: 3771437 - RNA, 20 nt, Salmonella typhimurium LT2
gccuacgugcucucaacaua

SEQ ID NO: 3771438 - RNA, 14 nt, Salmonella typhimurium LT2
gccuagaugaauga

SEQ ID NO: 3771439 - RNA, 15 nt, Salmonella typhimurium LT2
gccuagaugaaugac

SEQ ID NO: 3771440 - RNA, 14 nt, Salmonella typhimurium LT2
gccuagcgcgcgca

SEQ ID NO: 3771441 - RNA, 13 nt, Salmonella typhimurium LT2
gccuaucaggccu

SEQ ID NO: 3771442 - RNA, 12 nt, Salmonella typhimurium LT2
gccuaucgccau

SEQ ID NO: 3771443 - RNA, 18 nt, Salmonella typhimurium LT2
gccuauuuucucuuccac

SEQ ID NO: 3771444 - RNA, 21 nt, Salmonella typhimurium LT2
gccucacccugaaauccggcu

SEQ ID NO: 3771445 - RNA, 16 nt, Salmonella typhimurium LT2
gccucacguagaucuu

SEQ ID NO: 3771446 - RNA, 17 nt, Salmonella typhimurium LT2
gccucagugaaucgcau

SEQ ID NO: 3771447 - RNA, 16 nt, Salmonella typhimurium LT2
gccucauccgcugaca

SEQ ID NO: 3771448 - RNA, 20 nt, Salmonella typhimurium LT2
gccucaucgacagacuucac

SEQ ID NO: 3771449 - RNA, 16 nt, Salmonella typhimurium LT2
gccucauuaaaaaaac

SEQ ID NO: 3771450 - RNA, 22 nt, Salmonella typhimurium LT2
gccuccagacuggcgaccgcca

SEQ ID NO: 3771451 - RNA, 18 nt, Salmonella typhimurium LT2
gccuccagcacuuccuga

SEQ ID NO: 3771452 - RNA, 17 nt, Salmonella typhimurium LT2
gccucccccucaaucgg

SEQ ID NO: 3771453 - RNA, 13 nt, Salmonella typhimurium LT2
gccuccccugccg

SEQ ID NO: 3771454 - RNA, 16 nt, Salmonella typhimurium LT2
gccuccgaagagaccu

SEQ ID NO: 3771455 - RNA, 20 nt, Salmonella typhimurium LT2
gccuccggaugacgccgcuu

SEQ ID NO: 3771456 - RNA, 18 nt, Salmonella typhimurium LT2
gccucgaaaauauauucu

SEQ ID NO: 3771457 - RNA, 18 nt, Salmonella typhimurium LT2
gccucgccaaagcgcugc

SEQ ID NO: 3771458 - RNA, 13 nt, Salmonella typhimurium LT2
gccucgccccuuc

SEQ ID NO: 3771459 - RNA, 18 nt, Salmonella typhimurium LT2
gccucgccccuucggggc

SEQ ID NO: 3771460 - RNA, 16 nt, Salmonella typhimurium LT2
gccucgcgauccgcca

SEQ ID NO: 3771461 - RNA, 17 nt, Salmonella typhimurium LT2
gccucgcgauccgccag

SEQ ID NO: 3771462 - RNA, 17 nt, Salmonella typhimurium LT2
gccucgcgcaccccggc

SEQ ID NO: 3771463 - RNA, 15 nt, Salmonella typhimurium LT2
gccucgcucaccggc

SEQ ID NO: 3771464 - RNA, 11 nt, Salmonella typhimurium LT2
gccucgcugac

SEQ ID NO: 3771465 - RNA, 15 nt, Salmonella typhimurium LT2
gccucgcugacgcca

SEQ ID NO: 3771466 - RNA, 17 nt, Salmonella typhimurium LT2
gccucgcugacgccagc

SEQ ID NO: 3771467 - RNA, 21 nt, Salmonella typhimurium LT2
gccucgcugacgccagccagc

SEQ ID NO: 3771468 - RNA, 22 nt, Salmonella typhimurium LT2
gccucgcugauacgcaccagcu

SEQ ID NO: 3771469 - RNA, 17 nt, Salmonella typhimurium LT2
gccucguccugcaauuu

SEQ ID NO: 3771470 - RNA, 15 nt, Salmonella typhimurium LT2
gccucguuugcugag

SEQ ID NO: 3771471 - RNA, 17 nt, Salmonella typhimurium LT2
gccucguuugcugagca

SEQ ID NO: 3771472 - RNA, 14 nt, Salmonella typhimurium LT2
gccucuaucuucuc

SEQ ID NO: 3771473 - RNA, 16 nt, Salmonella typhimurium LT2
gccucuaucuucucag

SEQ ID NO: 3771474 - RNA, 13 nt, Salmonella typhimurium LT2
gccucucccgaac

SEQ ID NO: 3771475 - RNA, 19 nt, Salmonella typhimurium LT2
gccucuccucgaugcgccg

SEQ ID NO: 3771476 - RNA, 18 nt, Salmonella typhimurium LT2
gccucucguaagagaggc

SEQ ID NO: 3771477 - RNA, 14 nt, Salmonella typhimurium LT2
gccucuuccgccug

SEQ ID NO: 3771478 - RNA, 18 nt, Salmonella typhimurium LT2
gccucuuucagccggcua

SEQ ID NO: 3771479 - RNA, 18 nt, Salmonella typhimurium LT2
gccucuuuuuagcagcaa

SEQ ID NO: 3771480 - RNA, 21 nt, Salmonella typhimurium LT2
gccucuuuuuucgccacgcca

SEQ ID NO: 3771481 - RNA, 23 nt, Salmonella typhimurium LT2
gccugaaaauagcgccauugcga

SEQ ID NO: 3771482 - RNA, 16 nt, Salmonella typhimurium LT2
gccugaaagauuauuu

SEQ ID NO: 3771483 - RNA, 14 nt, Salmonella typhimurium LT2
gccugaaccggugg

SEQ ID NO: 3771484 - RNA, 22 nt, Salmonella typhimurium LT2
gccugaacgaagagaugccgga

SEQ ID NO: 3771485 - RNA, 18 nt, Salmonella typhimurium LT2
gccugaauaaucggcguc

SEQ ID NO: 3771486 - RNA, 17 nt, Salmonella typhimurium LT2
gcgaauuacuaaucugu

SEQ ID NO: 3771487 - RNA, 18 nt, Salmonella typhimurium LT2
gcgaauuucaaucgccag

SEQ ID NO: 3771488 - RNA, 20 nt, Salmonella typhimurium LT2
gcgaauuuccugccagaccu

SEQ ID NO: 3771489 - RNA, 19 nt, Salmonella typhimurium LT2
gcgaauuucggcaaugacg

SEQ ID NO: 3771490 - RNA, 21 nt, Salmonella typhimurium LT2
gcgaauuucggcaaugacggu

SEQ ID NO: 3771491 - RNA, 17 nt, Salmonella typhimurium LT2
gcgaauuugccccagau

SEQ ID NO: 3771492 - RNA, 16 nt, Salmonella typhimurium LT2
gcgacaaacagcgccc

SEQ ID NO: 3771493 - RNA, 23 nt, Salmonella typhimurium LT2
gcgacaaaucugccgggagcaga

SEQ ID NO: 3771494 - RNA, 14 nt, Salmonella typhimurium LT2
gcgacaacgccgga

SEQ ID NO: 3771495 - RNA, 23 nt, Salmonella typhimurium LT2
gcgacacgcgcgcugcgccugga

SEQ ID NO: 3771496 - RNA, 20 nt, Salmonella typhimurium LT2
gcgacagacgcuuaucgccg

SEQ ID NO: 3771497 - RNA, 15 nt, Salmonella typhimurium LT2
gcgacagcgcgccaa

SEQ ID NO: 3771498 - RNA, 21 nt, Salmonella typhimurium LT2
gcgacagucgcagagcccagc

SEQ ID NO: 3771499 - RNA, 16 nt, Salmonella typhimurium LT2
gcgacaucagccagcc

SEQ ID NO: 3771500 - RNA, 14 nt, Salmonella typhimurium LT2
gcgacaucccagac

SEQ ID NO: 3771501 - RNA, 14 nt, Salmonella typhimurium LT2
gcgacauccgcuuu

SEQ ID NO: 3771502 - RNA, 16 nt, Salmonella typhimurium LT2
gcgaccaacagcauca

SEQ ID NO: 3771503 - RNA, 17 nt, Salmonella typhimurium LT2
gcgaccaauauccgcag

SEQ ID NO: 3771504 - RNA, 18 nt, Salmonella typhimurium LT2
gcgaccaccgucccagua

SEQ ID NO: 3771505 - RNA, 14 nt, Salmonella typhimurium LT2
gcgaccacgccagc

SEQ ID NO: 3771506 - RNA, 18 nt, Salmonella typhimurium LT2
gcgaccacgccagccagc

SEQ ID NO: 3771507 - RNA, 19 nt, Salmonella typhimurium LT2
gcgaccacgccagccagcc

SEQ ID NO: 3771508 - RNA, 21 nt, Salmonella typhimurium LT2
gcgaccacuagcgccgccagc

SEQ ID NO: 3771509 - RNA, 11 nt, Salmonella typhimurium LT2
gcgaccagcgc

SEQ ID NO: 3771510 - RNA, 15 nt, Salmonella typhimurium LT2
gcgaccagcgcacca

SEQ ID NO: 3771511 - RNA, 20 nt, Salmonella typhimurium LT2
gcgaccaguucaccggcggc

SEQ ID NO: 3771512 - RNA, 13 nt, Salmonella typhimurium LT2
gcgacccagcgca

SEQ ID NO: 3771513 - RNA, 20 nt, Salmonella typhimurium LT2
gcgaccgcaucaaugcccag

SEQ ID NO: 3771514 - RNA, 21 nt, Salmonella typhimurium LT2
gcgaccgcgccggucgccagc

SEQ ID NO: 3771515 - RNA, 11 nt, Salmonella typhimurium LT2
gcgaccggcac

SEQ ID NO: 3771516 - RNA, 23 nt, Salmonella typhimurium LT2
gcgaccggcucgcuguucgccag

SEQ ID NO: 3771517 - RNA, 17 nt, Salmonella typhimurium LT2
gcgaccucuugcgcgac

SEQ ID NO: 3771518 - RNA, 16 nt, Salmonella typhimurium LT2
gcgacgacacggcgca

SEQ ID NO: 3771519 - RNA, 18 nt, Salmonella typhimurium LT2
gcgacgacacggcgcaga

SEQ ID NO: 3771520 - RNA, 22 nt, Salmonella typhimurium LT2
gcgacgccagauuaucggccag

SEQ ID NO: 3771521 - RNA, 14 nt, Salmonella typhimurium LT2
gcgacgccgccauc

SEQ ID NO: 3771522 - RNA, 21 nt, Salmonella typhimurium LT2
gcgacgccucguuugcugagc

SEQ ID NO: 3771523 - RNA, 13 nt, Salmonella typhimurium LT2
gcgacgcgcaccc

SEQ ID NO: 3771524 - RNA, 17 nt, Salmonella typhimurium LT2
gcgacgcgcacccggcu

SEQ ID NO: 3771525 - RNA, 15 nt, Salmonella typhimurium LT2
gcgacgcucuuugga

SEQ ID NO: 3771526 - RNA, 15 nt, Salmonella typhimurium LT2
gcgacggaccggcag

SEQ ID NO: 3771527 - RNA, 16 nt, Salmonella typhimurium LT2
gcgacggcaucggcau

SEQ ID NO: 3771528 - RNA, 20 nt, Salmonella typhimurium LT2
gcgacguaaugaucagcgcu

SEQ ID NO: 3771529 - RNA, 18 nt, Salmonella typhimurium LT2
gcgacguccgccaacagc

SEQ ID NO: 3771530 - RNA, 19 nt, Salmonella typhimurium LT2
gcgacguuaacgccgccau

SEQ ID NO: 3771531 - RNA, 23 nt, Salmonella typhimurium LT2
gcgacuacgguaaaccaggccag

SEQ ID NO: 3771532 - RNA, 22 nt, Salmonella typhimurium LT2
gcgacuaucccucugaagcgcu

SEQ ID NO: 3771533 - RNA, 13 nt, Salmonella typhimurium LT2
gcgacucauccac

SEQ ID NO: 3771534 - RNA, 18 nt, Salmonella typhimurium LT2
gcgacuggaacaggccaa

SEQ ID NO: 3771535 - RNA, 16 nt, Salmonella typhimurium LT2
gcgacuucgcuuccug

SEQ ID NO: 3771536 - RNA, 20 nt, Salmonella typhimurium LT2
gcgacuuuccgccaccagau

SEQ ID NO: 3771537 - RNA, 14 nt, Salmonella typhimurium LT2
gcgacuuugcgccg

SEQ ID NO: 3771538 - RNA, 18 nt, Salmonella typhimurium LT2
gcgacuuuuuucacccag

SEQ ID NO: 3771539 - RNA, 15 nt, Salmonella typhimurium LT2
gcgagaaucgccagg

SEQ ID NO: 3771540 - RNA, 16 nt, Salmonella typhimurium LT2
gcgagaguuugugaug

SEQ ID NO: 3771541 - RNA, 20 nt, Salmonella typhimurium LT2
gcgagcaaaacccggugcgg

SEQ ID NO: 3771542 - RNA, 19 nt, Salmonella typhimurium LT2
gcgagcgauagagaguucc

SEQ ID NO: 3771543 - RNA, 18 nt, Salmonella typhimurium LT2
gcgagcguuccguauuuu

SEQ ID NO: 3771544 - RNA, 19 nt, Salmonella typhimurium LT2
gcgagcguuuugaugucca

SEQ ID NO: 3771545 - RNA, 20 nt, Salmonella typhimurium LT2
gcgagcugccaguucauucc

SEQ ID NO: 3771546 - RNA, 16 nt, Salmonella typhimurium LT2
gcgagcuucucgccgg

SEQ ID NO: 3771547 - RNA, 21 nt, Salmonella typhimurium LT2
gcgaggcagcggcgaucaucu

SEQ ID NO: 3771548 - RNA, 14 nt, Salmonella typhimurium LT2
gcgaggccaacggc

SEQ ID NO: 3771549 - RNA, 15 nt, Salmonella typhimurium LT2
gcgaggucgagcuca

SEQ ID NO: 3771550 - RNA, 17 nt, Salmonella typhimurium LT2
gcgagguucccgccgcc

SEQ ID NO: 3771551 - RNA, 18 nt, Salmonella typhimurium LT2
gcgagguuuuagcguguc

SEQ ID NO: 3771552 - RNA, 17 nt, Salmonella typhimurium LT2
gcgaguuaagcgcccgc

SEQ ID NO: 3771553 - RNA, 21 nt, Salmonella typhimurium LT2
gcgauaaaaauauccgccauc

SEQ ID NO: 3771554 - RNA, 17 nt, Salmonella typhimurium LT2
gcgauaaaccagcccca

SEQ ID NO: 3771555 - RNA, 13 nt, Salmonella typhimurium LT2
gcgauaaacgauc

SEQ ID NO: 3771556 - RNA, 14 nt, Salmonella typhimurium LT2
gcgauaaacgccag

SEQ ID NO: 3771557 - RNA, 20 nt, Salmonella typhimurium LT2
gcgauaaacgccagcccuuc

SEQ ID NO: 3771558 - RNA, 16 nt, Salmonella typhimurium LT2
gcgauaacccgcgcau

SEQ ID NO: 3771559 - RNA, 17 nt, Salmonella typhimurium LT2
gcgauaaccgccgccgc

SEQ ID NO: 3771560 - RNA, 19 nt, Salmonella typhimurium LT2
gcgauaaccgccgccgcgc

SEQ ID NO: 3771561 - RNA, 14 nt, Salmonella typhimurium LT2
gcgauaagcgucuu

SEQ ID NO: 3771562 - RNA, 20 nt, Salmonella typhimurium LT2
gcgauaaggucgcuauccag

SEQ ID NO: 3771563 - RNA, 19 nt, Salmonella typhimurium LT2
gcgauaccaguaauacgcc

SEQ ID NO: 3771564 - RNA, 19 nt, Salmonella typhimurium LT2
gcgauacgcagaaccgccg

SEQ ID NO: 3771565 - RNA, 18 nt, Salmonella typhimurium LT2
gcgauacggauagcguca

SEQ ID NO: 3771566 - RNA, 15 nt, Salmonella typhimurium LT2
gcgauacguaggccu

SEQ ID NO: 3771567 - RNA, 15 nt, Salmonella typhimurium LT2
gcgauacucucgcag

SEQ ID NO: 3771568 - RNA, 19 nt, Salmonella typhimurium LT2
gcgauacugccgcccaucg

SEQ ID NO: 3771569 - RNA, 22 nt, Salmonella typhimurium LT2
gcgauacugccgcccaucgcca

SEQ ID NO: 3771570 - RNA, 14 nt, Salmonella typhimurium LT2
gcgauacuggcagu

SEQ ID NO: 3771571 - RNA, 14 nt, Salmonella typhimurium LT2
gcgauagagaguuc

SEQ ID NO: 3771572 - RNA, 20 nt, Salmonella typhimurium LT2
gcgauagagaguuccuccug

SEQ ID NO: 3771573 - RNA, 13 nt, Salmonella typhimurium LT2
gcgauagcugcug

SEQ ID NO: 3771574 - RNA, 13 nt, Salmonella typhimurium LT2
gcgauauagcgca

SEQ ID NO: 3771575 - RNA, 15 nt, Salmonella typhimurium LT2
gcgauauccggacaa

SEQ ID NO: 3771576 - RNA, 21 nt, Salmonella typhimurium LT2
gcgauauuguccgucagcgca

SEQ ID NO: 3771577 - RNA, 20 nt, Salmonella typhimurium LT2
gcgaucaauuuuuaguucgc

SEQ ID NO: 3771578 - RNA, 20 nt, Salmonella typhimurium LT2
gcgaucaccagcaccgccag

SEQ ID NO: 3771579 - RNA, 24 nt, Salmonella typhimurium LT2
gcgaucaccagcaccgccagcgca

SEQ ID NO: 3771580 - RNA, 13 nt, Salmonella typhimurium LT2
gcgaucagcgcca

SEQ ID NO: 3771581 - RNA, 15 nt, Salmonella typhimurium LT2
gcgaucagcgccacc

SEQ ID NO: 3771582 - RNA, 19 nt, Salmonella typhimurium LT2
gcgaucagcucuucgcuuu

SEQ ID NO: 3771583 - RNA, 22 nt, Salmonella typhimurium LT2
gcgauccaacaauuauauacga

SEQ ID NO: 3771584 - RNA, 22 nt, Salmonella typhimurium LT2
gcgauccacaaucgucgugccu

SEQ ID NO: 3771585 - RNA, 20 nt, Salmonella typhimurium LT2
gcgauccagccccagcgcca

SEQ ID NO: 3771586 - RNA, 22 nt, Salmonella typhimurium LT2
gcgauccagccccagcgccagc

SEQ ID NO: 3771587 - RNA, 17 nt, Salmonella typhimurium LT2
gcgauccaggucuuccg

SEQ ID NO: 3771588 - RNA, 21 nt, Salmonella typhimurium LT2
gcgauccaggucuuccgccgg

SEQ ID NO: 3771589 - RNA, 16 nt, Salmonella typhimurium LT2
gcgaucgcgauucgcc

SEQ ID NO: 3771590 - RNA, 17 nt, Salmonella typhimurium LT2
gcgcauuaacacgcucu

SEQ ID NO: 3771591 - RNA, 21 nt, Salmonella typhimurium LT2
gcgcauuaacgccgugcucau

SEQ ID NO: 3771592 - RNA, 22 nt, Salmonella typhimurium LT2
gcgcauuauguaauaacugacg

SEQ ID NO: 3771593 - RNA, 22 nt, Salmonella typhimurium LT2
gcgcauucuugcgccgcaaacu

SEQ ID NO: 3771594 - RNA, 14 nt, Salmonella typhimurium LT2
gcgcauugcccuuc

SEQ ID NO: 3771595 - RNA, 21 nt, Salmonella typhimurium LT2
gcgcauugcccuucgcgcgau

SEQ ID NO: 3771596 - RNA, 19 nt, Salmonella typhimurium LT2
gcgcauugccugaaccggu

SEQ ID NO: 3771597 - RNA, 21 nt, Salmonella typhimurium LT2
gcgcauugcgucccagcacaa

SEQ ID NO: 3771598 - RNA, 13 nt, Salmonella typhimurium LT2
gcgcauugcuguc

SEQ ID NO: 3771599 - RNA, 17 nt, Salmonella typhimurium LT2
gcgcauuuuacugccgu

SEQ ID NO: 3771600 - RNA, 19 nt, Salmonella typhimurium LT2
gcgccaaaagaggcagcaa

SEQ ID NO: 3771601 - RNA, 21 nt, Salmonella typhimurium LT2
gcgccaaacgggcaagccagc

SEQ ID NO: 3771602 - RNA, 19 nt, Salmonella typhimurium LT2
gcgccaaagcaaucgccag

SEQ ID NO: 3771603 - RNA, 14 nt, Salmonella typhimurium LT2
gcgccaagcgccuc

SEQ ID NO: 3771604 - RNA, 18 nt, Salmonella typhimurium LT2
gcgccaauauagccgaug

SEQ ID NO: 3771605 - RNA, 21 nt, Salmonella typhimurium LT2
gcgccaaucaccgccagcaac

SEQ ID NO: 3771606 - RNA, 17 nt, Salmonella typhimurium LT2
gcgccaaugcgaaaaua

SEQ ID NO: 3771607 - RNA, 19 nt, Salmonella typhimurium LT2
gcgccaccacaaacgccgu

SEQ ID NO: 3771608 - RNA, 15 nt, Salmonella typhimurium LT2
gcgccaccaucgucg

SEQ ID NO: 3771609 - RNA, 19 nt, Salmonella typhimurium LT2
gcgccaccaucgucgccag

SEQ ID NO: 3771610 - RNA, 23 nt, Salmonella typhimurium LT2
gcgccaccaucgucgccagaccc

SEQ ID NO: 3771611 - RNA, 15 nt, Salmonella typhimurium LT2
gcgccacgcccacgc

SEQ ID NO: 3771612 - RNA, 15 nt, Salmonella typhimurium LT2
gcgccacgcccagcg

SEQ ID NO: 3771613 - RNA, 18 nt, Salmonella typhimurium LT2
gcgccacgcgccagccgu

SEQ ID NO: 3771614 - RNA, 22 nt, Salmonella typhimurium LT2
gcgccacggauggccucugcca

SEQ ID NO: 3771615 - RNA, 16 nt, Salmonella typhimurium LT2
gcgccacuuccagcgc

SEQ ID NO: 3771616 - RNA, 15 nt, Salmonella typhimurium LT2
gcgccacuuuuccgg

SEQ ID NO: 3771617 - RNA, 17 nt, Salmonella typhimurium LT2
gcgccacuuuuccggca

SEQ ID NO: 3771618 - RNA, 12 nt, Salmonella typhimurium LT2
gcgccagcaggu

SEQ ID NO: 3771619 - RNA, 21 nt, Salmonella typhimurium LT2
gcgccagcaggucgcacuccu

SEQ ID NO: 3771620 - RNA, 22 nt, Salmonella typhimurium LT2
gcgccagccaaaccacgcgcga

SEQ ID NO: 3771621 - RNA, 18 nt, Salmonella typhimurium LT2
gcgccagccagucgccag

SEQ ID NO: 3771622 - RNA, 22 nt, Salmonella typhimurium LT2
gcgccagccagucgccaggcaa

SEQ ID NO: 3771623 - RNA, 15 nt, Salmonella typhimurium LT2
gcgccagcccugcga

SEQ ID NO: 3771624 - RNA, 17 nt, Salmonella typhimurium LT2
gcgccagccgcgccauc

SEQ ID NO: 3771625 - RNA, 13 nt, Salmonella typhimurium LT2
gcgccagccgcuu

SEQ ID NO: 3771626 - RNA, 14 nt, Salmonella typhimurium LT2
gcgccagccuuccc

SEQ ID NO: 3771627 - RNA, 19 nt, Salmonella typhimurium LT2
gcgccagcgacaacgcuuc

SEQ ID NO: 3771628 - RNA, 20 nt, Salmonella typhimurium LT2
gcgccagcgaccaccguccc

SEQ ID NO: 3771629 - RNA, 15 nt, Salmonella typhimurium LT2
gcgccagcgacugcu

SEQ ID NO: 3771630 - RNA, 16 nt, Salmonella typhimurium LT2
gcgccagcgcgcguac

SEQ ID NO: 3771631 - RNA, 23 nt, Salmonella typhimurium LT2
gcgccagcgcugacaucauccac

SEQ ID NO: 3771632 - RNA, 24 nt, Salmonella typhimurium LT2
gcgccagcgcugacaucauccacg

SEQ ID NO: 3771633 - RNA, 23 nt, Salmonella typhimurium LT2
gcgccagcggauugccauacacg

SEQ ID NO: 3771634 - RNA, 18 nt, Salmonella typhimurium LT2
gcgccagcguaguuucac

SEQ ID NO: 3771635 - RNA, 21 nt, Salmonella typhimurium LT2
gcgccagcguugaccagccua

SEQ ID NO: 3771636 - RNA, 14 nt, Salmonella typhimurium LT2
gcgccagcucaucg

SEQ ID NO: 3771637 - RNA, 22 nt, Salmonella typhimurium LT2
gcgccagcucaucgggcgaagc

SEQ ID NO: 3771638 - RNA, 14 nt, Salmonella typhimurium LT2
gcgccagcucauua

SEQ ID NO: 3771639 - RNA, 15 nt, Salmonella typhimurium LT2
gcgccagcucauuaa

SEQ ID NO: 3771640 - RNA, 22 nt, Salmonella typhimurium LT2
gcgccagcuccauagaaaucag

SEQ ID NO: 3771641 - RNA, 13 nt, Salmonella typhimurium LT2
gcgccaggcagca

SEQ ID NO: 3771642 - RNA, 16 nt, Salmonella typhimurium LT2
gcgccaguaacaccga

SEQ ID NO: 3771643 - RNA, 20 nt, Salmonella typhimurium LT2
gcgccaguaaugccgugccg

SEQ ID NO: 3771644 - RNA, 14 nt, Salmonella typhimurium LT2
gcgccaguucagcg

SEQ ID NO: 3771645 - RNA, 21 nt, Salmonella typhimurium LT2
gcgccaguucauccagcagca

SEQ ID NO: 3771646 - RNA, 14 nt, Salmonella typhimurium LT2
gcgccaguuuuucc

SEQ ID NO: 3771647 - RNA, 18 nt, Salmonella typhimurium LT2
gcgccauaauccauuacg

SEQ ID NO: 3771648 - RNA, 19 nt, Salmonella typhimurium LT2
gcgccauacuuacugcugu

SEQ ID NO: 3771649 - RNA, 16 nt, Salmonella typhimurium LT2
gcgccauauccgcaga

SEQ ID NO: 3771650 - RNA, 18 nt, Salmonella typhimurium LT2
gcgccauauuaacaaugc

SEQ ID NO: 3771651 - RNA, 21 nt, Salmonella typhimurium LT2
gcgccauauugcuguauuuua

SEQ ID NO: 3771652 - RNA, 16 nt, Salmonella typhimurium LT2
gcgccaucaggcacaa

SEQ ID NO: 3771653 - RNA, 21 nt, Salmonella typhimurium LT2
gcgccaucaggcacaaugcga

SEQ ID NO: 3771654 - RNA, 19 nt, Salmonella typhimurium LT2
gcgccaucaggcauggcag

SEQ ID NO: 3771655 - RNA, 14 nt, Salmonella typhimurium LT2
gcgccaucaugcag

SEQ ID NO: 3771656 - RNA, 18 nt, Salmonella typhimurium LT2
gcgccauccaccaggcau

SEQ ID NO: 3771657 - RNA, 20 nt, Salmonella typhimurium LT2
gcgccauccaccaggcaugc

SEQ ID NO: 3771658 - RNA, 15 nt, Salmonella typhimurium LT2
gcgccauccggcaca

SEQ ID NO: 3771659 - RNA, 16 nt, Salmonella typhimurium LT2
gcgccauccggcacac

SEQ ID NO: 3771660 - RNA, 15 nt, Salmonella typhimurium LT2
gcgccauccggcaga

SEQ ID NO: 3771661 - RNA, 13 nt, Salmonella typhimurium LT2
gcgccauccggcu

SEQ ID NO: 3771662 - RNA, 20 nt, Salmonella typhimurium LT2
gcgccaucgggcaauggcag

SEQ ID NO: 3771663 - RNA, 14 nt, Salmonella typhimurium LT2
gcgccaucuccucc

SEQ ID NO: 3771664 - RNA, 17 nt, Salmonella typhimurium LT2
gcgccaucuccuccuca

SEQ ID NO: 3771665 - RNA, 18 nt, Salmonella typhimurium LT2
gcgccaucuuucacccau

SEQ ID NO: 3771666 - RNA, 18 nt, Salmonella typhimurium LT2
gcgccaugcgcggcauca

SEQ ID NO: 3771667 - RNA, 15 nt, Salmonella typhimurium LT2
gcgccaugcuuuccg

SEQ ID NO: 3771668 - RNA, 16 nt, Salmonella typhimurium LT2
gcgccaugcuuuccgg

SEQ ID NO: 3771669 - RNA, 19 nt, Salmonella typhimurium LT2
gcgccauguucauaaagug

SEQ ID NO: 3771670 - RNA, 20 nt, Salmonella typhimurium LT2
gcgccauuaacgccaugacg

SEQ ID NO: 3771671 - RNA, 19 nt, Salmonella typhimurium LT2
gcgccauuccugccgccgc

SEQ ID NO: 3771672 - RNA, 20 nt, Salmonella typhimurium LT2
gcgccauuccugccgccgca

SEQ ID NO: 3771673 - RNA, 17 nt, Salmonella typhimurium LT2
gcgccauuugccagaua

SEQ ID NO: 3771674 - RNA, 13 nt, Salmonella typhimurium LT2
gcgcccagcgccg

SEQ ID NO: 3771675 - RNA, 19 nt, Salmonella typhimurium LT2
gcgcccaguccuuccggcg

SEQ ID NO: 3771676 - RNA, 15 nt, Salmonella typhimurium LT2
gcgcccauuccgccu

SEQ ID NO: 3771677 - RNA, 20 nt, Salmonella typhimurium LT2
gcgcccauuccgccugccgc

SEQ ID NO: 3771678 - RNA, 23 nt, Salmonella typhimurium LT2
gcgccccagcaugagccagcccu

SEQ ID NO: 3771679 - RNA, 22 nt, Salmonella typhimurium LT2
gcgccccaguaacgcgccccag

SEQ ID NO: 3771680 - RNA, 14 nt, Salmonella typhimurium LT2
gcgcccccaguucc

SEQ ID NO: 3771681 - RNA, 13 nt, Salmonella typhimurium LT2
gcgccccggcggc

SEQ ID NO: 3771682 - RNA, 16 nt, Salmonella typhimurium LT2
gcgccccguuuccgcg

SEQ ID NO: 3771683 - RNA, 17 nt, Salmonella typhimurium LT2
gcgcccgagcgacgccc

SEQ ID NO: 3771684 - RNA, 19 nt, Salmonella typhimurium LT2
gcgcccgcgaucgcuucca

SEQ ID NO: 3771685 - RNA, 12 nt, Salmonella typhimurium LT2
gcgcccgcgcgc

SEQ ID NO: 3771686 - RNA, 18 nt, Salmonella typhimurium LT2
gcgcccucauuccccauu

SEQ ID NO: 3771687 - RNA, 13 nt, Salmonella typhimurium LT2
gcgcccuccucca

SEQ ID NO: 3771688 - RNA, 14 nt, Salmonella typhimurium LT2
gcgcccugcaaaag

SEQ ID NO: 3771689 - RNA, 16 nt, Salmonella typhimurium LT2
gcgccgacaaucggcg

SEQ ID NO: 3771690 - RNA, 16 nt, Salmonella typhimurium LT2
gcgccgacaucgccac

SEQ ID NO: 3771691 - RNA, 18 nt, Salmonella typhimurium LT2
gcgccgacguuaucgccg

SEQ ID NO: 3771692 - RNA, 12 nt, Salmonella typhimurium LT2
gcgccgagagaa

SEQ ID NO: 3771693 - RNA, 19 nt, Salmonella typhimurium LT2
gcgccgagguuuucaucca

SEQ ID NO: 3771694 - RNA, 12 nt, Salmonella typhimurium LT2
gcgcgcccagca

SEQ ID NO: 3771695 - RNA, 15 nt, Salmonella typhimurium LT2
gcgcgcccgacgcgc

SEQ ID NO: 3771696 - RNA, 18 nt, Salmonella typhimurium LT2
gcgcgcccgccaccagca

SEQ ID NO: 3771697 - RNA, 14 nt, Salmonella typhimurium LT2
gcgcgcccgcuucc

SEQ ID NO: 3771698 - RNA, 12 nt, Salmonella typhimurium LT2
gcgcgcccugcg

SEQ ID NO: 3771699 - RNA, 16 nt, Salmonella typhimurium LT2
gcgcgcccugcgggcc

SEQ ID NO: 3771700 - RNA, 13 nt, Salmonella typhimurium LT2
gcgcgccgccaac

SEQ ID NO: 3771701 - RNA, 14 nt, Salmonella typhimurium LT2
gcgcgccgcccugc

SEQ ID NO: 3771702 - RNA, 12 nt, Salmonella typhimurium LT2
gcgcgccgccuc

SEQ ID NO: 3771703 - RNA, 24 nt, Salmonella typhimurium LT2
gcgcgccgccucgcgauccgccag

SEQ ID NO: 3771704 - RNA, 14 nt, Salmonella typhimurium LT2
gcgcgccgccugcu

SEQ ID NO: 3771705 - RNA, 16 nt, Salmonella typhimurium LT2
gcgcgccuaccgccau

SEQ ID NO: 3771706 - RNA, 23 nt, Salmonella typhimurium LT2
gcgcgccugcuccaccagcgcau

SEQ ID NO: 3771707 - RNA, 17 nt, Salmonella typhimurium LT2
gcgcgcgaaaagaaacu

SEQ ID NO: 3771708 - RNA, 17 nt, Salmonella typhimurium LT2
gcgcgcgaauauguucu

SEQ ID NO: 3771709 - RNA, 15 nt, Salmonella typhimurium LT2
gcgcgcgccagucau

SEQ ID NO: 3771710 - RNA, 13 nt, Salmonella typhimurium LT2
gcgcgcggcugcg

SEQ ID NO: 3771711 - RNA, 21 nt, Salmonella typhimurium LT2
gcgcgcguacccugcgugaac

SEQ ID NO: 3771712 - RNA, 14 nt, Salmonella typhimurium LT2
gcgcgcugccgccc

SEQ ID NO: 3771713 - RNA, 19 nt, Salmonella typhimurium LT2
gcgcgcuucguuuuccgca

SEQ ID NO: 3771714 - RNA, 22 nt, Salmonella typhimurium LT2
gcgcgcuuucaccgccucaucg

SEQ ID NO: 3771715 - RNA, 24 nt, Salmonella typhimurium LT2
gcgcgcuuucaccgccucaucggc

SEQ ID NO: 3771716 - RNA, 22 nt, Salmonella typhimurium LT2
gcgcgcuuuucgccagcgcauc

SEQ ID NO: 3771717 - RNA, 17 nt, Salmonella typhimurium LT2
gcgcggauauggcggcg

SEQ ID NO: 3771718 - RNA, 14 nt, Salmonella typhimurium LT2
gcgcggaucgccau

SEQ ID NO: 3771719 - RNA, 23 nt, Salmonella typhimurium LT2
gcgcggcaauuucacugucgcca

SEQ ID NO: 3771720 - RNA, 14 nt, Salmonella typhimurium LT2
gcgcggcacaggcg

SEQ ID NO: 3771721 - RNA, 11 nt, Salmonella typhimurium LT2
gcgcggcagca

SEQ ID NO: 3771722 - RNA, 14 nt, Salmonella typhimurium LT2
gcgcggcagcgcgc

SEQ ID NO: 3771723 - RNA, 16 nt, Salmonella typhimurium LT2
gcgcggcagcgcgcac

SEQ ID NO: 3771724 - RNA, 13 nt, Salmonella typhimurium LT2
gcgcggcaggccg

SEQ ID NO: 3771725 - RNA, 23 nt, Salmonella typhimurium LT2
gcgcggcaggccuuucggcagcg

SEQ ID NO: 3771726 - RNA, 19 nt, Salmonella typhimurium LT2
gcgcggcccauucaacggg

SEQ ID NO: 3771727 - RNA, 16 nt, Salmonella typhimurium LT2
gcgcggcgaaggucgc

SEQ ID NO: 3771728 - RNA, 10 nt, Salmonella typhimurium LT2
gcgcggcgga

SEQ ID NO: 3771729 - RNA, 14 nt, Salmonella typhimurium LT2
gcgcggcguucugc

SEQ ID NO: 3771730 - RNA, 15 nt, Salmonella typhimurium LT2
gcgcggcugcggauu

SEQ ID NO: 3771731 - RNA, 20 nt, Salmonella typhimurium LT2
gcgcggcugcgggaggcggu

SEQ ID NO: 3771732 - RNA, 20 nt, Salmonella typhimurium LT2
gcgcgggcgguacagcaucc

SEQ ID NO: 3771733 - RNA, 15 nt, Salmonella typhimurium LT2
gcgcggggaacacaa

SEQ ID NO: 3771734 - RNA, 16 nt, Salmonella typhimurium LT2
gcgcggggaacacaau

SEQ ID NO: 3771735 - RNA, 14 nt, Salmonella typhimurium LT2
gcgcggggaacacg

SEQ ID NO: 3771736 - RNA, 14 nt, Salmonella typhimurium LT2
gcgcggggaacacu

SEQ ID NO: 3771737 - RNA, 18 nt, Salmonella typhimurium LT2
gcgcgguuaacagccgcu

SEQ ID NO: 3771738 - RNA, 20 nt, Salmonella typhimurium LT2
gcgcguagguuggcugaggc

SEQ ID NO: 3771739 - RNA, 16 nt, Salmonella typhimurium LT2
gcgcgucaacggcgcg

SEQ ID NO: 3771740 - RNA, 15 nt, Salmonella typhimurium LT2
gcgcgucagcgccuc

SEQ ID NO: 3771741 - RNA, 19 nt, Salmonella typhimurium LT2
gcgcgucauaaccgcaguc

SEQ ID NO: 3771742 - RNA, 16 nt, Salmonella typhimurium LT2
gcgcguccagcggcaa

SEQ ID NO: 3771743 - RNA, 16 nt, Salmonella typhimurium LT2
gcgcguccuuauaaug

SEQ ID NO: 3771744 - RNA, 19 nt, Salmonella typhimurium LT2
gcgcguccuuauaaugcuu

SEQ ID NO: 3771745 - RNA, 13 nt, Salmonella typhimurium LT2
gcgcgucgccuga

SEQ ID NO: 3771746 - RNA, 21 nt, Salmonella typhimurium LT2
gcgcguucauccaugauggcg

SEQ ID NO: 3771747 - RNA, 15 nt, Salmonella typhimurium LT2
gcgcguucgccguca

SEQ ID NO: 3771748 - RNA, 19 nt, Salmonella typhimurium LT2
gcgcguucgccgucacgcc

SEQ ID NO: 3771749 - RNA, 20 nt, Salmonella typhimurium LT2
gcgcguugaugaaucugguc

SEQ ID NO: 3771750 - RNA, 16 nt, Salmonella typhimurium LT2
gcgcguuuagcgccag

SEQ ID NO: 3771751 - RNA, 21 nt, Salmonella typhimurium LT2
gcgcguuucugcgccucagcc

SEQ ID NO: 3771752 - RNA, 14 nt, Salmonella typhimurium LT2
gcgcuaaaccggcg

SEQ ID NO: 3771753 - RNA, 15 nt, Salmonella typhimurium LT2
gcgcuaaaucguccg

SEQ ID NO: 3771754 - RNA, 22 nt, Salmonella typhimurium LT2
gcgcuaacgucgccaucaggcg

SEQ ID NO: 3771755 - RNA, 14 nt, Salmonella typhimurium LT2
gcgcuaagccagcc

SEQ ID NO: 3771756 - RNA, 22 nt, Salmonella typhimurium LT2
gcgcuaagcguuacggaaaaaa

SEQ ID NO: 3771757 - RNA, 21 nt, Salmonella typhimurium LT2
gcgcuaaugcuuauccggccu

SEQ ID NO: 3771758 - RNA, 17 nt, Salmonella typhimurium LT2
gcgcuaauguggauagu

SEQ ID NO: 3771759 - RNA, 13 nt, Salmonella typhimurium LT2
gcgcuaccagcgc

SEQ ID NO: 3771760 - RNA, 14 nt, Salmonella typhimurium LT2
gcgcuaccagcgcg

SEQ ID NO: 3771761 - RNA, 20 nt, Salmonella typhimurium LT2
gcgcuacgcuuaucaggccu

SEQ ID NO: 3771762 - RNA, 17 nt, Salmonella typhimurium LT2
gcgcuacgcuuauccgg

SEQ ID NO: 3771763 - RNA, 19 nt, Salmonella typhimurium LT2
gcgcuacgcuuauccggcu

SEQ ID NO: 3771764 - RNA, 16 nt, Salmonella typhimurium LT2
gcgcuacgcuuaucgg

SEQ ID NO: 3771765 - RNA, 17 nt, Salmonella typhimurium LT2
gcgcuacguuuaucugg

SEQ ID NO: 3771766 - RNA, 15 nt, Salmonella typhimurium LT2
gcgcuagugccgcca

SEQ ID NO: 3771767 - RNA, 23 nt, Salmonella typhimurium LT2
gcgcuaucaauauucaugcuuuc

SEQ ID NO: 3771768 - RNA, 13 nt, Salmonella typhimurium LT2
gcgcuauccggcc

SEQ ID NO: 3771769 - RNA, 14 nt, Salmonella typhimurium LT2
gcgcuauccggccc

SEQ ID NO: 3771770 - RNA, 17 nt, Salmonella typhimurium LT2
gcgcuaucgguaucaug

SEQ ID NO: 3771771 - RNA, 20 nt, Salmonella typhimurium LT2
gcgcuaucuauucacuggca

SEQ ID NO: 3771772 - RNA, 23 nt, Salmonella typhimurium LT2
gcgcuauucccaggcaaaugauu

SEQ ID NO: 3771773 - RNA, 14 nt, Salmonella typhimurium LT2
gcgcucaaaugguc

SEQ ID NO: 3771774 - RNA, 22 nt, Salmonella typhimurium LT2
gcgcucaacacauaacgcccga

SEQ ID NO: 3771775 - RNA, 15 nt, Salmonella typhimurium LT2
gcgcucaccgccgga

SEQ ID NO: 3771776 - RNA, 21 nt, Salmonella typhimurium LT2
gcgcucaccuccgccaccagc

SEQ ID NO: 3771777 - RNA, 22 nt, Salmonella typhimurium LT2
gcgcucaccuccgccaccagcg

SEQ ID NO: 3771778 - RNA, 21 nt, Salmonella typhimurium LT2
gcgcucacgcuuauccggccu

SEQ ID NO: 3771779 - RNA, 17 nt, Salmonella typhimurium LT2
gcgcucacuaccgcgau

SEQ ID NO: 3771780 - RNA, 12 nt, Salmonella typhimurium LT2
gcgcucaucaga

SEQ ID NO: 3771781 - RNA, 14 nt, Salmonella typhimurium LT2
gcgcucaugccacg

SEQ ID NO: 3771782 - RNA, 18 nt, Salmonella typhimurium LT2
gcgcucaugccacgccau

SEQ ID NO: 3771783 - RNA, 22 nt, Salmonella typhimurium LT2
gcgcuccaccaaccaggcaaac

SEQ ID NO: 3771784 - RNA, 19 nt, Salmonella typhimurium LT2
gcgcuccagaccaccagcg

SEQ ID NO: 3771785 - RNA, 22 nt, Salmonella typhimurium LT2
gcgcuccagaccaccagcgaca

SEQ ID NO: 3771786 - RNA, 19 nt, Salmonella typhimurium LT2
gcgcuccagcuucaucauc

SEQ ID NO: 3771787 - RNA, 12 nt, Salmonella typhimurium LT2
gcgcuccaggau

SEQ ID NO: 3771788 - RNA, 23 nt, Salmonella typhimurium LT2
gcgcuccaggaugugaggcagau

SEQ ID NO: 3771789 - RNA, 15 nt, Salmonella typhimurium LT2
gcgcuccgcacgccg

SEQ ID NO: 3771790 - RNA, 16 nt, Salmonella typhimurium LT2
gcgcuccggcacuggc

SEQ ID NO: 3771791 - RNA, 14 nt, Salmonella typhimurium LT2
gcgcucgcccuucg

SEQ ID NO: 3771792 - RNA, 15 nt, Salmonella typhimurium LT2
gcgcucgcccuucgg

SEQ ID NO: 3771793 - RNA, 15 nt, Salmonella typhimurium LT2
gcgcucgcucaucac

SEQ ID NO: 3771794 - RNA, 16 nt, Salmonella typhimurium LT2
gcgcucggcagcagcg

SEQ ID NO: 3771795 - RNA, 17 nt, Salmonella typhimurium LT2
gcgcucguaggccagcg

SEQ ID NO: 3771796 - RNA, 19 nt, Salmonella typhimurium LT2
gcgcucuacguugaccuca

SEQ ID NO: 3771797 - RNA, 19 nt, Salmonella typhimurium LT2
gcgcucuaucaccgcccgc

SEQ ID NO: 3771798 - RNA, 16 nt, Salmonella typhimurium LT2
gcggcaaagauaaucu

SEQ ID NO: 3771799 - RNA, 18 nt, Salmonella typhimurium LT2
gcggcaacagcaccagaa

SEQ ID NO: 3771800 - RNA, 16 nt, Salmonella typhimurium LT2
gcggcaaccagcccau

SEQ ID NO: 3771801 - RNA, 20 nt, Salmonella typhimurium LT2
gcggcaacccgacugccacc

SEQ ID NO: 3771802 - RNA, 23 nt, Salmonella typhimurium LT2
gcggcaacccuuuggccaccagc

SEQ ID NO: 3771803 - RNA, 21 nt, Salmonella typhimurium LT2
gcggcaauagcgagaggcaau

SEQ ID NO: 3771804 - RNA, 17 nt, Salmonella typhimurium LT2
gcggcaaucgccucauc

SEQ ID NO: 3771805 - RNA, 16 nt, Salmonella typhimurium LT2
gcggcaaugccgccgu

SEQ ID NO: 3771806 - RNA, 17 nt, Salmonella typhimurium LT2
gcggcaauggccgcagc

SEQ ID NO: 3771807 - RNA, 14 nt, Salmonella typhimurium LT2
gcggcacauaagcg

SEQ ID NO: 3771808 - RNA, 20 nt, Salmonella typhimurium LT2
gcggcacgagcacuguggcg

SEQ ID NO: 3771809 - RNA, 24 nt, Salmonella typhimurium LT2
gcggcacugcucuuuaacaauuua

SEQ ID NO: 3771810 - RNA, 19 nt, Salmonella typhimurium LT2
gcggcagaaucacggccga

SEQ ID NO: 3771811 - RNA, 19 nt, Salmonella typhimurium LT2
gcggcagaauuaacucauc

SEQ ID NO: 3771812 - RNA, 22 nt, Salmonella typhimurium LT2
gcggcagaauuaacucaucaca

SEQ ID NO: 3771813 - RNA, 24 nt, Salmonella typhimurium LT2
gcggcagaauuaacucaucacagc

SEQ ID NO: 3771814 - RNA, 12 nt, Salmonella typhimurium LT2
gcggcagauccu

SEQ ID NO: 3771815 - RNA, 21 nt, Salmonella typhimurium LT2
gcggcagcacgagcauccaga

SEQ ID NO: 3771816 - RNA, 14 nt, Salmonella typhimurium LT2
gcggcagccaugcu

SEQ ID NO: 3771817 - RNA, 23 nt, Salmonella typhimurium LT2
gcggcagccaugcuauucagcag

SEQ ID NO: 3771818 - RNA, 11 nt, Salmonella typhimurium LT2
gcggcagcgcg

SEQ ID NO: 3771819 - RNA, 22 nt, Salmonella typhimurium LT2
gcggcaggauccccaucccaau

SEQ ID NO: 3771820 - RNA, 18 nt, Salmonella typhimurium LT2
gcggcaggccggcagccu

SEQ ID NO: 3771821 - RNA, 20 nt, Salmonella typhimurium LT2
gcggcagggcggucugguac

SEQ ID NO: 3771822 - RNA, 19 nt, Salmonella typhimurium LT2
gcggcaggugagggcgucg

SEQ ID NO: 3771823 - RNA, 21 nt, Salmonella typhimurium LT2
gcggcagucccaaugcggaaa

SEQ ID NO: 3771824 - RNA, 20 nt, Salmonella typhimurium LT2
gcggcauacuuucgcgcggc

SEQ ID NO: 3771825 - RNA, 16 nt, Salmonella typhimurium LT2
gcggcaucagccugca

SEQ ID NO: 3771826 - RNA, 22 nt, Salmonella typhimurium LT2
gcggcaucccuuucauuuuucc

SEQ ID NO: 3771827 - RNA, 17 nt, Salmonella typhimurium LT2
gcggcaucguagucagg

SEQ ID NO: 3771828 - RNA, 16 nt, Salmonella typhimurium LT2
gcggcaugauccacca

SEQ ID NO: 3771829 - RNA, 15 nt, Salmonella typhimurium LT2
gcggcauggucugaa

SEQ ID NO: 3771830 - RNA, 17 nt, Salmonella typhimurium LT2
gcggcauguaaagcgcc

SEQ ID NO: 3771831 - RNA, 16 nt, Salmonella typhimurium LT2
gcggcauuaaaaaaaa

SEQ ID NO: 3771832 - RNA, 21 nt, Salmonella typhimurium LT2
gcggcauuaaaaaaaagagcg

SEQ ID NO: 3771833 - RNA, 19 nt, Salmonella typhimurium LT2
gcggcauuggcguuaccgg

SEQ ID NO: 3771834 - RNA, 22 nt, Salmonella typhimurium LT2
gcggcauuggcguuaccggcag

SEQ ID NO: 3771835 - RNA, 18 nt, Salmonella typhimurium LT2
gcggccaaagggagcaga

SEQ ID NO: 3771836 - RNA, 23 nt, Salmonella typhimurium LT2
gcggccaaaucgucagccgccag

SEQ ID NO: 3771837 - RNA, 20 nt, Salmonella typhimurium LT2
gcggccagaaccugcucggc

SEQ ID NO: 3771838 - RNA, 12 nt, Salmonella typhimurium LT2
gcggccagcaug

SEQ ID NO: 3771839 - RNA, 13 nt, Salmonella typhimurium LT2
gcggccagcgggc

SEQ ID NO: 3771840 - RNA, 20 nt, Salmonella typhimurium LT2
gcggccaguuguucuuucac

SEQ ID NO: 3771841 - RNA, 14 nt, Salmonella typhimurium LT2
gcggccaucacgcu

SEQ ID NO: 3771842 - RNA, 20 nt, Salmonella typhimurium LT2
gcggccaugaucgccgccau

SEQ ID NO: 3771843 - RNA, 20 nt, Salmonella typhimurium LT2
gcggcccauucaacgggcga

SEQ ID NO: 3771844 - RNA, 16 nt, Salmonella typhimurium LT2
gcggcccauucgccca

SEQ ID NO: 3771845 - RNA, 16 nt, Salmonella typhimurium LT2
gcggccgccgcugguc

SEQ ID NO: 3771846 - RNA, 14 nt, Salmonella typhimurium LT2
gcggccuccuggcu

SEQ ID NO: 3771847 - RNA, 14 nt, Salmonella typhimurium LT2
gcggccugcgccag

SEQ ID NO: 3771848 - RNA, 15 nt, Salmonella typhimurium LT2
gcggccugcggcgag

SEQ ID NO: 3771849 - RNA, 16 nt, Salmonella typhimurium LT2
gcggccuuuauccagc

SEQ ID NO: 3771850 - RNA, 18 nt, Salmonella typhimurium LT2
gcggcgaaacgccuuauc

SEQ ID NO: 3771851 - RNA, 20 nt, Salmonella typhimurium LT2
gcggcgaaauauuaucgcca

SEQ ID NO: 3771852 - RNA, 18 nt, Salmonella typhimurium LT2
gcggcgaagcaucuuucc

SEQ ID NO: 3771853 - RNA, 20 nt, Salmonella typhimurium LT2
gcggcgaagcaucuuuccgg

SEQ ID NO: 3771854 - RNA, 22 nt, Salmonella typhimurium LT2
gcggcgaauauagcuaaugcaa

SEQ ID NO: 3771855 - RNA, 15 nt, Salmonella typhimurium LT2
gcggcgacaucgcca

SEQ ID NO: 3771856 - RNA, 15 nt, Salmonella typhimurium LT2
gcggcgaucaccacg

SEQ ID NO: 3771857 - RNA, 21 nt, Salmonella typhimurium LT2
gcggcgaucagacgcugguug

SEQ ID NO: 3771858 - RNA, 22 nt, Salmonella typhimurium LT2
gcggcgcauucuugcgccgcaa

SEQ ID NO: 3771859 - RNA, 15 nt, Salmonella typhimurium LT2
gcggcgccauccggc

SEQ ID NO: 3771860 - RNA, 12 nt, Salmonella typhimurium LT2
gcggcgccgcaa

SEQ ID NO: 3771861 - RNA, 13 nt, Salmonella typhimurium LT2
gcggcgcgcccgg

SEQ ID NO: 3771862 - RNA, 14 nt, Salmonella typhimurium LT2
gcggcgcgcccggc

SEQ ID NO: 3771863 - RNA, 15 nt, Salmonella typhimurium LT2
gcggcggacaacgcu

SEQ ID NO: 3771864 - RNA, 20 nt, Salmonella typhimurium LT2
gcggcggacaacgcuccagc

SEQ ID NO: 3771865 - RNA, 22 nt, Salmonella typhimurium LT2
gcggcggacaacgcuccagcag

SEQ ID NO: 3771866 - RNA, 21 nt, Salmonella typhimurium LT2
gcggcggggauaaucagcagc

SEQ ID NO: 3771867 - RNA, 19 nt, Salmonella typhimurium LT2
gcggcgguuauccgccagc

SEQ ID NO: 3771868 - RNA, 21 nt, Salmonella typhimurium LT2
gcggcgguuauccgccagcgc

SEQ ID NO: 3771869 - RNA, 16 nt, Salmonella typhimurium LT2
gcggcgguucauccug

SEQ ID NO: 3771870 - RNA, 22 nt, Salmonella typhimurium LT2
gcggcguaaaccccuucaccac

SEQ ID NO: 3771871 - RNA, 15 nt, Salmonella typhimurium LT2
gcggcguccgccagc

SEQ ID NO: 3771872 - RNA, 16 nt, Salmonella typhimurium LT2
gcggcgugaccgccuu

SEQ ID NO: 3771873 - RNA, 20 nt, Salmonella typhimurium LT2
gcggcguggaaccgccggag

SEQ ID NO: 3771874 - RNA, 13 nt, Salmonella typhimurium LT2
gcggcguggcgca

SEQ ID NO: 3771875 - RNA, 14 nt, Salmonella typhimurium LT2
gcggcguucaaaac

SEQ ID NO: 3771876 - RNA, 16 nt, Salmonella typhimurium LT2
gcggcguucaaaacgc

SEQ ID NO: 3771877 - RNA, 15 nt, Salmonella typhimurium LT2
gcggcguucccgcag

SEQ ID NO: 3771878 - RNA, 17 nt, Salmonella typhimurium LT2
gcggcguucugcgccau

SEQ ID NO: 3771879 - RNA, 19 nt, Salmonella typhimurium LT2
gcggcuacgccuuacccgg

SEQ ID NO: 3771880 - RNA, 19 nt, Salmonella typhimurium LT2
gcggcuagcgccuuauccg

SEQ ID NO: 3771881 - RNA, 20 nt, Salmonella typhimurium LT2
gcggcuagcgccuuauccgg

SEQ ID NO: 3771882 - RNA, 14 nt, Salmonella typhimurium LT2
gcggcucaccagcu

SEQ ID NO: 3771883 - RNA, 15 nt, Salmonella typhimurium LT2
gcggcucaccagcug

SEQ ID NO: 3771884 - RNA, 13 nt, Salmonella typhimurium LT2
gcggcucaggaag

SEQ ID NO: 3771885 - RNA, 22 nt, Salmonella typhimurium LT2
gcggcugaaccacccugaaaag

SEQ ID NO: 3771886 - RNA, 16 nt, Salmonella typhimurium LT2
gcggcugacacucauc

SEQ ID NO: 3771887 - RNA, 18 nt, Salmonella typhimurium LT2
gcggcuggaacucaucgg

SEQ ID NO: 3771888 - RNA, 16 nt, Salmonella typhimurium LT2
gcggcuguguccgcca

SEQ ID NO: 3771889 - RNA, 17 nt, Salmonella typhimurium LT2
gcggcuguguccgccau

SEQ ID NO: 3771890 - RNA, 15 nt, Salmonella typhimurium LT2
gcggcuguucaccac

SEQ ID NO: 3771891 - RNA, 13 nt, Salmonella typhimurium LT2
gcggcuucaauac

SEQ ID NO: 3771892 - RNA, 15 nt, Salmonella typhimurium LT2
gcggcuucagcgaca

SEQ ID NO: 3771893 - RNA, 14 nt, Salmonella typhimurium LT2
gcggcuuggcugua

SEQ ID NO: 3771894 - RNA, 17 nt, Salmonella typhimurium LT2
gcggcuuuuucaucauc

SEQ ID NO: 3771895 - RNA, 14 nt, Salmonella typhimurium LT2
gcgggaagcgcgca

SEQ ID NO: 3771896 - RNA, 16 nt, Salmonella typhimurium LT2
gcgggagaucggcugu

SEQ ID NO: 3771897 - RNA, 20 nt, Salmonella typhimurium LT2
gcgggauaacgcaacaacag

SEQ ID NO: 3771898 - RNA, 21 nt, Salmonella typhimurium LT2
gcgggauuggucgcgccgcgc

SEQ ID NO: 3771899 - RNA, 17 nt, Salmonella typhimurium LT2
gcgggcaaugccaccag

SEQ ID NO: 3771900 - RNA, 19 nt, Salmonella typhimurium LT2
gcgggcagaaaaaucagca

SEQ ID NO: 3771901 - RNA, 21 nt, Salmonella typhimurium LT2
gcgggcagacaaaacauaucc

SEQ ID NO: 3771902 - RNA, 17 nt, Salmonella typhimurium LT2
gcgucacaaaaacaccc

SEQ ID NO: 3771903 - RNA, 21 nt, Salmonella typhimurium LT2
gcgucacaauaucgagaugac

SEQ ID NO: 3771904 - RNA, 14 nt, Salmonella typhimurium LT2
gcgucacccgccgg

SEQ ID NO: 3771905 - RNA, 16 nt, Salmonella typhimurium LT2
gcgucagcccaagcug

SEQ ID NO: 3771906 - RNA, 14 nt, Salmonella typhimurium LT2
gcgucagcccuucu

SEQ ID NO: 3771907 - RNA, 13 nt, Salmonella typhimurium LT2
gcgucagcgcggc

SEQ ID NO: 3771908 - RNA, 17 nt, Salmonella typhimurium LT2
gcgucagcgugcgguaa

SEQ ID NO: 3771909 - RNA, 12 nt, Salmonella typhimurium LT2
gcgucaggcgau

SEQ ID NO: 3771910 - RNA, 18 nt, Salmonella typhimurium LT2
gcgucauagccgcgcguc

SEQ ID NO: 3771911 - RNA, 19 nt, Salmonella typhimurium LT2
gcgucauaguuuuccagcc

SEQ ID NO: 3771912 - RNA, 20 nt, Salmonella typhimurium LT2
gcgucaucauugcgccaaga

SEQ ID NO: 3771913 - RNA, 21 nt, Salmonella typhimurium LT2
gcgucaucccgguuucccgcg

SEQ ID NO: 3771914 - RNA, 20 nt, Salmonella typhimurium LT2
gcgucaucggcgcgcuggcg

SEQ ID NO: 3771915 - RNA, 21 nt, Salmonella typhimurium LT2
gcgucaugcgaaacgcuugug

SEQ ID NO: 3771916 - RNA, 20 nt, Salmonella typhimurium LT2
gcgucauuaauggccuguac

SEQ ID NO: 3771917 - RNA, 22 nt, Salmonella typhimurium LT2
gcguccacucgcccauuugcga

SEQ ID NO: 3771918 - RNA, 23 nt, Salmonella typhimurium LT2
gcguccacuuucucggcuuucca

SEQ ID NO: 3771919 - RNA, 15 nt, Salmonella typhimurium LT2
gcgucccgucccacc

SEQ ID NO: 3771920 - RNA, 16 nt, Salmonella typhimurium LT2
gcgucccgucccacca

SEQ ID NO: 3771921 - RNA, 15 nt, Salmonella typhimurium LT2
gcgucccucgccggu

SEQ ID NO: 3771922 - RNA, 20 nt, Salmonella typhimurium LT2
gcgucccucuccagggcaac

SEQ ID NO: 3771923 - RNA, 16 nt, Salmonella typhimurium LT2
gcguccgauggacucc

SEQ ID NO: 3771924 - RNA, 17 nt, Salmonella typhimurium LT2
gcguccggggccagcgc

SEQ ID NO: 3771925 - RNA, 18 nt, Salmonella typhimurium LT2
gcguccggggccagcgcc

SEQ ID NO: 3771926 - RNA, 19 nt, Salmonella typhimurium LT2
gcguccggggccagcgcca

SEQ ID NO: 3771927 - RNA, 17 nt, Salmonella typhimurium LT2
gcguccgguagagaacg

SEQ ID NO: 3771928 - RNA, 18 nt, Salmonella typhimurium LT2
gcguccguucugauacuc

SEQ ID NO: 3771929 - RNA, 18 nt, Salmonella typhimurium LT2
gcguccuccagcgugcag

SEQ ID NO: 3771930 - RNA, 15 nt, Salmonella typhimurium LT2
gcguccuucuuccgc

SEQ ID NO: 3771931 - RNA, 16 nt, Salmonella typhimurium LT2
gcgucgaaugacgcgc

SEQ ID NO: 3771932 - RNA, 13 nt, Salmonella typhimurium LT2
gcgucgagcgccg

SEQ ID NO: 3771933 - RNA, 20 nt, Salmonella typhimurium LT2
gcgucgcauucgauacgcac

SEQ ID NO: 3771934 - RNA, 21 nt, Salmonella typhimurium LT2
gcgucgccaaagcagcugcug

SEQ ID NO: 3771935 - RNA, 19 nt, Salmonella typhimurium LT2
gcgucgccauaaagcugua

SEQ ID NO: 3771936 - RNA, 13 nt, Salmonella typhimurium LT2
gcgucgccgccgu

SEQ ID NO: 3771937 - RNA, 14 nt, Salmonella typhimurium LT2
gcgucgcgcauggc

SEQ ID NO: 3771938 - RNA, 17 nt, Salmonella typhimurium LT2
gcgucgcguaccagcgc

SEQ ID NO: 3771939 - RNA, 18 nt, Salmonella typhimurium LT2
gcgucgcuaaucagcaac

SEQ ID NO: 3771940 - RNA, 18 nt, Salmonella typhimurium LT2
gcgucgguuauagacgcc

SEQ ID NO: 3771941 - RNA, 23 nt, Salmonella typhimurium LT2
gcgucgucauagcguugauaugc

SEQ ID NO: 3771942 - RNA, 14 nt, Salmonella typhimurium LT2
gcgucuaaauuucg

SEQ ID NO: 3771943 - RNA, 15 nt, Salmonella typhimurium LT2
gcgucucaagcuuuu

SEQ ID NO: 3771944 - RNA, 17 nt, Salmonella typhimurium LT2
gcgucucagcaggcggc

SEQ ID NO: 3771945 - RNA, 16 nt, Salmonella typhimurium LT2
gcgucucauccggcag

SEQ ID NO: 3771946 - RNA, 18 nt, Salmonella typhimurium LT2
gcgucucgcacucgccgc

SEQ ID NO: 3771947 - RNA, 19 nt, Salmonella typhimurium LT2
gcgucugacagcgcgcguc

SEQ ID NO: 3771948 - RNA, 18 nt, Salmonella typhimurium LT2
gcgucugagcaucccggu

SEQ ID NO: 3771949 - RNA, 18 nt, Salmonella typhimurium LT2
gcgucugccccaaacgcu

SEQ ID NO: 3771950 - RNA, 15 nt, Salmonella typhimurium LT2
gcgucuggagcgugc

SEQ ID NO: 3771951 - RNA, 16 nt, Salmonella typhimurium LT2
gcgucuuauccggccu

SEQ ID NO: 3771952 - RNA, 13 nt, Salmonella typhimurium LT2
gcgucuucuucca

SEQ ID NO: 3771953 - RNA, 23 nt, Salmonella typhimurium LT2
gcgugaacgucuuauccggccug

SEQ ID NO: 3771954 - RNA, 17 nt, Salmonella typhimurium LT2
gcgugaccaccgccuug

SEQ ID NO: 3771955 - RNA, 13 nt, Salmonella typhimurium LT2
gcgugacccagac

SEQ ID NO: 3771956 - RNA, 18 nt, Salmonella typhimurium LT2
gcgugauaaaggccggca

SEQ ID NO: 3771957 - RNA, 17 nt, Salmonella typhimurium LT2
gcgugauaauuccccca

SEQ ID NO: 3771958 - RNA, 19 nt, Salmonella typhimurium LT2
gcgugccgauucccgccug

SEQ ID NO: 3771959 - RNA, 23 nt, Salmonella typhimurium LT2
gcgugccugccgcagaagcgaca

SEQ ID NO: 3771960 - RNA, 16 nt, Salmonella typhimurium LT2
gcgugcgucauccggc

SEQ ID NO: 3771961 - RNA, 21 nt, Salmonella typhimurium LT2
gcgugcguucauggcgcgaca

SEQ ID NO: 3771962 - RNA, 15 nt, Salmonella typhimurium LT2
gcgugcucgcggcgg

SEQ ID NO: 3771963 - RNA, 15 nt, Salmonella typhimurium LT2
gcgugcuggcggccg

SEQ ID NO: 3771964 - RNA, 20 nt, Salmonella typhimurium LT2
gcguggcaucuuaucaggcc

SEQ ID NO: 3771965 - RNA, 21 nt, Salmonella typhimurium LT2
gcguggcaucuuaucaggccu

SEQ ID NO: 3771966 - RNA, 14 nt, Salmonella typhimurium LT2
gcgugguggcguca

SEQ ID NO: 3771967 - RNA, 22 nt, Salmonella typhimurium LT2
gcguguaaccaccugggucagc

SEQ ID NO: 3771968 - RNA, 22 nt, Salmonella typhimurium LT2
gcgugugucccggacaauguaa

SEQ ID NO: 3771969 - RNA, 20 nt, Salmonella typhimurium LT2
gcguguuucaucucaucaau

SEQ ID NO: 3771970 - RNA, 17 nt, Salmonella typhimurium LT2
gcguguuucguugcgac

SEQ ID NO: 3771971 - RNA, 20 nt, Salmonella typhimurium LT2
gcguuaacggcuucguuuca

SEQ ID NO: 3771972 - RNA, 20 nt, Salmonella typhimurium LT2
gcguuaauauccuucagcgu

SEQ ID NO: 3771973 - RNA, 13 nt, Salmonella typhimurium LT2
gcguuaaugcauu

SEQ ID NO: 3771974 - RNA, 18 nt, Salmonella typhimurium LT2
gcguuaauggccugauga

SEQ ID NO: 3771975 - RNA, 14 nt, Salmonella typhimurium LT2
gcguuacgcgccac

SEQ ID NO: 3771976 - RNA, 14 nt, Salmonella typhimurium LT2
gcguuacgcgcugc

SEQ ID NO: 3771977 - RNA, 22 nt, Salmonella typhimurium LT2
gcguuacggccaaauuuagagu

SEQ ID NO: 3771978 - RNA, 17 nt, Salmonella typhimurium LT2
gcguuacgggaacagaa

SEQ ID NO: 3771979 - RNA, 20 nt, Salmonella typhimurium LT2
gcguuacuggcgaccggcag

SEQ ID NO: 3771980 - RNA, 15 nt, Salmonella typhimurium LT2
gcguuagccuaaaug

SEQ ID NO: 3771981 - RNA, 23 nt, Salmonella typhimurium LT2
gcguuaucgcuaauucucccugc

SEQ ID NO: 3771982 - RNA, 16 nt, Salmonella typhimurium LT2
gcguuaucuguaauug

SEQ ID NO: 3771983 - RNA, 23 nt, Salmonella typhimurium LT2
gcguuaugcgcuugcgcaauuuc

SEQ ID NO: 3771984 - RNA, 19 nt, Salmonella typhimurium LT2
gcguuauugaccaucgcca

SEQ ID NO: 3771985 - RNA, 17 nt, Salmonella typhimurium LT2
gcguuauuugcauuuuc

SEQ ID NO: 3771986 - RNA, 23 nt, Salmonella typhimurium LT2
gcguucacgccgccauccggcaa

SEQ ID NO: 3771987 - RNA, 12 nt, Salmonella typhimurium LT2
gcguucagcgcc

SEQ ID NO: 3771988 - RNA, 13 nt, Salmonella typhimurium LT2
gcguucauggcaa

SEQ ID NO: 3771989 - RNA, 17 nt, Salmonella typhimurium LT2
gcguuccccaacagcga

SEQ ID NO: 3771990 - RNA, 19 nt, Salmonella typhimurium LT2
gcguuccccaacagcgacc

SEQ ID NO: 3771991 - RNA, 15 nt, Salmonella typhimurium LT2
gcguuccuuaucagc

SEQ ID NO: 3771992 - RNA, 16 nt, Salmonella typhimurium LT2
gcguuccuuaucagca

SEQ ID NO: 3771993 - RNA, 19 nt, Salmonella typhimurium LT2
gcguucgaccguuuccgcc

SEQ ID NO: 3771994 - RNA, 15 nt, Salmonella typhimurium LT2
gcguucgcccugcgc

SEQ ID NO: 3771995 - RNA, 13 nt, Salmonella typhimurium LT2
gcguucggccugc

SEQ ID NO: 3771996 - RNA, 19 nt, Salmonella typhimurium LT2
gcguucugcgccauuucca

SEQ ID NO: 3771997 - RNA, 16 nt, Salmonella typhimurium LT2
gcguucugcugugccg

SEQ ID NO: 3771998 - RNA, 20 nt, Salmonella typhimurium LT2
gcguucugguugaccggaaa

SEQ ID NO: 3771999 - RNA, 21 nt, Salmonella typhimurium LT2
gcguucuuccacuucagcagc

SEQ ID NO: 3772000 - RNA, 24 nt, Salmonella typhimurium LT2
gcguugaccagccuaccugccgcc

SEQ ID NO: 3772001 - RNA, 19 nt, Salmonella typhimurium LT2
gcguugagcguguccucug

SEQ ID NO: 3772002 - RNA, 12 nt, Salmonella typhimurium LT2
gcguuggcggcu

SEQ ID NO: 3772003 - RNA, 20 nt, Salmonella typhimurium LT2
gcguuggcgucagaccggca

SEQ ID NO: 3772004 - RNA, 18 nt, Salmonella typhimurium LT2
gcguugggugcagcguca

SEQ ID NO: 3772005 - RNA, 18 nt, Salmonella typhimurium LT2
gcguuguacggauggggu

SEQ ID NO: 3772006 - RNA, 12 nt, Salmonella typhimurium LT2
gcucaaauauga

SEQ ID NO: 3772007 - RNA, 16 nt, Salmonella typhimurium LT2
gcucaacaaacuuaau

SEQ ID NO: 3772008 - RNA, 17 nt, Salmonella typhimurium LT2
gcucaacacauaacgcc

SEQ ID NO: 3772009 - RNA, 17 nt, Salmonella typhimurium LT2
gcucaaccacgauaacc

SEQ ID NO: 3772010 - RNA, 16 nt, Salmonella typhimurium LT2
gcucaaccgcgcggcg

SEQ ID NO: 3772011 - RNA, 21 nt, Salmonella typhimurium LT2
gcucaacgccuuuacaaucga

SEQ ID NO: 3772012 - RNA, 18 nt, Salmonella typhimurium LT2
gcucaacgcguucaucca

SEQ ID NO: 3772013 - RNA, 18 nt, Salmonella typhimurium LT2
gcucaagcuguagcguuu

SEQ ID NO: 3772014 - RNA, 13 nt, Salmonella typhimurium LT2
gcucaauaauauc

SEQ ID NO: 3772015 - RNA, 20 nt, Salmonella typhimurium LT2
gcucaauaccuuaguaaaac

SEQ ID NO: 3772016 - RNA, 17 nt, Salmonella typhimurium LT2
gcucaauaugccaggca

SEQ ID NO: 3772017 - RNA, 19 nt, Salmonella typhimurium LT2
gcucaaucagaauuucgcc

SEQ ID NO: 3772018 - RNA, 14 nt, Salmonella typhimurium LT2
gcucaauccaggug

SEQ ID NO: 3772019 - RNA, 14 nt, Salmonella typhimurium LT2
gcucaauuuuuuuc

SEQ ID NO: 3772020 - RNA, 24 nt, Salmonella typhimurium LT2
gcucacaaugccgcccaggauaca

SEQ ID NO: 3772021 - RNA, 19 nt, Salmonella typhimurium LT2
gcucaccacgucauccggc

SEQ ID NO: 3772022 - RNA, 23 nt, Salmonella typhimurium LT2
gcucacccaguuuuuuucugcca

SEQ ID NO: 3772023 - RNA, 15 nt, Salmonella typhimurium LT2
gcucacggcacgccc

SEQ ID NO: 3772024 - RNA, 16 nt, Salmonella typhimurium LT2
gcucacgguuucuacu

SEQ ID NO: 3772025 - RNA, 20 nt, Salmonella typhimurium LT2
gcucacgguuucuacuucca

SEQ ID NO: 3772026 - RNA, 20 nt, Salmonella typhimurium LT2
gcucagaaccucaucccggc

SEQ ID NO: 3772027 - RNA, 21 nt, Salmonella typhimurium LT2
gcucagccaggcgcggcgcgc

SEQ ID NO: 3772028 - RNA, 13 nt, Salmonella typhimurium LT2
gcucagcgcggca

SEQ ID NO: 3772029 - RNA, 16 nt, Salmonella typhimurium LT2
gcucagcgcggcagcc

SEQ ID NO: 3772030 - RNA, 19 nt, Salmonella typhimurium LT2
gcucaggagcgccugacag

SEQ ID NO: 3772031 - RNA, 18 nt, Salmonella typhimurium LT2
gcucagggcaaagucuuc

SEQ ID NO: 3772032 - RNA, 16 nt, Salmonella typhimurium LT2
gcucagggcauccgcc

SEQ ID NO: 3772033 - RNA, 23 nt, Salmonella typhimurium LT2
gcucagggucagaauacagaauc

SEQ ID NO: 3772034 - RNA, 22 nt, Salmonella typhimurium LT2
gcucagguaggugauaagcagg

SEQ ID NO: 3772035 - RNA, 22 nt, Salmonella typhimurium LT2
gcucagguucgggccaccuucc

SEQ ID NO: 3772036 - RNA, 20 nt, Salmonella typhimurium LT2
gcucagguuguccagcagca

SEQ ID NO: 3772037 - RNA, 16 nt, Salmonella typhimurium LT2
gcucagucacuucaac

SEQ ID NO: 3772038 - RNA, 18 nt, Salmonella typhimurium LT2
gcucagucacuucaaccu

SEQ ID NO: 3772039 - RNA, 22 nt, Salmonella typhimurium LT2
gcucaguugcguucccaguucc

SEQ ID NO: 3772040 - RNA, 19 nt, Salmonella typhimurium LT2
gcucauaaauugcagcgac

SEQ ID NO: 3772041 - RNA, 20 nt, Salmonella typhimurium LT2
gcucauaaauugcagcgacc

SEQ ID NO: 3772042 - RNA, 18 nt, Salmonella typhimurium LT2
gcucauaacccuccugcc

SEQ ID NO: 3772043 - RNA, 22 nt, Salmonella typhimurium LT2
gcucauaacggcuuaacgccag

SEQ ID NO: 3772044 - RNA, 20 nt, Salmonella typhimurium LT2
gcucauaauggaccagaaca

SEQ ID NO: 3772045 - RNA, 21 nt, Salmonella typhimurium LT2
gcucauaauggaccagaacau

SEQ ID NO: 3772046 - RNA, 17 nt, Salmonella typhimurium LT2
gcucauaccuggcuuga

SEQ ID NO: 3772047 - RNA, 20 nt, Salmonella typhimurium LT2
gcucauagccgcuuuccgcc

SEQ ID NO: 3772048 - RNA, 18 nt, Salmonella typhimurium LT2
gcucauaucguugcggau

SEQ ID NO: 3772049 - RNA, 13 nt, Salmonella typhimurium LT2
gcucauccagcaa

SEQ ID NO: 3772050 - RNA, 16 nt, Salmonella typhimurium LT2
gcucauccagcaacag

SEQ ID NO: 3772051 - RNA, 20 nt, Salmonella typhimurium LT2
gcucaucggcggcaaagccg

SEQ ID NO: 3772052 - RNA, 16 nt, Salmonella typhimurium LT2
gcucaugcgcggcggg

SEQ ID NO: 3772053 - RNA, 17 nt, Salmonella typhimurium LT2
gcucaugugcagcaucc

SEQ ID NO: 3772054 - RNA, 20 nt, Salmonella typhimurium LT2
gcucaugugcagcauccagc

SEQ ID NO: 3772055 - RNA, 23 nt, Salmonella typhimurium LT2
gcucaugugcagcauccagcuca

SEQ ID NO: 3772056 - RNA, 21 nt, Salmonella typhimurium LT2
gcucauuaaaccgcgcggcau

SEQ ID NO: 3772057 - RNA, 18 nt, Salmonella typhimurium LT2
gcucauuaacgacaacuu

SEQ ID NO: 3772058 - RNA, 15 nt, Salmonella typhimurium LT2
gcucauuauuuggau

SEQ ID NO: 3772059 - RNA, 15 nt, Salmonella typhimurium LT2
gcucauuucagcgag

SEQ ID NO: 3772060 - RNA, 22 nt, Salmonella typhimurium LT2
gcucauuugcggcgucgccugg

SEQ ID NO: 3772061 - RNA, 17 nt, Salmonella typhimurium LT2
gcucauuuuauccaaca

SEQ ID NO: 3772062 - RNA, 22 nt, Salmonella typhimurium LT2
gcucauuuuauccaacagcgca

SEQ ID NO: 3772063 - RNA, 13 nt, Salmonella typhimurium LT2
gcuccaauaaaua

SEQ ID NO: 3772064 - RNA, 23 nt, Salmonella typhimurium LT2
gcuccaccagcgcaucaaugucg

SEQ ID NO: 3772065 - RNA, 17 nt, Salmonella typhimurium LT2
gcuccacuggcccccug

SEQ ID NO: 3772066 - RNA, 20 nt, Salmonella typhimurium LT2
gcuccacuggcccccuguuc

SEQ ID NO: 3772067 - RNA, 21 nt, Salmonella typhimurium LT2
gcuccacuggcccccuguucc

SEQ ID NO: 3772068 - RNA, 21 nt, Salmonella typhimurium LT2
gcuccagaagcacuucuccac

SEQ ID NO: 3772069 - RNA, 15 nt, Salmonella typhimurium LT2
gcuccagaccaccag

SEQ ID NO: 3772070 - RNA, 20 nt, Salmonella typhimurium LT2
gcuccagaccaccagcgaca

SEQ ID NO: 3772071 - RNA, 9 nt, Salmonella typhimurium LT2
gcuccagca

SEQ ID NO: 3772072 - RNA, 15 nt, Salmonella typhimurium LT2
gcuccagcaucacau

SEQ ID NO: 3772073 - RNA, 18 nt, Salmonella typhimurium LT2
gcuccagcgccagcucca

SEQ ID NO: 3772074 - RNA, 17 nt, Salmonella typhimurium LT2
gcuccagcgccugcugc

SEQ ID NO: 3772075 - RNA, 21 nt, Salmonella typhimurium LT2
gcuccagcggaagaucgccau

SEQ ID NO: 3772076 - RNA, 11 nt, Salmonella typhimurium LT2
gcuccagcugg

SEQ ID NO: 3772077 - RNA, 16 nt, Salmonella typhimurium LT2
gcuccagcuggcuggc

SEQ ID NO: 3772078 - RNA, 23 nt, Salmonella typhimurium LT2
gcuccagcuucaucaucagcagc

SEQ ID NO: 3772079 - RNA, 23 nt, Salmonella typhimurium LT2
gcuccagggcugcuggccuucca

SEQ ID NO: 3772080 - RNA, 23 nt, Salmonella typhimurium LT2
gcuccaguggucguuagccagau

SEQ ID NO: 3772081 - RNA, 16 nt, Salmonella typhimurium LT2
gcuccaguuguuccag

SEQ ID NO: 3772082 - RNA, 20 nt, Salmonella typhimurium LT2
gcuccaguuguuccagcagc

SEQ ID NO: 3772083 - RNA, 16 nt, Salmonella typhimurium LT2
gcuccaguuucgccag

SEQ ID NO: 3772084 - RNA, 17 nt, Salmonella typhimurium LT2
gcuccaguuucgccagc

SEQ ID NO: 3772085 - RNA, 19 nt, Salmonella typhimurium LT2
gcuccaucagaucaucaau

SEQ ID NO: 3772086 - RNA, 14 nt, Salmonella typhimurium LT2
gcuccauccaccag

SEQ ID NO: 3772087 - RNA, 15 nt, Salmonella typhimurium LT2
gcuccauccaccagc

SEQ ID NO: 3772088 - RNA, 18 nt, Salmonella typhimurium LT2
gcuccauccaccagcccc

SEQ ID NO: 3772089 - RNA, 21 nt, Salmonella typhimurium LT2
gcucccagauuaaaucauccu

SEQ ID NO: 3772090 - RNA, 17 nt, Salmonella typhimurium LT2
gcuccccauaaaaaugg

SEQ ID NO: 3772091 - RNA, 15 nt, Salmonella typhimurium LT2
gcuccccgccgcggc

SEQ ID NO: 3772092 - RNA, 15 nt, Salmonella typhimurium LT2
gcucccgcagccacu

SEQ ID NO: 3772093 - RNA, 18 nt, Salmonella typhimurium LT2
gcucccgcagccacuccc

SEQ ID NO: 3772094 - RNA, 21 nt, Salmonella typhimurium LT2
gcucccgcgucacgaccggcg

SEQ ID NO: 3772095 - RNA, 20 nt, Salmonella typhimurium LT2
gcucccggaaccgaccgcga

SEQ ID NO: 3772096 - RNA, 23 nt, Salmonella typhimurium LT2
gcucccggaaccgaccgcgauaa

SEQ ID NO: 3772097 - RNA, 17 nt, Salmonella typhimurium LT2
gcucccggcguuuuugu

SEQ ID NO: 3772098 - RNA, 24 nt, Salmonella typhimurium LT2
gcucccguuccaggcgcucgccgc

SEQ ID NO: 3772099 - RNA, 22 nt, Salmonella typhimurium LT2
gcuccgagacucaaagaaaaca

SEQ ID NO: 3772100 - RNA, 20 nt, Salmonella typhimurium LT2
gcuccgcaguaaucaccguc

SEQ ID NO: 3772101 - RNA, 15 nt, Salmonella typhimurium LT2
gcuccgccagcaaug

SEQ ID NO: 3772102 - RNA, 15 nt, Salmonella typhimurium LT2
gcuccgccccgccuu

SEQ ID NO: 3772103 - RNA, 20 nt, Salmonella typhimurium LT2
gcuccgccggagcaucauuu

SEQ ID NO: 3772104 - RNA, 23 nt, Salmonella typhimurium LT2
gcuccggcacuggcgcuggcugc

SEQ ID NO: 3772105 - RNA, 15 nt, Salmonella typhimurium LT2
gcuccgggccgauac

SEQ ID NO: 3772106 - RNA, 21 nt, Salmonella typhimurium LT2
gcuccgggcgguucggcugcc

SEQ ID NO: 3772107 - RNA, 22 nt, Salmonella typhimurium LT2
gcuccgggcgguucggcugccc

SEQ ID NO: 3772108 - RNA, 16 nt, Salmonella typhimurium LT2
gcuccguaucgugcug

SEQ ID NO: 3772109 - RNA, 20 nt, Salmonella typhimurium LT2
gcugauaaagagcaggccaa

SEQ ID NO: 3772110 - RNA, 13 nt, Salmonella typhimurium LT2
gcugauaacaaua

SEQ ID NO: 3772111 - RNA, 14 nt, Salmonella typhimurium LT2
gcugauaacaauau

SEQ ID NO: 3772112 - RNA, 13 nt, Salmonella typhimurium LT2
gcugauaauacug

SEQ ID NO: 3772113 - RNA, 12 nt, Salmonella typhimurium LT2
gcugauaaucaa

SEQ ID NO: 3772114 - RNA, 18 nt, Salmonella typhimurium LT2
gcugauaccgucuuccuu

SEQ ID NO: 3772115 - RNA, 16 nt, Salmonella typhimurium LT2
gcugauacgccuggau

SEQ ID NO: 3772116 - RNA, 22 nt, Salmonella typhimurium LT2
gcugauacuuauuacgguauca

SEQ ID NO: 3772117 - RNA, 20 nt, Salmonella typhimurium LT2
gcugauauuuucaggcaccg

SEQ ID NO: 3772118 - RNA, 13 nt, Salmonella typhimurium LT2
gcugaugcagaua

SEQ ID NO: 3772119 - RNA, 18 nt, Salmonella typhimurium LT2
gcugaugucugcgcucuu

SEQ ID NO: 3772120 - RNA, 16 nt, Salmonella typhimurium LT2
gcugaugugcggccug

SEQ ID NO: 3772121 - RNA, 17 nt, Salmonella typhimurium LT2
gcugaugugcuccauca

SEQ ID NO: 3772122 - RNA, 23 nt, Salmonella typhimurium LT2
gcugauguucauucaacaucgcc

SEQ ID NO: 3772123 - RNA, 19 nt, Salmonella typhimurium LT2
gcugauuccggcgcaucca

SEQ ID NO: 3772124 - RNA, 22 nt, Salmonella typhimurium LT2
gcugauuugcgucaaaacagau

SEQ ID NO: 3772125 - RNA, 16 nt, Salmonella typhimurium LT2
gcugcaaauacugcuu

SEQ ID NO: 3772126 - RNA, 16 nt, Salmonella typhimurium LT2
gcugcaaccagcggcg

SEQ ID NO: 3772127 - RNA, 15 nt, Salmonella typhimurium LT2
gcugcaacccgccgc

SEQ ID NO: 3772128 - RNA, 20 nt, Salmonella typhimurium LT2
gcugcaacgucgcgcccugc

SEQ ID NO: 3772129 - RNA, 19 nt, Salmonella typhimurium LT2
gcugcacaaaauacuguuu

SEQ ID NO: 3772130 - RNA, 20 nt, Salmonella typhimurium LT2
gcugcacccggagagaaaca

SEQ ID NO: 3772131 - RNA, 17 nt, Salmonella typhimurium LT2
gcugcacgccaucggcu

SEQ ID NO: 3772132 - RNA, 14 nt, Salmonella typhimurium LT2
gcugcacucagaaa

SEQ ID NO: 3772133 - RNA, 21 nt, Salmonella typhimurium LT2
gcugcagcuuaggauucgcca

SEQ ID NO: 3772134 - RNA, 14 nt, Salmonella typhimurium LT2
gcugcaggugcguu

SEQ ID NO: 3772135 - RNA, 14 nt, Salmonella typhimurium LT2
gcugcauaaaacug

SEQ ID NO: 3772136 - RNA, 15 nt, Salmonella typhimurium LT2
gcugcauccgcgcuu

SEQ ID NO: 3772137 - RNA, 16 nt, Salmonella typhimurium LT2
gcugcaucuuacugac

SEQ ID NO: 3772138 - RNA, 21 nt, Salmonella typhimurium LT2
gcugcaucuuacugaccggcc

SEQ ID NO: 3772139 - RNA, 13 nt, Salmonella typhimurium LT2
gcugccagccagc

SEQ ID NO: 3772140 - RNA, 15 nt, Salmonella typhimurium LT2
gcugccagccagcgg

SEQ ID NO: 3772141 - RNA, 13 nt, Salmonella typhimurium LT2
gcugccagccgcc

SEQ ID NO: 3772142 - RNA, 20 nt, Salmonella typhimurium LT2
gcugccagggcaucgcgcga

SEQ ID NO: 3772143 - RNA, 16 nt, Salmonella typhimurium LT2
gcugccaugcggcggc

SEQ ID NO: 3772144 - RNA, 17 nt, Salmonella typhimurium LT2
gcugccauuaucaccau

SEQ ID NO: 3772145 - RNA, 18 nt, Salmonella typhimurium LT2
gcugccauuaucaccauu

SEQ ID NO: 3772146 - RNA, 22 nt, Salmonella typhimurium LT2
gcugccgacaaagagcucccca

SEQ ID NO: 3772147 - RNA, 15 nt, Salmonella typhimurium LT2
gcugccgacuacgcc

SEQ ID NO: 3772148 - RNA, 22 nt, Salmonella typhimurium LT2
gcugccgacuacgccuccugcc

SEQ ID NO: 3772149 - RNA, 13 nt, Salmonella typhimurium LT2
gcugccgauugcc

SEQ ID NO: 3772150 - RNA, 21 nt, Salmonella typhimurium LT2
gcugccgccauuugcgcggcu

SEQ ID NO: 3772151 - RNA, 15 nt, Salmonella typhimurium LT2
gcugccgcccuuucc

SEQ ID NO: 3772152 - RNA, 18 nt, Salmonella typhimurium LT2
gcugccggaaagccccag

SEQ ID NO: 3772153 - RNA, 13 nt, Salmonella typhimurium LT2
gcugccuuauccg

SEQ ID NO: 3772154 - RNA, 14 nt, Salmonella typhimurium LT2
gcugccuuuuuuaa

SEQ ID NO: 3772155 - RNA, 15 nt, Salmonella typhimurium LT2
gcugcgacagcgaac

SEQ ID NO: 3772156 - RNA, 13 nt, Salmonella typhimurium LT2
gcugcgcaaaucc

SEQ ID NO: 3772157 - RNA, 13 nt, Salmonella typhimurium LT2
gcugcgcacggca

SEQ ID NO: 3772158 - RNA, 13 nt, Salmonella typhimurium LT2
gcugcgcagcacu

SEQ ID NO: 3772159 - RNA, 14 nt, Salmonella typhimurium LT2
gcugcgccagccau

SEQ ID NO: 3772160 - RNA, 16 nt, Salmonella typhimurium LT2
gcugcgcccgacgcca

SEQ ID NO: 3772161 - RNA, 12 nt, Salmonella typhimurium LT2
gcugcgccgcgc

SEQ ID NO: 3772162 - RNA, 18 nt, Salmonella typhimurium LT2
gcugcgccugcgcgagcu

SEQ ID NO: 3772163 - RNA, 19 nt, Salmonella typhimurium LT2
gcugcgccugcgcgagcuc

SEQ ID NO: 3772164 - RNA, 22 nt, Salmonella typhimurium LT2
gcugcgccuggaaaaaagcgcc

SEQ ID NO: 3772165 - RNA, 17 nt, Salmonella typhimurium LT2
gcugcgcugcggucagg

SEQ ID NO: 3772166 - RNA, 19 nt, Salmonella typhimurium LT2
gcugcgcuuauccggccua

SEQ ID NO: 3772167 - RNA, 15 nt, Salmonella typhimurium LT2
gcugcgcuuuccagg

SEQ ID NO: 3772168 - RNA, 17 nt, Salmonella typhimurium LT2
gcugcgcuuuccaggcc

SEQ ID NO: 3772169 - RNA, 16 nt, Salmonella typhimurium LT2
gcugcggauguuaaug

SEQ ID NO: 3772170 - RNA, 21 nt, Salmonella typhimurium LT2
gcugcggccuccgcagcuuca

SEQ ID NO: 3772171 - RNA, 14 nt, Salmonella typhimurium LT2
gcugcgggaggcgg

SEQ ID NO: 3772172 - RNA, 18 nt, Salmonella typhimurium LT2
gcugcgggaggcggucug

SEQ ID NO: 3772173 - RNA, 23 nt, Salmonella typhimurium LT2
gcugcgguauuaacccgcagccg

SEQ ID NO: 3772174 - RNA, 23 nt, Salmonella typhimurium LT2
gcugcuauucgguagucgcugac

SEQ ID NO: 3772175 - RNA, 17 nt, Salmonella typhimurium LT2
gcugcuauuuugcgcuu

SEQ ID NO: 3772176 - RNA, 19 nt, Salmonella typhimurium LT2
gcugcucaacauacgggcu

SEQ ID NO: 3772177 - RNA, 16 nt, Salmonella typhimurium LT2
gcugcucauuucagcg

SEQ ID NO: 3772178 - RNA, 12 nt, Salmonella typhimurium LT2
gcugcucccuca

SEQ ID NO: 3772179 - RNA, 21 nt, Salmonella typhimurium LT2
gcugcucguaaguuuccugcg

SEQ ID NO: 3772180 - RNA, 16 nt, Salmonella typhimurium LT2
gcugcucuugcggcug

SEQ ID NO: 3772181 - RNA, 18 nt, Salmonella typhimurium LT2
gcugcucuugcggcugca

SEQ ID NO: 3772182 - RNA, 23 nt, Salmonella typhimurium LT2
gcugcugaccuuaauccagccgu

SEQ ID NO: 3772183 - RNA, 16 nt, Salmonella typhimurium LT2
gcugcugcgcggccag

SEQ ID NO: 3772184 - RNA, 23 nt, Salmonella typhimurium LT2
gcugcugcgcuuuccaggccagc

SEQ ID NO: 3772185 - RNA, 23 nt, Salmonella typhimurium LT2
gcugcuggagaccaccggcaaag

SEQ ID NO: 3772186 - RNA, 12 nt, Salmonella typhimurium LT2
gcugcuggcgcg

SEQ ID NO: 3772187 - RNA, 16 nt, Salmonella typhimurium LT2
gcugcuggugcgccug

SEQ ID NO: 3772188 - RNA, 22 nt, Salmonella typhimurium LT2
gcugcuguaacagacgcaggcc

SEQ ID NO: 3772189 - RNA, 22 nt, Salmonella typhimurium LT2
gcugcuugcuuuucaucaccau

SEQ ID NO: 3772190 - RNA, 19 nt, Salmonella typhimurium LT2
gcugcuuucuaccagccug

SEQ ID NO: 3772191 - RNA, 23 nt, Salmonella typhimurium LT2
gcugcuuuuggcggcaacaaaug

SEQ ID NO: 3772192 - RNA, 21 nt, Salmonella typhimurium LT2
gcuggaaaaauaagagggcgc

SEQ ID NO: 3772193 - RNA, 11 nt, Salmonella typhimurium LT2
gcuggaaacgc

SEQ ID NO: 3772194 - RNA, 18 nt, Salmonella typhimurium LT2
gcuggaaacgcggcccug

SEQ ID NO: 3772195 - RNA, 16 nt, Salmonella typhimurium LT2
gcuggaaagcucuuca

SEQ ID NO: 3772196 - RNA, 14 nt, Salmonella typhimurium LT2
gcuggaaauguucu

SEQ ID NO: 3772197 - RNA, 22 nt, Salmonella typhimurium LT2
gcuggaaucuaccgccaucggc

SEQ ID NO: 3772198 - RNA, 17 nt, Salmonella typhimurium LT2
gcuggaauguccacucc

SEQ ID NO: 3772199 - RNA, 23 nt, Salmonella typhimurium LT2
gcuggacaugcuccgccccgccu

SEQ ID NO: 3772200 - RNA, 13 nt, Salmonella typhimurium LT2
gcuggcaaagcag

SEQ ID NO: 3772201 - RNA, 14 nt, Salmonella typhimurium LT2
gcuggcacuggcag

SEQ ID NO: 3772202 - RNA, 13 nt, Salmonella typhimurium LT2
gcuggcaggccau

SEQ ID NO: 3772203 - RNA, 14 nt, Salmonella typhimurium LT2
gcuggcaggcgcga

SEQ ID NO: 3772204 - RNA, 22 nt, Salmonella typhimurium LT2
gcuggccuagaugaaugacugu

SEQ ID NO: 3772205 - RNA, 16 nt, Salmonella typhimurium LT2
gcuggccuccagcacu

SEQ ID NO: 3772206 - RNA, 16 nt, Salmonella typhimurium LT2
gcuggcgaaccaccag

SEQ ID NO: 3772207 - RNA, 15 nt, Salmonella typhimurium LT2
gcuggcgacggcggu

SEQ ID NO: 3772208 - RNA, 19 nt, Salmonella typhimurium LT2
gcuggcgauaaugccguga

SEQ ID NO: 3772209 - RNA, 22 nt, Salmonella typhimurium LT2
gcuggcgaugauaaucguccca

SEQ ID NO: 3772210 - RNA, 19 nt, Salmonella typhimurium LT2
gcuggcgcaaagaaggcau

SEQ ID NO: 3772211 - RNA, 18 nt, Salmonella typhimurium LT2
gcuggcgcacgcgucauc

SEQ ID NO: 3772212 - RNA, 15 nt, Salmonella typhimurium LT2
gcuggcgcagccgcu

SEQ ID NO: 3772213 - RNA, 15 nt, Salmonella typhimurium LT2
gcuuaugaagcgcgu

SEQ ID NO: 3772214 - RNA, 16 nt, Salmonella typhimurium LT2
gcuuauuauuuuuucu

SEQ ID NO: 3772215 - RNA, 17 nt, Salmonella typhimurium LT2
gcuuauuauuuuuucuu

SEQ ID NO: 3772216 - RNA, 18 nt, Salmonella typhimurium LT2
gcuuauucagucuggcaa

SEQ ID NO: 3772217 - RNA, 16 nt, Salmonella typhimurium LT2
gcuucaaaaagcgcgc

SEQ ID NO: 3772218 - RNA, 20 nt, Salmonella typhimurium LT2
gcuucaaaaagcgcgcggcu

SEQ ID NO: 3772219 - RNA, 23 nt, Salmonella typhimurium LT2
gcuucaaaaagcgcgcggcugcg

SEQ ID NO: 3772220 - RNA, 17 nt, Salmonella typhimurium LT2
gcuucaacagcggcggc

SEQ ID NO: 3772221 - RNA, 19 nt, Salmonella typhimurium LT2
gcuucaaccguuucuuuuu

SEQ ID NO: 3772222 - RNA, 14 nt, Salmonella typhimurium LT2
gcuucaaccuccug

SEQ ID NO: 3772223 - RNA, 18 nt, Salmonella typhimurium LT2
gcuucaccgauuuaaaau

SEQ ID NO: 3772224 - RNA, 20 nt, Salmonella typhimurium LT2
gcuucaccggcgugcgcuua

SEQ ID NO: 3772225 - RNA, 16 nt, Salmonella typhimurium LT2
gcuucacgaagucugg

SEQ ID NO: 3772226 - RNA, 17 nt, Salmonella typhimurium LT2
gcuucacgagcggucag

SEQ ID NO: 3772227 - RNA, 23 nt, Salmonella typhimurium LT2
gcuucacgagcggucaggccagc

SEQ ID NO: 3772228 - RNA, 11 nt, Salmonella typhimurium LT2
gcuucacgcca

SEQ ID NO: 3772229 - RNA, 22 nt, Salmonella typhimurium LT2
gcuucacgcgcuguaacuucac

SEQ ID NO: 3772230 - RNA, 23 nt, Salmonella typhimurium LT2
gcuucacgcggauugccgcccgu

SEQ ID NO: 3772231 - RNA, 17 nt, Salmonella typhimurium LT2
gcuucacuaacugguac

SEQ ID NO: 3772232 - RNA, 21 nt, Salmonella typhimurium LT2
gcuucagaaagcagguuuuga

SEQ ID NO: 3772233 - RNA, 18 nt, Salmonella typhimurium LT2
gcuucagcccgaagaagc

SEQ ID NO: 3772234 - RNA, 12 nt, Salmonella typhimurium LT2
gcuucagcgaca

SEQ ID NO: 3772235 - RNA, 16 nt, Salmonella typhimurium LT2
gcuucagcggcgcguu

SEQ ID NO: 3772236 - RNA, 22 nt, Salmonella typhimurium LT2
gcuucaggugugguacggcuuu

SEQ ID NO: 3772237 - RNA, 15 nt, Salmonella typhimurium LT2
gcuucauaucgccau

SEQ ID NO: 3772238 - RNA, 17 nt, Salmonella typhimurium LT2
gcuucaucaccaucgcc

SEQ ID NO: 3772239 - RNA, 21 nt, Salmonella typhimurium LT2
gcuucaucauucauccagacc

SEQ ID NO: 3772240 - RNA, 15 nt, Salmonella typhimurium LT2
gcuucaucugguuuu

SEQ ID NO: 3772241 - RNA, 19 nt, Salmonella typhimurium LT2
gcuucaugugccgcgacaa

SEQ ID NO: 3772242 - RNA, 19 nt, Salmonella typhimurium LT2
gcuucauugguuaauucaa

SEQ ID NO: 3772243 - RNA, 20 nt, Salmonella typhimurium LT2
gcuuccacgcacgccggccc

SEQ ID NO: 3772244 - RNA, 15 nt, Salmonella typhimurium LT2
gcuuccacugcaucu

SEQ ID NO: 3772245 - RNA, 13 nt, Salmonella typhimurium LT2
gcuuccagcgccg

SEQ ID NO: 3772246 - RNA, 17 nt, Salmonella typhimurium LT2
gcuuccagcuccaucca

SEQ ID NO: 3772247 - RNA, 15 nt, Salmonella typhimurium LT2
gcuucccaaaaggaa

SEQ ID NO: 3772248 - RNA, 17 nt, Salmonella typhimurium LT2
gcuucccaaaaggaagc

SEQ ID NO: 3772249 - RNA, 16 nt, Salmonella typhimurium LT2
gcuucccacagucggc

SEQ ID NO: 3772250 - RNA, 19 nt, Salmonella typhimurium LT2
gcuucccagcgucgccagu

SEQ ID NO: 3772251 - RNA, 15 nt, Salmonella typhimurium LT2
gcuucccccggcgcc

SEQ ID NO: 3772252 - RNA, 16 nt, Salmonella typhimurium LT2
gcuucccgaugccagc

SEQ ID NO: 3772253 - RNA, 18 nt, Salmonella typhimurium LT2
gcuucccgaugccagcaa

SEQ ID NO: 3772254 - RNA, 15 nt, Salmonella typhimurium LT2
gcuuccgccaugguu

SEQ ID NO: 3772255 - RNA, 14 nt, Salmonella typhimurium LT2
gcuuccgccgggaa

SEQ ID NO: 3772256 - RNA, 13 nt, Salmonella typhimurium LT2
gcuuccgccuucu

SEQ ID NO: 3772257 - RNA, 15 nt, Salmonella typhimurium LT2
gcuuccguccccagc

SEQ ID NO: 3772258 - RNA, 19 nt, Salmonella typhimurium LT2
gcuuccugcgcugucacca

SEQ ID NO: 3772259 - RNA, 13 nt, Salmonella typhimurium LT2
gcuucgccaauaa

SEQ ID NO: 3772260 - RNA, 20 nt, Salmonella typhimurium LT2
gcuucgcgcagccagcgccc

SEQ ID NO: 3772261 - RNA, 15 nt, Salmonella typhimurium LT2
gcuucgcgcgccagu

SEQ ID NO: 3772262 - RNA, 15 nt, Salmonella typhimurium LT2
gcuucggacuccuga

SEQ ID NO: 3772263 - RNA, 15 nt, Salmonella typhimurium LT2
gcuucggcuccagcg

SEQ ID NO: 3772264 - RNA, 18 nt, Salmonella typhimurium LT2
gcuucggcuccagcgccu

SEQ ID NO: 3772265 - RNA, 19 nt, Salmonella typhimurium LT2
gcuucggugaucuccucgc

SEQ ID NO: 3772266 - RNA, 19 nt, Salmonella typhimurium LT2
gcuucgguugccugcguca

SEQ ID NO: 3772267 - RNA, 14 nt, Salmonella typhimurium LT2
gcuucgucagcucc

SEQ ID NO: 3772268 - RNA, 15 nt, Salmonella typhimurium LT2
gcuucguccagaucc

SEQ ID NO: 3772269 - RNA, 21 nt, Salmonella typhimurium LT2
gcuucguggcaaucagcaauu

SEQ ID NO: 3772270 - RNA, 22 nt, Salmonella typhimurium LT2
gcuucucacggauccagaacug

SEQ ID NO: 3772271 - RNA, 19 nt, Salmonella typhimurium LT2
gcuucucccagccgucaug

SEQ ID NO: 3772272 - RNA, 15 nt, Salmonella typhimurium LT2
gcuucucgccuucag

SEQ ID NO: 3772273 - RNA, 19 nt, Salmonella typhimurium LT2
gcuucucuucaaacucgcu

SEQ ID NO: 3772274 - RNA, 16 nt, Salmonella typhimurium LT2
gcuucugauacugcuc

SEQ ID NO: 3772275 - RNA, 21 nt, Salmonella typhimurium LT2
gcuucugccccccgacuucac

SEQ ID NO: 3772276 - RNA, 15 nt, Salmonella typhimurium LT2
gcuucuggcggcggc

SEQ ID NO: 3772277 - RNA, 14 nt, Salmonella typhimurium LT2
gcuucuucaacguu

SEQ ID NO: 3772278 - RNA, 17 nt, Salmonella typhimurium LT2
gcuucuuccggccccgg

SEQ ID NO: 3772279 - RNA, 13 nt, Salmonella typhimurium LT2
gcuucuucuacca

SEQ ID NO: 3772280 - RNA, 18 nt, Salmonella typhimurium LT2
gcuucuucuuuagauaau

SEQ ID NO: 3772281 - RNA, 13 nt, Salmonella typhimurium LT2
gcuucuuggcgau

SEQ ID NO: 3772282 - RNA, 14 nt, Salmonella typhimurium LT2
gcuugacucugaag

SEQ ID NO: 3772283 - RNA, 23 nt, Salmonella typhimurium LT2
gcuugagcaggcuuacgauauuu

SEQ ID NO: 3772284 - RNA, 16 nt, Salmonella typhimurium LT2
gcuugagccagugagc

SEQ ID NO: 3772285 - RNA, 20 nt, Salmonella typhimurium LT2
gcuugaucucucccuggcag

SEQ ID NO: 3772286 - RNA, 19 nt, Salmonella typhimurium LT2
gcuugcauugcuuuuaguu

SEQ ID NO: 3772287 - RNA, 18 nt, Salmonella typhimurium LT2
gcuugccaaagcgggcaa

SEQ ID NO: 3772288 - RNA, 16 nt, Salmonella typhimurium LT2
gcuugcccagcauauu

SEQ ID NO: 3772289 - RNA, 16 nt, Salmonella typhimurium LT2
gcuugccccucuuuuu

SEQ ID NO: 3772290 - RNA, 14 nt, Salmonella typhimurium LT2
gcuugcccggccgu

SEQ ID NO: 3772291 - RNA, 14 nt, Salmonella typhimurium LT2
gcuugcccggccua

SEQ ID NO: 3772292 - RNA, 16 nt, Salmonella typhimurium LT2
gcuugccgaccgcaac

SEQ ID NO: 3772293 - RNA, 18 nt, Salmonella typhimurium LT2
gcuugccgguucgcgacu

SEQ ID NO: 3772294 - RNA, 17 nt, Salmonella typhimurium LT2
gcuugcgcauggccuga

SEQ ID NO: 3772295 - RNA, 14 nt, Salmonella typhimurium LT2
gcuugcgccagcau

SEQ ID NO: 3772296 - RNA, 15 nt, Salmonella typhimurium LT2
gcuugcgccagcauc

SEQ ID NO: 3772297 - RNA, 14 nt, Salmonella typhimurium LT2
gcuugcgcuauccg

SEQ ID NO: 3772298 - RNA, 19 nt, Salmonella typhimurium LT2
gcuugcucguaccaggccc

SEQ ID NO: 3772299 - RNA, 19 nt, Salmonella typhimurium LT2
gcuugcuuuucaucaccau

SEQ ID NO: 3772300 - RNA, 20 nt, Salmonella typhimurium LT2
gcuuggccaguggggcugcu

SEQ ID NO: 3772301 - RNA, 18 nt, Salmonella typhimurium LT2
gcuuggguauagagcaau

SEQ ID NO: 3772302 - RNA, 14 nt, Salmonella typhimurium LT2
gcuuguaggccgga

SEQ ID NO: 3772303 - RNA, 16 nt, Salmonella typhimurium LT2
gcuugucgaucaucag

SEQ ID NO: 3772304 - RNA, 19 nt, Salmonella typhimurium LT2
gcuugucgcgagcuuccag

SEQ ID NO: 3772305 - RNA, 14 nt, Salmonella typhimurium LT2
gcuugugggagaag

SEQ ID NO: 3772306 - RNA, 17 nt, Salmonella typhimurium LT2
gcuuguuagcuuucugc

SEQ ID NO: 3772307 - RNA, 20 nt, Salmonella typhimurium LT2
gcuuguuagcuuucugccag

SEQ ID NO: 3772308 - RNA, 22 nt, Salmonella typhimurium LT2
gcuuguuuacgcccucaucggc

SEQ ID NO: 3772309 - RNA, 16 nt, Salmonella typhimurium LT2
gcuuuaaauucagcac

SEQ ID NO: 3772310 - RNA, 13 nt, Salmonella typhimurium LT2
gcuuuaagcgcug

SEQ ID NO: 3772311 - RNA, 13 nt, Salmonella typhimurium LT2
gcuuuaaguuuuu

SEQ ID NO: 3772312 - RNA, 21 nt, Salmonella typhimurium LT2
gcuuuaaugcuuuaaaugccu

SEQ ID NO: 3772313 - RNA, 15 nt, Salmonella typhimurium LT2
gcuuuaccgggccua

SEQ ID NO: 3772314 - RNA, 23 nt, Salmonella typhimurium LT2
gcuuuacgaccgcagaaacagau

SEQ ID NO: 3772315 - RNA, 16 nt, Salmonella typhimurium LT2
gcuuuacgaugagcaa

SEQ ID NO: 3772316 - RNA, 12 nt, Salmonella typhimurium LT2
gcuuuauauaaa

SEQ ID NO: 3772317 - RNA, 19 nt, Salmonella typhimurium LT2
ggaacugacagcagugaca

SEQ ID NO: 3772318 - RNA, 14 nt, Salmonella typhimurium LT2
ggaacugcggccag

SEQ ID NO: 3772319 - RNA, 17 nt, Salmonella typhimurium LT2
ggaacuggcuccagcug

SEQ ID NO: 3772320 - RNA, 21 nt, Salmonella typhimurium LT2
ggaacuggcuccagcugguau

SEQ ID NO: 3772321 - RNA, 16 nt, Salmonella typhimurium LT2
ggaacuggugaaacag

SEQ ID NO: 3772322 - RNA, 18 nt, Salmonella typhimurium LT2
ggaacuguucagccagca

SEQ ID NO: 3772323 - RNA, 21 nt, Salmonella typhimurium LT2
ggaagaaaucccacauuugau

SEQ ID NO: 3772324 - RNA, 14 nt, Salmonella typhimurium LT2
ggaagacuggcgca

SEQ ID NO: 3772325 - RNA, 20 nt, Salmonella typhimurium LT2
ggaagcgacgacacggcgca

SEQ ID NO: 3772326 - RNA, 13 nt, Salmonella typhimurium LT2
ggaagcggcuggg

SEQ ID NO: 3772327 - RNA, 15 nt, Salmonella typhimurium LT2
ggaagcugcgcagca

SEQ ID NO: 3772328 - RNA, 18 nt, Salmonella typhimurium LT2
ggaagcugcgcagcacuu

SEQ ID NO: 3772329 - RNA, 18 nt, Salmonella typhimurium LT2
ggaaggauagccguauga

SEQ ID NO: 3772330 - RNA, 16 nt, Salmonella typhimurium LT2
ggaaggggaaaagggu

SEQ ID NO: 3772331 - RNA, 20 nt, Salmonella typhimurium LT2
ggaaggguaugccagcaggc

SEQ ID NO: 3772332 - RNA, 23 nt, Salmonella typhimurium LT2
ggaaggucgcauccgcguuagca

SEQ ID NO: 3772333 - RNA, 22 nt, Salmonella typhimurium LT2
ggaaguuaccgcgccaggcggc

SEQ ID NO: 3772334 - RNA, 16 nt, Salmonella typhimurium LT2
ggaaguuuugcuggaa

SEQ ID NO: 3772335 - RNA, 18 nt, Salmonella typhimurium LT2
ggaauaaaggucacauca

SEQ ID NO: 3772336 - RNA, 21 nt, Salmonella typhimurium LT2
ggaauaacaucguaaaucaaa

SEQ ID NO: 3772337 - RNA, 19 nt, Salmonella typhimurium LT2
ggaauacccagcucagcuu

SEQ ID NO: 3772338 - RNA, 22 nt, Salmonella typhimurium LT2
ggaauacguaauaccugaagcc

SEQ ID NO: 3772339 - RNA, 19 nt, Salmonella typhimurium LT2
ggaauaucuucaucgguaa

SEQ ID NO: 3772340 - RNA, 16 nt, Salmonella typhimurium LT2
ggaauaugagcacagc

SEQ ID NO: 3772341 - RNA, 17 nt, Salmonella typhimurium LT2
ggaauauugagaauaaa

SEQ ID NO: 3772342 - RNA, 21 nt, Salmonella typhimurium LT2
ggaauauugaugccguuuuca

SEQ ID NO: 3772343 - RNA, 13 nt, Salmonella typhimurium LT2
ggaauccaugacc

SEQ ID NO: 3772344 - RNA, 14 nt, Salmonella typhimurium LT2
ggaauccccgccgc

SEQ ID NO: 3772345 - RNA, 14 nt, Salmonella typhimurium LT2
ggaaucgcgaucca

SEQ ID NO: 3772346 - RNA, 12 nt, Salmonella typhimurium LT2
ggaaucgcuggg

SEQ ID NO: 3772347 - RNA, 20 nt, Salmonella typhimurium LT2
ggaaugccccagguuauaga

SEQ ID NO: 3772348 - RNA, 22 nt, Salmonella typhimurium LT2
ggaaugccgugauaggagagca

SEQ ID NO: 3772349 - RNA, 19 nt, Salmonella typhimurium LT2
ggaauuuuauccuggguuu

SEQ ID NO: 3772350 - RNA, 16 nt, Salmonella typhimurium LT2
ggacaacguaccggca

SEQ ID NO: 3772351 - RNA, 16 nt, Salmonella typhimurium LT2
ggacacauuucuuuug

SEQ ID NO: 3772352 - RNA, 23 nt, Salmonella typhimurium LT2
ggacacggcgucaaauccaccgc

SEQ ID NO: 3772353 - RNA, 12 nt, Salmonella typhimurium LT2
ggacagaaaaaa

SEQ ID NO: 3772354 - RNA, 17 nt, Salmonella typhimurium LT2
ggacagaaaaaauagua

SEQ ID NO: 3772355 - RNA, 14 nt, Salmonella typhimurium LT2
ggacagcagcauau

SEQ ID NO: 3772356 - RNA, 11 nt, Salmonella typhimurium LT2
ggacagcgaca

SEQ ID NO: 3772357 - RNA, 20 nt, Salmonella typhimurium LT2
ggacagcgacacuccgcgca

SEQ ID NO: 3772358 - RNA, 21 nt, Salmonella typhimurium LT2
ggacaggcgacgccgccaucc

SEQ ID NO: 3772359 - RNA, 19 nt, Salmonella typhimurium LT2
ggacaguucgccaacgcgu

SEQ ID NO: 3772360 - RNA, 16 nt, Salmonella typhimurium LT2
ggacauacgccgccga

SEQ ID NO: 3772361 - RNA, 15 nt, Salmonella typhimurium LT2
ggacauccauccggg

SEQ ID NO: 3772362 - RNA, 15 nt, Salmonella typhimurium LT2
ggaccagcacaaaaa

SEQ ID NO: 3772363 - RNA, 23 nt, Salmonella typhimurium LT2
ggacccguggcugcgccugcgcg

SEQ ID NO: 3772364 - RNA, 12 nt, Salmonella typhimurium LT2
ggacccugacca

SEQ ID NO: 3772365 - RNA, 14 nt, Salmonella typhimurium LT2
ggacccugaccaca

SEQ ID NO: 3772366 - RNA, 17 nt, Salmonella typhimurium LT2
ggaccggcaaucgccug

SEQ ID NO: 3772367 - RNA, 18 nt, Salmonella typhimurium LT2
ggaccggcaaucgccugc

SEQ ID NO: 3772368 - RNA, 12 nt, Salmonella typhimurium LT2
ggaccguacuca

SEQ ID NO: 3772369 - RNA, 23 nt, Salmonella typhimurium LT2
ggacgauagccaugcccggcggc

SEQ ID NO: 3772370 - RNA, 19 nt, Salmonella typhimurium LT2
ggacgcaagagcguccagu

SEQ ID NO: 3772371 - RNA, 19 nt, Salmonella typhimurium LT2
ggacgcagcucauacccuu

SEQ ID NO: 3772372 - RNA, 21 nt, Salmonella typhimurium LT2
ggacgcgacuuuccgccacca

SEQ ID NO: 3772373 - RNA, 20 nt, Salmonella typhimurium LT2
ggacgcuuuuauccggcgcu

SEQ ID NO: 3772374 - RNA, 13 nt, Salmonella typhimurium LT2
ggacggcaucagg

SEQ ID NO: 3772375 - RNA, 13 nt, Salmonella typhimurium LT2
ggacggcgcagcg

SEQ ID NO: 3772376 - RNA, 15 nt, Salmonella typhimurium LT2
ggacggcggccagca

SEQ ID NO: 3772377 - RNA, 23 nt, Salmonella typhimurium LT2
ggacggcggcugcgaugccauca

SEQ ID NO: 3772378 - RNA, 19 nt, Salmonella typhimurium LT2
ggacgggauacggcgagac

SEQ ID NO: 3772379 - RNA, 17 nt, Salmonella typhimurium LT2
ggacgguaccugaagcc

SEQ ID NO: 3772380 - RNA, 17 nt, Salmonella typhimurium LT2
ggacgucaugccgccac

SEQ ID NO: 3772381 - RNA, 21 nt, Salmonella typhimurium LT2
ggacguggguuucaauauagc

SEQ ID NO: 3772382 - RNA, 12 nt, Salmonella typhimurium LT2
ggacguugaaaa

SEQ ID NO: 3772383 - RNA, 23 nt, Salmonella typhimurium LT2
ggacguugagcguuacgggaaca

SEQ ID NO: 3772384 - RNA, 19 nt, Salmonella typhimurium LT2
ggacguuuggcuuauccgc

SEQ ID NO: 3772385 - RNA, 15 nt, Salmonella typhimurium LT2
ggacucccaggugug

SEQ ID NO: 3772386 - RNA, 18 nt, Salmonella typhimurium LT2
ggacugauacagccaaau

SEQ ID NO: 3772387 - RNA, 13 nt, Salmonella typhimurium LT2
ggacugggcugau

SEQ ID NO: 3772388 - RNA, 18 nt, Salmonella typhimurium LT2
ggacuuaucaggccuacg

SEQ ID NO: 3772389 - RNA, 13 nt, Salmonella typhimurium LT2
ggagacgggcgga

SEQ ID NO: 3772390 - RNA, 12 nt, Salmonella typhimurium LT2
ggagagagccug

SEQ ID NO: 3772391 - RNA, 16 nt, Salmonella typhimurium LT2
ggagagaugccgccag

SEQ ID NO: 3772392 - RNA, 20 nt, Salmonella typhimurium LT2
ggagagcggauaauccgcca

SEQ ID NO: 3772393 - RNA, 17 nt, Salmonella typhimurium LT2
ggagagcggcuggaaga

SEQ ID NO: 3772394 - RNA, 18 nt, Salmonella typhimurium LT2
ggagaggcguucaugccu

SEQ ID NO: 3772395 - RNA, 22 nt, Salmonella typhimurium LT2
ggagagguuagcgcagggggga

SEQ ID NO: 3772396 - RNA, 19 nt, Salmonella typhimurium LT2
ggagauaagcugggcguca

SEQ ID NO: 3772397 - RNA, 14 nt, Salmonella typhimurium LT2
ggagauauacaucu

SEQ ID NO: 3772398 - RNA, 13 nt, Salmonella typhimurium LT2
ggagaucagcaug

SEQ ID NO: 3772399 - RNA, 23 nt, Salmonella typhimurium LT2
ggagaucgacaacaacaucugug

SEQ ID NO: 3772400 - RNA, 15 nt, Salmonella typhimurium LT2
ggagaucgcuuucca

SEQ ID NO: 3772401 - RNA, 17 nt, Salmonella typhimurium LT2
ggagauuaacagcgcga

SEQ ID NO: 3772402 - RNA, 19 nt, Salmonella typhimurium LT2
ggagauugccccccagcca

SEQ ID NO: 3772403 - RNA, 20 nt, Salmonella typhimurium LT2
ggagcaaacagcgugggaag

SEQ ID NO: 3772404 - RNA, 21 nt, Salmonella typhimurium LT2
ggagcaaacagcgugggaagc

SEQ ID NO: 3772405 - RNA, 17 nt, Salmonella typhimurium LT2
ggagcaugaucggccag

SEQ ID NO: 3772406 - RNA, 16 nt, Salmonella typhimurium LT2
ggagccagccugagga

SEQ ID NO: 3772407 - RNA, 11 nt, Salmonella typhimurium LT2
ggagcccagua

SEQ ID NO: 3772408 - RNA, 22 nt, Salmonella typhimurium LT2
ggagcgaagaauucgcaaugug

SEQ ID NO: 3772409 - RNA, 23 nt, Salmonella typhimurium LT2
ggagcgcauuuuacugccguauc

SEQ ID NO: 3772410 - RNA, 13 nt, Salmonella typhimurium LT2
ggagcgcggcggc

SEQ ID NO: 3772411 - RNA, 22 nt, Salmonella typhimurium LT2
ggagcgugcucauuugcggcgu

SEQ ID NO: 3772412 - RNA, 14 nt, Salmonella typhimurium LT2
ggagcugcgcuucg

SEQ ID NO: 3772413 - RNA, 17 nt, Salmonella typhimurium LT2
ggaggaaaguccgggcu

SEQ ID NO: 3772414 - RNA, 23 nt, Salmonella typhimurium LT2
ggaggcgugagcgaacaggucgc

SEQ ID NO: 3772415 - RNA, 15 nt, Salmonella typhimurium LT2
ggagggggagugcug

SEQ ID NO: 3772416 - RNA, 20 nt, Salmonella typhimurium LT2
ggagguauacauccacuggu

SEQ ID NO: 3772417 - RNA, 14 nt, Salmonella typhimurium LT2
ggaggugcucuccc

SEQ ID NO: 3772418 - RNA, 23 nt, Salmonella typhimurium LT2
ggaguaguguaauaccacugccc

SEQ ID NO: 3772419 - RNA, 23 nt, Salmonella typhimurium LT2
ggaguaugcgacgguaaaaauau

SEQ ID NO: 3772420 - RNA, 18 nt, Salmonella typhimurium LT2
ggagucaaguuagccccc

SEQ ID NO: 3772421 - RNA, 14 nt, Salmonella typhimurium LT2
ggcaacauaaauaa

SEQ ID NO: 3772422 - RNA, 14 nt, Salmonella typhimurium LT2
ggcaacgaaaauca

SEQ ID NO: 3772423 - RNA, 20 nt, Salmonella typhimurium LT2
ggcaacgccagagcgucuca

SEQ ID NO: 3772424 - RNA, 13 nt, Salmonella typhimurium LT2
ggcaacgccuucc

SEQ ID NO: 3772425 - RNA, 16 nt, Salmonella typhimurium LT2
ggcaacggcgacaaga

SEQ ID NO: 3772426 - RNA, 20 nt, Salmonella typhimurium LT2
ggcaagaaucacgccgauga

SEQ ID NO: 3772427 - RNA, 17 nt, Salmonella typhimurium LT2
ggcaagaauuucaauca

SEQ ID NO: 3772428 - RNA, 19 nt, Salmonella typhimurium LT2
ggcaagaauuucaaucauc

SEQ ID NO: 3772429 - RNA, 13 nt, Salmonella typhimurium LT2
ggcaagccagcau

SEQ ID NO: 3772430 - RNA, 13 nt, Salmonella typhimurium LT2
ggcaagcugaugu

SEQ ID NO: 3772431 - RNA, 16 nt, Salmonella typhimurium LT2
ggcaagcugauguuca

SEQ ID NO: 3772432 - RNA, 18 nt, Salmonella typhimurium LT2
ggcaaggaaaaccaguaa

SEQ ID NO: 3772433 - RNA, 15 nt, Salmonella typhimurium LT2
ggcaagggcaagggc

SEQ ID NO: 3772434 - RNA, 19 nt, Salmonella typhimurium LT2
ggcaagggcaagggcaagg

SEQ ID NO: 3772435 - RNA, 14 nt, Salmonella typhimurium LT2
ggcaaguaaaauaa

SEQ ID NO: 3772436 - RNA, 19 nt, Salmonella typhimurium LT2
ggcaaguucguuugcugac

SEQ ID NO: 3772437 - RNA, 14 nt, Salmonella typhimurium LT2
ggcaauaaaguuua

SEQ ID NO: 3772438 - RNA, 23 nt, Salmonella typhimurium LT2
ggcaauagaccagcggcccgcgc

SEQ ID NO: 3772439 - RNA, 12 nt, Salmonella typhimurium LT2
ggcaaucaucag

SEQ ID NO: 3772440 - RNA, 12 nt, Salmonella typhimurium LT2
ggcaauccauca

SEQ ID NO: 3772441 - RNA, 22 nt, Salmonella typhimurium LT2
ggcaaucgacguugaucgccau

SEQ ID NO: 3772442 - RNA, 21 nt, Salmonella typhimurium LT2
ggcaaucgcgguaugcgauac

SEQ ID NO: 3772443 - RNA, 15 nt, Salmonella typhimurium LT2
ggcaaucggccaggu

SEQ ID NO: 3772444 - RNA, 19 nt, Salmonella typhimurium LT2
ggcaaugaccgcaauuaaa

SEQ ID NO: 3772445 - RNA, 12 nt, Salmonella typhimurium LT2
ggcaaugccacc

SEQ ID NO: 3772446 - RNA, 19 nt, Salmonella typhimurium LT2
ggcaaugccaccagcgcca

SEQ ID NO: 3772447 - RNA, 21 nt, Salmonella typhimurium LT2
ggcaaugcccccucggcagca

SEQ ID NO: 3772448 - RNA, 22 nt, Salmonella typhimurium LT2
ggcaaugccucaccccauggcg

SEQ ID NO: 3772449 - RNA, 14 nt, Salmonella typhimurium LT2
ggcaauggcagauu

SEQ ID NO: 3772450 - RNA, 13 nt, Salmonella typhimurium LT2
ggcaauuaacauu

SEQ ID NO: 3772451 - RNA, 23 nt, Salmonella typhimurium LT2
ggcaauuucacugucgccaggcc

SEQ ID NO: 3772452 - RNA, 22 nt, Salmonella typhimurium LT2
ggcacaaaauauuacgccauca

SEQ ID NO: 3772453 - RNA, 19 nt, Salmonella typhimurium LT2
ggcacaaccuggcuugccg

SEQ ID NO: 3772454 - RNA, 12 nt, Salmonella typhimurium LT2
ggcacaauagcg

SEQ ID NO: 3772455 - RNA, 17 nt, Salmonella typhimurium LT2
ggcacaauagcgcuaaa

SEQ ID NO: 3772456 - RNA, 14 nt, Salmonella typhimurium LT2
ggcacacagcacua

SEQ ID NO: 3772457 - RNA, 14 nt, Salmonella typhimurium LT2
ggcacacaggccgc

SEQ ID NO: 3772458 - RNA, 15 nt, Salmonella typhimurium LT2
ggcacaccggccauu

SEQ ID NO: 3772459 - RNA, 20 nt, Salmonella typhimurium LT2
ggcacagcgugggcaaauca

SEQ ID NO: 3772460 - RNA, 18 nt, Salmonella typhimurium LT2
ggcacauauuccggcgcu

SEQ ID NO: 3772461 - RNA, 20 nt, Salmonella typhimurium LT2
ggcacauugucagcugaaca

SEQ ID NO: 3772462 - RNA, 12 nt, Salmonella typhimurium LT2
ggcaccagcaau

SEQ ID NO: 3772463 - RNA, 15 nt, Salmonella typhimurium LT2
ggcaccgguuuuuga

SEQ ID NO: 3772464 - RNA, 16 nt, Salmonella typhimurium LT2
ggcaccguuagugauu

SEQ ID NO: 3772465 - RNA, 15 nt, Salmonella typhimurium LT2
ggcaccucguccaga

SEQ ID NO: 3772466 - RNA, 12 nt, Salmonella typhimurium LT2
ggcacgccaucg

SEQ ID NO: 3772467 - RNA, 15 nt, Salmonella typhimurium LT2
ggcacgccugugcuu

SEQ ID NO: 3772468 - RNA, 13 nt, Salmonella typhimurium LT2
ggcacgcucuccu

SEQ ID NO: 3772469 - RNA, 19 nt, Salmonella typhimurium LT2
ggcacgcucuccuacacca

SEQ ID NO: 3772470 - RNA, 18 nt, Salmonella typhimurium LT2
ggcacggucaaucaucag

SEQ ID NO: 3772471 - RNA, 15 nt, Salmonella typhimurium LT2
ggcacggucugcuga

SEQ ID NO: 3772472 - RNA, 18 nt, Salmonella typhimurium LT2
ggcacuacgguccaguug

SEQ ID NO: 3772473 - RNA, 22 nt, Salmonella typhimurium LT2
ggcacucaccucuuccgccagg

SEQ ID NO: 3772474 - RNA, 21 nt, Salmonella typhimurium LT2
ggcacuucgauaaacgccucg

SEQ ID NO: 3772475 - RNA, 11 nt, Salmonella typhimurium LT2
ggcagaauaaa

SEQ ID NO: 3772476 - RNA, 19 nt, Salmonella typhimurium LT2
ggcagacaaaacauaucca

SEQ ID NO: 3772477 - RNA, 15 nt, Salmonella typhimurium LT2
ggcagacaugaccgc

SEQ ID NO: 3772478 - RNA, 14 nt, Salmonella typhimurium LT2
ggcagacggcuggg

SEQ ID NO: 3772479 - RNA, 14 nt, Salmonella typhimurium LT2
ggcagagcgcgcuc

SEQ ID NO: 3772480 - RNA, 18 nt, Salmonella typhimurium LT2
ggcagagcggcaacacau

SEQ ID NO: 3772481 - RNA, 16 nt, Salmonella typhimurium LT2
ggcagaguccagcggc

SEQ ID NO: 3772482 - RNA, 20 nt, Salmonella typhimurium LT2
ggcagaguccagcggcagcu

SEQ ID NO: 3772483 - RNA, 21 nt, Salmonella typhimurium LT2
ggcagauaaaccacgccgucg

SEQ ID NO: 3772484 - RNA, 16 nt, Salmonella typhimurium LT2
ggcagaucgcgcuccc

SEQ ID NO: 3772485 - RNA, 23 nt, Salmonella typhimurium LT2
ggcagauuauuuaaaucccacua

SEQ ID NO: 3772486 - RNA, 16 nt, Salmonella typhimurium LT2
ggcagcaauacgcccg

SEQ ID NO: 3772487 - RNA, 13 nt, Salmonella typhimurium LT2
ggcagcagcgcgc

SEQ ID NO: 3772488 - RNA, 14 nt, Salmonella typhimurium LT2
ggcagcagcuucau

SEQ ID NO: 3772489 - RNA, 15 nt, Salmonella typhimurium LT2
ggcagccccaggccu

SEQ ID NO: 3772490 - RNA, 15 nt, Salmonella typhimurium LT2
ggcagccgacagcgu

SEQ ID NO: 3772491 - RNA, 21 nt, Salmonella typhimurium LT2
ggcagcgcaacgcuuaauccc

SEQ ID NO: 3772492 - RNA, 15 nt, Salmonella typhimurium LT2
ggcagcgccagcggu

SEQ ID NO: 3772493 - RNA, 19 nt, Salmonella typhimurium LT2
ggcagcgcgaacaggcugg

SEQ ID NO: 3772494 - RNA, 20 nt, Salmonella typhimurium LT2
ggcagcgucggcuucaucac

SEQ ID NO: 3772495 - RNA, 16 nt, Salmonella typhimurium LT2
ggcagcguggcgagcu

SEQ ID NO: 3772496 - RNA, 15 nt, Salmonella typhimurium LT2
ggcagcucuuucaac

SEQ ID NO: 3772497 - RNA, 13 nt, Salmonella typhimurium LT2
ggcagcuuacugu

SEQ ID NO: 3772498 - RNA, 20 nt, Salmonella typhimurium LT2
ggcagcuuacugugccgccg

SEQ ID NO: 3772499 - RNA, 19 nt, Salmonella typhimurium LT2
ggcaggaaauccagcagaa

SEQ ID NO: 3772500 - RNA, 21 nt, Salmonella typhimurium LT2
ggcaggaugaaugacugucca

SEQ ID NO: 3772501 - RNA, 13 nt, Salmonella typhimurium LT2
ggcaggcaaaucu

SEQ ID NO: 3772502 - RNA, 13 nt, Salmonella typhimurium LT2
ggcaggcagcgcc

SEQ ID NO: 3772503 - RNA, 15 nt, Salmonella typhimurium LT2
ggcaggcagcgccag

SEQ ID NO: 3772504 - RNA, 12 nt, Salmonella typhimurium LT2
ggcaggcaucgc

SEQ ID NO: 3772505 - RNA, 14 nt, Salmonella typhimurium LT2
ggcaggccuaacac

SEQ ID NO: 3772506 - RNA, 20 nt, Salmonella typhimurium LT2
ggcaggccugauucagguca

SEQ ID NO: 3772507 - RNA, 23 nt, Salmonella typhimurium LT2
ggcagggaacacccgcccgguuu

SEQ ID NO: 3772508 - RNA, 15 nt, Salmonella typhimurium LT2
ggcagggcagcgagc

SEQ ID NO: 3772509 - RNA, 15 nt, Salmonella typhimurium LT2
ggcagguauuaaucc

SEQ ID NO: 3772510 - RNA, 14 nt, Salmonella typhimurium LT2
ggcaguaagccagc

SEQ ID NO: 3772511 - RNA, 15 nt, Salmonella typhimurium LT2
ggcaguaagccagcg

SEQ ID NO: 3772512 - RNA, 19 nt, Salmonella typhimurium LT2
ggcaguaagccagcgggcg

SEQ ID NO: 3772513 - RNA, 17 nt, Salmonella typhimurium LT2
ggcaguccuugcagcca

SEQ ID NO: 3772514 - RNA, 23 nt, Salmonella typhimurium LT2
ggcagucgcaucauggcgaaucc

SEQ ID NO: 3772515 - RNA, 13 nt, Salmonella typhimurium LT2
ggcagugcauaaa

SEQ ID NO: 3772516 - RNA, 19 nt, Salmonella typhimurium LT2
ggcagugccgguugccuga

SEQ ID NO: 3772517 - RNA, 15 nt, Salmonella typhimurium LT2
ggcaguguuucccaa

SEQ ID NO: 3772518 - RNA, 12 nt, Salmonella typhimurium LT2
ggcaguucccua

SEQ ID NO: 3772519 - RNA, 21 nt, Salmonella typhimurium LT2
ggcaguuuuucuacgaugacg

SEQ ID NO: 3772520 - RNA, 19 nt, Salmonella typhimurium LT2
ggcauaaaaaagaggaaug

SEQ ID NO: 3772521 - RNA, 12 nt, Salmonella typhimurium LT2
ggcauaaacgcc

SEQ ID NO: 3772522 - RNA, 15 nt, Salmonella typhimurium LT2
ggcauaacccgccgc

SEQ ID NO: 3772523 - RNA, 17 nt, Salmonella typhimurium LT2
ggcauaaccgcagcgcg

SEQ ID NO: 3772524 - RNA, 15 nt, Salmonella typhimurium LT2
ggcauauccggcgca

SEQ ID NO: 3772525 - RNA, 16 nt, Salmonella typhimurium LT2
ggcaucaauaaaauca

SEQ ID NO: 3772526 - RNA, 16 nt, Salmonella typhimurium LT2
ggccgacgauaaacag

SEQ ID NO: 3772527 - RNA, 20 nt, Salmonella typhimurium LT2
ggccgacguaaacgucggcc

SEQ ID NO: 3772528 - RNA, 14 nt, Salmonella typhimurium LT2
ggccgagaggcuga

SEQ ID NO: 3772529 - RNA, 19 nt, Salmonella typhimurium LT2
ggccgauauugcggccuuc

SEQ ID NO: 3772530 - RNA, 21 nt, Salmonella typhimurium LT2
ggccgauauugcggccuuccu

SEQ ID NO: 3772531 - RNA, 17 nt, Salmonella typhimurium LT2
ggccgauggucgcgcca

SEQ ID NO: 3772532 - RNA, 12 nt, Salmonella typhimurium LT2
ggccgcagcgcc

SEQ ID NO: 3772533 - RNA, 18 nt, Salmonella typhimurium LT2
ggccgccacgaccugcag

SEQ ID NO: 3772534 - RNA, 12 nt, Salmonella typhimurium LT2
ggccgccagaga

SEQ ID NO: 3772535 - RNA, 22 nt, Salmonella typhimurium LT2
ggccgccagcgugacccagaca

SEQ ID NO: 3772536 - RNA, 16 nt, Salmonella typhimurium LT2
ggccgccaucuccggc

SEQ ID NO: 3772537 - RNA, 20 nt, Salmonella typhimurium LT2
ggccgccaucuccggcagcg

SEQ ID NO: 3772538 - RNA, 19 nt, Salmonella typhimurium LT2
ggccgcguuaacgccguug

SEQ ID NO: 3772539 - RNA, 23 nt, Salmonella typhimurium LT2
ggccgcuaucugcuccgccagca

SEQ ID NO: 3772540 - RNA, 22 nt, Salmonella typhimurium LT2
ggccgcucgccauaucuucuac

SEQ ID NO: 3772541 - RNA, 14 nt, Salmonella typhimurium LT2
ggccgcucgccugc

SEQ ID NO: 3772542 - RNA, 18 nt, Salmonella typhimurium LT2
ggccggaauacguaauac

SEQ ID NO: 3772543 - RNA, 22 nt, Salmonella typhimurium LT2
ggccggauaaggcauucacgcc

SEQ ID NO: 3772544 - RNA, 21 nt, Salmonella typhimurium LT2
ggccggauaaggcgcuagccg

SEQ ID NO: 3772545 - RNA, 20 nt, Salmonella typhimurium LT2
ggccggauaaggcguaacac

SEQ ID NO: 3772546 - RNA, 19 nt, Salmonella typhimurium LT2
ggccggauaaggcguaacc

SEQ ID NO: 3772547 - RNA, 22 nt, Salmonella typhimurium LT2
ggccggaugccagucaauaagc

SEQ ID NO: 3772548 - RNA, 24 nt, Salmonella typhimurium LT2
ggccggcauaaugauuguccagcc

SEQ ID NO: 3772549 - RNA, 14 nt, Salmonella typhimurium LT2
ggccggccgcggcg

SEQ ID NO: 3772550 - RNA, 17 nt, Salmonella typhimurium LT2
ggccggcuucuccacca

SEQ ID NO: 3772551 - RNA, 21 nt, Salmonella typhimurium LT2
ggccguagugcuucucuucaa

SEQ ID NO: 3772552 - RNA, 19 nt, Salmonella typhimurium LT2
ggccgucaaaccggcgguc

SEQ ID NO: 3772553 - RNA, 21 nt, Salmonella typhimurium LT2
ggccgucccacgcgccgccga

SEQ ID NO: 3772554 - RNA, 14 nt, Salmonella typhimurium LT2
ggccgucggcgcca

SEQ ID NO: 3772555 - RNA, 23 nt, Salmonella typhimurium LT2
ggccguucauucgccccagcaua

SEQ ID NO: 3772556 - RNA, 15 nt, Salmonella typhimurium LT2
ggccguuuucccggc

SEQ ID NO: 3772557 - RNA, 15 nt, Salmonella typhimurium LT2
ggccuacgcgcaugu

SEQ ID NO: 3772558 - RNA, 17 nt, Salmonella typhimurium LT2
ggccuacguuccaugcg

SEQ ID NO: 3772559 - RNA, 22 nt, Salmonella typhimurium LT2
ggccuagaugaaugacugucca

SEQ ID NO: 3772560 - RNA, 12 nt, Salmonella typhimurium LT2
ggccuaucaggc

SEQ ID NO: 3772561 - RNA, 14 nt, Salmonella typhimurium LT2
ggccucauccgcau

SEQ ID NO: 3772562 - RNA, 18 nt, Salmonella typhimurium LT2
ggccuccugacgaagggc

SEQ ID NO: 3772563 - RNA, 15 nt, Salmonella typhimurium LT2
ggccucgccccuucg

SEQ ID NO: 3772564 - RNA, 17 nt, Salmonella typhimurium LT2
ggccucuaucuucucag

SEQ ID NO: 3772565 - RNA, 19 nt, Salmonella typhimurium LT2
ggccugauaagcacaggcc

SEQ ID NO: 3772566 - RNA, 20 nt, Salmonella typhimurium LT2
ggccugauaagcauagcgcc

SEQ ID NO: 3772567 - RNA, 14 nt, Salmonella typhimurium LT2
ggccugauaagcgc

SEQ ID NO: 3772568 - RNA, 18 nt, Salmonella typhimurium LT2
ggccugauaagcgcagcg

SEQ ID NO: 3772569 - RNA, 22 nt, Salmonella typhimurium LT2
ggccugauaagcguagcgccau

SEQ ID NO: 3772570 - RNA, 23 nt, Salmonella typhimurium LT2
ggccugcagaauuucuacacagc

SEQ ID NO: 3772571 - RNA, 21 nt, Salmonella typhimurium LT2
ggccugcugcagacugccggc

SEQ ID NO: 3772572 - RNA, 18 nt, Salmonella typhimurium LT2
ggccugcuuaaacagaau

SEQ ID NO: 3772573 - RNA, 19 nt, Salmonella typhimurium LT2
ggccugcuuaaacagaauu

SEQ ID NO: 3772574 - RNA, 12 nt, Salmonella typhimurium LT2
ggccuggagauc

SEQ ID NO: 3772575 - RNA, 19 nt, Salmonella typhimurium LT2
ggccuggagcguaagcgcg

SEQ ID NO: 3772576 - RNA, 17 nt, Salmonella typhimurium LT2
ggccuggcugagaaaaa

SEQ ID NO: 3772577 - RNA, 18 nt, Salmonella typhimurium LT2
ggccuggcugagaaaaau

SEQ ID NO: 3772578 - RNA, 20 nt, Salmonella typhimurium LT2
ggccugguaagcgcagcgcc

SEQ ID NO: 3772579 - RNA, 16 nt, Salmonella typhimurium LT2
ggccugucuccgcagc

SEQ ID NO: 3772580 - RNA, 22 nt, Salmonella typhimurium LT2
ggccugugacguuaacgcagca

SEQ ID NO: 3772581 - RNA, 23 nt, Salmonella typhimurium LT2
ggccugugccugacagcaaugag

SEQ ID NO: 3772582 - RNA, 23 nt, Salmonella typhimurium LT2
ggccuguuuuuuauuuuuucgca

SEQ ID NO: 3772583 - RNA, 19 nt, Salmonella typhimurium LT2
ggccuuauccagacgcuga

SEQ ID NO: 3772584 - RNA, 22 nt, Salmonella typhimurium LT2
ggccuuauuuauagcaaauaug

SEQ ID NO: 3772585 - RNA, 15 nt, Salmonella typhimurium LT2
ggccuucaaucagca

SEQ ID NO: 3772586 - RNA, 15 nt, Salmonella typhimurium LT2
ggccuuucggcagcg

SEQ ID NO: 3772587 - RNA, 23 nt, Salmonella typhimurium LT2
ggcgaaaacgacguagcucgccc

SEQ ID NO: 3772588 - RNA, 17 nt, Salmonella typhimurium LT2
ggcgaaaagcuggcuga

SEQ ID NO: 3772589 - RNA, 13 nt, Salmonella typhimurium LT2
ggcgaaagaaaau

SEQ ID NO: 3772590 - RNA, 14 nt, Salmonella typhimurium LT2
ggcgaaagaaaauu

SEQ ID NO: 3772591 - RNA, 22 nt, Salmonella typhimurium LT2
ggcgaaauggaucggcuugccu

SEQ ID NO: 3772592 - RNA, 23 nt, Salmonella typhimurium LT2
ggcgaacaauaccguuagcguca

SEQ ID NO: 3772593 - RNA, 21 nt, Salmonella typhimurium LT2
ggcgaacagccccaccgccag

SEQ ID NO: 3772594 - RNA, 14 nt, Salmonella typhimurium LT2
ggcgaacaggcuca

SEQ ID NO: 3772595 - RNA, 15 nt, Salmonella typhimurium LT2
ggcgaacaggcucag

SEQ ID NO: 3772596 - RNA, 19 nt, Salmonella typhimurium LT2
ggcgaacaggcucagcgcc

SEQ ID NO: 3772597 - RNA, 17 nt, Salmonella typhimurium LT2
ggcgaaccacggcuuca

SEQ ID NO: 3772598 - RNA, 21 nt, Salmonella typhimurium LT2
ggcgaaccggcaucggcagcg

SEQ ID NO: 3772599 - RNA, 20 nt, Salmonella typhimurium LT2
ggcgaacgcuuucugcgucc

SEQ ID NO: 3772600 - RNA, 15 nt, Salmonella typhimurium LT2
ggcgaacuccagcgc

SEQ ID NO: 3772601 - RNA, 18 nt, Salmonella typhimurium LT2
ggcgaacuucauccacgc

SEQ ID NO: 3772602 - RNA, 14 nt, Salmonella typhimurium LT2
ggcgaagcggugca

SEQ ID NO: 3772603 - RNA, 17 nt, Salmonella typhimurium LT2
ggcgaagcucagccagg

SEQ ID NO: 3772604 - RNA, 15 nt, Salmonella typhimurium LT2
ggcgaauaaaauuca

SEQ ID NO: 3772605 - RNA, 15 nt, Salmonella typhimurium LT2
ggcgaauagucgccg

SEQ ID NO: 3772606 - RNA, 21 nt, Salmonella typhimurium LT2
ggcgaauauagcuaaugcaau

SEQ ID NO: 3772607 - RNA, 14 nt, Salmonella typhimurium LT2
ggcgaaucgccugu

SEQ ID NO: 3772608 - RNA, 16 nt, Salmonella typhimurium LT2
ggcgacaaacagcgcc

SEQ ID NO: 3772609 - RNA, 17 nt, Salmonella typhimurium LT2
ggcgacaaacagcgccc

SEQ ID NO: 3772610 - RNA, 15 nt, Salmonella typhimurium LT2
ggcgacaagaauaug

SEQ ID NO: 3772611 - RNA, 20 nt, Salmonella typhimurium LT2
ggcgacaaucaaucuggccg

SEQ ID NO: 3772612 - RNA, 20 nt, Salmonella typhimurium LT2
ggcgacaaugcucucuucgc

SEQ ID NO: 3772613 - RNA, 21 nt, Salmonella typhimurium LT2
ggcgacagacgcuuaucgccg

SEQ ID NO: 3772614 - RNA, 20 nt, Salmonella typhimurium LT2
ggcgacagggauauuccaua

SEQ ID NO: 3772615 - RNA, 14 nt, Salmonella typhimurium LT2
ggcgacaucgccaa

SEQ ID NO: 3772616 - RNA, 17 nt, Salmonella typhimurium LT2
ggcgaccacuagcgccg

SEQ ID NO: 3772617 - RNA, 23 nt, Salmonella typhimurium LT2
ggcgaccacuagcgccgccagcu

SEQ ID NO: 3772618 - RNA, 14 nt, Salmonella typhimurium LT2
ggcgacccgcccac

SEQ ID NO: 3772619 - RNA, 15 nt, Salmonella typhimurium LT2
ggcgacccgcccacg

SEQ ID NO: 3772620 - RNA, 14 nt, Salmonella typhimurium LT2
ggcgaccggcagcc

SEQ ID NO: 3772621 - RNA, 20 nt, Salmonella typhimurium LT2
ggcgaccuucacgccgccaa

SEQ ID NO: 3772622 - RNA, 16 nt, Salmonella typhimurium LT2
ggcgacgaaucagcga

SEQ ID NO: 3772623 - RNA, 16 nt, Salmonella typhimurium LT2
ggcgacgaucagcgcc

SEQ ID NO: 3772624 - RNA, 20 nt, Salmonella typhimurium LT2
ggcgacgcaggcgccuuauc

SEQ ID NO: 3772625 - RNA, 21 nt, Salmonella typhimurium LT2
ggcgacgccucguuugcugag

SEQ ID NO: 3772626 - RNA, 16 nt, Salmonella typhimurium LT2
ggcgacgcuuucaccu

SEQ ID NO: 3772627 - RNA, 20 nt, Salmonella typhimurium LT2
ggcgacgugacgcgccagcg

SEQ ID NO: 3772628 - RNA, 21 nt, Salmonella typhimurium LT2
ggcgacuaacgucuuauccgg

SEQ ID NO: 3772629 - RNA, 14 nt, Salmonella typhimurium LT2
ggcgacuaucgccg

SEQ ID NO: 3772630 - RNA, 17 nt, Salmonella typhimurium LT2
ggcgacucauuacgcca

SEQ ID NO: 3772631 - RNA, 18 nt, Salmonella typhimurium LT2
ggcgacuggaacaggcca

SEQ ID NO: 3772632 - RNA, 17 nt, Salmonella typhimurium LT2
ggcgacuuuuuucaaau

SEQ ID NO: 3772633 - RNA, 19 nt, Salmonella typhimurium LT2
ggcgagaacucgucuuauc

SEQ ID NO: 3772634 - RNA, 22 nt, Salmonella typhimurium LT2
ggcgagagaauuaacagcgcga

SEQ ID NO: 3772635 - RNA, 21 nt, Salmonella typhimurium LT2
ggcgagcguuuugauguccag

SEQ ID NO: 3772636 - RNA, 19 nt, Salmonella typhimurium LT2
ggcgaggaacaucagccag

SEQ ID NO: 3772637 - RNA, 19 nt, Salmonella typhimurium LT2
ggcgagggaaaacaucgcc

SEQ ID NO: 3772638 - RNA, 21 nt, Salmonella typhimurium LT2
ggcgauaaaccaacagccgcc

SEQ ID NO: 3772639 - RNA, 23 nt, Salmonella typhimurium LT2
ggcgauaaaccaacagccgccug

SEQ ID NO: 3772640 - RNA, 17 nt, Salmonella typhimurium LT2
ggcgauaacccgcgcau

SEQ ID NO: 3772641 - RNA, 18 nt, Salmonella typhimurium LT2
ggcgauaaccucucaccg

SEQ ID NO: 3772642 - RNA, 19 nt, Salmonella typhimurium LT2
ggcgauaaccucucaccgc

SEQ ID NO: 3772643 - RNA, 21 nt, Salmonella typhimurium LT2
ggcgauaaggucgcuauccag

SEQ ID NO: 3772644 - RNA, 23 nt, Salmonella typhimurium LT2
ggcgauaaggucgcuauccagca

SEQ ID NO: 3772645 - RNA, 13 nt, Salmonella typhimurium LT2
ggcgauaccagua

SEQ ID NO: 3772646 - RNA, 21 nt, Salmonella typhimurium LT2
ggcgauaccgguacggaacgu

SEQ ID NO: 3772647 - RNA, 22 nt, Salmonella typhimurium LT2
ggcgauacuccgacggcgagcg

SEQ ID NO: 3772648 - RNA, 21 nt, Salmonella typhimurium LT2
ggcgauacugcuccgccggag

SEQ ID NO: 3772649 - RNA, 13 nt, Salmonella typhimurium LT2
ggcgauacuggca

SEQ ID NO: 3772650 - RNA, 13 nt, Salmonella typhimurium LT2
ggcgauagcccca

SEQ ID NO: 3772651 - RNA, 13 nt, Salmonella typhimurium LT2
ggcgauagcgccc

SEQ ID NO: 3772652 - RNA, 16 nt, Salmonella typhimurium LT2
ggcgauagugucgcca

SEQ ID NO: 3772653 - RNA, 22 nt, Salmonella typhimurium LT2
ggcgauaguguggucgucagcc

SEQ ID NO: 3772654 - RNA, 20 nt, Salmonella typhimurium LT2
ggcgauauuguccgucagcg

SEQ ID NO: 3772655 - RNA, 20 nt, Salmonella typhimurium LT2
ggcgaucaccagcaccgcca

SEQ ID NO: 3772656 - RNA, 16 nt, Salmonella typhimurium LT2
ggcgaucagacgcugg

SEQ ID NO: 3772657 - RNA, 15 nt, Salmonella typhimurium LT2
ggcgaucagcggcgc

SEQ ID NO: 3772658 - RNA, 18 nt, Salmonella typhimurium LT2
ggcgaucaucgcaggcgg

SEQ ID NO: 3772659 - RNA, 16 nt, Salmonella typhimurium LT2
ggcgaucgcuaaucag

SEQ ID NO: 3772660 - RNA, 19 nt, Salmonella typhimurium LT2
ggcgaucgcuaaucaggac

SEQ ID NO: 3772661 - RNA, 20 nt, Salmonella typhimurium LT2
ggcgaugauaguguccacuu

SEQ ID NO: 3772662 - RNA, 13 nt, Salmonella typhimurium LT2
ggcgaugccguua

SEQ ID NO: 3772663 - RNA, 14 nt, Salmonella typhimurium LT2
ggcgauucaucgac

SEQ ID NO: 3772664 - RNA, 20 nt, Salmonella typhimurium LT2
ggcgauucggacuaauacuu

SEQ ID NO: 3772665 - RNA, 17 nt, Salmonella typhimurium LT2
ggcgcaaauggcugcga

SEQ ID NO: 3772666 - RNA, 22 nt, Salmonella typhimurium LT2
ggcgcaaccgacgggcgcuggu

SEQ ID NO: 3772667 - RNA, 20 nt, Salmonella typhimurium LT2
ggcgcaacguuugccagcgu

SEQ ID NO: 3772668 - RNA, 19 nt, Salmonella typhimurium LT2
ggcgcaaucuuugccgcaa

SEQ ID NO: 3772669 - RNA, 17 nt, Salmonella typhimurium LT2
ggcgcacacccugcaga

SEQ ID NO: 3772670 - RNA, 22 nt, Salmonella typhimurium LT2
ggcgcacaguacgcggccgccg

SEQ ID NO: 3772671 - RNA, 21 nt, Salmonella typhimurium LT2
ggcgcacgcgucaucggcgcg

SEQ ID NO: 3772672 - RNA, 22 nt, Salmonella typhimurium LT2
ggcgcagccguacacaaucauc

SEQ ID NO: 3772673 - RNA, 22 nt, Salmonella typhimurium LT2
ggcgcagcgaaacugcgcgccg

SEQ ID NO: 3772674 - RNA, 15 nt, Salmonella typhimurium LT2
ggcgcagcgccauca

SEQ ID NO: 3772675 - RNA, 12 nt, Salmonella typhimurium LT2
ggcgcagcuucu

SEQ ID NO: 3772676 - RNA, 12 nt, Salmonella typhimurium LT2
ggcgcaggccag

SEQ ID NO: 3772677 - RNA, 23 nt, Salmonella typhimurium LT2
ggcgcaggggcauuuuccggcga

SEQ ID NO: 3772678 - RNA, 17 nt, Salmonella typhimurium LT2
ggcgcaguucgccacca

SEQ ID NO: 3772679 - RNA, 15 nt, Salmonella typhimurium LT2
ggcgcauaucgcccu

SEQ ID NO: 3772680 - RNA, 15 nt, Salmonella typhimurium LT2
ggcgcaucggucucc

SEQ ID NO: 3772681 - RNA, 18 nt, Salmonella typhimurium LT2
ggcgcaucugaaaaaccu

SEQ ID NO: 3772682 - RNA, 13 nt, Salmonella typhimurium LT2
ggcgcaugcugcc

SEQ ID NO: 3772683 - RNA, 18 nt, Salmonella typhimurium LT2
ggcgcauuuucggcagcg

SEQ ID NO: 3772684 - RNA, 21 nt, Salmonella typhimurium LT2
ggcgcauuuucggcagcgcga

SEQ ID NO: 3772685 - RNA, 16 nt, Salmonella typhimurium LT2
ggcgccaccagcgauu

SEQ ID NO: 3772686 - RNA, 16 nt, Salmonella typhimurium LT2
ggcgccagcgacaacg

SEQ ID NO: 3772687 - RNA, 23 nt, Salmonella typhimurium LT2
ggcgccagcucugccgguuggcc

SEQ ID NO: 3772688 - RNA, 11 nt, Salmonella typhimurium LT2
ggcgccaguac

SEQ ID NO: 3772689 - RNA, 13 nt, Salmonella typhimurium LT2
ggcgccauccggc

SEQ ID NO: 3772690 - RNA, 18 nt, Salmonella typhimurium LT2
ggcgccaugauccagcgg

SEQ ID NO: 3772691 - RNA, 12 nt, Salmonella typhimurium LT2
ggcgccauuucg

SEQ ID NO: 3772692 - RNA, 17 nt, Salmonella typhimurium LT2
ggcgccgccagccagga

SEQ ID NO: 3772693 - RNA, 15 nt, Salmonella typhimurium LT2
ggcgccucgcgcggc

SEQ ID NO: 3772694 - RNA, 17 nt, Salmonella typhimurium LT2
ggcgccuuucgcgcugc

SEQ ID NO: 3772695 - RNA, 17 nt, Salmonella typhimurium LT2
ggcgcgaaaacagcugg

SEQ ID NO: 3772696 - RNA, 22 nt, Salmonella typhimurium LT2
ggcgcgaaacugcugccgcagc

SEQ ID NO: 3772697 - RNA, 22 nt, Salmonella typhimurium LT2
ggcgcgaacgccuuauccggcc

SEQ ID NO: 3772698 - RNA, 19 nt, Salmonella typhimurium LT2
ggcgcgaauacucgcgcug

SEQ ID NO: 3772699 - RNA, 22 nt, Salmonella typhimurium LT2
ggcgcgaugacggcgcguuauc

SEQ ID NO: 3772700 - RNA, 12 nt, Salmonella typhimurium LT2
ggcgcgcccggc

SEQ ID NO: 3772701 - RNA, 15 nt, Salmonella typhimurium LT2
ggcgcgcguggcuuc

SEQ ID NO: 3772702 - RNA, 19 nt, Salmonella typhimurium LT2
ggcgcggaaagccuucauc

SEQ ID NO: 3772703 - RNA, 15 nt, Salmonella typhimurium LT2
ggcgcggauuuccgg

SEQ ID NO: 3772704 - RNA, 13 nt, Salmonella typhimurium LT2
ggcgcggcguagc

SEQ ID NO: 3772705 - RNA, 20 nt, Salmonella typhimurium LT2
ggcgcgggcgagauguuuua

SEQ ID NO: 3772706 - RNA, 15 nt, Salmonella typhimurium LT2
ggcgcggggaacaca

SEQ ID NO: 3772707 - RNA, 20 nt, Salmonella typhimurium LT2
ggcgcgguauuucgccgccg

SEQ ID NO: 3772708 - RNA, 12 nt, Salmonella typhimurium LT2
ggcgcguccagc

SEQ ID NO: 3772709 - RNA, 17 nt, Salmonella typhimurium LT2
ggcgcuaagccagccaa

SEQ ID NO: 3772710 - RNA, 13 nt, Salmonella typhimurium LT2
ggcgcuaaugcuu

SEQ ID NO: 3772711 - RNA, 19 nt, Salmonella typhimurium LT2
ggcgcuaaugcuuauccgg

SEQ ID NO: 3772712 - RNA, 19 nt, Salmonella typhimurium LT2
ggcgcuacgcuuaucaggc

SEQ ID NO: 3772713 - RNA, 20 nt, Salmonella typhimurium LT2
ggcgcuacgcuuaucaggcc

SEQ ID NO: 3772714 - RNA, 22 nt, Salmonella typhimurium LT2
ggcgcuacgcuuaucaggccua

SEQ ID NO: 3772715 - RNA, 17 nt, Salmonella typhimurium LT2
ggcgcuacgcuuauccg

SEQ ID NO: 3772716 - RNA, 20 nt, Salmonella typhimurium LT2
ggcgcuacgcuuauccggcu

SEQ ID NO: 3772717 - RNA, 19 nt, Salmonella typhimurium LT2
ggcgcuacggcgcacagua

SEQ ID NO: 3772718 - RNA, 18 nt, Salmonella typhimurium LT2
ggcgcuacguuuaucugg

SEQ ID NO: 3772719 - RNA, 19 nt, Salmonella typhimurium LT2
ggcgcuagccgcauccggc

SEQ ID NO: 3772720 - RNA, 14 nt, Salmonella typhimurium LT2
ggcgcuauucccag

SEQ ID NO: 3772721 - RNA, 17 nt, Salmonella typhimurium LT2
ggcgcucaacagccaga

SEQ ID NO: 3772722 - RNA, 16 nt, Salmonella typhimurium LT2
ggcgcugaugacgcgc

SEQ ID NO: 3772723 - RNA, 18 nt, Salmonella typhimurium LT2
ggcgcugcgccaucaggc

SEQ ID NO: 3772724 - RNA, 15 nt, Salmonella typhimurium LT2
ggcgcugcgcgcauc

SEQ ID NO: 3772725 - RNA, 20 nt, Salmonella typhimurium LT2
ggcgcugcgcgcaucgggcc

SEQ ID NO: 3772726 - RNA, 17 nt, Salmonella typhimurium LT2
ggcgcugcgcuuaccgg

SEQ ID NO: 3772727 - RNA, 23 nt, Salmonella typhimurium LT2
ggcgcugcgcuuaccgggccuac

SEQ ID NO: 3772728 - RNA, 15 nt, Salmonella typhimurium LT2
ggcgcugcgcuuauc

SEQ ID NO: 3772729 - RNA, 19 nt, Salmonella typhimurium LT2
ggcgcugcgcuuaucaggc

SEQ ID NO: 3772730 - RNA, 20 nt, Salmonella typhimurium LT2
ggcgcugcgcuuauccggcc

SEQ ID NO: 3772731 - RNA, 23 nt, Salmonella typhimurium LT2
ggcgcugcgcuuauccggccuac

SEQ ID NO: 3772732 - RNA, 23 nt, Salmonella typhimurium LT2
ggcguuugcgccgcuauccggca

SEQ ID NO: 3772733 - RNA, 15 nt, Salmonella typhimurium LT2
ggcguuuuccagcgc

SEQ ID NO: 3772734 - RNA, 16 nt, Salmonella typhimurium LT2
ggcguuuuccagcgcg

SEQ ID NO: 3772735 - RNA, 16 nt, Salmonella typhimurium LT2
ggcguuuugccgggcg

SEQ ID NO: 3772736 - RNA, 12 nt, Salmonella typhimurium LT2
ggcuaacgcgcc

SEQ ID NO: 3772737 - RNA, 15 nt, Salmonella typhimurium LT2
ggcuaauauccagcc

SEQ ID NO: 3772738 - RNA, 12 nt, Salmonella typhimurium LT2
ggcuacccauga

SEQ ID NO: 3772739 - RNA, 16 nt, Salmonella typhimurium LT2
ggcuaccucuuauccg

SEQ ID NO: 3772740 - RNA, 23 nt, Salmonella typhimurium LT2
ggcuacggaguucaccgccggcg

SEQ ID NO: 3772741 - RNA, 21 nt, Salmonella typhimurium LT2
ggcuacguacacagucaaaca

SEQ ID NO: 3772742 - RNA, 14 nt, Salmonella typhimurium LT2
ggcuaucaauaugg

SEQ ID NO: 3772743 - RNA, 22 nt, Salmonella typhimurium LT2
ggcuaucaccucugcgggcucc

SEQ ID NO: 3772744 - RNA, 12 nt, Salmonella typhimurium LT2
ggcuauccggcu

SEQ ID NO: 3772745 - RNA, 14 nt, Salmonella typhimurium LT2
ggcuauccucaacu

SEQ ID NO: 3772746 - RNA, 15 nt, Salmonella typhimurium LT2
ggcuaucuucuuccg

SEQ ID NO: 3772747 - RNA, 18 nt, Salmonella typhimurium LT2
ggcuaugcucccccccuu

SEQ ID NO: 3772748 - RNA, 12 nt, Salmonella typhimurium LT2
ggcucaaauugg

SEQ ID NO: 3772749 - RNA, 18 nt, Salmonella typhimurium LT2
ggcucaauacccuuuucu

SEQ ID NO: 3772750 - RNA, 13 nt, Salmonella typhimurium LT2
ggcucaauaugcc

SEQ ID NO: 3772751 - RNA, 23 nt, Salmonella typhimurium LT2
ggcucagacaguagcggcgaggc

SEQ ID NO: 3772752 - RNA, 13 nt, Salmonella typhimurium LT2
ggcucauauuauc

SEQ ID NO: 3772753 - RNA, 13 nt, Salmonella typhimurium LT2
ggcucaucaaaca

SEQ ID NO: 3772754 - RNA, 20 nt, Salmonella typhimurium LT2
ggcucaucaaacagcggcac

SEQ ID NO: 3772755 - RNA, 14 nt, Salmonella typhimurium LT2
ggcucauccagcag

SEQ ID NO: 3772756 - RNA, 23 nt, Salmonella typhimurium LT2
ggcucauuuuauccaacagcgca

SEQ ID NO: 3772757 - RNA, 11 nt, Salmonella typhimurium LT2
ggcuccagcac

SEQ ID NO: 3772758 - RNA, 14 nt, Salmonella typhimurium LT2
ggcuccagcgccag

SEQ ID NO: 3772759 - RNA, 18 nt, Salmonella typhimurium LT2
ggcuccagcgccagcucc

SEQ ID NO: 3772760 - RNA, 16 nt, Salmonella typhimurium LT2
ggcucccacucuucca

SEQ ID NO: 3772761 - RNA, 17 nt, Salmonella typhimurium LT2
ggcucccacucuuccag

SEQ ID NO: 3772762 - RNA, 16 nt, Salmonella typhimurium LT2
ggcucccuuuacaggu

SEQ ID NO: 3772763 - RNA, 14 nt, Salmonella typhimurium LT2
ggcucgcccgcgcu

SEQ ID NO: 3772764 - RNA, 21 nt, Salmonella typhimurium LT2
ggcucgcguugcgucauauaa

SEQ ID NO: 3772765 - RNA, 22 nt, Salmonella typhimurium LT2
ggcucgucguugaaaucgucag

SEQ ID NO: 3772766 - RNA, 16 nt, Salmonella typhimurium LT2
ggcucuaaaaaggaaa

SEQ ID NO: 3772767 - RNA, 22 nt, Salmonella typhimurium LT2
ggcugaaaaauccccccuccuc

SEQ ID NO: 3772768 - RNA, 13 nt, Salmonella typhimurium LT2
ggcugaaagcgcc

SEQ ID NO: 3772769 - RNA, 15 nt, Salmonella typhimurium LT2
ggcugaaagcgccuu

SEQ ID NO: 3772770 - RNA, 16 nt, Salmonella typhimurium LT2
ggcugaaccaggccgg

SEQ ID NO: 3772771 - RNA, 17 nt, Salmonella typhimurium LT2
ggcugaaccccuguuca

SEQ ID NO: 3772772 - RNA, 14 nt, Salmonella typhimurium LT2
ggcugaaugaagcc

SEQ ID NO: 3772773 - RNA, 13 nt, Salmonella typhimurium LT2
ggcugagaaaaau

SEQ ID NO: 3772774 - RNA, 15 nt, Salmonella typhimurium LT2
ggcugagaaaaauac

SEQ ID NO: 3772775 - RNA, 18 nt, Salmonella typhimurium LT2
ggcugagaaggucagucc

SEQ ID NO: 3772776 - RNA, 21 nt, Salmonella typhimurium LT2
ggcugagaaucaccuggcagc

SEQ ID NO: 3772777 - RNA, 14 nt, Salmonella typhimurium LT2
ggcugccagccagc

SEQ ID NO: 3772778 - RNA, 15 nt, Salmonella typhimurium LT2
ggcugccaucaggcg

SEQ ID NO: 3772779 - RNA, 12 nt, Salmonella typhimurium LT2
ggcugccgauga

SEQ ID NO: 3772780 - RNA, 12 nt, Salmonella typhimurium LT2
ggcugccgccau

SEQ ID NO: 3772781 - RNA, 18 nt, Salmonella typhimurium LT2
ggcugcgaugccaucaga

SEQ ID NO: 3772782 - RNA, 13 nt, Salmonella typhimurium LT2
ggcugcgccugcg

SEQ ID NO: 3772783 - RNA, 15 nt, Salmonella typhimurium LT2
ggcugcggcacgcua

SEQ ID NO: 3772784 - RNA, 14 nt, Salmonella typhimurium LT2
ggcugcggcauggc

SEQ ID NO: 3772785 - RNA, 15 nt, Salmonella typhimurium LT2
ggcugcggccuccgc

SEQ ID NO: 3772786 - RNA, 22 nt, Salmonella typhimurium LT2
ggcugcguaaaaucagcauccu

SEQ ID NO: 3772787 - RNA, 16 nt, Salmonella typhimurium LT2
ggcuggacgucaugcc

SEQ ID NO: 3772788 - RNA, 14 nt, Salmonella typhimurium LT2
ggcuggaucaggcg

SEQ ID NO: 3772789 - RNA, 16 nt, Salmonella typhimurium LT2
ggcugguaagagagcc

SEQ ID NO: 3772790 - RNA, 17 nt, Salmonella typhimurium LT2
ggcuguacuuuaaccgg

SEQ ID NO: 3772791 - RNA, 13 nt, Salmonella typhimurium LT2
ggcugucccagag

SEQ ID NO: 3772792 - RNA, 13 nt, Salmonella typhimurium LT2
ggcugucgauccc

SEQ ID NO: 3772793 - RNA, 18 nt, Salmonella typhimurium LT2
ggcugucggcagaaccug

SEQ ID NO: 3772794 - RNA, 18 nt, Salmonella typhimurium LT2
ggcugugcgugacccaua

SEQ ID NO: 3772795 - RNA, 22 nt, Salmonella typhimurium LT2
ggcuguuuugcuucuucagccu

SEQ ID NO: 3772796 - RNA, 16 nt, Salmonella typhimurium LT2
ggcuuaauacagcaac

SEQ ID NO: 3772797 - RNA, 18 nt, Salmonella typhimurium LT2
ggcuuaaugcgcacgcca

SEQ ID NO: 3772798 - RNA, 20 nt, Salmonella typhimurium LT2
ggcuuacggcuauucuucga

SEQ ID NO: 3772799 - RNA, 19 nt, Salmonella typhimurium LT2
ggcuuaguaggcuggcgac

SEQ ID NO: 3772800 - RNA, 18 nt, Salmonella typhimurium LT2
ggcuucaaccguuucuuu

SEQ ID NO: 3772801 - RNA, 16 nt, Salmonella typhimurium LT2
ggcuucaaccuccugc

SEQ ID NO: 3772802 - RNA, 23 nt, Salmonella typhimurium LT2
ggcuuccacccgggaagcccuuu

SEQ ID NO: 3772803 - RNA, 22 nt, Salmonella typhimurium LT2
ggcuuccaguugaaaaccacaa

SEQ ID NO: 3772804 - RNA, 19 nt, Salmonella typhimurium LT2
ggcuucgcuggucagcgca

SEQ ID NO: 3772805 - RNA, 15 nt, Salmonella typhimurium LT2
ggcuucggucagauc

SEQ ID NO: 3772806 - RNA, 22 nt, Salmonella typhimurium LT2
ggcuucguuaagcgguuuucaa

SEQ ID NO: 3772807 - RNA, 20 nt, Salmonella typhimurium LT2
ggcuugaguuuuucucgcaa

SEQ ID NO: 3772808 - RNA, 23 nt, Salmonella typhimurium LT2
ggcuugauguagucgcucagguu

SEQ ID NO: 3772809 - RNA, 14 nt, Salmonella typhimurium LT2
ggcuugccagcaga

SEQ ID NO: 3772810 - RNA, 13 nt, Salmonella typhimurium LT2
ggcuuuaaugcuu

SEQ ID NO: 3772811 - RNA, 19 nt, Salmonella typhimurium LT2
ggcuuuacgaccgcagaaa

SEQ ID NO: 3772812 - RNA, 22 nt, Salmonella typhimurium LT2
ggcuuuaguuuccgguaaauca

SEQ ID NO: 3772813 - RNA, 13 nt, Salmonella typhimurium LT2
ggcuuuauauaaa

SEQ ID NO: 3772814 - RNA, 16 nt, Salmonella typhimurium LT2
ggcuuuaugcacgccg

SEQ ID NO: 3772815 - RNA, 14 nt, Salmonella typhimurium LT2
ggcuuuauugacua

SEQ ID NO: 3772816 - RNA, 21 nt, Salmonella typhimurium LT2
ggcuuucacaccguuauccgg

SEQ ID NO: 3772817 - RNA, 14 nt, Salmonella typhimurium LT2
ggcuuucuaccugc

SEQ ID NO: 3772818 - RNA, 16 nt, Salmonella typhimurium LT2
ggcuuucuaccugcaa

SEQ ID NO: 3772819 - RNA, 21 nt, Salmonella typhimurium LT2
ggcuuugacaaaacucauggc

SEQ ID NO: 3772820 - RNA, 16 nt, Salmonella typhimurium LT2
ggcuuuggccucagca

SEQ ID NO: 3772821 - RNA, 14 nt, Salmonella typhimurium LT2
ggcuuuguaucagc

SEQ ID NO: 3772822 - RNA, 12 nt, Salmonella typhimurium LT2
ggcuuuuuaauc

SEQ ID NO: 3772823 - RNA, 20 nt, Salmonella typhimurium LT2
gggaaaaauguguugcggcc

SEQ ID NO: 3772824 - RNA, 19 nt, Salmonella typhimurium LT2
gggaaaaauuugaucugaa

SEQ ID NO: 3772825 - RNA, 15 nt, Salmonella typhimurium LT2
gggaaacgagcgcgg

SEQ ID NO: 3772826 - RNA, 18 nt, Salmonella typhimurium LT2
gggaaacggauucucuaa

SEQ ID NO: 3772827 - RNA, 19 nt, Salmonella typhimurium LT2
gggaaaucucccuggcagu

SEQ ID NO: 3772828 - RNA, 17 nt, Salmonella typhimurium LT2
gggaaaugagaaaagga

SEQ ID NO: 3772829 - RNA, 18 nt, Salmonella typhimurium LT2
gggaacauuuuucagccc

SEQ ID NO: 3772830 - RNA, 17 nt, Salmonella typhimurium LT2
gggaacuagcgaaucac

SEQ ID NO: 3772831 - RNA, 16 nt, Salmonella typhimurium LT2
gggaacuccagcaggg

SEQ ID NO: 3772832 - RNA, 22 nt, Salmonella typhimurium LT2
gggaagaugugccacuccgcca

SEQ ID NO: 3772833 - RNA, 15 nt, Salmonella typhimurium LT2
gggaaguaaggcaua

SEQ ID NO: 3772834 - RNA, 17 nt, Salmonella typhimurium LT2
gggaaguagcaaaucau

SEQ ID NO: 3772835 - RNA, 12 nt, Salmonella typhimurium LT2
gggacacucaag

SEQ ID NO: 3772836 - RNA, 16 nt, Salmonella typhimurium LT2
gggacggcggccagca

SEQ ID NO: 3772837 - RNA, 20 nt, Salmonella typhimurium LT2
ggguauugcuucguggcaau

SEQ ID NO: 3772838 - RNA, 20 nt, Salmonella typhimurium LT2
gggucacgauaaccaggucg

SEQ ID NO: 3772839 - RNA, 11 nt, Salmonella typhimurium LT2
gggucaggaac

SEQ ID NO: 3772840 - RNA, 17 nt, Salmonella typhimurium LT2
gggucaguacgcgcgua

SEQ ID NO: 3772841 - RNA, 18 nt, Salmonella typhimurium LT2
gggucgacguugccaggc

SEQ ID NO: 3772842 - RNA, 17 nt, Salmonella typhimurium LT2
gggucgcuucggcgacc

SEQ ID NO: 3772843 - RNA, 23 nt, Salmonella typhimurium LT2
gggucgguuucaguucguagagc

SEQ ID NO: 3772844 - RNA, 14 nt, Salmonella typhimurium LT2
gggucugaauagcg

SEQ ID NO: 3772845 - RNA, 22 nt, Salmonella typhimurium LT2
gggucuuauuucuccugcgcca

SEQ ID NO: 3772846 - RNA, 15 nt, Salmonella typhimurium LT2
gggugaaagggugcg

SEQ ID NO: 3772847 - RNA, 22 nt, Salmonella typhimurium LT2
gggugagcaaaggcagccaaca

SEQ ID NO: 3772848 - RNA, 17 nt, Salmonella typhimurium LT2
gggugcagcgucaggaa

SEQ ID NO: 3772849 - RNA, 12 nt, Salmonella typhimurium LT2
gggugccaggca

SEQ ID NO: 3772850 - RNA, 14 nt, Salmonella typhimurium LT2
gggugcgcagcccc

SEQ ID NO: 3772851 - RNA, 15 nt, Salmonella typhimurium LT2
ggguggcggcugcgc

SEQ ID NO: 3772852 - RNA, 16 nt, Salmonella typhimurium LT2
ggguggucacgccauu

SEQ ID NO: 3772853 - RNA, 13 nt, Salmonella typhimurium LT2
ggguuaaaccagc

SEQ ID NO: 3772854 - RNA, 17 nt, Salmonella typhimurium LT2
ggguuagcgccggugca

SEQ ID NO: 3772855 - RNA, 17 nt, Salmonella typhimurium LT2
ggguucaaguccccccc

SEQ ID NO: 3772856 - RNA, 11 nt, Salmonella typhimurium LT2
ggguucaucca

SEQ ID NO: 3772857 - RNA, 15 nt, Salmonella typhimurium LT2
ggguucguaauaagg

SEQ ID NO: 3772858 - RNA, 23 nt, Salmonella typhimurium LT2
ggguuugcagaugugccucaagg

SEQ ID NO: 3772859 - RNA, 19 nt, Salmonella typhimurium LT2
ggguuugccagcaccagca

SEQ ID NO: 3772860 - RNA, 20 nt, Salmonella typhimurium LT2
ggguuuucucuuuccagcga

SEQ ID NO: 3772861 - RNA, 18 nt, Salmonella typhimurium LT2
gguaaaaauauggcgggc

SEQ ID NO: 3772862 - RNA, 22 nt, Salmonella typhimurium LT2
gguaaaauccaccacguuaccg

SEQ ID NO: 3772863 - RNA, 17 nt, Salmonella typhimurium LT2
gguaaaauugccgccaa

SEQ ID NO: 3772864 - RNA, 16 nt, Salmonella typhimurium LT2
gguaaacacgacgcug

SEQ ID NO: 3772865 - RNA, 14 nt, Salmonella typhimurium LT2
gguaaacagaucga

SEQ ID NO: 3772866 - RNA, 15 nt, Salmonella typhimurium LT2
gguaaaccaggccag

SEQ ID NO: 3772867 - RNA, 21 nt, Salmonella typhimurium LT2
gguaaacgcuccggcaggcaa

SEQ ID NO: 3772868 - RNA, 22 nt, Salmonella typhimurium LT2
gguaacaguccguggcacggua

SEQ ID NO: 3772869 - RNA, 23 nt, Salmonella typhimurium LT2
gguaacaucgaacuguuuaccca

SEQ ID NO: 3772870 - RNA, 19 nt, Salmonella typhimurium LT2
gguaaccuuaauuugugau

SEQ ID NO: 3772871 - RNA, 14 nt, Salmonella typhimurium LT2
gguaacgcgaaaaa

SEQ ID NO: 3772872 - RNA, 21 nt, Salmonella typhimurium LT2
gguaacguuacuugauggaaa

SEQ ID NO: 3772873 - RNA, 22 nt, Salmonella typhimurium LT2
gguaagacguuuacgccgccau

SEQ ID NO: 3772874 - RNA, 14 nt, Salmonella typhimurium LT2
gguaagcaauaugg

SEQ ID NO: 3772875 - RNA, 23 nt, Salmonella typhimurium LT2
gguaagcccauggcaggcagcac

SEQ ID NO: 3772876 - RNA, 21 nt, Salmonella typhimurium LT2
gguaagccuggcauaacauug

SEQ ID NO: 3772877 - RNA, 18 nt, Salmonella typhimurium LT2
gguaagcugcggcagaau

SEQ ID NO: 3772878 - RNA, 18 nt, Salmonella typhimurium LT2
gguaaguacggcaaaaau

SEQ ID NO: 3772879 - RNA, 19 nt, Salmonella typhimurium LT2
gguaaguacggcaaaaaua

SEQ ID NO: 3772880 - RNA, 13 nt, Salmonella typhimurium LT2
gguaaguugaaag

SEQ ID NO: 3772881 - RNA, 22 nt, Salmonella typhimurium LT2
gguaauacuaaucucacccaua

SEQ ID NO: 3772882 - RNA, 19 nt, Salmonella typhimurium LT2
gguaauauuaaaaccauug

SEQ ID NO: 3772883 - RNA, 22 nt, Salmonella typhimurium LT2
gguaaucauuucauuaaucagu

SEQ ID NO: 3772884 - RNA, 15 nt, Salmonella typhimurium LT2
gguaauggucagcau

SEQ ID NO: 3772885 - RNA, 17 nt, Salmonella typhimurium LT2
gguaauuaaaggcagcg

SEQ ID NO: 3772886 - RNA, 21 nt, Salmonella typhimurium LT2
gguaauuuucaccuccgggug

SEQ ID NO: 3772887 - RNA, 21 nt, Salmonella typhimurium LT2
gguacacucucggguacacaa

SEQ ID NO: 3772888 - RNA, 13 nt, Salmonella typhimurium LT2
gguaccagaucgu

SEQ ID NO: 3772889 - RNA, 14 nt, Salmonella typhimurium LT2
gguaccccagccau

SEQ ID NO: 3772890 - RNA, 21 nt, Salmonella typhimurium LT2
gguacccggucccuggcuggu

SEQ ID NO: 3772891 - RNA, 15 nt, Salmonella typhimurium LT2
gguacgacgcggcuc

SEQ ID NO: 3772892 - RNA, 22 nt, Salmonella typhimurium LT2
gguacgacuuauucaaucaauu

SEQ ID NO: 3772893 - RNA, 13 nt, Salmonella typhimurium LT2
gguacgcuccagg

SEQ ID NO: 3772894 - RNA, 15 nt, Salmonella typhimurium LT2
gguacucaacaucau

SEQ ID NO: 3772895 - RNA, 16 nt, Salmonella typhimurium LT2
gguacucuuccagcug

SEQ ID NO: 3772896 - RNA, 23 nt, Salmonella typhimurium LT2
gguacuugacgucgccauaucca

SEQ ID NO: 3772897 - RNA, 11 nt, Salmonella typhimurium LT2
gguagaaaaac

SEQ ID NO: 3772898 - RNA, 20 nt, Salmonella typhimurium LT2
gguagacccggcauugaaac

SEQ ID NO: 3772899 - RNA, 13 nt, Salmonella typhimurium LT2
gguagccacagau

SEQ ID NO: 3772900 - RNA, 15 nt, Salmonella typhimurium LT2
gguagccacagauua

SEQ ID NO: 3772901 - RNA, 20 nt, Salmonella typhimurium LT2
gguagcggcacguacugcac

SEQ ID NO: 3772902 - RNA, 22 nt, Salmonella typhimurium LT2
gguagcgguggcgcuccagccg

SEQ ID NO: 3772903 - RNA, 16 nt, Salmonella typhimurium LT2
gguaggacauagccgc

SEQ ID NO: 3772904 - RNA, 19 nt, Salmonella typhimurium LT2
gguaguggcgaucagcggc

SEQ ID NO: 3772905 - RNA, 22 nt, Salmonella typhimurium LT2
gguauaaaaacugccagggcca

SEQ ID NO: 3772906 - RNA, 16 nt, Salmonella typhimurium LT2
gguauaaucagcauca

SEQ ID NO: 3772907 - RNA, 14 nt, Salmonella typhimurium LT2
gguaucagcgcguu

SEQ ID NO: 3772908 - RNA, 23 nt, Salmonella typhimurium LT2
gguaucaucaauacgcgacagcg

SEQ ID NO: 3772909 - RNA, 19 nt, Salmonella typhimurium LT2
gguaucauugcugcuguau

SEQ ID NO: 3772910 - RNA, 14 nt, Salmonella typhimurium LT2
gguauccagcagaa

SEQ ID NO: 3772911 - RNA, 12 nt, Salmonella typhimurium LT2
gguauccagcgc

SEQ ID NO: 3772912 - RNA, 13 nt, Salmonella typhimurium LT2
gguaucccaaacg

SEQ ID NO: 3772913 - RNA, 16 nt, Salmonella typhimurium LT2
gguaucgguaucgcag

SEQ ID NO: 3772914 - RNA, 18 nt, Salmonella typhimurium LT2
gguaucguugcggcgcag

SEQ ID NO: 3772915 - RNA, 12 nt, Salmonella typhimurium LT2
gguaugaaacau

SEQ ID NO: 3772916 - RNA, 16 nt, Salmonella typhimurium LT2
gguaugaaacauauau

SEQ ID NO: 3772917 - RNA, 16 nt, Salmonella typhimurium LT2
gguaugaacgggaacc

SEQ ID NO: 3772918 - RNA, 22 nt, Salmonella typhimurium LT2
gguaugaauuuuuuccacccgc

SEQ ID NO: 3772919 - RNA, 13 nt, Salmonella typhimurium LT2
gguauucaucgug

SEQ ID NO: 3772920 - RNA, 19 nt, Salmonella typhimurium LT2
gguauucguuaccagcauc

SEQ ID NO: 3772921 - RNA, 18 nt, Salmonella typhimurium LT2
gguauuucugaaaaaccg

SEQ ID NO: 3772922 - RNA, 20 nt, Salmonella typhimurium LT2
ggucaaaaaagcgacgcugu

SEQ ID NO: 3772923 - RNA, 14 nt, Salmonella typhimurium LT2
ggucaaaagcugca

SEQ ID NO: 3772924 - RNA, 19 nt, Salmonella typhimurium LT2
ggucaacccuauugccaca

SEQ ID NO: 3772925 - RNA, 23 nt, Salmonella typhimurium LT2
ggucaauaagugauacauagucu

SEQ ID NO: 3772926 - RNA, 13 nt, Salmonella typhimurium LT2
ggucaaucaucag

SEQ ID NO: 3772927 - RNA, 15 nt, Salmonella typhimurium LT2
ggucagcagaaacug

SEQ ID NO: 3772928 - RNA, 17 nt, Salmonella typhimurium LT2
ggucagcauuucaucca

SEQ ID NO: 3772929 - RNA, 23 nt, Salmonella typhimurium LT2
ggucagcauuucauccauuaaac

SEQ ID NO: 3772930 - RNA, 14 nt, Salmonella typhimurium LT2
ggucagcggcgcgc

SEQ ID NO: 3772931 - RNA, 20 nt, Salmonella typhimurium LT2
ggucagcuuuucagcccagg

SEQ ID NO: 3772932 - RNA, 14 nt, Salmonella typhimurium LT2
ggucaggaaacugg

SEQ ID NO: 3772933 - RNA, 12 nt, Salmonella typhimurium LT2
ggucaggcagca

SEQ ID NO: 3772934 - RNA, 13 nt, Salmonella typhimurium LT2
ggucaggccagcc

SEQ ID NO: 3772935 - RNA, 21 nt, Salmonella typhimurium LT2
ggucagggugaaucccgccau

SEQ ID NO: 3772936 - RNA, 15 nt, Salmonella typhimurium LT2
ggucaguacgcgcgu

SEQ ID NO: 3772937 - RNA, 17 nt, Salmonella typhimurium LT2
ggucaucaccuccagca

SEQ ID NO: 3772938 - RNA, 18 nt, Salmonella typhimurium LT2
ggucaucaccuccagcac

SEQ ID NO: 3772939 - RNA, 19 nt, Salmonella typhimurium LT2
ggucaucaccuccagcacg

SEQ ID NO: 3772940 - RNA, 21 nt, Salmonella typhimurium LT2
ggucaucgaaggcaucuucag

SEQ ID NO: 3772941 - RNA, 15 nt, Salmonella typhimurium LT2
gguuuacugccagua

SEQ ID NO: 3772942 - RNA, 19 nt, Salmonella typhimurium LT2
gguuucccugccucaacau

SEQ ID NO: 3772943 - RNA, 18 nt, Salmonella typhimurium LT2
gguuucuacuuccaccac

SEQ ID NO: 3772944 - RNA, 23 nt, Salmonella typhimurium LT2
gguuugacccauuuuaaaaguua

SEQ ID NO: 3772945 - RNA, 15 nt, Salmonella typhimurium LT2
gguuugcauugccau

SEQ ID NO: 3772946 - RNA, 17 nt, Salmonella typhimurium LT2
gguuugccagcaccagc

SEQ ID NO: 3772947 - RNA, 20 nt, Salmonella typhimurium LT2
gguuugugucguaguggcau

SEQ ID NO: 3772948 - RNA, 14 nt, Salmonella typhimurium LT2
gguuuuaaaaauaa

SEQ ID NO: 3772949 - RNA, 16 nt, Salmonella typhimurium LT2
gguuuuauugcacguu

SEQ ID NO: 3772950 - RNA, 18 nt, Salmonella typhimurium LT2
gguuuuuggcuugccggu

SEQ ID NO: 3772951 - RNA, 15 nt, Salmonella typhimurium LT2
gguuuuuuuacucug

SEQ ID NO: 3772952 - RNA, 23 nt, Salmonella typhimurium LT2
guaaaaaaaaccguaucacugua

SEQ ID NO: 3772953 - RNA, 14 nt, Salmonella typhimurium LT2
guaaaaaugcuucc

SEQ ID NO: 3772954 - RNA, 23 nt, Salmonella typhimurium LT2
guaaaacaaaaaaacggccucaa

SEQ ID NO: 3772955 - RNA, 20 nt, Salmonella typhimurium LT2
guaaaacacgccuccauaca

SEQ ID NO: 3772956 - RNA, 17 nt, Salmonella typhimurium LT2
guaaaacgauauugccu

SEQ ID NO: 3772957 - RNA, 15 nt, Salmonella typhimurium LT2
guaaaaguauguauu

SEQ ID NO: 3772958 - RNA, 15 nt, Salmonella typhimurium LT2
guaaaaucagcagcg

SEQ ID NO: 3772959 - RNA, 12 nt, Salmonella typhimurium LT2
guaaaaucagcg

SEQ ID NO: 3772960 - RNA, 16 nt, Salmonella typhimurium LT2
guaaaauggacuuccg

SEQ ID NO: 3772961 - RNA, 14 nt, Salmonella typhimurium LT2
guaaaauugccgcc

SEQ ID NO: 3772962 - RNA, 15 nt, Salmonella typhimurium LT2
guaaacaggcaggcc

SEQ ID NO: 3772963 - RNA, 21 nt, Salmonella typhimurium LT2
guaaacaugcuggaugacaaa

SEQ ID NO: 3772964 - RNA, 16 nt, Salmonella typhimurium LT2
guaaaccauuucuccu

SEQ ID NO: 3772965 - RNA, 19 nt, Salmonella typhimurium LT2
guaaaccauuucuccugca

SEQ ID NO: 3772966 - RNA, 16 nt, Salmonella typhimurium LT2
guaaaccccuucacca

SEQ ID NO: 3772967 - RNA, 21 nt, Salmonella typhimurium LT2
guaaacccgauucugccaguu

SEQ ID NO: 3772968 - RNA, 17 nt, Salmonella typhimurium LT2
guaaaccggucucuuaa

SEQ ID NO: 3772969 - RNA, 20 nt, Salmonella typhimurium LT2
guaaaccguguuccagcgcc

SEQ ID NO: 3772970 - RNA, 21 nt, Salmonella typhimurium LT2
guaaaccucuuuggcgcgaac

SEQ ID NO: 3772971 - RNA, 22 nt, Salmonella typhimurium LT2
guaaacgcaacaccaucccgcu

SEQ ID NO: 3772972 - RNA, 15 nt, Salmonella typhimurium LT2
guaaacgcgaccagc

SEQ ID NO: 3772973 - RNA, 21 nt, Salmonella typhimurium LT2
guaaacgcgaccagcgcacca

SEQ ID NO: 3772974 - RNA, 14 nt, Salmonella typhimurium LT2
guaaacgcugcgca

SEQ ID NO: 3772975 - RNA, 18 nt, Salmonella typhimurium LT2
guaaacggcagccgccac

SEQ ID NO: 3772976 - RNA, 14 nt, Salmonella typhimurium LT2
guaaacggcgcuga

SEQ ID NO: 3772977 - RNA, 21 nt, Salmonella typhimurium LT2
guaaacuggauaagcgcagcg

SEQ ID NO: 3772978 - RNA, 19 nt, Salmonella typhimurium LT2
guaaagaagccgccgccau

SEQ ID NO: 3772979 - RNA, 17 nt, Salmonella typhimurium LT2
guaaagauuagaauagc

SEQ ID NO: 3772980 - RNA, 14 nt, Salmonella typhimurium LT2
guaaagcagugcag

SEQ ID NO: 3772981 - RNA, 22 nt, Salmonella typhimurium LT2
guaaagcguguaaccaccuggg

SEQ ID NO: 3772982 - RNA, 19 nt, Salmonella typhimurium LT2
guaaaggcguagaucucua

SEQ ID NO: 3772983 - RNA, 16 nt, Salmonella typhimurium LT2
guaaaggggagcccag

SEQ ID NO: 3772984 - RNA, 16 nt, Salmonella typhimurium LT2
guaaaggucgccgcau

SEQ ID NO: 3772985 - RNA, 16 nt, Salmonella typhimurium LT2
guaaaguuauucacgu

SEQ ID NO: 3772986 - RNA, 20 nt, Salmonella typhimurium LT2
guaaauaaaugccgcaauaa

SEQ ID NO: 3772987 - RNA, 15 nt, Salmonella typhimurium LT2
guaaauaaucgacga

SEQ ID NO: 3772988 - RNA, 17 nt, Salmonella typhimurium LT2
guaaauaaucgacgaua

SEQ ID NO: 3772989 - RNA, 13 nt, Salmonella typhimurium LT2
guaaauacccagg

SEQ ID NO: 3772990 - RNA, 14 nt, Salmonella typhimurium LT2
guaaauacugaacu

SEQ ID NO: 3772991 - RNA, 17 nt, Salmonella typhimurium LT2
guaaauagagaaaucaa

SEQ ID NO: 3772992 - RNA, 18 nt, Salmonella typhimurium LT2
guaaauagagaaaucaac

SEQ ID NO: 3772993 - RNA, 13 nt, Salmonella typhimurium LT2
guaaauauaacgc

SEQ ID NO: 3772994 - RNA, 15 nt, Salmonella typhimurium LT2
guaaauauugauuaa

SEQ ID NO: 3772995 - RNA, 18 nt, Salmonella typhimurium LT2
guaaauauugauuaaucg

SEQ ID NO: 3772996 - RNA, 15 nt, Salmonella typhimurium LT2
guaaaucaauuuuaa

SEQ ID NO: 3772997 - RNA, 17 nt, Salmonella typhimurium LT2
guaaaucagaauaccgc

SEQ ID NO: 3772998 - RNA, 19 nt, Salmonella typhimurium LT2
guaaaucauuuguacaaaa

SEQ ID NO: 3772999 - RNA, 22 nt, Salmonella typhimurium LT2
guaaaucauuuguacaaaaaau

SEQ ID NO: 3773000 - RNA, 19 nt, Salmonella typhimurium LT2
guaaaucgcgcccgacaug

SEQ ID NO: 3773001 - RNA, 19 nt, Salmonella typhimurium LT2
guaaaucugaaauaaaagc

SEQ ID NO: 3773002 - RNA, 20 nt, Salmonella typhimurium LT2
guaaaugcgcgcggcugccg

SEQ ID NO: 3773003 - RNA, 14 nt, Salmonella typhimurium LT2
guaaauuauuuaca

SEQ ID NO: 3773004 - RNA, 17 nt, Salmonella typhimurium LT2
guaaauuccuuguuuua

SEQ ID NO: 3773005 - RNA, 20 nt, Salmonella typhimurium LT2
guaaauuuguuuaaucauaa

SEQ ID NO: 3773006 - RNA, 21 nt, Salmonella typhimurium LT2
guaaauuuguuuaaucauaaa

SEQ ID NO: 3773007 - RNA, 22 nt, Salmonella typhimurium LT2
guaaauuuguuuaaucauaaaa

SEQ ID NO: 3773008 - RNA, 18 nt, Salmonella typhimurium LT2
guaacaacuguuuuucac

SEQ ID NO: 3773009 - RNA, 21 nt, Salmonella typhimurium LT2
guaacacaaaaucccuggcaa

SEQ ID NO: 3773010 - RNA, 17 nt, Salmonella typhimurium LT2
guaacaccgcggcgcuc

SEQ ID NO: 3773011 - RNA, 22 nt, Salmonella typhimurium LT2
guaacaccuguaacgucacauu

SEQ ID NO: 3773012 - RNA, 16 nt, Salmonella typhimurium LT2
guaacaggcaccagcg

SEQ ID NO: 3773013 - RNA, 19 nt, Salmonella typhimurium LT2
guaacauaaaagcgauuua

SEQ ID NO: 3773014 - RNA, 14 nt, Salmonella typhimurium LT2
guaacauauuuuua

SEQ ID NO: 3773015 - RNA, 20 nt, Salmonella typhimurium LT2
guaacauccuggguuugcug

SEQ ID NO: 3773016 - RNA, 23 nt, Salmonella typhimurium LT2
guaaccaccacugauuccagagc

SEQ ID NO: 3773017 - RNA, 21 nt, Salmonella typhimurium LT2
guaaccggccagccugcgcca

SEQ ID NO: 3773018 - RNA, 19 nt, Salmonella typhimurium LT2
guaacgacgaauauccaga

SEQ ID NO: 3773019 - RNA, 22 nt, Salmonella typhimurium LT2
guaacgaguugcggcaacguga

SEQ ID NO: 3773020 - RNA, 20 nt, Salmonella typhimurium LT2
guaacgcaacucaucgucau

SEQ ID NO: 3773021 - RNA, 19 nt, Salmonella typhimurium LT2
guaacgccgucggcagcca

SEQ ID NO: 3773022 - RNA, 17 nt, Salmonella typhimurium LT2
guaacgggugaucuuua

SEQ ID NO: 3773023 - RNA, 21 nt, Salmonella typhimurium LT2
guaacgggugaucuuuauaaa

SEQ ID NO: 3773024 - RNA, 17 nt, Salmonella typhimurium LT2
guaacguaaauacccag

SEQ ID NO: 3773025 - RNA, 14 nt, Salmonella typhimurium LT2
guaacguagcaauc

SEQ ID NO: 3773026 - RNA, 14 nt, Salmonella typhimurium LT2
guaacuaucuguuc

SEQ ID NO: 3773027 - RNA, 16 nt, Salmonella typhimurium LT2
guaacuaucuguucuu

SEQ ID NO: 3773028 - RNA, 18 nt, Salmonella typhimurium LT2
guaacucuauaucgacag

SEQ ID NO: 3773029 - RNA, 23 nt, Salmonella typhimurium LT2
guaacugcaccuuuuuuuccagc

SEQ ID NO: 3773030 - RNA, 17 nt, Salmonella typhimurium LT2
guaagaaugcgcgucag

SEQ ID NO: 3773031 - RNA, 22 nt, Salmonella typhimurium LT2
guaagaauuauuaccaaugagc

SEQ ID NO: 3773032 - RNA, 15 nt, Salmonella typhimurium LT2
guaagagagccuuau

SEQ ID NO: 3773033 - RNA, 18 nt, Salmonella typhimurium LT2
guaagauuugcgccgccg

SEQ ID NO: 3773034 - RNA, 21 nt, Salmonella typhimurium LT2
guaagccgcgcugguuggugu

SEQ ID NO: 3773035 - RNA, 15 nt, Salmonella typhimurium LT2
guaagccuggcauaa

SEQ ID NO: 3773036 - RNA, 18 nt, Salmonella typhimurium LT2
guaagcggcggaccagcg

SEQ ID NO: 3773037 - RNA, 13 nt, Salmonella typhimurium LT2
guaagcucccggg

SEQ ID NO: 3773038 - RNA, 20 nt, Salmonella typhimurium LT2
guaaggcauuaauauccagu

SEQ ID NO: 3773039 - RNA, 18 nt, Salmonella typhimurium LT2
guaaggugaaauacccgc

SEQ ID NO: 3773040 - RNA, 21 nt, Salmonella typhimurium LT2
guaaguaugccgcauaaaauu

SEQ ID NO: 3773041 - RNA, 19 nt, Salmonella typhimurium LT2
guaagucgccgcagcucca

SEQ ID NO: 3773042 - RNA, 19 nt, Salmonella typhimurium LT2
guaaguuuaugguaaucac

SEQ ID NO: 3773043 - RNA, 17 nt, Salmonella typhimurium LT2
guaaguuuccugcgcag

SEQ ID NO: 3773044 - RNA, 15 nt, Salmonella typhimurium LT2
guacucauccauuuc

SEQ ID NO: 3773045 - RNA, 15 nt, Salmonella typhimurium LT2
guacuccagcccauc

SEQ ID NO: 3773046 - RNA, 14 nt, Salmonella typhimurium LT2
guacuccugcaucg

SEQ ID NO: 3773047 - RNA, 18 nt, Salmonella typhimurium LT2
guacucugauccuacccg

SEQ ID NO: 3773048 - RNA, 16 nt, Salmonella typhimurium LT2
guacucuuccagcugc

SEQ ID NO: 3773049 - RNA, 23 nt, Salmonella typhimurium LT2
guacucuuccagcugcucuucuu

SEQ ID NO: 3773050 - RNA, 18 nt, Salmonella typhimurium LT2
guacucuuuuuccgcgag

SEQ ID NO: 3773051 - RNA, 14 nt, Salmonella typhimurium LT2
guacuuacccagag

SEQ ID NO: 3773052 - RNA, 16 nt, Salmonella typhimurium LT2
guacuucuccugccag

SEQ ID NO: 3773053 - RNA, 21 nt, Salmonella typhimurium LT2
guacuuguugcuggcaggcca

SEQ ID NO: 3773054 - RNA, 21 nt, Salmonella typhimurium LT2
guacuuucuacaaauguuguc

SEQ ID NO: 3773055 - RNA, 12 nt, Salmonella typhimurium LT2
guacuuucucca

SEQ ID NO: 3773056 - RNA, 13 nt, Salmonella typhimurium LT2
guacuuuucaucc

SEQ ID NO: 3773057 - RNA, 22 nt, Salmonella typhimurium LT2
guacuuuucauccacagcgcca

SEQ ID NO: 3773058 - RNA, 18 nt, Salmonella typhimurium LT2
guagaacuuccaacuaaa

SEQ ID NO: 3773059 - RNA, 19 nt, Salmonella typhimurium LT2
guagaaugaauuucuucau

SEQ ID NO: 3773060 - RNA, 16 nt, Salmonella typhimurium LT2
guagacaaacagcgcg

SEQ ID NO: 3773061 - RNA, 22 nt, Salmonella typhimurium LT2
guagacccggcauugaaacgca

SEQ ID NO: 3773062 - RNA, 14 nt, Salmonella typhimurium LT2
guagaccgcaucga

SEQ ID NO: 3773063 - RNA, 18 nt, Salmonella typhimurium LT2
guagacgcgcuagcuuca

SEQ ID NO: 3773064 - RNA, 13 nt, Salmonella typhimurium LT2
guagacucaggcg

SEQ ID NO: 3773065 - RNA, 16 nt, Salmonella typhimurium LT2
guagacucaggcgcau

SEQ ID NO: 3773066 - RNA, 14 nt, Salmonella typhimurium LT2
guagagcuccacgc

SEQ ID NO: 3773067 - RNA, 19 nt, Salmonella typhimurium LT2
guagaguaacccuucagcu

SEQ ID NO: 3773068 - RNA, 17 nt, Salmonella typhimurium LT2
guagaucuuuugcgccu

SEQ ID NO: 3773069 - RNA, 12 nt, Salmonella typhimurium LT2
guagaugaacuc

SEQ ID NO: 3773070 - RNA, 16 nt, Salmonella typhimurium LT2
guagcagaagacgcug

SEQ ID NO: 3773071 - RNA, 13 nt, Salmonella typhimurium LT2
guagcagcgauga

SEQ ID NO: 3773072 - RNA, 15 nt, Salmonella typhimurium LT2
guagcagcgaugaca

SEQ ID NO: 3773073 - RNA, 14 nt, Salmonella typhimurium LT2
guagcaggagaucu

SEQ ID NO: 3773074 - RNA, 23 nt, Salmonella typhimurium LT2
guagcaggagaucuuuccauuuc

SEQ ID NO: 3773075 - RNA, 12 nt, Salmonella typhimurium LT2
guagcaucauca

SEQ ID NO: 3773076 - RNA, 15 nt, Salmonella typhimurium LT2
guagccaacacauca

SEQ ID NO: 3773077 - RNA, 18 nt, Salmonella typhimurium LT2
guagccgcaaaugccauc

SEQ ID NO: 3773078 - RNA, 19 nt, Salmonella typhimurium LT2
guagccgcaaaugccaucc

SEQ ID NO: 3773079 - RNA, 14 nt, Salmonella typhimurium LT2
guagccgcgccaga

SEQ ID NO: 3773080 - RNA, 15 nt, Salmonella typhimurium LT2
guagcgacgccaucc

SEQ ID NO: 3773081 - RNA, 14 nt, Salmonella typhimurium LT2
guagcgagccaucg

SEQ ID NO: 3773082 - RNA, 16 nt, Salmonella typhimurium LT2
guagcgagccaucggc

SEQ ID NO: 3773083 - RNA, 19 nt, Salmonella typhimurium LT2
guagcgcauuauucggcuu

SEQ ID NO: 3773084 - RNA, 21 nt, Salmonella typhimurium LT2
guagcgcauugcgucccagca

SEQ ID NO: 3773085 - RNA, 12 nt, Salmonella typhimurium LT2
guagcgccauca

SEQ ID NO: 3773086 - RNA, 15 nt, Salmonella typhimurium LT2
guagcgccaucaggc

SEQ ID NO: 3773087 - RNA, 21 nt, Salmonella typhimurium LT2
guagcgccugugcuuucgcca

SEQ ID NO: 3773088 - RNA, 12 nt, Salmonella typhimurium LT2
guagcgcgcuuc

SEQ ID NO: 3773089 - RNA, 20 nt, Salmonella typhimurium LT2
guagcgcugaagcccgcgau

SEQ ID NO: 3773090 - RNA, 21 nt, Salmonella typhimurium LT2
guagcggcaacagcaccagaa

SEQ ID NO: 3773091 - RNA, 14 nt, Salmonella typhimurium LT2
guagcggcgccggg

SEQ ID NO: 3773092 - RNA, 16 nt, Salmonella typhimurium LT2
guagcguacaggcgga

SEQ ID NO: 3773093 - RNA, 20 nt, Salmonella typhimurium LT2
guagcgucaauacgccucgg

SEQ ID NO: 3773094 - RNA, 14 nt, Salmonella typhimurium LT2
guagcgucaccggc

SEQ ID NO: 3773095 - RNA, 21 nt, Salmonella typhimurium LT2
guagcgucucaucaaaaaggc

SEQ ID NO: 3773096 - RNA, 17 nt, Salmonella typhimurium LT2
guagcgucuuauccggc

SEQ ID NO: 3773097 - RNA, 16 nt, Salmonella typhimurium LT2
guagcguucaucaaua

SEQ ID NO: 3773098 - RNA, 23 nt, Salmonella typhimurium LT2
guagcguuucgcgcgcgccugcc

SEQ ID NO: 3773099 - RNA, 16 nt, Salmonella typhimurium LT2
guagcucauaacucgc

SEQ ID NO: 3773100 - RNA, 18 nt, Salmonella typhimurium LT2
guagcucgcccagcacua

SEQ ID NO: 3773101 - RNA, 16 nt, Salmonella typhimurium LT2
guagcugcgccugaaa

SEQ ID NO: 3773102 - RNA, 24 nt, Salmonella typhimurium LT2
guagcugcgcgccgcaaaacgcgu

SEQ ID NO: 3773103 - RNA, 23 nt, Salmonella typhimurium LT2
guagcuggagauacuuucuucua

SEQ ID NO: 3773104 - RNA, 19 nt, Salmonella typhimurium LT2
guaggcccgguaagcgcag

SEQ ID NO: 3773105 - RNA, 21 nt, Salmonella typhimurium LT2
guaggcccgguaagcgcagcg

SEQ ID NO: 3773106 - RNA, 12 nt, Salmonella typhimurium LT2
guaggccggaua

SEQ ID NO: 3773107 - RNA, 13 nt, Salmonella typhimurium LT2
guaggccggauaa

SEQ ID NO: 3773108 - RNA, 20 nt, Salmonella typhimurium LT2
guaggccggauaagcguuag

SEQ ID NO: 3773109 - RNA, 20 nt, Salmonella typhimurium LT2
guaggccggauuaaggcguu

SEQ ID NO: 3773110 - RNA, 19 nt, Salmonella typhimurium LT2
guaggccugauaagcgcag

SEQ ID NO: 3773111 - RNA, 19 nt, Salmonella typhimurium LT2
guaggccugauaagcguag

SEQ ID NO: 3773112 - RNA, 13 nt, Salmonella typhimurium LT2
guaggcuucaacc

SEQ ID NO: 3773113 - RNA, 18 nt, Salmonella typhimurium LT2
guagggcugccaucaggc

SEQ ID NO: 3773114 - RNA, 19 nt, Salmonella typhimurium LT2
guagguuccgacaauaaaa

SEQ ID NO: 3773115 - RNA, 15 nt, Salmonella typhimurium LT2
guaguaauauuaaaa

SEQ ID NO: 3773116 - RNA, 14 nt, Salmonella typhimurium LT2
guaguacaggguuu

SEQ ID NO: 3773117 - RNA, 18 nt, Salmonella typhimurium LT2
guagugaggcugguugug

SEQ ID NO: 3773118 - RNA, 19 nt, Salmonella typhimurium LT2
guagugcuucucuucaaac

SEQ ID NO: 3773119 - RNA, 22 nt, Salmonella typhimurium LT2
guaguggcagaguccagcggca

SEQ ID NO: 3773120 - RNA, 17 nt, Salmonella typhimurium LT2
guaguggcgaucagcgg

SEQ ID NO: 3773121 - RNA, 15 nt, Salmonella typhimurium LT2
guaguguaauaccac

SEQ ID NO: 3773122 - RNA, 13 nt, Salmonella typhimurium LT2
guaguuagcgccc

SEQ ID NO: 3773123 - RNA, 16 nt, Salmonella typhimurium LT2
guaguuggugggugau

SEQ ID NO: 3773124 - RNA, 16 nt, Salmonella typhimurium LT2
guauaaaauggcaaag

SEQ ID NO: 3773125 - RNA, 17 nt, Salmonella typhimurium LT2
guauaaacucagcaaua

SEQ ID NO: 3773126 - RNA, 18 nt, Salmonella typhimurium LT2
guauaaauaaaauuguua

SEQ ID NO: 3773127 - RNA, 12 nt, Salmonella typhimurium LT2
guauaaaucacg

SEQ ID NO: 3773128 - RNA, 18 nt, Salmonella typhimurium LT2
guauaaauuuccgcagcc

SEQ ID NO: 3773129 - RNA, 14 nt, Salmonella typhimurium LT2
guauaacuggucau

SEQ ID NO: 3773130 - RNA, 13 nt, Salmonella typhimurium LT2
guauaauaauauc

SEQ ID NO: 3773131 - RNA, 14 nt, Salmonella typhimurium LT2
guauaaucagcauc

SEQ ID NO: 3773132 - RNA, 14 nt, Salmonella typhimurium LT2
guauaccgcuuuuc

SEQ ID NO: 3773133 - RNA, 16 nt, Salmonella typhimurium LT2
guauacucagacgacc

SEQ ID NO: 3773134 - RNA, 14 nt, Salmonella typhimurium LT2
guauagaaauagcc

SEQ ID NO: 3773135 - RNA, 15 nt, Salmonella typhimurium LT2
guauagaaauagccu

SEQ ID NO: 3773136 - RNA, 13 nt, Salmonella typhimurium LT2
guauagccaggca

SEQ ID NO: 3773137 - RNA, 14 nt, Salmonella typhimurium LT2
guauaggccaggcu

SEQ ID NO: 3773138 - RNA, 20 nt, Salmonella typhimurium LT2
guauaucuuucuuaucccac

SEQ ID NO: 3773139 - RNA, 18 nt, Salmonella typhimurium LT2
guaucaaacccuuccaga

SEQ ID NO: 3773140 - RNA, 20 nt, Salmonella typhimurium LT2
guaucaaugcgacagcggca

SEQ ID NO: 3773141 - RNA, 16 nt, Salmonella typhimurium LT2
guaucacaaucagcca

SEQ ID NO: 3773142 - RNA, 18 nt, Salmonella typhimurium LT2
guaucacugauauaaccc

SEQ ID NO: 3773143 - RNA, 16 nt, Salmonella typhimurium LT2
guaucacuguaaaagg

SEQ ID NO: 3773144 - RNA, 21 nt, Salmonella typhimurium LT2
guaucaucgcuuaacggccca

SEQ ID NO: 3773145 - RNA, 17 nt, Salmonella typhimurium LT2
guaucauuuugauucag

SEQ ID NO: 3773146 - RNA, 21 nt, Salmonella typhimurium LT2
guauccauucucaucagaccg

SEQ ID NO: 3773147 - RNA, 17 nt, Salmonella typhimurium LT2
guaucccaccuaaccca

SEQ ID NO: 3773148 - RNA, 12 nt, Salmonella typhimurium LT2
guaucccgccag

SEQ ID NO: 3773149 - RNA, 22 nt, Salmonella typhimurium LT2
gucaggacguuauuaagcgaau

SEQ ID NO: 3773150 - RNA, 17 nt, Salmonella typhimurium LT2
gucaggaggccugaaua

SEQ ID NO: 3773151 - RNA, 22 nt, Salmonella typhimurium LT2
gucaggaugggcuucuucacua

SEQ ID NO: 3773152 - RNA, 15 nt, Salmonella typhimurium LT2
gucaggcaaaaauaa

SEQ ID NO: 3773153 - RNA, 15 nt, Salmonella typhimurium LT2
gucaggcagaaauaa

SEQ ID NO: 3773154 - RNA, 20 nt, Salmonella typhimurium LT2
gucaggccggugugcuugcg

SEQ ID NO: 3773155 - RNA, 15 nt, Salmonella typhimurium LT2
gucaggcucuaauaa

SEQ ID NO: 3773156 - RNA, 21 nt, Salmonella typhimurium LT2
gucagggugaauaccagcggc

SEQ ID NO: 3773157 - RNA, 18 nt, Salmonella typhimurium LT2
gucaggguuuucaggaag

SEQ ID NO: 3773158 - RNA, 20 nt, Salmonella typhimurium LT2
gucagguuacgcacuacauc

SEQ ID NO: 3773159 - RNA, 19 nt, Salmonella typhimurium LT2
gucaguaagauuugcgccg

SEQ ID NO: 3773160 - RNA, 23 nt, Salmonella typhimurium LT2
gucaguaagauuugcgccgccgu

SEQ ID NO: 3773161 - RNA, 18 nt, Salmonella typhimurium LT2
gucaguaccucgcauacu

SEQ ID NO: 3773162 - RNA, 13 nt, Salmonella typhimurium LT2
gucaguacgcgcg

SEQ ID NO: 3773163 - RNA, 17 nt, Salmonella typhimurium LT2
gucaguagcguucucuc

SEQ ID NO: 3773164 - RNA, 13 nt, Salmonella typhimurium LT2
gucagucacauac

SEQ ID NO: 3773165 - RNA, 14 nt, Salmonella typhimurium LT2
gucagucacauacu

SEQ ID NO: 3773166 - RNA, 17 nt, Salmonella typhimurium LT2
gucagucccgcacuuuc

SEQ ID NO: 3773167 - RNA, 22 nt, Salmonella typhimurium LT2
gucagucccgggcuaaucgcaa

SEQ ID NO: 3773168 - RNA, 15 nt, Salmonella typhimurium LT2
gucagugaacguuca

SEQ ID NO: 3773169 - RNA, 20 nt, Salmonella typhimurium LT2
gucaguguuuccauacauuu

SEQ ID NO: 3773170 - RNA, 12 nt, Salmonella typhimurium LT2
gucaguuccaua

SEQ ID NO: 3773171 - RNA, 14 nt, Salmonella typhimurium LT2
gucaguuccauaau

SEQ ID NO: 3773172 - RNA, 14 nt, Salmonella typhimurium LT2
gucaguucgccacg

SEQ ID NO: 3773173 - RNA, 15 nt, Salmonella typhimurium LT2
gucauaaguguuuua

SEQ ID NO: 3773174 - RNA, 16 nt, Salmonella typhimurium LT2
gucauaaguguuuuaa

SEQ ID NO: 3773175 - RNA, 20 nt, Salmonella typhimurium LT2
gucauaaguguuuuaaguuu

SEQ ID NO: 3773176 - RNA, 20 nt, Salmonella typhimurium LT2
gucauaauacucaauauccu

SEQ ID NO: 3773177 - RNA, 13 nt, Salmonella typhimurium LT2
gucauaccaugau

SEQ ID NO: 3773178 - RNA, 19 nt, Salmonella typhimurium LT2
gucauagucggcgccaaag

SEQ ID NO: 3773179 - RNA, 21 nt, Salmonella typhimurium LT2
gucauauagccgcgcaguuuc

SEQ ID NO: 3773180 - RNA, 15 nt, Salmonella typhimurium LT2
gucauauugccgaua

SEQ ID NO: 3773181 - RNA, 14 nt, Salmonella typhimurium LT2
gucauauugccgcc

SEQ ID NO: 3773182 - RNA, 21 nt, Salmonella typhimurium LT2
gucauauugccgccuuuguug

SEQ ID NO: 3773183 - RNA, 17 nt, Salmonella typhimurium LT2
gucaucaacgcgaucuu

SEQ ID NO: 3773184 - RNA, 22 nt, Salmonella typhimurium LT2
gucaucaagauuuugugaccgc

SEQ ID NO: 3773185 - RNA, 15 nt, Salmonella typhimurium LT2
gucaucauuacaggc

SEQ ID NO: 3773186 - RNA, 23 nt, Salmonella typhimurium LT2
gucauccccccgccgcuggcgag

SEQ ID NO: 3773187 - RNA, 17 nt, Salmonella typhimurium LT2
gucaucccgaaccuggu

SEQ ID NO: 3773188 - RNA, 15 nt, Salmonella typhimurium LT2
gucauccggcaauca

SEQ ID NO: 3773189 - RNA, 17 nt, Salmonella typhimurium LT2
gucauccuguucaucca

SEQ ID NO: 3773190 - RNA, 16 nt, Salmonella typhimurium LT2
gucaucgccuucaucc

SEQ ID NO: 3773191 - RNA, 23 nt, Salmonella typhimurium LT2
gucaucgcggaaagcaaugucgc

SEQ ID NO: 3773192 - RNA, 23 nt, Salmonella typhimurium LT2
gucaucgucugcgucuucuucca

SEQ ID NO: 3773193 - RNA, 14 nt, Salmonella typhimurium LT2
gucaucugccaguu

SEQ ID NO: 3773194 - RNA, 14 nt, Salmonella typhimurium LT2
gucaugaagcucaa

SEQ ID NO: 3773195 - RNA, 21 nt, Salmonella typhimurium LT2
gucaugccuuuuuuaccaauu

SEQ ID NO: 3773196 - RNA, 12 nt, Salmonella typhimurium LT2
gucaugcggaug

SEQ ID NO: 3773197 - RNA, 15 nt, Salmonella typhimurium LT2
gucaugcuaaaacag

SEQ ID NO: 3773198 - RNA, 17 nt, Salmonella typhimurium LT2
gucaugcuaaaacagau

SEQ ID NO: 3773199 - RNA, 18 nt, Salmonella typhimurium LT2
gucaugcuggcgaugagu

SEQ ID NO: 3773200 - RNA, 14 nt, Salmonella typhimurium LT2
gucauuaaaaccgc

SEQ ID NO: 3773201 - RNA, 12 nt, Salmonella typhimurium LT2
gucauuaaaaug

SEQ ID NO: 3773202 - RNA, 17 nt, Salmonella typhimurium LT2
gucauuaagaaacugag

SEQ ID NO: 3773203 - RNA, 20 nt, Salmonella typhimurium LT2
gucauuccuuccacgcguac

SEQ ID NO: 3773204 - RNA, 14 nt, Salmonella typhimurium LT2
gucauugacagcaa

SEQ ID NO: 3773205 - RNA, 19 nt, Salmonella typhimurium LT2
gucauugcuaugccugaaa

SEQ ID NO: 3773206 - RNA, 19 nt, Salmonella typhimurium LT2
gucauugggagcaaagcuc

SEQ ID NO: 3773207 - RNA, 15 nt, Salmonella typhimurium LT2
gucauuguaaaaccg

SEQ ID NO: 3773208 - RNA, 12 nt, Salmonella typhimurium LT2
gucauuuugccg

SEQ ID NO: 3773209 - RNA, 13 nt, Salmonella typhimurium LT2
gucauuuuuucaa

SEQ ID NO: 3773210 - RNA, 14 nt, Salmonella typhimurium LT2
guccaaagauaaac

SEQ ID NO: 3773211 - RNA, 21 nt, Salmonella typhimurium LT2
guccaacaaggauauccgcca

SEQ ID NO: 3773212 - RNA, 23 nt, Salmonella typhimurium LT2
guccaacaaggauauccgccagu

SEQ ID NO: 3773213 - RNA, 18 nt, Salmonella typhimurium LT2
guccaacuggcugcgccg

SEQ ID NO: 3773214 - RNA, 15 nt, Salmonella typhimurium LT2
guccacaaacgccgg

SEQ ID NO: 3773215 - RNA, 13 nt, Salmonella typhimurium LT2
guccaccagcaca

SEQ ID NO: 3773216 - RNA, 15 nt, Salmonella typhimurium LT2
guccacgacaauauc

SEQ ID NO: 3773217 - RNA, 15 nt, Salmonella typhimurium LT2
guccacgacagaacc

SEQ ID NO: 3773218 - RNA, 17 nt, Salmonella typhimurium LT2
guccacgacagaacccg

SEQ ID NO: 3773219 - RNA, 22 nt, Salmonella typhimurium LT2
guccacuuaaauuuugauggac

SEQ ID NO: 3773220 - RNA, 13 nt, Salmonella typhimurium LT2
guccacuuucugu

SEQ ID NO: 3773221 - RNA, 22 nt, Salmonella typhimurium LT2
guccagaggaucuggacgccaa

SEQ ID NO: 3773222 - RNA, 19 nt, Salmonella typhimurium LT2
guccagauaccggauugcu

SEQ ID NO: 3773223 - RNA, 15 nt, Salmonella typhimurium LT2
guccagaugcgccag

SEQ ID NO: 3773224 - RNA, 15 nt, Salmonella typhimurium LT2
guccagaugcugggc

SEQ ID NO: 3773225 - RNA, 14 nt, Salmonella typhimurium LT2
guccagcagccaug

SEQ ID NO: 3773226 - RNA, 18 nt, Salmonella typhimurium LT2
guccagccuguccagaua

SEQ ID NO: 3773227 - RNA, 17 nt, Salmonella typhimurium LT2
guccagguuaaacguca

SEQ ID NO: 3773228 - RNA, 13 nt, Salmonella typhimurium LT2
guccauaaaauga

SEQ ID NO: 3773229 - RNA, 20 nt, Salmonella typhimurium LT2
guccauaccggacuccaggc

SEQ ID NO: 3773230 - RNA, 14 nt, Salmonella typhimurium LT2
guccauauucaguu

SEQ ID NO: 3773231 - RNA, 22 nt, Salmonella typhimurium LT2
guccaugcaugacgcaggcgca

SEQ ID NO: 3773232 - RNA, 16 nt, Salmonella typhimurium LT2
guccauugcgagaaaa

SEQ ID NO: 3773233 - RNA, 17 nt, Salmonella typhimurium LT2
guccauuucuugcauca

SEQ ID NO: 3773234 - RNA, 14 nt, Salmonella typhimurium LT2
guccauuuuccucc

SEQ ID NO: 3773235 - RNA, 18 nt, Salmonella typhimurium LT2
gucccaccagcgcggcac

SEQ ID NO: 3773236 - RNA, 19 nt, Salmonella typhimurium LT2
gucccaccagcgcggcaca

SEQ ID NO: 3773237 - RNA, 14 nt, Salmonella typhimurium LT2
gucccagcacaauc

SEQ ID NO: 3773238 - RNA, 20 nt, Salmonella typhimurium LT2
gucccagcacaaucccggca

SEQ ID NO: 3773239 - RNA, 12 nt, Salmonella typhimurium LT2
gucccaggccag

SEQ ID NO: 3773240 - RNA, 16 nt, Salmonella typhimurium LT2
gucccaggccagaugc

SEQ ID NO: 3773241 - RNA, 14 nt, Salmonella typhimurium LT2
gucccaucgcgcca

SEQ ID NO: 3773242 - RNA, 18 nt, Salmonella typhimurium LT2
gucccaucguaacgccgu

SEQ ID NO: 3773243 - RNA, 18 nt, Salmonella typhimurium LT2
guccccauaccccgcgcc

SEQ ID NO: 3773244 - RNA, 20 nt, Salmonella typhimurium LT2
gucccccagggaugcgccac

SEQ ID NO: 3773245 - RNA, 15 nt, Salmonella typhimurium LT2
guccccugcaggaau

SEQ ID NO: 3773246 - RNA, 15 nt, Salmonella typhimurium LT2
guccccuuuucaccc

SEQ ID NO: 3773247 - RNA, 20 nt, Salmonella typhimurium LT2
gucccgacgaacgaagagcc

SEQ ID NO: 3773248 - RNA, 21 nt, Salmonella typhimurium LT2
gucccgcagcauuuccgccgc

SEQ ID NO: 3773249 - RNA, 13 nt, Salmonella typhimurium LT2
gucccggcagugc

SEQ ID NO: 3773250 - RNA, 18 nt, Salmonella typhimurium LT2
gucccggcagugcauaaa

SEQ ID NO: 3773251 - RNA, 20 nt, Salmonella typhimurium LT2
gucccggcgucauacugcca

SEQ ID NO: 3773252 - RNA, 14 nt, Salmonella typhimurium LT2
gucccgucccacca

SEQ ID NO: 3773253 - RNA, 19 nt, Salmonella typhimurium LT2
gucgcguuuaccgccgccg

SEQ ID NO: 3773254 - RNA, 21 nt, Salmonella typhimurium LT2
gucgcuaaagccuaccaccuc

SEQ ID NO: 3773255 - RNA, 22 nt, Salmonella typhimurium LT2
gucgcuaaagcgacuuauccgg

SEQ ID NO: 3773256 - RNA, 17 nt, Salmonella typhimurium LT2
gucgcuaaucagcaacu

SEQ ID NO: 3773257 - RNA, 22 nt, Salmonella typhimurium LT2
gucgcuaccacagaaaucgccg

SEQ ID NO: 3773258 - RNA, 16 nt, Salmonella typhimurium LT2
gucgcuauggugcggg

SEQ ID NO: 3773259 - RNA, 21 nt, Salmonella typhimurium LT2
gucgcucagguuguccagcag

SEQ ID NO: 3773260 - RNA, 17 nt, Salmonella typhimurium LT2
gucgcuccggaacgcga

SEQ ID NO: 3773261 - RNA, 15 nt, Salmonella typhimurium LT2
gucggacguaugcuu

SEQ ID NO: 3773262 - RNA, 17 nt, Salmonella typhimurium LT2
gucggccaggugccgag

SEQ ID NO: 3773263 - RNA, 18 nt, Salmonella typhimurium LT2
gucggccuuuuugcgccg

SEQ ID NO: 3773264 - RNA, 21 nt, Salmonella typhimurium LT2
gucggccuuuuugcgccgcga

SEQ ID NO: 3773265 - RNA, 12 nt, Salmonella typhimurium LT2
gucggcgccauc

SEQ ID NO: 3773266 - RNA, 15 nt, Salmonella typhimurium LT2
gucggcucauccagc

SEQ ID NO: 3773267 - RNA, 19 nt, Salmonella typhimurium LT2
gucggcucauccagcagca

SEQ ID NO: 3773268 - RNA, 15 nt, Salmonella typhimurium LT2
gucgggaacgcuguc

SEQ ID NO: 3773269 - RNA, 23 nt, Salmonella typhimurium LT2
gucgggaagagagaaaaucggcg

SEQ ID NO: 3773270 - RNA, 17 nt, Salmonella typhimurium LT2
gucgggccgcgcugcgc

SEQ ID NO: 3773271 - RNA, 13 nt, Salmonella typhimurium LT2
gucgggccugcug

SEQ ID NO: 3773272 - RNA, 20 nt, Salmonella typhimurium LT2
gucgguaaagcgcaccagcc

SEQ ID NO: 3773273 - RNA, 17 nt, Salmonella typhimurium LT2
gucgguaauguccgcca

SEQ ID NO: 3773274 - RNA, 22 nt, Salmonella typhimurium LT2
gucggugauauauucagcaaau

SEQ ID NO: 3773275 - RNA, 16 nt, Salmonella typhimurium LT2
gucguaggcucaaagu

SEQ ID NO: 3773276 - RNA, 23 nt, Salmonella typhimurium LT2
gucguauaccguuucuccgcgau

SEQ ID NO: 3773277 - RNA, 22 nt, Salmonella typhimurium LT2
gucguauccccagucuuccugc

SEQ ID NO: 3773278 - RNA, 20 nt, Salmonella typhimurium LT2
gucgucauuugaaucugcag

SEQ ID NO: 3773279 - RNA, 19 nt, Salmonella typhimurium LT2
gucgucgauuuucugcuca

SEQ ID NO: 3773280 - RNA, 22 nt, Salmonella typhimurium LT2
gucgucggcauggucagcauaa

SEQ ID NO: 3773281 - RNA, 20 nt, Salmonella typhimurium LT2
gucgugaguggcggcacgca

SEQ ID NO: 3773282 - RNA, 19 nt, Salmonella typhimurium LT2
gucgugcgguaccgcguua

SEQ ID NO: 3773283 - RNA, 21 nt, Salmonella typhimurium LT2
gucguuagccagauggcugca

SEQ ID NO: 3773284 - RNA, 16 nt, Salmonella typhimurium LT2
gucguuaucgccccag

SEQ ID NO: 3773285 - RNA, 20 nt, Salmonella typhimurium LT2
gucguuguaguuaucgccga

SEQ ID NO: 3773286 - RNA, 17 nt, Salmonella typhimurium LT2
gucguuucccccgcgac

SEQ ID NO: 3773287 - RNA, 18 nt, Salmonella typhimurium LT2
gucuaacuuaccaguuau

SEQ ID NO: 3773288 - RNA, 17 nt, Salmonella typhimurium LT2
gucuacacuuugcgccg

SEQ ID NO: 3773289 - RNA, 14 nt, Salmonella typhimurium LT2
gucuaccagcucuc

SEQ ID NO: 3773290 - RNA, 19 nt, Salmonella typhimurium LT2
gucuacccgguguaaaaaa

SEQ ID NO: 3773291 - RNA, 15 nt, Salmonella typhimurium LT2
gucuaucgcuucucc

SEQ ID NO: 3773292 - RNA, 16 nt, Salmonella typhimurium LT2
gucucaaucgcaaauu

SEQ ID NO: 3773293 - RNA, 20 nt, Salmonella typhimurium LT2
gucuccagcucauuuuuaca

SEQ ID NO: 3773294 - RNA, 17 nt, Salmonella typhimurium LT2
gucucccagaugaaaaa

SEQ ID NO: 3773295 - RNA, 14 nt, Salmonella typhimurium LT2
gucuccgccuggaa

SEQ ID NO: 3773296 - RNA, 18 nt, Salmonella typhimurium LT2
gucuccggcgcgccgcug

SEQ ID NO: 3773297 - RNA, 23 nt, Salmonella typhimurium LT2
gucucgccgcggugauccuccug

SEQ ID NO: 3773298 - RNA, 14 nt, Salmonella typhimurium LT2
gucucgcguccauu

SEQ ID NO: 3773299 - RNA, 14 nt, Salmonella typhimurium LT2
gucucggccuggcc

SEQ ID NO: 3773300 - RNA, 20 nt, Salmonella typhimurium LT2
gucucuucaugcauaaccgc

SEQ ID NO: 3773301 - RNA, 14 nt, Salmonella typhimurium LT2
gucucuucgcuggc

SEQ ID NO: 3773302 - RNA, 23 nt, Salmonella typhimurium LT2
gucucuuuagaaaaagaaaccuc

SEQ ID NO: 3773303 - RNA, 14 nt, Salmonella typhimurium LT2
gucugaaagcgacu

SEQ ID NO: 3773304 - RNA, 23 nt, Salmonella typhimurium LT2
gucugaaucaaugcaucuucacu

SEQ ID NO: 3773305 - RNA, 13 nt, Salmonella typhimurium LT2
gucugaccgggcg

SEQ ID NO: 3773306 - RNA, 17 nt, Salmonella typhimurium LT2
gucugacggccugucuc

SEQ ID NO: 3773307 - RNA, 19 nt, Salmonella typhimurium LT2
gucugauaagcgcagcgcc

SEQ ID NO: 3773308 - RNA, 22 nt, Salmonella typhimurium LT2
gucugauaagcgcagcgccauc

SEQ ID NO: 3773309 - RNA, 20 nt, Salmonella typhimurium LT2
gucugaugagcgcagcgacu

SEQ ID NO: 3773310 - RNA, 21 nt, Salmonella typhimurium LT2
gucugauugcgcccuccggca

SEQ ID NO: 3773311 - RNA, 21 nt, Salmonella typhimurium LT2
gucugcacgccaauaauuucg

SEQ ID NO: 3773312 - RNA, 14 nt, Salmonella typhimurium LT2
gucugccagcuccu

SEQ ID NO: 3773313 - RNA, 16 nt, Salmonella typhimurium LT2
gucugcccgcgccauc

SEQ ID NO: 3773314 - RNA, 20 nt, Salmonella typhimurium LT2
gucugcccggcaaccugagc

SEQ ID NO: 3773315 - RNA, 18 nt, Salmonella typhimurium LT2
gucugcgucuucuuccac

SEQ ID NO: 3773316 - RNA, 19 nt, Salmonella typhimurium LT2
gucugcgucuucuuccacu

SEQ ID NO: 3773317 - RNA, 14 nt, Salmonella typhimurium LT2
gucugcguugaaua

SEQ ID NO: 3773318 - RNA, 23 nt, Salmonella typhimurium LT2
gucugcugggcgauuucacgaau

SEQ ID NO: 3773319 - RNA, 20 nt, Salmonella typhimurium LT2
gucugcuguaggccggauaa

SEQ ID NO: 3773320 - RNA, 22 nt, Salmonella typhimurium LT2
gucuggauuuggcugccgagca

SEQ ID NO: 3773321 - RNA, 13 nt, Salmonella typhimurium LT2
gucuggggaacaa

SEQ ID NO: 3773322 - RNA, 16 nt, Salmonella typhimurium LT2
gucugguaaacgcaau

SEQ ID NO: 3773323 - RNA, 20 nt, Salmonella typhimurium LT2
gucugguacggccaccaggc

SEQ ID NO: 3773324 - RNA, 20 nt, Salmonella typhimurium LT2
gucugguaucugucaugcgg

SEQ ID NO: 3773325 - RNA, 11 nt, Salmonella typhimurium LT2
gucuggucagc

SEQ ID NO: 3773326 - RNA, 22 nt, Salmonella typhimurium LT2
gucuguuuuucguuccuucagc

SEQ ID NO: 3773327 - RNA, 13 nt, Salmonella typhimurium LT2
gucuuaaauauga

SEQ ID NO: 3773328 - RNA, 16 nt, Salmonella typhimurium LT2
gucuuaacccauggcu

SEQ ID NO: 3773329 - RNA, 18 nt, Salmonella typhimurium LT2
gucuuaaccuuuuguauc

SEQ ID NO: 3773330 - RNA, 19 nt, Salmonella typhimurium LT2
gucuuagcuaucugcccug

SEQ ID NO: 3773331 - RNA, 19 nt, Salmonella typhimurium LT2
gucuuauccggccuccaaa

SEQ ID NO: 3773332 - RNA, 17 nt, Salmonella typhimurium LT2
gucuuauuucuccugcg

SEQ ID NO: 3773333 - RNA, 23 nt, Salmonella typhimurium LT2
gucuucacucugggauuugcgaa

SEQ ID NO: 3773334 - RNA, 18 nt, Salmonella typhimurium LT2
gucuucagcaauuacccg

SEQ ID NO: 3773335 - RNA, 14 nt, Salmonella typhimurium LT2
gucuucaucccagu

SEQ ID NO: 3773336 - RNA, 11 nt, Salmonella typhimurium LT2
gucuuccagca

SEQ ID NO: 3773337 - RNA, 15 nt, Salmonella typhimurium LT2
gucuucccgcaaacu

SEQ ID NO: 3773338 - RNA, 14 nt, Salmonella typhimurium LT2
gucuucgaugccau

SEQ ID NO: 3773339 - RNA, 21 nt, Salmonella typhimurium LT2
gucuucgcacugcccuucccg

SEQ ID NO: 3773340 - RNA, 19 nt, Salmonella typhimurium LT2
gucuucuaccgcuucuuaa

SEQ ID NO: 3773341 - RNA, 13 nt, Salmonella typhimurium LT2
gucuucugccagc

SEQ ID NO: 3773342 - RNA, 18 nt, Salmonella typhimurium LT2
gucuucuuaguaacauaa

SEQ ID NO: 3773343 - RNA, 22 nt, Salmonella typhimurium LT2
gucuugucaggcucuaauaacu

SEQ ID NO: 3773344 - RNA, 21 nt, Salmonella typhimurium LT2
gucuuuacugaaucucagaua

SEQ ID NO: 3773345 - RNA, 20 nt, Salmonella typhimurium LT2
gucuuuauucugaaagaaaa

SEQ ID NO: 3773346 - RNA, 13 nt, Salmonella typhimurium LT2
gucuuugaauaac

SEQ ID NO: 3773347 - RNA, 12 nt, Salmonella typhimurium LT2
gucuuuuauccc

SEQ ID NO: 3773348 - RNA, 14 nt, Salmonella typhimurium LT2
gucuuuuucucaau

SEQ ID NO: 3773349 - RNA, 23 nt, Salmonella typhimurium LT2
gugaaaaagcggcuguagccagc

SEQ ID NO: 3773350 - RNA, 17 nt, Salmonella typhimurium LT2
gugaaaccggcgcgccu

SEQ ID NO: 3773351 - RNA, 14 nt, Salmonella typhimurium LT2
gugaaacuguuuua

SEQ ID NO: 3773352 - RNA, 19 nt, Salmonella typhimurium LT2
gugaaaguaaguuuauggu

SEQ ID NO: 3773353 - RNA, 16 nt, Salmonella typhimurium LT2
gugaaagugauuucau

SEQ ID NO: 3773354 - RNA, 21 nt, Salmonella typhimurium LT2
gugaaauuuccuccgccgaua

SEQ ID NO: 3773355 - RNA, 15 nt, Salmonella typhimurium LT2
gugaaccaaagcaaa

SEQ ID NO: 3773356 - RNA, 13 nt, Salmonella typhimurium LT2
guuaaaucauaac

SEQ ID NO: 3773357 - RNA, 15 nt, Salmonella typhimurium LT2
guuaacagaaugcug

SEQ ID NO: 3773358 - RNA, 18 nt, Salmonella typhimurium LT2
guuaacagaaugcugaac

SEQ ID NO: 3773359 - RNA, 19 nt, Salmonella typhimurium LT2
guuaacccacaacgcacca

SEQ ID NO: 3773360 - RNA, 19 nt, Salmonella typhimurium LT2
guuaacccgguuuaucccc

SEQ ID NO: 3773361 - RNA, 17 nt, Salmonella typhimurium LT2
guuaacccguccauauu

SEQ ID NO: 3773362 - RNA, 15 nt, Salmonella typhimurium LT2
guuaaccuugcgccu

SEQ ID NO: 3773363 - RNA, 18 nt, Salmonella typhimurium LT2
guuaacucuuuugcagca

SEQ ID NO: 3773364 - RNA, 21 nt, Salmonella typhimurium LT2
guuaacucuuuugcagcaaau

SEQ ID NO: 3773365 - RNA, 21 nt, Salmonella typhimurium LT2
guuaacuggauauuccaguua

SEQ ID NO: 3773366 - RNA, 12 nt, Salmonella typhimurium LT2
guuaacuucaag

SEQ ID NO: 3773367 - RNA, 17 nt, Salmonella typhimurium LT2
guuaagcauuucgccag

SEQ ID NO: 3773368 - RNA, 21 nt, Salmonella typhimurium LT2
guuaagcgcccgcgcgccagc

SEQ ID NO: 3773369 - RNA, 19 nt, Salmonella typhimurium LT2
guuaaggggcaggcgucaa

SEQ ID NO: 3773370 - RNA, 11 nt, Salmonella typhimurium LT2
guuaauacuga

SEQ ID NO: 3773371 - RNA, 16 nt, Salmonella typhimurium LT2
guuaaucacuaccugc

SEQ ID NO: 3773372 - RNA, 16 nt, Salmonella typhimurium LT2
guuaaucagcgcuguc

SEQ ID NO: 3773373 - RNA, 19 nt, Salmonella typhimurium LT2
guuaauccagagcggauaa

SEQ ID NO: 3773374 - RNA, 15 nt, Salmonella typhimurium LT2
guuaaucucacgcuc

SEQ ID NO: 3773375 - RNA, 22 nt, Salmonella typhimurium LT2
guuaauggccugaugacgcugc

SEQ ID NO: 3773376 - RNA, 14 nt, Salmonella typhimurium LT2
guuaauuaaauguu

SEQ ID NO: 3773377 - RNA, 12 nt, Salmonella typhimurium LT2
guuaauucuauu

SEQ ID NO: 3773378 - RNA, 15 nt, Salmonella typhimurium LT2
guuaauucuggcaau

SEQ ID NO: 3773379 - RNA, 23 nt, Salmonella typhimurium LT2
guuacaggacauuuggggcuggc

SEQ ID NO: 3773380 - RNA, 14 nt, Salmonella typhimurium LT2
guuacaugcugaag

SEQ ID NO: 3773381 - RNA, 23 nt, Salmonella typhimurium LT2
guuaccccuuuuucaauuuccag

SEQ ID NO: 3773382 - RNA, 14 nt, Salmonella typhimurium LT2
guuacccgccaguc

SEQ ID NO: 3773383 - RNA, 19 nt, Salmonella typhimurium LT2
guuacccuauuuugcgccu

SEQ ID NO: 3773384 - RNA, 21 nt, Salmonella typhimurium LT2
guuaccgccggcuucgucuuu

SEQ ID NO: 3773385 - RNA, 15 nt, Salmonella typhimurium LT2
guuaccguauggucg

SEQ ID NO: 3773386 - RNA, 20 nt, Salmonella typhimurium LT2
guuacgcacgccagauaaau

SEQ ID NO: 3773387 - RNA, 21 nt, Salmonella typhimurium LT2
guuacgcacgccagauaaauc

SEQ ID NO: 3773388 - RNA, 17 nt, Salmonella typhimurium LT2
guuacgcacuacaucau

SEQ ID NO: 3773389 - RNA, 12 nt, Salmonella typhimurium LT2
guuacgcaucug

SEQ ID NO: 3773390 - RNA, 16 nt, Salmonella typhimurium LT2
guuacgcgcugcaaau

SEQ ID NO: 3773391 - RNA, 21 nt, Salmonella typhimurium LT2
guuacgcggucuuuuaaaaga

SEQ ID NO: 3773392 - RNA, 23 nt, Salmonella typhimurium LT2
guuacggcugaagcugccguccc

SEQ ID NO: 3773393 - RNA, 16 nt, Salmonella typhimurium LT2
guuacgggaacagaau

SEQ ID NO: 3773394 - RNA, 13 nt, Salmonella typhimurium LT2
guuacuaaaagua

SEQ ID NO: 3773395 - RNA, 16 nt, Salmonella typhimurium LT2
guuacucuuccaccau

SEQ ID NO: 3773396 - RNA, 14 nt, Salmonella typhimurium LT2
guuacucuuccucc

SEQ ID NO: 3773397 - RNA, 20 nt, Salmonella typhimurium LT2
guuacucuuccuccccaggc

SEQ ID NO: 3773398 - RNA, 22 nt, Salmonella typhimurium LT2
guuacucuuccuccccaggcgc

SEQ ID NO: 3773399 - RNA, 17 nt, Salmonella typhimurium LT2
guuacucuucugaccau

SEQ ID NO: 3773400 - RNA, 19 nt, Salmonella typhimurium LT2
guuagauauaguuuuucaa

SEQ ID NO: 3773401 - RNA, 20 nt, Salmonella typhimurium LT2
guuagauuagguacguacau

SEQ ID NO: 3773402 - RNA, 15 nt, Salmonella typhimurium LT2
guuagcaaguccggg

SEQ ID NO: 3773403 - RNA, 23 nt, Salmonella typhimurium LT2
guuagcauagacgaucagcgcau

SEQ ID NO: 3773404 - RNA, 12 nt, Salmonella typhimurium LT2
guuagccccuua

SEQ ID NO: 3773405 - RNA, 23 nt, Salmonella typhimurium LT2
guuagcgcauuuuuaucagaccu

SEQ ID NO: 3773406 - RNA, 18 nt, Salmonella typhimurium LT2
guuagcgccaccgggcau

SEQ ID NO: 3773407 - RNA, 16 nt, Salmonella typhimurium LT2
guuagcgcccauaaug

SEQ ID NO: 3773408 - RNA, 13 nt, Salmonella typhimurium LT2
guuagcuggcugu

SEQ ID NO: 3773409 - RNA, 11 nt, Salmonella typhimurium LT2
guuaguguccu

SEQ ID NO: 3773410 - RNA, 17 nt, Salmonella typhimurium LT2
guuaguuucuauuaaau

SEQ ID NO: 3773411 - RNA, 18 nt, Salmonella typhimurium LT2
guuauaaauccccgccgc

SEQ ID NO: 3773412 - RNA, 21 nt, Salmonella typhimurium LT2
guuauaaauccccgccgccau

SEQ ID NO: 3773413 - RNA, 22 nt, Salmonella typhimurium LT2
guuauaaccgaugcagccugga

SEQ ID NO: 3773414 - RNA, 22 nt, Salmonella typhimurium LT2
guuauaaggccugccguccuga

SEQ ID NO: 3773415 - RNA, 15 nt, Salmonella typhimurium LT2
guuauacaucgcuuu

SEQ ID NO: 3773416 - RNA, 21 nt, Salmonella typhimurium LT2
guuauagacgccggucaugcc

SEQ ID NO: 3773417 - RNA, 23 nt, Salmonella typhimurium LT2
guuauagcggggacuguggaaga

SEQ ID NO: 3773418 - RNA, 14 nt, Salmonella typhimurium LT2
guuaucaggauaau

SEQ ID NO: 3773419 - RNA, 13 nt, Salmonella typhimurium LT2
guuauccagcagc

SEQ ID NO: 3773420 - RNA, 19 nt, Salmonella typhimurium LT2
guuauccagcagccacaga

SEQ ID NO: 3773421 - RNA, 19 nt, Salmonella typhimurium LT2
guuauccagcagccaggua

SEQ ID NO: 3773422 - RNA, 14 nt, Salmonella typhimurium LT2
guuaucccugcuga

SEQ ID NO: 3773423 - RNA, 12 nt, Salmonella typhimurium LT2
guuaucggccug

SEQ ID NO: 3773424 - RNA, 17 nt, Salmonella typhimurium LT2
guuaucguagugccaca

SEQ ID NO: 3773425 - RNA, 16 nt, Salmonella typhimurium LT2
guuaucuuauaaauaa

SEQ ID NO: 3773426 - RNA, 19 nt, Salmonella typhimurium LT2
guuaucuuuuauuucaucu

SEQ ID NO: 3773427 - RNA, 16 nt, Salmonella typhimurium LT2
guuaugaaacccgcca

SEQ ID NO: 3773428 - RNA, 21 nt, Salmonella typhimurium LT2
guuaugcaaguucgaauagcc

SEQ ID NO: 3773429 - RNA, 11 nt, Salmonella typhimurium LT2
guuaugccauc

SEQ ID NO: 3773430 - RNA, 21 nt, Salmonella typhimurium LT2
guuaugccaucuaacacaaau

SEQ ID NO: 3773431 - RNA, 15 nt, Salmonella typhimurium LT2
guuaugcccuuccag

SEQ ID NO: 3773432 - RNA, 20 nt, Salmonella typhimurium LT2
guuaugccgacaguuuuacc

SEQ ID NO: 3773433 - RNA, 22 nt, Salmonella typhimurium LT2
guuaugccuuuuucaacagcac

SEQ ID NO: 3773434 - RNA, 15 nt, Salmonella typhimurium LT2
guuauucagcaggag

SEQ ID NO: 3773435 - RNA, 16 nt, Salmonella typhimurium LT2
guuauucggucagaua

SEQ ID NO: 3773436 - RNA, 14 nt, Salmonella typhimurium LT2
guuauugaccaucg

SEQ ID NO: 3773437 - RNA, 22 nt, Salmonella typhimurium LT2
guuauugugguguuccauugcu

SEQ ID NO: 3773438 - RNA, 20 nt, Salmonella typhimurium LT2
guucaaaaugcccgcauugc

SEQ ID NO: 3773439 - RNA, 18 nt, Salmonella typhimurium LT2
guucaacgaagaaaagcc

SEQ ID NO: 3773440 - RNA, 12 nt, Salmonella typhimurium LT2
guucaacggcaa

SEQ ID NO: 3773441 - RNA, 14 nt, Salmonella typhimurium LT2
guucaagucucgcc

SEQ ID NO: 3773442 - RNA, 18 nt, Salmonella typhimurium LT2
guucaauagagcgcagca

SEQ ID NO: 3773443 - RNA, 15 nt, Salmonella typhimurium LT2
guucaauauccagcc

SEQ ID NO: 3773444 - RNA, 18 nt, Salmonella typhimurium LT2
guucaauauucaaugggu

SEQ ID NO: 3773445 - RNA, 20 nt, Salmonella typhimurium LT2
guucaauucauagagcgcgu

SEQ ID NO: 3773446 - RNA, 20 nt, Salmonella typhimurium LT2
guucaccaccacccagugcc

SEQ ID NO: 3773447 - RNA, 13 nt, Salmonella typhimurium LT2
guucaccggcggc

SEQ ID NO: 3773448 - RNA, 21 nt, Salmonella typhimurium LT2
guucaccguuuaaaaacauca

SEQ ID NO: 3773449 - RNA, 20 nt, Salmonella typhimurium LT2
guucacgcgccgccugcacg

SEQ ID NO: 3773450 - RNA, 16 nt, Salmonella typhimurium LT2
guucacuccuaagaga

SEQ ID NO: 3773451 - RNA, 17 nt, Salmonella typhimurium LT2
guucacuccuaagagaa

SEQ ID NO: 3773452 - RNA, 20 nt, Salmonella typhimurium LT2
guucagaaauguauucuccc

SEQ ID NO: 3773453 - RNA, 23 nt, Salmonella typhimurium LT2
guucagaccagaaccucacggag

SEQ ID NO: 3773454 - RNA, 12 nt, Salmonella typhimurium LT2
guucagccagca

SEQ ID NO: 3773455 - RNA, 12 nt, Salmonella typhimurium LT2
guucagccgcca

SEQ ID NO: 3773456 - RNA, 13 nt, Salmonella typhimurium LT2
guucagccgccag

SEQ ID NO: 3773457 - RNA, 14 nt, Salmonella typhimurium LT2
guucagccgccagu

SEQ ID NO: 3773458 - RNA, 18 nt, Salmonella typhimurium LT2
guucagcgacaggcuguc

SEQ ID NO: 3773459 - RNA, 19 nt, Salmonella typhimurium LT2
guucaggcggcaaaaaacg

SEQ ID NO: 3773460 - RNA, 16 nt, Salmonella typhimurium LT2
guugcgaauaaacaca

SEQ ID NO: 3773461 - RNA, 22 nt, Salmonella typhimurium LT2
guugcgcaucauucugucagca

SEQ ID NO: 3773462 - RNA, 17 nt, Salmonella typhimurium LT2
guugcgccaagcgccuc

SEQ ID NO: 3773463 - RNA, 13 nt, Salmonella typhimurium LT2
guugcgccaccau

SEQ ID NO: 3773464 - RNA, 14 nt, Salmonella typhimurium LT2
guugcgcccaucau

SEQ ID NO: 3773465 - RNA, 15 nt, Salmonella typhimurium LT2
guugcgcuucgcucc

SEQ ID NO: 3773466 - RNA, 20 nt, Salmonella typhimurium LT2
guugcggguguucaccgcua

SEQ ID NO: 3773467 - RNA, 17 nt, Salmonella typhimurium LT2
guugcgucaccgggcug

SEQ ID NO: 3773468 - RNA, 14 nt, Salmonella typhimurium LT2
guugcgucauauaa

SEQ ID NO: 3773469 - RNA, 13 nt, Salmonella typhimurium LT2
guugcuaaaucca

SEQ ID NO: 3773470 - RNA, 15 nt, Salmonella typhimurium LT2
guugcuauugaaaaa

SEQ ID NO: 3773471 - RNA, 14 nt, Salmonella typhimurium LT2
guugcuccagcauc

SEQ ID NO: 3773472 - RNA, 21 nt, Salmonella typhimurium LT2
guugcucccgcaccuggucua

SEQ ID NO: 3773473 - RNA, 21 nt, Salmonella typhimurium LT2
guugcuccuguaagucaggua

SEQ ID NO: 3773474 - RNA, 14 nt, Salmonella typhimurium LT2
guugcugcaaaaga

SEQ ID NO: 3773475 - RNA, 16 nt, Salmonella typhimurium LT2
guugcuuuauaaaaag

SEQ ID NO: 3773476 - RNA, 13 nt, Salmonella typhimurium LT2
guuggagguggaa

SEQ ID NO: 3773477 - RNA, 16 nt, Salmonella typhimurium LT2
guuggaguaauguuca

SEQ ID NO: 3773478 - RNA, 20 nt, Salmonella typhimurium LT2
guuggaugaaccauaucaaa

SEQ ID NO: 3773479 - RNA, 14 nt, Salmonella typhimurium LT2
guuggauugcaucc

SEQ ID NO: 3773480 - RNA, 23 nt, Salmonella typhimurium LT2
guuggcaacccguaccuccagcg

SEQ ID NO: 3773481 - RNA, 12 nt, Salmonella typhimurium LT2
guuggccgccag

SEQ ID NO: 3773482 - RNA, 18 nt, Salmonella typhimurium LT2
guugggauuaucgcggau

SEQ ID NO: 3773483 - RNA, 20 nt, Salmonella typhimurium LT2
guugggguugcccggcgcca

SEQ ID NO: 3773484 - RNA, 15 nt, Salmonella typhimurium LT2
guuguacuuguugcu

SEQ ID NO: 3773485 - RNA, 23 nt, Salmonella typhimurium LT2
guuguaguuucagcccaaaagcg

SEQ ID NO: 3773486 - RNA, 18 nt, Salmonella typhimurium LT2
guuguccaguaaggcaag

SEQ ID NO: 3773487 - RNA, 20 nt, Salmonella typhimurium LT2
guuguccauuuuccucccau

SEQ ID NO: 3773488 - RNA, 13 nt, Salmonella typhimurium LT2
guugucccaggcc

SEQ ID NO: 3773489 - RNA, 16 nt, Salmonella typhimurium LT2
guugucgaacugcacg

SEQ ID NO: 3773490 - RNA, 19 nt, Salmonella typhimurium LT2
guugucggcucauccagca

SEQ ID NO: 3773491 - RNA, 17 nt, Salmonella typhimurium LT2
guugucggggcuuuaau

SEQ ID NO: 3773492 - RNA, 17 nt, Salmonella typhimurium LT2
guugugcauuccaggug

SEQ ID NO: 3773493 - RNA, 17 nt, Salmonella typhimurium LT2
guuguuccagcagcuca

SEQ ID NO: 3773494 - RNA, 12 nt, Salmonella typhimurium LT2
guuguucugggu

SEQ ID NO: 3773495 - RNA, 15 nt, Salmonella typhimurium LT2
guuguugacaccacg

SEQ ID NO: 3773496 - RNA, 24 nt, Salmonella typhimurium LT2
guuguuugaucccgcugaagacug

SEQ ID NO: 3773497 - RNA, 12 nt, Salmonella typhimurium LT2
guuuaaaccacu

SEQ ID NO: 3773498 - RNA, 13 nt, Salmonella typhimurium LT2
guuuaaagcgcuc

SEQ ID NO: 3773499 - RNA, 15 nt, Salmonella typhimurium LT2
guuuaaucauaaaac

SEQ ID NO: 3773500 - RNA, 19 nt, Salmonella typhimurium LT2
guuuaaugcuuucaauacu

SEQ ID NO: 3773501 - RNA, 20 nt, Salmonella typhimurium LT2
guuuaaugucaccaucaucg

SEQ ID NO: 3773502 - RNA, 19 nt, Salmonella typhimurium LT2
guuuaauucuuugagcauc

SEQ ID NO: 3773503 - RNA, 21 nt, Salmonella typhimurium LT2
guuuacccacuucuuccagcg

SEQ ID NO: 3773504 - RNA, 19 nt, Salmonella typhimurium LT2
guuuacccagcgaaugcug

SEQ ID NO: 3773505 - RNA, 21 nt, Salmonella typhimurium LT2
guuuacgagugcguucuucca

SEQ ID NO: 3773506 - RNA, 18 nt, Salmonella typhimurium LT2
guuuacgcccucaucggc

SEQ ID NO: 3773507 - RNA, 21 nt, Salmonella typhimurium LT2
guuuacgccgccauccggcac

SEQ ID NO: 3773508 - RNA, 14 nt, Salmonella typhimurium LT2
guuuacgcugcucc

SEQ ID NO: 3773509 - RNA, 17 nt, Salmonella typhimurium LT2
guuuacguagcagcgcg

SEQ ID NO: 3773510 - RNA, 20 nt, Salmonella typhimurium LT2
guuuacuccauucccagcuc

SEQ ID NO: 3773511 - RNA, 13 nt, Salmonella typhimurium LT2
guuuagacagaca

SEQ ID NO: 3773512 - RNA, 17 nt, Salmonella typhimurium LT2
guuuagcgccagcagca

SEQ ID NO: 3773513 - RNA, 17 nt, Salmonella typhimurium LT2
guuuauauaaaaauagc

SEQ ID NO: 3773514 - RNA, 10 nt, Salmonella typhimurium LT2
guuuauccgg

SEQ ID NO: 3773515 - RNA, 19 nt, Salmonella typhimurium LT2
guuuaucucaucgacuuca

SEQ ID NO: 3773516 - RNA, 21 nt, Salmonella typhimurium LT2
guuuaucuggcuuacaggcac

SEQ ID NO: 3773517 - RNA, 20 nt, Salmonella typhimurium LT2
guuuauugagauaauuuaug

SEQ ID NO: 3773518 - RNA, 22 nt, Salmonella typhimurium LT2
guuuauuuaacguguuacguuu

SEQ ID NO: 3773519 - RNA, 17 nt, Salmonella typhimurium LT2
guuuauuucgucagcac

SEQ ID NO: 3773520 - RNA, 21 nt, Salmonella typhimurium LT2
guuucaacccccucagcaaug

SEQ ID NO: 3773521 - RNA, 23 nt, Salmonella typhimurium LT2
guuucaacccccucagcaaugau

SEQ ID NO: 3773522 - RNA, 19 nt, Salmonella typhimurium LT2
guuucaagcaguuccagca

SEQ ID NO: 3773523 - RNA, 19 nt, Salmonella typhimurium LT2
guuucaaugcccaggcgcc

SEQ ID NO: 3773524 - RNA, 18 nt, Salmonella typhimurium LT2
guuucaauuccacaggcg

SEQ ID NO: 3773525 - RNA, 13 nt, Salmonella typhimurium LT2
guuucaccagcac

SEQ ID NO: 3773526 - RNA, 14 nt, Salmonella typhimurium LT2
guuucaccgccaga

SEQ ID NO: 3773527 - RNA, 16 nt, Salmonella typhimurium LT2
guuucaccgccagagc

SEQ ID NO: 3773528 - RNA, 17 nt, Salmonella typhimurium LT2
guuucaccgccagagca

SEQ ID NO: 3773529 - RNA, 19 nt, Salmonella typhimurium LT2
guuucaccguuuucgucaa

SEQ ID NO: 3773530 - RNA, 17 nt, Salmonella typhimurium LT2
guuucaccuucacaggu

SEQ ID NO: 3773531 - RNA, 22 nt, Salmonella typhimurium LT2
guuucaccuucacaggugguua

SEQ ID NO: 3773532 - RNA, 17 nt, Salmonella typhimurium LT2
guuucacgcucuucgcc

SEQ ID NO: 3773533 - RNA, 17 nt, Salmonella typhimurium LT2
guuucagauagagaagg

SEQ ID NO: 3773534 - RNA, 14 nt, Salmonella typhimurium LT2
guuucagcagcggu

SEQ ID NO: 3773535 - RNA, 15 nt, Salmonella typhimurium LT2
guuucagcuuccagu

SEQ ID NO: 3773536 - RNA, 22 nt, Salmonella typhimurium LT2
guuucaggacggcauaagccag

SEQ ID NO: 3773537 - RNA, 20 nt, Salmonella typhimurium LT2
guuucaggucaucggccugc

SEQ ID NO: 3773538 - RNA, 14 nt, Salmonella typhimurium LT2
guuucagugauaaa

SEQ ID NO: 3773539 - RNA, 18 nt, Salmonella typhimurium LT2
guuuccacugaguuucac

SEQ ID NO: 3773540 - RNA, 22 nt, Salmonella typhimurium LT2
guuuccacugaguuucaccgcc

SEQ ID NO: 3773541 - RNA, 21 nt, Salmonella typhimurium LT2
guuuccagcaucgaccaggau

SEQ ID NO: 3773542 - RNA, 21 nt, Salmonella typhimurium LT2
guuucccagucaacaaccucu

SEQ ID NO: 3773543 - RNA, 22 nt, Salmonella typhimurium LT2
guuucccauugggccagcagcg

SEQ ID NO: 3773544 - RNA, 19 nt, Salmonella typhimurium LT2
guuucccccuccauacccu

SEQ ID NO: 3773545 - RNA, 16 nt, Salmonella typhimurium LT2
guuucccucauauuug

SEQ ID NO: 3773546 - RNA, 13 nt, Salmonella typhimurium LT2
guuuccggcagcu

SEQ ID NO: 3773547 - RNA, 13 nt, Salmonella typhimurium LT2
guuuccggcgcuu

SEQ ID NO: 3773548 - RNA, 21 nt, Salmonella typhimurium LT2
guuuccguuuguaacauauuu

SEQ ID NO: 3773549 - RNA, 22 nt, Salmonella typhimurium LT2
guuuccugcgcagauaccggcg

SEQ ID NO: 3773550 - RNA, 17 nt, Salmonella typhimurium LT2
guuucgacgggagguga

SEQ ID NO: 3773551 - RNA, 22 nt, Salmonella typhimurium LT2
guuucgaguucggcaaucugcu

SEQ ID NO: 3773552 - RNA, 21 nt, Salmonella typhimurium LT2
guuucgauacauccggcaggc

SEQ ID NO: 3773553 - RNA, 20 nt, Salmonella typhimurium LT2
guuucgccagcggcagcgcg

SEQ ID NO: 3773554 - RNA, 13 nt, Salmonella typhimurium LT2
guuucgccaggcc

SEQ ID NO: 3773555 - RNA, 13 nt, Salmonella typhimurium LT2
guuucgccgccau

SEQ ID NO: 3773556 - RNA, 21 nt, Salmonella typhimurium LT2
guuucgcugcacuucaauguc

SEQ ID NO: 3773557 - RNA, 14 nt, Salmonella typhimurium LT2
guuucggcauccca

SEQ ID NO: 3773558 - RNA, 18 nt, Salmonella typhimurium LT2
guuucguuuagcgccugc

SEQ ID NO: 3773559 - RNA, 15 nt, Salmonella typhimurium LT2
guuucuacaauagag

SEQ ID NO: 3773560 - RNA, 15 nt, Salmonella typhimurium LT2
guuucuacauucaaa

SEQ ID NO: 3773561 - RNA, 19 nt, Salmonella typhimurium LT2
guuucucccgccagaugca

SEQ ID NO: 3773562 - RNA, 23 nt, Salmonella typhimurium LT2
guuucugccgguucggcaucgcc

SEQ ID NO: 3773563 - RNA, 14 nt, Salmonella typhimurium LT2
guuucuguauuuuc

SEQ ID NO: 3773564 - RNA, 17 nt, Salmonella typhimurium LT2
uaaacacguuaucugac

SEQ ID NO: 3773565 - RNA, 19 nt, Salmonella typhimurium LT2
uaaacacucuccaccaaau

SEQ ID NO: 3773566 - RNA, 18 nt, Salmonella typhimurium LT2
uaaacagcaucaccauac

SEQ ID NO: 3773567 - RNA, 15 nt, Salmonella typhimurium LT2
uaaacaggcaggccc

SEQ ID NO: 3773568 - RNA, 16 nt, Salmonella typhimurium LT2
uaaacagguaaaacaa

SEQ ID NO: 3773569 - RNA, 16 nt, Salmonella typhimurium LT2
uaaacaguuccgcaaa

SEQ ID NO: 3773570 - RNA, 19 nt, Salmonella typhimurium LT2
uaaacaguuccgcaaagcc

SEQ ID NO: 3773571 - RNA, 12 nt, Salmonella typhimurium LT2
uaaacauauggc

SEQ ID NO: 3773572 - RNA, 16 nt, Salmonella typhimurium LT2
uaaacaucagccauuc

SEQ ID NO: 3773573 - RNA, 16 nt, Salmonella typhimurium LT2
uaaacaugcuggauga

SEQ ID NO: 3773574 - RNA, 17 nt, Salmonella typhimurium LT2
uaaaccacaugaccagc

SEQ ID NO: 3773575 - RNA, 23 nt, Salmonella typhimurium LT2
uaaaccaccauacccaacagcag

SEQ ID NO: 3773576 - RNA, 19 nt, Salmonella typhimurium LT2
uaaacccccuggccggaaa

SEQ ID NO: 3773577 - RNA, 17 nt, Salmonella typhimurium LT2
uaaaccgaaaggguaua

SEQ ID NO: 3773578 - RNA, 22 nt, Salmonella typhimurium LT2
uaaaccgaaaggguauacaaaa

SEQ ID NO: 3773579 - RNA, 15 nt, Salmonella typhimurium LT2
uaaaccgccagauga

SEQ ID NO: 3773580 - RNA, 18 nt, Salmonella typhimurium LT2
uaaaccgccguuuugauu

SEQ ID NO: 3773581 - RNA, 18 nt, Salmonella typhimurium LT2
uaaaccgcgauaaaccug

SEQ ID NO: 3773582 - RNA, 23 nt, Salmonella typhimurium LT2
uaaaccgcugccacacucucucc

SEQ ID NO: 3773583 - RNA, 17 nt, Salmonella typhimurium LT2
uaaacgacagcgccauc

SEQ ID NO: 3773584 - RNA, 18 nt, Salmonella typhimurium LT2
uaaacgacagcgccauca

SEQ ID NO: 3773585 - RNA, 12 nt, Salmonella typhimurium LT2
uaaacgccggau

SEQ ID NO: 3773586 - RNA, 17 nt, Salmonella typhimurium LT2
uaaacgccggauuccag

SEQ ID NO: 3773587 - RNA, 16 nt, Salmonella typhimurium LT2
uaaacgccucauccgg

SEQ ID NO: 3773588 - RNA, 13 nt, Salmonella typhimurium LT2
uaaacgccugcac

SEQ ID NO: 3773589 - RNA, 15 nt, Salmonella typhimurium LT2
uaaacgccugcacca

SEQ ID NO: 3773590 - RNA, 15 nt, Salmonella typhimurium LT2
uaaacgcuuuuucaa

SEQ ID NO: 3773591 - RNA, 22 nt, Salmonella typhimurium LT2
uaaacggcagccgccaccacaa

SEQ ID NO: 3773592 - RNA, 18 nt, Salmonella typhimurium LT2
uaaacggcgcaaugccgc

SEQ ID NO: 3773593 - RNA, 17 nt, Salmonella typhimurium LT2
uaaacggcgcugaaagg

SEQ ID NO: 3773594 - RNA, 22 nt, Salmonella typhimurium LT2
uaaacggcucugcaucauuccu

SEQ ID NO: 3773595 - RNA, 12 nt, Salmonella typhimurium LT2
uaaacgggcagc

SEQ ID NO: 3773596 - RNA, 22 nt, Salmonella typhimurium LT2
uaaacgggcagcgggugcucca

SEQ ID NO: 3773597 - RNA, 14 nt, Salmonella typhimurium LT2
uaaacgucaugcug

SEQ ID NO: 3773598 - RNA, 15 nt, Salmonella typhimurium LT2
uaaacgugccacagu

SEQ ID NO: 3773599 - RNA, 15 nt, Salmonella typhimurium LT2
uaaacguuauucauu

SEQ ID NO: 3773600 - RNA, 14 nt, Salmonella typhimurium LT2
uaaacucagcgcca

SEQ ID NO: 3773601 - RNA, 19 nt, Salmonella typhimurium LT2
uaaacucuguguuaugaau

SEQ ID NO: 3773602 - RNA, 13 nt, Salmonella typhimurium LT2
uaaacugcgccau

SEQ ID NO: 3773603 - RNA, 16 nt, Salmonella typhimurium LT2
uaaacuguuuccaguu

SEQ ID NO: 3773604 - RNA, 22 nt, Salmonella typhimurium LT2
uaaacuucacgucacucacauu

SEQ ID NO: 3773605 - RNA, 15 nt, Salmonella typhimurium LT2
uaaagacacagauuc

SEQ ID NO: 3773606 - RNA, 15 nt, Salmonella typhimurium LT2
uaaagaccggcacaa

SEQ ID NO: 3773607 - RNA, 15 nt, Salmonella typhimurium LT2
uaaagagcaggccaa

SEQ ID NO: 3773608 - RNA, 17 nt, Salmonella typhimurium LT2
uaaagauaaauaaaaaa

SEQ ID NO: 3773609 - RNA, 20 nt, Salmonella typhimurium LT2
uaaagauuuuuauuaaaauu

SEQ ID NO: 3773610 - RNA, 17 nt, Salmonella typhimurium LT2
uaaagcaccaucgcaaa

SEQ ID NO: 3773611 - RNA, 18 nt, Salmonella typhimurium LT2
uaaagcagaccaccccac

SEQ ID NO: 3773612 - RNA, 22 nt, Salmonella typhimurium LT2
uaaagcagaccaccccacagca

SEQ ID NO: 3773613 - RNA, 13 nt, Salmonella typhimurium LT2
uaaagcagugcag

SEQ ID NO: 3773614 - RNA, 23 nt, Salmonella typhimurium LT2
uaaagcauagcgucaucaacaua

SEQ ID NO: 3773615 - RNA, 15 nt, Salmonella typhimurium LT2
uaaagccaauccaga

SEQ ID NO: 3773616 - RNA, 19 nt, Salmonella typhimurium LT2
uaaagcccgguucaccguu

SEQ ID NO: 3773617 - RNA, 20 nt, Salmonella typhimurium LT2
uaaagccgcauuuuuccagc

SEQ ID NO: 3773618 - RNA, 23 nt, Salmonella typhimurium LT2
uaaagccguuuguuugcaucgug

SEQ ID NO: 3773619 - RNA, 20 nt, Salmonella typhimurium LT2
uaaagccucucguaagagag

SEQ ID NO: 3773620 - RNA, 13 nt, Salmonella typhimurium LT2
uaaagccuucaug

SEQ ID NO: 3773621 - RNA, 15 nt, Salmonella typhimurium LT2
uaaagccuucaugcu

SEQ ID NO: 3773622 - RNA, 19 nt, Salmonella typhimurium LT2
uaaagcgcucguuauaauu

SEQ ID NO: 3773623 - RNA, 14 nt, Salmonella typhimurium LT2
uaaagcuucugcgc

SEQ ID NO: 3773624 - RNA, 23 nt, Salmonella typhimurium LT2
uaaaggcggaaaucagcacaaag

SEQ ID NO: 3773625 - RNA, 20 nt, Salmonella typhimurium LT2
uaaaggggagcccaguagcc

SEQ ID NO: 3773626 - RNA, 14 nt, Salmonella typhimurium LT2
uaaaggucaucaca

SEQ ID NO: 3773627 - RNA, 23 nt, Salmonella typhimurium LT2
uaaaggugagagacugaaaauaa

SEQ ID NO: 3773628 - RNA, 18 nt, Salmonella typhimurium LT2
uaaagguuucgauacagc

SEQ ID NO: 3773629 - RNA, 15 nt, Salmonella typhimurium LT2
uaaaguaaggcugau

SEQ ID NO: 3773630 - RNA, 22 nt, Salmonella typhimurium LT2
uaaaguagccaaugccugacgc

SEQ ID NO: 3773631 - RNA, 17 nt, Salmonella typhimurium LT2
uaaaguaguuggugggu

SEQ ID NO: 3773632 - RNA, 23 nt, Salmonella typhimurium LT2
uaaaguccugcgucgcuucgcca

SEQ ID NO: 3773633 - RNA, 14 nt, Salmonella typhimurium LT2
uaaagugaguguua

SEQ ID NO: 3773634 - RNA, 18 nt, Salmonella typhimurium LT2
uaaaguuauacagcaccu

SEQ ID NO: 3773635 - RNA, 21 nt, Salmonella typhimurium LT2
uaaaguuauacagcaccugcu

SEQ ID NO: 3773636 - RNA, 13 nt, Salmonella typhimurium LT2
uaaaguuauucac

SEQ ID NO: 3773637 - RNA, 16 nt, Salmonella typhimurium LT2
uaaaguuauucacgua

SEQ ID NO: 3773638 - RNA, 14 nt, Salmonella typhimurium LT2
uaaauaaaaaccau

SEQ ID NO: 3773639 - RNA, 15 nt, Salmonella typhimurium LT2
uaaauaaaaaccauu

SEQ ID NO: 3773640 - RNA, 12 nt, Salmonella typhimurium LT2
uaaauaaacagc

SEQ ID NO: 3773641 - RNA, 16 nt, Salmonella typhimurium LT2
uaaauaaacagcgccu

SEQ ID NO: 3773642 - RNA, 13 nt, Salmonella typhimurium LT2
uaaauaacaaaag

SEQ ID NO: 3773643 - RNA, 22 nt, Salmonella typhimurium LT2
uaaauaacgccagaucucacaa

SEQ ID NO: 3773644 - RNA, 13 nt, Salmonella typhimurium LT2
uaaauaauuuugu

SEQ ID NO: 3773645 - RNA, 18 nt, Salmonella typhimurium LT2
uaaauaccacaacaagaa

SEQ ID NO: 3773646 - RNA, 22 nt, Salmonella typhimurium LT2
uaaauacccaggccaucagaau

SEQ ID NO: 3773647 - RNA, 18 nt, Salmonella typhimurium LT2
uaaauagacuguugaaag

SEQ ID NO: 3773648 - RNA, 16 nt, Salmonella typhimurium LT2
uaaauagagaaaucaa

SEQ ID NO: 3773649 - RNA, 16 nt, Salmonella typhimurium LT2
uaaauaggcgccgccg

SEQ ID NO: 3773650 - RNA, 19 nt, Salmonella typhimurium LT2
uaaauaggcgccgccgaca

SEQ ID NO: 3773651 - RNA, 14 nt, Salmonella typhimurium LT2
uaaauaggcggcau

SEQ ID NO: 3773652 - RNA, 14 nt, Salmonella typhimurium LT2
uaaauagugcgcua

SEQ ID NO: 3773653 - RNA, 24 nt, Salmonella typhimurium LT2
uaaauauugaguucaauaagcgaa

SEQ ID NO: 3773654 - RNA, 15 nt, Salmonella typhimurium LT2
uaaaucaaccugcug

SEQ ID NO: 3773655 - RNA, 20 nt, Salmonella typhimurium LT2
uaaaucacgcugaaaaccgc

SEQ ID NO: 3773656 - RNA, 23 nt, Salmonella typhimurium LT2
uaaaucagcuuugcggccagcau

SEQ ID NO: 3773657 - RNA, 15 nt, Salmonella typhimurium LT2
uaaaucaggaaaaag

SEQ ID NO: 3773658 - RNA, 23 nt, Salmonella typhimurium LT2
uaaaucauaccagcgaaaugcga

SEQ ID NO: 3773659 - RNA, 11 nt, Salmonella typhimurium LT2
uaaaucaucau

SEQ ID NO: 3773660 - RNA, 19 nt, Salmonella typhimurium LT2
uaaaucauuuguacaaaaa

SEQ ID NO: 3773661 - RNA, 12 nt, Salmonella typhimurium LT2
uaaauccagcgc

SEQ ID NO: 3773662 - RNA, 14 nt, Salmonella typhimurium LT2
uaaauccgccagug

SEQ ID NO: 3773663 - RNA, 21 nt, Salmonella typhimurium LT2
uaaaucugaaauaaaagcaau

SEQ ID NO: 3773664 - RNA, 13 nt, Salmonella typhimurium LT2
uaaaucugccguc

SEQ ID NO: 3773665 - RNA, 14 nt, Salmonella typhimurium LT2
uaaaugacgcgcga

SEQ ID NO: 3773666 - RNA, 16 nt, Salmonella typhimurium LT2
uaaaugcauagcccca

SEQ ID NO: 3773667 - RNA, 22 nt, Salmonella typhimurium LT2
uaaaugcgguuaauuggcccuu

SEQ ID NO: 3773668 - RNA, 23 nt, Salmonella typhimurium LT2
uaacgcguccaacuggcuuucau

SEQ ID NO: 3773669 - RNA, 23 nt, Salmonella typhimurium LT2
uaacgcgugcucuuuuucgccuu

SEQ ID NO: 3773670 - RNA, 21 nt, Salmonella typhimurium LT2
uaacgcuggaagaggcgccug

SEQ ID NO: 3773671 - RNA, 21 nt, Salmonella typhimurium LT2
uaacgcuguaccggcagguga

SEQ ID NO: 3773672 - RNA, 15 nt, Salmonella typhimurium LT2
uaacgcuucaccucu

SEQ ID NO: 3773673 - RNA, 23 nt, Salmonella typhimurium LT2
uaacggcgaaaagcuggcugaca

SEQ ID NO: 3773674 - RNA, 19 nt, Salmonella typhimurium LT2
uaacguacagguugugcau

SEQ ID NO: 3773675 - RNA, 18 nt, Salmonella typhimurium LT2
uaacguagcaaucucuau

SEQ ID NO: 3773676 - RNA, 17 nt, Salmonella typhimurium LT2
uaacgucaccgcuuuuu

SEQ ID NO: 3773677 - RNA, 17 nt, Salmonella typhimurium LT2
uaacguccggcguccug

SEQ ID NO: 3773678 - RNA, 18 nt, Salmonella typhimurium LT2
uaacguccugggcugcca

SEQ ID NO: 3773679 - RNA, 20 nt, Salmonella typhimurium LT2
uaacguccugggcugccagg

SEQ ID NO: 3773680 - RNA, 15 nt, Salmonella typhimurium LT2
uaacgucgccaucag

SEQ ID NO: 3773681 - RNA, 18 nt, Salmonella typhimurium LT2
uaacgucgucauucaugg

SEQ ID NO: 3773682 - RNA, 22 nt, Salmonella typhimurium LT2
uaacguguuuucgauuucauuc

SEQ ID NO: 3773683 - RNA, 17 nt, Salmonella typhimurium LT2
uaacguuaacgccgcau

SEQ ID NO: 3773684 - RNA, 15 nt, Salmonella typhimurium LT2
uaacguuaaggaaac

SEQ ID NO: 3773685 - RNA, 16 nt, Salmonella typhimurium LT2
uaacguucuuaauacc

SEQ ID NO: 3773686 - RNA, 17 nt, Salmonella typhimurium LT2
uaacguuuaaugucacc

SEQ ID NO: 3773687 - RNA, 13 nt, Salmonella typhimurium LT2
uaacuaaaauacu

SEQ ID NO: 3773688 - RNA, 18 nt, Salmonella typhimurium LT2
uaacucaauagcggcgcu

SEQ ID NO: 3773689 - RNA, 16 nt, Salmonella typhimurium LT2
uaacuccagcaucauu

SEQ ID NO: 3773690 - RNA, 19 nt, Salmonella typhimurium LT2
uaacuccuucuaauuccag

SEQ ID NO: 3773691 - RNA, 22 nt, Salmonella typhimurium LT2
uaacuccuucuaauuccaggau

SEQ ID NO: 3773692 - RNA, 15 nt, Salmonella typhimurium LT2
uaacucucucuguaa

SEQ ID NO: 3773693 - RNA, 13 nt, Salmonella typhimurium LT2
uaacucuucaucg

SEQ ID NO: 3773694 - RNA, 19 nt, Salmonella typhimurium LT2
uaacucuuccgcaaucaca

SEQ ID NO: 3773695 - RNA, 17 nt, Salmonella typhimurium LT2
uaacugaagguuuuucc

SEQ ID NO: 3773696 - RNA, 13 nt, Salmonella typhimurium LT2
uaacugacagacu

SEQ ID NO: 3773697 - RNA, 15 nt, Salmonella typhimurium LT2
uaacugcaaacgcgg

SEQ ID NO: 3773698 - RNA, 21 nt, Salmonella typhimurium LT2
uaacugcaaaucuucggcaaa

SEQ ID NO: 3773699 - RNA, 20 nt, Salmonella typhimurium LT2
uaacugcgguaaauaaugcg

SEQ ID NO: 3773700 - RNA, 13 nt, Salmonella typhimurium LT2
uaacuggaaaaag

SEQ ID NO: 3773701 - RNA, 16 nt, Salmonella typhimurium LT2
uaacuggaaaaagacc

SEQ ID NO: 3773702 - RNA, 21 nt, Salmonella typhimurium LT2
uaacuggaaaaagaccaauac

SEQ ID NO: 3773703 - RNA, 16 nt, Salmonella typhimurium LT2
uaacuggacaacauuu

SEQ ID NO: 3773704 - RNA, 20 nt, Salmonella typhimurium LT2
uaacuggacaacauuucgca

SEQ ID NO: 3773705 - RNA, 20 nt, Salmonella typhimurium LT2
uaacuggucaaacaaaucau

SEQ ID NO: 3773706 - RNA, 22 nt, Salmonella typhimurium LT2
uaacuuaaacgccggauuccag

SEQ ID NO: 3773707 - RNA, 17 nt, Salmonella typhimurium LT2
uaacuuauccacgcccu

SEQ ID NO: 3773708 - RNA, 15 nt, Salmonella typhimurium LT2
uaacuucagcaucau

SEQ ID NO: 3773709 - RNA, 20 nt, Salmonella typhimurium LT2
uaacuucagcaucaucuccc

SEQ ID NO: 3773710 - RNA, 23 nt, Salmonella typhimurium LT2
uaacuuccuuugccuuucuuauu

SEQ ID NO: 3773711 - RNA, 16 nt, Salmonella typhimurium LT2
uaacuucggccagcga

SEQ ID NO: 3773712 - RNA, 18 nt, Salmonella typhimurium LT2
uaacuucuccuccaucag

SEQ ID NO: 3773713 - RNA, 15 nt, Salmonella typhimurium LT2
uaacuucugcaggga

SEQ ID NO: 3773714 - RNA, 22 nt, Salmonella typhimurium LT2
uaacuucuuaauggauucuguu

SEQ ID NO: 3773715 - RNA, 21 nt, Salmonella typhimurium LT2
uaagaaacugagugugucuuu

SEQ ID NO: 3773716 - RNA, 16 nt, Salmonella typhimurium LT2
uaagaaagauaaaaua

SEQ ID NO: 3773717 - RNA, 13 nt, Salmonella typhimurium LT2
uaagaacgagaac

SEQ ID NO: 3773718 - RNA, 15 nt, Salmonella typhimurium LT2
uaagaaguaaacaga

SEQ ID NO: 3773719 - RNA, 19 nt, Salmonella typhimurium LT2
uaagaaguaaacagaauca

SEQ ID NO: 3773720 - RNA, 19 nt, Salmonella typhimurium LT2
uaagaagucugugaggaaa

SEQ ID NO: 3773721 - RNA, 20 nt, Salmonella typhimurium LT2
uaagaaugcgcgucaggcca

SEQ ID NO: 3773722 - RNA, 19 nt, Salmonella typhimurium LT2
uaagaauuauuaccaauga

SEQ ID NO: 3773723 - RNA, 19 nt, Salmonella typhimurium LT2
uaagaauucguccagauga

SEQ ID NO: 3773724 - RNA, 14 nt, Salmonella typhimurium LT2
uaagaccagcauca

SEQ ID NO: 3773725 - RNA, 16 nt, Salmonella typhimurium LT2
uaagacgcuacgcguc

SEQ ID NO: 3773726 - RNA, 17 nt, Salmonella typhimurium LT2
uaagacguuuacgccgc

SEQ ID NO: 3773727 - RNA, 17 nt, Salmonella typhimurium LT2
uaagagccuaucccacc

SEQ ID NO: 3773728 - RNA, 19 nt, Salmonella typhimurium LT2
uaagaguccauucggccug

SEQ ID NO: 3773729 - RNA, 20 nt, Salmonella typhimurium LT2
uaagauauuuuguuuuaaau

SEQ ID NO: 3773730 - RNA, 14 nt, Salmonella typhimurium LT2
uaagauccugacuc

SEQ ID NO: 3773731 - RNA, 14 nt, Salmonella typhimurium LT2
uaagaugcggaugc

SEQ ID NO: 3773732 - RNA, 18 nt, Salmonella typhimurium LT2
uaagaugcggaugccgca

SEQ ID NO: 3773733 - RNA, 23 nt, Salmonella typhimurium LT2
uaagauucccccgcaugaaaugc

SEQ ID NO: 3773734 - RNA, 18 nt, Salmonella typhimurium LT2
uaagcaaaggcgguuuua

SEQ ID NO: 3773735 - RNA, 18 nt, Salmonella typhimurium LT2
uaagcaacugauuaaucu

SEQ ID NO: 3773736 - RNA, 14 nt, Salmonella typhimurium LT2
uaagcaauauggcu

SEQ ID NO: 3773737 - RNA, 19 nt, Salmonella typhimurium LT2
uaagcaauuacggacagaa

SEQ ID NO: 3773738 - RNA, 14 nt, Salmonella typhimurium LT2
uaagcacaggccau

SEQ ID NO: 3773739 - RNA, 18 nt, Salmonella typhimurium LT2
uaagcaccggcgggcuga

SEQ ID NO: 3773740 - RNA, 18 nt, Salmonella typhimurium LT2
uaagcaccugcgacgcau

SEQ ID NO: 3773741 - RNA, 21 nt, Salmonella typhimurium LT2
uaagcagugagauugacagaa

SEQ ID NO: 3773742 - RNA, 15 nt, Salmonella typhimurium LT2
uaagcauccaggaag

SEQ ID NO: 3773743 - RNA, 13 nt, Salmonella typhimurium LT2
uaagcauccccac

SEQ ID NO: 3773744 - RNA, 23 nt, Salmonella typhimurium LT2
uaagcauuagcgccauccggcac

SEQ ID NO: 3773745 - RNA, 21 nt, Salmonella typhimurium LT2
uaagccagcccugccaccagc

SEQ ID NO: 3773746 - RNA, 19 nt, Salmonella typhimurium LT2
uaagccaugugacggcaug

SEQ ID NO: 3773747 - RNA, 23 nt, Salmonella typhimurium LT2
uaagcccauggcaggcagcacaa

SEQ ID NO: 3773748 - RNA, 18 nt, Salmonella typhimurium LT2
uaagccuggcauaacauu

SEQ ID NO: 3773749 - RNA, 18 nt, Salmonella typhimurium LT2
uaagcgcaaacuuccaca

SEQ ID NO: 3773750 - RNA, 15 nt, Salmonella typhimurium LT2
uaagcgcagcgccau

SEQ ID NO: 3773751 - RNA, 22 nt, Salmonella typhimurium LT2
uaagcgcagcgccaucaggccu

SEQ ID NO: 3773752 - RNA, 22 nt, Salmonella typhimurium LT2
uaagcgcccguccaugaguagc

SEQ ID NO: 3773753 - RNA, 13 nt, Salmonella typhimurium LT2
uaagcgccgcuga

SEQ ID NO: 3773754 - RNA, 14 nt, Salmonella typhimurium LT2
uaagcgcucaggca

SEQ ID NO: 3773755 - RNA, 18 nt, Salmonella typhimurium LT2
uaagcguucaucaggcau

SEQ ID NO: 3773756 - RNA, 16 nt, Salmonella typhimurium LT2
uaagcuauguuuuuau

SEQ ID NO: 3773757 - RNA, 18 nt, Salmonella typhimurium LT2
uaagcugagccuucaccg

SEQ ID NO: 3773758 - RNA, 23 nt, Salmonella typhimurium LT2
uaagcuggcgaacguuacccggc

SEQ ID NO: 3773759 - RNA, 15 nt, Salmonella typhimurium LT2
uaagcuuauccugcc

SEQ ID NO: 3773760 - RNA, 15 nt, Salmonella typhimurium LT2
uaaggacauucagca

SEQ ID NO: 3773761 - RNA, 21 nt, Salmonella typhimurium LT2
uaaggacauucagcacgcuuu

SEQ ID NO: 3773762 - RNA, 14 nt, Salmonella typhimurium LT2
uaaggaucggaaga

SEQ ID NO: 3773763 - RNA, 16 nt, Salmonella typhimurium LT2
uaaggcaaacaaggca

SEQ ID NO: 3773764 - RNA, 12 nt, Salmonella typhimurium LT2
uaaggcagccau

SEQ ID NO: 3773765 - RNA, 13 nt, Salmonella typhimurium LT2
uaaggcaggcaaa

SEQ ID NO: 3773766 - RNA, 15 nt, Salmonella typhimurium LT2
uaaggcccuggcuca

SEQ ID NO: 3773767 - RNA, 22 nt, Salmonella typhimurium LT2
uaaggccggcauuuuauucaua

SEQ ID NO: 3773768 - RNA, 14 nt, Salmonella typhimurium LT2
uaaggcgaagucgc

SEQ ID NO: 3773769 - RNA, 20 nt, Salmonella typhimurium LT2
uaaggcgauaccuaaucccu

SEQ ID NO: 3773770 - RNA, 15 nt, Salmonella typhimurium LT2
uaaggcugauuauau

SEQ ID NO: 3773771 - RNA, 15 nt, Salmonella typhimurium LT2
uaaugacauccagag

SEQ ID NO: 3773772 - RNA, 20 nt, Salmonella typhimurium LT2
uaaugacccagucgggaaac

SEQ ID NO: 3773773 - RNA, 21 nt, Salmonella typhimurium LT2
uaaugagaccagcgucgccug

SEQ ID NO: 3773774 - RNA, 19 nt, Salmonella typhimurium LT2
uaaugagcgucgccagacc

SEQ ID NO: 3773775 - RNA, 21 nt, Salmonella typhimurium LT2
uaaugaguacggguauuccag

SEQ ID NO: 3773776 - RNA, 22 nt, Salmonella typhimurium LT2
uaaugaucguaugcagccaggc

SEQ ID NO: 3773777 - RNA, 20 nt, Salmonella typhimurium LT2
uaaugauguuggggagaauu

SEQ ID NO: 3773778 - RNA, 17 nt, Salmonella typhimurium LT2
uaaugcaauaaacuaag

SEQ ID NO: 3773779 - RNA, 15 nt, Salmonella typhimurium LT2
uaaugcauggcagau

SEQ ID NO: 3773780 - RNA, 14 nt, Salmonella typhimurium LT2
uaaugccaaaaugg

SEQ ID NO: 3773781 - RNA, 16 nt, Salmonella typhimurium LT2
uaaugccacgagaaau

SEQ ID NO: 3773782 - RNA, 17 nt, Salmonella typhimurium LT2
uaaugcccaccgauuuc

SEQ ID NO: 3773783 - RNA, 18 nt, Salmonella typhimurium LT2
uaaugccgucaucagcaa

SEQ ID NO: 3773784 - RNA, 18 nt, Salmonella typhimurium LT2
uaaugccuaucuugauau

SEQ ID NO: 3773785 - RNA, 22 nt, Salmonella typhimurium LT2
uaaugccuggagccagccugag

SEQ ID NO: 3773786 - RNA, 14 nt, Salmonella typhimurium LT2
uaaugccuggcagu

SEQ ID NO: 3773787 - RNA, 17 nt, Salmonella typhimurium LT2
uaaugccuguguaucgc

SEQ ID NO: 3773788 - RNA, 16 nt, Salmonella typhimurium LT2
uaaugccuucugaaaa

SEQ ID NO: 3773789 - RNA, 22 nt, Salmonella typhimurium LT2
uaaugcgaaaaacgggagauug

SEQ ID NO: 3773790 - RNA, 14 nt, Salmonella typhimurium LT2
uaaugcgaaaaaua

SEQ ID NO: 3773791 - RNA, 18 nt, Salmonella typhimurium LT2
uaaugcgaaaauaaaggu

SEQ ID NO: 3773792 - RNA, 16 nt, Salmonella typhimurium LT2
uaaugcugcaccacac

SEQ ID NO: 3773793 - RNA, 15 nt, Salmonella typhimurium LT2
uaaugcugccagcau

SEQ ID NO: 3773794 - RNA, 14 nt, Salmonella typhimurium LT2
uaaugcuugcugcu

SEQ ID NO: 3773795 - RNA, 15 nt, Salmonella typhimurium LT2
uaaugcuuuaaaugc

SEQ ID NO: 3773796 - RNA, 17 nt, Salmonella typhimurium LT2
uaaugcuuuaaaugccu

SEQ ID NO: 3773797 - RNA, 21 nt, Salmonella typhimurium LT2
uaauggauucucgcgccgggg

SEQ ID NO: 3773798 - RNA, 19 nt, Salmonella typhimurium LT2
uaauggcagaauaaaacag

SEQ ID NO: 3773799 - RNA, 18 nt, Salmonella typhimurium LT2
uaauggcauaacgcugua

SEQ ID NO: 3773800 - RNA, 19 nt, Salmonella typhimurium LT2
uaauggccuguaccgcuuc

SEQ ID NO: 3773801 - RNA, 17 nt, Salmonella typhimurium LT2
uaauggcgcgaaaacag

SEQ ID NO: 3773802 - RNA, 18 nt, Salmonella typhimurium LT2
uaauggcgcgaaaacagc

SEQ ID NO: 3773803 - RNA, 19 nt, Salmonella typhimurium LT2
uaaugguaccaauagccuu

SEQ ID NO: 3773804 - RNA, 19 nt, Salmonella typhimurium LT2
uaauggucagaucugcgcc

SEQ ID NO: 3773805 - RNA, 18 nt, Salmonella typhimurium LT2
uaauggucucgccgauag

SEQ ID NO: 3773806 - RNA, 19 nt, Salmonella typhimurium LT2
uaauguaaaggugagcucu

SEQ ID NO: 3773807 - RNA, 20 nt, Salmonella typhimurium LT2
uaaugucaccaucaucgaua

SEQ ID NO: 3773808 - RNA, 14 nt, Salmonella typhimurium LT2
uaaugucccugcca

SEQ ID NO: 3773809 - RNA, 16 nt, Salmonella typhimurium LT2
uaaugugauccgcccc

SEQ ID NO: 3773810 - RNA, 17 nt, Salmonella typhimurium LT2
uaauguuaggaguaaau

SEQ ID NO: 3773811 - RNA, 15 nt, Salmonella typhimurium LT2
uaauguugccguggc

SEQ ID NO: 3773812 - RNA, 14 nt, Salmonella typhimurium LT2
uaauguuuacgcca

SEQ ID NO: 3773813 - RNA, 13 nt, Salmonella typhimurium LT2
uaauuagagacau

SEQ ID NO: 3773814 - RNA, 21 nt, Salmonella typhimurium LT2
uaauuauuccauuuuaaccuu

SEQ ID NO: 3773815 - RNA, 14 nt, Salmonella typhimurium LT2
uaauucaaccggcg

SEQ ID NO: 3773816 - RNA, 14 nt, Salmonella typhimurium LT2
uaauucacaacuga

SEQ ID NO: 3773817 - RNA, 16 nt, Salmonella typhimurium LT2
uaauucauaacaccaa

SEQ ID NO: 3773818 - RNA, 18 nt, Salmonella typhimurium LT2
uaauucauaacaccaaua

SEQ ID NO: 3773819 - RNA, 17 nt, Salmonella typhimurium LT2
uaauuccgcaucauuca

SEQ ID NO: 3773820 - RNA, 22 nt, Salmonella typhimurium LT2
uaauucgggcgguugccacucu

SEQ ID NO: 3773821 - RNA, 23 nt, Salmonella typhimurium LT2
uaauugcccccuuuuuauucaua

SEQ ID NO: 3773822 - RNA, 21 nt, Salmonella typhimurium LT2
uaauugccugacgaaaacccg

SEQ ID NO: 3773823 - RNA, 22 nt, Salmonella typhimurium LT2
uaauugccuggcagcuugccuu

SEQ ID NO: 3773824 - RNA, 18 nt, Salmonella typhimurium LT2
uaauugcuuuuuuccaca

SEQ ID NO: 3773825 - RNA, 16 nt, Salmonella typhimurium LT2
uaauuggcauccagca

SEQ ID NO: 3773826 - RNA, 19 nt, Salmonella typhimurium LT2
uaauuguggaaauaagagu

SEQ ID NO: 3773827 - RNA, 14 nt, Salmonella typhimurium LT2
uaauuuaauaauaa

SEQ ID NO: 3773828 - RNA, 18 nt, Salmonella typhimurium LT2
uaauuuaauaauaaauuu

SEQ ID NO: 3773829 - RNA, 17 nt, Salmonella typhimurium LT2
uaauuuauauugugccu

SEQ ID NO: 3773830 - RNA, 15 nt, Salmonella typhimurium LT2
uaauuuauccaguaa

SEQ ID NO: 3773831 - RNA, 17 nt, Salmonella typhimurium LT2
uaauuuuacuuucauuc

SEQ ID NO: 3773832 - RNA, 18 nt, Salmonella typhimurium LT2
uaauuuuacuuucauucc

SEQ ID NO: 3773833 - RNA, 13 nt, Salmonella typhimurium LT2
uaauuuucaccuc

SEQ ID NO: 3773834 - RNA, 17 nt, Salmonella typhimurium LT2
uaauuuucaccuccggg

SEQ ID NO: 3773835 - RNA, 19 nt, Salmonella typhimurium LT2
uaauuuucccaguucaucc

SEQ ID NO: 3773836 - RNA, 20 nt, Salmonella typhimurium LT2
uaauuuucccaguucaucca

SEQ ID NO: 3773837 - RNA, 20 nt, Salmonella typhimurium LT2
uaauuuucgcaaacuggucg

SEQ ID NO: 3773838 - RNA, 14 nt, Salmonella typhimurium LT2
uaauuuucuuuuau

SEQ ID NO: 3773839 - RNA, 15 nt, Salmonella typhimurium LT2
uaauuuucuuuuauu

SEQ ID NO: 3773840 - RNA, 16 nt, Salmonella typhimurium LT2
uaauuuugccaucgcg

SEQ ID NO: 3773841 - RNA, 19 nt, Salmonella typhimurium LT2
uaauuuuguuaaagugagu

SEQ ID NO: 3773842 - RNA, 19 nt, Salmonella typhimurium LT2
uacaaaaaagacagcaucu

SEQ ID NO: 3773843 - RNA, 12 nt, Salmonella typhimurium LT2
uacaaaaugacg

SEQ ID NO: 3773844 - RNA, 13 nt, Salmonella typhimurium LT2
uacaaacaaauaa

SEQ ID NO: 3773845 - RNA, 22 nt, Salmonella typhimurium LT2
uacaaacacgucuuugcugcca

SEQ ID NO: 3773846 - RNA, 23 nt, Salmonella typhimurium LT2
uacaaacgcaccgccaaacgcgg

SEQ ID NO: 3773847 - RNA, 23 nt, Salmonella typhimurium LT2
uacaaagcagauagagcauaaua

SEQ ID NO: 3773848 - RNA, 21 nt, Salmonella typhimurium LT2
uacaaauuacacaauaucaau

SEQ ID NO: 3773849 - RNA, 13 nt, Salmonella typhimurium LT2
uacaacaauaaug

SEQ ID NO: 3773850 - RNA, 19 nt, Salmonella typhimurium LT2
uacaaccucaaauaagguu

SEQ ID NO: 3773851 - RNA, 15 nt, Salmonella typhimurium LT2
uacaagauuugcaau

SEQ ID NO: 3773852 - RNA, 16 nt, Salmonella typhimurium LT2
uacaagauuugcaaua

SEQ ID NO: 3773853 - RNA, 23 nt, Salmonella typhimurium LT2
uacaagcguugaauuccaucggc

SEQ ID NO: 3773854 - RNA, 15 nt, Salmonella typhimurium LT2
uacaaguucagcagg

SEQ ID NO: 3773855 - RNA, 23 nt, Salmonella typhimurium LT2
uacaaguucagcaggcuacggua

SEQ ID NO: 3773856 - RNA, 22 nt, Salmonella typhimurium LT2
uacaauauugcgcgcuauguuc

SEQ ID NO: 3773857 - RNA, 22 nt, Salmonella typhimurium LT2
uacaauggcaggcauagacauc

SEQ ID NO: 3773858 - RNA, 21 nt, Salmonella typhimurium LT2
uacaauuauugcguugcuuua

SEQ ID NO: 3773859 - RNA, 15 nt, Salmonella typhimurium LT2
uacacaagcuaaaaa

SEQ ID NO: 3773860 - RNA, 15 nt, Salmonella typhimurium LT2
uacacacuuaccgac

SEQ ID NO: 3773861 - RNA, 17 nt, Salmonella typhimurium LT2
uacacauggagaacaga

SEQ ID NO: 3773862 - RNA, 19 nt, Salmonella typhimurium LT2
uacacauuuuaaaccaauc

SEQ ID NO: 3773863 - RNA, 22 nt, Salmonella typhimurium LT2
uacacauuuuauccggcgucac

SEQ ID NO: 3773864 - RNA, 17 nt, Salmonella typhimurium LT2
uacaccauuggcgcugg

SEQ ID NO: 3773865 - RNA, 18 nt, Salmonella typhimurium LT2
uacaccccuucuggagaa

SEQ ID NO: 3773866 - RNA, 15 nt, Salmonella typhimurium LT2
uacaccguuucugau

SEQ ID NO: 3773867 - RNA, 20 nt, Salmonella typhimurium LT2
uacaccugacggcagccacg

SEQ ID NO: 3773868 - RNA, 22 nt, Salmonella typhimurium LT2
uacaccuuauccggccugcgaa

SEQ ID NO: 3773869 - RNA, 18 nt, Salmonella typhimurium LT2
uacaccuucacauuggca

SEQ ID NO: 3773870 - RNA, 16 nt, Salmonella typhimurium LT2
uacacgauuaaccuca

SEQ ID NO: 3773871 - RNA, 23 nt, Salmonella typhimurium LT2
uacacgcaucgggucgcgugccg

SEQ ID NO: 3773872 - RNA, 21 nt, Salmonella typhimurium LT2
uacacgcgacaaugccauaaa

SEQ ID NO: 3773873 - RNA, 14 nt, Salmonella typhimurium LT2
uacacgucgguaua

SEQ ID NO: 3773874 - RNA, 19 nt, Salmonella typhimurium LT2
uacccgcgccgguucuccc

SEQ ID NO: 3773875 - RNA, 17 nt, Salmonella typhimurium LT2
uacccgcucggcauaca

SEQ ID NO: 3773876 - RNA, 20 nt, Salmonella typhimurium LT2
uacccggccuacacaucauc

SEQ ID NO: 3773877 - RNA, 18 nt, Salmonella typhimurium LT2
uacccggccuacaucguc

SEQ ID NO: 3773878 - RNA, 14 nt, Salmonella typhimurium LT2
uacccggcucccau

SEQ ID NO: 3773879 - RNA, 21 nt, Salmonella typhimurium LT2
uacccgguguaaaaaaugggu

SEQ ID NO: 3773880 - RNA, 19 nt, Salmonella typhimurium LT2
uacccguguggcugugcga

SEQ ID NO: 3773881 - RNA, 20 nt, Salmonella typhimurium LT2
uacccuauuuacagagcaau

SEQ ID NO: 3773882 - RNA, 18 nt, Salmonella typhimurium LT2
uacccuccgccauagccu

SEQ ID NO: 3773883 - RNA, 17 nt, Salmonella typhimurium LT2
uacccuguauuuuuucc

SEQ ID NO: 3773884 - RNA, 18 nt, Salmonella typhimurium LT2
uacccuguauuuuuucca

SEQ ID NO: 3773885 - RNA, 20 nt, Salmonella typhimurium LT2
uacccuucacggucaaacgc

SEQ ID NO: 3773886 - RNA, 14 nt, Salmonella typhimurium LT2
uaccgaacaaugug

SEQ ID NO: 3773887 - RNA, 17 nt, Salmonella typhimurium LT2
uaccgaacaaugugcgg

SEQ ID NO: 3773888 - RNA, 15 nt, Salmonella typhimurium LT2
uaccgaacagccagg

SEQ ID NO: 3773889 - RNA, 17 nt, Salmonella typhimurium LT2
uaccgaacagccaggcu

SEQ ID NO: 3773890 - RNA, 16 nt, Salmonella typhimurium LT2
uaccgacacaucaucg

SEQ ID NO: 3773891 - RNA, 19 nt, Salmonella typhimurium LT2
uaccgauaaaucaaacgca

SEQ ID NO: 3773892 - RNA, 20 nt, Salmonella typhimurium LT2
uaccgauaaaucaaacgcac

SEQ ID NO: 3773893 - RNA, 14 nt, Salmonella typhimurium LT2
uaccgauagcgcgg

SEQ ID NO: 3773894 - RNA, 15 nt, Salmonella typhimurium LT2
uaccgauagcgcgga

SEQ ID NO: 3773895 - RNA, 20 nt, Salmonella typhimurium LT2
uaccgcagauaacaggcaau

SEQ ID NO: 3773896 - RNA, 18 nt, Salmonella typhimurium LT2
uaccgcagcgaaugugcu

SEQ ID NO: 3773897 - RNA, 15 nt, Salmonella typhimurium LT2
uaccgccaaacgccg

SEQ ID NO: 3773898 - RNA, 21 nt, Salmonella typhimurium LT2
uaccgccaccuuucugcucca

SEQ ID NO: 3773899 - RNA, 16 nt, Salmonella typhimurium LT2
uaccgccauccggcau

SEQ ID NO: 3773900 - RNA, 19 nt, Salmonella typhimurium LT2
uaccgccguuucguugcca

SEQ ID NO: 3773901 - RNA, 17 nt, Salmonella typhimurium LT2
uaccgccuucagcgcgc

SEQ ID NO: 3773902 - RNA, 14 nt, Salmonella typhimurium LT2
uaccgcgccaggcg

SEQ ID NO: 3773903 - RNA, 18 nt, Salmonella typhimurium LT2
uaccgcucacaaugccgc

SEQ ID NO: 3773904 - RNA, 22 nt, Salmonella typhimurium LT2
uaccgcuucuuaauggccagua

SEQ ID NO: 3773905 - RNA, 20 nt, Salmonella typhimurium LT2
uaccgcuugggccaccugcc

SEQ ID NO: 3773906 - RNA, 23 nt, Salmonella typhimurium LT2
uaccgcuugggccaccugccagg

SEQ ID NO: 3773907 - RNA, 20 nt, Salmonella typhimurium LT2
uaccggaaucgccugcgucg

SEQ ID NO: 3773908 - RNA, 14 nt, Salmonella typhimurium LT2
uaccggcacaccgg

SEQ ID NO: 3773909 - RNA, 17 nt, Salmonella typhimurium LT2
uaccggcaccagcaaug

SEQ ID NO: 3773910 - RNA, 23 nt, Salmonella typhimurium LT2
uaccggcaggugauggcggcuug

SEQ ID NO: 3773911 - RNA, 15 nt, Salmonella typhimurium LT2
uaccggcaucacgcc

SEQ ID NO: 3773912 - RNA, 20 nt, Salmonella typhimurium LT2
uaccggcgcgcgccagcucg

SEQ ID NO: 3773913 - RNA, 18 nt, Salmonella typhimurium LT2
uaccggcgcucagccaga

SEQ ID NO: 3773914 - RNA, 17 nt, Salmonella typhimurium LT2
uaccggcgguaauuuac

SEQ ID NO: 3773915 - RNA, 16 nt, Salmonella typhimurium LT2
uaccgggcuaaaccac

SEQ ID NO: 3773916 - RNA, 16 nt, Salmonella typhimurium LT2
uaccgggcuuacagcg

SEQ ID NO: 3773917 - RNA, 23 nt, Salmonella typhimurium LT2
uaccgguuuuauaggccgguaug

SEQ ID NO: 3773918 - RNA, 15 nt, Salmonella typhimurium LT2
uaccgucaaaacgcc

SEQ ID NO: 3773919 - RNA, 15 nt, Salmonella typhimurium LT2
uaccgucagcagcac

SEQ ID NO: 3773920 - RNA, 21 nt, Salmonella typhimurium LT2
uaccguccggaucgacggcaa

SEQ ID NO: 3773921 - RNA, 15 nt, Salmonella typhimurium LT2
uaccgucgagaaacc

SEQ ID NO: 3773922 - RNA, 22 nt, Salmonella typhimurium LT2
uaccgucguuaaagcggauacu

SEQ ID NO: 3773923 - RNA, 20 nt, Salmonella typhimurium LT2
uaccgugcaaaaucacgcgg

SEQ ID NO: 3773924 - RNA, 20 nt, Salmonella typhimurium LT2
uaccgugugcagugacagag

SEQ ID NO: 3773925 - RNA, 17 nt, Salmonella typhimurium LT2
uaccguuggaauaaauc

SEQ ID NO: 3773926 - RNA, 15 nt, Salmonella typhimurium LT2
uaccuaccagcgcgc

SEQ ID NO: 3773927 - RNA, 17 nt, Salmonella typhimurium LT2
uaccuaccagcgcgcca

SEQ ID NO: 3773928 - RNA, 18 nt, Salmonella typhimurium LT2
uaccuacgcgauaaaaaa

SEQ ID NO: 3773929 - RNA, 18 nt, Salmonella typhimurium LT2
uaccuaucggaagaaaac

SEQ ID NO: 3773930 - RNA, 20 nt, Salmonella typhimurium LT2
uaccuauuuguuccggcaag

SEQ ID NO: 3773931 - RNA, 13 nt, Salmonella typhimurium LT2
uaccuauuuuaaa

SEQ ID NO: 3773932 - RNA, 22 nt, Salmonella typhimurium LT2
uaccuauuuuaaauucccagcg

SEQ ID NO: 3773933 - RNA, 21 nt, Salmonella typhimurium LT2
uaccucaaaaaccaguugcca

SEQ ID NO: 3773934 - RNA, 15 nt, Salmonella typhimurium LT2
uaccucaaauauuga

SEQ ID NO: 3773935 - RNA, 20 nt, Salmonella typhimurium LT2
uaccuccucucuuccuccug

SEQ ID NO: 3773936 - RNA, 14 nt, Salmonella typhimurium LT2
uaccugaaaccagg

SEQ ID NO: 3773937 - RNA, 14 nt, Salmonella typhimurium LT2
uaccugauaaaacu

SEQ ID NO: 3773938 - RNA, 11 nt, Salmonella typhimurium LT2
uaccugaucca

SEQ ID NO: 3773939 - RNA, 20 nt, Salmonella typhimurium LT2
uaccugccgccauaacgccg

SEQ ID NO: 3773940 - RNA, 19 nt, Salmonella typhimurium LT2
uaccugccugucuuuucuc

SEQ ID NO: 3773941 - RNA, 14 nt, Salmonella typhimurium LT2
uaccugguauuauu

SEQ ID NO: 3773942 - RNA, 15 nt, Salmonella typhimurium LT2
uaccuucacaaaaag

SEQ ID NO: 3773943 - RNA, 21 nt, Salmonella typhimurium LT2
uaccuucgcguuuaucaccaa

SEQ ID NO: 3773944 - RNA, 14 nt, Salmonella typhimurium LT2
uaccuuguucuucc

SEQ ID NO: 3773945 - RNA, 15 nt, Salmonella typhimurium LT2
uaccuuguucuucca

SEQ ID NO: 3773946 - RNA, 16 nt, Salmonella typhimurium LT2
uaccuuguucuuccau

SEQ ID NO: 3773947 - RNA, 19 nt, Salmonella typhimurium LT2
uaccuuuaaacuguuucca

SEQ ID NO: 3773948 - RNA, 23 nt, Salmonella typhimurium LT2
uaccuuuuccggcggcaguccca

SEQ ID NO: 3773949 - RNA, 18 nt, Salmonella typhimurium LT2
uacgaaguuuaauucauu

SEQ ID NO: 3773950 - RNA, 19 nt, Salmonella typhimurium LT2
uacgacacccgauacacgc

SEQ ID NO: 3773951 - RNA, 16 nt, Salmonella typhimurium LT2
uacgaccgcagaaaca

SEQ ID NO: 3773952 - RNA, 21 nt, Salmonella typhimurium LT2
uacgacucaauacauucagua

SEQ ID NO: 3773953 - RNA, 14 nt, Salmonella typhimurium LT2
uacgacuuacgcag

SEQ ID NO: 3773954 - RNA, 17 nt, Salmonella typhimurium LT2
uacgacuuacgcagcau

SEQ ID NO: 3773955 - RNA, 16 nt, Salmonella typhimurium LT2
uacgaucgccaccgca

SEQ ID NO: 3773956 - RNA, 15 nt, Salmonella typhimurium LT2
uacgaucguuugccc

SEQ ID NO: 3773957 - RNA, 12 nt, Salmonella typhimurium LT2
uacgauguauca

SEQ ID NO: 3773958 - RNA, 22 nt, Salmonella typhimurium LT2
uacgauguaucacguuuuuuac

SEQ ID NO: 3773959 - RNA, 16 nt, Salmonella typhimurium LT2
uacgcaaaaaaagcca

SEQ ID NO: 3773960 - RNA, 21 nt, Salmonella typhimurium LT2
uacgcaccagcucuacaucgc

SEQ ID NO: 3773961 - RNA, 21 nt, Salmonella typhimurium LT2
uacgcagaaccgccgcgauag

SEQ ID NO: 3773962 - RNA, 18 nt, Salmonella typhimurium LT2
uacgcagcacuuucgcuu

SEQ ID NO: 3773963 - RNA, 14 nt, Salmonella typhimurium LT2
uacgcagcaggcag

SEQ ID NO: 3773964 - RNA, 16 nt, Salmonella typhimurium LT2
uacgcagcaggcagac

SEQ ID NO: 3773965 - RNA, 16 nt, Salmonella typhimurium LT2
uacgcagccccauuug

SEQ ID NO: 3773966 - RNA, 18 nt, Salmonella typhimurium LT2
uacgcaggccauuucgcc

SEQ ID NO: 3773967 - RNA, 13 nt, Salmonella typhimurium LT2
uacgcaucaccag

SEQ ID NO: 3773968 - RNA, 14 nt, Salmonella typhimurium LT2
uacgcaucaccagg

SEQ ID NO: 3773969 - RNA, 17 nt, Salmonella typhimurium LT2
uacgcauuucaagcaga

SEQ ID NO: 3773970 - RNA, 15 nt, Salmonella typhimurium LT2
uacgccacggcuuaa

SEQ ID NO: 3773971 - RNA, 19 nt, Salmonella typhimurium LT2
uacgccagcagacagguga

SEQ ID NO: 3773972 - RNA, 20 nt, Salmonella typhimurium LT2
uacgccaucagggacgauag

SEQ ID NO: 3773973 - RNA, 14 nt, Salmonella typhimurium LT2
uacgcccacgcggc

SEQ ID NO: 3773974 - RNA, 22 nt, Salmonella typhimurium LT2
uacgcccagccgugaaugguca

SEQ ID NO: 3773975 - RNA, 15 nt, Salmonella typhimurium LT2
uacgccccacuuuca

SEQ ID NO: 3773976 - RNA, 18 nt, Salmonella typhimurium LT2
uacgcccucaucggcaaa

SEQ ID NO: 3773977 - RNA, 15 nt, Salmonella typhimurium LT2
uacgccgccagcaau

SEQ ID NO: 3773978 - RNA, 19 nt, Salmonella typhimurium LT2
uacuuauagcuggcuuuau

SEQ ID NO: 3773979 - RNA, 18 nt, Salmonella typhimurium LT2
uacuuaucaacuucuuca

SEQ ID NO: 3773980 - RNA, 22 nt, Salmonella typhimurium LT2
uacuucacaauaagaaauuuag

SEQ ID NO: 3773981 - RNA, 15 nt, Salmonella typhimurium LT2
uacuucauauuccga

SEQ ID NO: 3773982 - RNA, 20 nt, Salmonella typhimurium LT2
uacuucucgaaguucucaau

SEQ ID NO: 3773983 - RNA, 16 nt, Salmonella typhimurium LT2
uacuucugacagugac

SEQ ID NO: 3773984 - RNA, 17 nt, Salmonella typhimurium LT2
uacuugcgccgccaucc

SEQ ID NO: 3773985 - RNA, 21 nt, Salmonella typhimurium LT2
uacuuuauaaaucaggaaaaa

SEQ ID NO: 3773986 - RNA, 15 nt, Salmonella typhimurium LT2
uacuuucaaaauacu

SEQ ID NO: 3773987 - RNA, 16 nt, Salmonella typhimurium LT2
uacuuucccccagauu

SEQ ID NO: 3773988 - RNA, 14 nt, Salmonella typhimurium LT2
uacuuucuacaaau

SEQ ID NO: 3773989 - RNA, 17 nt, Salmonella typhimurium LT2
uacuuuggccuaacagu

SEQ ID NO: 3773990 - RNA, 14 nt, Salmonella typhimurium LT2
uacuuuguacugua

SEQ ID NO: 3773991 - RNA, 19 nt, Salmonella typhimurium LT2
uacuuuugaacauaaaguc

SEQ ID NO: 3773992 - RNA, 16 nt, Salmonella typhimurium LT2
uagaaaguacaucauu

SEQ ID NO: 3773993 - RNA, 22 nt, Salmonella typhimurium LT2
uagaaagucuuuuguuuuucuc

SEQ ID NO: 3773994 - RNA, 14 nt, Salmonella typhimurium LT2
uagaaccacuuauu

SEQ ID NO: 3773995 - RNA, 14 nt, Salmonella typhimurium LT2
uagaacccaaagcc

SEQ ID NO: 3773996 - RNA, 20 nt, Salmonella typhimurium LT2
uagaagcucaugugcagcau

SEQ ID NO: 3773997 - RNA, 18 nt, Salmonella typhimurium LT2
uagaaucccaccaauugc

SEQ ID NO: 3773998 - RNA, 20 nt, Salmonella typhimurium LT2
uagaaugaauuucuucaucc

SEQ ID NO: 3773999 - RNA, 11 nt, Salmonella typhimurium LT2
uagacaaacag

SEQ ID NO: 3774000 - RNA, 14 nt, Salmonella typhimurium LT2
uagacaaugcaggc

SEQ ID NO: 3774001 - RNA, 20 nt, Salmonella typhimurium LT2
uagacaaugcaggccggaua

SEQ ID NO: 3774002 - RNA, 13 nt, Salmonella typhimurium LT2
uagacacaaaugc

SEQ ID NO: 3774003 - RNA, 20 nt, Salmonella typhimurium LT2
uagacagcggcuaauuuauu

SEQ ID NO: 3774004 - RNA, 21 nt, Salmonella typhimurium LT2
uagacaguuuuuucguuccag

SEQ ID NO: 3774005 - RNA, 20 nt, Salmonella typhimurium LT2
uagaccagcgccggagcaaa

SEQ ID NO: 3774006 - RNA, 16 nt, Salmonella typhimurium LT2
uagaccagcggcccgc

SEQ ID NO: 3774007 - RNA, 20 nt, Salmonella typhimurium LT2
uagaccuggcucucggcaac

SEQ ID NO: 3774008 - RNA, 22 nt, Salmonella typhimurium LT2
uagaccuguuccaugacguuca

SEQ ID NO: 3774009 - RNA, 22 nt, Salmonella typhimurium LT2
uagacgacaucuuuuccugaag

SEQ ID NO: 3774010 - RNA, 13 nt, Salmonella typhimurium LT2
uagacgagcgaaa

SEQ ID NO: 3774011 - RNA, 17 nt, Salmonella typhimurium LT2
uagacgccggucaugcc

SEQ ID NO: 3774012 - RNA, 18 nt, Salmonella typhimurium LT2
uagacgcgcuagcuucag

SEQ ID NO: 3774013 - RNA, 20 nt, Salmonella typhimurium LT2
uagacgcgcuagcuucaggu

SEQ ID NO: 3774014 - RNA, 19 nt, Salmonella typhimurium LT2
uagacuacaugccaacuuu

SEQ ID NO: 3774015 - RNA, 21 nt, Salmonella typhimurium LT2
uagacuggcgccgucacguuc

SEQ ID NO: 3774016 - RNA, 21 nt, Salmonella typhimurium LT2
uagacuuuggcgcagucacag

SEQ ID NO: 3774017 - RNA, 13 nt, Salmonella typhimurium LT2
uagagaaaucaac

SEQ ID NO: 3774018 - RNA, 16 nt, Salmonella typhimurium LT2
uagagaccauagacuc

SEQ ID NO: 3774019 - RNA, 18 nt, Salmonella typhimurium LT2
uagagcaaucuggcagua

SEQ ID NO: 3774020 - RNA, 19 nt, Salmonella typhimurium LT2
uagagcaaucuggcaguau

SEQ ID NO: 3774021 - RNA, 15 nt, Salmonella typhimurium LT2
uagagugcuucuuca

SEQ ID NO: 3774022 - RNA, 13 nt, Salmonella typhimurium LT2
uagaguuaaaagg

SEQ ID NO: 3774023 - RNA, 17 nt, Salmonella typhimurium LT2
uagauauaguuuuucaa

SEQ ID NO: 3774024 - RNA, 15 nt, Salmonella typhimurium LT2
uagaugaaugacugu

SEQ ID NO: 3774025 - RNA, 15 nt, Salmonella typhimurium LT2
uagauguaagcaauu

SEQ ID NO: 3774026 - RNA, 13 nt, Salmonella typhimurium LT2
uagauuaaucacu

SEQ ID NO: 3774027 - RNA, 17 nt, Salmonella typhimurium LT2
uagauucaaccagugca

SEQ ID NO: 3774028 - RNA, 12 nt, Salmonella typhimurium LT2
uagcaaaacaua

SEQ ID NO: 3774029 - RNA, 14 nt, Salmonella typhimurium LT2
uagcaaacuacuuu

SEQ ID NO: 3774030 - RNA, 12 nt, Salmonella typhimurium LT2
uagcaaaucauc

SEQ ID NO: 3774031 - RNA, 22 nt, Salmonella typhimurium LT2
uagcaaaucaucgccaugacca

SEQ ID NO: 3774032 - RNA, 20 nt, Salmonella typhimurium LT2
uagcaacacagacuuugcac

SEQ ID NO: 3774033 - RNA, 18 nt, Salmonella typhimurium LT2
uagcaacagacuauccag

SEQ ID NO: 3774034 - RNA, 20 nt, Salmonella typhimurium LT2
uagcaaccucggcuugcuuc

SEQ ID NO: 3774035 - RNA, 18 nt, Salmonella typhimurium LT2
uagcaacgcgaagcagcu

SEQ ID NO: 3774036 - RNA, 14 nt, Salmonella typhimurium LT2
uagcaagggcaagg

SEQ ID NO: 3774037 - RNA, 16 nt, Salmonella typhimurium LT2
uagcaagguauguauu

SEQ ID NO: 3774038 - RNA, 13 nt, Salmonella typhimurium LT2
uagcaaugaagca

SEQ ID NO: 3774039 - RNA, 15 nt, Salmonella typhimurium LT2
uagcaaugaagcaag

SEQ ID NO: 3774040 - RNA, 14 nt, Salmonella typhimurium LT2
uagcaccaggccaa

SEQ ID NO: 3774041 - RNA, 21 nt, Salmonella typhimurium LT2
uagcacccuucgcuauccauc

SEQ ID NO: 3774042 - RNA, 17 nt, Salmonella typhimurium LT2
uagcaccuggcggagcu

SEQ ID NO: 3774043 - RNA, 23 nt, Salmonella typhimurium LT2
uagcagaauggcgaucaccgcau

SEQ ID NO: 3774044 - RNA, 19 nt, Salmonella typhimurium LT2
uagcagcauaaacaucagc

SEQ ID NO: 3774045 - RNA, 20 nt, Salmonella typhimurium LT2
uagcaggagaucuuuccauu

SEQ ID NO: 3774046 - RNA, 22 nt, Salmonella typhimurium LT2
uagcaugacaauaacggccuca

SEQ ID NO: 3774047 - RNA, 11 nt, Salmonella typhimurium LT2
uagcauucgcg

SEQ ID NO: 3774048 - RNA, 16 nt, Salmonella typhimurium LT2
uagcauuuuuacucag

SEQ ID NO: 3774049 - RNA, 15 nt, Salmonella typhimurium LT2
uagccaaaagcgcca

SEQ ID NO: 3774050 - RNA, 15 nt, Salmonella typhimurium LT2
uagccaacacaucag

SEQ ID NO: 3774051 - RNA, 17 nt, Salmonella typhimurium LT2
uagccaauaacgucugg

SEQ ID NO: 3774052 - RNA, 18 nt, Salmonella typhimurium LT2
uagccacagauuaugcag

SEQ ID NO: 3774053 - RNA, 20 nt, Salmonella typhimurium LT2
uagccaccggcagcgucguc

SEQ ID NO: 3774054 - RNA, 17 nt, Salmonella typhimurium LT2
uagccagagcgcgcugg

SEQ ID NO: 3774055 - RNA, 20 nt, Salmonella typhimurium LT2
uagccagagcgcgcuggcaa

SEQ ID NO: 3774056 - RNA, 12 nt, Salmonella typhimurium LT2
uagccagcauca

SEQ ID NO: 3774057 - RNA, 20 nt, Salmonella typhimurium LT2
uagccagccugaacgggugg

SEQ ID NO: 3774058 - RNA, 21 nt, Salmonella typhimurium LT2
uagccagcgcagcguggccuu

SEQ ID NO: 3774059 - RNA, 20 nt, Salmonella typhimurium LT2
uagccaguaccgaaaucauc

SEQ ID NO: 3774060 - RNA, 22 nt, Salmonella typhimurium LT2
uagccaguucgccuucuucauc

SEQ ID NO: 3774061 - RNA, 17 nt, Salmonella typhimurium LT2
uagccauauaugaaauc

SEQ ID NO: 3774062 - RNA, 22 nt, Salmonella typhimurium LT2
uagcccagucgcacaaagcguu

SEQ ID NO: 3774063 - RNA, 17 nt, Salmonella typhimurium LT2
uagcccgcuuuaccgaa

SEQ ID NO: 3774064 - RNA, 19 nt, Salmonella typhimurium LT2
uagcccugaucccacagcg

SEQ ID NO: 3774065 - RNA, 21 nt, Salmonella typhimurium LT2
uagcccuuucauuucugccug

SEQ ID NO: 3774066 - RNA, 20 nt, Salmonella typhimurium LT2
uagccgccagauccuggcug

SEQ ID NO: 3774067 - RNA, 22 nt, Salmonella typhimurium LT2
uagccgccagcuaauuuuacuu

SEQ ID NO: 3774068 - RNA, 14 nt, Salmonella typhimurium LT2
uagccgcgccagac

SEQ ID NO: 3774069 - RNA, 21 nt, Salmonella typhimurium LT2
uagccgcgcgccgccucuuca

SEQ ID NO: 3774070 - RNA, 19 nt, Salmonella typhimurium LT2
uagccgcgcgucagcgugu

SEQ ID NO: 3774071 - RNA, 19 nt, Salmonella typhimurium LT2
uagccgcgcucaagcuggg

SEQ ID NO: 3774072 - RNA, 21 nt, Salmonella typhimurium LT2
uagccguccauguucggcaug

SEQ ID NO: 3774073 - RNA, 14 nt, Salmonella typhimurium LT2
uagccguucuccag

SEQ ID NO: 3774074 - RNA, 21 nt, Salmonella typhimurium LT2
uagccuaaugacggacgcaga

SEQ ID NO: 3774075 - RNA, 15 nt, Salmonella typhimurium LT2
uagccugaacgccgg

SEQ ID NO: 3774076 - RNA, 16 nt, Salmonella typhimurium LT2
uagccugaacgccgga

SEQ ID NO: 3774077 - RNA, 18 nt, Salmonella typhimurium LT2
uagccugaacgccggaac

SEQ ID NO: 3774078 - RNA, 19 nt, Salmonella typhimurium LT2
uagccugccagcaacccac

SEQ ID NO: 3774079 - RNA, 20 nt, Salmonella typhimurium LT2
uagccugcuggguacgugca

SEQ ID NO: 3774080 - RNA, 21 nt, Salmonella typhimurium LT2
uagccuuccuggggaacagaa

SEQ ID NO: 3774081 - RNA, 24 nt, Salmonella typhimurium LT2
uagccuugacgcaauagaguaaug

SEQ ID NO: 3774082 - RNA, 17 nt, Salmonella typhimurium LT2
uaguaucauauuuucuu

SEQ ID NO: 3774083 - RNA, 11 nt, Salmonella typhimurium LT2
uagucagcgca

SEQ ID NO: 3774084 - RNA, 21 nt, Salmonella typhimurium LT2
uagucaggcacaaaaaacaaa

SEQ ID NO: 3774085 - RNA, 13 nt, Salmonella typhimurium LT2
uagucaggcagca

SEQ ID NO: 3774086 - RNA, 22 nt, Salmonella typhimurium LT2
uagucauaauacucaauauccu

SEQ ID NO: 3774087 - RNA, 17 nt, Salmonella typhimurium LT2
uagucauauucacggcc

SEQ ID NO: 3774088 - RNA, 23 nt, Salmonella typhimurium LT2
uagucaucaacgcgaucuucaua

SEQ ID NO: 3774089 - RNA, 16 nt, Salmonella typhimurium LT2
uagucauugacagcaa

SEQ ID NO: 3774090 - RNA, 17 nt, Salmonella typhimurium LT2
uagucauugacagcaag

SEQ ID NO: 3774091 - RNA, 13 nt, Salmonella typhimurium LT2
uaguccagcagcc

SEQ ID NO: 3774092 - RNA, 14 nt, Salmonella typhimurium LT2
uaguccagcagcca

SEQ ID NO: 3774093 - RNA, 18 nt, Salmonella typhimurium LT2
uaguccgggugcaaaccc

SEQ ID NO: 3774094 - RNA, 15 nt, Salmonella typhimurium LT2
uaguccgguaucggc

SEQ ID NO: 3774095 - RNA, 18 nt, Salmonella typhimurium LT2
uaguccgguaucggcaau

SEQ ID NO: 3774096 - RNA, 21 nt, Salmonella typhimurium LT2
uagucgacagcccgccagcau

SEQ ID NO: 3774097 - RNA, 16 nt, Salmonella typhimurium LT2
uagucggcaaugcucu

SEQ ID NO: 3774098 - RNA, 19 nt, Salmonella typhimurium LT2
uagucuauguucaguaaga

SEQ ID NO: 3774099 - RNA, 18 nt, Salmonella typhimurium LT2
uagucugccauuuccuga

SEQ ID NO: 3774100 - RNA, 15 nt, Salmonella typhimurium LT2
uagugaucgggcuga

SEQ ID NO: 3774101 - RNA, 19 nt, Salmonella typhimurium LT2
uagugauuucgaacucuac

SEQ ID NO: 3774102 - RNA, 22 nt, Salmonella typhimurium LT2
uagugcagaaaggcgugcagcg

SEQ ID NO: 3774103 - RNA, 14 nt, Salmonella typhimurium LT2
uagugccgccaggc

SEQ ID NO: 3774104 - RNA, 15 nt, Salmonella typhimurium LT2
uagugcgauaugugg

SEQ ID NO: 3774105 - RNA, 14 nt, Salmonella typhimurium LT2
uaguggauggccca

SEQ ID NO: 3774106 - RNA, 18 nt, Salmonella typhimurium LT2
uaguggauggcccacugu

SEQ ID NO: 3774107 - RNA, 18 nt, Salmonella typhimurium LT2
uaguguaguuagcgccca

SEQ ID NO: 3774108 - RNA, 15 nt, Salmonella typhimurium LT2
uaguguauccagaua

SEQ ID NO: 3774109 - RNA, 12 nt, Salmonella typhimurium LT2
uagugucacaaa

SEQ ID NO: 3774110 - RNA, 17 nt, Salmonella typhimurium LT2
uaguguucgcggcuggu

SEQ ID NO: 3774111 - RNA, 11 nt, Salmonella typhimurium LT2
uaguuaaaaaa

SEQ ID NO: 3774112 - RNA, 18 nt, Salmonella typhimurium LT2
uaguuaaaggugguguua

SEQ ID NO: 3774113 - RNA, 21 nt, Salmonella typhimurium LT2
uaguuaacgccguuaccagca

SEQ ID NO: 3774114 - RNA, 17 nt, Salmonella typhimurium LT2
uaguugaauaaccucaa

SEQ ID NO: 3774115 - RNA, 12 nt, Salmonella typhimurium LT2
uaguuguuuuau

SEQ ID NO: 3774116 - RNA, 24 nt, Salmonella typhimurium LT2
uaguuuaaauccagcgcgcugagc

SEQ ID NO: 3774117 - RNA, 24 nt, Salmonella typhimurium LT2
uaguuuauugagauaauuuaugau

SEQ ID NO: 3774118 - RNA, 19 nt, Salmonella typhimurium LT2
uaguuucccgguaaaucau

SEQ ID NO: 3774119 - RNA, 22 nt, Salmonella typhimurium LT2
uaguuuccgccgcgguauucau

SEQ ID NO: 3774120 - RNA, 23 nt, Salmonella typhimurium LT2
uaguuuccgccgcgguauucaua

SEQ ID NO: 3774121 - RNA, 16 nt, Salmonella typhimurium LT2
uaguuucuauuaaauc

SEQ ID NO: 3774122 - RNA, 14 nt, Salmonella typhimurium LT2
uaguuugcauaacc

SEQ ID NO: 3774123 - RNA, 20 nt, Salmonella typhimurium LT2
uaguuuuaaccuucuacccc

SEQ ID NO: 3774124 - RNA, 15 nt, Salmonella typhimurium LT2
uauaaaacauaaaga

SEQ ID NO: 3774125 - RNA, 21 nt, Salmonella typhimurium LT2
uauaaaacuucgauaauaaaa

SEQ ID NO: 3774126 - RNA, 12 nt, Salmonella typhimurium LT2
uauaaaauuuaa

SEQ ID NO: 3774127 - RNA, 11 nt, Salmonella typhimurium LT2
uauaaaccuga

SEQ ID NO: 3774128 - RNA, 14 nt, Salmonella typhimurium LT2
uauaaacucagcaa

SEQ ID NO: 3774129 - RNA, 15 nt, Salmonella typhimurium LT2
uauaaacucagcaau

SEQ ID NO: 3774130 - RNA, 11 nt, Salmonella typhimurium LT2
uauaaauauag

SEQ ID NO: 3774131 - RNA, 18 nt, Salmonella typhimurium LT2
uauaacagaauaagccag

SEQ ID NO: 3774132 - RNA, 16 nt, Salmonella typhimurium LT2
uauaacgcguucuggc

SEQ ID NO: 3774133 - RNA, 23 nt, Salmonella typhimurium LT2
uauaacuaaacucaucuuuauuc

SEQ ID NO: 3774134 - RNA, 15 nt, Salmonella typhimurium LT2
uauaacuuucaauau

SEQ ID NO: 3774135 - RNA, 18 nt, Salmonella typhimurium LT2
uauaagcgccgucauccg

SEQ ID NO: 3774136 - RNA, 13 nt, Salmonella typhimurium LT2
uauaaguaacugg

SEQ ID NO: 3774137 - RNA, 16 nt, Salmonella typhimurium LT2
uauaaucacagggguc

SEQ ID NO: 3774138 - RNA, 23 nt, Salmonella typhimurium LT2
uauaaugccuggagccagccuga

SEQ ID NO: 3774139 - RNA, 18 nt, Salmonella typhimurium LT2
uauaauugcuuuuuucca

SEQ ID NO: 3774140 - RNA, 15 nt, Salmonella typhimurium LT2
uauacaaaaaagaca

SEQ ID NO: 3774141 - RNA, 17 nt, Salmonella typhimurium LT2
uauacacuucauccuuu

SEQ ID NO: 3774142 - RNA, 14 nt, Salmonella typhimurium LT2
uauacagacaaugc

SEQ ID NO: 3774143 - RNA, 12 nt, Salmonella typhimurium LT2
uauacagcaccu

SEQ ID NO: 3774144 - RNA, 15 nt, Salmonella typhimurium LT2
uauacagcaccugcu

SEQ ID NO: 3774145 - RNA, 17 nt, Salmonella typhimurium LT2
uauacagcaccugcuca

SEQ ID NO: 3774146 - RNA, 17 nt, Salmonella typhimurium LT2
uauacaguaaaacgcca

SEQ ID NO: 3774147 - RNA, 16 nt, Salmonella typhimurium LT2
uauacauacauacaua

SEQ ID NO: 3774148 - RNA, 17 nt, Salmonella typhimurium LT2
uauacaucgcuuuccag

SEQ ID NO: 3774149 - RNA, 15 nt, Salmonella typhimurium LT2
uauaccagcgucagc

SEQ ID NO: 3774150 - RNA, 14 nt, Salmonella typhimurium LT2
uauaccaugccgcc

SEQ ID NO: 3774151 - RNA, 16 nt, Salmonella typhimurium LT2
uauacccguguggcug

SEQ ID NO: 3774152 - RNA, 16 nt, Salmonella typhimurium LT2
uauacgcggcguaccg

SEQ ID NO: 3774153 - RNA, 15 nt, Salmonella typhimurium LT2
uauacucaaaaaauc

SEQ ID NO: 3774154 - RNA, 21 nt, Salmonella typhimurium LT2
uauagacgccggucaugccau

SEQ ID NO: 3774155 - RNA, 19 nt, Salmonella typhimurium LT2
uauagagcaaucuggcagu

SEQ ID NO: 3774156 - RNA, 19 nt, Salmonella typhimurium LT2
uauagagcgccauauugcu

SEQ ID NO: 3774157 - RNA, 22 nt, Salmonella typhimurium LT2
uauagcaaucauaaagcgcccg

SEQ ID NO: 3774158 - RNA, 13 nt, Salmonella typhimurium LT2
uauagccaggcag

SEQ ID NO: 3774159 - RNA, 15 nt, Salmonella typhimurium LT2
uauagccaggcagau

SEQ ID NO: 3774160 - RNA, 13 nt, Salmonella typhimurium LT2
uauagcccacgca

SEQ ID NO: 3774161 - RNA, 20 nt, Salmonella typhimurium LT2
uauagccgcguuugaguagc

SEQ ID NO: 3774162 - RNA, 22 nt, Salmonella typhimurium LT2
uauagcucagcgcggcagccgg

SEQ ID NO: 3774163 - RNA, 22 nt, Salmonella typhimurium LT2
uauaggacgccuguaaugccgc

SEQ ID NO: 3774164 - RNA, 12 nt, Salmonella typhimurium LT2
uauaggccaggc

SEQ ID NO: 3774165 - RNA, 14 nt, Salmonella typhimurium LT2
uauaggggccaagc

SEQ ID NO: 3774166 - RNA, 19 nt, Salmonella typhimurium LT2
uauaguccugaugaaaaac

SEQ ID NO: 3774167 - RNA, 19 nt, Salmonella typhimurium LT2
uauaguuuuuaccauauuu

SEQ ID NO: 3774168 - RNA, 13 nt, Salmonella typhimurium LT2
uauaguuuuucaa

SEQ ID NO: 3774169 - RNA, 14 nt, Salmonella typhimurium LT2
uauauaacauauag

SEQ ID NO: 3774170 - RNA, 17 nt, Salmonella typhimurium LT2
uauauaauuuauagcca

SEQ ID NO: 3774171 - RNA, 17 nt, Salmonella typhimurium LT2
uauauacccaaaauaau

SEQ ID NO: 3774172 - RNA, 14 nt, Salmonella typhimurium LT2
uauauagucaaugc

SEQ ID NO: 3774173 - RNA, 15 nt, Salmonella typhimurium LT2
uauaugcaaaacugu

SEQ ID NO: 3774174 - RNA, 13 nt, Salmonella typhimurium LT2
uauauucagaauu

SEQ ID NO: 3774175 - RNA, 18 nt, Salmonella typhimurium LT2
uauauucagcaaaugcgc

SEQ ID NO: 3774176 - RNA, 15 nt, Salmonella typhimurium LT2
uauauuccagccagg

SEQ ID NO: 3774177 - RNA, 17 nt, Salmonella typhimurium LT2
uauauucguccuuuauc

SEQ ID NO: 3774178 - RNA, 23 nt, Salmonella typhimurium LT2
uauauucugggcuuacuuuccaa

SEQ ID NO: 3774179 - RNA, 16 nt, Salmonella typhimurium LT2
uauauucuuuguuuaa

SEQ ID NO: 3774180 - RNA, 20 nt, Salmonella typhimurium LT2
uauauucuuuguuuaaaaau

SEQ ID NO: 3774181 - RNA, 13 nt, Salmonella typhimurium LT2
uauauuggcuggc

SEQ ID NO: 3774182 - RNA, 15 nt, Salmonella typhimurium LT2
uauauuuauauauag

SEQ ID NO: 3774183 - RNA, 16 nt, Salmonella typhimurium LT2
uauauuuaucugucac

SEQ ID NO: 3774184 - RNA, 18 nt, Salmonella typhimurium LT2
uaucaaaaaaaaccagau

SEQ ID NO: 3774185 - RNA, 20 nt, Salmonella typhimurium LT2
uaucaaaccaguuuuucauu

SEQ ID NO: 3774186 - RNA, 17 nt, Salmonella typhimurium LT2
uaucaaacugaaaauca

SEQ ID NO: 3774187 - RNA, 14 nt, Salmonella typhimurium LT2
uaucuuccagcgcg

SEQ ID NO: 3774188 - RNA, 20 nt, Salmonella typhimurium LT2
uaucuucugcugcucccuca

SEQ ID NO: 3774189 - RNA, 22 nt, Salmonella typhimurium LT2
uaucuugagucaaaagauugau

SEQ ID NO: 3774190 - RNA, 13 nt, Salmonella typhimurium LT2
uaucuugauauca

SEQ ID NO: 3774191 - RNA, 12 nt, Salmonella typhimurium LT2
uaucuugcuuua

SEQ ID NO: 3774192 - RNA, 20 nt, Salmonella typhimurium LT2
uaucuuuaaacuuuuuuaug

SEQ ID NO: 3774193 - RNA, 22 nt, Salmonella typhimurium LT2
uaucuuuauuaaaaagcagcca

SEQ ID NO: 3774194 - RNA, 23 nt, Salmonella typhimurium LT2
uaucuuugccuuuugacagcaca

SEQ ID NO: 3774195 - RNA, 20 nt, Salmonella typhimurium LT2
uaugaaaccccaaaucagca

SEQ ID NO: 3774196 - RNA, 13 nt, Salmonella typhimurium LT2
uaugaaagagaaa

SEQ ID NO: 3774197 - RNA, 17 nt, Salmonella typhimurium LT2
uaugaaagagaaaucuc

SEQ ID NO: 3774198 - RNA, 16 nt, Salmonella typhimurium LT2
uaugaaagccaucgcu

SEQ ID NO: 3774199 - RNA, 15 nt, Salmonella typhimurium LT2
uaugaaauucuugcc

SEQ ID NO: 3774200 - RNA, 20 nt, Salmonella typhimurium LT2
uaugaacaggcagcguaaua

SEQ ID NO: 3774201 - RNA, 19 nt, Salmonella typhimurium LT2
uaugaacgccagcggcgga

SEQ ID NO: 3774202 - RNA, 15 nt, Salmonella typhimurium LT2
uaugaauaaaaaaca

SEQ ID NO: 3774203 - RNA, 23 nt, Salmonella typhimurium LT2
uaugaauaaaaaacaagauuaau

SEQ ID NO: 3774204 - RNA, 15 nt, Salmonella typhimurium LT2
uaugacaacauaaag

SEQ ID NO: 3774205 - RNA, 18 nt, Salmonella typhimurium LT2
uaugaccgagucuacauc

SEQ ID NO: 3774206 - RNA, 16 nt, Salmonella typhimurium LT2
uaugagcgaacggcuu

SEQ ID NO: 3774207 - RNA, 21 nt, Salmonella typhimurium LT2
uaugauagccguucuccagcg

SEQ ID NO: 3774208 - RNA, 20 nt, Salmonella typhimurium LT2
uaugaucgacaaugaucaga

SEQ ID NO: 3774209 - RNA, 16 nt, Salmonella typhimurium LT2
uaugauuucacccaga

SEQ ID NO: 3774210 - RNA, 15 nt, Salmonella typhimurium LT2
uaugauuuuaacauc

SEQ ID NO: 3774211 - RNA, 15 nt, Salmonella typhimurium LT2
uaugcaacaugucga

SEQ ID NO: 3774212 - RNA, 15 nt, Salmonella typhimurium LT2
uaugcacaaccagcg

SEQ ID NO: 3774213 - RNA, 14 nt, Salmonella typhimurium LT2
uaugcagccgauag

SEQ ID NO: 3774214 - RNA, 19 nt, Salmonella typhimurium LT2
uaugcaggggcaguaaauu

SEQ ID NO: 3774215 - RNA, 21 nt, Salmonella typhimurium LT2
uaugcauauucauaucgaagc

SEQ ID NO: 3774216 - RNA, 18 nt, Salmonella typhimurium LT2
uaugccagcucaaaucgc

SEQ ID NO: 3774217 - RNA, 22 nt, Salmonella typhimurium LT2
uaugcccccuccagccagcgcc

SEQ ID NO: 3774218 - RNA, 18 nt, Salmonella typhimurium LT2
uaugccccgacaucagau

SEQ ID NO: 3774219 - RNA, 20 nt, Salmonella typhimurium LT2
uaugcccgccgcuggcgggc

SEQ ID NO: 3774220 - RNA, 20 nt, Salmonella typhimurium LT2
uaugccggaggauauuuauu

SEQ ID NO: 3774221 - RNA, 21 nt, Salmonella typhimurium LT2
uaugccggauaguuacccggc

SEQ ID NO: 3774222 - RNA, 19 nt, Salmonella typhimurium LT2
uaugccuggggucgucagc

SEQ ID NO: 3774223 - RNA, 21 nt, Salmonella typhimurium LT2
uaugcgacgguaaaaauaucu

SEQ ID NO: 3774224 - RNA, 14 nt, Salmonella typhimurium LT2
uaugcgcaaaucaa

SEQ ID NO: 3774225 - RNA, 14 nt, Salmonella typhimurium LT2
uaugcgccuguuag

SEQ ID NO: 3774226 - RNA, 14 nt, Salmonella typhimurium LT2
uaugcgcuuccagc

SEQ ID NO: 3774227 - RNA, 21 nt, Salmonella typhimurium LT2
uaugcuccaguuguuccagca

SEQ ID NO: 3774228 - RNA, 22 nt, Salmonella typhimurium LT2
uaugcugaucaucuggccuacg

SEQ ID NO: 3774229 - RNA, 22 nt, Salmonella typhimurium LT2
uauggaaguugccgccauaggu

SEQ ID NO: 3774230 - RNA, 22 nt, Salmonella typhimurium LT2
uauggauaagcgucgccagcgu

SEQ ID NO: 3774231 - RNA, 16 nt, Salmonella typhimurium LT2
uauggccguuugcugu

SEQ ID NO: 3774232 - RNA, 23 nt, Salmonella typhimurium LT2
uauggcgaaggaugaccggcuau

SEQ ID NO: 3774233 - RNA, 16 nt, Salmonella typhimurium LT2
uauggguguagcucau

SEQ ID NO: 3774234 - RNA, 14 nt, Salmonella typhimurium LT2
uaugguaauuuaaa

SEQ ID NO: 3774235 - RNA, 17 nt, Salmonella typhimurium LT2
uaugguaauuuaaagua

SEQ ID NO: 3774236 - RNA, 22 nt, Salmonella typhimurium LT2
uauguaacugaacccaucgccc

SEQ ID NO: 3774237 - RNA, 17 nt, Salmonella typhimurium LT2
uauguaccgucaucgcc

SEQ ID NO: 3774238 - RNA, 19 nt, Salmonella typhimurium LT2
uauguaccgucaucgccca

SEQ ID NO: 3774239 - RNA, 16 nt, Salmonella typhimurium LT2
uauguagcgcugaagc

SEQ ID NO: 3774240 - RNA, 17 nt, Salmonella typhimurium LT2
uauguauugcauuuuau

SEQ ID NO: 3774241 - RNA, 21 nt, Salmonella typhimurium LT2
uaugucaguaauauauuacga

SEQ ID NO: 3774242 - RNA, 22 nt, Salmonella typhimurium LT2
uauguuaaaagagaaaaagaag

SEQ ID NO: 3774243 - RNA, 21 nt, Salmonella typhimurium LT2
uauguuaacgccgauuaaugc

SEQ ID NO: 3774244 - RNA, 20 nt, Salmonella typhimurium LT2
uauguuaccuguuaaauugu

SEQ ID NO: 3774245 - RNA, 21 nt, Salmonella typhimurium LT2
uauguuugccgucaucgcuca

SEQ ID NO: 3774246 - RNA, 14 nt, Salmonella typhimurium LT2
uauuaaaaagcagc

SEQ ID NO: 3774247 - RNA, 15 nt, Salmonella typhimurium LT2
uauuaaaaagccagc

SEQ ID NO: 3774248 - RNA, 15 nt, Salmonella typhimurium LT2
uauuaaaauaaauua

SEQ ID NO: 3774249 - RNA, 15 nt, Salmonella typhimurium LT2
uauuaacaucagccg

SEQ ID NO: 3774250 - RNA, 13 nt, Salmonella typhimurium LT2
uauuaacggucuu

SEQ ID NO: 3774251 - RNA, 17 nt, Salmonella typhimurium LT2
uauuaagccuuuuuaaa

SEQ ID NO: 3774252 - RNA, 19 nt, Salmonella typhimurium LT2
uauuaagccuuuuuaaaua

SEQ ID NO: 3774253 - RNA, 17 nt, Salmonella typhimurium LT2
uauuaauugcagacgcu

SEQ ID NO: 3774254 - RNA, 15 nt, Salmonella typhimurium LT2
uauuaccuccugcau

SEQ ID NO: 3774255 - RNA, 16 nt, Salmonella typhimurium LT2
uauuacgauugcgcca

SEQ ID NO: 3774256 - RNA, 22 nt, Salmonella typhimurium LT2
uauuacgcaagaucacauacaa

SEQ ID NO: 3774257 - RNA, 11 nt, Salmonella typhimurium LT2
uauuauaaaau

SEQ ID NO: 3774258 - RNA, 13 nt, Salmonella typhimurium LT2
uauuauaaaauaa

SEQ ID NO: 3774259 - RNA, 13 nt, Salmonella typhimurium LT2
uauuaucaauccu

SEQ ID NO: 3774260 - RNA, 17 nt, Salmonella typhimurium LT2
uauuaucggcaccaucu

SEQ ID NO: 3774261 - RNA, 19 nt, Salmonella typhimurium LT2
uauuauuuugauaaucauc

SEQ ID NO: 3774262 - RNA, 15 nt, Salmonella typhimurium LT2
uauuauuuuuucuuu

SEQ ID NO: 3774263 - RNA, 15 nt, Salmonella typhimurium LT2
uauucaagcuguugg

SEQ ID NO: 3774264 - RNA, 19 nt, Salmonella typhimurium LT2
uauucaagcuguuggaugc

SEQ ID NO: 3774265 - RNA, 12 nt, Salmonella typhimurium LT2
uauucaauaaua

SEQ ID NO: 3774266 - RNA, 17 nt, Salmonella typhimurium LT2
uauucaaucaauuuuaa

SEQ ID NO: 3774267 - RNA, 21 nt, Salmonella typhimurium LT2
uauucacacgcucacccaguu

SEQ ID NO: 3774268 - RNA, 14 nt, Salmonella typhimurium LT2
uauucaccuggaaa

SEQ ID NO: 3774269 - RNA, 23 nt, Salmonella typhimurium LT2
uauucacgcagcuuauuggcaau

SEQ ID NO: 3774270 - RNA, 19 nt, Salmonella typhimurium LT2
uauucacuuuccgaaucag

SEQ ID NO: 3774271 - RNA, 15 nt, Salmonella typhimurium LT2
uauucaggccuccug

SEQ ID NO: 3774272 - RNA, 12 nt, Salmonella typhimurium LT2
uauucaggugga

SEQ ID NO: 3774273 - RNA, 20 nt, Salmonella typhimurium LT2
uauucauaucguaaauuacu

SEQ ID NO: 3774274 - RNA, 15 nt, Salmonella typhimurium LT2
uauucaucggcacau

SEQ ID NO: 3774275 - RNA, 16 nt, Salmonella typhimurium LT2
uauucauuuccagcac

SEQ ID NO: 3774276 - RNA, 20 nt, Salmonella typhimurium LT2
uauuccagagaguuuucccc

SEQ ID NO: 3774277 - RNA, 21 nt, Salmonella typhimurium LT2
uauuccagccaggaauggcua

SEQ ID NO: 3774278 - RNA, 15 nt, Salmonella typhimurium LT2
uauuccauacagaaa

SEQ ID NO: 3774279 - RNA, 17 nt, Salmonella typhimurium LT2
uauuccaucaaaagcuu

SEQ ID NO: 3774280 - RNA, 20 nt, Salmonella typhimurium LT2
uauuccgagucgaucucuuu

SEQ ID NO: 3774281 - RNA, 20 nt, Salmonella typhimurium LT2
uauuccgcucagauaacaua

SEQ ID NO: 3774282 - RNA, 16 nt, Salmonella typhimurium LT2
uauuccggcgacgcuu

SEQ ID NO: 3774283 - RNA, 16 nt, Salmonella typhimurium LT2
uauuccggcgcuggcg

SEQ ID NO: 3774284 - RNA, 15 nt, Salmonella typhimurium LT2
uauucgacacaggcg

SEQ ID NO: 3774285 - RNA, 17 nt, Salmonella typhimurium LT2
uauucgcgcccucauuc

SEQ ID NO: 3774286 - RNA, 20 nt, Salmonella typhimurium LT2
uauucucaaccagccgauca

SEQ ID NO: 3774287 - RNA, 16 nt, Salmonella typhimurium LT2
uauucugaaagaaaag

SEQ ID NO: 3774288 - RNA, 23 nt, Salmonella typhimurium LT2
uauucugcacgcacgacggugcu

SEQ ID NO: 3774289 - RNA, 15 nt, Salmonella typhimurium LT2
uauucuguuuuuuca

SEQ ID NO: 3774290 - RNA, 16 nt, Salmonella typhimurium LT2
uauucuguuuuuucag

SEQ ID NO: 3774291 - RNA, 23 nt, Salmonella typhimurium LT2
ucaacagcgcggcaggccggcag

SEQ ID NO: 3774292 - RNA, 22 nt, Salmonella typhimurium LT2
ucaacagcggcggcaguagucg

SEQ ID NO: 3774293 - RNA, 21 nt, Salmonella typhimurium LT2
ucaacauauuuuucacacaua

SEQ ID NO: 3774294 - RNA, 19 nt, Salmonella typhimurium LT2
ucaacaucauuaagccggg

SEQ ID NO: 3774295 - RNA, 22 nt, Salmonella typhimurium LT2
ucaacaucuuugccgcgucgau

SEQ ID NO: 3774296 - RNA, 15 nt, Salmonella typhimurium LT2
ucaaccaacggcgcu

SEQ ID NO: 3774297 - RNA, 18 nt, Salmonella typhimurium LT2
ucaaccacgauaaccaga

SEQ ID NO: 3774298 - RNA, 20 nt, Salmonella typhimurium LT2
ucaaccacggauaagccagc

SEQ ID NO: 3774299 - RNA, 19 nt, Salmonella typhimurium LT2
ucaacccucccugcauuau

SEQ ID NO: 3774300 - RNA, 22 nt, Salmonella typhimurium LT2
ucaaccgcgcggcguucugcgc

SEQ ID NO: 3774301 - RNA, 18 nt, Salmonella typhimurium LT2
ucaaccgcuuucagcgca

SEQ ID NO: 3774302 - RNA, 22 nt, Salmonella typhimurium LT2
ucaaccggguuaagcugaauac

SEQ ID NO: 3774303 - RNA, 18 nt, Salmonella typhimurium LT2
ucaacgaccucaaaauag

SEQ ID NO: 3774304 - RNA, 14 nt, Salmonella typhimurium LT2
ucaacgccauaauc

SEQ ID NO: 3774305 - RNA, 21 nt, Salmonella typhimurium LT2
ucaacgcccgcuuucaccauc

SEQ ID NO: 3774306 - RNA, 17 nt, Salmonella typhimurium LT2
ucaacgccgccaggaua

SEQ ID NO: 3774307 - RNA, 20 nt, Salmonella typhimurium LT2
ucaacgccgcgcuucuggaa

SEQ ID NO: 3774308 - RNA, 23 nt, Salmonella typhimurium LT2
ucaacgcgaucuucauagucgcu

SEQ ID NO: 3774309 - RNA, 14 nt, Salmonella typhimurium LT2
ucaacgcgccgcca

SEQ ID NO: 3774310 - RNA, 19 nt, Salmonella typhimurium LT2
ucaacgcguucauccagcg

SEQ ID NO: 3774311 - RNA, 20 nt, Salmonella typhimurium LT2
ucaacgcguucauccagcgc

SEQ ID NO: 3774312 - RNA, 15 nt, Salmonella typhimurium LT2
ucaacggucaaaaua

SEQ ID NO: 3774313 - RNA, 19 nt, Salmonella typhimurium LT2
ucaacgguucgacggagau

SEQ ID NO: 3774314 - RNA, 16 nt, Salmonella typhimurium LT2
ucaacguccaccagcg

SEQ ID NO: 3774315 - RNA, 16 nt, Salmonella typhimurium LT2
ucaacgucuugccaug

SEQ ID NO: 3774316 - RNA, 14 nt, Salmonella typhimurium LT2
ucaacgugaaaaau

SEQ ID NO: 3774317 - RNA, 21 nt, Salmonella typhimurium LT2
ucaacguuucgcuaucgccca

SEQ ID NO: 3774318 - RNA, 22 nt, Salmonella typhimurium LT2
ucaacucgcggcccaaccacua

SEQ ID NO: 3774319 - RNA, 14 nt, Salmonella typhimurium LT2
ucaacucuccuuuc

SEQ ID NO: 3774320 - RNA, 21 nt, Salmonella typhimurium LT2
ucaacugcgggaaguagcaaa

SEQ ID NO: 3774321 - RNA, 21 nt, Salmonella typhimurium LT2
ucaacuggaugacugaauuau

SEQ ID NO: 3774322 - RNA, 21 nt, Salmonella typhimurium LT2
ucaacuguaccugauccagcu

SEQ ID NO: 3774323 - RNA, 19 nt, Salmonella typhimurium LT2
ucaagacgcucgacgucca

SEQ ID NO: 3774324 - RNA, 16 nt, Salmonella typhimurium LT2
ucaagacgguuguuuu

SEQ ID NO: 3774325 - RNA, 16 nt, Salmonella typhimurium LT2
ucaagaguaggccgga

SEQ ID NO: 3774326 - RNA, 15 nt, Salmonella typhimurium LT2
ucaagauaaaaagac

SEQ ID NO: 3774327 - RNA, 16 nt, Salmonella typhimurium LT2
ucaagaucgcgcagca

SEQ ID NO: 3774328 - RNA, 16 nt, Salmonella typhimurium LT2
ucaagcaguuccagca

SEQ ID NO: 3774329 - RNA, 20 nt, Salmonella typhimurium LT2
ucaagccagccguccuccag

SEQ ID NO: 3774330 - RNA, 19 nt, Salmonella typhimurium LT2
ucaagccagguugcgcccg

SEQ ID NO: 3774331 - RNA, 14 nt, Salmonella typhimurium LT2
ucaagcccagcuca

SEQ ID NO: 3774332 - RNA, 14 nt, Salmonella typhimurium LT2
ucaagcgaaaaaau

SEQ ID NO: 3774333 - RNA, 23 nt, Salmonella typhimurium LT2
ucaagcgccgccgcauuuugcuu

SEQ ID NO: 3774334 - RNA, 16 nt, Salmonella typhimurium LT2
ucaagcggcaccacau

SEQ ID NO: 3774335 - RNA, 22 nt, Salmonella typhimurium LT2
ucaagcguuuccagaguacauu

SEQ ID NO: 3774336 - RNA, 20 nt, Salmonella typhimurium LT2
ucaagcucaccaccaccaaa

SEQ ID NO: 3774337 - RNA, 21 nt, Salmonella typhimurium LT2
ucaagcuggacgguaaccauu

SEQ ID NO: 3774338 - RNA, 13 nt, Salmonella typhimurium LT2
ucaagcuguugga

SEQ ID NO: 3774339 - RNA, 12 nt, Salmonella typhimurium LT2
ucaagcuuuacc

SEQ ID NO: 3774340 - RNA, 20 nt, Salmonella typhimurium LT2
ucaagcuuugcguaaaaaaa

SEQ ID NO: 3774341 - RNA, 23 nt, Salmonella typhimurium LT2
ucaaggauggagauaucaccauc

SEQ ID NO: 3774342 - RNA, 13 nt, Salmonella typhimurium LT2
ucaaggcaauaga

SEQ ID NO: 3774343 - RNA, 15 nt, Salmonella typhimurium LT2
ucaaggcgcagaacc

SEQ ID NO: 3774344 - RNA, 10 nt, Salmonella typhimurium LT2
ucaagucccc

SEQ ID NO: 3774345 - RNA, 22 nt, Salmonella typhimurium LT2
ucaaguccccccccucgcacca

SEQ ID NO: 3774346 - RNA, 22 nt, Salmonella typhimurium LT2
ucaagugucgauaaccuggaug

SEQ ID NO: 3774347 - RNA, 22 nt, Salmonella typhimurium LT2
ucaaguuauguuauccccacuu

SEQ ID NO: 3774348 - RNA, 21 nt, Salmonella typhimurium LT2
ucaauaaacauuuuuuuugca

SEQ ID NO: 3774349 - RNA, 19 nt, Salmonella typhimurium LT2
ucaauaaagccgcauuuuu

SEQ ID NO: 3774350 - RNA, 23 nt, Salmonella typhimurium LT2
ucaauaaaucgggacggauacug

SEQ ID NO: 3774351 - RNA, 22 nt, Salmonella typhimurium LT2
ucaauaagaaacugcuguagca

SEQ ID NO: 3774352 - RNA, 15 nt, Salmonella typhimurium LT2
ucaauaaguaccauu

SEQ ID NO: 3774353 - RNA, 12 nt, Salmonella typhimurium LT2
ucaauaauaucc

SEQ ID NO: 3774354 - RNA, 13 nt, Salmonella typhimurium LT2
ucaauaauauccu

SEQ ID NO: 3774355 - RNA, 15 nt, Salmonella typhimurium LT2
ucaauaaucccuucu

SEQ ID NO: 3774356 - RNA, 18 nt, Salmonella typhimurium LT2
ucaauacauucaguacaa

SEQ ID NO: 3774357 - RNA, 17 nt, Salmonella typhimurium LT2
ucaauaccguccagcgc

SEQ ID NO: 3774358 - RNA, 17 nt, Salmonella typhimurium LT2
ucaauaccuuaguaaaa

SEQ ID NO: 3774359 - RNA, 16 nt, Salmonella typhimurium LT2
ucaauacguaacgcaa

SEQ ID NO: 3774360 - RNA, 18 nt, Salmonella typhimurium LT2
ucaauagcacaucagcca

SEQ ID NO: 3774361 - RNA, 12 nt, Salmonella typhimurium LT2
ucaauagcgauu

SEQ ID NO: 3774362 - RNA, 22 nt, Salmonella typhimurium LT2
ucaauauacucccgaauggcuu

SEQ ID NO: 3774363 - RNA, 15 nt, Salmonella typhimurium LT2
ucaauaucauagugc

SEQ ID NO: 3774364 - RNA, 13 nt, Salmonella typhimurium LT2
ucaauaucauugu

SEQ ID NO: 3774365 - RNA, 20 nt, Salmonella typhimurium LT2
ucaauaucuuuuugcgucau

SEQ ID NO: 3774366 - RNA, 14 nt, Salmonella typhimurium LT2
ucaauaugccaggc

SEQ ID NO: 3774367 - RNA, 14 nt, Salmonella typhimurium LT2
ucaauaugcguuaa

SEQ ID NO: 3774368 - RNA, 23 nt, Salmonella typhimurium LT2
ucaauauguuguggcaauauuuu

SEQ ID NO: 3774369 - RNA, 16 nt, Salmonella typhimurium LT2
ucaauauuaucguaau

SEQ ID NO: 3774370 - RNA, 16 nt, Salmonella typhimurium LT2
ucaauauucaaugggu

SEQ ID NO: 3774371 - RNA, 20 nt, Salmonella typhimurium LT2
ucaauauucaauggguuaug

SEQ ID NO: 3774372 - RNA, 20 nt, Salmonella typhimurium LT2
ucaaucaacgguucgacgga

SEQ ID NO: 3774373 - RNA, 13 nt, Salmonella typhimurium LT2
ucaaucaacucuu

SEQ ID NO: 3774374 - RNA, 14 nt, Salmonella typhimurium LT2
ucaaucacuuucag

SEQ ID NO: 3774375 - RNA, 22 nt, Salmonella typhimurium LT2
ucaaucagcgugggcagccguu

SEQ ID NO: 3774376 - RNA, 12 nt, Salmonella typhimurium LT2
ucaaucaggcua

SEQ ID NO: 3774377 - RNA, 16 nt, Salmonella typhimurium LT2
ucaaucaucagaagaa

SEQ ID NO: 3774378 - RNA, 17 nt, Salmonella typhimurium LT2
ucaaucaucauaucccg

SEQ ID NO: 3774379 - RNA, 15 nt, Salmonella typhimurium LT2
ucaaucgccaaaucc

SEQ ID NO: 3774380 - RNA, 13 nt, Salmonella typhimurium LT2
ucaaucgccacca

SEQ ID NO: 3774381 - RNA, 15 nt, Salmonella typhimurium LT2
ucaaucgccaccaca

SEQ ID NO: 3774382 - RNA, 16 nt, Salmonella typhimurium LT2
ucaaucgccaccacau

SEQ ID NO: 3774383 - RNA, 15 nt, Salmonella typhimurium LT2
ucaaucgguacgcca

SEQ ID NO: 3774384 - RNA, 18 nt, Salmonella typhimurium LT2
ucaaucgucagacggaca

SEQ ID NO: 3774385 - RNA, 22 nt, Salmonella typhimurium LT2
ucaaucuggccguuugcugcuc

SEQ ID NO: 3774386 - RNA, 16 nt, Salmonella typhimurium LT2
ucaaugcccagcgcaa

SEQ ID NO: 3774387 - RNA, 13 nt, Salmonella typhimurium LT2
ucaaugcccggca

SEQ ID NO: 3774388 - RNA, 22 nt, Salmonella typhimurium LT2
ucaaugcccuuaaauccggccu

SEQ ID NO: 3774389 - RNA, 17 nt, Salmonella typhimurium LT2
ucaaugccgucggcaau

SEQ ID NO: 3774390 - RNA, 19 nt, Salmonella typhimurium LT2
ucaauggugaauuugcugc

SEQ ID NO: 3774391 - RNA, 15 nt, Salmonella typhimurium LT2
ucaaugguuaauuaa

SEQ ID NO: 3774392 - RNA, 16 nt, Salmonella typhimurium LT2
ucaaugguuaauuaaa

SEQ ID NO: 3774393 - RNA, 15 nt, Salmonella typhimurium LT2
ucaauguccugaauu

SEQ ID NO: 3774394 - RNA, 19 nt, Salmonella typhimurium LT2
ucaaugucugauggcgcug

SEQ ID NO: 3774395 - RNA, 23 nt, Salmonella typhimurium LT2
ucacgaccggcgaacgcuggcug

SEQ ID NO: 3774396 - RNA, 14 nt, Salmonella typhimurium LT2
ucacgauaaggccu

SEQ ID NO: 3774397 - RNA, 16 nt, Salmonella typhimurium LT2
ucacgauaaugaaccu

SEQ ID NO: 3774398 - RNA, 19 nt, Salmonella typhimurium LT2
ucacgauaaugaaccuuac

SEQ ID NO: 3774399 - RNA, 14 nt, Salmonella typhimurium LT2
ucacgauaauguuu

SEQ ID NO: 3774400 - RNA, 19 nt, Salmonella typhimurium LT2
ucacgauccgcaaauuacu

SEQ ID NO: 3774401 - RNA, 17 nt, Salmonella typhimurium LT2
ucacgcaaaugcagcgg

SEQ ID NO: 3774402 - RNA, 14 nt, Salmonella typhimurium LT2
ucacgcaacaacag

SEQ ID NO: 3774403 - RNA, 23 nt, Salmonella typhimurium LT2
ucacgcaacaacaggccagaaua

SEQ ID NO: 3774404 - RNA, 18 nt, Salmonella typhimurium LT2
ucacgcaacaggccgcau

SEQ ID NO: 3774405 - RNA, 19 nt, Salmonella typhimurium LT2
ucacgcagcgccuuaucca

SEQ ID NO: 3774406 - RNA, 20 nt, Salmonella typhimurium LT2
ucacgcagcgugaagcugcc

SEQ ID NO: 3774407 - RNA, 20 nt, Salmonella typhimurium LT2
ucacgcagcuuauuggcaau

SEQ ID NO: 3774408 - RNA, 20 nt, Salmonella typhimurium LT2
ucacgccaucgacaaaggca

SEQ ID NO: 3774409 - RNA, 15 nt, Salmonella typhimurium LT2
ucacgcccgccgaag

SEQ ID NO: 3774410 - RNA, 15 nt, Salmonella typhimurium LT2
ucacgcccgcggcau

SEQ ID NO: 3774411 - RNA, 19 nt, Salmonella typhimurium LT2
ucacgccgacgacaggcag

SEQ ID NO: 3774412 - RNA, 21 nt, Salmonella typhimurium LT2
ucacgccgaugguugccagac

SEQ ID NO: 3774413 - RNA, 15 nt, Salmonella typhimurium LT2
ucacgccguccagca

SEQ ID NO: 3774414 - RNA, 22 nt, Salmonella typhimurium LT2
ucacgcgccgccugcacggcgu

SEQ ID NO: 3774415 - RNA, 22 nt, Salmonella typhimurium LT2
ucacgcgcuguaacuucacgcc

SEQ ID NO: 3774416 - RNA, 17 nt, Salmonella typhimurium LT2
ucacgcguucaauauuc

SEQ ID NO: 3774417 - RNA, 15 nt, Salmonella typhimurium LT2
ucacgcucccggaac

SEQ ID NO: 3774418 - RNA, 18 nt, Salmonella typhimurium LT2
ucacgcuccuugagcgcc

SEQ ID NO: 3774419 - RNA, 17 nt, Salmonella typhimurium LT2
ucacgcucuucgccaau

SEQ ID NO: 3774420 - RNA, 20 nt, Salmonella typhimurium LT2
ucacgcugaaaaccgcauca

SEQ ID NO: 3774421 - RNA, 16 nt, Salmonella typhimurium LT2
ucacgcugcaguuuau

SEQ ID NO: 3774422 - RNA, 19 nt, Salmonella typhimurium LT2
ucacgcuggugcgcggaag

SEQ ID NO: 3774423 - RNA, 19 nt, Salmonella typhimurium LT2
ucacggcaucugcggcaug

SEQ ID NO: 3774424 - RNA, 17 nt, Salmonella typhimurium LT2
ucacggcgaaucgccug

SEQ ID NO: 3774425 - RNA, 14 nt, Salmonella typhimurium LT2
ucacgggaacggcg

SEQ ID NO: 3774426 - RNA, 13 nt, Salmonella typhimurium LT2
ucacgggcaucau

SEQ ID NO: 3774427 - RNA, 18 nt, Salmonella typhimurium LT2
ucacgguagaccaaaugg

SEQ ID NO: 3774428 - RNA, 18 nt, Salmonella typhimurium LT2
ucacgguauucguuacca

SEQ ID NO: 3774429 - RNA, 23 nt, Salmonella typhimurium LT2
ucacgguauucguuaccagcauc

SEQ ID NO: 3774430 - RNA, 20 nt, Salmonella typhimurium LT2
ucacguacaaacgcuucuau

SEQ ID NO: 3774431 - RNA, 22 nt, Salmonella typhimurium LT2
ucacgucgcgaagcugugcguu

SEQ ID NO: 3774432 - RNA, 18 nt, Salmonella typhimurium LT2
ucacgucgcgcgccgccu

SEQ ID NO: 3774433 - RNA, 13 nt, Salmonella typhimurium LT2
ucacguucagcgc

SEQ ID NO: 3774434 - RNA, 19 nt, Salmonella typhimurium LT2
ucacguugacgcaaacugc

SEQ ID NO: 3774435 - RNA, 18 nt, Salmonella typhimurium LT2
ucacguuuugcagcgcca

SEQ ID NO: 3774436 - RNA, 20 nt, Salmonella typhimurium LT2
ucacguuuugcagcgccauc

SEQ ID NO: 3774437 - RNA, 14 nt, Salmonella typhimurium LT2
ucacguuuuuacuc

SEQ ID NO: 3774438 - RNA, 23 nt, Salmonella typhimurium LT2
ucacguuuuuuacgucagcaaua

SEQ ID NO: 3774439 - RNA, 20 nt, Salmonella typhimurium LT2
ucacuaaacuaaugccuggc

SEQ ID NO: 3774440 - RNA, 15 nt, Salmonella typhimurium LT2
ucacuaacuagccau

SEQ ID NO: 3774441 - RNA, 21 nt, Salmonella typhimurium LT2
ucacuaacuccagcaucauuu

SEQ ID NO: 3774442 - RNA, 22 nt, Salmonella typhimurium LT2
ucacuaacuccagcaucauuuu

SEQ ID NO: 3774443 - RNA, 17 nt, Salmonella typhimurium LT2
ucacuccuaagagaaaa

SEQ ID NO: 3774444 - RNA, 19 nt, Salmonella typhimurium LT2
ucacugacuauccacagcg

SEQ ID NO: 3774445 - RNA, 20 nt, Salmonella typhimurium LT2
ucacuggcgaguugccggag

SEQ ID NO: 3774446 - RNA, 22 nt, Salmonella typhimurium LT2
ucacugucgccaggccaucgcc

SEQ ID NO: 3774447 - RNA, 12 nt, Salmonella typhimurium LT2
ucacuuauaaau

SEQ ID NO: 3774448 - RNA, 14 nt, Salmonella typhimurium LT2
ucacuuauguacaa

SEQ ID NO: 3774449 - RNA, 15 nt, Salmonella typhimurium LT2
ucacuucaauguuag

SEQ ID NO: 3774450 - RNA, 14 nt, Salmonella typhimurium LT2
ucacuucaucauca

SEQ ID NO: 3774451 - RNA, 15 nt, Salmonella typhimurium LT2
ucacuucaucaucau

SEQ ID NO: 3774452 - RNA, 13 nt, Salmonella typhimurium LT2
ucacuucauccgg

SEQ ID NO: 3774453 - RNA, 21 nt, Salmonella typhimurium LT2
ucacuuccgccaccacgccca

SEQ ID NO: 3774454 - RNA, 23 nt, Salmonella typhimurium LT2
ucacuucugaguucggcaugggg

SEQ ID NO: 3774455 - RNA, 19 nt, Salmonella typhimurium LT2
ucacuucuucauaaaaccc

SEQ ID NO: 3774456 - RNA, 22 nt, Salmonella typhimurium LT2
ucacuucuuugaaguucaucac

SEQ ID NO: 3774457 - RNA, 19 nt, Salmonella typhimurium LT2
ucacuuucuugccacuggc

SEQ ID NO: 3774458 - RNA, 17 nt, Salmonella typhimurium LT2
ucacuuuucuuuccugc

SEQ ID NO: 3774459 - RNA, 16 nt, Salmonella typhimurium LT2
ucacuuuugggccgcg

SEQ ID NO: 3774460 - RNA, 13 nt, Salmonella typhimurium LT2
ucagaaauccgcg

SEQ ID NO: 3774461 - RNA, 19 nt, Salmonella typhimurium LT2
ucagaaauguauucucccg

SEQ ID NO: 3774462 - RNA, 15 nt, Salmonella typhimurium LT2
ucagaagaagacaac

SEQ ID NO: 3774463 - RNA, 20 nt, Salmonella typhimurium LT2
ucagaauacagaauccggcg

SEQ ID NO: 3774464 - RNA, 20 nt, Salmonella typhimurium LT2
ucagaauaccgcguccuucu

SEQ ID NO: 3774465 - RNA, 16 nt, Salmonella typhimurium LT2
ucagaauaugccaggg

SEQ ID NO: 3774466 - RNA, 13 nt, Salmonella typhimurium LT2
ucagaauauguuu

SEQ ID NO: 3774467 - RNA, 20 nt, Salmonella typhimurium LT2
ucagacacauucugugaucc

SEQ ID NO: 3774468 - RNA, 12 nt, Salmonella typhimurium LT2
ucagacaguagc

SEQ ID NO: 3774469 - RNA, 23 nt, Salmonella typhimurium LT2
ucagaccagaaccucacggagaa

SEQ ID NO: 3774470 - RNA, 23 nt, Salmonella typhimurium LT2
ucagaccgagacccagcgcgaau

SEQ ID NO: 3774471 - RNA, 20 nt, Salmonella typhimurium LT2
ucagacgaggcgcaacauuu

SEQ ID NO: 3774472 - RNA, 15 nt, Salmonella typhimurium LT2
ucagacgcugguugu

SEQ ID NO: 3774473 - RNA, 17 nt, Salmonella typhimurium LT2
ucagaggggauggcgua

SEQ ID NO: 3774474 - RNA, 23 nt, Salmonella typhimurium LT2
ucagagguaaucagaucggcaag

SEQ ID NO: 3774475 - RNA, 19 nt, Salmonella typhimurium LT2
ucagauaaccuguggaucg

SEQ ID NO: 3774476 - RNA, 18 nt, Salmonella typhimurium LT2
ucagauacggcuccagca

SEQ ID NO: 3774477 - RNA, 19 nt, Salmonella typhimurium LT2
ucagauagagaaggcugga

SEQ ID NO: 3774478 - RNA, 22 nt, Salmonella typhimurium LT2
ucagauagcgaaccaucauuaa

SEQ ID NO: 3774479 - RNA, 18 nt, Salmonella typhimurium LT2
ucagauaguauuucccuu

SEQ ID NO: 3774480 - RNA, 21 nt, Salmonella typhimurium LT2
ucagauccuggcgugucccca

SEQ ID NO: 3774481 - RNA, 16 nt, Salmonella typhimurium LT2
ucagauccuucauuca

SEQ ID NO: 3774482 - RNA, 18 nt, Salmonella typhimurium LT2
ucagaucgguaaaggcgu

SEQ ID NO: 3774483 - RNA, 16 nt, Salmonella typhimurium LT2
ucagaucugcgcccau

SEQ ID NO: 3774484 - RNA, 17 nt, Salmonella typhimurium LT2
ucagaucuuauaugagc

SEQ ID NO: 3774485 - RNA, 14 nt, Salmonella typhimurium LT2
ucagaugacagucc

SEQ ID NO: 3774486 - RNA, 16 nt, Salmonella typhimurium LT2
ucagaugguuugccgc

SEQ ID NO: 3774487 - RNA, 17 nt, Salmonella typhimurium LT2
ucagaugugguauuuuc

SEQ ID NO: 3774488 - RNA, 18 nt, Salmonella typhimurium LT2
ucagaugugguauuuucu

SEQ ID NO: 3774489 - RNA, 19 nt, Salmonella typhimurium LT2
ucagauuaaucaggcguuc

SEQ ID NO: 3774490 - RNA, 17 nt, Salmonella typhimurium LT2
ucagauuacccccuucg

SEQ ID NO: 3774491 - RNA, 19 nt, Salmonella typhimurium LT2
ucagauucgcuacugcauc

SEQ ID NO: 3774492 - RNA, 20 nt, Salmonella typhimurium LT2
ucagcaaacgaccuuucgcc

SEQ ID NO: 3774493 - RNA, 18 nt, Salmonella typhimurium LT2
ucagcaacggaagcugac

SEQ ID NO: 3774494 - RNA, 14 nt, Salmonella typhimurium LT2
ucagcaagcgccag

SEQ ID NO: 3774495 - RNA, 20 nt, Salmonella typhimurium LT2
ucagcaauaauuuuaccauu

SEQ ID NO: 3774496 - RNA, 15 nt, Salmonella typhimurium LT2
ucagcaauauuuugu

SEQ ID NO: 3774497 - RNA, 18 nt, Salmonella typhimurium LT2
ucagcaaucgcuggcgua

SEQ ID NO: 3774498 - RNA, 18 nt, Salmonella typhimurium LT2
ucagggguccccacggga

SEQ ID NO: 3774499 - RNA, 17 nt, Salmonella typhimurium LT2
ucaggguuagcgauccu

SEQ ID NO: 3774500 - RNA, 15 nt, Salmonella typhimurium LT2
ucaggguuuucagga

SEQ ID NO: 3774501 - RNA, 19 nt, Salmonella typhimurium LT2
ucaggguuuucuaccgcag

SEQ ID NO: 3774502 - RNA, 22 nt, Salmonella typhimurium LT2
ucagguaaguguaaguucauuu

SEQ ID NO: 3774503 - RNA, 14 nt, Salmonella typhimurium LT2
ucagguaucccgcc

SEQ ID NO: 3774504 - RNA, 20 nt, Salmonella typhimurium LT2
ucaggugaauaccaaagccc

SEQ ID NO: 3774505 - RNA, 17 nt, Salmonella typhimurium LT2
ucaggugaguaaauaaa

SEQ ID NO: 3774506 - RNA, 13 nt, Salmonella typhimurium LT2
ucagguuacgcac

SEQ ID NO: 3774507 - RNA, 15 nt, Salmonella typhimurium LT2
ucagguuaggcgcga

SEQ ID NO: 3774508 - RNA, 19 nt, Salmonella typhimurium LT2
ucagguuaggcgcgauaau

SEQ ID NO: 3774509 - RNA, 18 nt, Salmonella typhimurium LT2
ucagguuaugcgcgccaa

SEQ ID NO: 3774510 - RNA, 19 nt, Salmonella typhimurium LT2
ucagguuccacgucugggu

SEQ ID NO: 3774511 - RNA, 21 nt, Salmonella typhimurium LT2
ucagguucgggccaccuucca

SEQ ID NO: 3774512 - RNA, 11 nt, Salmonella typhimurium LT2
ucagguuuuuu

SEQ ID NO: 3774513 - RNA, 21 nt, Salmonella typhimurium LT2
ucagguuuuuugugaguucau

SEQ ID NO: 3774514 - RNA, 17 nt, Salmonella typhimurium LT2
ucaguaaaucccgcauc

SEQ ID NO: 3774515 - RNA, 17 nt, Salmonella typhimurium LT2
ucaguaccucgcauacu

SEQ ID NO: 3774516 - RNA, 21 nt, Salmonella typhimurium LT2
ucaguacgcgcgcggcgucaa

SEQ ID NO: 3774517 - RNA, 20 nt, Salmonella typhimurium LT2
ucaguagccgccgcaggaca

SEQ ID NO: 3774518 - RNA, 21 nt, Salmonella typhimurium LT2
ucaguagccgccgcaggacag

SEQ ID NO: 3774519 - RNA, 23 nt, Salmonella typhimurium LT2
ucaguagcuuuuccgcuggaaua

SEQ ID NO: 3774520 - RNA, 23 nt, Salmonella typhimurium LT2
ucaguaugaucaugcccggcaaa

SEQ ID NO: 3774521 - RNA, 16 nt, Salmonella typhimurium LT2
ucagucacauacuucu

SEQ ID NO: 3774522 - RNA, 22 nt, Salmonella typhimurium LT2
ucagucccgggcuaaucgcaaa

SEQ ID NO: 3774523 - RNA, 13 nt, Salmonella typhimurium LT2
ucagugaacaccc

SEQ ID NO: 3774524 - RNA, 20 nt, Salmonella typhimurium LT2
ucagugauggauuucacaau

SEQ ID NO: 3774525 - RNA, 17 nt, Salmonella typhimurium LT2
ucaguggcggcaaaaaa

SEQ ID NO: 3774526 - RNA, 22 nt, Salmonella typhimurium LT2
ucaguggcggcaaaaaauauag

SEQ ID NO: 3774527 - RNA, 19 nt, Salmonella typhimurium LT2
ucaguggcguagcguacug

SEQ ID NO: 3774528 - RNA, 16 nt, Salmonella typhimurium LT2
ucaguggucaggcgac

SEQ ID NO: 3774529 - RNA, 21 nt, Salmonella typhimurium LT2
ucaguguuuccauacauuuuu

SEQ ID NO: 3774530 - RNA, 21 nt, Salmonella typhimurium LT2
ucaguuaagcggggguaacaa

SEQ ID NO: 3774531 - RNA, 22 nt, Salmonella typhimurium LT2
ucaguuaugacagacaggccuu

SEQ ID NO: 3774532 - RNA, 14 nt, Salmonella typhimurium LT2
ucaguucacgcgcc

SEQ ID NO: 3774533 - RNA, 12 nt, Salmonella typhimurium LT2
ucaguucagaaa

SEQ ID NO: 3774534 - RNA, 16 nt, Salmonella typhimurium LT2
ucaguucggagaucag

SEQ ID NO: 3774535 - RNA, 22 nt, Salmonella typhimurium LT2
ucaguucucgguauccagcucg

SEQ ID NO: 3774536 - RNA, 20 nt, Salmonella typhimurium LT2
ucaguugcguucccaguucc

SEQ ID NO: 3774537 - RNA, 14 nt, Salmonella typhimurium LT2
ucaguugguuagaa

SEQ ID NO: 3774538 - RNA, 14 nt, Salmonella typhimurium LT2
ucaguuuuggcaau

SEQ ID NO: 3774539 - RNA, 18 nt, Salmonella typhimurium LT2
ucaguuuuggcaaucaca

SEQ ID NO: 3774540 - RNA, 15 nt, Salmonella typhimurium LT2
ucauaaaaaagaaua

SEQ ID NO: 3774541 - RNA, 22 nt, Salmonella typhimurium LT2
ucauaaauguacugcaauaacc

SEQ ID NO: 3774542 - RNA, 14 nt, Salmonella typhimurium LT2
ucauaaauucgcag

SEQ ID NO: 3774543 - RNA, 19 nt, Salmonella typhimurium LT2
ucauaacaccaauacguga

SEQ ID NO: 3774544 - RNA, 15 nt, Salmonella typhimurium LT2
ucauaagucauccag

SEQ ID NO: 3774545 - RNA, 20 nt, Salmonella typhimurium LT2
ucauaauaagcgcucaggca

SEQ ID NO: 3774546 - RNA, 16 nt, Salmonella typhimurium LT2
ucauaaucgcgauacu

SEQ ID NO: 3774547 - RNA, 23 nt, Salmonella typhimurium LT2
ucauaaucgcgauacugccgccc

SEQ ID NO: 3774548 - RNA, 20 nt, Salmonella typhimurium LT2
ucauaaugucccugccacgc

SEQ ID NO: 3774549 - RNA, 21 nt, Salmonella typhimurium LT2
ucauacagcccgcgcagaauc

SEQ ID NO: 3774550 - RNA, 13 nt, Salmonella typhimurium LT2
ucauaccaugauu

SEQ ID NO: 3774551 - RNA, 14 nt, Salmonella typhimurium LT2
ucauaccgccgccc

SEQ ID NO: 3774552 - RNA, 19 nt, Salmonella typhimurium LT2
ucauaccggauauggcaaa

SEQ ID NO: 3774553 - RNA, 22 nt, Salmonella typhimurium LT2
ucauacgaucgcgcacaugcug

SEQ ID NO: 3774554 - RNA, 18 nt, Salmonella typhimurium LT2
ucauacgcuuuacgcuua

SEQ ID NO: 3774555 - RNA, 22 nt, Salmonella typhimurium LT2
ucauacgcuuucugaauuuccu

SEQ ID NO: 3774556 - RNA, 14 nt, Salmonella typhimurium LT2
ucauacuggcgaug

SEQ ID NO: 3774557 - RNA, 23 nt, Salmonella typhimurium LT2
ucauacuggcgaugauacccuga

SEQ ID NO: 3774558 - RNA, 14 nt, Salmonella typhimurium LT2
ucauagacugcgcu

SEQ ID NO: 3774559 - RNA, 22 nt, Salmonella typhimurium LT2
ucauagacugcgcuuaacgcuu

SEQ ID NO: 3774560 - RNA, 19 nt, Salmonella typhimurium LT2
ucauagcccagcgugccug

SEQ ID NO: 3774561 - RNA, 20 nt, Salmonella typhimurium LT2
ucauagucgcuuuucauacu

SEQ ID NO: 3774562 - RNA, 14 nt, Salmonella typhimurium LT2
ucauagucggcgcc

SEQ ID NO: 3774563 - RNA, 14 nt, Salmonella typhimurium LT2
ucauagugcgcgcg

SEQ ID NO: 3774564 - RNA, 16 nt, Salmonella typhimurium LT2
ucauaguuuuccagcc

SEQ ID NO: 3774565 - RNA, 13 nt, Salmonella typhimurium LT2
ucauauaaaacag

SEQ ID NO: 3774566 - RNA, 17 nt, Salmonella typhimurium LT2
ucauauaaucugaaaga

SEQ ID NO: 3774567 - RNA, 21 nt, Salmonella typhimurium LT2
ucauaucccggcugacauaau

SEQ ID NO: 3774568 - RNA, 16 nt, Salmonella typhimurium LT2
ucauaucgauaccgaa

SEQ ID NO: 3774569 - RNA, 19 nt, Salmonella typhimurium LT2
ucauauggaagcuguuaau

SEQ ID NO: 3774570 - RNA, 21 nt, Salmonella typhimurium LT2
ucauauggaagcuguuaauuu

SEQ ID NO: 3774571 - RNA, 13 nt, Salmonella typhimurium LT2
ucauauuaucgcg

SEQ ID NO: 3774572 - RNA, 13 nt, Salmonella typhimurium LT2
ucauauuccagcc

SEQ ID NO: 3774573 - RNA, 17 nt, Salmonella typhimurium LT2
ucauauugcccaucgcg

SEQ ID NO: 3774574 - RNA, 15 nt, Salmonella typhimurium LT2
ucauauugcgccgca

SEQ ID NO: 3774575 - RNA, 19 nt, Salmonella typhimurium LT2
ucauauuguagguuuuccu

SEQ ID NO: 3774576 - RNA, 23 nt, Salmonella typhimurium LT2
ucauauuguagguuuuccucucu

SEQ ID NO: 3774577 - RNA, 21 nt, Salmonella typhimurium LT2
ucauauuuauacaucauccgu

SEQ ID NO: 3774578 - RNA, 11 nt, Salmonella typhimurium LT2
ucauauuugcu

SEQ ID NO: 3774579 - RNA, 22 nt, Salmonella typhimurium LT2
ucauauuugcuggcuugcucag

SEQ ID NO: 3774580 - RNA, 21 nt, Salmonella typhimurium LT2
ucauauuuucagaaaucauau

SEQ ID NO: 3774581 - RNA, 13 nt, Salmonella typhimurium LT2
ucaucaaaaaggc

SEQ ID NO: 3774582 - RNA, 15 nt, Salmonella typhimurium LT2
ucaucaaacgauacc

SEQ ID NO: 3774583 - RNA, 13 nt, Salmonella typhimurium LT2
ucaucaaauuauc

SEQ ID NO: 3774584 - RNA, 16 nt, Salmonella typhimurium LT2
ucaucaagagauaucc

SEQ ID NO: 3774585 - RNA, 13 nt, Salmonella typhimurium LT2
ucaucaaguaccg

SEQ ID NO: 3774586 - RNA, 17 nt, Salmonella typhimurium LT2
ucaucaauaucuuuuug

SEQ ID NO: 3774587 - RNA, 14 nt, Salmonella typhimurium LT2
ucaucaaucgcuuu

SEQ ID NO: 3774588 - RNA, 16 nt, Salmonella typhimurium LT2
ucaucacaucccagca

SEQ ID NO: 3774589 - RNA, 14 nt, Salmonella typhimurium LT2
ucaucacaucgcgc

SEQ ID NO: 3774590 - RNA, 16 nt, Salmonella typhimurium LT2
ucaucaccaucgccgg

SEQ ID NO: 3774591 - RNA, 16 nt, Salmonella typhimurium LT2
ucaucaccuccagcac

SEQ ID NO: 3774592 - RNA, 15 nt, Salmonella typhimurium LT2
ucaucagaagaagac

SEQ ID NO: 3774593 - RNA, 20 nt, Salmonella typhimurium LT2
ucaucagaccgagacccagc

SEQ ID NO: 3774594 - RNA, 19 nt, Salmonella typhimurium LT2
ucaucagcacaaaauccca

SEQ ID NO: 3774595 - RNA, 12 nt, Salmonella typhimurium LT2
ucaucagcagca

SEQ ID NO: 3774596 - RNA, 15 nt, Salmonella typhimurium LT2
ucaucagccagcauc

SEQ ID NO: 3774597 - RNA, 16 nt, Salmonella typhimurium LT2
ucaucagccagcaucg

SEQ ID NO: 3774598 - RNA, 14 nt, Salmonella typhimurium LT2
ucaucaguaacuga

SEQ ID NO: 3774599 - RNA, 23 nt, Salmonella typhimurium LT2
ucaucagucucaaacgccugcau

SEQ ID NO: 3774600 - RNA, 15 nt, Salmonella typhimurium LT2
ucaucaucagcagca

SEQ ID NO: 3774601 - RNA, 11 nt, Salmonella typhimurium LT2
ucaucaucagg

SEQ ID NO: 3774602 - RNA, 15 nt, Salmonella typhimurium LT2
ucauucucuaccccu

SEQ ID NO: 3774603 - RNA, 14 nt, Salmonella typhimurium LT2
ucauucugucagca

SEQ ID NO: 3774604 - RNA, 15 nt, Salmonella typhimurium LT2
ucauucugucagcaa

SEQ ID NO: 3774605 - RNA, 14 nt, Salmonella typhimurium LT2
ucauucuguucaau

SEQ ID NO: 3774606 - RNA, 20 nt, Salmonella typhimurium LT2
ucauugacccucccugcgcu

SEQ ID NO: 3774607 - RNA, 11 nt, Salmonella typhimurium LT2
ucauugagcau

SEQ ID NO: 3774608 - RNA, 17 nt, Salmonella typhimurium LT2
ucauugccguaaauuga

SEQ ID NO: 3774609 - RNA, 18 nt, Salmonella typhimurium LT2
ucauugcgaucuccuuua

SEQ ID NO: 3774610 - RNA, 20 nt, Salmonella typhimurium LT2
ucauuggaagagacacgcug

SEQ ID NO: 3774611 - RNA, 21 nt, Salmonella typhimurium LT2
ucauuggaagagacacgcuga

SEQ ID NO: 3774612 - RNA, 16 nt, Salmonella typhimurium LT2
ucauuggggacgcgca

SEQ ID NO: 3774613 - RNA, 15 nt, Salmonella typhimurium LT2
ucauuguauuucuca

SEQ ID NO: 3774614 - RNA, 13 nt, Salmonella typhimurium LT2
ucauuucaacaua

SEQ ID NO: 3774615 - RNA, 12 nt, Salmonella typhimurium LT2
ucauuucuacaa

SEQ ID NO: 3774616 - RNA, 18 nt, Salmonella typhimurium LT2
ucauuucugccugcuuca

SEQ ID NO: 3774617 - RNA, 18 nt, Salmonella typhimurium LT2
ucauuugcaauggccccu

SEQ ID NO: 3774618 - RNA, 20 nt, Salmonella typhimurium LT2
ucauuuguacaaaaaaugug

SEQ ID NO: 3774619 - RNA, 14 nt, Salmonella typhimurium LT2
ucauuuucccacug

SEQ ID NO: 3774620 - RNA, 21 nt, Salmonella typhimurium LT2
ucauuuucccacugaccugcu

SEQ ID NO: 3774621 - RNA, 14 nt, Salmonella typhimurium LT2
ucauuuugauucag

SEQ ID NO: 3774622 - RNA, 15 nt, Salmonella typhimurium LT2
ucauuuugccgauaa

SEQ ID NO: 3774623 - RNA, 20 nt, Salmonella typhimurium LT2
ucauuuuuaggcguacauua

SEQ ID NO: 3774624 - RNA, 21 nt, Salmonella typhimurium LT2
uccaacaaggauauccgccag

SEQ ID NO: 3774625 - RNA, 19 nt, Salmonella typhimurium LT2
uccaacacaucgacaugca

SEQ ID NO: 3774626 - RNA, 22 nt, Salmonella typhimurium LT2
uccaacacaucgacaugcagau

SEQ ID NO: 3774627 - RNA, 16 nt, Salmonella typhimurium LT2
uccaacagaaggcuuc

SEQ ID NO: 3774628 - RNA, 12 nt, Salmonella typhimurium LT2
uccaacauagcu

SEQ ID NO: 3774629 - RNA, 22 nt, Salmonella typhimurium LT2
uccaacauagcuaaauuaaaaa

SEQ ID NO: 3774630 - RNA, 17 nt, Salmonella typhimurium LT2
uccaaccgcugaccauc

SEQ ID NO: 3774631 - RNA, 18 nt, Salmonella typhimurium LT2
uccaacgcgguuuucccu

SEQ ID NO: 3774632 - RNA, 18 nt, Salmonella typhimurium LT2
uccaacucaguuuccagc

SEQ ID NO: 3774633 - RNA, 17 nt, Salmonella typhimurium LT2
uccaacuggcuuucauc

SEQ ID NO: 3774634 - RNA, 16 nt, Salmonella typhimurium LT2
uccaacugucgccauc

SEQ ID NO: 3774635 - RNA, 16 nt, Salmonella typhimurium LT2
uccaacuuaugaaaac

SEQ ID NO: 3774636 - RNA, 22 nt, Salmonella typhimurium LT2
uccacaaaaggauacagcgccg

SEQ ID NO: 3774637 - RNA, 12 nt, Salmonella typhimurium LT2
uccacaccuucc

SEQ ID NO: 3774638 - RNA, 16 nt, Salmonella typhimurium LT2
uccacaccuuccacuu

SEQ ID NO: 3774639 - RNA, 21 nt, Salmonella typhimurium LT2
uccacacgccuggccaggcuu

SEQ ID NO: 3774640 - RNA, 20 nt, Salmonella typhimurium LT2
uccacacguccauccgggua

SEQ ID NO: 3774641 - RNA, 16 nt, Salmonella typhimurium LT2
uccacagcgaauuccg

SEQ ID NO: 3774642 - RNA, 15 nt, Salmonella typhimurium LT2
uccacauacugcaau

SEQ ID NO: 3774643 - RNA, 16 nt, Salmonella typhimurium LT2
uccacauccccgcguu

SEQ ID NO: 3774644 - RNA, 14 nt, Salmonella typhimurium LT2
uccacauuccagac

SEQ ID NO: 3774645 - RNA, 21 nt, Salmonella typhimurium LT2
uccacauuggcuuugccauuc

SEQ ID NO: 3774646 - RNA, 16 nt, Salmonella typhimurium LT2
uccaccaaccaggcaa

SEQ ID NO: 3774647 - RNA, 22 nt, Salmonella typhimurium LT2
uccaccacgacgagacguuggg

SEQ ID NO: 3774648 - RNA, 16 nt, Salmonella typhimurium LT2
uccaccacuugauucu

SEQ ID NO: 3774649 - RNA, 19 nt, Salmonella typhimurium LT2
uccaccagcccaucuuucg

SEQ ID NO: 3774650 - RNA, 18 nt, Salmonella typhimurium LT2
uccaccagcuuaucugac

SEQ ID NO: 3774651 - RNA, 17 nt, Salmonella typhimurium LT2
uccaccaggcaugcagc

SEQ ID NO: 3774652 - RNA, 15 nt, Salmonella typhimurium LT2
uccaccauaguuucg

SEQ ID NO: 3774653 - RNA, 13 nt, Salmonella typhimurium LT2
uccaccauucgcg

SEQ ID NO: 3774654 - RNA, 14 nt, Salmonella typhimurium LT2
uccacccaguucau

SEQ ID NO: 3774655 - RNA, 19 nt, Salmonella typhimurium LT2
uccacccaguucauuaaca

SEQ ID NO: 3774656 - RNA, 14 nt, Salmonella typhimurium LT2
uccacccucccaga

SEQ ID NO: 3774657 - RNA, 15 nt, Salmonella typhimurium LT2
uccacccuggcgcag

SEQ ID NO: 3774658 - RNA, 19 nt, Salmonella typhimurium LT2
uccaccgccagacgcccca

SEQ ID NO: 3774659 - RNA, 19 nt, Salmonella typhimurium LT2
uccaccuucucuuuaugcg

SEQ ID NO: 3774660 - RNA, 17 nt, Salmonella typhimurium LT2
uccacgacagaacccgg

SEQ ID NO: 3774661 - RNA, 20 nt, Salmonella typhimurium LT2
uccacgcccagcgccgggaa

SEQ ID NO: 3774662 - RNA, 20 nt, Salmonella typhimurium LT2
uccacgcccugcuuuuucag

SEQ ID NO: 3774663 - RNA, 22 nt, Salmonella typhimurium LT2
uccacgccgaacgauugacccg

SEQ ID NO: 3774664 - RNA, 15 nt, Salmonella typhimurium LT2
uccacgguaaaacac

SEQ ID NO: 3774665 - RNA, 22 nt, Salmonella typhimurium LT2
uccacgguacuggugcccgcaa

SEQ ID NO: 3774666 - RNA, 18 nt, Salmonella typhimurium LT2
uccacggucggucaagcu

SEQ ID NO: 3774667 - RNA, 15 nt, Salmonella typhimurium LT2
uccacgucuggguuu

SEQ ID NO: 3774668 - RNA, 22 nt, Salmonella typhimurium LT2
uccacguuccgcaaucgcugcc

SEQ ID NO: 3774669 - RNA, 17 nt, Salmonella typhimurium LT2
uccacugcagugucaaa

SEQ ID NO: 3774670 - RNA, 19 nt, Salmonella typhimurium LT2
uccacugcaucucuuccag

SEQ ID NO: 3774671 - RNA, 12 nt, Salmonella typhimurium LT2
uccacuggcccc

SEQ ID NO: 3774672 - RNA, 21 nt, Salmonella typhimurium LT2
uccacuggcccccuguuccag

SEQ ID NO: 3774673 - RNA, 16 nt, Salmonella typhimurium LT2
uccacuguccagaucu

SEQ ID NO: 3774674 - RNA, 14 nt, Salmonella typhimurium LT2
uccacuucagcagc

SEQ ID NO: 3774675 - RNA, 18 nt, Salmonella typhimurium LT2
uccacuucagccagcugc

SEQ ID NO: 3774676 - RNA, 23 nt, Salmonella typhimurium LT2
uccacuugggggcgggucgacgu

SEQ ID NO: 3774677 - RNA, 17 nt, Salmonella typhimurium LT2
uccacuuucagcggcuu

SEQ ID NO: 3774678 - RNA, 21 nt, Salmonella typhimurium LT2
uccacuuucucggcuuuccag

SEQ ID NO: 3774679 - RNA, 16 nt, Salmonella typhimurium LT2
uccagaaacaguuccg

SEQ ID NO: 3774680 - RNA, 24 nt, Salmonella typhimurium LT2
uccagaacgaauuuacucgccaau

SEQ ID NO: 3774681 - RNA, 17 nt, Salmonella typhimurium LT2
uccagaauacgaauauu

SEQ ID NO: 3774682 - RNA, 17 nt, Salmonella typhimurium LT2
uccagaaugcguaaaaa

SEQ ID NO: 3774683 - RNA, 16 nt, Salmonella typhimurium LT2
uccagacaauccgcgg

SEQ ID NO: 3774684 - RNA, 12 nt, Salmonella typhimurium LT2
uccagacagcuu

SEQ ID NO: 3774685 - RNA, 14 nt, Salmonella typhimurium LT2
uccagaccaccagc

SEQ ID NO: 3774686 - RNA, 19 nt, Salmonella typhimurium LT2
uccagaccaccagcgacau

SEQ ID NO: 3774687 - RNA, 20 nt, Salmonella typhimurium LT2
uccagacgcugacaaaucgg

SEQ ID NO: 3774688 - RNA, 15 nt, Salmonella typhimurium LT2
uccagacguugcucu

SEQ ID NO: 3774689 - RNA, 14 nt, Salmonella typhimurium LT2
uccagacucugcgc

SEQ ID NO: 3774690 - RNA, 23 nt, Salmonella typhimurium LT2
uccagacuguggccgguauauuu

SEQ ID NO: 3774691 - RNA, 17 nt, Salmonella typhimurium LT2
uccagaggcauuauugc

SEQ ID NO: 3774692 - RNA, 15 nt, Salmonella typhimurium LT2
uccagaggcguugcc

SEQ ID NO: 3774693 - RNA, 22 nt, Salmonella typhimurium LT2
uccagaggguaauuucuuccau

SEQ ID NO: 3774694 - RNA, 15 nt, Salmonella typhimurium LT2
uccagaguacauucu

SEQ ID NO: 3774695 - RNA, 18 nt, Salmonella typhimurium LT2
uccagaguacauucucuu

SEQ ID NO: 3774696 - RNA, 16 nt, Salmonella typhimurium LT2
uccagauagggccagg

SEQ ID NO: 3774697 - RNA, 17 nt, Salmonella typhimurium LT2
uccagauccacugcauc

SEQ ID NO: 3774698 - RNA, 12 nt, Salmonella typhimurium LT2
uccagaucuuca

SEQ ID NO: 3774699 - RNA, 14 nt, Salmonella typhimurium LT2
uccagaucuucaga

SEQ ID NO: 3774700 - RNA, 22 nt, Salmonella typhimurium LT2
uccagaugacacuaucuccuuc

SEQ ID NO: 3774701 - RNA, 20 nt, Salmonella typhimurium LT2
uccagaugcgccagauucau

SEQ ID NO: 3774702 - RNA, 23 nt, Salmonella typhimurium LT2
uccagaugcgugaccgcguugcc

SEQ ID NO: 3774703 - RNA, 22 nt, Salmonella typhimurium LT2
uccagauuacuaugaggauuau

SEQ ID NO: 3774704 - RNA, 15 nt, Salmonella typhimurium LT2
uccagauugcucagg

SEQ ID NO: 3774705 - RNA, 15 nt, Salmonella typhimurium LT2
uccagcaagccggaa

SEQ ID NO: 3774706 - RNA, 22 nt, Salmonella typhimurium LT2
uccauuagcgccugaugcacau

SEQ ID NO: 3774707 - RNA, 14 nt, Salmonella typhimurium LT2
uccauucaucgauu

SEQ ID NO: 3774708 - RNA, 16 nt, Salmonella typhimurium LT2
uccauuccagaacgaa

SEQ ID NO: 3774709 - RNA, 13 nt, Salmonella typhimurium LT2
uccauucccagcu

SEQ ID NO: 3774710 - RNA, 15 nt, Salmonella typhimurium LT2
uccauucgucgagcu

SEQ ID NO: 3774711 - RNA, 21 nt, Salmonella typhimurium LT2
uccauugcuuccuugauauuu

SEQ ID NO: 3774712 - RNA, 17 nt, Salmonella typhimurium LT2
uccauuuccguuuucag

SEQ ID NO: 3774713 - RNA, 10 nt, Salmonella typhimurium LT2
uccauuuccu

SEQ ID NO: 3774714 - RNA, 21 nt, Salmonella typhimurium LT2
uccauuuuggggaaaauaccg

SEQ ID NO: 3774715 - RNA, 12 nt, Salmonella typhimurium LT2
uccauuuuucag

SEQ ID NO: 3774716 - RNA, 20 nt, Salmonella typhimurium LT2
uccauuuuucgaucuucucc

SEQ ID NO: 3774717 - RNA, 18 nt, Salmonella typhimurium LT2
ucccaacccgaccaggac

SEQ ID NO: 3774718 - RNA, 21 nt, Salmonella typhimurium LT2
ucccaacccgaccaggacaaa

SEQ ID NO: 3774719 - RNA, 14 nt, Salmonella typhimurium LT2
ucccaacuguuuuc

SEQ ID NO: 3774720 - RNA, 16 nt, Salmonella typhimurium LT2
ucccaauaaucccaaa

SEQ ID NO: 3774721 - RNA, 20 nt, Salmonella typhimurium LT2
ucccaaugcggaaaccaguu

SEQ ID NO: 3774722 - RNA, 13 nt, Salmonella typhimurium LT2
ucccaaugcuuuc

SEQ ID NO: 3774723 - RNA, 20 nt, Salmonella typhimurium LT2
ucccacaacuguucuucgcu

SEQ ID NO: 3774724 - RNA, 19 nt, Salmonella typhimurium LT2
ucccacagcggaugguauu

SEQ ID NO: 3774725 - RNA, 21 nt, Salmonella typhimurium LT2
ucccacauccggcugaaaaau

SEQ ID NO: 3774726 - RNA, 13 nt, Salmonella typhimurium LT2
ucccaccacgcag

SEQ ID NO: 3774727 - RNA, 21 nt, Salmonella typhimurium LT2
ucccaccauaaagcgaauaau

SEQ ID NO: 3774728 - RNA, 15 nt, Salmonella typhimurium LT2
ucccacgcauagucc

SEQ ID NO: 3774729 - RNA, 17 nt, Salmonella typhimurium LT2
ucccacugaccugcugg

SEQ ID NO: 3774730 - RNA, 16 nt, Salmonella typhimurium LT2
ucccacugcacgccag

SEQ ID NO: 3774731 - RNA, 12 nt, Salmonella typhimurium LT2
ucccagaagaaa

SEQ ID NO: 3774732 - RNA, 13 nt, Salmonella typhimurium LT2
ucccagacaaaau

SEQ ID NO: 3774733 - RNA, 21 nt, Salmonella typhimurium LT2
ucccagaugaaaaaucggcaa

SEQ ID NO: 3774734 - RNA, 15 nt, Salmonella typhimurium LT2
ucccagaugcgccag

SEQ ID NO: 3774735 - RNA, 20 nt, Salmonella typhimurium LT2
ucccagcagagaucuuucac

SEQ ID NO: 3774736 - RNA, 21 nt, Salmonella typhimurium LT2
ucccagccgggcaggaaaagc

SEQ ID NO: 3774737 - RNA, 23 nt, Salmonella typhimurium LT2
ucccagccgggcaggaaaagcug

SEQ ID NO: 3774738 - RNA, 11 nt, Salmonella typhimurium LT2
ucccagcgccc

SEQ ID NO: 3774739 - RNA, 15 nt, Salmonella typhimurium LT2
ucccagcgucgccag

SEQ ID NO: 3774740 - RNA, 15 nt, Salmonella typhimurium LT2
ucccaggagauauca

SEQ ID NO: 3774741 - RNA, 19 nt, Salmonella typhimurium LT2
ucccaggagauaucaaaag

SEQ ID NO: 3774742 - RNA, 19 nt, Salmonella typhimurium LT2
ucccaggcgcgcagcugcc

SEQ ID NO: 3774743 - RNA, 23 nt, Salmonella typhimurium LT2
ucccaguaguuaccguaaucauc

SEQ ID NO: 3774744 - RNA, 18 nt, Salmonella typhimurium LT2
ucccagucauccgguuca

SEQ ID NO: 3774745 - RNA, 20 nt, Salmonella typhimurium LT2
ucccagucaucgucugcguc

SEQ ID NO: 3774746 - RNA, 14 nt, Salmonella typhimurium LT2
ucccaguggcgucg

SEQ ID NO: 3774747 - RNA, 18 nt, Salmonella typhimurium LT2
ucccauauuuuuucugcc

SEQ ID NO: 3774748 - RNA, 19 nt, Salmonella typhimurium LT2
ucccaucaauaagcgaauu

SEQ ID NO: 3774749 - RNA, 22 nt, Salmonella typhimurium LT2
ucccaucgcuuugcagaaaauc

SEQ ID NO: 3774750 - RNA, 16 nt, Salmonella typhimurium LT2
ucccaucguaacgccg

SEQ ID NO: 3774751 - RNA, 16 nt, Salmonella typhimurium LT2
uccccaacaucauguc

SEQ ID NO: 3774752 - RNA, 14 nt, Salmonella typhimurium LT2
uccccaacaucauu

SEQ ID NO: 3774753 - RNA, 18 nt, Salmonella typhimurium LT2
uccccacaaucccgccag

SEQ ID NO: 3774754 - RNA, 18 nt, Salmonella typhimurium LT2
uccccaccacugauggcg

SEQ ID NO: 3774755 - RNA, 22 nt, Salmonella typhimurium LT2
uccccacgccgaccaccagcuu

SEQ ID NO: 3774756 - RNA, 17 nt, Salmonella typhimurium LT2
uccccacuaccgccacu

SEQ ID NO: 3774757 - RNA, 13 nt, Salmonella typhimurium LT2
uccccagccgcuu

SEQ ID NO: 3774758 - RNA, 18 nt, Salmonella typhimurium LT2
uccccagcguaccacgcc

SEQ ID NO: 3774759 - RNA, 20 nt, Salmonella typhimurium LT2
uccccaggcuggcgcagccg

SEQ ID NO: 3774760 - RNA, 16 nt, Salmonella typhimurium LT2
uccccaucccaaucag

SEQ ID NO: 3774761 - RNA, 23 nt, Salmonella typhimurium LT2
uccccauuugaacucuuccagau

SEQ ID NO: 3774762 - RNA, 16 nt, Salmonella typhimurium LT2
uccccauuuuuuucag

SEQ ID NO: 3774763 - RNA, 14 nt, Salmonella typhimurium LT2
ucccccaaaaugcc

SEQ ID NO: 3774764 - RNA, 15 nt, Salmonella typhimurium LT2
ucccccaccaccauu

SEQ ID NO: 3774765 - RNA, 22 nt, Salmonella typhimurium LT2
ucccccacgccuguucaucagg

SEQ ID NO: 3774766 - RNA, 12 nt, Salmonella typhimurium LT2
ucccccacuucu

SEQ ID NO: 3774767 - RNA, 17 nt, Salmonella typhimurium LT2
ucccccagauucugaug

SEQ ID NO: 3774768 - RNA, 14 nt, Salmonella typhimurium LT2
ucccccagcacgcu

SEQ ID NO: 3774769 - RNA, 22 nt, Salmonella typhimurium LT2
ucccccuccauacccuauuuac

SEQ ID NO: 3774770 - RNA, 17 nt, Salmonella typhimurium LT2
uccccgccgccaucacc

SEQ ID NO: 3774771 - RNA, 14 nt, Salmonella typhimurium LT2
uccccgccgcggcg

SEQ ID NO: 3774772 - RNA, 21 nt, Salmonella typhimurium LT2
uccccgcuucgucgccaucca

SEQ ID NO: 3774773 - RNA, 16 nt, Salmonella typhimurium LT2
uccccggccagcgcgc

SEQ ID NO: 3774774 - RNA, 14 nt, Salmonella typhimurium LT2
uccccgucauacuu

SEQ ID NO: 3774775 - RNA, 16 nt, Salmonella typhimurium LT2
uccccucuuccaucag

SEQ ID NO: 3774776 - RNA, 21 nt, Salmonella typhimurium LT2
uccccucuuccaucagccagg

SEQ ID NO: 3774777 - RNA, 12 nt, Salmonella typhimurium LT2
uccccugcuccu

SEQ ID NO: 3774778 - RNA, 14 nt, Salmonella typhimurium LT2
uccccuucaggaau

SEQ ID NO: 3774779 - RNA, 18 nt, Salmonella typhimurium LT2
uccccuuuaggcggcgcc

SEQ ID NO: 3774780 - RNA, 19 nt, Salmonella typhimurium LT2
ucccgaaaugguuccaggc

SEQ ID NO: 3774781 - RNA, 13 nt, Salmonella typhimurium LT2
ucccgacgaauaa

SEQ ID NO: 3774782 - RNA, 19 nt, Salmonella typhimurium LT2
ucccgacgaauaacaaaau

SEQ ID NO: 3774783 - RNA, 14 nt, Salmonella typhimurium LT2
ucccgauaaugacc

SEQ ID NO: 3774784 - RNA, 17 nt, Salmonella typhimurium LT2
ucccgcaagaaacaggc

SEQ ID NO: 3774785 - RNA, 17 nt, Salmonella typhimurium LT2
ucccgcacuuuccagcc

SEQ ID NO: 3774786 - RNA, 13 nt, Salmonella typhimurium LT2
ucccgccagcugc

SEQ ID NO: 3774787 - RNA, 15 nt, Salmonella typhimurium LT2
ucccgccaucgucca

SEQ ID NO: 3774788 - RNA, 19 nt, Salmonella typhimurium LT2
ucccgccgccaucgccagu

SEQ ID NO: 3774789 - RNA, 12 nt, Salmonella typhimurium LT2
ucccgccgcgau

SEQ ID NO: 3774790 - RNA, 20 nt, Salmonella typhimurium LT2
ucccgccuaacccaccgaua

SEQ ID NO: 3774791 - RNA, 21 nt, Salmonella typhimurium LT2
ucccgccuggcgaaacgccug

SEQ ID NO: 3774792 - RNA, 22 nt, Salmonella typhimurium LT2
ucccgcgacgucaauaaagccg

SEQ ID NO: 3774793 - RNA, 18 nt, Salmonella typhimurium LT2
ucccgcgcugcgccgcaa

SEQ ID NO: 3774794 - RNA, 16 nt, Salmonella typhimurium LT2
ucccgcgcuucauccg

SEQ ID NO: 3774795 - RNA, 17 nt, Salmonella typhimurium LT2
ucccgcgcuucauccga

SEQ ID NO: 3774796 - RNA, 18 nt, Salmonella typhimurium LT2
ucccgcggcggacagcgg

SEQ ID NO: 3774797 - RNA, 22 nt, Salmonella typhimurium LT2
ucccgcguucgcgcaguucauc

SEQ ID NO: 3774798 - RNA, 13 nt, Salmonella typhimurium LT2
ucccgcugaagac

SEQ ID NO: 3774799 - RNA, 14 nt, Salmonella typhimurium LT2
ucccgcugaagacu

SEQ ID NO: 3774800 - RNA, 15 nt, Salmonella typhimurium LT2
ucccgcugguugccu

SEQ ID NO: 3774801 - RNA, 18 nt, Salmonella typhimurium LT2
ucccgcugugauccaugu

SEQ ID NO: 3774802 - RNA, 14 nt, Salmonella typhimurium LT2
ucccggcagugcau

SEQ ID NO: 3774803 - RNA, 14 nt, Salmonella typhimurium LT2
ucccggcauuauaa

SEQ ID NO: 3774804 - RNA, 17 nt, Salmonella typhimurium LT2
ucccggcugacauaauc

SEQ ID NO: 3774805 - RNA, 22 nt, Salmonella typhimurium LT2
ucccggcuuaaauuuuuaauaa

SEQ ID NO: 3774806 - RNA, 16 nt, Salmonella typhimurium LT2
ucccgggcgauaaacc

SEQ ID NO: 3774807 - RNA, 15 nt, Salmonella typhimurium LT2
ucccggggauuucau

SEQ ID NO: 3774808 - RNA, 12 nt, Salmonella typhimurium LT2
ucccgggugcgc

SEQ ID NO: 3774809 - RNA, 15 nt, Salmonella typhimurium LT2
ucccguaaaagaaga

SEQ ID NO: 3774810 - RNA, 21 nt, Salmonella typhimurium LT2
uccggcaagucagaccagucg

SEQ ID NO: 3774811 - RNA, 13 nt, Salmonella typhimurium LT2
uccggcaaucaaa

SEQ ID NO: 3774812 - RNA, 14 nt, Salmonella typhimurium LT2
uccggcacagcguu

SEQ ID NO: 3774813 - RNA, 19 nt, Salmonella typhimurium LT2
uccggcaccucguccagau

SEQ ID NO: 3774814 - RNA, 18 nt, Salmonella typhimurium LT2
uccggcacgauaaauugc

SEQ ID NO: 3774815 - RNA, 21 nt, Salmonella typhimurium LT2
uccggcacggucaaucaucag

SEQ ID NO: 3774816 - RNA, 16 nt, Salmonella typhimurium LT2
uccggcacucuucuuc

SEQ ID NO: 3774817 - RNA, 18 nt, Salmonella typhimurium LT2
uccggcacuggcgcuggc

SEQ ID NO: 3774818 - RNA, 17 nt, Salmonella typhimurium LT2
uccggcagacggcuggg

SEQ ID NO: 3774819 - RNA, 15 nt, Salmonella typhimurium LT2
uccggcagucgggcg

SEQ ID NO: 3774820 - RNA, 15 nt, Salmonella typhimurium LT2
uccggcauaaauaau

SEQ ID NO: 3774821 - RNA, 12 nt, Salmonella typhimurium LT2
uccggcauuuuu

SEQ ID NO: 3774822 - RNA, 14 nt, Salmonella typhimurium LT2
uccggccagacagg

SEQ ID NO: 3774823 - RNA, 19 nt, Salmonella typhimurium LT2
uccggccuacagcugauug

SEQ ID NO: 3774824 - RNA, 20 nt, Salmonella typhimurium LT2
uccggccuacgcgucaauua

SEQ ID NO: 3774825 - RNA, 22 nt, Salmonella typhimurium LT2
uccggccuacguuccaugcgau

SEQ ID NO: 3774826 - RNA, 23 nt, Salmonella typhimurium LT2
uccggccuacucuugagccagau

SEQ ID NO: 3774827 - RNA, 17 nt, Salmonella typhimurium LT2
uccggccugcaggcaac

SEQ ID NO: 3774828 - RNA, 16 nt, Salmonella typhimurium LT2
uccggccugcagggaa

SEQ ID NO: 3774829 - RNA, 13 nt, Salmonella typhimurium LT2
uccggccugcaug

SEQ ID NO: 3774830 - RNA, 21 nt, Salmonella typhimurium LT2
uccggcgaaaaaccaggcaac

SEQ ID NO: 3774831 - RNA, 21 nt, Salmonella typhimurium LT2
uccggcgaauagucgccgcgg

SEQ ID NO: 3774832 - RNA, 18 nt, Salmonella typhimurium LT2
uccggcgaggcguaaaac

SEQ ID NO: 3774833 - RNA, 20 nt, Salmonella typhimurium LT2
uccggcgaucaccacgccuu

SEQ ID NO: 3774834 - RNA, 15 nt, Salmonella typhimurium LT2
uccggcgcagacggc

SEQ ID NO: 3774835 - RNA, 18 nt, Salmonella typhimurium LT2
uccggcgccuccagccau

SEQ ID NO: 3774836 - RNA, 14 nt, Salmonella typhimurium LT2
uccggcgcgaacgg

SEQ ID NO: 3774837 - RNA, 14 nt, Salmonella typhimurium LT2
uccggcgcggcgcg

SEQ ID NO: 3774838 - RNA, 23 nt, Salmonella typhimurium LT2
uccggcgcgguauuucgccgccg

SEQ ID NO: 3774839 - RNA, 21 nt, Salmonella typhimurium LT2
uccggcgcugaugacgcgccg

SEQ ID NO: 3774840 - RNA, 22 nt, Salmonella typhimurium LT2
uccggcgcugugcggcgugcag

SEQ ID NO: 3774841 - RNA, 14 nt, Salmonella typhimurium LT2
uccggcggcagccg

SEQ ID NO: 3774842 - RNA, 19 nt, Salmonella typhimurium LT2
uccggcgggagcucuacca

SEQ ID NO: 3774843 - RNA, 17 nt, Salmonella typhimurium LT2
uccggcggucagccagc

SEQ ID NO: 3774844 - RNA, 20 nt, Salmonella typhimurium LT2
uccggcgucagcauggugug

SEQ ID NO: 3774845 - RNA, 22 nt, Salmonella typhimurium LT2
uccggcgucccuuucccuucca

SEQ ID NO: 3774846 - RNA, 23 nt, Salmonella typhimurium LT2
uccggcgucuggguuugcagcag

SEQ ID NO: 3774847 - RNA, 15 nt, Salmonella typhimurium LT2
uccggcucguccagg

SEQ ID NO: 3774848 - RNA, 16 nt, Salmonella typhimurium LT2
uccggcucgucccgca

SEQ ID NO: 3774849 - RNA, 19 nt, Salmonella typhimurium LT2
uccggcugccagccagcgg

SEQ ID NO: 3774850 - RNA, 22 nt, Salmonella typhimurium LT2
uccggcuuaaugcauggcagau

SEQ ID NO: 3774851 - RNA, 16 nt, Salmonella typhimurium LT2
uccgggauagcacuac

SEQ ID NO: 3774852 - RNA, 20 nt, Salmonella typhimurium LT2
uccgggccacucuccagcau

SEQ ID NO: 3774853 - RNA, 22 nt, Salmonella typhimurium LT2
uccgggccacucuccagcaucc

SEQ ID NO: 3774854 - RNA, 15 nt, Salmonella typhimurium LT2
uccggggccagcgcc

SEQ ID NO: 3774855 - RNA, 16 nt, Salmonella typhimurium LT2
uccgggguucgaaucc

SEQ ID NO: 3774856 - RNA, 22 nt, Salmonella typhimurium LT2
uccgggguucuuuuuaaaacac

SEQ ID NO: 3774857 - RNA, 13 nt, Salmonella typhimurium LT2
uccggguaauuuu

SEQ ID NO: 3774858 - RNA, 19 nt, Salmonella typhimurium LT2
uccggguauucaucggcac

SEQ ID NO: 3774859 - RNA, 15 nt, Salmonella typhimurium LT2
uccgguacgccuaaa

SEQ ID NO: 3774860 - RNA, 14 nt, Salmonella typhimurium LT2
uccgguacguccac

SEQ ID NO: 3774861 - RNA, 16 nt, Salmonella typhimurium LT2
uccgguauuccaucaa

SEQ ID NO: 3774862 - RNA, 12 nt, Salmonella typhimurium LT2
uccggucaucca

SEQ ID NO: 3774863 - RNA, 17 nt, Salmonella typhimurium LT2
uccggugaagguaauuu

SEQ ID NO: 3774864 - RNA, 18 nt, Salmonella typhimurium LT2
uccggugaagguaauuuu

SEQ ID NO: 3774865 - RNA, 16 nt, Salmonella typhimurium LT2
uccggugaucggcuug

SEQ ID NO: 3774866 - RNA, 14 nt, Salmonella typhimurium LT2
uccgguuccagcgg

SEQ ID NO: 3774867 - RNA, 12 nt, Salmonella typhimurium LT2
uccgguuucaac

SEQ ID NO: 3774868 - RNA, 20 nt, Salmonella typhimurium LT2
uccguacauaacagcagcag

SEQ ID NO: 3774869 - RNA, 23 nt, Salmonella typhimurium LT2
uccguaggcggcuaccgccguau

SEQ ID NO: 3774870 - RNA, 13 nt, Salmonella typhimurium LT2
uccguaucgugcu

SEQ ID NO: 3774871 - RNA, 19 nt, Salmonella typhimurium LT2
uccguaucguugaccguga

SEQ ID NO: 3774872 - RNA, 23 nt, Salmonella typhimurium LT2
uccguauuacacuacuucuucag

SEQ ID NO: 3774873 - RNA, 19 nt, Salmonella typhimurium LT2
uccguauucggaauaaugu

SEQ ID NO: 3774874 - RNA, 18 nt, Salmonella typhimurium LT2
uccgucaacaccugcauc

SEQ ID NO: 3774875 - RNA, 23 nt, Salmonella typhimurium LT2
uccgucagaauaucuuuuacaaa

SEQ ID NO: 3774876 - RNA, 13 nt, Salmonella typhimurium LT2
uccguccagaccg

SEQ ID NO: 3774877 - RNA, 11 nt, Salmonella typhimurium LT2
uccgucucaga

SEQ ID NO: 3774878 - RNA, 13 nt, Salmonella typhimurium LT2
uccgugaccugcu

SEQ ID NO: 3774879 - RNA, 14 nt, Salmonella typhimurium LT2
uccguuagcccuuu

SEQ ID NO: 3774880 - RNA, 16 nt, Salmonella typhimurium LT2
uccguucccaaugcuu

SEQ ID NO: 3774881 - RNA, 15 nt, Salmonella typhimurium LT2
uccguucccucugag

SEQ ID NO: 3774882 - RNA, 18 nt, Salmonella typhimurium LT2
uccguuuguaacauauuu

SEQ ID NO: 3774883 - RNA, 15 nt, Salmonella typhimurium LT2
uccguuuucaacgcc

SEQ ID NO: 3774884 - RNA, 17 nt, Salmonella typhimurium LT2
uccuacaccaccagccc

SEQ ID NO: 3774885 - RNA, 23 nt, Salmonella typhimurium LT2
uccuaccuugccgggccuggcau

SEQ ID NO: 3774886 - RNA, 20 nt, Salmonella typhimurium LT2
uccuaggacgaaaaaugaau

SEQ ID NO: 3774887 - RNA, 18 nt, Salmonella typhimurium LT2
uccucaaccugaggaaga

SEQ ID NO: 3774888 - RNA, 18 nt, Salmonella typhimurium LT2
uccucaccguagcuccag

SEQ ID NO: 3774889 - RNA, 22 nt, Salmonella typhimurium LT2
uccucaccguagcuccagaccu

SEQ ID NO: 3774890 - RNA, 12 nt, Salmonella typhimurium LT2
uccucacgcccu

SEQ ID NO: 3774891 - RNA, 13 nt, Salmonella typhimurium LT2
uccucauacagcc

SEQ ID NO: 3774892 - RNA, 16 nt, Salmonella typhimurium LT2
uccucauacagcccgc

SEQ ID NO: 3774893 - RNA, 13 nt, Salmonella typhimurium LT2
uccucauuauugc

SEQ ID NO: 3774894 - RNA, 19 nt, Salmonella typhimurium LT2
uccucauuuuguugcucca

SEQ ID NO: 3774895 - RNA, 13 nt, Salmonella typhimurium LT2
uccuccagcggca

SEQ ID NO: 3774896 - RNA, 15 nt, Salmonella typhimurium LT2
uccuccaucagcgcu

SEQ ID NO: 3774897 - RNA, 13 nt, Salmonella typhimurium LT2
uccuccaucaguu

SEQ ID NO: 3774898 - RNA, 14 nt, Salmonella typhimurium LT2
uccuccgccgauaa

SEQ ID NO: 3774899 - RNA, 14 nt, Salmonella typhimurium LT2
uccuccugcagacu

SEQ ID NO: 3774900 - RNA, 16 nt, Salmonella typhimurium LT2
uccuccugcagacucc

SEQ ID NO: 3774901 - RNA, 14 nt, Salmonella typhimurium LT2
uccucgacuucauu

SEQ ID NO: 3774902 - RNA, 14 nt, Salmonella typhimurium LT2
uccucgcauccucc

SEQ ID NO: 3774903 - RNA, 20 nt, Salmonella typhimurium LT2
uccucggacgaaaaaugaau

SEQ ID NO: 3774904 - RNA, 14 nt, Salmonella typhimurium LT2
uccucgucggcaag

SEQ ID NO: 3774905 - RNA, 16 nt, Salmonella typhimurium LT2
uccucuauuuuuucaa

SEQ ID NO: 3774906 - RNA, 18 nt, Salmonella typhimurium LT2
uccucucuuccuccugau

SEQ ID NO: 3774907 - RNA, 13 nt, Salmonella typhimurium LT2
uccucugaaaaau

SEQ ID NO: 3774908 - RNA, 19 nt, Salmonella typhimurium LT2
uccucuuuucgaacgccga

SEQ ID NO: 3774909 - RNA, 18 nt, Salmonella typhimurium LT2
uccugaaacgcggcguag

SEQ ID NO: 3774910 - RNA, 22 nt, Salmonella typhimurium LT2
uccugaaagaguacgccgauag

SEQ ID NO: 3774911 - RNA, 21 nt, Salmonella typhimurium LT2
uccugaaccagcggcaccagc

SEQ ID NO: 3774912 - RNA, 22 nt, Salmonella typhimurium LT2
uccugaaccagcggcaccagca

SEQ ID NO: 3774913 - RNA, 17 nt, Salmonella typhimurium LT2
uccugaagcggcgcaau

SEQ ID NO: 3774914 - RNA, 17 nt, Salmonella typhimurium LT2
ucgaccgugauucgccc

SEQ ID NO: 3774915 - RNA, 20 nt, Salmonella typhimurium LT2
ucgaccucuucguucauccg

SEQ ID NO: 3774916 - RNA, 17 nt, Salmonella typhimurium LT2
ucgaccuggugcucaau

SEQ ID NO: 3774917 - RNA, 17 nt, Salmonella typhimurium LT2
ucgaccuucaucucuuu

SEQ ID NO: 3774918 - RNA, 16 nt, Salmonella typhimurium LT2
ucgacgaaauggugug

SEQ ID NO: 3774919 - RNA, 16 nt, Salmonella typhimurium LT2
ucgacggccagcgcgc

SEQ ID NO: 3774920 - RNA, 18 nt, Salmonella typhimurium LT2
ucgacgucaccaucagcg

SEQ ID NO: 3774921 - RNA, 20 nt, Salmonella typhimurium LT2
ucgacguucagcauauccag

SEQ ID NO: 3774922 - RNA, 15 nt, Salmonella typhimurium LT2
ucgacguugccaggc

SEQ ID NO: 3774923 - RNA, 14 nt, Salmonella typhimurium LT2
ucgacguuuuucag

SEQ ID NO: 3774924 - RNA, 23 nt, Salmonella typhimurium LT2
ucgacuaaaggcagcgcgcuguc

SEQ ID NO: 3774925 - RNA, 13 nt, Salmonella typhimurium LT2
ucgacucgagcga

SEQ ID NO: 3774926 - RNA, 23 nt, Salmonella typhimurium LT2
ucgacucgagcgaaagaacguug

SEQ ID NO: 3774927 - RNA, 17 nt, Salmonella typhimurium LT2
ucgacugcggaacgccc

SEQ ID NO: 3774928 - RNA, 16 nt, Salmonella typhimurium LT2
ucgacuggucgcagcc

SEQ ID NO: 3774929 - RNA, 20 nt, Salmonella typhimurium LT2
ucgagauaauccagccacag

SEQ ID NO: 3774930 - RNA, 21 nt, Salmonella typhimurium LT2
ucgagaugcguuggcucgcug

SEQ ID NO: 3774931 - RNA, 23 nt, Salmonella typhimurium LT2
ucgagaugcguuggcucgcugcc

SEQ ID NO: 3774932 - RNA, 19 nt, Salmonella typhimurium LT2
ucgagauuuuucugcgcca

SEQ ID NO: 3774933 - RNA, 15 nt, Salmonella typhimurium LT2
ucgagcagcaggacg

SEQ ID NO: 3774934 - RNA, 17 nt, Salmonella typhimurium LT2
ucgagcgccgucacucc

SEQ ID NO: 3774935 - RNA, 21 nt, Salmonella typhimurium LT2
ucgagcuuuugcugcgccagc

SEQ ID NO: 3774936 - RNA, 23 nt, Salmonella typhimurium LT2
ucgagcuuuugcugcgccagcca

SEQ ID NO: 3774937 - RNA, 22 nt, Salmonella typhimurium LT2
ucgaggaagcugcgcagcacuu

SEQ ID NO: 3774938 - RNA, 15 nt, Salmonella typhimurium LT2
ucgaggccauauuuu

SEQ ID NO: 3774939 - RNA, 19 nt, Salmonella typhimurium LT2
ucgaggcuggucgcgauag

SEQ ID NO: 3774940 - RNA, 22 nt, Salmonella typhimurium LT2
ucgaggucagcauuucauccau

SEQ ID NO: 3774941 - RNA, 14 nt, Salmonella typhimurium LT2
ucgagugaaccgga

SEQ ID NO: 3774942 - RNA, 14 nt, Salmonella typhimurium LT2
ucgauaaacucaug

SEQ ID NO: 3774943 - RNA, 21 nt, Salmonella typhimurium LT2
ucgauaaagcgauuaccggca

SEQ ID NO: 3774944 - RNA, 16 nt, Salmonella typhimurium LT2
ucgauaaccaccagcg

SEQ ID NO: 3774945 - RNA, 14 nt, Salmonella typhimurium LT2
ucgauaaccuggau

SEQ ID NO: 3774946 - RNA, 16 nt, Salmonella typhimurium LT2
ucgauaagccagcgau

SEQ ID NO: 3774947 - RNA, 16 nt, Salmonella typhimurium LT2
ucgauaauaaaauauu

SEQ ID NO: 3774948 - RNA, 17 nt, Salmonella typhimurium LT2
ucgauaauaaaauauua

SEQ ID NO: 3774949 - RNA, 17 nt, Salmonella typhimurium LT2
ucgauaaucauacagcg

SEQ ID NO: 3774950 - RNA, 23 nt, Salmonella typhimurium LT2
ucgauaaucgguagcacuuuaaa

SEQ ID NO: 3774951 - RNA, 19 nt, Salmonella typhimurium LT2
ucgauaccaauucccagac

SEQ ID NO: 3774952 - RNA, 17 nt, Salmonella typhimurium LT2
ucgauacuauaacgcuu

SEQ ID NO: 3774953 - RNA, 22 nt, Salmonella typhimurium LT2
ucgauacucacgacuuucacca

SEQ ID NO: 3774954 - RNA, 21 nt, Salmonella typhimurium LT2
ucgauagcgacggcgcgccaa

SEQ ID NO: 3774955 - RNA, 17 nt, Salmonella typhimurium LT2
ucgauagcguuuuccag

SEQ ID NO: 3774956 - RNA, 13 nt, Salmonella typhimurium LT2
ucgauaguccauu

SEQ ID NO: 3774957 - RNA, 13 nt, Salmonella typhimurium LT2
ucgauauccgugc

SEQ ID NO: 3774958 - RNA, 15 nt, Salmonella typhimurium LT2
ucgauaucugccugc

SEQ ID NO: 3774959 - RNA, 22 nt, Salmonella typhimurium LT2
ucgauaucugccugcagaccca

SEQ ID NO: 3774960 - RNA, 17 nt, Salmonella typhimurium LT2
ucgaucagcauaucgau

SEQ ID NO: 3774961 - RNA, 19 nt, Salmonella typhimurium LT2
ucgauccaguuaauucguc

SEQ ID NO: 3774962 - RNA, 17 nt, Salmonella typhimurium LT2
ucgauccccucuuccau

SEQ ID NO: 3774963 - RNA, 15 nt, Salmonella typhimurium LT2
ucgaucccgccgcau

SEQ ID NO: 3774964 - RNA, 15 nt, Salmonella typhimurium LT2
ucgaucucaggcuua

SEQ ID NO: 3774965 - RNA, 14 nt, Salmonella typhimurium LT2
ucgaugaaaaagag

SEQ ID NO: 3774966 - RNA, 20 nt, Salmonella typhimurium LT2
ucgaugaccgcuuucgccug

SEQ ID NO: 3774967 - RNA, 17 nt, Salmonella typhimurium LT2
ucgaugauuuucaaacc

SEQ ID NO: 3774968 - RNA, 16 nt, Salmonella typhimurium LT2
ucgaugcacgccacau

SEQ ID NO: 3774969 - RNA, 19 nt, Salmonella typhimurium LT2
ucgaugccaugaacgaccc

SEQ ID NO: 3774970 - RNA, 16 nt, Salmonella typhimurium LT2
ucgauggccucaucau

SEQ ID NO: 3774971 - RNA, 14 nt, Salmonella typhimurium LT2
ucgaugucgucgau

SEQ ID NO: 3774972 - RNA, 12 nt, Salmonella typhimurium LT2
ucgauuaaacgc

SEQ ID NO: 3774973 - RNA, 14 nt, Salmonella typhimurium LT2
ucgauucucuucuu

SEQ ID NO: 3774974 - RNA, 13 nt, Salmonella typhimurium LT2
ucgauuuacggau

SEQ ID NO: 3774975 - RNA, 12 nt, Salmonella typhimurium LT2
ucgauuuccggc

SEQ ID NO: 3774976 - RNA, 17 nt, Salmonella typhimurium LT2
ucgcaaacggaauaaac

SEQ ID NO: 3774977 - RNA, 22 nt, Salmonella typhimurium LT2
ucgcaacagauaagcaccugca

SEQ ID NO: 3774978 - RNA, 16 nt, Salmonella typhimurium LT2
ucgcaacagcauacgc

SEQ ID NO: 3774979 - RNA, 20 nt, Salmonella typhimurium LT2
ucgcaacgccggugccugcc

SEQ ID NO: 3774980 - RNA, 22 nt, Salmonella typhimurium LT2
ucgcaacgcuuaucagucccca

SEQ ID NO: 3774981 - RNA, 20 nt, Salmonella typhimurium LT2
ucgcaaggcgcgguccgccc

SEQ ID NO: 3774982 - RNA, 20 nt, Salmonella typhimurium LT2
ucgcaauauacugauauugc

SEQ ID NO: 3774983 - RNA, 17 nt, Salmonella typhimurium LT2
ucgcacagaaucaccuu

SEQ ID NO: 3774984 - RNA, 20 nt, Salmonella typhimurium LT2
ucgcacaguuuuccccccuc

SEQ ID NO: 3774985 - RNA, 14 nt, Salmonella typhimurium LT2
ucgcacaucaugau

SEQ ID NO: 3774986 - RNA, 15 nt, Salmonella typhimurium LT2
ucgcaccaccggacu

SEQ ID NO: 3774987 - RNA, 13 nt, Salmonella typhimurium LT2
ucgcaccauagca

SEQ ID NO: 3774988 - RNA, 21 nt, Salmonella typhimurium LT2
ucgcacgaacgggaucaugau

SEQ ID NO: 3774989 - RNA, 17 nt, Salmonella typhimurium LT2
ucgcacgccuuuaagcu

SEQ ID NO: 3774990 - RNA, 22 nt, Salmonella typhimurium LT2
ucgcacgucugucguuuguagg

SEQ ID NO: 3774991 - RNA, 16 nt, Salmonella typhimurium LT2
ucgcagacauggcaau

SEQ ID NO: 3774992 - RNA, 15 nt, Salmonella typhimurium LT2
ucgcagaccauccau

SEQ ID NO: 3774993 - RNA, 14 nt, Salmonella typhimurium LT2
ucgcagaucgccug

SEQ ID NO: 3774994 - RNA, 17 nt, Salmonella typhimurium LT2
ucgcagcaauucugcug

SEQ ID NO: 3774995 - RNA, 16 nt, Salmonella typhimurium LT2
ucgcagcccagcacau

SEQ ID NO: 3774996 - RNA, 24 nt, Salmonella typhimurium LT2
ucgcagcgcuuugccgcugcugcc

SEQ ID NO: 3774997 - RNA, 12 nt, Salmonella typhimurium LT2
ucgcagcggcug

SEQ ID NO: 3774998 - RNA, 21 nt, Salmonella typhimurium LT2
ucgcaggcccgauaagcgccg

SEQ ID NO: 3774999 - RNA, 20 nt, Salmonella typhimurium LT2
ucgcagggcugcuggugcgc

SEQ ID NO: 3775000 - RNA, 21 nt, Salmonella typhimurium LT2
ucgcaggguaugaauuuuuuc

SEQ ID NO: 3775001 - RNA, 20 nt, Salmonella typhimurium LT2
ucgcaucagggcgacgucag

SEQ ID NO: 3775002 - RNA, 16 nt, Salmonella typhimurium LT2
ucgcaucccaggagau

SEQ ID NO: 3775003 - RNA, 15 nt, Salmonella typhimurium LT2
ucgcauccuccaucc

SEQ ID NO: 3775004 - RNA, 20 nt, Salmonella typhimurium LT2
ucgcauggggagaccccaca

SEQ ID NO: 3775005 - RNA, 20 nt, Salmonella typhimurium LT2
ucgcauguugacugcgcucc

SEQ ID NO: 3775006 - RNA, 17 nt, Salmonella typhimurium LT2
ucgcauuuaaucgccug

SEQ ID NO: 3775007 - RNA, 20 nt, Salmonella typhimurium LT2
ucgccaaaacccagaaucag

SEQ ID NO: 3775008 - RNA, 14 nt, Salmonella typhimurium LT2
ucgccaaagcagcu

SEQ ID NO: 3775009 - RNA, 14 nt, Salmonella typhimurium LT2
ucgccaacaccgau

SEQ ID NO: 3775010 - RNA, 19 nt, Salmonella typhimurium LT2
ucgccaacgccaaccggcu

SEQ ID NO: 3775011 - RNA, 17 nt, Salmonella typhimurium LT2
ucgccaagaucgccaag

SEQ ID NO: 3775012 - RNA, 16 nt, Salmonella typhimurium LT2
ucgccaauaaugccgc

SEQ ID NO: 3775013 - RNA, 20 nt, Salmonella typhimurium LT2
ucgccaauaaugccgccguc

SEQ ID NO: 3775014 - RNA, 15 nt, Salmonella typhimurium LT2
ucgccacagcggaau

SEQ ID NO: 3775015 - RNA, 19 nt, Salmonella typhimurium LT2
ucgccacaugcggcaggcu

SEQ ID NO: 3775016 - RNA, 14 nt, Salmonella typhimurium LT2
ucgccaccagcgau

SEQ ID NO: 3775017 - RNA, 15 nt, Salmonella typhimurium LT2
ucgccaccaggaacg

SEQ ID NO: 3775018 - RNA, 12 nt, Salmonella typhimurium LT2
ucgcgccgccaa

SEQ ID NO: 3775019 - RNA, 20 nt, Salmonella typhimurium LT2
ucgcgccgccgccaacgccg

SEQ ID NO: 3775020 - RNA, 18 nt, Salmonella typhimurium LT2
ucgcgccggaacagggcc

SEQ ID NO: 3775021 - RNA, 22 nt, Salmonella typhimurium LT2
ucgcgccggaacagggccgcau

SEQ ID NO: 3775022 - RNA, 17 nt, Salmonella typhimurium LT2
ucgcgccgugcccagca

SEQ ID NO: 3775023 - RNA, 19 nt, Salmonella typhimurium LT2
ucgcgccgugcccagcauc

SEQ ID NO: 3775024 - RNA, 18 nt, Salmonella typhimurium LT2
ucgcgccuucgccggguu

SEQ ID NO: 3775025 - RNA, 17 nt, Salmonella typhimurium LT2
ucgcgcggcaauuucac

SEQ ID NO: 3775026 - RNA, 20 nt, Salmonella typhimurium LT2
ucgcgcggcgguucauccug

SEQ ID NO: 3775027 - RNA, 16 nt, Salmonella typhimurium LT2
ucgcgcguccacggcg

SEQ ID NO: 3775028 - RNA, 22 nt, Salmonella typhimurium LT2
ucgcgcguggugcuuagcuggc

SEQ ID NO: 3775029 - RNA, 14 nt, Salmonella typhimurium LT2
ucgcgcuauaucag

SEQ ID NO: 3775030 - RNA, 19 nt, Salmonella typhimurium LT2
ucgcgcuguauaaucccgc

SEQ ID NO: 3775031 - RNA, 19 nt, Salmonella typhimurium LT2
ucgcgcugucugccggcgu

SEQ ID NO: 3775032 - RNA, 20 nt, Salmonella typhimurium LT2
ucgcgcuguucgcuuaaccg

SEQ ID NO: 3775033 - RNA, 21 nt, Salmonella typhimurium LT2
ucgcgcuuucaaucgucagac

SEQ ID NO: 3775034 - RNA, 20 nt, Salmonella typhimurium LT2
ucgcggaagcgaccggcguc

SEQ ID NO: 3775035 - RNA, 22 nt, Salmonella typhimurium LT2
ucgcggaagcgaccggcgucau

SEQ ID NO: 3775036 - RNA, 14 nt, Salmonella typhimurium LT2
ucgcggaauuucag

SEQ ID NO: 3775037 - RNA, 17 nt, Salmonella typhimurium LT2
ucgcggaauuucaggaa

SEQ ID NO: 3775038 - RNA, 19 nt, Salmonella typhimurium LT2
ucgcggauaugcagcagcc

SEQ ID NO: 3775039 - RNA, 13 nt, Salmonella typhimurium LT2
ucgcggcagcgcu

SEQ ID NO: 3775040 - RNA, 20 nt, Salmonella typhimurium LT2
ucgcggcaguaagccagcgg

SEQ ID NO: 3775041 - RNA, 12 nt, Salmonella typhimurium LT2
ucgcggcgcaaa

SEQ ID NO: 3775042 - RNA, 20 nt, Salmonella typhimurium LT2
ucgcggcuguucaccacguu

SEQ ID NO: 3775043 - RNA, 14 nt, Salmonella typhimurium LT2
ucgcgggcaaucaa

SEQ ID NO: 3775044 - RNA, 16 nt, Salmonella typhimurium LT2
ucgcggugaucccagg

SEQ ID NO: 3775045 - RNA, 17 nt, Salmonella typhimurium LT2
ucgcggugaucccaggc

SEQ ID NO: 3775046 - RNA, 17 nt, Salmonella typhimurium LT2
ucgcgguggguagcggc

SEQ ID NO: 3775047 - RNA, 24 nt, Salmonella typhimurium LT2
ucgcguacaggauguccaggcgac

SEQ ID NO: 3775048 - RNA, 16 nt, Salmonella typhimurium LT2
ucgcguaguuuuucau

SEQ ID NO: 3775049 - RNA, 17 nt, Salmonella typhimurium LT2
ucgcgucuacgucagga

SEQ ID NO: 3775050 - RNA, 13 nt, Salmonella typhimurium LT2
ucgcgugcaacag

SEQ ID NO: 3775051 - RNA, 13 nt, Salmonella typhimurium LT2
ucgcguucagcgc

SEQ ID NO: 3775052 - RNA, 15 nt, Salmonella typhimurium LT2
ucgcguugcaaucgc

SEQ ID NO: 3775053 - RNA, 18 nt, Salmonella typhimurium LT2
ucgcguuuuucgaaaauu

SEQ ID NO: 3775054 - RNA, 23 nt, Salmonella typhimurium LT2
ucgcuaagagugacgguuuucac

SEQ ID NO: 3775055 - RNA, 14 nt, Salmonella typhimurium LT2
ucgcuaauaaauuc

SEQ ID NO: 3775056 - RNA, 13 nt, Salmonella typhimurium LT2
ucgcuaauaucca

SEQ ID NO: 3775057 - RNA, 15 nt, Salmonella typhimurium LT2
ucgcuaauucucccu

SEQ ID NO: 3775058 - RNA, 20 nt, Salmonella typhimurium LT2
ucgcuacaaccagcgcggcc

SEQ ID NO: 3775059 - RNA, 12 nt, Salmonella typhimurium LT2
ucgcuacaggca

SEQ ID NO: 3775060 - RNA, 14 nt, Salmonella typhimurium LT2
ucgcuacaggcaau

SEQ ID NO: 3775061 - RNA, 22 nt, Salmonella typhimurium LT2
ucgcuaccacagaaaucgccgg

SEQ ID NO: 3775062 - RNA, 20 nt, Salmonella typhimurium LT2
ucgcuaccuucuucccauau

SEQ ID NO: 3775063 - RNA, 16 nt, Salmonella typhimurium LT2
ucgcuaccuuuuuuca

SEQ ID NO: 3775064 - RNA, 17 nt, Salmonella typhimurium LT2
ucgcuaccuuuuuucag

SEQ ID NO: 3775065 - RNA, 24 nt, Salmonella typhimurium LT2
ucgcuaucagacugaucgccgcug

SEQ ID NO: 3775066 - RNA, 23 nt, Salmonella typhimurium LT2
ucgcuaucugacagccaaacugc

SEQ ID NO: 3775067 - RNA, 17 nt, Salmonella typhimurium LT2
ucgcucaauagcgauuc

SEQ ID NO: 3775068 - RNA, 21 nt, Salmonella typhimurium LT2
ucgcucaauagcgauucauca

SEQ ID NO: 3775069 - RNA, 14 nt, Salmonella typhimurium LT2
ucgcucaccggccc

SEQ ID NO: 3775070 - RNA, 17 nt, Salmonella typhimurium LT2
ucgcucagguuguccag

SEQ ID NO: 3775071 - RNA, 20 nt, Salmonella typhimurium LT2
ucgcucagguuguccagcag

SEQ ID NO: 3775072 - RNA, 19 nt, Salmonella typhimurium LT2
ucgcucaucucaagcccca

SEQ ID NO: 3775073 - RNA, 16 nt, Salmonella typhimurium LT2
ucgcucgcgccacgca

SEQ ID NO: 3775074 - RNA, 15 nt, Salmonella typhimurium LT2
ucgcugaaaaugacu

SEQ ID NO: 3775075 - RNA, 17 nt, Salmonella typhimurium LT2
ucgcugacgccagccag

SEQ ID NO: 3775076 - RNA, 18 nt, Salmonella typhimurium LT2
ucgcugacgccagccagc

SEQ ID NO: 3775077 - RNA, 20 nt, Salmonella typhimurium LT2
ucgcugacgccagccagccg

SEQ ID NO: 3775078 - RNA, 13 nt, Salmonella typhimurium LT2
ucgcugauaaaaa

SEQ ID NO: 3775079 - RNA, 14 nt, Salmonella typhimurium LT2
ucgcugccuugagu

SEQ ID NO: 3775080 - RNA, 16 nt, Salmonella typhimurium LT2
ucgcugcucccggcgu

SEQ ID NO: 3775081 - RNA, 17 nt, Salmonella typhimurium LT2
ucgcuggccuccagcac

SEQ ID NO: 3775082 - RNA, 18 nt, Salmonella typhimurium LT2
ucgcuggcguagauauuc

SEQ ID NO: 3775083 - RNA, 16 nt, Salmonella typhimurium LT2
ucgcuggcguauuaug

SEQ ID NO: 3775084 - RNA, 14 nt, Salmonella typhimurium LT2
ucgcuggucagcgc

SEQ ID NO: 3775085 - RNA, 17 nt, Salmonella typhimurium LT2
ucgcuggugugcagcca

SEQ ID NO: 3775086 - RNA, 21 nt, Salmonella typhimurium LT2
ucgcuguaccgccauccggcc

SEQ ID NO: 3775087 - RNA, 20 nt, Salmonella typhimurium LT2
ucgcuuaacaacuccagcaa

SEQ ID NO: 3775088 - RNA, 22 nt, Salmonella typhimurium LT2
ucgcuuaacaacuccagcaaau

SEQ ID NO: 3775089 - RNA, 22 nt, Salmonella typhimurium LT2
ucgcuuaacggcccaggcaucg

SEQ ID NO: 3775090 - RNA, 19 nt, Salmonella typhimurium LT2
ucgcuuagcuucccgcauu

SEQ ID NO: 3775091 - RNA, 18 nt, Salmonella typhimurium LT2
ucgcuuaucgggccuaca

SEQ ID NO: 3775092 - RNA, 19 nt, Salmonella typhimurium LT2
ucgcuuauucggccuacag

SEQ ID NO: 3775093 - RNA, 13 nt, Salmonella typhimurium LT2
ucgcuuccagcgc

SEQ ID NO: 3775094 - RNA, 19 nt, Salmonella typhimurium LT2
ucgcuugcccagcauauua

SEQ ID NO: 3775095 - RNA, 19 nt, Salmonella typhimurium LT2
ucgcuugcccggccuacgu

SEQ ID NO: 3775096 - RNA, 21 nt, Salmonella typhimurium LT2
ucgcuugcggcugccagugac

SEQ ID NO: 3775097 - RNA, 23 nt, Salmonella typhimurium LT2
ucgcuuuccauuacgcuuaucgg

SEQ ID NO: 3775098 - RNA, 19 nt, Salmonella typhimurium LT2
ucgcuuuuauguuacccag

SEQ ID NO: 3775099 - RNA, 15 nt, Salmonella typhimurium LT2
ucgcuuuucauacug

SEQ ID NO: 3775100 - RNA, 16 nt, Salmonella typhimurium LT2
ucgcuuuucauacugg

SEQ ID NO: 3775101 - RNA, 19 nt, Salmonella typhimurium LT2
ucgcuuuuugcgccagcgc

SEQ ID NO: 3775102 - RNA, 19 nt, Salmonella typhimurium LT2
ucggaaacuauccuggccu

SEQ ID NO: 3775103 - RNA, 18 nt, Salmonella typhimurium LT2
ucggaacgcgacucccag

SEQ ID NO: 3775104 - RNA, 19 nt, Salmonella typhimurium LT2
ucggaacucacuugucuuc

SEQ ID NO: 3775105 - RNA, 19 nt, Salmonella typhimurium LT2
ucggaagacuggcgcagca

SEQ ID NO: 3775106 - RNA, 20 nt, Salmonella typhimurium LT2
ucggaauaauguaaaaaaau

SEQ ID NO: 3775107 - RNA, 23 nt, Salmonella typhimurium LT2
ucggaccagaaccucacggagaa

SEQ ID NO: 3775108 - RNA, 22 nt, Salmonella typhimurium LT2
ucggacguaugcuuacagagca

SEQ ID NO: 3775109 - RNA, 15 nt, Salmonella typhimurium LT2
ucggagauauacauc

SEQ ID NO: 3775110 - RNA, 20 nt, Salmonella typhimurium LT2
ucggagauuucauccucuug

SEQ ID NO: 3775111 - RNA, 16 nt, Salmonella typhimurium LT2
ucggagguucgaaucc

SEQ ID NO: 3775112 - RNA, 20 nt, Salmonella typhimurium LT2
ucggagguuuucucauccag

SEQ ID NO: 3775113 - RNA, 16 nt, Salmonella typhimurium LT2
ucggauaauccagacg

SEQ ID NO: 3775114 - RNA, 13 nt, Salmonella typhimurium LT2
ucggauuauuggu

SEQ ID NO: 3775115 - RNA, 20 nt, Salmonella typhimurium LT2
ucggcaaaacgcgccacgaa

SEQ ID NO: 3775116 - RNA, 20 nt, Salmonella typhimurium LT2
ucggcaaacaucugcuccag

SEQ ID NO: 3775117 - RNA, 19 nt, Salmonella typhimurium LT2
ucggcaaauccccuuucgg

SEQ ID NO: 3775118 - RNA, 14 nt, Salmonella typhimurium LT2
ucggcaauaucccg

SEQ ID NO: 3775119 - RNA, 17 nt, Salmonella typhimurium LT2
ucggcaauuuccggcga

SEQ ID NO: 3775120 - RNA, 18 nt, Salmonella typhimurium LT2
ucggcaauuuccggcgac

SEQ ID NO: 3775121 - RNA, 13 nt, Salmonella typhimurium LT2
ucgucgaagcuuu

SEQ ID NO: 3775122 - RNA, 23 nt, Salmonella typhimurium LT2
ucgucgccaccaugcugguuggg

SEQ ID NO: 3775123 - RNA, 19 nt, Salmonella typhimurium LT2
ucgucgcccgucaggcgcc

SEQ ID NO: 3775124 - RNA, 21 nt, Salmonella typhimurium LT2
ucgucgcgcccaacuccccca

SEQ ID NO: 3775125 - RNA, 19 nt, Salmonella typhimurium LT2
ucgucgcuucgucagcucc

SEQ ID NO: 3775126 - RNA, 15 nt, Salmonella typhimurium LT2
ucgucggcaagaauu

SEQ ID NO: 3775127 - RNA, 22 nt, Salmonella typhimurium LT2
ucgucggcaagaauuucaauca

SEQ ID NO: 3775128 - RNA, 18 nt, Salmonella typhimurium LT2
ucgucggcauggucagca

SEQ ID NO: 3775129 - RNA, 19 nt, Salmonella typhimurium LT2
ucgucggcauggucagcau

SEQ ID NO: 3775130 - RNA, 14 nt, Salmonella typhimurium LT2
ucgucggccagcgc

SEQ ID NO: 3775131 - RNA, 20 nt, Salmonella typhimurium LT2
ucgucgucuucaucccaguc

SEQ ID NO: 3775132 - RNA, 16 nt, Salmonella typhimurium LT2
ucgucugccgggaaca

SEQ ID NO: 3775133 - RNA, 16 nt, Salmonella typhimurium LT2
ucgucugcgucuucuu

SEQ ID NO: 3775134 - RNA, 19 nt, Salmonella typhimurium LT2
ucgucugcgucuucuucca

SEQ ID NO: 3775135 - RNA, 20 nt, Salmonella typhimurium LT2
ucgucugguaucugucaugc

SEQ ID NO: 3775136 - RNA, 14 nt, Salmonella typhimurium LT2
ucgucuguacggaa

SEQ ID NO: 3775137 - RNA, 18 nt, Salmonella typhimurium LT2
ucgucuguuguucuuauu

SEQ ID NO: 3775138 - RNA, 14 nt, Salmonella typhimurium LT2
ucgucuucaucuuc

SEQ ID NO: 3775139 - RNA, 23 nt, Salmonella typhimurium LT2
ucgugaaaaccuaaauaaauacc

SEQ ID NO: 3775140 - RNA, 15 nt, Salmonella typhimurium LT2
ucgugacccacacau

SEQ ID NO: 3775141 - RNA, 17 nt, Salmonella typhimurium LT2
ucgugaggauaauccau

SEQ ID NO: 3775142 - RNA, 12 nt, Salmonella typhimurium LT2
ucgugauaaacg

SEQ ID NO: 3775143 - RNA, 19 nt, Salmonella typhimurium LT2
ucgugauugauucgcgcca

SEQ ID NO: 3775144 - RNA, 20 nt, Salmonella typhimurium LT2
ucgugcaggauucgaaccug

SEQ ID NO: 3775145 - RNA, 17 nt, Salmonella typhimurium LT2
ucgugcaguaaugccuc

SEQ ID NO: 3775146 - RNA, 21 nt, Salmonella typhimurium LT2
ucgugccagacucuugcucuu

SEQ ID NO: 3775147 - RNA, 19 nt, Salmonella typhimurium LT2
ucgugccagugaugcgcgg

SEQ ID NO: 3775148 - RNA, 19 nt, Salmonella typhimurium LT2
ucgugccaugaccauucgc

SEQ ID NO: 3775149 - RNA, 14 nt, Salmonella typhimurium LT2
ucgugcgccccagg

SEQ ID NO: 3775150 - RNA, 14 nt, Salmonella typhimurium LT2
ucguggccacacuu

SEQ ID NO: 3775151 - RNA, 20 nt, Salmonella typhimurium LT2
ucguguaaaugacgccagac

SEQ ID NO: 3775152 - RNA, 16 nt, Salmonella typhimurium LT2
ucguguuaccagcaac

SEQ ID NO: 3775153 - RNA, 16 nt, Salmonella typhimurium LT2
ucguguuguccggcca

SEQ ID NO: 3775154 - RNA, 21 nt, Salmonella typhimurium LT2
ucguuaaaacggaucagccug

SEQ ID NO: 3775155 - RNA, 23 nt, Salmonella typhimurium LT2
ucguuaaaaucggggucuuccag

SEQ ID NO: 3775156 - RNA, 13 nt, Salmonella typhimurium LT2
ucguuaauaaucu

SEQ ID NO: 3775157 - RNA, 16 nt, Salmonella typhimurium LT2
ucguuagcaaauugcu

SEQ ID NO: 3775158 - RNA, 15 nt, Salmonella typhimurium LT2
ucguuauccagcagc

SEQ ID NO: 3775159 - RNA, 20 nt, Salmonella typhimurium LT2
ucguuauuuccgagaucgcc

SEQ ID NO: 3775160 - RNA, 15 nt, Salmonella typhimurium LT2
ucguucaggcguagc

SEQ ID NO: 3775161 - RNA, 16 nt, Salmonella typhimurium LT2
ucguucaggcguagcg

SEQ ID NO: 3775162 - RNA, 14 nt, Salmonella typhimurium LT2
ucguucaguuucaa

SEQ ID NO: 3775163 - RNA, 16 nt, Salmonella typhimurium LT2
ucguucauugcuuucu

SEQ ID NO: 3775164 - RNA, 17 nt, Salmonella typhimurium LT2
ucguuccgguucuuccc

SEQ ID NO: 3775165 - RNA, 14 nt, Salmonella typhimurium LT2
ucguucgacgacua

SEQ ID NO: 3775166 - RNA, 14 nt, Salmonella typhimurium LT2
ucguugccagcggc

SEQ ID NO: 3775167 - RNA, 15 nt, Salmonella typhimurium LT2
ucguuguaguaaucc

SEQ ID NO: 3775168 - RNA, 13 nt, Salmonella typhimurium LT2
ucguuuauuuaac

SEQ ID NO: 3775169 - RNA, 13 nt, Salmonella typhimurium LT2
ucguuucuacaau

SEQ ID NO: 3775170 - RNA, 15 nt, Salmonella typhimurium LT2
ucguuugcaguuccg

SEQ ID NO: 3775171 - RNA, 17 nt, Salmonella typhimurium LT2
ucguuuuuguuuaaaaa

SEQ ID NO: 3775172 - RNA, 12 nt, Salmonella typhimurium LT2
ucuaaaaaggaa

SEQ ID NO: 3775173 - RNA, 11 nt, Salmonella typhimurium LT2
ucuaaaaauaa

SEQ ID NO: 3775174 - RNA, 21 nt, Salmonella typhimurium LT2
ucuaaaaauaauugauaauaa

SEQ ID NO: 3775175 - RNA, 23 nt, Salmonella typhimurium LT2
ucuaaagagacagaaucaggcca

SEQ ID NO: 3775176 - RNA, 23 nt, Salmonella typhimurium LT2
ucuaaaucaaucacuuauguaca

SEQ ID NO: 3775177 - RNA, 17 nt, Salmonella typhimurium LT2
ucuaaaucauaccagcg

SEQ ID NO: 3775178 - RNA, 23 nt, Salmonella typhimurium LT2
ucuaacgcaacggaaggaaauaa

SEQ ID NO: 3775179 - RNA, 16 nt, Salmonella typhimurium LT2
ucuaagaauuuaaucu

SEQ ID NO: 3775180 - RNA, 16 nt, Salmonella typhimurium LT2
ucuaauaacacaauac

SEQ ID NO: 3775181 - RNA, 14 nt, Salmonella typhimurium LT2
ucuaauuaaaaaga

SEQ ID NO: 3775182 - RNA, 13 nt, Salmonella typhimurium LT2
ucuacaaguucag

SEQ ID NO: 3775183 - RNA, 20 nt, Salmonella typhimurium LT2
ucuacaguuugucaucaguc

SEQ ID NO: 3775184 - RNA, 15 nt, Salmonella typhimurium LT2
ucuacaucaagagaa

SEQ ID NO: 3775185 - RNA, 22 nt, Salmonella typhimurium LT2
ucuacauuucgugcaguccugu

SEQ ID NO: 3775186 - RNA, 20 nt, Salmonella typhimurium LT2
ucuaccaacugagcuaacga

SEQ ID NO: 3775187 - RNA, 17 nt, Salmonella typhimurium LT2
ucuaccagccuggcuga

SEQ ID NO: 3775188 - RNA, 22 nt, Salmonella typhimurium LT2
ucuaccagccuggcugaaccag

SEQ ID NO: 3775189 - RNA, 19 nt, Salmonella typhimurium LT2
ucuaccauugauaccaaua

SEQ ID NO: 3775190 - RNA, 14 nt, Salmonella typhimurium LT2
ucuaccccgugauu

SEQ ID NO: 3775191 - RNA, 16 nt, Salmonella typhimurium LT2
ucuaccgcauacugaa

SEQ ID NO: 3775192 - RNA, 15 nt, Salmonella typhimurium LT2
ucuacgcgccagcag

SEQ ID NO: 3775193 - RNA, 19 nt, Salmonella typhimurium LT2
ucuacgcugccauccucau

SEQ ID NO: 3775194 - RNA, 16 nt, Salmonella typhimurium LT2
ucuacucugcucgcca

SEQ ID NO: 3775195 - RNA, 22 nt, Salmonella typhimurium LT2
ucuacuuuucggguguccacuc

SEQ ID NO: 3775196 - RNA, 19 nt, Salmonella typhimurium LT2
ucuagaugaugauuuauga

SEQ ID NO: 3775197 - RNA, 18 nt, Salmonella typhimurium LT2
ucuauagcggucaaaaua

SEQ ID NO: 3775198 - RNA, 20 nt, Salmonella typhimurium LT2
ucuauagcggucaaaauaua

SEQ ID NO: 3775199 - RNA, 22 nt, Salmonella typhimurium LT2
ucuaucacuucaauguuagcau

SEQ ID NO: 3775200 - RNA, 15 nt, Salmonella typhimurium LT2
ucuauccaauaauaa

SEQ ID NO: 3775201 - RNA, 21 nt, Salmonella typhimurium LT2
ucuauccacuggguaaggcgc

SEQ ID NO: 3775202 - RNA, 19 nt, Salmonella typhimurium LT2
ucuauccggaggccuucuu

SEQ ID NO: 3775203 - RNA, 19 nt, Salmonella typhimurium LT2
ucuaucuguuuuaauuccu

SEQ ID NO: 3775204 - RNA, 17 nt, Salmonella typhimurium LT2
ucuaugaaugccggaug

SEQ ID NO: 3775205 - RNA, 16 nt, Salmonella typhimurium LT2
ucuauguucaguaaga

SEQ ID NO: 3775206 - RNA, 13 nt, Salmonella typhimurium LT2
ucuauuaaaauaa

SEQ ID NO: 3775207 - RNA, 18 nt, Salmonella typhimurium LT2
ucuauucguucucugaau

SEQ ID NO: 3775208 - RNA, 24 nt, Salmonella typhimurium LT2
ucuauuuuucccggaucgcuaauu

SEQ ID NO: 3775209 - RNA, 13 nt, Salmonella typhimurium LT2
ucuauuuuuucaa

SEQ ID NO: 3775210 - RNA, 16 nt, Salmonella typhimurium LT2
ucucaaaaacaccauu

SEQ ID NO: 3775211 - RNA, 14 nt, Salmonella typhimurium LT2
ucucaaagugcgcc

SEQ ID NO: 3775212 - RNA, 18 nt, Salmonella typhimurium LT2
ucucaacauaauaaagcc

SEQ ID NO: 3775213 - RNA, 15 nt, Salmonella typhimurium LT2
ucucaagcgccgccg

SEQ ID NO: 3775214 - RNA, 19 nt, Salmonella typhimurium LT2
ucucaauaucguugccgcc

SEQ ID NO: 3775215 - RNA, 17 nt, Salmonella typhimurium LT2
ucucacaaauaucacaa

SEQ ID NO: 3775216 - RNA, 14 nt, Salmonella typhimurium LT2
ucucagauaauagc

SEQ ID NO: 3775217 - RNA, 20 nt, Salmonella typhimurium LT2
ucucagcggagugcugagac

SEQ ID NO: 3775218 - RNA, 20 nt, Salmonella typhimurium LT2
ucucaggcuugccaaagcgg

SEQ ID NO: 3775219 - RNA, 12 nt, Salmonella typhimurium LT2
ucucauccagcu

SEQ ID NO: 3775220 - RNA, 14 nt, Salmonella typhimurium LT2
ucucaugcguaaau

SEQ ID NO: 3775221 - RNA, 14 nt, Salmonella typhimurium LT2
ucucauggagcugc

SEQ ID NO: 3775222 - RNA, 15 nt, Salmonella typhimurium LT2
ucucauugaucaguu

SEQ ID NO: 3775223 - RNA, 18 nt, Salmonella typhimurium LT2
ucucauuguguacaucca

SEQ ID NO: 3775224 - RNA, 20 nt, Salmonella typhimurium LT2
ucucauuguguacauccagg

SEQ ID NO: 3775225 - RNA, 18 nt, Salmonella typhimurium LT2
ucugcuugagcaggcaga

SEQ ID NO: 3775226 - RNA, 13 nt, Salmonella typhimurium LT2
ucugcuuuuucac

SEQ ID NO: 3775227 - RNA, 19 nt, Salmonella typhimurium LT2
ucuggaaagcgccucgcaa

SEQ ID NO: 3775228 - RNA, 22 nt, Salmonella typhimurium LT2
ucuggaugcguucaaagaucuc

SEQ ID NO: 3775229 - RNA, 15 nt, Salmonella typhimurium LT2
ucuggauuuggcugc

SEQ ID NO: 3775230 - RNA, 17 nt, Salmonella typhimurium LT2
ucuggcaauaaggcgau

SEQ ID NO: 3775231 - RNA, 19 nt, Salmonella typhimurium LT2
ucuggccaaagcggguuaa

SEQ ID NO: 3775232 - RNA, 17 nt, Salmonella typhimurium LT2
ucuggccaauuuuucac

SEQ ID NO: 3775233 - RNA, 21 nt, Salmonella typhimurium LT2
ucuggccgcgaugguuacucc

SEQ ID NO: 3775234 - RNA, 16 nt, Salmonella typhimurium LT2
ucuggccguuugcugc

SEQ ID NO: 3775235 - RNA, 19 nt, Salmonella typhimurium LT2
ucuggccuacgugcucacg

SEQ ID NO: 3775236 - RNA, 15 nt, Salmonella typhimurium LT2
ucuggccucuuauca

SEQ ID NO: 3775237 - RNA, 24 nt, Salmonella typhimurium LT2
ucuggcgaauaauguuguccacaa

SEQ ID NO: 3775238 - RNA, 19 nt, Salmonella typhimurium LT2
ucuggcgacaucuggcuca

SEQ ID NO: 3775239 - RNA, 15 nt, Salmonella typhimurium LT2
ucuggcgcaaccggc

SEQ ID NO: 3775240 - RNA, 16 nt, Salmonella typhimurium LT2
ucuggcggcggguuaa

SEQ ID NO: 3775241 - RNA, 17 nt, Salmonella typhimurium LT2
ucuggcguuggcaucug

SEQ ID NO: 3775242 - RNA, 22 nt, Salmonella typhimurium LT2
ucuggcucaagaguaggccgga

SEQ ID NO: 3775243 - RNA, 22 nt, Salmonella typhimurium LT2
ucuggcucgccguuaugcagcg

SEQ ID NO: 3775244 - RNA, 16 nt, Salmonella typhimurium LT2
ucugguacauacuguu

SEQ ID NO: 3775245 - RNA, 15 nt, Salmonella typhimurium LT2
ucugguaucgagugg

SEQ ID NO: 3775246 - RNA, 20 nt, Salmonella typhimurium LT2
ucuggucagcgaugacgccu

SEQ ID NO: 3775247 - RNA, 21 nt, Salmonella typhimurium LT2
ucuguauaucuuucuuauccc

SEQ ID NO: 3775248 - RNA, 17 nt, Salmonella typhimurium LT2
ucuguaugacaacauaa

SEQ ID NO: 3775249 - RNA, 23 nt, Salmonella typhimurium LT2
ucugucacuuaaguaaagauuuu

SEQ ID NO: 3775250 - RNA, 23 nt, Salmonella typhimurium LT2
ucugucgccgcguaaauccacau

SEQ ID NO: 3775251 - RNA, 22 nt, Salmonella typhimurium LT2
ucugucuuuacugaaucucaga

SEQ ID NO: 3775252 - RNA, 16 nt, Salmonella typhimurium LT2
ucugugcgguuugcgc

SEQ ID NO: 3775253 - RNA, 23 nt, Salmonella typhimurium LT2
ucuguggccgcgcauguuugccu

SEQ ID NO: 3775254 - RNA, 22 nt, Salmonella typhimurium LT2
ucugugucguccgggccugaua

SEQ ID NO: 3775255 - RNA, 22 nt, Salmonella typhimurium LT2
ucuguuaaaaaauuuauaacgu

SEQ ID NO: 3775256 - RNA, 23 nt, Salmonella typhimurium LT2
ucuguuaucaggcauagagaggc

SEQ ID NO: 3775257 - RNA, 19 nt, Salmonella typhimurium LT2
ucuguugccgcccgucgcg

SEQ ID NO: 3775258 - RNA, 21 nt, Salmonella typhimurium LT2
ucuguuucaguucggagauca

SEQ ID NO: 3775259 - RNA, 22 nt, Salmonella typhimurium LT2
ucuguuucaguucggagaucag

SEQ ID NO: 3775260 - RNA, 22 nt, Salmonella typhimurium LT2
ucuguuugagaaaaacaucaug

SEQ ID NO: 3775261 - RNA, 17 nt, Salmonella typhimurium LT2
ucuguuuuagcaugaca

SEQ ID NO: 3775262 - RNA, 23 nt, Salmonella typhimurium LT2
ucuguuuuuggaaacuaugcaaa

SEQ ID NO: 3775263 - RNA, 21 nt, Salmonella typhimurium LT2
ucuuaauuuuguugaaauuuc

SEQ ID NO: 3775264 - RNA, 12 nt, Salmonella typhimurium LT2
ucuuacauaaga

SEQ ID NO: 3775265 - RNA, 21 nt, Salmonella typhimurium LT2
ucuuaccaggucuuaccuauu

SEQ ID NO: 3775266 - RNA, 23 nt, Salmonella typhimurium LT2
ucuuaccgcuaaaauacccgacc

SEQ ID NO: 3775267 - RNA, 16 nt, Salmonella typhimurium LT2
ucuuacgagaggcuuu

SEQ ID NO: 3775268 - RNA, 18 nt, Salmonella typhimurium LT2
ucuuacggaaaaaugucg

SEQ ID NO: 3775269 - RNA, 16 nt, Salmonella typhimurium LT2
ucuuacggauaaaaac

SEQ ID NO: 3775270 - RNA, 23 nt, Salmonella typhimurium LT2
ucuuacggcgcccaacaaacgcu

SEQ ID NO: 3775271 - RNA, 16 nt, Salmonella typhimurium LT2
ucuuagaauagcauca

SEQ ID NO: 3775272 - RNA, 24 nt, Salmonella typhimurium LT2
ucuuagguuuguagcgcaaauauc

SEQ ID NO: 3775273 - RNA, 14 nt, Salmonella typhimurium LT2
ucuuaguaacauaa

SEQ ID NO: 3775274 - RNA, 15 nt, Salmonella typhimurium LT2
ucuuagugaaauacc

SEQ ID NO: 3775275 - RNA, 12 nt, Salmonella typhimurium LT2
ucuuauccgacu

SEQ ID NO: 3775276 - RNA, 15 nt, Salmonella typhimurium LT2
ucuuaugccgcuuuu

SEQ ID NO: 3775277 - RNA, 20 nt, Salmonella typhimurium LT2
ucuuauuagcgauuuaaugu

SEQ ID NO: 3775278 - RNA, 12 nt, Salmonella typhimurium LT2
ucuuauuuuccg

SEQ ID NO: 3775279 - RNA, 13 nt, Salmonella typhimurium LT2
ucuucaaacggca

SEQ ID NO: 3775280 - RNA, 22 nt, Salmonella typhimurium LT2
ucuucaacaccgacauccgcca

SEQ ID NO: 3775281 - RNA, 19 nt, Salmonella typhimurium LT2
ucuucaacggucucaggcu

SEQ ID NO: 3775282 - RNA, 22 nt, Salmonella typhimurium LT2
ucuucaacguugucgaacugca

SEQ ID NO: 3775283 - RNA, 15 nt, Salmonella typhimurium LT2
ucuucaaggcucaau

SEQ ID NO: 3775284 - RNA, 23 nt, Salmonella typhimurium LT2
ucuucacgacccggcguuuucag

SEQ ID NO: 3775285 - RNA, 23 nt, Salmonella typhimurium LT2
ucuucacgaucgaacgcuaaauc

SEQ ID NO: 3775286 - RNA, 15 nt, Salmonella typhimurium LT2
ucuucacuaaaaaca

SEQ ID NO: 3775287 - RNA, 20 nt, Salmonella typhimurium LT2
ucuucacucaccacaaaggc

SEQ ID NO: 3775288 - RNA, 20 nt, Salmonella typhimurium LT2
ucuucaguuccgccagacuc

SEQ ID NO: 3775289 - RNA, 18 nt, Salmonella typhimurium LT2
ucuucauagucgcuuuuc

SEQ ID NO: 3775290 - RNA, 13 nt, Salmonella typhimurium LT2
ucuucaucaugau

SEQ ID NO: 3775291 - RNA, 16 nt, Salmonella typhimurium LT2
ucuucaucaugaugau

SEQ ID NO: 3775292 - RNA, 14 nt, Salmonella typhimurium LT2
ucuucauccaugcg

SEQ ID NO: 3775293 - RNA, 24 nt, Salmonella typhimurium LT2
ucuucaucccacucaaucauuguc

SEQ ID NO: 3775294 - RNA, 17 nt, Salmonella typhimurium LT2
ucuucaucccagcuaaa

SEQ ID NO: 3775295 - RNA, 15 nt, Salmonella typhimurium LT2
ucuucaucccagucg

SEQ ID NO: 3775296 - RNA, 21 nt, Salmonella typhimurium LT2
ucuucaucggucagagcauaa

SEQ ID NO: 3775297 - RNA, 22 nt, Salmonella typhimurium LT2
ucuucaucguuacgcagauagg

SEQ ID NO: 3775298 - RNA, 15 nt, Salmonella typhimurium LT2
ucuucaucguuucug

SEQ ID NO: 3775299 - RNA, 17 nt, Salmonella typhimurium LT2
ucuucaugcagcgcggu

SEQ ID NO: 3775300 - RNA, 19 nt, Salmonella typhimurium LT2
ucuucauggucggacggac

SEQ ID NO: 3775301 - RNA, 18 nt, Salmonella typhimurium LT2
ucuuccacgccgucgaug

SEQ ID NO: 3775302 - RNA, 17 nt, Salmonella typhimurium LT2
ucuuccacuucagcagc

SEQ ID NO: 3775303 - RNA, 15 nt, Salmonella typhimurium LT2
ucuuccacuucagcc

SEQ ID NO: 3775304 - RNA, 17 nt, Salmonella typhimurium LT2
ucuuccagcgccaaaaa

SEQ ID NO: 3775305 - RNA, 19 nt, Salmonella typhimurium LT2
ucuuccagcgucuccagac

SEQ ID NO: 3775306 - RNA, 14 nt, Salmonella typhimurium LT2
ucuuccagcugcuc

SEQ ID NO: 3775307 - RNA, 14 nt, Salmonella typhimurium LT2
ucuuccaucagcca

SEQ ID NO: 3775308 - RNA, 18 nt, Salmonella typhimurium LT2
ucuuccaucagccaggcg

SEQ ID NO: 3775309 - RNA, 16 nt, Salmonella typhimurium LT2
ucuuccaugccuucau

SEQ ID NO: 3775310 - RNA, 23 nt, Salmonella typhimurium LT2
ucuucccaccggacgaaaaaucu

SEQ ID NO: 3775311 - RNA, 12 nt, Salmonella typhimurium LT2
ucuucccauauu

SEQ ID NO: 3775312 - RNA, 15 nt, Salmonella typhimurium LT2
ucuuccgacagggcc

SEQ ID NO: 3775313 - RNA, 23 nt, Salmonella typhimurium LT2
ucuuccgccauacccggcuccca

SEQ ID NO: 3775314 - RNA, 12 nt, Salmonella typhimurium LT2
ucuuccggcgug

SEQ ID NO: 3775315 - RNA, 19 nt, Salmonella typhimurium LT2
ucuuccguuuuacacggcg

SEQ ID NO: 3775316 - RNA, 15 nt, Salmonella typhimurium LT2
ucuuccucugugccg

SEQ ID NO: 3775317 - RNA, 14 nt, Salmonella typhimurium LT2
ucuucgacacauuu

SEQ ID NO: 3775318 - RNA, 18 nt, Salmonella typhimurium LT2
ucuucgacacauuucagc

SEQ ID NO: 3775319 - RNA, 16 nt, Salmonella typhimurium LT2
ucuucgacauauuuac

SEQ ID NO: 3775320 - RNA, 20 nt, Salmonella typhimurium LT2
ucuucgacauauuuacgugc

SEQ ID NO: 3775321 - RNA, 21 nt, Salmonella typhimurium LT2
ucuucgauaaagggaugggca

SEQ ID NO: 3775322 - RNA, 19 nt, Salmonella typhimurium LT2
ucuucgccaaacacccagc

SEQ ID NO: 3775323 - RNA, 15 nt, Salmonella typhimurium LT2
ucuucggcuucaccg

SEQ ID NO: 3775324 - RNA, 23 nt, Salmonella typhimurium LT2
ucuucguaggcaacaauuucuac

SEQ ID NO: 3775325 - RNA, 20 nt, Salmonella typhimurium LT2
ucuucguguaacgcauacau

SEQ ID NO: 3775326 - RNA, 15 nt, Salmonella typhimurium LT2
ucuucuaaaucauac

SEQ ID NO: 3775327 - RNA, 14 nt, Salmonella typhimurium LT2
ucuucuacaaugcg

SEQ ID NO: 3775328 - RNA, 19 nt, Salmonella typhimurium LT2
ugaacggcgucauccggcg

SEQ ID NO: 3775329 - RNA, 19 nt, Salmonella typhimurium LT2
ugaacuauaggaaaauaau

SEQ ID NO: 3775330 - RNA, 20 nt, Salmonella typhimurium LT2
ugaacucgacgccuucuucg

SEQ ID NO: 3775331 - RNA, 21 nt, Salmonella typhimurium LT2
ugaacugacguuagucauauu

SEQ ID NO: 3775332 - RNA, 15 nt, Salmonella typhimurium LT2
ugaacugcccggagc

SEQ ID NO: 3775333 - RNA, 17 nt, Salmonella typhimurium LT2
ugaacugcgcguauccg

SEQ ID NO: 3775334 - RNA, 20 nt, Salmonella typhimurium LT2
ugaacuuuuuguaggagcuc

SEQ ID NO: 3775335 - RNA, 18 nt, Salmonella typhimurium LT2
ugaagaccuuaucucgcu

SEQ ID NO: 3775336 - RNA, 19 nt, Salmonella typhimurium LT2
ugaagacguucuaucaggu

SEQ ID NO: 3775337 - RNA, 17 nt, Salmonella typhimurium LT2
ugaagaguuugaucaug

SEQ ID NO: 3775338 - RNA, 14 nt, Salmonella typhimurium LT2
ugaagaucagcaga

SEQ ID NO: 3775339 - RNA, 18 nt, Salmonella typhimurium LT2
ugaagauguagucgccuu

SEQ ID NO: 3775340 - RNA, 13 nt, Salmonella typhimurium LT2
ugaagcauaaaaa

SEQ ID NO: 3775341 - RNA, 16 nt, Salmonella typhimurium LT2
ugaagcauaaaaagac

SEQ ID NO: 3775342 - RNA, 20 nt, Salmonella typhimurium LT2
ugaagccauccucacgcaac

SEQ ID NO: 3775343 - RNA, 16 nt, Salmonella typhimurium LT2
ugaagcgaccggcguc

SEQ ID NO: 3775344 - RNA, 17 nt, Salmonella typhimurium LT2
ugaagcgcguucguccc

SEQ ID NO: 3775345 - RNA, 14 nt, Salmonella typhimurium LT2
ugaagcugccguag

SEQ ID NO: 3775346 - RNA, 18 nt, Salmonella typhimurium LT2
ugaagcugccgucccagc

SEQ ID NO: 3775347 - RNA, 17 nt, Salmonella typhimurium LT2
ugaaggcaaaacaccau

SEQ ID NO: 3775348 - RNA, 22 nt, Salmonella typhimurium LT2
ugaagguaaaggcggaaaucag

SEQ ID NO: 3775349 - RNA, 19 nt, Salmonella typhimurium LT2
ugaaggucggcugaaucag

SEQ ID NO: 3775350 - RNA, 21 nt, Salmonella typhimurium LT2
ugaaguaauagguugcgccaa

SEQ ID NO: 3775351 - RNA, 16 nt, Salmonella typhimurium LT2
ugaaguaauguucagg

SEQ ID NO: 3775352 - RNA, 22 nt, Salmonella typhimurium LT2
ugaagugugcaaacgauaaaag

SEQ ID NO: 3775353 - RNA, 13 nt, Salmonella typhimurium LT2
ugaauaaaccaga

SEQ ID NO: 3775354 - RNA, 14 nt, Salmonella typhimurium LT2
ugaauaaaggguuu

SEQ ID NO: 3775355 - RNA, 15 nt, Salmonella typhimurium LT2
ugaauaacagcacca

SEQ ID NO: 3775356 - RNA, 17 nt, Salmonella typhimurium LT2
ugaauaaccauuccuau

SEQ ID NO: 3775357 - RNA, 19 nt, Salmonella typhimurium LT2
ugaauaauauguaaauuau

SEQ ID NO: 3775358 - RNA, 14 nt, Salmonella typhimurium LT2
ugaauaaugaccuc

SEQ ID NO: 3775359 - RNA, 17 nt, Salmonella typhimurium LT2
ugaauaaugguaaauuu

SEQ ID NO: 3775360 - RNA, 16 nt, Salmonella typhimurium LT2
ugaauaauuucuucuu

SEQ ID NO: 3775361 - RNA, 18 nt, Salmonella typhimurium LT2
ugaauaauuucuucuuua

SEQ ID NO: 3775362 - RNA, 15 nt, Salmonella typhimurium LT2
ugaauaccaaagccc

SEQ ID NO: 3775363 - RNA, 19 nt, Salmonella typhimurium LT2
ugaauaccaaagcccgcaa

SEQ ID NO: 3775364 - RNA, 17 nt, Salmonella typhimurium LT2
ugaauaccaaaucucaa

SEQ ID NO: 3775365 - RNA, 13 nt, Salmonella typhimurium LT2
ugaauagcgcaga

SEQ ID NO: 3775366 - RNA, 15 nt, Salmonella typhimurium LT2
ugaauaguagcugag

SEQ ID NO: 3775367 - RNA, 15 nt, Salmonella typhimurium LT2
ugaauauaauucaua

SEQ ID NO: 3775368 - RNA, 13 nt, Salmonella typhimurium LT2
ugaauaucaagau

SEQ ID NO: 3775369 - RNA, 22 nt, Salmonella typhimurium LT2
ugaauaucgagcggcaguagca

SEQ ID NO: 3775370 - RNA, 18 nt, Salmonella typhimurium LT2
ugaauauggccagucccc

SEQ ID NO: 3775371 - RNA, 19 nt, Salmonella typhimurium LT2
ugaauaugguucuccguca

SEQ ID NO: 3775372 - RNA, 16 nt, Salmonella typhimurium LT2
ugaaucaagcuuugcg

SEQ ID NO: 3775373 - RNA, 17 nt, Salmonella typhimurium LT2
ugaaucagaagcgucau

SEQ ID NO: 3775374 - RNA, 22 nt, Salmonella typhimurium LT2
ugaaucaucgguaaaugcuuau

SEQ ID NO: 3775375 - RNA, 19 nt, Salmonella typhimurium LT2
ugaauccagcguacugagu

SEQ ID NO: 3775376 - RNA, 21 nt, Salmonella typhimurium LT2
ugaauccccagaauuucuuug

SEQ ID NO: 3775377 - RNA, 17 nt, Salmonella typhimurium LT2
ugaaucccccugccaca

SEQ ID NO: 3775378 - RNA, 21 nt, Salmonella typhimurium LT2
ugaaucgccgucagugagccc

SEQ ID NO: 3775379 - RNA, 20 nt, Salmonella typhimurium LT2
ugaaucgcgcgcgccaguca

SEQ ID NO: 3775380 - RNA, 18 nt, Salmonella typhimurium LT2
ugaaucggcaccuggagc

SEQ ID NO: 3775381 - RNA, 21 nt, Salmonella typhimurium LT2
ugaaucucagauaauagcugc

SEQ ID NO: 3775382 - RNA, 11 nt, Salmonella typhimurium LT2
ugaaugacugu

SEQ ID NO: 3775383 - RNA, 12 nt, Salmonella typhimurium LT2
ugaaugacuguc

SEQ ID NO: 3775384 - RNA, 13 nt, Salmonella typhimurium LT2
ugaaugacugucc

SEQ ID NO: 3775385 - RNA, 16 nt, Salmonella typhimurium LT2
ugaaugagcaaugaga

SEQ ID NO: 3775386 - RNA, 23 nt, Salmonella typhimurium LT2
ugaaugagcaaugagauccacug

SEQ ID NO: 3775387 - RNA, 12 nt, Salmonella typhimurium LT2
ugaaugccaucc

SEQ ID NO: 3775388 - RNA, 18 nt, Salmonella typhimurium LT2
ugaaugccauccagcacc

SEQ ID NO: 3775389 - RNA, 19 nt, Salmonella typhimurium LT2
ugaaugccccagcgcugcu

SEQ ID NO: 3775390 - RNA, 22 nt, Salmonella typhimurium LT2
ugaaugccccagcgcugcugua

SEQ ID NO: 3775391 - RNA, 21 nt, Salmonella typhimurium LT2
ugaaugcucucauauuccagc

SEQ ID NO: 3775392 - RNA, 18 nt, Salmonella typhimurium LT2
ugaauggcggagaucucc

SEQ ID NO: 3775393 - RNA, 13 nt, Salmonella typhimurium LT2
ugaauuaacuuau

SEQ ID NO: 3775394 - RNA, 17 nt, Salmonella typhimurium LT2
ugaauuaacuuauucgu

SEQ ID NO: 3775395 - RNA, 22 nt, Salmonella typhimurium LT2
ugaauuacagcucauaaacgcg

SEQ ID NO: 3775396 - RNA, 23 nt, Salmonella typhimurium LT2
ugaauuagguuacguugucacaa

SEQ ID NO: 3775397 - RNA, 18 nt, Salmonella typhimurium LT2
ugaauugauuagcuuuaa

SEQ ID NO: 3775398 - RNA, 18 nt, Salmonella typhimurium LT2
ugaauugccauuguucgc

SEQ ID NO: 3775399 - RNA, 22 nt, Salmonella typhimurium LT2
ugaauuuaauggucuuaaaugc

SEQ ID NO: 3775400 - RNA, 13 nt, Salmonella typhimurium LT2
ugaauuucuucau

SEQ ID NO: 3775401 - RNA, 20 nt, Salmonella typhimurium LT2
ugaauuugcugcauuucuug

SEQ ID NO: 3775402 - RNA, 16 nt, Salmonella typhimurium LT2
ugacaaaaaucugaau

SEQ ID NO: 3775403 - RNA, 19 nt, Salmonella typhimurium LT2
ugacaaaaaucugaauucg

SEQ ID NO: 3775404 - RNA, 13 nt, Salmonella typhimurium LT2
ugacaaaaauuaa

SEQ ID NO: 3775405 - RNA, 18 nt, Salmonella typhimurium LT2
ugacaaagguugcgccaa

SEQ ID NO: 3775406 - RNA, 21 nt, Salmonella typhimurium LT2
ugacaaagguugcgccaaagc

SEQ ID NO: 3775407 - RNA, 16 nt, Salmonella typhimurium LT2
ugacaaauaaaauaag

SEQ ID NO: 3775408 - RNA, 22 nt, Salmonella typhimurium LT2
ugacaaauuguuuaaaaacagg

SEQ ID NO: 3775409 - RNA, 14 nt, Salmonella typhimurium LT2
ugacaacaaaaaga

SEQ ID NO: 3775410 - RNA, 17 nt, Salmonella typhimurium LT2
ugacaacuauugcugcc

SEQ ID NO: 3775411 - RNA, 16 nt, Salmonella typhimurium LT2
ugacaagcagcggaaa

SEQ ID NO: 3775412 - RNA, 17 nt, Salmonella typhimurium LT2
ugacaauaacggccuca

SEQ ID NO: 3775413 - RNA, 21 nt, Salmonella typhimurium LT2
ugacaauaaucaguuagcgaa

SEQ ID NO: 3775414 - RNA, 16 nt, Salmonella typhimurium LT2
ugacaauacugaacgc

SEQ ID NO: 3775415 - RNA, 17 nt, Salmonella typhimurium LT2
ugacaauacugaacgcc

SEQ ID NO: 3775416 - RNA, 21 nt, Salmonella typhimurium LT2
ugacaaucuccuccggcuuca

SEQ ID NO: 3775417 - RNA, 12 nt, Salmonella typhimurium LT2
ugacaaucugcu

SEQ ID NO: 3775418 - RNA, 16 nt, Salmonella typhimurium LT2
ugacaaucugcuggaa

SEQ ID NO: 3775419 - RNA, 11 nt, Salmonella typhimurium LT2
ugacacagcgu

SEQ ID NO: 3775420 - RNA, 15 nt, Salmonella typhimurium LT2
ugacacaucaccucc

SEQ ID NO: 3775421 - RNA, 19 nt, Salmonella typhimurium LT2
ugacacaucaccuccagcg

SEQ ID NO: 3775422 - RNA, 18 nt, Salmonella typhimurium LT2
ugacaccacggcaauaaa

SEQ ID NO: 3775423 - RNA, 17 nt, Salmonella typhimurium LT2
ugacacgccaguucaug

SEQ ID NO: 3775424 - RNA, 14 nt, Salmonella typhimurium LT2
ugacacggaacaac

SEQ ID NO: 3775425 - RNA, 15 nt, Salmonella typhimurium LT2
ugacacuaucuccuu

SEQ ID NO: 3775426 - RNA, 13 nt, Salmonella typhimurium LT2
ugacacucaucca

SEQ ID NO: 3775427 - RNA, 14 nt, Salmonella typhimurium LT2
ugacacugauauac

SEQ ID NO: 3775428 - RNA, 15 nt, Salmonella typhimurium LT2
ugacacuuuauucuc

SEQ ID NO: 3775429 - RNA, 13 nt, Salmonella typhimurium LT2
ugacagaggaaug

SEQ ID NO: 3775430 - RNA, 15 nt, Salmonella typhimurium LT2
ugacagaguccacag

SEQ ID NO: 3775431 - RNA, 21 nt, Salmonella typhimurium LT2
ugacagcaaguugcgccacug

SEQ ID NO: 3775432 - RNA, 16 nt, Salmonella typhimurium LT2
ugacucgcugcgcucg

SEQ ID NO: 3775433 - RNA, 21 nt, Salmonella typhimurium LT2
ugacugccguauaauccagcu

SEQ ID NO: 3775434 - RNA, 22 nt, Salmonella typhimurium LT2
ugacugguaaaacgauauugcc

SEQ ID NO: 3775435 - RNA, 21 nt, Salmonella typhimurium LT2
ugacuuuaccgguuucaaucc

SEQ ID NO: 3775436 - RNA, 15 nt, Salmonella typhimurium LT2
ugacuuugaccagca

SEQ ID NO: 3775437 - RNA, 12 nt, Salmonella typhimurium LT2
ugacuuuuacgc

SEQ ID NO: 3775438 - RNA, 21 nt, Salmonella typhimurium LT2
ugacuuuuuucaaccucacug

SEQ ID NO: 3775439 - RNA, 23 nt, Salmonella typhimurium LT2
ugagaaaaagcguugacgggcga

SEQ ID NO: 3775440 - RNA, 14 nt, Salmonella typhimurium LT2
ugagaaaagcagag

SEQ ID NO: 3775441 - RNA, 20 nt, Salmonella typhimurium LT2
ugagaaaaggaagaauaaau

SEQ ID NO: 3775442 - RNA, 23 nt, Salmonella typhimurium LT2
ugagaaaaggaagaauaaauaac

SEQ ID NO: 3775443 - RNA, 14 nt, Salmonella typhimurium LT2
ugagaaaaguaaaa

SEQ ID NO: 3775444 - RNA, 19 nt, Salmonella typhimurium LT2
ugagaaaauuacgcccauc

SEQ ID NO: 3775445 - RNA, 20 nt, Salmonella typhimurium LT2
ugagaaggucaguccaccug

SEQ ID NO: 3775446 - RNA, 17 nt, Salmonella typhimurium LT2
ugagaauuuccaguuca

SEQ ID NO: 3775447 - RNA, 18 nt, Salmonella typhimurium LT2
ugagaauuuccaguucaa

SEQ ID NO: 3775448 - RNA, 18 nt, Salmonella typhimurium LT2
ugagacaaaaaagcugcg

SEQ ID NO: 3775449 - RNA, 19 nt, Salmonella typhimurium LT2
ugagacccaaaggaggaaa

SEQ ID NO: 3775450 - RNA, 18 nt, Salmonella typhimurium LT2
ugagacgcagccucucuu

SEQ ID NO: 3775451 - RNA, 19 nt, Salmonella typhimurium LT2
ugagagcacguaggccuga

SEQ ID NO: 3775452 - RNA, 20 nt, Salmonella typhimurium LT2
ugagagcacguaggccugau

SEQ ID NO: 3775453 - RNA, 22 nt, Salmonella typhimurium LT2
ugagagucgauacucacgacuu

SEQ ID NO: 3775454 - RNA, 20 nt, Salmonella typhimurium LT2
ugagauaauuuaugauuuua

SEQ ID NO: 3775455 - RNA, 13 nt, Salmonella typhimurium LT2
ugagauacugcga

SEQ ID NO: 3775456 - RNA, 20 nt, Salmonella typhimurium LT2
ugagauacugcgaucgccgg

SEQ ID NO: 3775457 - RNA, 21 nt, Salmonella typhimurium LT2
ugagauauuuugucaggccgc

SEQ ID NO: 3775458 - RNA, 18 nt, Salmonella typhimurium LT2
ugagaucgguaauuucca

SEQ ID NO: 3775459 - RNA, 21 nt, Salmonella typhimurium LT2
ugagaucgguaauuuccacgc

SEQ ID NO: 3775460 - RNA, 19 nt, Salmonella typhimurium LT2
ugagaugcaggccaagcag

SEQ ID NO: 3775461 - RNA, 20 nt, Salmonella typhimurium LT2
ugagauugauaaucagcaag

SEQ ID NO: 3775462 - RNA, 20 nt, Salmonella typhimurium LT2
ugagauuguggaacuuuauc

SEQ ID NO: 3775463 - RNA, 12 nt, Salmonella typhimurium LT2
ugagcaaaacac

SEQ ID NO: 3775464 - RNA, 18 nt, Salmonella typhimurium LT2
ugagcaaaccgcaaauaa

SEQ ID NO: 3775465 - RNA, 12 nt, Salmonella typhimurium LT2
ugagcaaaggca

SEQ ID NO: 3775466 - RNA, 13 nt, Salmonella typhimurium LT2
ugagcaaaggcag

SEQ ID NO: 3775467 - RNA, 19 nt, Salmonella typhimurium LT2
ugagcaaaggcagccaaca

SEQ ID NO: 3775468 - RNA, 21 nt, Salmonella typhimurium LT2
ugagcaaugagauccacugag

SEQ ID NO: 3775469 - RNA, 22 nt, Salmonella typhimurium LT2
ugagcaaugggaaggaaaauag

SEQ ID NO: 3775470 - RNA, 16 nt, Salmonella typhimurium LT2
ugagcagccagcccag

SEQ ID NO: 3775471 - RNA, 17 nt, Salmonella typhimurium LT2
ugagcagccagcccagc

SEQ ID NO: 3775472 - RNA, 21 nt, Salmonella typhimurium LT2
ugagcaguugaucguaaagcg

SEQ ID NO: 3775473 - RNA, 19 nt, Salmonella typhimurium LT2
ugagcauaaacgacaucaa

SEQ ID NO: 3775474 - RNA, 18 nt, Salmonella typhimurium LT2
ugagcauacacauucagg

SEQ ID NO: 3775475 - RNA, 20 nt, Salmonella typhimurium LT2
ugagcaucaaacuuuuaaau

SEQ ID NO: 3775476 - RNA, 23 nt, Salmonella typhimurium LT2
ugagccacucacguucagcgcgg

SEQ ID NO: 3775477 - RNA, 22 nt, Salmonella typhimurium LT2
ugagccacugcauuacucgccu

SEQ ID NO: 3775478 - RNA, 19 nt, Salmonella typhimurium LT2
ugagccagaugucgccaga

SEQ ID NO: 3775479 - RNA, 16 nt, Salmonella typhimurium LT2
ugagccauuccagcgu

SEQ ID NO: 3775480 - RNA, 14 nt, Salmonella typhimurium LT2
ugagcccuccucca

SEQ ID NO: 3775481 - RNA, 21 nt, Salmonella typhimurium LT2
ugagccuaaaacauuaaucgc

SEQ ID NO: 3775482 - RNA, 16 nt, Salmonella typhimurium LT2
ugagccucuaaauguu

SEQ ID NO: 3775483 - RNA, 16 nt, Salmonella typhimurium LT2
ugagcgaaacuccagc

SEQ ID NO: 3775484 - RNA, 18 nt, Salmonella typhimurium LT2
ugagcgaaacuccagcga

SEQ ID NO: 3775485 - RNA, 20 nt, Salmonella typhimurium LT2
ugagcgagucagacaccagc

SEQ ID NO: 3775486 - RNA, 13 nt, Salmonella typhimurium LT2
ugagcgcaaugcu

SEQ ID NO: 3775487 - RNA, 20 nt, Salmonella typhimurium LT2
ugagcgccgcgccuaccagc

SEQ ID NO: 3775488 - RNA, 17 nt, Salmonella typhimurium LT2
ugagcgcgaacgcucca

SEQ ID NO: 3775489 - RNA, 18 nt, Salmonella typhimurium LT2
ugagcgcuugcugcguaa

SEQ ID NO: 3775490 - RNA, 23 nt, Salmonella typhimurium LT2
ugagcggaacgucuuuuuccagc

SEQ ID NO: 3775491 - RNA, 18 nt, Salmonella typhimurium LT2
ugagcggagucgucaaau

SEQ ID NO: 3775492 - RNA, 17 nt, Salmonella typhimurium LT2
ugagcggauauucuccg

SEQ ID NO: 3775493 - RNA, 18 nt, Salmonella typhimurium LT2
ugagcggcucauccagca

SEQ ID NO: 3775494 - RNA, 19 nt, Salmonella typhimurium LT2
ugagcggcucauccagcaa

SEQ ID NO: 3775495 - RNA, 12 nt, Salmonella typhimurium LT2
ugagcgggccgu

SEQ ID NO: 3775496 - RNA, 15 nt, Salmonella typhimurium LT2
ugagcgucgccagac

SEQ ID NO: 3775497 - RNA, 19 nt, Salmonella typhimurium LT2
ugagcgugaucgucuccug

SEQ ID NO: 3775498 - RNA, 20 nt, Salmonella typhimurium LT2
ugagcguggaaaacagcgcc

SEQ ID NO: 3775499 - RNA, 13 nt, Salmonella typhimurium LT2
ugagcguggcgua

SEQ ID NO: 3775500 - RNA, 20 nt, Salmonella typhimurium LT2
ugagcguguccucugcugcg

SEQ ID NO: 3775501 - RNA, 23 nt, Salmonella typhimurium LT2
ugagcguuacgccaucagggacg

SEQ ID NO: 3775502 - RNA, 23 nt, Salmonella typhimurium LT2
ugagcguugggcacccauacgcg

SEQ ID NO: 3775503 - RNA, 11 nt, Salmonella typhimurium LT2
ugagcuaauca

SEQ ID NO: 3775504 - RNA, 13 nt, Salmonella typhimurium LT2
ugagcuauuucag

SEQ ID NO: 3775505 - RNA, 15 nt, Salmonella typhimurium LT2
ugagcuauuucagug

SEQ ID NO: 3775506 - RNA, 17 nt, Salmonella typhimurium LT2
ugagcugacugacguga

SEQ ID NO: 3775507 - RNA, 16 nt, Salmonella typhimurium LT2
ugagcuuaacgcguag

SEQ ID NO: 3775508 - RNA, 20 nt, Salmonella typhimurium LT2
ugaggaaaaaccgccucaau

SEQ ID NO: 3775509 - RNA, 16 nt, Salmonella typhimurium LT2
ugaggaagaagcgcac

SEQ ID NO: 3775510 - RNA, 19 nt, Salmonella typhimurium LT2
ugaggagucauugcuaugc

SEQ ID NO: 3775511 - RNA, 20 nt, Salmonella typhimurium LT2
ugaggagucauugcuaugcc

SEQ ID NO: 3775512 - RNA, 13 nt, Salmonella typhimurium LT2
ugaggcaagaggg

SEQ ID NO: 3775513 - RNA, 23 nt, Salmonella typhimurium LT2
ugaggccugcacaaaaagagcaa

SEQ ID NO: 3775514 - RNA, 17 nt, Salmonella typhimurium LT2
ugaggcgacaaucucac

SEQ ID NO: 3775515 - RNA, 12 nt, Salmonella typhimurium LT2
ugaggcgcagcc

SEQ ID NO: 3775516 - RNA, 17 nt, Salmonella typhimurium LT2
ugaggcguugcuccagc

SEQ ID NO: 3775517 - RNA, 20 nt, Salmonella typhimurium LT2
ugagguggccgagaggcuga

SEQ ID NO: 3775518 - RNA, 19 nt, Salmonella typhimurium LT2
ugaguaaagagaucaauuu

SEQ ID NO: 3775519 - RNA, 13 nt, Salmonella typhimurium LT2
ugaguaaauaaaa

SEQ ID NO: 3775520 - RNA, 21 nt, Salmonella typhimurium LT2
ugaguauugacgaaaagauaa

SEQ ID NO: 3775521 - RNA, 16 nt, Salmonella typhimurium LT2
ugaguauuggcaagaa

SEQ ID NO: 3775522 - RNA, 17 nt, Salmonella typhimurium LT2
ugagucgggccugcugc

SEQ ID NO: 3775523 - RNA, 14 nt, Salmonella typhimurium LT2
ugaguguaauacuc

SEQ ID NO: 3775524 - RNA, 14 nt, Salmonella typhimurium LT2
ugaguguuacucuu

SEQ ID NO: 3775525 - RNA, 16 nt, Salmonella typhimurium LT2
ugaguuggccuaccau

SEQ ID NO: 3775526 - RNA, 16 nt, Salmonella typhimurium LT2
ugaguuugucauccag

SEQ ID NO: 3775527 - RNA, 18 nt, Salmonella typhimurium LT2
ugaguuugucauccagac

SEQ ID NO: 3775528 - RNA, 14 nt, Salmonella typhimurium LT2
ugauaaaacgcagg

SEQ ID NO: 3775529 - RNA, 13 nt, Salmonella typhimurium LT2
ugauaaagcgcuc

SEQ ID NO: 3775530 - RNA, 12 nt, Salmonella typhimurium LT2
ugauaacaauau

SEQ ID NO: 3775531 - RNA, 14 nt, Salmonella typhimurium LT2
ugauaacccaacuc

SEQ ID NO: 3775532 - RNA, 21 nt, Salmonella typhimurium LT2
ugauaacgauaagugaagcgu

SEQ ID NO: 3775533 - RNA, 14 nt, Salmonella typhimurium LT2
ugauaagagaaaau

SEQ ID NO: 3775534 - RNA, 18 nt, Salmonella typhimurium LT2
ugauaagcauagcgccau

SEQ ID NO: 3775535 - RNA, 20 nt, Salmonella typhimurium LT2
ugauggcgcgacgcuuauca

SEQ ID NO: 3775536 - RNA, 16 nt, Salmonella typhimurium LT2
ugauggcgcugcgcca

SEQ ID NO: 3775537 - RNA, 20 nt, Salmonella typhimurium LT2
ugauggcgcugcgcuuauca

SEQ ID NO: 3775538 - RNA, 21 nt, Salmonella typhimurium LT2
ugauggcuaauauccagccac

SEQ ID NO: 3775539 - RNA, 14 nt, Salmonella typhimurium LT2
ugauguaccugcgu

SEQ ID NO: 3775540 - RNA, 18 nt, Salmonella typhimurium LT2
ugauguagucaucaacgc

SEQ ID NO: 3775541 - RNA, 16 nt, Salmonella typhimurium LT2
ugaugucgaggaaaaa

SEQ ID NO: 3775542 - RNA, 17 nt, Salmonella typhimurium LT2
ugaugucgaggaaaaac

SEQ ID NO: 3775543 - RNA, 17 nt, Salmonella typhimurium LT2
ugauuaaaagucaacug

SEQ ID NO: 3775544 - RNA, 19 nt, Salmonella typhimurium LT2
ugauuaaguuuuuuuaaaa

SEQ ID NO: 3775545 - RNA, 18 nt, Salmonella typhimurium LT2
ugauuaaucagcucagca

SEQ ID NO: 3775546 - RNA, 21 nt, Salmonella typhimurium LT2
ugauuaaucagcucagcaaca

SEQ ID NO: 3775547 - RNA, 17 nt, Salmonella typhimurium LT2
ugauuaaugcugcacca

SEQ ID NO: 3775548 - RNA, 18 nt, Salmonella typhimurium LT2
ugauuaaugcugcaccac

SEQ ID NO: 3775549 - RNA, 12 nt, Salmonella typhimurium LT2
ugauuacaaaau

SEQ ID NO: 3775550 - RNA, 15 nt, Salmonella typhimurium LT2
ugauuacaaaaugug

SEQ ID NO: 3775551 - RNA, 16 nt, Salmonella typhimurium LT2
ugauucacuuucuugc

SEQ ID NO: 3775552 - RNA, 15 nt, Salmonella typhimurium LT2
ugauuccagagcgaa

SEQ ID NO: 3775553 - RNA, 15 nt, Salmonella typhimurium LT2
ugauucgcuggccuc

SEQ ID NO: 3775554 - RNA, 16 nt, Salmonella typhimurium LT2
ugauucuacucugcuc

SEQ ID NO: 3775555 - RNA, 13 nt, Salmonella typhimurium LT2
ugauuuaaaagua

SEQ ID NO: 3775556 - RNA, 20 nt, Salmonella typhimurium LT2
ugauuuaauucgauaauuuc

SEQ ID NO: 3775557 - RNA, 11 nt, Salmonella typhimurium LT2
ugauuuauuca

SEQ ID NO: 3775558 - RNA, 13 nt, Salmonella typhimurium LT2
ugauuuccagaau

SEQ ID NO: 3775559 - RNA, 16 nt, Salmonella typhimurium LT2
ugauuugcggcagaaa

SEQ ID NO: 3775560 - RNA, 15 nt, Salmonella typhimurium LT2
ugauuuggaggccgg

SEQ ID NO: 3775561 - RNA, 16 nt, Salmonella typhimurium LT2
ugauuuggaggccgga

SEQ ID NO: 3775562 - RNA, 21 nt, Salmonella typhimurium LT2
ugauuuuaacaucaccuuuca

SEQ ID NO: 3775563 - RNA, 18 nt, Salmonella typhimurium LT2
ugcaaaaaaggccagagg

SEQ ID NO: 3775564 - RNA, 12 nt, Salmonella typhimurium LT2
ugcaaaaugaug

SEQ ID NO: 3775565 - RNA, 14 nt, Salmonella typhimurium LT2
ugcaaacccaucuc

SEQ ID NO: 3775566 - RNA, 21 nt, Salmonella typhimurium LT2
ugcaaacuaaacgacguggag

SEQ ID NO: 3775567 - RNA, 13 nt, Salmonella typhimurium LT2
ugcaaagaaaaac

SEQ ID NO: 3775568 - RNA, 15 nt, Salmonella typhimurium LT2
ugcaaauaccacauc

SEQ ID NO: 3775569 - RNA, 17 nt, Salmonella typhimurium LT2
ugcaaauaccacaucag

SEQ ID NO: 3775570 - RNA, 15 nt, Salmonella typhimurium LT2
ugcaaauacugcuuu

SEQ ID NO: 3775571 - RNA, 20 nt, Salmonella typhimurium LT2
ugcaaauacugcuuuuccgg

SEQ ID NO: 3775572 - RNA, 14 nt, Salmonella typhimurium LT2
ugcaaauauucgcc

SEQ ID NO: 3775573 - RNA, 14 nt, Salmonella typhimurium LT2
ugcaaaucaccaca

SEQ ID NO: 3775574 - RNA, 21 nt, Salmonella typhimurium LT2
ugcaacagaagaguuaacuuc

SEQ ID NO: 3775575 - RNA, 22 nt, Salmonella typhimurium LT2
ugcaacagaagaguuaacuucu

SEQ ID NO: 3775576 - RNA, 14 nt, Salmonella typhimurium LT2
ugcaacagcaccag

SEQ ID NO: 3775577 - RNA, 18 nt, Salmonella typhimurium LT2
ugcaacccgccgccauca

SEQ ID NO: 3775578 - RNA, 23 nt, Salmonella typhimurium LT2
ugcaaccuccgcaccuucaucau

SEQ ID NO: 3775579 - RNA, 21 nt, Salmonella typhimurium LT2
ugcaacgacgcgggaucguca

SEQ ID NO: 3775580 - RNA, 21 nt, Salmonella typhimurium LT2
ugcaacgaucccuaauaaaau

SEQ ID NO: 3775581 - RNA, 17 nt, Salmonella typhimurium LT2
ugcaacgccagaugcgu

SEQ ID NO: 3775582 - RNA, 21 nt, Salmonella typhimurium LT2
ugcaacgcuuuagugccgcca

SEQ ID NO: 3775583 - RNA, 17 nt, Salmonella typhimurium LT2
ugcaacuccugggcaaa

SEQ ID NO: 3775584 - RNA, 18 nt, Salmonella typhimurium LT2
ugcaacuggcaagcgcua

SEQ ID NO: 3775585 - RNA, 14 nt, Salmonella typhimurium LT2
ugcaacuucaccuu

SEQ ID NO: 3775586 - RNA, 19 nt, Salmonella typhimurium LT2
ugcaaggcaucgucggcga

SEQ ID NO: 3775587 - RNA, 17 nt, Salmonella typhimurium LT2
ugcaauaaaauauccuc

SEQ ID NO: 3775588 - RNA, 17 nt, Salmonella typhimurium LT2
ugcaauaccggcugcuu

SEQ ID NO: 3775589 - RNA, 20 nt, Salmonella typhimurium LT2
ugcaauaccgggauuguaua

SEQ ID NO: 3775590 - RNA, 18 nt, Salmonella typhimurium LT2
ugcaauaucgaugccagu

SEQ ID NO: 3775591 - RNA, 15 nt, Salmonella typhimurium LT2
ugcaaucacacuaca

SEQ ID NO: 3775592 - RNA, 12 nt, Salmonella typhimurium LT2
ugcaaucagauu

SEQ ID NO: 3775593 - RNA, 16 nt, Salmonella typhimurium LT2
ugcaaugugcaggcuu

SEQ ID NO: 3775594 - RNA, 21 nt, Salmonella typhimurium LT2
ugcaauguucaauaucaaauu

SEQ ID NO: 3775595 - RNA, 21 nt, Salmonella typhimurium LT2
ugcaauguuuucagcaaauaa

SEQ ID NO: 3775596 - RNA, 14 nt, Salmonella typhimurium LT2
ugcaauuccggcga

SEQ ID NO: 3775597 - RNA, 17 nt, Salmonella typhimurium LT2
ugcaauuccggcgaaaa

SEQ ID NO: 3775598 - RNA, 19 nt, Salmonella typhimurium LT2
ugcaauuccggcgaaaaac

SEQ ID NO: 3775599 - RNA, 20 nt, Salmonella typhimurium LT2
ugcaauuccggcgaaaaacc

SEQ ID NO: 3775600 - RNA, 19 nt, Salmonella typhimurium LT2
ugcaauuucuuuuccagac

SEQ ID NO: 3775601 - RNA, 13 nt, Salmonella typhimurium LT2
ugcacaaaauacu

SEQ ID NO: 3775602 - RNA, 15 nt, Salmonella typhimurium LT2
ugcacaaaauacugu

SEQ ID NO: 3775603 - RNA, 16 nt, Salmonella typhimurium LT2
ugcacaaaauacuguu

SEQ ID NO: 3775604 - RNA, 15 nt, Salmonella typhimurium LT2
ugcacaauaccaaua

SEQ ID NO: 3775605 - RNA, 16 nt, Salmonella typhimurium LT2
ugcacaauaccaauaa

SEQ ID NO: 3775606 - RNA, 16 nt, Salmonella typhimurium LT2
ugcacaaucgccagcc

SEQ ID NO: 3775607 - RNA, 16 nt, Salmonella typhimurium LT2
ugcacaauuuuagccg

SEQ ID NO: 3775608 - RNA, 23 nt, Salmonella typhimurium LT2
ugcacaauuuuagccgcaucuuc

SEQ ID NO: 3775609 - RNA, 18 nt, Salmonella typhimurium LT2
ugcacagucugcagaccu

SEQ ID NO: 3775610 - RNA, 19 nt, Salmonella typhimurium LT2
ugcacauaacgugccaucu

SEQ ID NO: 3775611 - RNA, 15 nt, Salmonella typhimurium LT2
ugcacauguuucagc

SEQ ID NO: 3775612 - RNA, 17 nt, Salmonella typhimurium LT2
ugcaccaaauccuccag

SEQ ID NO: 3775613 - RNA, 20 nt, Salmonella typhimurium LT2
ugcaccaaauccuccagcgg

SEQ ID NO: 3775614 - RNA, 22 nt, Salmonella typhimurium LT2
ugcaccgcaucaaacucgccca

SEQ ID NO: 3775615 - RNA, 19 nt, Salmonella typhimurium LT2
ugcaccuuuuuuuccagcg

SEQ ID NO: 3775616 - RNA, 20 nt, Salmonella typhimurium LT2
ugcaccuuuuuuuccagcgu

SEQ ID NO: 3775617 - RNA, 15 nt, Salmonella typhimurium LT2
ugcacgccaggguaa

SEQ ID NO: 3775618 - RNA, 21 nt, Salmonella typhimurium LT2
ugcacgccaggguaauacugg

SEQ ID NO: 3775619 - RNA, 21 nt, Salmonella typhimurium LT2
ugcacgcuuuaucuggucugc

SEQ ID NO: 3775620 - RNA, 22 nt, Salmonella typhimurium LT2
ugcacgucgagacgguguuuag

SEQ ID NO: 3775621 - RNA, 17 nt, Salmonella typhimurium LT2
ugcacugacuuacaggc

SEQ ID NO: 3775622 - RNA, 17 nt, Salmonella typhimurium LT2
ugcacugccugauggcg

SEQ ID NO: 3775623 - RNA, 15 nt, Salmonella typhimurium LT2
ugcacugcugauagu

SEQ ID NO: 3775624 - RNA, 17 nt, Salmonella typhimurium LT2
ugcacugguagaaaaac

SEQ ID NO: 3775625 - RNA, 18 nt, Salmonella typhimurium LT2
ugcacuucaugccgaaca

SEQ ID NO: 3775626 - RNA, 23 nt, Salmonella typhimurium LT2
ugcacuucgccgggauaaaacac

SEQ ID NO: 3775627 - RNA, 15 nt, Salmonella typhimurium LT2
ugcacuugucgggga

SEQ ID NO: 3775628 - RNA, 16 nt, Salmonella typhimurium LT2
ugcagaaaggcgugca

SEQ ID NO: 3775629 - RNA, 15 nt, Salmonella typhimurium LT2
ugcagaacaccgcgu

SEQ ID NO: 3775630 - RNA, 18 nt, Salmonella typhimurium LT2
ugcagaccuuuccaggau

SEQ ID NO: 3775631 - RNA, 20 nt, Salmonella typhimurium LT2
ugcagauccgcgauaucaau

SEQ ID NO: 3775632 - RNA, 19 nt, Salmonella typhimurium LT2
ugcagauccuuaacgucaa

SEQ ID NO: 3775633 - RNA, 13 nt, Salmonella typhimurium LT2
ugcagaugcugcu

SEQ ID NO: 3775634 - RNA, 14 nt, Salmonella typhimurium LT2
ugcagaugcugcug

SEQ ID NO: 3775635 - RNA, 18 nt, Salmonella typhimurium LT2
ugcagauuacugagcagu

SEQ ID NO: 3775636 - RNA, 13 nt, Salmonella typhimurium LT2
ugcagauuuugcu

SEQ ID NO: 3775637 - RNA, 15 nt, Salmonella typhimurium LT2
ugcagauuuugcucc

SEQ ID NO: 3775638 - RNA, 12 nt, Salmonella typhimurium LT2
ugcagcaaauac

SEQ ID NO: 3775639 - RNA, 23 nt, Salmonella typhimurium LT2
ugccaguaguugaauaaccucaa

SEQ ID NO: 3775640 - RNA, 20 nt, Salmonella typhimurium LT2
ugccagucgagaucgacguu

SEQ ID NO: 3775641 - RNA, 19 nt, Salmonella typhimurium LT2
ugccagucgguaaugccgu

SEQ ID NO: 3775642 - RNA, 13 nt, Salmonella typhimurium LT2
ugccagugaaaaa

SEQ ID NO: 3775643 - RNA, 18 nt, Salmonella typhimurium LT2
ugccaguugcaguugcgc

SEQ ID NO: 3775644 - RNA, 16 nt, Salmonella typhimurium LT2
ugccaguuucucaaag

SEQ ID NO: 3775645 - RNA, 19 nt, Salmonella typhimurium LT2
ugccauacuuuuccagcgc

SEQ ID NO: 3775646 - RNA, 20 nt, Salmonella typhimurium LT2
ugccauaucguucaguuuca

SEQ ID NO: 3775647 - RNA, 14 nt, Salmonella typhimurium LT2
ugccauauuuucca

SEQ ID NO: 3775648 - RNA, 16 nt, Salmonella typhimurium LT2
ugccauauuuuccagu

SEQ ID NO: 3775649 - RNA, 19 nt, Salmonella typhimurium LT2
ugccauccagcaccaggcg

SEQ ID NO: 3775650 - RNA, 17 nt, Salmonella typhimurium LT2
ugccaucgcuucuacag

SEQ ID NO: 3775651 - RNA, 20 nt, Salmonella typhimurium LT2
ugccaucgcuuugagcagcg

SEQ ID NO: 3775652 - RNA, 14 nt, Salmonella typhimurium LT2
ugccaucggccagc

SEQ ID NO: 3775653 - RNA, 18 nt, Salmonella typhimurium LT2
ugccaugaugagcgccau

SEQ ID NO: 3775654 - RNA, 14 nt, Salmonella typhimurium LT2
ugccaugcggcggc

SEQ ID NO: 3775655 - RNA, 15 nt, Salmonella typhimurium LT2
ugccauguuaauacc

SEQ ID NO: 3775656 - RNA, 22 nt, Salmonella typhimurium LT2
ugccauguuaauaccagcgcca

SEQ ID NO: 3775657 - RNA, 23 nt, Salmonella typhimurium LT2
ugccauuaucaccauucccagcg

SEQ ID NO: 3775658 - RNA, 17 nt, Salmonella typhimurium LT2
ugccauucgcccaguca

SEQ ID NO: 3775659 - RNA, 20 nt, Salmonella typhimurium LT2
ugccauuuccugauuuuuua

SEQ ID NO: 3775660 - RNA, 21 nt, Salmonella typhimurium LT2
ugccauuuuugcaucaucacu

SEQ ID NO: 3775661 - RNA, 20 nt, Salmonella typhimurium LT2
ugcccaaauaaaagccgcca

SEQ ID NO: 3775662 - RNA, 18 nt, Salmonella typhimurium LT2
ugcccacccgggccggaa

SEQ ID NO: 3775663 - RNA, 15 nt, Salmonella typhimurium LT2
ugcccacggcguagc

SEQ ID NO: 3775664 - RNA, 18 nt, Salmonella typhimurium LT2
ugcccagcaucccgcugg

SEQ ID NO: 3775665 - RNA, 18 nt, Salmonella typhimurium LT2
ugcccaguuuacccagcg

SEQ ID NO: 3775666 - RNA, 14 nt, Salmonella typhimurium LT2
ugcccaugaagcga

SEQ ID NO: 3775667 - RNA, 13 nt, Salmonella typhimurium LT2
ugcccauuccgcc

SEQ ID NO: 3775668 - RNA, 18 nt, Salmonella typhimurium LT2
ugcccauuucagcauuaa

SEQ ID NO: 3775669 - RNA, 20 nt, Salmonella typhimurium LT2
ugcccauuucagcauuaaga

SEQ ID NO: 3775670 - RNA, 21 nt, Salmonella typhimurium LT2
ugccccacgauacgucccugc

SEQ ID NO: 3775671 - RNA, 18 nt, Salmonella typhimurium LT2
ugccccagcgcugcugua

SEQ ID NO: 3775672 - RNA, 15 nt, Salmonella typhimurium LT2
ugccccauccggcaa

SEQ ID NO: 3775673 - RNA, 15 nt, Salmonella typhimurium LT2
ugccccauuguucuu

SEQ ID NO: 3775674 - RNA, 22 nt, Salmonella typhimurium LT2
ugccccccgacuucacgcugca

SEQ ID NO: 3775675 - RNA, 15 nt, Salmonella typhimurium LT2
ugcccccgagccaga

SEQ ID NO: 3775676 - RNA, 19 nt, Salmonella typhimurium LT2
ugcccccgaucacggcgaa

SEQ ID NO: 3775677 - RNA, 20 nt, Salmonella typhimurium LT2
ugcccgaacgcaauacugua

SEQ ID NO: 3775678 - RNA, 17 nt, Salmonella typhimurium LT2
ugcccgacgccgcggcg

SEQ ID NO: 3775679 - RNA, 21 nt, Salmonella typhimurium LT2
ugcccgccacccuccgggccg

SEQ ID NO: 3775680 - RNA, 20 nt, Salmonella typhimurium LT2
ugcccgccaggguaucauca

SEQ ID NO: 3775681 - RNA, 22 nt, Salmonella typhimurium LT2
ugcccgccgccgcaugaaucaa

SEQ ID NO: 3775682 - RNA, 18 nt, Salmonella typhimurium LT2
ugcccgccguuaaaucau

SEQ ID NO: 3775683 - RNA, 16 nt, Salmonella typhimurium LT2
ugcccgcguucugcug

SEQ ID NO: 3775684 - RNA, 14 nt, Salmonella typhimurium LT2
ugcccggccguuac

SEQ ID NO: 3775685 - RNA, 13 nt, Salmonella typhimurium LT2
ugcccggccuccg

SEQ ID NO: 3775686 - RNA, 19 nt, Salmonella typhimurium LT2
ugcccgguggcgcugcgcu

SEQ ID NO: 3775687 - RNA, 21 nt, Salmonella typhimurium LT2
ugcccgguuaaggggcaggcg

SEQ ID NO: 3775688 - RNA, 16 nt, Salmonella typhimurium LT2
ugcccgguuuuuuaau

SEQ ID NO: 3775689 - RNA, 19 nt, Salmonella typhimurium LT2
ugcccgucgcuacaggcaa

SEQ ID NO: 3775690 - RNA, 13 nt, Salmonella typhimurium LT2
ugcccguuccagg

SEQ ID NO: 3775691 - RNA, 19 nt, Salmonella typhimurium LT2
ugcccucaacgcccugcuc

SEQ ID NO: 3775692 - RNA, 15 nt, Salmonella typhimurium LT2
ugcccucuuuaucaa

SEQ ID NO: 3775693 - RNA, 22 nt, Salmonella typhimurium LT2
ugcccugcuugucgaucaucag

SEQ ID NO: 3775694 - RNA, 19 nt, Salmonella typhimurium LT2
ugcccuguuucgcaggccg

SEQ ID NO: 3775695 - RNA, 18 nt, Salmonella typhimurium LT2
ugcccuuaaauccggccu

SEQ ID NO: 3775696 - RNA, 21 nt, Salmonella typhimurium LT2
ugcccuuaaauccggccucca

SEQ ID NO: 3775697 - RNA, 15 nt, Salmonella typhimurium LT2
ugcccuuccagcucu

SEQ ID NO: 3775698 - RNA, 15 nt, Salmonella typhimurium LT2
ugcccuucgcgcgau

SEQ ID NO: 3775699 - RNA, 13 nt, Salmonella typhimurium LT2
ugcccuuucuuau

SEQ ID NO: 3775700 - RNA, 13 nt, Salmonella typhimurium LT2
ugccgaacgcggc

SEQ ID NO: 3775701 - RNA, 21 nt, Salmonella typhimurium LT2
ugccgaagaaagcuaucgcca

SEQ ID NO: 3775702 - RNA, 22 nt, Salmonella typhimurium LT2
ugccgaauggcggcuucgccau

SEQ ID NO: 3775703 - RNA, 22 nt, Salmonella typhimurium LT2
ugccgacaaagagcuccccacg

SEQ ID NO: 3775704 - RNA, 13 nt, Salmonella typhimurium LT2
ugccgacaggcag

SEQ ID NO: 3775705 - RNA, 18 nt, Salmonella typhimurium LT2
ugccgagcagaucgcggc

SEQ ID NO: 3775706 - RNA, 18 nt, Salmonella typhimurium LT2
ugccgauagucuccgcca

SEQ ID NO: 3775707 - RNA, 18 nt, Salmonella typhimurium LT2
ugccgaucaccagcgcau

SEQ ID NO: 3775708 - RNA, 14 nt, Salmonella typhimurium LT2
ugccgaugaaauaa

SEQ ID NO: 3775709 - RNA, 15 nt, Salmonella typhimurium LT2
ugccgaugaaauaau

SEQ ID NO: 3775710 - RNA, 21 nt, Salmonella typhimurium LT2
ugccgaugacgcuccugaauc

SEQ ID NO: 3775711 - RNA, 16 nt, Salmonella typhimurium LT2
ugccgaugacucccag

SEQ ID NO: 3775712 - RNA, 17 nt, Salmonella typhimurium LT2
ugccgaugacucccagu

SEQ ID NO: 3775713 - RNA, 23 nt, Salmonella typhimurium LT2
ugccgaugaucccggcgccgccg

SEQ ID NO: 3775714 - RNA, 20 nt, Salmonella typhimurium LT2
ugccgauuccaugcccaguu

SEQ ID NO: 3775715 - RNA, 20 nt, Salmonella typhimurium LT2
ugccgcaaacgccugcuccg

SEQ ID NO: 3775716 - RNA, 19 nt, Salmonella typhimurium LT2
ugccgcaaaugaccagauc

SEQ ID NO: 3775717 - RNA, 14 nt, Salmonella typhimurium LT2
ugccgcacucccca

SEQ ID NO: 3775718 - RNA, 18 nt, Salmonella typhimurium LT2
ugccgccagcaguugcag

SEQ ID NO: 3775719 - RNA, 21 nt, Salmonella typhimurium LT2
ugccgccaguuguucaacaug

SEQ ID NO: 3775720 - RNA, 20 nt, Salmonella typhimurium LT2
ugccgccauaggucagcgcu

SEQ ID NO: 3775721 - RNA, 12 nt, Salmonella typhimurium LT2
ugccgccauccg

SEQ ID NO: 3775722 - RNA, 19 nt, Salmonella typhimurium LT2
ugccgcccaccugcagcag

SEQ ID NO: 3775723 - RNA, 16 nt, Salmonella typhimurium LT2
ugccgcccauccagag

SEQ ID NO: 3775724 - RNA, 19 nt, Salmonella typhimurium LT2
ugccgcccaucgccacagc

SEQ ID NO: 3775725 - RNA, 20 nt, Salmonella typhimurium LT2
ugccgcccguuuuuuccagu

SEQ ID NO: 3775726 - RNA, 14 nt, Salmonella typhimurium LT2
ugccgccgcaccac

SEQ ID NO: 3775727 - RNA, 19 nt, Salmonella typhimurium LT2
ugccgccgggccaucuucc

SEQ ID NO: 3775728 - RNA, 15 nt, Salmonella typhimurium LT2
ugccgccugccugca

SEQ ID NO: 3775729 - RNA, 14 nt, Salmonella typhimurium LT2
ugccgcgaucgcgg

SEQ ID NO: 3775730 - RNA, 15 nt, Salmonella typhimurium LT2
ugccgcgaucgcggc

SEQ ID NO: 3775731 - RNA, 13 nt, Salmonella typhimurium LT2
ugccgcgccagcc

SEQ ID NO: 3775732 - RNA, 17 nt, Salmonella typhimurium LT2
ugccgcgcccagcgccg

SEQ ID NO: 3775733 - RNA, 18 nt, Salmonella typhimurium LT2
ugccgcgccugccauagc

SEQ ID NO: 3775734 - RNA, 22 nt, Salmonella typhimurium LT2
ugccgcgcggauucuccaggcg

SEQ ID NO: 3775735 - RNA, 23 nt, Salmonella typhimurium LT2
ugccgcgcuggugggacuguuca

SEQ ID NO: 3775736 - RNA, 14 nt, Salmonella typhimurium LT2
ugccgcugcugccu

SEQ ID NO: 3775737 - RNA, 15 nt, Salmonella typhimurium LT2
ugccgcugcugccuu

SEQ ID NO: 3775738 - RNA, 14 nt, Salmonella typhimurium LT2
ugccggaaaaugcg

SEQ ID NO: 3775739 - RNA, 22 nt, Salmonella typhimurium LT2
ugccggaaagacggcagcgcca

SEQ ID NO: 3775740 - RNA, 13 nt, Salmonella typhimurium LT2
ugccggaacgcga

SEQ ID NO: 3775741 - RNA, 16 nt, Salmonella typhimurium LT2
ugccggaacucagcua

SEQ ID NO: 3775742 - RNA, 13 nt, Salmonella typhimurium LT2
ugccggaagggau

SEQ ID NO: 3775743 - RNA, 13 nt, Salmonella typhimurium LT2
ugcgcaagaaaag

SEQ ID NO: 3775744 - RNA, 18 nt, Salmonella typhimurium LT2
ugcgcaagcacugaaugc

SEQ ID NO: 3775745 - RNA, 15 nt, Salmonella typhimurium LT2
ugcgcaauuccagca

SEQ ID NO: 3775746 - RNA, 12 nt, Salmonella typhimurium LT2
ugcgcacucaga

SEQ ID NO: 3775747 - RNA, 18 nt, Salmonella typhimurium LT2
ugcgcagaccgcguucca

SEQ ID NO: 3775748 - RNA, 24 nt, Salmonella typhimurium LT2
ugcgcagccacggcgcacacgccc

SEQ ID NO: 3775749 - RNA, 18 nt, Salmonella typhimurium LT2
ugcgcagccccagcgcca

SEQ ID NO: 3775750 - RNA, 20 nt, Salmonella typhimurium LT2
ugcgcagccccagcgccagc

SEQ ID NO: 3775751 - RNA, 21 nt, Salmonella typhimurium LT2
ugcgcagccccagcgccagcc

SEQ ID NO: 3775752 - RNA, 18 nt, Salmonella typhimurium LT2
ugcgcauccucuuuccgu

SEQ ID NO: 3775753 - RNA, 19 nt, Salmonella typhimurium LT2
ugcgcauccucuuuccguu

SEQ ID NO: 3775754 - RNA, 21 nt, Salmonella typhimurium LT2
ugcgcaucuggggcgcuuugc

SEQ ID NO: 3775755 - RNA, 16 nt, Salmonella typhimurium LT2
ugcgcauugacgugcu

SEQ ID NO: 3775756 - RNA, 14 nt, Salmonella typhimurium LT2
ugcgccaagcgccu

SEQ ID NO: 3775757 - RNA, 17 nt, Salmonella typhimurium LT2
ugcgccaccagcgcagu

SEQ ID NO: 3775758 - RNA, 20 nt, Salmonella typhimurium LT2
ugcgccaccagcgcaguaaa

SEQ ID NO: 3775759 - RNA, 23 nt, Salmonella typhimurium LT2
ugcgccaccuuaaucgacuucau

SEQ ID NO: 3775760 - RNA, 13 nt, Salmonella typhimurium LT2
ugcgccacggaug

SEQ ID NO: 3775761 - RNA, 20 nt, Salmonella typhimurium LT2
ugcgccacguucggcgugua

SEQ ID NO: 3775762 - RNA, 20 nt, Salmonella typhimurium LT2
ugcgccagauaaccaaucac

SEQ ID NO: 3775763 - RNA, 14 nt, Salmonella typhimurium LT2
ugcgccagcaccau

SEQ ID NO: 3775764 - RNA, 13 nt, Salmonella typhimurium LT2
ugcgccagcagcg

SEQ ID NO: 3775765 - RNA, 15 nt, Salmonella typhimurium LT2
ugcgccagcauggcg

SEQ ID NO: 3775766 - RNA, 20 nt, Salmonella typhimurium LT2
ugcgccagccagcucaccag

SEQ ID NO: 3775767 - RNA, 12 nt, Salmonella typhimurium LT2
ugcgccagcgca

SEQ ID NO: 3775768 - RNA, 20 nt, Salmonella typhimurium LT2
ugcgccagcgcauuaccgcc

SEQ ID NO: 3775769 - RNA, 13 nt, Salmonella typhimurium LT2
ugcgccagcgccg

SEQ ID NO: 3775770 - RNA, 17 nt, Salmonella typhimurium LT2
ugcgccaggcagcaccu

SEQ ID NO: 3775771 - RNA, 19 nt, Salmonella typhimurium LT2
ugcgccaguacguuaugcc

SEQ ID NO: 3775772 - RNA, 17 nt, Salmonella typhimurium LT2
ugcgccaguucagcguc

SEQ ID NO: 3775773 - RNA, 21 nt, Salmonella typhimurium LT2
ugcgccaguucauccagcagc

SEQ ID NO: 3775774 - RNA, 18 nt, Salmonella typhimurium LT2
ugcgccauccaccaggca

SEQ ID NO: 3775775 - RNA, 13 nt, Salmonella typhimurium LT2
ugcgccauuaacg

SEQ ID NO: 3775776 - RNA, 23 nt, Salmonella typhimurium LT2
ugcgccauugccguaucagcaag

SEQ ID NO: 3775777 - RNA, 19 nt, Salmonella typhimurium LT2
ugcgccauuucaauaauau

SEQ ID NO: 3775778 - RNA, 15 nt, Salmonella typhimurium LT2
ugcgccauuuccagc

SEQ ID NO: 3775779 - RNA, 21 nt, Salmonella typhimurium LT2
ugcgcccagcccggaaauaaa

SEQ ID NO: 3775780 - RNA, 14 nt, Salmonella typhimurium LT2
ugcgccccagcaug

SEQ ID NO: 3775781 - RNA, 19 nt, Salmonella typhimurium LT2
ugcgccccggcggcguaca

SEQ ID NO: 3775782 - RNA, 18 nt, Salmonella typhimurium LT2
ugcgccccugcaggcgau

SEQ ID NO: 3775783 - RNA, 13 nt, Salmonella typhimurium LT2
ugcgcccgguaau

SEQ ID NO: 3775784 - RNA, 17 nt, Salmonella typhimurium LT2
ugcgcccuuccgucagc

SEQ ID NO: 3775785 - RNA, 16 nt, Salmonella typhimurium LT2
ugcgccgcaaacucag

SEQ ID NO: 3775786 - RNA, 19 nt, Salmonella typhimurium LT2
ugcgccgccagugagguga

SEQ ID NO: 3775787 - RNA, 18 nt, Salmonella typhimurium LT2
ugcgccgccauccggcga

SEQ ID NO: 3775788 - RNA, 23 nt, Salmonella typhimurium LT2
ugcgccgccauccggcgauggug

SEQ ID NO: 3775789 - RNA, 17 nt, Salmonella typhimurium LT2
ugcgccgcgagugcagg

SEQ ID NO: 3775790 - RNA, 20 nt, Salmonella typhimurium LT2
ugcgccgcuccguacgcguc

SEQ ID NO: 3775791 - RNA, 21 nt, Salmonella typhimurium LT2
ugcgccgcuugugccgacguc

SEQ ID NO: 3775792 - RNA, 21 nt, Salmonella typhimurium LT2
ugcgccguaaggcgugccgcc

SEQ ID NO: 3775793 - RNA, 23 nt, Salmonella typhimurium LT2
ugcgccgugaaaauaaaauaucc

SEQ ID NO: 3775794 - RNA, 21 nt, Salmonella typhimurium LT2
ugcgccgugaaauuuccuccg

SEQ ID NO: 3775795 - RNA, 16 nt, Salmonella typhimurium LT2
ugcgccgugcuuguuc

SEQ ID NO: 3775796 - RNA, 18 nt, Salmonella typhimurium LT2
ugcgccugugguuuaaaa

SEQ ID NO: 3775797 - RNA, 21 nt, Salmonella typhimurium LT2
ugcgccuguuagggcgcggcu

SEQ ID NO: 3775798 - RNA, 22 nt, Salmonella typhimurium LT2
ugcgccuguuagggcgcggcug

SEQ ID NO: 3775799 - RNA, 17 nt, Salmonella typhimurium LT2
ugcgccuuacccggccu

SEQ ID NO: 3775800 - RNA, 12 nt, Salmonella typhimurium LT2
ugcgccuuccag

SEQ ID NO: 3775801 - RNA, 21 nt, Salmonella typhimurium LT2
ugcgccuucugcugcgggaaa

SEQ ID NO: 3775802 - RNA, 22 nt, Salmonella typhimurium LT2
ugcgccuugacgauaugcugcc

SEQ ID NO: 3775803 - RNA, 15 nt, Salmonella typhimurium LT2
ugcgcgaccacgcca

SEQ ID NO: 3775804 - RNA, 18 nt, Salmonella typhimurium LT2
ugcgcgaccacgccagcc

SEQ ID NO: 3775805 - RNA, 22 nt, Salmonella typhimurium LT2
ugcgcgaccacgccagccagcc

SEQ ID NO: 3775806 - RNA, 22 nt, Salmonella typhimurium LT2
ugcgcgaccgcaucaaugccca

SEQ ID NO: 3775807 - RNA, 19 nt, Salmonella typhimurium LT2
ugcgcgacgcccaccaguc

SEQ ID NO: 3775808 - RNA, 18 nt, Salmonella typhimurium LT2
ugcgcgacugcgcgcggu

SEQ ID NO: 3775809 - RNA, 22 nt, Salmonella typhimurium LT2
ugcgcgaucucuuuggccagua

SEQ ID NO: 3775810 - RNA, 16 nt, Salmonella typhimurium LT2
ugcgcgcaucgggccg

SEQ ID NO: 3775811 - RNA, 23 nt, Salmonella typhimurium LT2
ugcgcgccauacuuacugcuguc

SEQ ID NO: 3775812 - RNA, 17 nt, Salmonella typhimurium LT2
ugcgcgcgagugauccc

SEQ ID NO: 3775813 - RNA, 22 nt, Salmonella typhimurium LT2
ugcgcgcgugaccccaggcaua

SEQ ID NO: 3775814 - RNA, 21 nt, Salmonella typhimurium LT2
ugcgcggauugagcgaaucca

SEQ ID NO: 3775815 - RNA, 14 nt, Salmonella typhimurium LT2
ugcgcggcaucagc

SEQ ID NO: 3775816 - RNA, 22 nt, Salmonella typhimurium LT2
ugcgcggcgacgcgaggcuuuu

SEQ ID NO: 3775817 - RNA, 17 nt, Salmonella typhimurium LT2
ugcgcgguccacaggcc

SEQ ID NO: 3775818 - RNA, 22 nt, Salmonella typhimurium LT2
ugcgcguaaacgcaacaccauc

SEQ ID NO: 3775819 - RNA, 20 nt, Salmonella typhimurium LT2
ugcgcguagcccacagguag

SEQ ID NO: 3775820 - RNA, 14 nt, Salmonella typhimurium LT2
ugcgcgucccucuc

SEQ ID NO: 3775821 - RNA, 21 nt, Salmonella typhimurium LT2
ugcgcgucccucuccagggca

SEQ ID NO: 3775822 - RNA, 18 nt, Salmonella typhimurium LT2
ugcgcguuuagcgccagc

SEQ ID NO: 3775823 - RNA, 23 nt, Salmonella typhimurium LT2
ugcgcuaagcguuacggaaaaaa

SEQ ID NO: 3775824 - RNA, 21 nt, Salmonella typhimurium LT2
ugcgcuacggcuuccggcguc

SEQ ID NO: 3775825 - RNA, 21 nt, Salmonella typhimurium LT2
ugcgcuacgggcacccgguca

SEQ ID NO: 3775826 - RNA, 15 nt, Salmonella typhimurium LT2
ugcgcuauccgcgcu

SEQ ID NO: 3775827 - RNA, 23 nt, Salmonella typhimurium LT2
ugcgcucacccggcuggaggcgg

SEQ ID NO: 3775828 - RNA, 14 nt, Salmonella typhimurium LT2
ugcgcucaggguca

SEQ ID NO: 3775829 - RNA, 16 nt, Salmonella typhimurium LT2
ugcgcucagggucaga

SEQ ID NO: 3775830 - RNA, 15 nt, Salmonella typhimurium LT2
ugcgcuccugcuccc

SEQ ID NO: 3775831 - RNA, 23 nt, Salmonella typhimurium LT2
ugcgcugaaauagcgcugcggcu

SEQ ID NO: 3775832 - RNA, 19 nt, Salmonella typhimurium LT2
ugcgcuggaacugaucgug

SEQ ID NO: 3775833 - RNA, 18 nt, Salmonella typhimurium LT2
ugcgcugguuggcgcgcu

SEQ ID NO: 3775834 - RNA, 14 nt, Salmonella typhimurium LT2
ugcgcugucaccag

SEQ ID NO: 3775835 - RNA, 20 nt, Salmonella typhimurium LT2
ugcgcugucaccagcagcau

SEQ ID NO: 3775836 - RNA, 13 nt, Salmonella typhimurium LT2
ugcgcugucagca

SEQ ID NO: 3775837 - RNA, 20 nt, Salmonella typhimurium LT2
ugcgcuuaccgggccgacag

SEQ ID NO: 3775838 - RNA, 19 nt, Salmonella typhimurium LT2
ugcgcuuaccgggccuaca

SEQ ID NO: 3775839 - RNA, 20 nt, Salmonella typhimurium LT2
ugcgcuuaucaggccuacgc

SEQ ID NO: 3775840 - RNA, 20 nt, Salmonella typhimurium LT2
ugcgcuuaucaggccuacgg

SEQ ID NO: 3775841 - RNA, 19 nt, Salmonella typhimurium LT2
ugcgcuuaucaggccugua

SEQ ID NO: 3775842 - RNA, 19 nt, Salmonella typhimurium LT2
ugcgcuuauccggccuaca

SEQ ID NO: 3775843 - RNA, 21 nt, Salmonella typhimurium LT2
ugcgcuuaucgggcagacugu

SEQ ID NO: 3775844 - RNA, 17 nt, Salmonella typhimurium LT2
ugcgcuucgaugcguuc

SEQ ID NO: 3775845 - RNA, 18 nt, Salmonella typhimurium LT2
ugcgcuucgaugcguuca

SEQ ID NO: 3775846 - RNA, 19 nt, Salmonella typhimurium LT2
ugcucagcuuguagaaagg

SEQ ID NO: 3775847 - RNA, 21 nt, Salmonella typhimurium LT2
ugcucagggcauccgccgccg

SEQ ID NO: 3775848 - RNA, 14 nt, Salmonella typhimurium LT2
ugcucauaacccuc

SEQ ID NO: 3775849 - RNA, 19 nt, Salmonella typhimurium LT2
ugcucauaacccuccugcc

SEQ ID NO: 3775850 - RNA, 19 nt, Salmonella typhimurium LT2
ugcucauaagacgcauuaa

SEQ ID NO: 3775851 - RNA, 20 nt, Salmonella typhimurium LT2
ugcucauaagacgcauuaac

SEQ ID NO: 3775852 - RNA, 13 nt, Salmonella typhimurium LT2
ugcuccagcgccu

SEQ ID NO: 3775853 - RNA, 17 nt, Salmonella typhimurium LT2
ugcuccagcgccugcug

SEQ ID NO: 3775854 - RNA, 20 nt, Salmonella typhimurium LT2
ugcuccaguuguuccagcag

SEQ ID NO: 3775855 - RNA, 16 nt, Salmonella typhimurium LT2
ugcuccaucaucgcca

SEQ ID NO: 3775856 - RNA, 20 nt, Salmonella typhimurium LT2
ugcuccaucaucgccagcuu

SEQ ID NO: 3775857 - RNA, 12 nt, Salmonella typhimurium LT2
ugcuccaugauc

SEQ ID NO: 3775858 - RNA, 17 nt, Salmonella typhimurium LT2
ugcucccuuaaaaggga

SEQ ID NO: 3775859 - RNA, 13 nt, Salmonella typhimurium LT2
ugcuccggcuuaa

SEQ ID NO: 3775860 - RNA, 23 nt, Salmonella typhimurium LT2
ugcuccggcuuaaugcccggccc

SEQ ID NO: 3775861 - RNA, 13 nt, Salmonella typhimurium LT2
ugcuccgggccgu

SEQ ID NO: 3775862 - RNA, 15 nt, Salmonella typhimurium LT2
ugcuccgguuugagc

SEQ ID NO: 3775863 - RNA, 20 nt, Salmonella typhimurium LT2
ugcuccguaucgugcugcug

SEQ ID NO: 3775864 - RNA, 13 nt, Salmonella typhimurium LT2
ugcuccguccugu

SEQ ID NO: 3775865 - RNA, 21 nt, Salmonella typhimurium LT2
ugcucgauaccuuccgggccg

SEQ ID NO: 3775866 - RNA, 15 nt, Salmonella typhimurium LT2
ugcucgcccuguugc

SEQ ID NO: 3775867 - RNA, 22 nt, Salmonella typhimurium LT2
ugcucgguaucguagaugucca

SEQ ID NO: 3775868 - RNA, 22 nt, Salmonella typhimurium LT2
ugcucguaccaggccccugcca

SEQ ID NO: 3775869 - RNA, 23 nt, Salmonella typhimurium LT2
ugcucgucggcggaaaagcgccc

SEQ ID NO: 3775870 - RNA, 18 nt, Salmonella typhimurium LT2
ugcucguuuuuauacaaa

SEQ ID NO: 3775871 - RNA, 20 nt, Salmonella typhimurium LT2
ugcucuaaccaacugagcua

SEQ ID NO: 3775872 - RNA, 17 nt, Salmonella typhimurium LT2
ugcucuaccaacugagc

SEQ ID NO: 3775873 - RNA, 19 nt, Salmonella typhimurium LT2
ugcucuaccaacugagcua

SEQ ID NO: 3775874 - RNA, 19 nt, Salmonella typhimurium LT2
ugcucuacucaguaagcgc

SEQ ID NO: 3775875 - RNA, 17 nt, Salmonella typhimurium LT2
ugcucucccagcugagc

SEQ ID NO: 3775876 - RNA, 19 nt, Salmonella typhimurium LT2
ugcucucccagcugagcua

SEQ ID NO: 3775877 - RNA, 17 nt, Salmonella typhimurium LT2
ugcucuggcuuguucau

SEQ ID NO: 3775878 - RNA, 15 nt, Salmonella typhimurium LT2
ugcucuugcggcugc

SEQ ID NO: 3775879 - RNA, 21 nt, Salmonella typhimurium LT2
ugcugaacacaaugaauccuc

SEQ ID NO: 3775880 - RNA, 20 nt, Salmonella typhimurium LT2
ugcugaagcagauacugcgc

SEQ ID NO: 3775881 - RNA, 17 nt, Salmonella typhimurium LT2
ugcugaauagccagccc

SEQ ID NO: 3775882 - RNA, 16 nt, Salmonella typhimurium LT2
ugcugacaaucugcug

SEQ ID NO: 3775883 - RNA, 23 nt, Salmonella typhimurium LT2
ugcugacauuccuuuuaauuuuc

SEQ ID NO: 3775884 - RNA, 15 nt, Salmonella typhimurium LT2
ugcugaccuuaaucc

SEQ ID NO: 3775885 - RNA, 17 nt, Salmonella typhimurium LT2
ugcugaccuuaauccag

SEQ ID NO: 3775886 - RNA, 16 nt, Salmonella typhimurium LT2
ugcugacucgcgcaau

SEQ ID NO: 3775887 - RNA, 22 nt, Salmonella typhimurium LT2
ugcugauaacuaauggcauuuc

SEQ ID NO: 3775888 - RNA, 15 nt, Salmonella typhimurium LT2
ugcugauaauacugc

SEQ ID NO: 3775889 - RNA, 19 nt, Salmonella typhimurium LT2
ugcugaucuggcugcguaa

SEQ ID NO: 3775890 - RNA, 14 nt, Salmonella typhimurium LT2
ugcugcaaauauuc

SEQ ID NO: 3775891 - RNA, 12 nt, Salmonella typhimurium LT2
ugcugcaccaau

SEQ ID NO: 3775892 - RNA, 18 nt, Salmonella typhimurium LT2
ugcugcaccaaucaucac

SEQ ID NO: 3775893 - RNA, 16 nt, Salmonella typhimurium LT2
ugcugccacgucacgc

SEQ ID NO: 3775894 - RNA, 13 nt, Salmonella typhimurium LT2
ugcugccagcaug

SEQ ID NO: 3775895 - RNA, 20 nt, Salmonella typhimurium LT2
ugcugccgauuggucaauaa

SEQ ID NO: 3775896 - RNA, 15 nt, Salmonella typhimurium LT2
ugcugccggaaaacg

SEQ ID NO: 3775897 - RNA, 14 nt, Salmonella typhimurium LT2
ugcugccucaucaa

SEQ ID NO: 3775898 - RNA, 14 nt, Salmonella typhimurium LT2
ugcugcgacggucg

SEQ ID NO: 3775899 - RNA, 20 nt, Salmonella typhimurium LT2
ugcugcgcggccagaaccug

SEQ ID NO: 3775900 - RNA, 14 nt, Salmonella typhimurium LT2
ugcugcgcuuucca

SEQ ID NO: 3775901 - RNA, 20 nt, Salmonella typhimurium LT2
ugcugcgcuuuccaggccag

SEQ ID NO: 3775902 - RNA, 14 nt, Salmonella typhimurium LT2
ugcugcguuucauu

SEQ ID NO: 3775903 - RNA, 15 nt, Salmonella typhimurium LT2
ugcugcucccucacg

SEQ ID NO: 3775904 - RNA, 19 nt, Salmonella typhimurium LT2
ugcugcucuugcggcugca

SEQ ID NO: 3775905 - RNA, 17 nt, Salmonella typhimurium LT2
ugcugcuguuaccggac

SEQ ID NO: 3775906 - RNA, 21 nt, Salmonella typhimurium LT2
ugcugcuucaguaaaucccgc

SEQ ID NO: 3775907 - RNA, 23 nt, Salmonella typhimurium LT2
ugcuggacaggagcggaagaggc

SEQ ID NO: 3775908 - RNA, 13 nt, Salmonella typhimurium LT2
ugcuggcaggcca

SEQ ID NO: 3775909 - RNA, 18 nt, Salmonella typhimurium LT2
ugcuggccuguucaagug

SEQ ID NO: 3775910 - RNA, 19 nt, Salmonella typhimurium LT2
ugcuggcgaaccaccagcc

SEQ ID NO: 3775911 - RNA, 20 nt, Salmonella typhimurium LT2
ugcuggcgcgucacaacagc

SEQ ID NO: 3775912 - RNA, 21 nt, Salmonella typhimurium LT2
ugcuggcgcgucacaacagcc

SEQ ID NO: 3775913 - RNA, 19 nt, Salmonella typhimurium LT2
ugcuggcgcuacguuuguc

SEQ ID NO: 3775914 - RNA, 16 nt, Salmonella typhimurium LT2
ugcuggcuuaacucac

SEQ ID NO: 3775915 - RNA, 20 nt, Salmonella typhimurium LT2
ugcugggcgauuucacgaau

SEQ ID NO: 3775916 - RNA, 16 nt, Salmonella typhimurium LT2
ugcuggguacgugcaa

SEQ ID NO: 3775917 - RNA, 19 nt, Salmonella typhimurium LT2
ugcugguguuuuuuucauc

SEQ ID NO: 3775918 - RNA, 12 nt, Salmonella typhimurium LT2
ugcuguaaaccg

SEQ ID NO: 3775919 - RNA, 17 nt, Salmonella typhimurium LT2
ugcuguacauauccagu

SEQ ID NO: 3775920 - RNA, 13 nt, Salmonella typhimurium LT2
ugcuguagcacau

SEQ ID NO: 3775921 - RNA, 19 nt, Salmonella typhimurium LT2
ugcuguagcgucucaucaa

SEQ ID NO: 3775922 - RNA, 21 nt, Salmonella typhimurium LT2
ugcuguccgggcguuucagcu

SEQ ID NO: 3775923 - RNA, 13 nt, Salmonella typhimurium LT2
ugcugucgcccau

SEQ ID NO: 3775924 - RNA, 18 nt, Salmonella typhimurium LT2
ugcugucgguuaacacca

SEQ ID NO: 3775925 - RNA, 16 nt, Salmonella typhimurium LT2
ugcugucuuagugaaa

SEQ ID NO: 3775926 - RNA, 14 nt, Salmonella typhimurium LT2
ugcugugcauaucu

SEQ ID NO: 3775927 - RNA, 20 nt, Salmonella typhimurium LT2
ugcugugccaguaccgccgc

SEQ ID NO: 3775928 - RNA, 13 nt, Salmonella typhimurium LT2
ugcuguuaccgga

SEQ ID NO: 3775929 - RNA, 14 nt, Salmonella typhimurium LT2
ugcuguuaccggac

SEQ ID NO: 3775930 - RNA, 23 nt, Salmonella typhimurium LT2
ugcuguuaccguaagcgggaugg

SEQ ID NO: 3775931 - RNA, 13 nt, Salmonella typhimurium LT2
ugcuuaacuucug

SEQ ID NO: 3775932 - RNA, 17 nt, Salmonella typhimurium LT2
ugcuuaaugcucugcug

SEQ ID NO: 3775933 - RNA, 16 nt, Salmonella typhimurium LT2
ugcuuaccuuguucuu

SEQ ID NO: 3775934 - RNA, 19 nt, Salmonella typhimurium LT2
ugcuuaccuuguucuucca

SEQ ID NO: 3775935 - RNA, 19 nt, Salmonella typhimurium LT2
ugcuuacggcaaacugaaa

SEQ ID NO: 3775936 - RNA, 22 nt, Salmonella typhimurium LT2
ugcuuagcuggccaaucagcgg

SEQ ID NO: 3775937 - RNA, 18 nt, Salmonella typhimurium LT2
ugcuuagcuguuacggau

SEQ ID NO: 3775938 - RNA, 17 nt, Salmonella typhimurium LT2
ugcuuaucaaguaacgu

SEQ ID NO: 3775939 - RNA, 13 nt, Salmonella typhimurium LT2
ugcuuaucacgua

SEQ ID NO: 3775940 - RNA, 18 nt, Salmonella typhimurium LT2
ugcuuaucgauaucugcc

SEQ ID NO: 3775941 - RNA, 18 nt, Salmonella typhimurium LT2
ugcuuauugucgccgccg

SEQ ID NO: 3775942 - RNA, 20 nt, Salmonella typhimurium LT2
ugcuucaccucagcaaaauc

SEQ ID NO: 3775943 - RNA, 20 nt, Salmonella typhimurium LT2
ugcuucagacaacgccgccu

SEQ ID NO: 3775944 - RNA, 17 nt, Salmonella typhimurium LT2
ugcuucauaucgccauu

SEQ ID NO: 3775945 - RNA, 12 nt, Salmonella typhimurium LT2
ugcuuccagcuc

SEQ ID NO: 3775946 - RNA, 13 nt, Salmonella typhimurium LT2
ugcuuccagcucc

SEQ ID NO: 3775947 - RNA, 14 nt, Salmonella typhimurium LT2
ugcuuccagcucca

SEQ ID NO: 3775948 - RNA, 21 nt, Salmonella typhimurium LT2
ugcuuccgaccgcagcgaaga

SEQ ID NO: 3775949 - RNA, 12 nt, Salmonella typhimurium LT2
ugcuuccgccuu

SEQ ID NO: 3775950 - RNA, 12 nt, Salmonella typhimurium LT2
uggcaggccucu

SEQ ID NO: 3775951 - RNA, 22 nt, Salmonella typhimurium LT2
uggcauauuugccccuuccgcc

SEQ ID NO: 3775952 - RNA, 13 nt, Salmonella typhimurium LT2
uggcaucaagcau

SEQ ID NO: 3775953 - RNA, 19 nt, Salmonella typhimurium LT2
uggcaugauggucgccagc

SEQ ID NO: 3775954 - RNA, 15 nt, Salmonella typhimurium LT2
uggcauugugagcga

SEQ ID NO: 3775955 - RNA, 22 nt, Salmonella typhimurium LT2
uggcauuuccggaccguuauca

SEQ ID NO: 3775956 - RNA, 13 nt, Salmonella typhimurium LT2
uggccaaccagau

SEQ ID NO: 3775957 - RNA, 14 nt, Salmonella typhimurium LT2
uggccaaucagcgg

SEQ ID NO: 3775958 - RNA, 21 nt, Salmonella typhimurium LT2
uggccaaucagcggguauugc

SEQ ID NO: 3775959 - RNA, 12 nt, Salmonella typhimurium LT2
uggccaccagcu

SEQ ID NO: 3775960 - RNA, 15 nt, Salmonella typhimurium LT2
uggccaccuuuacgg

SEQ ID NO: 3775961 - RNA, 17 nt, Salmonella typhimurium LT2
uggccagcaugcccgcc

SEQ ID NO: 3775962 - RNA, 17 nt, Salmonella typhimurium LT2
uggccagcuccgcauaa

SEQ ID NO: 3775963 - RNA, 15 nt, Salmonella typhimurium LT2
uggccaggaauaaag

SEQ ID NO: 3775964 - RNA, 17 nt, Salmonella typhimurium LT2
uggccaguuucaaugcc

SEQ ID NO: 3775965 - RNA, 19 nt, Salmonella typhimurium LT2
uggccaucuuccagcauca

SEQ ID NO: 3775966 - RNA, 20 nt, Salmonella typhimurium LT2
uggccaugccuaaaccgaca

SEQ ID NO: 3775967 - RNA, 19 nt, Salmonella typhimurium LT2
uggccauuugcggaauaug

SEQ ID NO: 3775968 - RNA, 17 nt, Salmonella typhimurium LT2
uggcccagcgcgguggc

SEQ ID NO: 3775969 - RNA, 17 nt, Salmonella typhimurium LT2
uggcccagcuaaaccac

SEQ ID NO: 3775970 - RNA, 18 nt, Salmonella typhimurium LT2
uggcccaggcccggguaa

SEQ ID NO: 3775971 - RNA, 19 nt, Salmonella typhimurium LT2
uggcccaguuaacagaaug

SEQ ID NO: 3775972 - RNA, 13 nt, Salmonella typhimurium LT2
uggccccauucac

SEQ ID NO: 3775973 - RNA, 23 nt, Salmonella typhimurium LT2
uggccccggucaacgcgccgcca

SEQ ID NO: 3775974 - RNA, 16 nt, Salmonella typhimurium LT2
uggcccgcacugccga

SEQ ID NO: 3775975 - RNA, 20 nt, Salmonella typhimurium LT2
uggcccugccggaaaaugcg

SEQ ID NO: 3775976 - RNA, 18 nt, Salmonella typhimurium LT2
uggcccuucagacgcauc

SEQ ID NO: 3775977 - RNA, 22 nt, Salmonella typhimurium LT2
uggccgauaugaauaauuucgg

SEQ ID NO: 3775978 - RNA, 14 nt, Salmonella typhimurium LT2
uggccgaugcgccc

SEQ ID NO: 3775979 - RNA, 17 nt, Salmonella typhimurium LT2
uggccggcccgcuucau

SEQ ID NO: 3775980 - RNA, 16 nt, Salmonella typhimurium LT2
uggccuacgugcucac

SEQ ID NO: 3775981 - RNA, 13 nt, Salmonella typhimurium LT2
uggccucaucaug

SEQ ID NO: 3775982 - RNA, 21 nt, Salmonella typhimurium LT2
uggccuguaccgcuucccgcg

SEQ ID NO: 3775983 - RNA, 15 nt, Salmonella typhimurium LT2
uggccuuauaagcug

SEQ ID NO: 3775984 - RNA, 14 nt, Salmonella typhimurium LT2
uggccuucaaucag

SEQ ID NO: 3775985 - RNA, 16 nt, Salmonella typhimurium LT2
uggcgaacucuuccag

SEQ ID NO: 3775986 - RNA, 18 nt, Salmonella typhimurium LT2
uggcgaacucuuccagau

SEQ ID NO: 3775987 - RNA, 18 nt, Salmonella typhimurium LT2
uggcgaagugcagcguuu

SEQ ID NO: 3775988 - RNA, 17 nt, Salmonella typhimurium LT2
uggcgaauaaaauucag

SEQ ID NO: 3775989 - RNA, 21 nt, Salmonella typhimurium LT2
uggcgaauaaaauucagcgca

SEQ ID NO: 3775990 - RNA, 20 nt, Salmonella typhimurium LT2
uggcgaauacuguuccaggc

SEQ ID NO: 3775991 - RNA, 22 nt, Salmonella typhimurium LT2
uggcgaauccuaaacucaacug

SEQ ID NO: 3775992 - RNA, 23 nt, Salmonella typhimurium LT2
uggcgacagacgcuuaucgccgu

SEQ ID NO: 3775993 - RNA, 14 nt, Salmonella typhimurium LT2
uggcgaccgcugca

SEQ ID NO: 3775994 - RNA, 17 nt, Salmonella typhimurium LT2
uggcgaccggcagccgu

SEQ ID NO: 3775995 - RNA, 14 nt, Salmonella typhimurium LT2
uggcgaccgggucg

SEQ ID NO: 3775996 - RNA, 19 nt, Salmonella typhimurium LT2
uggcgacgaucagcgccac

SEQ ID NO: 3775997 - RNA, 18 nt, Salmonella typhimurium LT2
uggcgacggcaucggcau

SEQ ID NO: 3775998 - RNA, 22 nt, Salmonella typhimurium LT2
uggcgagacgacuaccggccau

SEQ ID NO: 3775999 - RNA, 17 nt, Salmonella typhimurium LT2
uggcgagauauaaaacg

SEQ ID NO: 3776000 - RNA, 16 nt, Salmonella typhimurium LT2
uggcgagcagaaaaag

SEQ ID NO: 3776001 - RNA, 18 nt, Salmonella typhimurium LT2
uggcgaggaacaucagcc

SEQ ID NO: 3776002 - RNA, 17 nt, Salmonella typhimurium LT2
uggcgauaauagaaccg

SEQ ID NO: 3776003 - RNA, 16 nt, Salmonella typhimurium LT2
uggcgauauccgugcc

SEQ ID NO: 3776004 - RNA, 17 nt, Salmonella typhimurium LT2
uggcgauauccgugccg

SEQ ID NO: 3776005 - RNA, 23 nt, Salmonella typhimurium LT2
uggcgauauccgugccgccgcga

SEQ ID NO: 3776006 - RNA, 14 nt, Salmonella typhimurium LT2
uggcgaucagcggc

SEQ ID NO: 3776007 - RNA, 19 nt, Salmonella typhimurium LT2
uggcgaucagcggcagcuc

SEQ ID NO: 3776008 - RNA, 18 nt, Salmonella typhimurium LT2
uggcgaugauaaucgucc

SEQ ID NO: 3776009 - RNA, 13 nt, Salmonella typhimurium LT2
uggcgauuuccag

SEQ ID NO: 3776010 - RNA, 20 nt, Salmonella typhimurium LT2
uggcgauuuccagcgaauaa

SEQ ID NO: 3776011 - RNA, 16 nt, Salmonella typhimurium LT2
uggcgauuucggugac

SEQ ID NO: 3776012 - RNA, 21 nt, Salmonella typhimurium LT2
uggcgcagccgcuuuuuaauu

SEQ ID NO: 3776013 - RNA, 12 nt, Salmonella typhimurium LT2
uggcgcagcgcu

SEQ ID NO: 3776014 - RNA, 20 nt, Salmonella typhimurium LT2
uggcgcauccacguaaauag

SEQ ID NO: 3776015 - RNA, 16 nt, Salmonella typhimurium LT2
uggcgccaccagcgau

SEQ ID NO: 3776016 - RNA, 22 nt, Salmonella typhimurium LT2
uggcgccaugcuuuccgggccu

SEQ ID NO: 3776017 - RNA, 18 nt, Salmonella typhimurium LT2
uggcgccugcggcaggca

SEQ ID NO: 3776018 - RNA, 19 nt, Salmonella typhimurium LT2
uggcgccuuucgcgcugca

SEQ ID NO: 3776019 - RNA, 17 nt, Salmonella typhimurium LT2
uggcgccuuuuggcagc

SEQ ID NO: 3776020 - RNA, 18 nt, Salmonella typhimurium LT2
uggcgccuuuuggcagca

SEQ ID NO: 3776021 - RNA, 14 nt, Salmonella typhimurium LT2
uggcgcgaaaacag

SEQ ID NO: 3776022 - RNA, 21 nt, Salmonella typhimurium LT2
uggcgcgacgcuuaucagccc

SEQ ID NO: 3776023 - RNA, 20 nt, Salmonella typhimurium LT2
uggcgcgccugcuccaccag

SEQ ID NO: 3776024 - RNA, 15 nt, Salmonella typhimurium LT2
uggcgcgcgccgccu

SEQ ID NO: 3776025 - RNA, 19 nt, Salmonella typhimurium LT2
uggcgcggaaagccuucau

SEQ ID NO: 3776026 - RNA, 22 nt, Salmonella typhimurium LT2
uggcgcggaaagccuucaucau

SEQ ID NO: 3776027 - RNA, 23 nt, Salmonella typhimurium LT2
uggcgcggaaagccuucaucauc

SEQ ID NO: 3776028 - RNA, 22 nt, Salmonella typhimurium LT2
uggcgcguagguuggcugaggc

SEQ ID NO: 3776029 - RNA, 18 nt, Salmonella typhimurium LT2
uggcgcgucaaucagcgu

SEQ ID NO: 3776030 - RNA, 20 nt, Salmonella typhimurium LT2
uggcgcgucaaucagcgugg

SEQ ID NO: 3776031 - RNA, 17 nt, Salmonella typhimurium LT2
uggcgcgucacaacagc

SEQ ID NO: 3776032 - RNA, 18 nt, Salmonella typhimurium LT2
uggcgcuacgcuuaucag

SEQ ID NO: 3776033 - RNA, 21 nt, Salmonella typhimurium LT2
uggcgcuacgcuuaucaggcc

SEQ ID NO: 3776034 - RNA, 18 nt, Salmonella typhimurium LT2
uggcgcuacgcuuauccg

SEQ ID NO: 3776035 - RNA, 18 nt, Salmonella typhimurium LT2
uggcgcuacgcuuaucgg

SEQ ID NO: 3776036 - RNA, 16 nt, Salmonella typhimurium LT2
uggcgcugcgcuuacc

SEQ ID NO: 3776037 - RNA, 19 nt, Salmonella typhimurium LT2
uggcgcugucgcuuaccgg

SEQ ID NO: 3776038 - RNA, 17 nt, Salmonella typhimurium LT2
uggcgcuugcuuaucgg

SEQ ID NO: 3776039 - RNA, 17 nt, Salmonella typhimurium LT2
uggcgcuuuaagugcau

SEQ ID NO: 3776040 - RNA, 19 nt, Salmonella typhimurium LT2
uggcgcuuuacaugccgcu

SEQ ID NO: 3776041 - RNA, 22 nt, Salmonella typhimurium LT2
uggcgcuuugcuuauccggccu

SEQ ID NO: 3776042 - RNA, 22 nt, Salmonella typhimurium LT2
uggcggaaaauagcgcaacggc

SEQ ID NO: 3776043 - RNA, 15 nt, Salmonella typhimurium LT2
uggcggaauugguag

SEQ ID NO: 3776044 - RNA, 14 nt, Salmonella typhimurium LT2
uggcggagccaaaa

SEQ ID NO: 3776045 - RNA, 12 nt, Salmonella typhimurium LT2
uggcggcaaaaa

SEQ ID NO: 3776046 - RNA, 23 nt, Salmonella typhimurium LT2
uggcggcauaaacgccuuauccg

SEQ ID NO: 3776047 - RNA, 16 nt, Salmonella typhimurium LT2
uggcggcgauacuccg

SEQ ID NO: 3776048 - RNA, 23 nt, Salmonella typhimurium LT2
uggcggcguaaacaccuuauccg

SEQ ID NO: 3776049 - RNA, 17 nt, Salmonella typhimurium LT2
uggcggcgugaacgccu

SEQ ID NO: 3776050 - RNA, 20 nt, Salmonella typhimurium LT2
uggcggcuaccucuuauccg

SEQ ID NO: 3776051 - RNA, 16 nt, Salmonella typhimurium LT2
uggcggcucagggcaa

SEQ ID NO: 3776052 - RNA, 18 nt, Salmonella typhimurium LT2
uggcgguaaauacgcggc

SEQ ID NO: 3776053 - RNA, 20 nt, Salmonella typhimurium LT2
uggucaucgcggccagcaug

SEQ ID NO: 3776054 - RNA, 19 nt, Salmonella typhimurium LT2
uggucgcagcccagcacau

SEQ ID NO: 3776055 - RNA, 13 nt, Salmonella typhimurium LT2
uggucgcgauagc

SEQ ID NO: 3776056 - RNA, 15 nt, Salmonella typhimurium LT2
uggucgcgccgcgcg

SEQ ID NO: 3776057 - RNA, 21 nt, Salmonella typhimurium LT2
uggucgucagccgugagcaga

SEQ ID NO: 3776058 - RNA, 18 nt, Salmonella typhimurium LT2
uggucuggauugcagaga

SEQ ID NO: 3776059 - RNA, 14 nt, Salmonella typhimurium LT2
uggucuucuuucag

SEQ ID NO: 3776060 - RNA, 21 nt, Salmonella typhimurium LT2
uggugaacauggcgcggcgua

SEQ ID NO: 3776061 - RNA, 15 nt, Salmonella typhimurium LT2
uggugacaucgccgg

SEQ ID NO: 3776062 - RNA, 16 nt, Salmonella typhimurium LT2
uggugauauaaacggg

SEQ ID NO: 3776063 - RNA, 17 nt, Salmonella typhimurium LT2
uggugauauaaacgggc

SEQ ID NO: 3776064 - RNA, 17 nt, Salmonella typhimurium LT2
uggugauccagcguagc

SEQ ID NO: 3776065 - RNA, 23 nt, Salmonella typhimurium LT2
uggugaucuggccaauuuuucac

SEQ ID NO: 3776066 - RNA, 16 nt, Salmonella typhimurium LT2
uggugaugaucgcggu

SEQ ID NO: 3776067 - RNA, 19 nt, Salmonella typhimurium LT2
uggugauuaacagcgccau

SEQ ID NO: 3776068 - RNA, 17 nt, Salmonella typhimurium LT2
uggugcagugcacugcc

SEQ ID NO: 3776069 - RNA, 15 nt, Salmonella typhimurium LT2
uggugcguccgguag

SEQ ID NO: 3776070 - RNA, 14 nt, Salmonella typhimurium LT2
uggugcucaaucag

SEQ ID NO: 3776071 - RNA, 16 nt, Salmonella typhimurium LT2
ugguggauauccagca

SEQ ID NO: 3776072 - RNA, 16 nt, Salmonella typhimurium LT2
uggugguugcaucguc

SEQ ID NO: 3776073 - RNA, 16 nt, Salmonella typhimurium LT2
ugguguccccugcagg

SEQ ID NO: 3776074 - RNA, 13 nt, Salmonella typhimurium LT2
ugguguuuuccag

SEQ ID NO: 3776075 - RNA, 20 nt, Salmonella typhimurium LT2
ugguuaaauuaaauaacaaa

SEQ ID NO: 3776076 - RNA, 15 nt, Salmonella typhimurium LT2
ugguuaaugaccugc

SEQ ID NO: 3776077 - RNA, 14 nt, Salmonella typhimurium LT2
ugguuaauucaaaa

SEQ ID NO: 3776078 - RNA, 15 nt, Salmonella typhimurium LT2
ugguuauauuacuga

SEQ ID NO: 3776079 - RNA, 14 nt, Salmonella typhimurium LT2
ugguuauccagcag

SEQ ID NO: 3776080 - RNA, 15 nt, Salmonella typhimurium LT2
ugguuauccagcagc

SEQ ID NO: 3776081 - RNA, 17 nt, Salmonella typhimurium LT2
ugguuauccagcaggua

SEQ ID NO: 3776082 - RNA, 23 nt, Salmonella typhimurium LT2
ugguucaaaaugcccgcauugcg

SEQ ID NO: 3776083 - RNA, 16 nt, Salmonella typhimurium LT2
ugguucgcauaauauc

SEQ ID NO: 3776084 - RNA, 18 nt, Salmonella typhimurium LT2
ugguugaaccgacggugc

SEQ ID NO: 3776085 - RNA, 21 nt, Salmonella typhimurium LT2
ugguugccgcaaaugaccaga

SEQ ID NO: 3776086 - RNA, 20 nt, Salmonella typhimurium LT2
ugguuuaaacucugaaaacg

SEQ ID NO: 3776087 - RNA, 20 nt, Salmonella typhimurium LT2
ugguuucaugcaucauugaa

SEQ ID NO: 3776088 - RNA, 19 nt, Salmonella typhimurium LT2
ugguuucccugaccaguug

SEQ ID NO: 3776089 - RNA, 17 nt, Salmonella typhimurium LT2
ugguuucccugccucaa

SEQ ID NO: 3776090 - RNA, 21 nt, Salmonella typhimurium LT2
ugguuucccugccucaacauc

SEQ ID NO: 3776091 - RNA, 12 nt, Salmonella typhimurium LT2
ugguuugucgau

SEQ ID NO: 3776092 - RNA, 18 nt, Salmonella typhimurium LT2
ugguuuuuaucuuuucuc

SEQ ID NO: 3776093 - RNA, 23 nt, Salmonella typhimurium LT2
ugguuuuuaucuuuucucccggc

SEQ ID NO: 3776094 - RNA, 11 nt, Salmonella typhimurium LT2
uguaaaaaaau

SEQ ID NO: 3776095 - RNA, 21 nt, Salmonella typhimurium LT2
uguaaaaaaauaaaaaaggca

SEQ ID NO: 3776096 - RNA, 12 nt, Salmonella typhimurium LT2
uguaaaaaugcu

SEQ ID NO: 3776097 - RNA, 21 nt, Salmonella typhimurium LT2
uguaaacccgauucugccagu

SEQ ID NO: 3776098 - RNA, 15 nt, Salmonella typhimurium LT2
uguaaagaaugaaaa

SEQ ID NO: 3776099 - RNA, 18 nt, Salmonella typhimurium LT2
uguaaaggugagcucuuu

SEQ ID NO: 3776100 - RNA, 17 nt, Salmonella typhimurium LT2
uguaaauauugaguuca

SEQ ID NO: 3776101 - RNA, 20 nt, Salmonella typhimurium LT2
uguaaauugcuuucuagcau

SEQ ID NO: 3776102 - RNA, 20 nt, Salmonella typhimurium LT2
uguaaauuuguuuaaucaua

SEQ ID NO: 3776103 - RNA, 15 nt, Salmonella typhimurium LT2
uguaacacgccuggc

SEQ ID NO: 3776104 - RNA, 13 nt, Salmonella typhimurium LT2
uguaaccaacaaa

SEQ ID NO: 3776105 - RNA, 19 nt, Salmonella typhimurium LT2
uguaaccuacgccaagcac

SEQ ID NO: 3776106 - RNA, 16 nt, Salmonella typhimurium LT2
uguaaccuuaaaaggc

SEQ ID NO: 3776107 - RNA, 22 nt, Salmonella typhimurium LT2
uguaacgaguugcggcaacgug

SEQ ID NO: 3776108 - RNA, 17 nt, Salmonella typhimurium LT2
uguaagcaauuacggac

SEQ ID NO: 3776109 - RNA, 21 nt, Salmonella typhimurium LT2
uguaaggggcauaaaaaagcc

SEQ ID NO: 3776110 - RNA, 19 nt, Salmonella typhimurium LT2
uguaaguuacuaaaaguaa

SEQ ID NO: 3776111 - RNA, 14 nt, Salmonella typhimurium LT2
uguaaguucauuua

SEQ ID NO: 3776112 - RNA, 16 nt, Salmonella typhimurium LT2
uguaauaauuaacaga

SEQ ID NO: 3776113 - RNA, 12 nt, Salmonella typhimurium LT2
uguaaucgccgu

SEQ ID NO: 3776114 - RNA, 15 nt, Salmonella typhimurium LT2
uguaauggugggaca

SEQ ID NO: 3776115 - RNA, 22 nt, Salmonella typhimurium LT2
uguaauggugggacacugccgg

SEQ ID NO: 3776116 - RNA, 21 nt, Salmonella typhimurium LT2
uguaauucucccaaauuuuuu

SEQ ID NO: 3776117 - RNA, 21 nt, Salmonella typhimurium LT2
uguacaaacacgucuuugcug

SEQ ID NO: 3776118 - RNA, 17 nt, Salmonella typhimurium LT2
uguacauaacaucucac

SEQ ID NO: 3776119 - RNA, 21 nt, Salmonella typhimurium LT2
uguaccaccacgccuuucacg

SEQ ID NO: 3776120 - RNA, 19 nt, Salmonella typhimurium LT2
uguacccucgcgccaguga

SEQ ID NO: 3776121 - RNA, 20 nt, Salmonella typhimurium LT2
uguaccugauccagcucuuc

SEQ ID NO: 3776122 - RNA, 13 nt, Salmonella typhimurium LT2
uguacgcccagcc

SEQ ID NO: 3776123 - RNA, 16 nt, Salmonella typhimurium LT2
uguacgcuggcucuug

SEQ ID NO: 3776124 - RNA, 12 nt, Salmonella typhimurium LT2
uguacggcguca

SEQ ID NO: 3776125 - RNA, 22 nt, Salmonella typhimurium LT2
uguacggcgucagccacgguuc

SEQ ID NO: 3776126 - RNA, 17 nt, Salmonella typhimurium LT2
uguacggcguuucgagu

SEQ ID NO: 3776127 - RNA, 15 nt, Salmonella typhimurium LT2
uguacguauuuacaa

SEQ ID NO: 3776128 - RNA, 15 nt, Salmonella typhimurium LT2
uguacuccugguagg

SEQ ID NO: 3776129 - RNA, 19 nt, Salmonella typhimurium LT2
uguacucugauccuacccg

SEQ ID NO: 3776130 - RNA, 21 nt, Salmonella typhimurium LT2
uguagaaaagaaggggcuggc

SEQ ID NO: 3776131 - RNA, 21 nt, Salmonella typhimurium LT2
uguagaaauucugcaggccaa

SEQ ID NO: 3776132 - RNA, 20 nt, Salmonella typhimurium LT2
uguagagcggauaagcgcag

SEQ ID NO: 3776133 - RNA, 14 nt, Salmonella typhimurium LT2
uguagaugaacucg

SEQ ID NO: 3776134 - RNA, 16 nt, Salmonella typhimurium LT2
uguagcaacagacuau

SEQ ID NO: 3776135 - RNA, 17 nt, Salmonella typhimurium LT2
uguagcgagccaucggc

SEQ ID NO: 3776136 - RNA, 13 nt, Salmonella typhimurium LT2
uguagcgcuuugg

SEQ ID NO: 3776137 - RNA, 19 nt, Salmonella typhimurium LT2
uguagcgcuuuuuccagcg

SEQ ID NO: 3776138 - RNA, 21 nt, Salmonella typhimurium LT2
uguagcgcuuuuuccagcgca

SEQ ID NO: 3776139 - RNA, 18 nt, Salmonella typhimurium LT2
uguagcucauaacucgcu

SEQ ID NO: 3776140 - RNA, 16 nt, Salmonella typhimurium LT2
uguaggcacuuuccag

SEQ ID NO: 3776141 - RNA, 21 nt, Salmonella typhimurium LT2
uguaggccgaauaagcgacag

SEQ ID NO: 3776142 - RNA, 20 nt, Salmonella typhimurium LT2
uguaggccggauaagcguaa

SEQ ID NO: 3776143 - RNA, 20 nt, Salmonella typhimurium LT2
uguaggccggauaagcguua

SEQ ID NO: 3776144 - RNA, 21 nt, Salmonella typhimurium LT2
uguaggccggauaaggcgcag

SEQ ID NO: 3776145 - RNA, 20 nt, Salmonella typhimurium LT2
uguaggccggguaagcgcaa

SEQ ID NO: 3776146 - RNA, 16 nt, Salmonella typhimurium LT2
uguaggccuaaaaaua

SEQ ID NO: 3776147 - RNA, 21 nt, Salmonella typhimurium LT2
uguaggccugauaagcgcagc

SEQ ID NO: 3776148 - RNA, 19 nt, Salmonella typhimurium LT2
uguaggccugauaagcgua

SEQ ID NO: 3776149 - RNA, 21 nt, Salmonella typhimurium LT2
uguaggccugauaagcguagc

SEQ ID NO: 3776150 - RNA, 20 nt, Salmonella typhimurium LT2
uguaggccugguaagcgcag

SEQ ID NO: 3776151 - RNA, 18 nt, Salmonella typhimurium LT2
uguaguuagcgcccauaa

SEQ ID NO: 3776152 - RNA, 13 nt, Salmonella typhimurium LT2
uguaguuaucgcc

SEQ ID NO: 3776153 - RNA, 15 nt, Salmonella typhimurium LT2
uguauaaacucagca

SEQ ID NO: 3776154 - RNA, 15 nt, Salmonella typhimurium LT2
uguauaaauaaaauu

SEQ ID NO: 3776155 - RNA, 12 nt, Salmonella typhimurium LT2
uguauaauuauu

SEQ ID NO: 3776156 - RNA, 16 nt, Salmonella typhimurium LT2
uguaucacguuuuuua

SEQ ID NO: 3776157 - RNA, 22 nt, Salmonella typhimurium LT2
ugugcggcgugcagaucaagcg

SEQ ID NO: 3776158 - RNA, 15 nt, Salmonella typhimurium LT2
ugugcguaucgccca

SEQ ID NO: 3776159 - RNA, 19 nt, Salmonella typhimurium LT2
ugugcguauucagcgcagu

SEQ ID NO: 3776160 - RNA, 15 nt, Salmonella typhimurium LT2
ugugcucaccgguaa

SEQ ID NO: 3776161 - RNA, 13 nt, Salmonella typhimurium LT2
ugugcuccaucag

SEQ ID NO: 3776162 - RNA, 22 nt, Salmonella typhimurium LT2
ugugcuccuggcgcagccgcuc

SEQ ID NO: 3776163 - RNA, 12 nt, Salmonella typhimurium LT2
ugugcuuccagc

SEQ ID NO: 3776164 - RNA, 15 nt, Salmonella typhimurium LT2
ugugcuuccagcucc

SEQ ID NO: 3776165 - RNA, 17 nt, Salmonella typhimurium LT2
ugugcuuccagcuccau

SEQ ID NO: 3776166 - RNA, 18 nt, Salmonella typhimurium LT2
ugugcuuucgccaccagc

SEQ ID NO: 3776167 - RNA, 21 nt, Salmonella typhimurium LT2
ugugcuuuuuauuuuucuggc

SEQ ID NO: 3776168 - RNA, 17 nt, Salmonella typhimurium LT2
uguggaaacuccagcgg

SEQ ID NO: 3776169 - RNA, 22 nt, Salmonella typhimurium LT2
uguggaacuuuaucgcacggcg

SEQ ID NO: 3776170 - RNA, 13 nt, Salmonella typhimurium LT2
uguggccugcuua

SEQ ID NO: 3776171 - RNA, 19 nt, Salmonella typhimurium LT2
uguggccugcuuaaacaga

SEQ ID NO: 3776172 - RNA, 12 nt, Salmonella typhimurium LT2
ugugggccaaaa

SEQ ID NO: 3776173 - RNA, 22 nt, Salmonella typhimurium LT2
ugugggcgacuaucgccgcccc

SEQ ID NO: 3776174 - RNA, 18 nt, Salmonella typhimurium LT2
uguggucgcggcucacca

SEQ ID NO: 3776175 - RNA, 20 nt, Salmonella typhimurium LT2
uguggucgcggcucaccagc

SEQ ID NO: 3776176 - RNA, 15 nt, Salmonella typhimurium LT2
ugugguuaucguaua

SEQ ID NO: 3776177 - RNA, 18 nt, Salmonella typhimurium LT2
ugugguugugguaaucaa

SEQ ID NO: 3776178 - RNA, 13 nt, Salmonella typhimurium LT2
ugugguuuaaaac

SEQ ID NO: 3776179 - RNA, 21 nt, Salmonella typhimurium LT2
uguguacauccaggaggcaaa

SEQ ID NO: 3776180 - RNA, 22 nt, Salmonella typhimurium LT2
uguguaccagcaacgccagcga

SEQ ID NO: 3776181 - RNA, 18 nt, Salmonella typhimurium LT2
uguguacgccaagcugca

SEQ ID NO: 3776182 - RNA, 22 nt, Salmonella typhimurium LT2
uguguagaaauucugcaggcca

SEQ ID NO: 3776183 - RNA, 12 nt, Salmonella typhimurium LT2
uguguauagcuu

SEQ ID NO: 3776184 - RNA, 21 nt, Salmonella typhimurium LT2
uguguaucgcccugccagcuc

SEQ ID NO: 3776185 - RNA, 15 nt, Salmonella typhimurium LT2
ugugucguccgggcc

SEQ ID NO: 3776186 - RNA, 17 nt, Salmonella typhimurium LT2
ugugucuuuuacacuga

SEQ ID NO: 3776187 - RNA, 13 nt, Salmonella typhimurium LT2
uguguuugagcag

SEQ ID NO: 3776188 - RNA, 14 nt, Salmonella typhimurium LT2
uguguuugagcagc

SEQ ID NO: 3776189 - RNA, 15 nt, Salmonella typhimurium LT2
uguguuugagcagcc

SEQ ID NO: 3776190 - RNA, 14 nt, Salmonella typhimurium LT2
uguuaaaaccggcu

SEQ ID NO: 3776191 - RNA, 22 nt, Salmonella typhimurium LT2
uguuaacgcggguuuuuacuuu

SEQ ID NO: 3776192 - RNA, 15 nt, Salmonella typhimurium LT2
uguuaauaagcagaa

SEQ ID NO: 3776193 - RNA, 11 nt, Salmonella typhimurium LT2
uguuaauccag

SEQ ID NO: 3776194 - RNA, 23 nt, Salmonella typhimurium LT2
uguuaauccagagcggauaaaua

SEQ ID NO: 3776195 - RNA, 16 nt, Salmonella typhimurium LT2
uguuaaugguaccaau

SEQ ID NO: 3776196 - RNA, 13 nt, Salmonella typhimurium LT2
uguuaaugucagc

SEQ ID NO: 3776197 - RNA, 21 nt, Salmonella typhimurium LT2
uguuaauuugcaucaggccaa

SEQ ID NO: 3776198 - RNA, 21 nt, Salmonella typhimurium LT2
uguuaccagcaacugaccauc

SEQ ID NO: 3776199 - RNA, 23 nt, Salmonella typhimurium LT2
uguuaccagcaacugaccaucuu

SEQ ID NO: 3776200 - RNA, 12 nt, Salmonella typhimurium LT2
uguuacccagcc

SEQ ID NO: 3776201 - RNA, 18 nt, Salmonella typhimurium LT2
uguuacgcugguuugugu

SEQ ID NO: 3776202 - RNA, 19 nt, Salmonella typhimurium LT2
uguuaguguccuuacggac

SEQ ID NO: 3776203 - RNA, 19 nt, Salmonella typhimurium LT2
uguuaguguucuuacggac

SEQ ID NO: 3776204 - RNA, 18 nt, Salmonella typhimurium LT2
uguuaguuucuauuaaau

SEQ ID NO: 3776205 - RNA, 20 nt, Salmonella typhimurium LT2
uguuauaaccagacgguuua

SEQ ID NO: 3776206 - RNA, 16 nt, Salmonella typhimurium LT2
uguuauccuaaaucug

SEQ ID NO: 3776207 - RNA, 17 nt, Salmonella typhimurium LT2
uguuaucuacaguguaa

SEQ ID NO: 3776208 - RNA, 13 nt, Salmonella typhimurium LT2
uguuaugaaugac

SEQ ID NO: 3776209 - RNA, 17 nt, Salmonella typhimurium LT2
uguucaaaaacauccac

SEQ ID NO: 3776210 - RNA, 22 nt, Salmonella typhimurium LT2
uguucaaauacgguuagccagu

SEQ ID NO: 3776211 - RNA, 16 nt, Salmonella typhimurium LT2
uguucaagcaauaaug

SEQ ID NO: 3776212 - RNA, 15 nt, Salmonella typhimurium LT2
uguucacauccagcc

SEQ ID NO: 3776213 - RNA, 15 nt, Salmonella typhimurium LT2
uguucagcacccaga

SEQ ID NO: 3776214 - RNA, 22 nt, Salmonella typhimurium LT2
uguucagcgcagaagcagacug

SEQ ID NO: 3776215 - RNA, 22 nt, Salmonella typhimurium LT2
uguucaguaagacaaaaaugga

SEQ ID NO: 3776216 - RNA, 14 nt, Salmonella typhimurium LT2
uguucauaaagugc

SEQ ID NO: 3776217 - RNA, 19 nt, Salmonella typhimurium LT2
uguucauaccggauauggc

SEQ ID NO: 3776218 - RNA, 23 nt, Salmonella typhimurium LT2
uguucauaucgaagaccuggccg

SEQ ID NO: 3776219 - RNA, 16 nt, Salmonella typhimurium LT2
uguucaucagguagua

SEQ ID NO: 3776220 - RNA, 21 nt, Salmonella typhimurium LT2
uguuccggcgucgcguucagc

SEQ ID NO: 3776221 - RNA, 16 nt, Salmonella typhimurium LT2
uguuccugcgggaaca

SEQ ID NO: 3776222 - RNA, 20 nt, Salmonella typhimurium LT2
uguucgagggcgauuuugac

SEQ ID NO: 3776223 - RNA, 15 nt, Salmonella typhimurium LT2
uguucgcuucuucua

SEQ ID NO: 3776224 - RNA, 21 nt, Salmonella typhimurium LT2
uguucgcuucuucuaccaccu

SEQ ID NO: 3776225 - RNA, 19 nt, Salmonella typhimurium LT2
uguucguagcccauagcaa

SEQ ID NO: 3776226 - RNA, 18 nt, Salmonella typhimurium LT2
uguucuccucugaaaaau

SEQ ID NO: 3776227 - RNA, 13 nt, Salmonella typhimurium LT2
uguucuuacggac

SEQ ID NO: 3776228 - RNA, 13 nt, Salmonella typhimurium LT2
uguucuucuuuca

SEQ ID NO: 3776229 - RNA, 20 nt, Salmonella typhimurium LT2
uguugaaacaucauuucuac

SEQ ID NO: 3776230 - RNA, 14 nt, Salmonella typhimurium LT2
uguugaccaacaau

SEQ ID NO: 3776231 - RNA, 14 nt, Salmonella typhimurium LT2
uguugaccagguug

SEQ ID NO: 3776232 - RNA, 15 nt, Salmonella typhimurium LT2
uguugacgcuaaccu

SEQ ID NO: 3776233 - RNA, 12 nt, Salmonella typhimurium LT2
uguugacugcgc

SEQ ID NO: 3776234 - RNA, 14 nt, Salmonella typhimurium LT2
uguugacugcgcuc

SEQ ID NO: 3776235 - RNA, 15 nt, Salmonella typhimurium LT2
uguugaggaaauucu

SEQ ID NO: 3776236 - RNA, 13 nt, Salmonella typhimurium LT2
uguugauacagaa

SEQ ID NO: 3776237 - RNA, 23 nt, Salmonella typhimurium LT2
uguugauauggugcgcuuuuggc

SEQ ID NO: 3776238 - RNA, 23 nt, Salmonella typhimurium LT2
uguugaucucauuguauuucuca

SEQ ID NO: 3776239 - RNA, 22 nt, Salmonella typhimurium LT2
uguugcaauaaaauauccucca

SEQ ID NO: 3776240 - RNA, 21 nt, Salmonella typhimurium LT2
uguugcaccuguuucugcugg

SEQ ID NO: 3776241 - RNA, 22 nt, Salmonella typhimurium LT2
uguugcacgcauggcacuggcg

SEQ ID NO: 3776242 - RNA, 19 nt, Salmonella typhimurium LT2
uguugcgcaaucacgcguu

SEQ ID NO: 3776243 - RNA, 21 nt, Salmonella typhimurium LT2
uguugcggaugaccgcaaacc

SEQ ID NO: 3776244 - RNA, 14 nt, Salmonella typhimurium LT2
uguugcuaaaucca

SEQ ID NO: 3776245 - RNA, 12 nt, Salmonella typhimurium LT2
uguugcuccaaa

SEQ ID NO: 3776246 - RNA, 13 nt, Salmonella typhimurium LT2
uguugcuccagca

SEQ ID NO: 3776247 - RNA, 16 nt, Salmonella typhimurium LT2
uguugcuccagcauca

SEQ ID NO: 3776248 - RNA, 21 nt, Salmonella typhimurium LT2
uguuggcaccguucgcauuac

SEQ ID NO: 3776249 - RNA, 19 nt, Salmonella typhimurium LT2
uguugggguugcccggcgc

SEQ ID NO: 3776250 - RNA, 13 nt, Salmonella typhimurium LT2
uguugguuuaaac

SEQ ID NO: 3776251 - RNA, 18 nt, Salmonella typhimurium LT2
uguugucgagguuauaaa

SEQ ID NO: 3776252 - RNA, 21 nt, Salmonella typhimurium LT2
uguugugugccgcgcuggugg

SEQ ID NO: 3776253 - RNA, 21 nt, Salmonella typhimurium LT2
uguuguucgucuuuugaauag

SEQ ID NO: 3776254 - RNA, 15 nt, Salmonella typhimurium LT2
uguuuaaaaucaacg

SEQ ID NO: 3776255 - RNA, 20 nt, Salmonella typhimurium LT2
uguuuaaucaacggguuaaa

SEQ ID NO: 3776256 - RNA, 16 nt, Salmonella typhimurium LT2
uguuuacgccgccauc

SEQ ID NO: 3776257 - RNA, 19 nt, Salmonella typhimurium LT2
uguuuauccccgcuggcgc

SEQ ID NO: 3776258 - RNA, 11 nt, Salmonella typhimurium LT2
uguuucaccaa

SEQ ID NO: 3776259 - RNA, 13 nt, Salmonella typhimurium LT2
uguuuccagugca

SEQ ID NO: 3776260 - RNA, 21 nt, Salmonella typhimurium LT2
uguuuccauacauuuuuguaa

SEQ ID NO: 3776261 - RNA, 15 nt, Salmonella typhimurium LT2
uuagcaugacaauaa

SEQ ID NO: 3776262 - RNA, 19 nt, Salmonella typhimurium LT2
uuagccaggugacuuugcc

SEQ ID NO: 3776263 - RNA, 18 nt, Salmonella typhimurium LT2
uuagcccaggccaauggc

SEQ ID NO: 3776264 - RNA, 14 nt, Salmonella typhimurium LT2
uuagcgaaacugcc

SEQ ID NO: 3776265 - RNA, 20 nt, Salmonella typhimurium LT2
uuagcgauuuaaugucgaca

SEQ ID NO: 3776266 - RNA, 19 nt, Salmonella typhimurium LT2
uuagcgcauuuuuaucaga

SEQ ID NO: 3776267 - RNA, 19 nt, Salmonella typhimurium LT2
uuagcgccuguagcguaau

SEQ ID NO: 3776268 - RNA, 22 nt, Salmonella typhimurium LT2
uuagcgcgaaauaaucagguga

SEQ ID NO: 3776269 - RNA, 23 nt, Salmonella typhimurium LT2
uuagcgcuaauuccuguccauug

SEQ ID NO: 3776270 - RNA, 19 nt, Salmonella typhimurium LT2
uuagcuggcauaaccgcag

SEQ ID NO: 3776271 - RNA, 18 nt, Salmonella typhimurium LT2
uuagcuggccaaucagcg

SEQ ID NO: 3776272 - RNA, 12 nt, Salmonella typhimurium LT2
uuagcuuccagc

SEQ ID NO: 3776273 - RNA, 15 nt, Salmonella typhimurium LT2
uuagcuuucugccag

SEQ ID NO: 3776274 - RNA, 10 nt, Salmonella typhimurium LT2
uuaggcagau

SEQ ID NO: 3776275 - RNA, 20 nt, Salmonella typhimurium LT2
uuagggcguaaauauaacgc

SEQ ID NO: 3776276 - RNA, 17 nt, Salmonella typhimurium LT2
uuagggggcuaccggag

SEQ ID NO: 3776277 - RNA, 20 nt, Salmonella typhimurium LT2
uuagggucagugauaacgcg

SEQ ID NO: 3776278 - RNA, 17 nt, Salmonella typhimurium LT2
uuaguaauaaagcguag

SEQ ID NO: 3776279 - RNA, 20 nt, Salmonella typhimurium LT2
uuaguaccgaacagccaggc

SEQ ID NO: 3776280 - RNA, 22 nt, Salmonella typhimurium LT2
uuaguaccgaacagccaggcuu

SEQ ID NO: 3776281 - RNA, 16 nt, Salmonella typhimurium LT2
uuaguaccgucuggcu

SEQ ID NO: 3776282 - RNA, 12 nt, Salmonella typhimurium LT2
uuagugaaauac

SEQ ID NO: 3776283 - RNA, 12 nt, Salmonella typhimurium LT2
uuagugccgcca

SEQ ID NO: 3776284 - RNA, 11 nt, Salmonella typhimurium LT2
uuaguguccuu

SEQ ID NO: 3776285 - RNA, 18 nt, Salmonella typhimurium LT2
uuaguguucuuacggacg

SEQ ID NO: 3776286 - RNA, 23 nt, Salmonella typhimurium LT2
uuauaaaacuucgauaauaaaau

SEQ ID NO: 3776287 - RNA, 23 nt, Salmonella typhimurium LT2
uuauaaauaagaauccagucagg

SEQ ID NO: 3776288 - RNA, 13 nt, Salmonella typhimurium LT2
uuauaagcgccaa

SEQ ID NO: 3776289 - RNA, 22 nt, Salmonella typhimurium LT2
uuauaaggccugccguccugau

SEQ ID NO: 3776290 - RNA, 20 nt, Salmonella typhimurium LT2
uuauaagguugccugccaga

SEQ ID NO: 3776291 - RNA, 23 nt, Salmonella typhimurium LT2
uuauacauccugugaaguaaaaa

SEQ ID NO: 3776292 - RNA, 22 nt, Salmonella typhimurium LT2
uuauacgccuauuuucugcucg

SEQ ID NO: 3776293 - RNA, 20 nt, Salmonella typhimurium LT2
uuauacggcggcaaugccgc

SEQ ID NO: 3776294 - RNA, 16 nt, Salmonella typhimurium LT2
uuauacuugcugcuau

SEQ ID NO: 3776295 - RNA, 23 nt, Salmonella typhimurium LT2
uuauacuugcugcuaugaaaaau

SEQ ID NO: 3776296 - RNA, 21 nt, Salmonella typhimurium LT2
uuauagacgccggucaugcca

SEQ ID NO: 3776297 - RNA, 20 nt, Salmonella typhimurium LT2
uuauagcaaccccucaucgg

SEQ ID NO: 3776298 - RNA, 17 nt, Salmonella typhimurium LT2
uuauagcuggcuuuaua

SEQ ID NO: 3776299 - RNA, 20 nt, Salmonella typhimurium LT2
uuauagcuggcuuuauauaa

SEQ ID NO: 3776300 - RNA, 19 nt, Salmonella typhimurium LT2
uuauaggugucagauccuu

SEQ ID NO: 3776301 - RNA, 21 nt, Salmonella typhimurium LT2
uuauaggugucagauccuuca

SEQ ID NO: 3776302 - RNA, 13 nt, Salmonella typhimurium LT2
uuauaguccacuu

SEQ ID NO: 3776303 - RNA, 19 nt, Salmonella typhimurium LT2
uuauagucuaauaacacaa

SEQ ID NO: 3776304 - RNA, 13 nt, Salmonella typhimurium LT2
uuauauaagcaua

SEQ ID NO: 3776305 - RNA, 20 nt, Salmonella typhimurium LT2
uuauauauguucaauauuca

SEQ ID NO: 3776306 - RNA, 16 nt, Salmonella typhimurium LT2
uuauauuacugacuau

SEQ ID NO: 3776307 - RNA, 12 nt, Salmonella typhimurium LT2
uuauauuccgca

SEQ ID NO: 3776308 - RNA, 19 nt, Salmonella typhimurium LT2
uuauauuggcuggccugcu

SEQ ID NO: 3776309 - RNA, 17 nt, Salmonella typhimurium LT2
uuaucaaaccaguuuuu

SEQ ID NO: 3776310 - RNA, 20 nt, Salmonella typhimurium LT2
uuaucaaaccaguuuuucau

SEQ ID NO: 3776311 - RNA, 20 nt, Salmonella typhimurium LT2
uuaucaaauuugcccagcac

SEQ ID NO: 3776312 - RNA, 19 nt, Salmonella typhimurium LT2
uuaucaacaaauuccggca

SEQ ID NO: 3776313 - RNA, 16 nt, Salmonella typhimurium LT2
uuaucaagagaaccgu

SEQ ID NO: 3776314 - RNA, 19 nt, Salmonella typhimurium LT2
uuaucaauaaccgccagca

SEQ ID NO: 3776315 - RNA, 18 nt, Salmonella typhimurium LT2
uuaucaaugguuaauuaa

SEQ ID NO: 3776316 - RNA, 24 nt, Salmonella typhimurium LT2
uuaucacccugaauuucaauaauc

SEQ ID NO: 3776317 - RNA, 19 nt, Salmonella typhimurium LT2
uuaucagaugugguauuuu

SEQ ID NO: 3776318 - RNA, 15 nt, Salmonella typhimurium LT2
uuaucagcaauaauu

SEQ ID NO: 3776319 - RNA, 22 nt, Salmonella typhimurium LT2
uuaucaggccaugcgcaagcgc

SEQ ID NO: 3776320 - RNA, 11 nt, Salmonella typhimurium LT2
uuaucaggccu

SEQ ID NO: 3776321 - RNA, 12 nt, Salmonella typhimurium LT2
uuaucaggccua

SEQ ID NO: 3776322 - RNA, 21 nt, Salmonella typhimurium LT2
uuaucaggcgacccauaacgg

SEQ ID NO: 3776323 - RNA, 17 nt, Salmonella typhimurium LT2
uuaucaucguaaaauca

SEQ ID NO: 3776324 - RNA, 14 nt, Salmonella typhimurium LT2
uuaucaugcugacu

SEQ ID NO: 3776325 - RNA, 13 nt, Salmonella typhimurium LT2
uuauccacgccgc

SEQ ID NO: 3776326 - RNA, 16 nt, Salmonella typhimurium LT2
uuauccagacugcuaa

SEQ ID NO: 3776327 - RNA, 11 nt, Salmonella typhimurium LT2
uuauccagcag

SEQ ID NO: 3776328 - RNA, 21 nt, Salmonella typhimurium LT2
uuauccgccagcgcaacgcgc

SEQ ID NO: 3776329 - RNA, 14 nt, Salmonella typhimurium LT2
uuauccggccuaca

SEQ ID NO: 3776330 - RNA, 22 nt, Salmonella typhimurium LT2
uuauccggcuuacggcuauucu

SEQ ID NO: 3776331 - RNA, 22 nt, Salmonella typhimurium LT2
uuauccuccgaacaggcguuug

SEQ ID NO: 3776332 - RNA, 21 nt, Salmonella typhimurium LT2
uuauccucuccugaagccagc

SEQ ID NO: 3776333 - RNA, 13 nt, Salmonella typhimurium LT2
uuauccugcaaau

SEQ ID NO: 3776334 - RNA, 18 nt, Salmonella typhimurium LT2
uuauccugcaaauagcgc

SEQ ID NO: 3776335 - RNA, 20 nt, Salmonella typhimurium LT2
uuauccuggguuugaccgcc

SEQ ID NO: 3776336 - RNA, 20 nt, Salmonella typhimurium LT2
uuaucgcccggauaacggcg

SEQ ID NO: 3776337 - RNA, 17 nt, Salmonella typhimurium LT2
uuaucgcccguaccgcg

SEQ ID NO: 3776338 - RNA, 13 nt, Salmonella typhimurium LT2
uuaucgccugggg

SEQ ID NO: 3776339 - RNA, 20 nt, Salmonella typhimurium LT2
uuaucggauuucguaccgaa

SEQ ID NO: 3776340 - RNA, 23 nt, Salmonella typhimurium LT2
uuaucggcgucgcggcaauagcg

SEQ ID NO: 3776341 - RNA, 14 nt, Salmonella typhimurium LT2
uuaucgggccuaca

SEQ ID NO: 3776342 - RNA, 13 nt, Salmonella typhimurium LT2
uuaucguccggca

SEQ ID NO: 3776343 - RNA, 14 nt, Salmonella typhimurium LT2
uuaucguccgucag

SEQ ID NO: 3776344 - RNA, 18 nt, Salmonella typhimurium LT2
uuaucguccgucagaucc

SEQ ID NO: 3776345 - RNA, 18 nt, Salmonella typhimurium LT2
uuaucuccauauccagca

SEQ ID NO: 3776346 - RNA, 12 nt, Salmonella typhimurium LT2
uuaucuguugau

SEQ ID NO: 3776347 - RNA, 11 nt, Salmonella typhimurium LT2
uuaucuuccac

SEQ ID NO: 3776348 - RNA, 20 nt, Salmonella typhimurium LT2
uuaucuuccacgguaaaaca

SEQ ID NO: 3776349 - RNA, 13 nt, Salmonella typhimurium LT2
uuaucuuccggca

SEQ ID NO: 3776350 - RNA, 16 nt, Salmonella typhimurium LT2
uuaucuugacaugaaa

SEQ ID NO: 3776351 - RNA, 16 nt, Salmonella typhimurium LT2
uuaugaauaaccaucg

SEQ ID NO: 3776352 - RNA, 17 nt, Salmonella typhimurium LT2
uuaugacgggaaacagu

SEQ ID NO: 3776353 - RNA, 23 nt, Salmonella typhimurium LT2
uuaugagaaaaguuggcauaaug

SEQ ID NO: 3776354 - RNA, 19 nt, Salmonella typhimurium LT2
uuaugcacaaccagcggca

SEQ ID NO: 3776355 - RNA, 21 nt, Salmonella typhimurium LT2
uuaugcacgccgggaauaauu

SEQ ID NO: 3776356 - RNA, 15 nt, Salmonella typhimurium LT2
uuaugcagucauucu

SEQ ID NO: 3776357 - RNA, 13 nt, Salmonella typhimurium LT2
uuaugcaguuccg

SEQ ID NO: 3776358 - RNA, 21 nt, Salmonella typhimurium LT2
uuaugccuuuuucaacagcac

SEQ ID NO: 3776359 - RNA, 21 nt, Salmonella typhimurium LT2
uuaugcgucaaaguugcauca

SEQ ID NO: 3776360 - RNA, 19 nt, Salmonella typhimurium LT2
uuaugcguuuaauugaauu

SEQ ID NO: 3776361 - RNA, 17 nt, Salmonella typhimurium LT2
uuauguaccgucaucgc

SEQ ID NO: 3776362 - RNA, 19 nt, Salmonella typhimurium LT2
uuauguaccgucaucgccc

SEQ ID NO: 3776363 - RNA, 13 nt, Salmonella typhimurium LT2
uuauguauuuaau

SEQ ID NO: 3776364 - RNA, 23 nt, Salmonella typhimurium LT2
uuauuaaaacucuccaugccauc

SEQ ID NO: 3776365 - RNA, 14 nt, Salmonella typhimurium LT2
uuccacgguaaaac

SEQ ID NO: 3776366 - RNA, 17 nt, Salmonella typhimurium LT2
uuccacucuucgggaau

SEQ ID NO: 3776367 - RNA, 20 nt, Salmonella typhimurium LT2
uuccacugcggcauuacgcg

SEQ ID NO: 3776368 - RNA, 18 nt, Salmonella typhimurium LT2
uuccagaaauaaaauacg

SEQ ID NO: 3776369 - RNA, 20 nt, Salmonella typhimurium LT2
uuccagagcgaacggauaaa

SEQ ID NO: 3776370 - RNA, 14 nt, Salmonella typhimurium LT2
uuccagcauuuccu

SEQ ID NO: 3776371 - RNA, 16 nt, Salmonella typhimurium LT2
uuccagcauuucuuca

SEQ ID NO: 3776372 - RNA, 14 nt, Salmonella typhimurium LT2
uuccagcgccauaa

SEQ ID NO: 3776373 - RNA, 18 nt, Salmonella typhimurium LT2
uuccagcgcguccagccc

SEQ ID NO: 3776374 - RNA, 16 nt, Salmonella typhimurium LT2
uuccagcggcaggccg

SEQ ID NO: 3776375 - RNA, 20 nt, Salmonella typhimurium LT2
uuccagcuguaccaucaccu

SEQ ID NO: 3776376 - RNA, 18 nt, Salmonella typhimurium LT2
uuccagggcuuccagaau

SEQ ID NO: 3776377 - RNA, 20 nt, Salmonella typhimurium LT2
uuccaguagucgcgccauuc

SEQ ID NO: 3776378 - RNA, 19 nt, Salmonella typhimurium LT2
uuccauaacccggcugagc

SEQ ID NO: 3776379 - RNA, 12 nt, Salmonella typhimurium LT2
uuccaucaaaag

SEQ ID NO: 3776380 - RNA, 13 nt, Salmonella typhimurium LT2
uuccaucaaaagc

SEQ ID NO: 3776381 - RNA, 15 nt, Salmonella typhimurium LT2
uuccaucaauaaucc

SEQ ID NO: 3776382 - RNA, 19 nt, Salmonella typhimurium LT2
uuccauggcaaaauucgua

SEQ ID NO: 3776383 - RNA, 17 nt, Salmonella typhimurium LT2
uuccauuagcuguuguu

SEQ ID NO: 3776384 - RNA, 16 nt, Salmonella typhimurium LT2
uuccauuaugaugagu

SEQ ID NO: 3776385 - RNA, 12 nt, Salmonella typhimurium LT2
uuccauugcugc

SEQ ID NO: 3776386 - RNA, 11 nt, Salmonella typhimurium LT2
uuccauuuuua

SEQ ID NO: 3776387 - RNA, 21 nt, Salmonella typhimurium LT2
uuccauuuuucgaucuucucc

SEQ ID NO: 3776388 - RNA, 14 nt, Salmonella typhimurium LT2
uucccaaaaggaag

SEQ ID NO: 3776389 - RNA, 19 nt, Salmonella typhimurium LT2
uucccaacaaugccacgcc

SEQ ID NO: 3776390 - RNA, 15 nt, Salmonella typhimurium LT2
uucccaacuguauuu

SEQ ID NO: 3776391 - RNA, 23 nt, Salmonella typhimurium LT2
uucccacaguuaacgccaacgcc

SEQ ID NO: 3776392 - RNA, 16 nt, Salmonella typhimurium LT2
uucccacuccgcccag

SEQ ID NO: 3776393 - RNA, 14 nt, Salmonella typhimurium LT2
uucccacugcgccg

SEQ ID NO: 3776394 - RNA, 13 nt, Salmonella typhimurium LT2
uucccacuuugcg

SEQ ID NO: 3776395 - RNA, 17 nt, Salmonella typhimurium LT2
uucccagcgggaacauc

SEQ ID NO: 3776396 - RNA, 18 nt, Salmonella typhimurium LT2
uucccagcgggaacauca

SEQ ID NO: 3776397 - RNA, 22 nt, Salmonella typhimurium LT2
uucccagugcgcggucauaucu

SEQ ID NO: 3776398 - RNA, 20 nt, Salmonella typhimurium LT2
uucccaucgcuuugcagaaa

SEQ ID NO: 3776399 - RNA, 17 nt, Salmonella typhimurium LT2
uucccauugagcagccg

SEQ ID NO: 3776400 - RNA, 19 nt, Salmonella typhimurium LT2
uucccauugggccagcagc

SEQ ID NO: 3776401 - RNA, 13 nt, Salmonella typhimurium LT2
uuccccacgccau

SEQ ID NO: 3776402 - RNA, 15 nt, Salmonella typhimurium LT2
uucccccaaaaugcc

SEQ ID NO: 3776403 - RNA, 20 nt, Salmonella typhimurium LT2
uucccccacuucugacagaa

SEQ ID NO: 3776404 - RNA, 18 nt, Salmonella typhimurium LT2
uucccccagccacgcgug

SEQ ID NO: 3776405 - RNA, 16 nt, Salmonella typhimurium LT2
uuccccggccagcgcg

SEQ ID NO: 3776406 - RNA, 22 nt, Salmonella typhimurium LT2
uuccccuguaacugcaccuuuu

SEQ ID NO: 3776407 - RNA, 21 nt, Salmonella typhimurium LT2
uucccgacuuuacaccccacu

SEQ ID NO: 3776408 - RNA, 21 nt, Salmonella typhimurium LT2
uucccgcaaacuggccacagc

SEQ ID NO: 3776409 - RNA, 17 nt, Salmonella typhimurium LT2
uucccgcgccagcgucg

SEQ ID NO: 3776410 - RNA, 15 nt, Salmonella typhimurium LT2
uucccggaucgcuaa

SEQ ID NO: 3776411 - RNA, 20 nt, Salmonella typhimurium LT2
uucccgguaaaucauauuga

SEQ ID NO: 3776412 - RNA, 15 nt, Salmonella typhimurium LT2
uucccucauauuugu

SEQ ID NO: 3776413 - RNA, 11 nt, Salmonella typhimurium LT2
uucccuggccg

SEQ ID NO: 3776414 - RNA, 23 nt, Salmonella typhimurium LT2
uuccgcaaagcccaucagcgcca

SEQ ID NO: 3776415 - RNA, 15 nt, Salmonella typhimurium LT2
uuccgcacauaauca

SEQ ID NO: 3776416 - RNA, 12 nt, Salmonella typhimurium LT2
uuccgcacgcgc

SEQ ID NO: 3776417 - RNA, 18 nt, Salmonella typhimurium LT2
uuccgcacgcgcgcccau

SEQ ID NO: 3776418 - RNA, 14 nt, Salmonella typhimurium LT2
uuccgccaccacgc

SEQ ID NO: 3776419 - RNA, 14 nt, Salmonella typhimurium LT2
uuccgccagacuca

SEQ ID NO: 3776420 - RNA, 19 nt, Salmonella typhimurium LT2
uuccgccaugaaaaaaacg

SEQ ID NO: 3776421 - RNA, 17 nt, Salmonella typhimurium LT2
uuccgccugccgcgccg

SEQ ID NO: 3776422 - RNA, 14 nt, Salmonella typhimurium LT2
uuccgcgcaaauac

SEQ ID NO: 3776423 - RNA, 17 nt, Salmonella typhimurium LT2
uuccgcguuaucaagag

SEQ ID NO: 3776424 - RNA, 22 nt, Salmonella typhimurium LT2
uuccgcuaucucuuccagcguc

SEQ ID NO: 3776425 - RNA, 15 nt, Salmonella typhimurium LT2
uuccgcuggaauaaa

SEQ ID NO: 3776426 - RNA, 17 nt, Salmonella typhimurium LT2
uuccgcugucgccccuu

SEQ ID NO: 3776427 - RNA, 22 nt, Salmonella typhimurium LT2
uuccggaaugagaugcacgcag

SEQ ID NO: 3776428 - RNA, 20 nt, Salmonella typhimurium LT2
uuccggaguaaugaaaccga

SEQ ID NO: 3776429 - RNA, 22 nt, Salmonella typhimurium LT2
uuccggaucgccgaagcggcag

SEQ ID NO: 3776430 - RNA, 14 nt, Salmonella typhimurium LT2
uuccggcaucacau

SEQ ID NO: 3776431 - RNA, 16 nt, Salmonella typhimurium LT2
uuccggcgaaaaacca

SEQ ID NO: 3776432 - RNA, 12 nt, Salmonella typhimurium LT2
uuccggcggcag

SEQ ID NO: 3776433 - RNA, 18 nt, Salmonella typhimurium LT2
uuccggcucgccacggcc

SEQ ID NO: 3776434 - RNA, 18 nt, Salmonella typhimurium LT2
uuccggcugccagccagc

SEQ ID NO: 3776435 - RNA, 22 nt, Salmonella typhimurium LT2
uuccggcuucguuaagcgguuu

SEQ ID NO: 3776436 - RNA, 21 nt, Salmonella typhimurium LT2
uuccgggcgcaccaguucccc

SEQ ID NO: 3776437 - RNA, 23 nt, Salmonella typhimurium LT2
uuccgguaaaucaacaaccggcu

SEQ ID NO: 3776438 - RNA, 21 nt, Salmonella typhimurium LT2
uuccguaagcgccagcgguuu

SEQ ID NO: 3776439 - RNA, 23 nt, Salmonella typhimurium LT2
uuccguauugagcagcggcugga

SEQ ID NO: 3776440 - RNA, 18 nt, Salmonella typhimurium LT2
uuccgucucagagcuaug

SEQ ID NO: 3776441 - RNA, 18 nt, Salmonella typhimurium LT2
uuccguuuuguugccgcc

SEQ ID NO: 3776442 - RNA, 12 nt, Salmonella typhimurium LT2
uuccuacaauga

SEQ ID NO: 3776443 - RNA, 14 nt, Salmonella typhimurium LT2
uuccucagaauccg

SEQ ID NO: 3776444 - RNA, 15 nt, Salmonella typhimurium LT2
uuccuccgccgauaa

SEQ ID NO: 3776445 - RNA, 22 nt, Salmonella typhimurium LT2
uuccugaaagaguacgccgaua

SEQ ID NO: 3776446 - RNA, 23 nt, Salmonella typhimurium LT2
uuccugaaagaguacgccgauag

SEQ ID NO: 3776447 - RNA, 17 nt, Salmonella typhimurium LT2
uuccugaaggguccgaa

SEQ ID NO: 3776448 - RNA, 21 nt, Salmonella typhimurium LT2
uuccugacuguaauuucgcug

SEQ ID NO: 3776449 - RNA, 22 nt, Salmonella typhimurium LT2
uuccugagcagacauauuuuca

SEQ ID NO: 3776450 - RNA, 17 nt, Salmonella typhimurium LT2
uuccugaucaaucaacu

SEQ ID NO: 3776451 - RNA, 16 nt, Salmonella typhimurium LT2
uuccugauccgccuua

SEQ ID NO: 3776452 - RNA, 15 nt, Salmonella typhimurium LT2
uuccugccagcacag

SEQ ID NO: 3776453 - RNA, 21 nt, Salmonella typhimurium LT2
uuccugcggugguaacgccuu

SEQ ID NO: 3776454 - RNA, 14 nt, Salmonella typhimurium LT2
uuccugcugguaga

SEQ ID NO: 3776455 - RNA, 21 nt, Salmonella typhimurium LT2
uuccuggaacuggcuccagcu

SEQ ID NO: 3776456 - RNA, 14 nt, Salmonella typhimurium LT2
uuccuggcuugcca

SEQ ID NO: 3776457 - RNA, 16 nt, Salmonella typhimurium LT2
uuccuggggaacagaa

SEQ ID NO: 3776458 - RNA, 14 nt, Salmonella typhimurium LT2
uuccuggugcgaca

SEQ ID NO: 3776459 - RNA, 20 nt, Salmonella typhimurium LT2
uuccuguacgccugcuucac

SEQ ID NO: 3776460 - RNA, 18 nt, Salmonella typhimurium LT2
uuccugucucuauuaacc

SEQ ID NO: 3776461 - RNA, 14 nt, Salmonella typhimurium LT2
uuccuguuccugag

SEQ ID NO: 3776462 - RNA, 16 nt, Salmonella typhimurium LT2
uuccuuacuguagcgc

SEQ ID NO: 3776463 - RNA, 12 nt, Salmonella typhimurium LT2
uuccuuaucagc

SEQ ID NO: 3776464 - RNA, 23 nt, Salmonella typhimurium LT2
uuccuuccgaaucaauuccuaca

SEQ ID NO: 3776465 - RNA, 16 nt, Salmonella typhimurium LT2
uuccuuguuccaccug

SEQ ID NO: 3776466 - RNA, 19 nt, Salmonella typhimurium LT2
uuccuuguuuuaacggaau

SEQ ID NO: 3776467 - RNA, 15 nt, Salmonella typhimurium LT2
uuccuuugccuuucu

SEQ ID NO: 3776468 - RNA, 13 nt, Salmonella typhimurium LT2
uuccuuuucgcag

SEQ ID NO: 3776469 - RNA, 12 nt, Salmonella typhimurium LT2
uucucuucuucu

SEQ ID NO: 3776470 - RNA, 14 nt, Salmonella typhimurium LT2
uucucuucuucuuu

SEQ ID NO: 3776471 - RNA, 14 nt, Salmonella typhimurium LT2
uucucuuuuauuau

SEQ ID NO: 3776472 - RNA, 18 nt, Salmonella typhimurium LT2
uucugaacagcggcggca

SEQ ID NO: 3776473 - RNA, 19 nt, Salmonella typhimurium LT2
uucugaacuguaaccggcg

SEQ ID NO: 3776474 - RNA, 19 nt, Salmonella typhimurium LT2
uucugaagcguaacagcgc

SEQ ID NO: 3776475 - RNA, 21 nt, Salmonella typhimurium LT2
uucugaagcguaacagcgcua

SEQ ID NO: 3776476 - RNA, 13 nt, Salmonella typhimurium LT2
uucugaauaaauu

SEQ ID NO: 3776477 - RNA, 13 nt, Salmonella typhimurium LT2
uucugaauaauau

SEQ ID NO: 3776478 - RNA, 18 nt, Salmonella typhimurium LT2
uucugaaucauauuuuau

SEQ ID NO: 3776479 - RNA, 18 nt, Salmonella typhimurium LT2
uucugaauuucacgcuuc

SEQ ID NO: 3776480 - RNA, 18 nt, Salmonella typhimurium LT2
uucugaccaguugcaggc

SEQ ID NO: 3776481 - RNA, 14 nt, Salmonella typhimurium LT2
uucugcacucgaug

SEQ ID NO: 3776482 - RNA, 13 nt, Salmonella typhimurium LT2
uucugcaggccaa

SEQ ID NO: 3776483 - RNA, 23 nt, Salmonella typhimurium LT2
uucugcaggcgggugcgcagccc

SEQ ID NO: 3776484 - RNA, 22 nt, Salmonella typhimurium LT2
uucugccaggcauaccuccucu

SEQ ID NO: 3776485 - RNA, 19 nt, Salmonella typhimurium LT2
uucugccaguucacgccgc

SEQ ID NO: 3776486 - RNA, 19 nt, Salmonella typhimurium LT2
uucugccccccgacuucac

SEQ ID NO: 3776487 - RNA, 13 nt, Salmonella typhimurium LT2
uucugccuuuuuu

SEQ ID NO: 3776488 - RNA, 18 nt, Salmonella typhimurium LT2
uucugcgccagccagcuc

SEQ ID NO: 3776489 - RNA, 15 nt, Salmonella typhimurium LT2
uucugcgccucagcc

SEQ ID NO: 3776490 - RNA, 18 nt, Salmonella typhimurium LT2
uucugcucgggccagcuc

SEQ ID NO: 3776491 - RNA, 13 nt, Salmonella typhimurium LT2
uucugcugauaau

SEQ ID NO: 3776492 - RNA, 22 nt, Salmonella typhimurium LT2
uucuggacgggcuaucaauaug

SEQ ID NO: 3776493 - RNA, 14 nt, Salmonella typhimurium LT2
uucuggcaauaagg

SEQ ID NO: 3776494 - RNA, 23 nt, Salmonella typhimurium LT2
uucuggccguuuucaaacaaaca

SEQ ID NO: 3776495 - RNA, 20 nt, Salmonella typhimurium LT2
uucuggcgcagauacgcguc

SEQ ID NO: 3776496 - RNA, 20 nt, Salmonella typhimurium LT2
uucugguuuucaaauuguuc

SEQ ID NO: 3776497 - RNA, 16 nt, Salmonella typhimurium LT2
uucuguauuuucuauc

SEQ ID NO: 3776498 - RNA, 14 nt, Salmonella typhimurium LT2
uucugucagcguuu

SEQ ID NO: 3776499 - RNA, 20 nt, Salmonella typhimurium LT2
uucuguccggaagacagcuu

SEQ ID NO: 3776500 - RNA, 20 nt, Salmonella typhimurium LT2
uucuguccugaguaaagccu

SEQ ID NO: 3776501 - RNA, 15 nt, Salmonella typhimurium LT2
uucugucgccaccac

SEQ ID NO: 3776502 - RNA, 17 nt, Salmonella typhimurium LT2
uucugucguguccuugc

SEQ ID NO: 3776503 - RNA, 20 nt, Salmonella typhimurium LT2
uucuguuuucgagccuugcc

SEQ ID NO: 3776504 - RNA, 13 nt, Salmonella typhimurium LT2
uucuuaauaccca

SEQ ID NO: 3776505 - RNA, 22 nt, Salmonella typhimurium LT2
uucuuaauacccauuucuucuu

SEQ ID NO: 3776506 - RNA, 13 nt, Salmonella typhimurium LT2
uucuuaauggcca

SEQ ID NO: 3776507 - RNA, 17 nt, Salmonella typhimurium LT2
uucuuaccugguauuau

SEQ ID NO: 3776508 - RNA, 19 nt, Salmonella typhimurium LT2
uucuuacggacgugggggu

SEQ ID NO: 3776509 - RNA, 14 nt, Salmonella typhimurium LT2
uucuuagaauagca

SEQ ID NO: 3776510 - RNA, 13 nt, Salmonella typhimurium LT2
uucuucaacggcg

SEQ ID NO: 3776511 - RNA, 15 nt, Salmonella typhimurium LT2
uucuuccagcggcag

SEQ ID NO: 3776512 - RNA, 21 nt, Salmonella typhimurium LT2
uucuucccaccggacgaaaaa

SEQ ID NO: 3776513 - RNA, 22 nt, Salmonella typhimurium LT2
uucuucccaccggacgaaaaau

SEQ ID NO: 3776514 - RNA, 12 nt, Salmonella typhimurium LT2
uucuuccgugcc

SEQ ID NO: 3776515 - RNA, 12 nt, Salmonella typhimurium LT2
uucuuccucucg

SEQ ID NO: 3776516 - RNA, 18 nt, Salmonella typhimurium LT2
uucuucggcucagacagu

SEQ ID NO: 3776517 - RNA, 18 nt, Salmonella typhimurium LT2
uucuucgucgucaucaca

SEQ ID NO: 3776518 - RNA, 21 nt, Salmonella typhimurium LT2
uucuucgucgucuucauccca

SEQ ID NO: 3776519 - RNA, 13 nt, Salmonella typhimurium LT2
uucuucucuucuu

SEQ ID NO: 3776520 - RNA, 15 nt, Salmonella typhimurium LT2
uucuucugccuuuuu

SEQ ID NO: 3776521 - RNA, 18 nt, Salmonella typhimurium LT2
uucuucuggcucagacca

SEQ ID NO: 3776522 - RNA, 20 nt, Salmonella typhimurium LT2
uucuucuuagaauagcauca

SEQ ID NO: 3776523 - RNA, 12 nt, Salmonella typhimurium LT2
uucuucuucacg

SEQ ID NO: 3776524 - RNA, 12 nt, Salmonella typhimurium LT2
uucuugagcugg

SEQ ID NO: 3776525 - RNA, 17 nt, Salmonella typhimurium LT2
uucuugcgccgcaaacu

SEQ ID NO: 3776526 - RNA, 21 nt, Salmonella typhimurium LT2
uucuugcgccgcaaacucagg

SEQ ID NO: 3776527 - RNA, 17 nt, Salmonella typhimurium LT2
uucuuuaauuugugcca

SEQ ID NO: 3776528 - RNA, 14 nt, Salmonella typhimurium LT2
uucuuuaccaguga

SEQ ID NO: 3776529 - RNA, 19 nt, Salmonella typhimurium LT2
uucuuuacgcagcaagaac

SEQ ID NO: 3776530 - RNA, 14 nt, Salmonella typhimurium LT2
uucuuuaugcgccu

SEQ ID NO: 3776531 - RNA, 13 nt, Salmonella typhimurium LT2
uucuuucacuguc

SEQ ID NO: 3776532 - RNA, 13 nt, Salmonella typhimurium LT2
uucuuucaucaaa

SEQ ID NO: 3776533 - RNA, 15 nt, Salmonella typhimurium LT2
uucuuuccugcaaau

SEQ ID NO: 3776534 - RNA, 15 nt, Salmonella typhimurium LT2
uucuuugccuuuuuc

SEQ ID NO: 3776535 - RNA, 13 nt, Salmonella typhimurium LT2
uucuuugcuaucc

SEQ ID NO: 3776536 - RNA, 13 nt, Salmonella typhimurium LT2
uucuuugucacca

SEQ ID NO: 3776537 - RNA, 20 nt, Salmonella typhimurium LT2
uucuuuuucgaucagcauau

SEQ ID NO: 3776538 - RNA, 21 nt, Salmonella typhimurium LT2
uugaaaaccacaaucacagcg

SEQ ID NO: 3776539 - RNA, 21 nt, Salmonella typhimurium LT2
uugaaaaccauaauaaugcca

SEQ ID NO: 3776540 - RNA, 14 nt, Salmonella typhimurium LT2
uugaaagaccuaaa

SEQ ID NO: 3776541 - RNA, 15 nt, Salmonella typhimurium LT2
uugaaaucuugcugu

SEQ ID NO: 3776542 - RNA, 15 nt, Salmonella typhimurium LT2
uugaacauauccgcg

SEQ ID NO: 3776543 - RNA, 11 nt, Salmonella typhimurium LT2
uugaaccaucu

SEQ ID NO: 3776544 - RNA, 22 nt, Salmonella typhimurium LT2
uugaaccuaaaaaccagaacuu

SEQ ID NO: 3776545 - RNA, 18 nt, Salmonella typhimurium LT2
uugaacggggaucaaaau

SEQ ID NO: 3776546 - RNA, 22 nt, Salmonella typhimurium LT2
uugaacgguaaacacgacgcug

SEQ ID NO: 3776547 - RNA, 18 nt, Salmonella typhimurium LT2
uugaacucuuucagacca

SEQ ID NO: 3776548 - RNA, 11 nt, Salmonella typhimurium LT2
uugaagacagc

SEQ ID NO: 3776549 - RNA, 17 nt, Salmonella typhimurium LT2
uugaagguauccagcca

SEQ ID NO: 3776550 - RNA, 18 nt, Salmonella typhimurium LT2
uugaagguauccagccag

SEQ ID NO: 3776551 - RNA, 17 nt, Salmonella typhimurium LT2
uugaagucccuuuuuua

SEQ ID NO: 3776552 - RNA, 21 nt, Salmonella typhimurium LT2
uugaaguccucuauuuuuuua

SEQ ID NO: 3776553 - RNA, 23 nt, Salmonella typhimurium LT2
uugaagugguggcgaacaggcuc

SEQ ID NO: 3776554 - RNA, 17 nt, Salmonella typhimurium LT2
uugaauaacguguuaug

SEQ ID NO: 3776555 - RNA, 16 nt, Salmonella typhimurium LT2
uugaauaaugcccguu

SEQ ID NO: 3776556 - RNA, 13 nt, Salmonella typhimurium LT2
uugaauuugacga

SEQ ID NO: 3776557 - RNA, 17 nt, Salmonella typhimurium LT2
uugacaacaaaucgcaa

SEQ ID NO: 3776558 - RNA, 13 nt, Salmonella typhimurium LT2
uugacaugaaaaa

SEQ ID NO: 3776559 - RNA, 14 nt, Salmonella typhimurium LT2
uugacaugaaaaau

SEQ ID NO: 3776560 - RNA, 15 nt, Salmonella typhimurium LT2
uugaccagcaauaaa

SEQ ID NO: 3776561 - RNA, 19 nt, Salmonella typhimurium LT2
uugaccagguugccagcgg

SEQ ID NO: 3776562 - RNA, 14 nt, Salmonella typhimurium LT2
uugaccgucaucca

SEQ ID NO: 3776563 - RNA, 16 nt, Salmonella typhimurium LT2
uugaccucaucaccua

SEQ ID NO: 3776564 - RNA, 17 nt, Salmonella typhimurium LT2
uugacgcuaaccucuau

SEQ ID NO: 3776565 - RNA, 15 nt, Salmonella typhimurium LT2
uugacgcuauaacug

SEQ ID NO: 3776566 - RNA, 22 nt, Salmonella typhimurium LT2
uugacgucacugucagcaucag

SEQ ID NO: 3776567 - RNA, 18 nt, Salmonella typhimurium LT2
uugacgugcucaaucgcc

SEQ ID NO: 3776568 - RNA, 18 nt, Salmonella typhimurium LT2
uugacguuuuugacaucc

SEQ ID NO: 3776569 - RNA, 22 nt, Salmonella typhimurium LT2
uugagacguuauuagccggaua

SEQ ID NO: 3776570 - RNA, 15 nt, Salmonella typhimurium LT2
uugagcagaucagca

SEQ ID NO: 3776571 - RNA, 12 nt, Salmonella typhimurium LT2
uugagccagaua

SEQ ID NO: 3776572 - RNA, 13 nt, Salmonella typhimurium LT2
uugagccauucca

SEQ ID NO: 3776573 - RNA, 15 nt, Salmonella typhimurium LT2
uugaggaaauucugg

SEQ ID NO: 3776574 - RNA, 17 nt, Salmonella typhimurium LT2
uugcuguuaauuucccg

SEQ ID NO: 3776575 - RNA, 21 nt, Salmonella typhimurium LT2
uugcuguuucagaauauguuu

SEQ ID NO: 3776576 - RNA, 16 nt, Salmonella typhimurium LT2
uugcuuaccuuguucu

SEQ ID NO: 3776577 - RNA, 16 nt, Salmonella typhimurium LT2
uugcuuauccggccua

SEQ ID NO: 3776578 - RNA, 21 nt, Salmonella typhimurium LT2
uugcuuauucagucuggcaaa

SEQ ID NO: 3776579 - RNA, 20 nt, Salmonella typhimurium LT2
uugcuucaggcgggguuaac

SEQ ID NO: 3776580 - RNA, 23 nt, Salmonella typhimurium LT2
uugcuucgcucucgugccaguaa

SEQ ID NO: 3776581 - RNA, 14 nt, Salmonella typhimurium LT2
uugcuuucuugaau

SEQ ID NO: 3776582 - RNA, 16 nt, Salmonella typhimurium LT2
uugcuuuuucggcaau

SEQ ID NO: 3776583 - RNA, 13 nt, Salmonella typhimurium LT2
uugcuuuuuucca

SEQ ID NO: 3776584 - RNA, 18 nt, Salmonella typhimurium LT2
uuggaaacuaugcaaaac

SEQ ID NO: 3776585 - RNA, 21 nt, Salmonella typhimurium LT2
uuggaaacuaugcaaaacgua

SEQ ID NO: 3776586 - RNA, 18 nt, Salmonella typhimurium LT2
uuggaaagauucuacauu

SEQ ID NO: 3776587 - RNA, 19 nt, Salmonella typhimurium LT2
uuggagaggaauuguccac

SEQ ID NO: 3776588 - RNA, 19 nt, Salmonella typhimurium LT2
uuggagauuucggcauuuu

SEQ ID NO: 3776589 - RNA, 19 nt, Salmonella typhimurium LT2
uuggaugaaccauaucaaa

SEQ ID NO: 3776590 - RNA, 15 nt, Salmonella typhimurium LT2
uuggcaaaaaaggcc

SEQ ID NO: 3776591 - RNA, 16 nt, Salmonella typhimurium LT2
uuggcaaaccccugcu

SEQ ID NO: 3776592 - RNA, 12 nt, Salmonella typhimurium LT2
uuggcaaauccg

SEQ ID NO: 3776593 - RNA, 15 nt, Salmonella typhimurium LT2
uuggcaaucaaaucc

SEQ ID NO: 3776594 - RNA, 15 nt, Salmonella typhimurium LT2
uuggcagacaaccau

SEQ ID NO: 3776595 - RNA, 12 nt, Salmonella typhimurium LT2
uuggcaggaucc

SEQ ID NO: 3776596 - RNA, 14 nt, Salmonella typhimurium LT2
uuggcaucugucau

SEQ ID NO: 3776597 - RNA, 19 nt, Salmonella typhimurium LT2
uuggcauuucgcauuguca

SEQ ID NO: 3776598 - RNA, 11 nt, Salmonella typhimurium LT2
uuggccagcgu

SEQ ID NO: 3776599 - RNA, 15 nt, Salmonella typhimurium LT2
uuggccgcuuuagua

SEQ ID NO: 3776600 - RNA, 23 nt, Salmonella typhimurium LT2
uuggcgagcaggaaccacaucgc

SEQ ID NO: 3776601 - RNA, 16 nt, Salmonella typhimurium LT2
uuggcgaucagcggca

SEQ ID NO: 3776602 - RNA, 14 nt, Salmonella typhimurium LT2
uuggcgauuuccag

SEQ ID NO: 3776603 - RNA, 16 nt, Salmonella typhimurium LT2
uuggcgcgaaccguaa

SEQ ID NO: 3776604 - RNA, 14 nt, Salmonella typhimurium LT2
uuggcgcgucauca

SEQ ID NO: 3776605 - RNA, 18 nt, Salmonella typhimurium LT2
uuggcguaaaucaggcca

SEQ ID NO: 3776606 - RNA, 22 nt, Salmonella typhimurium LT2
uuggcuuuaugaauaucaacgc

SEQ ID NO: 3776607 - RNA, 16 nt, Salmonella typhimurium LT2
uugggcggucuuauca

SEQ ID NO: 3776608 - RNA, 14 nt, Salmonella typhimurium LT2
uugguaucugcaau

SEQ ID NO: 3776609 - RNA, 20 nt, Salmonella typhimurium LT2
uuggugauuaacagcgccau

SEQ ID NO: 3776610 - RNA, 23 nt, Salmonella typhimurium LT2
uuggugauuaacagcgccaucag

SEQ ID NO: 3776611 - RNA, 16 nt, Salmonella typhimurium LT2
uugguuaacuucaagg

SEQ ID NO: 3776612 - RNA, 19 nt, Salmonella typhimurium LT2
uugguuagggaucaucuuc

SEQ ID NO: 3776613 - RNA, 13 nt, Salmonella typhimurium LT2
uugguugaaccga

SEQ ID NO: 3776614 - RNA, 14 nt, Salmonella typhimurium LT2
uuguaauaauuuaa

SEQ ID NO: 3776615 - RNA, 21 nt, Salmonella typhimurium LT2
uuguaauacaggcguguggca

SEQ ID NO: 3776616 - RNA, 19 nt, Salmonella typhimurium LT2
uuguacaaaaaaugugagc

SEQ ID NO: 3776617 - RNA, 17 nt, Salmonella typhimurium LT2
uuguacagcaauaaaag

SEQ ID NO: 3776618 - RNA, 20 nt, Salmonella typhimurium LT2
uuguacagcaauaaaaggaa

SEQ ID NO: 3776619 - RNA, 15 nt, Salmonella typhimurium LT2
uuguacagcuugccg

SEQ ID NO: 3776620 - RNA, 13 nt, Salmonella typhimurium LT2
uuguagaccugau

SEQ ID NO: 3776621 - RNA, 18 nt, Salmonella typhimurium LT2
uuguagcggcaacagcac

SEQ ID NO: 3776622 - RNA, 18 nt, Salmonella typhimurium LT2
uuguagcugcgccugaaa

SEQ ID NO: 3776623 - RNA, 15 nt, Salmonella typhimurium LT2
uuguaggcaggaauu

SEQ ID NO: 3776624 - RNA, 16 nt, Salmonella typhimurium LT2
uuguaguuaucgccga

SEQ ID NO: 3776625 - RNA, 22 nt, Salmonella typhimurium LT2
uuguaguuucagcccaaaagcg

SEQ ID NO: 3776626 - RNA, 19 nt, Salmonella typhimurium LT2
uuguaucugucacuuaagu

SEQ ID NO: 3776627 - RNA, 20 nt, Salmonella typhimurium LT2
uuguauuggucuaucgcuuc

SEQ ID NO: 3776628 - RNA, 19 nt, Salmonella typhimurium LT2
uuguauuuaccgacauccg

SEQ ID NO: 3776629 - RNA, 15 nt, Salmonella typhimurium LT2
uugucacaaacggca

SEQ ID NO: 3776630 - RNA, 20 nt, Salmonella typhimurium LT2
uugucacuauucuuaucauu

SEQ ID NO: 3776631 - RNA, 15 nt, Salmonella typhimurium LT2
uugucagcauaaagc

SEQ ID NO: 3776632 - RNA, 14 nt, Salmonella typhimurium LT2
uugucaggccgcgu

SEQ ID NO: 3776633 - RNA, 19 nt, Salmonella typhimurium LT2
uugucauaaugucccugcc

SEQ ID NO: 3776634 - RNA, 21 nt, Salmonella typhimurium LT2
uugucauaaugucccugccac

SEQ ID NO: 3776635 - RNA, 19 nt, Salmonella typhimurium LT2
uugucaucaguaugagcga

SEQ ID NO: 3776636 - RNA, 14 nt, Salmonella typhimurium LT2
uugucauugcccaa

SEQ ID NO: 3776637 - RNA, 18 nt, Salmonella typhimurium LT2
uuguccagcagcagcaca

SEQ ID NO: 3776638 - RNA, 23 nt, Salmonella typhimurium LT2
uuguccccaucuuuaaaucccuc

SEQ ID NO: 3776639 - RNA, 22 nt, Salmonella typhimurium LT2
uuguccgcuggucagcgcgcca

SEQ ID NO: 3776640 - RNA, 13 nt, Salmonella typhimurium LT2
uuguccggcagaa

SEQ ID NO: 3776641 - RNA, 15 nt, Salmonella typhimurium LT2
uuguccggccacgga

SEQ ID NO: 3776642 - RNA, 19 nt, Salmonella typhimurium LT2
uugucguucacguaaucgc

SEQ ID NO: 3776643 - RNA, 24 nt, Salmonella typhimurium LT2
uugucuauaccguagaucgccagc

SEQ ID NO: 3776644 - RNA, 13 nt, Salmonella typhimurium LT2
uugucuuaaauau

SEQ ID NO: 3776645 - RNA, 14 nt, Salmonella typhimurium LT2
uugucuucuuagua

SEQ ID NO: 3776646 - RNA, 13 nt, Salmonella typhimurium LT2
uugucuucuuucg

SEQ ID NO: 3776647 - RNA, 22 nt, Salmonella typhimurium LT2
uugugcuuauggguuuccucca

SEQ ID NO: 3776648 - RNA, 12 nt, Salmonella typhimurium LT2
uugugcuuuagc

SEQ ID NO: 3776649 - RNA, 15 nt, Salmonella typhimurium LT2
uuguuaacgcaaggu

SEQ ID NO: 3776650 - RNA, 15 nt, Salmonella typhimurium LT2
uuguucgcuucuucu

SEQ ID NO: 3776651 - RNA, 16 nt, Salmonella typhimurium LT2
uuguucgucuuuugaa

SEQ ID NO: 3776652 - RNA, 20 nt, Salmonella typhimurium LT2
uuguugaccaacaaucgccc

SEQ ID NO: 3776653 - RNA, 23 nt, Salmonella typhimurium LT2
uuguugccgcccguuuuuuccag

SEQ ID NO: 3776654 - RNA, 20 nt, Salmonella typhimurium LT2
uuguuggcugcacucagaaa

SEQ ID NO: 3776655 - RNA, 18 nt, Salmonella typhimurium LT2
uuguuuaccgcaauaaca

SEQ ID NO: 3776656 - RNA, 17 nt, Salmonella typhimurium LT2
uuguuuauuccauucau

SEQ ID NO: 3776657 - RNA, 18 nt, Salmonella typhimurium LT2
uuguuuguggcaaaguac

SEQ ID NO: 3776658 - RNA, 20 nt, Salmonella typhimurium LT2
uuguuuuaaauucaaccagu

SEQ ID NO: 3776659 - RNA, 21 nt, Salmonella typhimurium LT2
uuuaaaaagcugcauaaugcg

SEQ ID NO: 3776660 - RNA, 13 nt, Salmonella typhimurium LT2
uuuaaaaguacaa

SEQ ID NO: 3776661 - RNA, 13 nt, Salmonella typhimurium LT2
uuuaaaaucaacg

SEQ ID NO: 3776662 - RNA, 12 nt, Salmonella typhimurium LT2
uuuaaaaugacc

SEQ ID NO: 3776663 - RNA, 17 nt, Salmonella typhimurium LT2
uuuaacaauuuaucaga

SEQ ID NO: 3776664 - RNA, 12 nt, Salmonella typhimurium LT2
uuuaacagauag

SEQ ID NO: 3776665 - RNA, 20 nt, Salmonella typhimurium LT2
uuuaacagauaguuaauaau

SEQ ID NO: 3776666 - RNA, 16 nt, Salmonella typhimurium LT2
uuuaaccggcaacuuu

SEQ ID NO: 3776667 - RNA, 18 nt, Salmonella typhimurium LT2
uuuaacgcuuccggaucg

SEQ ID NO: 3776668 - RNA, 14 nt, Salmonella typhimurium LT2
uuuaacuuaaauaa

SEQ ID NO: 3776669 - RNA, 16 nt, Salmonella typhimurium LT2
uuuaagcauccaggaa

SEQ ID NO: 3776670 - RNA, 18 nt, Salmonella typhimurium LT2
uuuaagccgauugaauaa

SEQ ID NO: 3776671 - RNA, 17 nt, Salmonella typhimurium LT2
uuuaagcgccuccacaa

SEQ ID NO: 3776672 - RNA, 15 nt, Salmonella typhimurium LT2
uuuaaggacauucag

SEQ ID NO: 3776673 - RNA, 13 nt, Salmonella typhimurium LT2
uuuaaugauguag

SEQ ID NO: 3776674 - RNA, 17 nt, Salmonella typhimurium LT2
uuuaaugcuauuugugg

SEQ ID NO: 3776675 - RNA, 18 nt, Salmonella typhimurium LT2
uuuaauguugccguggca

SEQ ID NO: 3776676 - RNA, 15 nt, Salmonella typhimurium LT2
uuuaauuuaugcgcc

SEQ ID NO: 3776677 - RNA, 15 nt, Salmonella typhimurium LT2
uuuaauuuucuguaa

SEQ ID NO: 3776678 - RNA, 14 nt, Salmonella typhimurium LT2
uuucauuagccgcc

SEQ ID NO: 3776679 - RNA, 17 nt, Salmonella typhimurium LT2
uuucauuauaaaacuuc

SEQ ID NO: 3776680 - RNA, 18 nt, Salmonella typhimurium LT2
uuucauuccuuuagcuuc

SEQ ID NO: 3776681 - RNA, 19 nt, Salmonella typhimurium LT2
uuucauuucgcccaucgcu

SEQ ID NO: 3776682 - RNA, 13 nt, Salmonella typhimurium LT2
uuucauuucugcc

SEQ ID NO: 3776683 - RNA, 16 nt, Salmonella typhimurium LT2
uuucauuucugccugc

SEQ ID NO: 3776684 - RNA, 22 nt, Salmonella typhimurium LT2
uuuccacaaucccggcaacugc

SEQ ID NO: 3776685 - RNA, 20 nt, Salmonella typhimurium LT2
uuuccacggucggucaagcu

SEQ ID NO: 3776686 - RNA, 20 nt, Salmonella typhimurium LT2
uuuccagaguacauucucuu

SEQ ID NO: 3776687 - RNA, 23 nt, Salmonella typhimurium LT2
uuuccagcacggcauaagccuca

SEQ ID NO: 3776688 - RNA, 17 nt, Salmonella typhimurium LT2
uuuccagcucaaccgcg

SEQ ID NO: 3776689 - RNA, 21 nt, Salmonella typhimurium LT2
uuuccagucccugaagaaaag

SEQ ID NO: 3776690 - RNA, 14 nt, Salmonella typhimurium LT2
uuuccagugccgcc

SEQ ID NO: 3776691 - RNA, 15 nt, Salmonella typhimurium LT2
uuuccagugccgcca

SEQ ID NO: 3776692 - RNA, 20 nt, Salmonella typhimurium LT2
uuuccaguguuguucucuga

SEQ ID NO: 3776693 - RNA, 22 nt, Salmonella typhimurium LT2
uuuccauacauuuuuguaauaa

SEQ ID NO: 3776694 - RNA, 13 nt, Salmonella typhimurium LT2
uuuccaucaccau

SEQ ID NO: 3776695 - RNA, 22 nt, Salmonella typhimurium LT2
uuuccaucaccauuaacgggcg

SEQ ID NO: 3776696 - RNA, 13 nt, Salmonella typhimurium LT2
uuuccauuuuuca

SEQ ID NO: 3776697 - RNA, 15 nt, Salmonella typhimurium LT2
uuucccaggucacgc

SEQ ID NO: 3776698 - RNA, 19 nt, Salmonella typhimurium LT2
uuucccccuccauacccua

SEQ ID NO: 3776699 - RNA, 15 nt, Salmonella typhimurium LT2
uuuccccgaugccau

SEQ ID NO: 3776700 - RNA, 16 nt, Salmonella typhimurium LT2
uuuccccugacgggaa

SEQ ID NO: 3776701 - RNA, 18 nt, Salmonella typhimurium LT2
uuucccgcgugaacacca

SEQ ID NO: 3776702 - RNA, 18 nt, Salmonella typhimurium LT2
uuucccucauauuuguau

SEQ ID NO: 3776703 - RNA, 15 nt, Salmonella typhimurium LT2
uuucccuucugaaau

SEQ ID NO: 3776704 - RNA, 18 nt, Salmonella typhimurium LT2
uuucccuuuuuaaaauga

SEQ ID NO: 3776705 - RNA, 17 nt, Salmonella typhimurium LT2
uuuccgcaucguuauca

SEQ ID NO: 3776706 - RNA, 10 nt, Salmonella typhimurium LT2
uuuccgccau

SEQ ID NO: 3776707 - RNA, 16 nt, Salmonella typhimurium LT2
uuuccgccauagaaca

SEQ ID NO: 3776708 - RNA, 17 nt, Salmonella typhimurium LT2
uuuccgccaugaaaaaa

SEQ ID NO: 3776709 - RNA, 18 nt, Salmonella typhimurium LT2
uuuccgccugaucuuucu

SEQ ID NO: 3776710 - RNA, 16 nt, Salmonella typhimurium LT2
uuuccgcugucuaucc

SEQ ID NO: 3776711 - RNA, 14 nt, Salmonella typhimurium LT2
uuuccggaaugaga

SEQ ID NO: 3776712 - RNA, 19 nt, Salmonella typhimurium LT2
uuuccggcagcgcauaagc

SEQ ID NO: 3776713 - RNA, 18 nt, Salmonella typhimurium LT2
uuuccggcgggagcucua

SEQ ID NO: 3776714 - RNA, 23 nt, Salmonella typhimurium LT2
uuuccggcgucaaaaauaaaaaa

SEQ ID NO: 3776715 - RNA, 17 nt, Salmonella typhimurium LT2
uuuccguauugcaaugc

SEQ ID NO: 3776716 - RNA, 16 nt, Salmonella typhimurium LT2
uuuccguuagcccuuu

SEQ ID NO: 3776717 - RNA, 16 nt, Salmonella typhimurium LT2
uuuccucaaccucuuu

SEQ ID NO: 3776718 - RNA, 22 nt, Salmonella typhimurium LT2
uuuccucccauacccagguuug

SEQ ID NO: 3776719 - RNA, 23 nt, Salmonella typhimurium LT2
uuuccugccauuguuccggcgac

SEQ ID NO: 3776720 - RNA, 21 nt, Salmonella typhimurium LT2
uuuccugucucuauuaaccgg

SEQ ID NO: 3776721 - RNA, 13 nt, Salmonella typhimurium LT2
uuucgaaacguuc

SEQ ID NO: 3776722 - RNA, 15 nt, Salmonella typhimurium LT2
uuucgauuucauuca

SEQ ID NO: 3776723 - RNA, 21 nt, Salmonella typhimurium LT2
uuucgcaaacuggucgaggac

SEQ ID NO: 3776724 - RNA, 14 nt, Salmonella typhimurium LT2
uuucgcaacagcau

SEQ ID NO: 3776725 - RNA, 20 nt, Salmonella typhimurium LT2
uuucgccacgcucacuuuuc

SEQ ID NO: 3776726 - RNA, 20 nt, Salmonella typhimurium LT2
uuucgccagaaccgcgcugg

SEQ ID NO: 3776727 - RNA, 21 nt, Salmonella typhimurium LT2
uuucgccagcgcaucgauaua

SEQ ID NO: 3776728 - RNA, 20 nt, Salmonella typhimurium LT2
uuucgccagguacaucgcgc

SEQ ID NO: 3776729 - RNA, 15 nt, Salmonella typhimurium LT2
uuucgcccucgccac

SEQ ID NO: 3776730 - RNA, 17 nt, Salmonella typhimurium LT2
uuucgccgcgcggaucg

SEQ ID NO: 3776731 - RNA, 20 nt, Salmonella typhimurium LT2
uuucgccguaaaacaacagc

SEQ ID NO: 3776732 - RNA, 23 nt, Salmonella typhimurium LT2
uuucgcgauaauagaacccaaag

SEQ ID NO: 3776733 - RNA, 14 nt, Salmonella typhimurium LT2
uuucgcuaucgccc

SEQ ID NO: 3776734 - RNA, 16 nt, Salmonella typhimurium LT2
uuucgcucaacaaacu

SEQ ID NO: 3776735 - RNA, 20 nt, Salmonella typhimurium LT2
uuucgcucaacaaacuuaau

SEQ ID NO: 3776736 - RNA, 16 nt, Salmonella typhimurium LT2
uuucgcuccacuggcc

SEQ ID NO: 3776737 - RNA, 16 nt, Salmonella typhimurium LT2
uuucgcucgcuuugcc

SEQ ID NO: 3776738 - RNA, 21 nt, Salmonella typhimurium LT2
uuucgcucgcuuugccgccau

SEQ ID NO: 3776739 - RNA, 14 nt, Salmonella typhimurium LT2
uuucgcucuuauca

SEQ ID NO: 3776740 - RNA, 19 nt, Salmonella typhimurium LT2
uuucgcuugcggcugccag

SEQ ID NO: 3776741 - RNA, 21 nt, Salmonella typhimurium LT2
uuucggugauuuccagaauca

SEQ ID NO: 3776742 - RNA, 22 nt, Salmonella typhimurium LT2
uuucguacgaacucuuucuuga

SEQ ID NO: 3776743 - RNA, 14 nt, Salmonella typhimurium LT2
uuucgucacuaacu

SEQ ID NO: 3776744 - RNA, 22 nt, Salmonella typhimurium LT2
uuucgucacuaacuccagcauc

SEQ ID NO: 3776745 - RNA, 16 nt, Salmonella typhimurium LT2
uuucguguaaaugacg

SEQ ID NO: 3776746 - RNA, 14 nt, Salmonella typhimurium LT2
uuucguucuuucug

SEQ ID NO: 3776747 - RNA, 20 nt, Salmonella typhimurium LT2
uuucguucuuucugccaucg

SEQ ID NO: 3776748 - RNA, 18 nt, Salmonella typhimurium LT2
uuucguugccagaguuca

SEQ ID NO: 3776749 - RNA, 16 nt, Salmonella typhimurium LT2
uuucuaaugucagcuc

SEQ ID NO: 3776750 - RNA, 21 nt, Salmonella typhimurium LT2
uuucuaguaugucuaugauuu

SEQ ID NO: 3776751 - RNA, 14 nt, Salmonella typhimurium LT2
uuucucaaaaacac

SEQ ID NO: 3776752 - RNA, 18 nt, Salmonella typhimurium LT2
uuucucccgccagaugca

SEQ ID NO: 3776753 - RNA, 16 nt, Salmonella typhimurium LT2
uuucuccggccagaca

SEQ ID NO: 3776754 - RNA, 16 nt, Salmonella typhimurium LT2
uuucuccugauuaauc

SEQ ID NO: 3776755 - RNA, 21 nt, Salmonella typhimurium LT2
uuucuccugcgccagccggau

SEQ ID NO: 3776756 - RNA, 18 nt, Salmonella typhimurium LT2
uuucuccuucauauuuca

SEQ ID NO: 3776757 - RNA, 23 nt, Salmonella typhimurium LT2
uuucucgcacaccagauucccca

SEQ ID NO: 3776758 - RNA, 17 nt, Salmonella typhimurium LT2
uuucucggcuuuccagc

SEQ ID NO: 3776759 - RNA, 20 nt, Salmonella typhimurium LT2
uuucugauaacgcaggcgau

SEQ ID NO: 3776760 - RNA, 17 nt, Salmonella typhimurium LT2
uuucugcgccucagcca

SEQ ID NO: 3776761 - RNA, 15 nt, Salmonella typhimurium LT2
uuucugcuggccuuu

SEQ ID NO: 3776762 - RNA, 22 nt, Salmonella typhimurium LT2
uuucuggccccugagcaaucag

SEQ ID NO: 3776763 - RNA, 17 nt, Salmonella typhimurium LT2
uuucuguaauuugaaau

SEQ ID NO: 3776764 - RNA, 14 nt, Salmonella typhimurium LT2
uuucuguauuuucu

SEQ ID NO: 3776765 - RNA, 16 nt, Salmonella typhimurium LT2
uuucuguauuuucuau

SEQ ID NO: 3776766 - RNA, 20 nt, Salmonella typhimurium LT2
uuucuguguugcucaaaaaa

SEQ ID NO: 3776767 - RNA, 14 nt, Salmonella typhimurium LT2
uuucuguuaucagg

SEQ ID NO: 3776768 - RNA, 17 nt, Salmonella typhimurium LT2
uuucuguuaucaggcau

SEQ ID NO: 3776769 - RNA, 21 nt, Salmonella typhimurium LT2
uuucuucaagcguuuccagag

SEQ ID NO: 3776770 - RNA, 23 nt, Salmonella typhimurium LT2
uuucuucaggccagccugaucca

SEQ ID NO: 3776771 - RNA, 13 nt, Salmonella typhimurium LT2
uuucuucaucaaa

SEQ ID NO: 3776772 - RNA, 16 nt, Salmonella typhimurium LT2
uuucuucaucaacacu

SEQ ID NO: 3776773 - RNA, 13 nt, Salmonella typhimurium LT2
uuucuucauccca

SEQ ID NO: 3776774 - RNA, 17 nt, Salmonella typhimurium LT2
uuucuucaucccagcua

SEQ ID NO: 3776775 - RNA, 22 nt, Salmonella typhimurium LT2
uuucuucucaacgccggaugac

SEQ ID NO: 3776776 - RNA, 11 nt, Salmonella typhimurium LT2
uuucuucuuca

SEQ ID NO: 3776777 - RNA, 23 nt, Salmonella typhimurium LT2
uuucuugccacuggccucccagu

SEQ ID NO: 3776778 - RNA, 11 nt, Salmonella typhimurium LT2
uuucuuuaaac

SEQ ID NO: 3776779 - RNA, 13 nt, Salmonella typhimurium LT2
uuugaaaaucaca

SEQ ID NO: 3776780 - RNA, 14 nt, Salmonella typhimurium LT2
uuugaaaucgaaca

SEQ ID NO: 3776781 - RNA, 11 nt, Salmonella typhimurium LT2
uuugaauuuga

SEQ ID NO: 3776782 - RNA, 19 nt, Salmonella typhimurium LT2
uuuucaacggcaucaauaa

SEQ ID NO: 3776783 - RNA, 21 nt, Salmonella typhimurium LT2
uuuucaacggcaucaauaauu

SEQ ID NO: 3776784 - RNA, 12 nt, Salmonella typhimurium LT2
uuuucaauaauc

SEQ ID NO: 3776785 - RNA, 11 nt, Salmonella typhimurium LT2
uuuucaauauc

SEQ ID NO: 3776786 - RNA, 15 nt, Salmonella typhimurium LT2
uuuucacuaaucccc

SEQ ID NO: 3776787 - RNA, 16 nt, Salmonella typhimurium LT2
uuuucacuuauaaaua

SEQ ID NO: 3776788 - RNA, 14 nt, Salmonella typhimurium LT2
uuuucagcaggccu

SEQ ID NO: 3776789 - RNA, 23 nt, Salmonella typhimurium LT2
uuuucagccugaagccagcaauc

SEQ ID NO: 3776790 - RNA, 15 nt, Salmonella typhimurium LT2
uuuucauauguuuga

SEQ ID NO: 3776791 - RNA, 13 nt, Salmonella typhimurium LT2
uuuucaucaucau

SEQ ID NO: 3776792 - RNA, 13 nt, Salmonella typhimurium LT2
uuuucauuauaaa

SEQ ID NO: 3776793 - RNA, 14 nt, Salmonella typhimurium LT2
uuuuccacaauacc

SEQ ID NO: 3776794 - RNA, 19 nt, Salmonella typhimurium LT2
uuuuccagcauuucuucaa

SEQ ID NO: 3776795 - RNA, 13 nt, Salmonella typhimurium LT2
uuuuccagcgcga

SEQ ID NO: 3776796 - RNA, 22 nt, Salmonella typhimurium LT2
uuuuccagugccgccagaauca

SEQ ID NO: 3776797 - RNA, 14 nt, Salmonella typhimurium LT2
uuuucccaacugua

SEQ ID NO: 3776798 - RNA, 16 nt, Salmonella typhimurium LT2
uuuuccugcggcuuga

SEQ ID NO: 3776799 - RNA, 13 nt, Salmonella typhimurium LT2
uuuucgaaaauuu

SEQ ID NO: 3776800 - RNA, 15 nt, Salmonella typhimurium LT2
uuuucgaaaauuucg

SEQ ID NO: 3776801 - RNA, 15 nt, Salmonella typhimurium LT2
uuuucgaucuucucc

SEQ ID NO: 3776802 - RNA, 22 nt, Salmonella typhimurium LT2
uuuucgcagagucgcagcggcg

SEQ ID NO: 3776803 - RNA, 21 nt, Salmonella typhimurium LT2
uuuucgccagguacaucgcgc

SEQ ID NO: 3776804 - RNA, 20 nt, Salmonella typhimurium LT2
uuuucgcccccagcacgaca

SEQ ID NO: 3776805 - RNA, 12 nt, Salmonella typhimurium LT2
uuuucggcucac

SEQ ID NO: 3776806 - RNA, 21 nt, Salmonella typhimurium LT2
uuuucuaucgcaucagauaac

SEQ ID NO: 3776807 - RNA, 12 nt, Salmonella typhimurium LT2
uuuucucaucca

SEQ ID NO: 3776808 - RNA, 19 nt, Salmonella typhimurium LT2
uuuucucgcgcagccagua

SEQ ID NO: 3776809 - RNA, 13 nt, Salmonella typhimurium LT2
uuuucugcuuucu

SEQ ID NO: 3776810 - RNA, 14 nt, Salmonella typhimurium LT2
uuuucugcuuucuu

SEQ ID NO: 3776811 - RNA, 12 nt, Salmonella typhimurium LT2
uuuucuggaaca

SEQ ID NO: 3776812 - RNA, 17 nt, Salmonella typhimurium LT2
uuuucuguaauucuccc

SEQ ID NO: 3776813 - RNA, 20 nt, Salmonella typhimurium LT2
uuuucugucguguccuugcc

SEQ ID NO: 3776814 - RNA, 12 nt, Salmonella typhimurium LT2
uuuucuucuucg

SEQ ID NO: 3776815 - RNA, 22 nt, Salmonella typhimurium LT2
uuuugacauccauaauacgacu

SEQ ID NO: 3776816 - RNA, 15 nt, Salmonella typhimurium LT2
uuuugcagcaaauac

SEQ ID NO: 3776817 - RNA, 15 nt, Salmonella typhimurium LT2
uuuugccgauaaaaa

SEQ ID NO: 3776818 - RNA, 16 nt, Salmonella typhimurium LT2
uuuuggggaaaauacc

SEQ ID NO: 3776819 - RNA, 19 nt, Salmonella typhimurium LT2
uuuuggugacguguuugau

SEQ ID NO: 3776820 - RNA, 23 nt, Salmonella typhimurium LT2
uuuuggugauuaacagcgccauc

SEQ ID NO: 3776821 - RNA, 21 nt, Salmonella typhimurium LT2
uuuuguaggccuaaaaauagc

SEQ ID NO: 3776822 - RNA, 22 nt, Salmonella typhimurium LT2
uuuuguaucugucacuuaagua

SEQ ID NO: 3776823 - RNA, 21 nt, Salmonella typhimurium LT2
uuuuguauuccuucggugcca

SEQ ID NO: 3776824 - RNA, 15 nt, Salmonella typhimurium LT2
uuuugucauaaggcg

SEQ ID NO: 3776825 - RNA, 23 nt, Salmonella typhimurium LT2
uuuugucauaaggcgauauugcc

SEQ ID NO: 3776826 - RNA, 17 nt, Salmonella typhimurium LT2
uuuugucggaauuuccg

SEQ ID NO: 3776827 - RNA, 19 nt, Salmonella typhimurium LT2
uuuugugaauaucacccca

SEQ ID NO: 3776828 - RNA, 14 nt, Salmonella typhimurium LT2
uuuuguuaaauccc

SEQ ID NO: 3776829 - RNA, 13 nt, Salmonella typhimurium LT2
uuuuuaaaaaacc

SEQ ID NO: 3776830 - RNA, 13 nt, Salmonella typhimurium LT2
uuuuuaaauauua

SEQ ID NO: 3776831 - RNA, 15 nt, Salmonella typhimurium LT2
uuuuuaauccaggaa

SEQ ID NO: 3776832 - RNA, 13 nt, Salmonella typhimurium LT2
uuuuuaaugucca

SEQ ID NO: 3776833 - RNA, 12 nt, Salmonella typhimurium LT2
uuuuuaccaauu

SEQ ID NO: 3776834 - RNA, 16 nt, Salmonella typhimurium LT2
uuuuuaccauauuuau

SEQ ID NO: 3776835 - RNA, 22 nt, Salmonella typhimurium LT2
uuuuuauacugaucgcuggugc

SEQ ID NO: 3776836 - RNA, 16 nt, Salmonella typhimurium LT2
uuuuuauauucgcuca

SEQ ID NO: 3776837 - RNA, 14 nt, Salmonella typhimurium LT2
uuuuuaucuuuucu

SEQ ID NO: 3776838 - RNA, 15 nt, Salmonella typhimurium LT2
uuuuucaauuuccag

SEQ ID NO: 3776839 - RNA, 19 nt, Salmonella typhimurium LT2
uuuuucacgaccagccaac

SEQ ID NO: 3776840 - RNA, 12 nt, Salmonella typhimurium LT2
uuuuucagaucg

SEQ ID NO: 3776841 - RNA, 14 nt, Salmonella typhimurium LT2
uuuuucagccgcgc

SEQ ID NO: 3776842 - RNA, 13 nt, Salmonella typhimurium LT2
uuuuucaucauac

SEQ ID NO: 3776843 - RNA, 16 nt, Salmonella typhimurium LT2
uuuuucauccagcggu

SEQ ID NO: 3776844 - RNA, 19 nt, Salmonella typhimurium LT2
uuuuucaucugcaguaagu

SEQ ID NO: 3776845 - RNA, 22 nt, Salmonella typhimurium LT2
uuuuuccaguagucgcgccauu

SEQ ID NO: 3776846 - RNA, 23 nt, Salmonella typhimurium LT2
uuuuuccgccaccuguuucgcca

SEQ ID NO: 3776847 - RNA, 15 nt, Salmonella typhimurium LT2
uuuuuccgccgccgu

SEQ ID NO: 3776848 - RNA, 16 nt, Salmonella typhimurium LT2
uuuuucgaucagcaua

SEQ ID NO: 3776849 - RNA, 21 nt, Salmonella typhimurium LT2
uuuuucucgauaucuuccccg

SEQ ID NO: 3776850 - RNA, 23 nt, Salmonella typhimurium LT2
uuuuucugucguguccuugccag

SEQ ID NO: 3776851 - RNA, 22 nt, Salmonella typhimurium LT2
uuuuucuugcucucaggcagua

SEQ ID NO: 3776852 - RNA, 16 nt, Salmonella typhimurium LT2
uuuuugacuaaaguuu

SEQ ID NO: 3776853 - RNA, 19 nt, Salmonella typhimurium LT2
uuuuugaguuugucaucca

SEQ ID NO: 3776854 - RNA, 13 nt, Salmonella typhimurium LT2
uuuuuggcuaagu

SEQ ID NO: 3776855 - RNA, 13 nt, Salmonella typhimurium LT2
uuuuuguauuccu

SEQ ID NO: 3776856 - RNA, 12 nt, Salmonella typhimurium LT2
uuuuuuagcaua

SEQ ID NO: 3776857 - RNA, 12 nt, Salmonella typhimurium LT2
uuuuuucagccu

SEQ ID NO: 3776858 - RNA, 15 nt, Salmonella typhimurium LT2
uuuuuucuccuucau

SEQ ID NO: 3776859 - RNA, 22 nt, Salmonella typhimurium LT2
uuuuuuucaucuuuuaaaauca

SEQ ID NO: 3776860 - RNA, 10 nt, Salmonella typhimurium LT2
uuuuuuugca

SEQ ID NO: 3776861 - RNA, 23 nt, Salmonella typhimurium LT2
caccaguuuauccgccagccagc

SEQ ID NO: 3776862 - RNA, 22 nt, Salmonella typhimurium LT2
caccauaauuaccggcacaccg

SEQ ID NO: 3776863 - RNA, 15 nt, Salmonella typhimurium LT2
caccauacccaacag

SEQ ID NO: 3776864 - RNA, 17 nt, Salmonella typhimurium LT2
caccauacccaacagca

SEQ ID NO: 3776865 - RNA, 20 nt, Salmonella typhimurium LT2
caccauacccaacagcagac

SEQ ID NO: 3776866 - RNA, 19 nt, Salmonella typhimurium LT2
caccaucagcgucagcacc

SEQ ID NO: 3776867 - RNA, 14 nt, Salmonella typhimurium LT2
caccauccggcgcu

SEQ ID NO: 3776868 - RNA, 16 nt, Salmonella typhimurium LT2
caccauccggcgcugu

SEQ ID NO: 3776869 - RNA, 14 nt, Salmonella typhimurium LT2
caccaucgccggag

SEQ ID NO: 3776870 - RNA, 17 nt, Salmonella typhimurium LT2
caccaucgggucggcca

SEQ ID NO: 3776871 - RNA, 21 nt, Salmonella typhimurium LT2
caccaucguugccagcggcca

SEQ ID NO: 3776872 - RNA, 16 nt, Salmonella typhimurium LT2
caccaucuuuuccggc

SEQ ID NO: 3776873 - RNA, 15 nt, Salmonella typhimurium LT2
caccaucuuuuugcu

SEQ ID NO: 3776874 - RNA, 13 nt, Salmonella typhimurium LT2
caccaucuuuuuu

SEQ ID NO: 3776875 - RNA, 21 nt, Salmonella typhimurium LT2
caccaugacgcagugcaauau

SEQ ID NO: 3776876 - RNA, 13 nt, Salmonella typhimurium LT2
caccauggcgcca

SEQ ID NO: 3776877 - RNA, 18 nt, Salmonella typhimurium LT2
caccauggcuauccacgc

SEQ ID NO: 3776878 - RNA, 15 nt, Salmonella typhimurium LT2
caccauuaacaucag

SEQ ID NO: 3776879 - RNA, 16 nt, Salmonella typhimurium LT2
caccauuaacgggcgu

SEQ ID NO: 3776880 - RNA, 19 nt, Salmonella typhimurium LT2
caccauucauguuucgaca

SEQ ID NO: 3776881 - RNA, 14 nt, Salmonella typhimurium LT2
caccauucgcgcau

SEQ ID NO: 3776882 - RNA, 14 nt, Salmonella typhimurium LT2
caccauucuucaac

SEQ ID NO: 3776883 - RNA, 17 nt, Salmonella typhimurium LT2
cacccacgucaguaaga

SEQ ID NO: 3776884 - RNA, 20 nt, Salmonella typhimurium LT2
cacccagacuucaauauuua

SEQ ID NO: 3776885 - RNA, 19 nt, Salmonella typhimurium LT2
cacccaggauggcggccaa

SEQ ID NO: 3776886 - RNA, 16 nt, Salmonella typhimurium LT2
cacccauugaacccga

SEQ ID NO: 3776887 - RNA, 18 nt, Salmonella typhimurium LT2
cacccccagcugacuggc

SEQ ID NO: 3776888 - RNA, 20 nt, Salmonella typhimurium LT2
caccccgcgccgcugagaaa

SEQ ID NO: 3776889 - RNA, 18 nt, Salmonella typhimurium LT2
caccccgucgaggaucau

SEQ ID NO: 3776890 - RNA, 20 nt, Salmonella typhimurium LT2
cacccgaacaacaauacgcg

SEQ ID NO: 3776891 - RNA, 20 nt, Salmonella typhimurium LT2
cacccgauacacgccgacgc

SEQ ID NO: 3776892 - RNA, 22 nt, Salmonella typhimurium LT2
cacccgcagccgcaaucagcgu

SEQ ID NO: 3776893 - RNA, 12 nt, Salmonella typhimurium LT2
cacccgccggca

SEQ ID NO: 3776894 - RNA, 15 nt, Salmonella typhimurium LT2
cacccgcgcuaaauc

SEQ ID NO: 3776895 - RNA, 16 nt, Salmonella typhimurium LT2
cacccgcgcucagcgu

SEQ ID NO: 3776896 - RNA, 18 nt, Salmonella typhimurium LT2
cacccgcuuccagcgcgu

SEQ ID NO: 3776897 - RNA, 16 nt, Salmonella typhimurium LT2
cacccggauacgcggc

SEQ ID NO: 3776898 - RNA, 18 nt, Salmonella typhimurium LT2
cacccggcugacugccgu

SEQ ID NO: 3776899 - RNA, 16 nt, Salmonella typhimurium LT2
cacccgggaagcccuu

SEQ ID NO: 3776900 - RNA, 22 nt, Salmonella typhimurium LT2
cacccguauucuuugcgccuua

SEQ ID NO: 3776901 - RNA, 10 nt, Salmonella typhimurium LT2
cacccugccc

SEQ ID NO: 3776902 - RNA, 13 nt, Salmonella typhimurium LT2
cagguauuaaaua

SEQ ID NO: 3776903 - RNA, 16 nt, Salmonella typhimurium LT2
cagguauuaaauacag

SEQ ID NO: 3776904 - RNA, 18 nt, Salmonella typhimurium LT2
cagguauuaaauacagag

SEQ ID NO: 3776905 - RNA, 15 nt, Salmonella typhimurium LT2
cagguauucguuaaa

SEQ ID NO: 3776906 - RNA, 20 nt, Salmonella typhimurium LT2
cagguauugaguaugccgua

SEQ ID NO: 3776907 - RNA, 20 nt, Salmonella typhimurium LT2
cagguauuuagccacgccgu

SEQ ID NO: 3776908 - RNA, 20 nt, Salmonella typhimurium LT2
caggucaaaauuaaucgcca

SEQ ID NO: 3776909 - RNA, 19 nt, Salmonella typhimurium LT2
caggucaacuccccgcccc

SEQ ID NO: 3776910 - RNA, 19 nt, Salmonella typhimurium LT2
caggucaucaccuccagca

SEQ ID NO: 3776911 - RNA, 14 nt, Salmonella typhimurium LT2
caggucaucggccu

SEQ ID NO: 3776912 - RNA, 17 nt, Salmonella typhimurium LT2
caggucaucggccugcu

SEQ ID NO: 3776913 - RNA, 18 nt, Salmonella typhimurium LT2
caggucaucggccugcuu

SEQ ID NO: 3776914 - RNA, 16 nt, Salmonella typhimurium LT2
caggucaugcaggacg

SEQ ID NO: 3776915 - RNA, 21 nt, Salmonella typhimurium LT2
caggucgaccaccugcuguac

SEQ ID NO: 3776916 - RNA, 23 nt, Salmonella typhimurium LT2
caggucucauagcgccccaguaa

SEQ ID NO: 3776917 - RNA, 14 nt, Salmonella typhimurium LT2
caggucugauaaaa

SEQ ID NO: 3776918 - RNA, 16 nt, Salmonella typhimurium LT2
caggucugaugagcgc

SEQ ID NO: 3776919 - RNA, 16 nt, Salmonella typhimurium LT2
caggugaguaaauaaa

SEQ ID NO: 3776920 - RNA, 17 nt, Salmonella typhimurium LT2
caggugaguaaauaaaa

SEQ ID NO: 3776921 - RNA, 18 nt, Salmonella typhimurium LT2
caggugauagugcguucg

SEQ ID NO: 3776922 - RNA, 17 nt, Salmonella typhimurium LT2
caggugaucuguucaaa

SEQ ID NO: 3776923 - RNA, 19 nt, Salmonella typhimurium LT2
caggugcgagagcuguccu

SEQ ID NO: 3776924 - RNA, 11 nt, Salmonella typhimurium LT2
cagguggaucc

SEQ ID NO: 3776925 - RNA, 18 nt, Salmonella typhimurium LT2
cagguggaucccccuggc

SEQ ID NO: 3776926 - RNA, 20 nt, Salmonella typhimurium LT2
cagguggaucccccuggccc

SEQ ID NO: 3776927 - RNA, 20 nt, Salmonella typhimurium LT2
caggugguacaucaaaucag

SEQ ID NO: 3776928 - RNA, 17 nt, Salmonella typhimurium LT2
cagguguuaguguucuu

SEQ ID NO: 3776929 - RNA, 13 nt, Salmonella typhimurium LT2
cagguguuauuuu

SEQ ID NO: 3776930 - RNA, 12 nt, Salmonella typhimurium LT2
cagguuaaccca

SEQ ID NO: 3776931 - RNA, 19 nt, Salmonella typhimurium LT2
cagguuacgcacuacauca

SEQ ID NO: 3776932 - RNA, 15 nt, Salmonella typhimurium LT2
cagguuacucuucca

SEQ ID NO: 3776933 - RNA, 15 nt, Salmonella typhimurium LT2
cagguuagcagccac

SEQ ID NO: 3776934 - RNA, 19 nt, Salmonella typhimurium LT2
cagguuaggcgcgauaaua

SEQ ID NO: 3776935 - RNA, 16 nt, Salmonella typhimurium LT2
cagguuagugauguuc

SEQ ID NO: 3776936 - RNA, 16 nt, Salmonella typhimurium LT2
cagguuaucgguaauu

SEQ ID NO: 3776937 - RNA, 17 nt, Salmonella typhimurium LT2
cagguuauuguugcuac

SEQ ID NO: 3776938 - RNA, 22 nt, Salmonella typhimurium LT2
cagguuauuguugcuacgcgcc

SEQ ID NO: 3776939 - RNA, 15 nt, Salmonella typhimurium LT2
cagguucgaaucccg

SEQ ID NO: 3776940 - RNA, 23 nt, Salmonella typhimurium LT2
cagguugaggcggguaauuugcg

SEQ ID NO: 3776941 - RNA, 16 nt, Salmonella typhimurium LT2
cagguugaugcaaaug

SEQ ID NO: 3776942 - RNA, 21 nt, Salmonella typhimurium LT2
cagguugccgaugacucccag

SEQ ID NO: 3776943 - RNA, 14 nt, Salmonella typhimurium LT2
cagguugggucucg

SEQ ID NO: 3776944 - RNA, 14 nt, Salmonella typhimurium LT2
cagguugucauagc

SEQ ID NO: 3776945 - RNA, 13 nt, Salmonella typhimurium LT2
cagguuucaucgc

SEQ ID NO: 3776946 - RNA, 23 nt, Salmonella typhimurium LT2
cagguuucaucgccgauuccugc

SEQ ID NO: 3776947 - RNA, 16 nt, Salmonella typhimurium LT2
cagguuucguccgccg

SEQ ID NO: 3776948 - RNA, 19 nt, Salmonella typhimurium LT2
cagguuucguccgccgcua

SEQ ID NO: 3776949 - RNA, 13 nt, Salmonella typhimurium LT2
cagguuuuacuuc

SEQ ID NO: 3776950 - RNA, 15 nt, Salmonella typhimurium LT2
cagguuuuuaagcug

SEQ ID NO: 3776951 - RNA, 20 nt, Salmonella typhimurium LT2
cagguuuuuaagcugcccac

SEQ ID NO: 3776952 - RNA, 22 nt, Salmonella typhimurium LT2
cagguuuuuugugaguucauaa

SEQ ID NO: 3776953 - RNA, 15 nt, Salmonella typhimurium LT2
caguaaaaagaaagc

SEQ ID NO: 3776954 - RNA, 19 nt, Salmonella typhimurium LT2
caguaaaaagaaagcugcc

SEQ ID NO: 3776955 - RNA, 14 nt, Salmonella typhimurium LT2
caguaaaacccaau

SEQ ID NO: 3776956 - RNA, 22 nt, Salmonella typhimurium LT2
caguaaagauuuguuucaucgc

SEQ ID NO: 3776957 - RNA, 14 nt, Salmonella typhimurium LT2
caguaaaucaacuu

SEQ ID NO: 3776958 - RNA, 20 nt, Salmonella typhimurium LT2
caguaaaucccgcaucaccc

SEQ ID NO: 3776959 - RNA, 20 nt, Salmonella typhimurium LT2
caguaaauuaaacagcugua

SEQ ID NO: 3776960 - RNA, 15 nt, Salmonella typhimurium LT2
caguaaccgccacag

SEQ ID NO: 3776961 - RNA, 16 nt, Salmonella typhimurium LT2
caguaaccgccacagc

SEQ ID NO: 3776962 - RNA, 18 nt, Salmonella typhimurium LT2
caguaaccgccacagcau

SEQ ID NO: 3776963 - RNA, 20 nt, Salmonella typhimurium LT2
caguaacgauacccaccagc

SEQ ID NO: 3776964 - RNA, 15 nt, Salmonella typhimurium LT2
caguaacgcgcccca

SEQ ID NO: 3776965 - RNA, 15 nt, Salmonella typhimurium LT2
caguaacgcguccaa

SEQ ID NO: 3776966 - RNA, 17 nt, Salmonella typhimurium LT2
caguaacucaucgccag

SEQ ID NO: 3776967 - RNA, 18 nt, Salmonella typhimurium LT2
caguaacucaucgccagc

SEQ ID NO: 3776968 - RNA, 13 nt, Salmonella typhimurium LT2
caguaacugcaaa

SEQ ID NO: 3776969 - RNA, 22 nt, Salmonella typhimurium LT2
caguaacugcaaaucuucggca

SEQ ID NO: 3776970 - RNA, 22 nt, Salmonella typhimurium LT2
caguaacuucagcaucaucucc

SEQ ID NO: 3776971 - RNA, 21 nt, Salmonella typhimurium LT2
caguaagucgccgcagcucca

SEQ ID NO: 3776972 - RNA, 21 nt, Salmonella typhimurium LT2
caguaauauaaccaauuuaaa

SEQ ID NO: 3776973 - RNA, 20 nt, Salmonella typhimurium LT2
caguaauauccccaucccag

SEQ ID NO: 3776974 - RNA, 22 nt, Salmonella typhimurium LT2
caguaaucaccgucuccggcgc

SEQ ID NO: 3776975 - RNA, 20 nt, Salmonella typhimurium LT2
caguaaucccggucgcgcca

SEQ ID NO: 3776976 - RNA, 22 nt, Salmonella typhimurium LT2
caguaaucccggucgcgccagc

SEQ ID NO: 3776977 - RNA, 17 nt, Salmonella typhimurium LT2
caguaauccggcaacug

SEQ ID NO: 3776978 - RNA, 13 nt, Salmonella typhimurium LT2
caguaauuuuucc

SEQ ID NO: 3776979 - RNA, 18 nt, Salmonella typhimurium LT2
caguaauuuuuccgccuc

SEQ ID NO: 3776980 - RNA, 20 nt, Salmonella typhimurium LT2
caguaauuuuucucccagca

SEQ ID NO: 3776981 - RNA, 15 nt, Salmonella typhimurium LT2
caguacaaacaaaua

SEQ ID NO: 3776982 - RNA, 21 nt, Salmonella typhimurium LT2
caguacaaacaaauaaaucca

SEQ ID NO: 3776983 - RNA, 23 nt, Salmonella typhimurium LT2
caguacaaacaaauaaauccaug

SEQ ID NO: 3776984 - RNA, 18 nt, Salmonella typhimurium LT2
caguacaaacgcaccgcc

SEQ ID NO: 3776985 - RNA, 15 nt, Salmonella typhimurium LT2
caguacaauuuccug

SEQ ID NO: 3776986 - RNA, 19 nt, Salmonella typhimurium LT2
caguacaauuuccugccac

SEQ ID NO: 3776987 - RNA, 22 nt, Salmonella typhimurium LT2
caguacaauuucuggccccuga

SEQ ID NO: 3776988 - RNA, 13 nt, Salmonella typhimurium LT2
caguacagccaaa

SEQ ID NO: 3776989 - RNA, 17 nt, Salmonella typhimurium LT2
caguacagccaaaaaua

SEQ ID NO: 3776990 - RNA, 22 nt, Salmonella typhimurium LT2
caguaccgccuucagcgcgccc

SEQ ID NO: 3776991 - RNA, 17 nt, Salmonella typhimurium LT2
caguaccggcaggacaa

SEQ ID NO: 3776992 - RNA, 14 nt, Salmonella typhimurium LT2
caguacgaucauga

SEQ ID NO: 3776993 - RNA, 14 nt, Salmonella typhimurium LT2
caguacgccaaaaa

SEQ ID NO: 3776994 - RNA, 21 nt, Salmonella typhimurium LT2
caguacgccaaaaaaggcagc

SEQ ID NO: 3776995 - RNA, 17 nt, Salmonella typhimurium LT2
caguacgcgcgcggcgu

SEQ ID NO: 3776996 - RNA, 17 nt, Salmonella typhimurium LT2
caguacgcggccgccgc

SEQ ID NO: 3776997 - RNA, 12 nt, Salmonella typhimurium LT2
caguagauggcg

SEQ ID NO: 3776998 - RNA, 20 nt, Salmonella typhimurium LT2
caguagccgccgcaggacag

SEQ ID NO: 3776999 - RNA, 13 nt, Salmonella typhimurium LT2
caguagcgcgccc

SEQ ID NO: 3777000 - RNA, 18 nt, Salmonella typhimurium LT2
caguagcgggggccggcc

SEQ ID NO: 3777001 - RNA, 20 nt, Salmonella typhimurium LT2
caguagcgggggccggccgc

SEQ ID NO: 3777002 - RNA, 22 nt, Salmonella typhimurium LT2
caguagcgggggccggccgcgg

SEQ ID NO: 3777003 - RNA, 17 nt, Salmonella typhimurium LT2
caguagugucuucacga

SEQ ID NO: 3777004 - RNA, 21 nt, Salmonella typhimurium LT2
caguagugugguauucagccc

SEQ ID NO: 3777005 - RNA, 15 nt, Salmonella typhimurium LT2
caguauaaauaccuu

SEQ ID NO: 3777006 - RNA, 19 nt, Salmonella typhimurium LT2
caguauaauuucaggcugc

SEQ ID NO: 3777007 - RNA, 22 nt, Salmonella typhimurium LT2
caguaucuuuuauuauuacagg

SEQ ID NO: 3777008 - RNA, 22 nt, Salmonella typhimurium LT2
caguaugaucaugcccggcaaa

SEQ ID NO: 3777009 - RNA, 22 nt, Salmonella typhimurium LT2
caguaugcccccuccagccagc

SEQ ID NO: 3777010 - RNA, 16 nt, Salmonella typhimurium LT2
cagucacauacuucug

SEQ ID NO: 3777011 - RNA, 13 nt, Salmonella typhimurium LT2
cagucaccagcag

SEQ ID NO: 3777012 - RNA, 17 nt, Salmonella typhimurium LT2
cagucagcaauuaacaa

SEQ ID NO: 3777013 - RNA, 18 nt, Salmonella typhimurium LT2
cagucagcaauuaacaaa

SEQ ID NO: 3777014 - RNA, 14 nt, Salmonella typhimurium LT2
cagucagccuugac

SEQ ID NO: 3777015 - RNA, 19 nt, Salmonella typhimurium LT2
cagucagccuugaccgccu

SEQ ID NO: 3777016 - RNA, 16 nt, Salmonella typhimurium LT2
cagucagcgcgagcgu

SEQ ID NO: 3777017 - RNA, 14 nt, Salmonella typhimurium LT2
cagucaucgccgcu

SEQ ID NO: 3777018 - RNA, 15 nt, Salmonella typhimurium LT2
cagucauggcuuuua

SEQ ID NO: 3777019 - RNA, 19 nt, Salmonella typhimurium LT2
caguccaccuguaaccgcu

SEQ ID NO: 3777020 - RNA, 12 nt, Salmonella typhimurium LT2
caguccagaugc

SEQ ID NO: 3777021 - RNA, 21 nt, Salmonella typhimurium LT2
caguccccagcguaccacgcc

SEQ ID NO: 3777022 - RNA, 23 nt, Salmonella typhimurium LT2
caguccccagcguaccacgccgc

SEQ ID NO: 3777023 - RNA, 16 nt, Salmonella typhimurium LT2
cagucccugaagaaaa

SEQ ID NO: 3777024 - RNA, 16 nt, Salmonella typhimurium LT2
cagucccuguucgcca

SEQ ID NO: 3777025 - RNA, 19 nt, Salmonella typhimurium LT2
cagucccuguucgccaccc

SEQ ID NO: 3777026 - RNA, 23 nt, Salmonella typhimurium LT2
caguccgguacgacgacccuuuu

SEQ ID NO: 3777027 - RNA, 21 nt, Salmonella typhimurium LT2
caguccguggcacgguaaacu

SEQ ID NO: 3777028 - RNA, 18 nt, Salmonella typhimurium LT2
caguccuccggcugaagc

SEQ ID NO: 3777029 - RNA, 22 nt, Salmonella typhimurium LT2
caguccuccggcugaagcccca

SEQ ID NO: 3777030 - RNA, 14 nt, Salmonella typhimurium LT2
caguccucgcccac

SEQ ID NO: 3777031 - RNA, 17 nt, Salmonella typhimurium LT2
caguccucgcccacuuc

SEQ ID NO: 3777032 - RNA, 18 nt, Salmonella typhimurium LT2
caguccugccccugccag

SEQ ID NO: 3777033 - RNA, 15 nt, Salmonella typhimurium LT2
caguccuuucgaugc

SEQ ID NO: 3777034 - RNA, 23 nt, Salmonella typhimurium LT2
cagucgaacauccuugcacgcca

SEQ ID NO: 3777035 - RNA, 14 nt, Salmonella typhimurium LT2
cagucgcagagccc

SEQ ID NO: 3777036 - RNA, 16 nt, Salmonella typhimurium LT2
cagucgcagagcccag

SEQ ID NO: 3777037 - RNA, 14 nt, Salmonella typhimurium LT2
cagucgcuccacca

SEQ ID NO: 3777038 - RNA, 14 nt, Salmonella typhimurium LT2
cagucgcugagucu

SEQ ID NO: 3777039 - RNA, 16 nt, Salmonella typhimurium LT2
cagucgcuguacuuug

SEQ ID NO: 3777040 - RNA, 14 nt, Salmonella typhimurium LT2
cagucggcgaacuu

SEQ ID NO: 3777041 - RNA, 19 nt, Salmonella typhimurium LT2
cagucgggaucgccagauc

SEQ ID NO: 3777042 - RNA, 13 nt, Salmonella typhimurium LT2
cagucugcccggc

SEQ ID NO: 3777043 - RNA, 12 nt, Salmonella typhimurium LT2
cagugaaaaaaa

SEQ ID NO: 3777044 - RNA, 19 nt, Salmonella typhimurium LT2
cagugaaaccggcgcgccu

SEQ ID NO: 3777045 - RNA, 13 nt, Salmonella typhimurium LT2
cagugaaauaaau

SEQ ID NO: 3777046 - RNA, 14 nt, Salmonella typhimurium LT2
cagugaacacccug

SEQ ID NO: 3777047 - RNA, 17 nt, Salmonella typhimurium LT2
cagugaacacccugccc

SEQ ID NO: 3777048 - RNA, 15 nt, Salmonella typhimurium LT2
cagugaacguucacu

SEQ ID NO: 3777049 - RNA, 17 nt, Salmonella typhimurium LT2
cagugaacguucacuaa

SEQ ID NO: 3777050 - RNA, 16 nt, Salmonella typhimurium LT2
cagugaauccagcgua

SEQ ID NO: 3777051 - RNA, 19 nt, Salmonella typhimurium LT2
cagugacaaaaaucugaau

SEQ ID NO: 3777052 - RNA, 13 nt, Salmonella typhimurium LT2
cagugacaaugua

SEQ ID NO: 3777053 - RNA, 20 nt, Salmonella typhimurium LT2
cagugacacguaccugccug

SEQ ID NO: 3777054 - RNA, 15 nt, Salmonella typhimurium LT2
cagugacauuuaucu

SEQ ID NO: 3777055 - RNA, 23 nt, Salmonella typhimurium LT2
cagugacauuuaucuuccggcau

SEQ ID NO: 3777056 - RNA, 17 nt, Salmonella typhimurium LT2
cagugagcccuccucca

SEQ ID NO: 3777057 - RNA, 19 nt, Salmonella typhimurium LT2
cagugagcgauugcuggcc

SEQ ID NO: 3777058 - RNA, 20 nt, Salmonella typhimurium LT2
cagugauccaucgguucucu

SEQ ID NO: 3777059 - RNA, 19 nt, Salmonella typhimurium LT2
cagugauggauuucacaau

SEQ ID NO: 3777060 - RNA, 24 nt, Salmonella typhimurium LT2
cagugauuacaaaaugugcaauca

SEQ ID NO: 3777061 - RNA, 22 nt, Salmonella typhimurium LT2
cagugauuuccggguucacauc

SEQ ID NO: 3777062 - RNA, 12 nt, Salmonella typhimurium LT2
cagugcacugcc

SEQ ID NO: 3777063 - RNA, 13 nt, Salmonella typhimurium LT2
cagugcacugccu

SEQ ID NO: 3777064 - RNA, 14 nt, Salmonella typhimurium LT2
cagugcacugccug

SEQ ID NO: 3777065 - RNA, 16 nt, Salmonella typhimurium LT2
cagugcacugccugau

SEQ ID NO: 3777066 - RNA, 19 nt, Salmonella typhimurium LT2
cagugcaggauuuguauca

SEQ ID NO: 3777067 - RNA, 13 nt, Salmonella typhimurium LT2
cagugcauagcag

SEQ ID NO: 3777068 - RNA, 21 nt, Salmonella typhimurium LT2
cagugccaaaucaugagcgca

SEQ ID NO: 3777069 - RNA, 13 nt, Salmonella typhimurium LT2
cagugccgccaga

SEQ ID NO: 3777070 - RNA, 17 nt, Salmonella typhimurium LT2
cagugccgccagaauca

SEQ ID NO: 3777071 - RNA, 21 nt, Salmonella typhimurium LT2
cagugccggaaagacggcagc

SEQ ID NO: 3777072 - RNA, 18 nt, Salmonella typhimurium LT2
cagugcggcaaccaccag

SEQ ID NO: 3777073 - RNA, 14 nt, Salmonella typhimurium LT2
cagugcuuuuaacg

SEQ ID NO: 3777074 - RNA, 14 nt, Salmonella typhimurium LT2
caguggaaaacagc

SEQ ID NO: 3777075 - RNA, 17 nt, Salmonella typhimurium LT2
caguggaacaaacgcaa

SEQ ID NO: 3777076 - RNA, 22 nt, Salmonella typhimurium LT2
caguggaacaacucucccaacu

SEQ ID NO: 3777077 - RNA, 21 nt, Salmonella typhimurium LT2
caguggacuaugcuccaguug

SEQ ID NO: 3777078 - RNA, 21 nt, Salmonella typhimurium LT2
caguggagacacuucagccgg

SEQ ID NO: 3777079 - RNA, 23 nt, Salmonella typhimurium LT2
caguggagaggccaccagcgcca

SEQ ID NO: 3777080 - RNA, 19 nt, Salmonella typhimurium LT2
caguggcgcgccgcugucu

SEQ ID NO: 3777081 - RNA, 13 nt, Salmonella typhimurium LT2
cagugggaaaauu

SEQ ID NO: 3777082 - RNA, 24 nt, Salmonella typhimurium LT2
caguguacauagcuuugccacugg

SEQ ID NO: 3777083 - RNA, 14 nt, Salmonella typhimurium LT2
cagugugccgucau

SEQ ID NO: 3777084 - RNA, 11 nt, Salmonella typhimurium LT2
cagugugcucg

SEQ ID NO: 3777085 - RNA, 20 nt, Salmonella typhimurium LT2
cagugugcucguuuuuauac

SEQ ID NO: 3777086 - RNA, 21 nt, Salmonella typhimurium LT2
cagugugcucguuuuuauaca

SEQ ID NO: 3777087 - RNA, 15 nt, Salmonella typhimurium LT2
caguguuuauuaaaa

SEQ ID NO: 3777088 - RNA, 14 nt, Salmonella typhimurium LT2
caguguuuccauac

SEQ ID NO: 3777089 - RNA, 17 nt, Salmonella typhimurium LT2
caguguuucccaacaau

SEQ ID NO: 3777090 - RNA, 14 nt, Salmonella typhimurium LT2
caguuaagcggggg

SEQ ID NO: 3777091 - RNA, 21 nt, Salmonella typhimurium LT2
caguuacguuugcagcggaag

SEQ ID NO: 3777092 - RNA, 16 nt, Salmonella typhimurium LT2
caguuagcgaaacagu

SEQ ID NO: 3777093 - RNA, 17 nt, Salmonella typhimurium LT2
caguuagcuucagcaaa

SEQ ID NO: 3777094 - RNA, 24 nt, Salmonella typhimurium LT2
caguuauuaaucaagcccagcuca

SEQ ID NO: 3777095 - RNA, 18 nt, Salmonella typhimurium LT2
caguuauuuuacgggcgu

SEQ ID NO: 3777096 - RNA, 23 nt, Salmonella typhimurium LT2
caguucaauauucacuucgccca

SEQ ID NO: 3777097 - RNA, 20 nt, Salmonella typhimurium LT2
caguucacgcgccgccugca

SEQ ID NO: 3777098 - RNA, 20 nt, Salmonella typhimurium LT2
caguucacuccuaagagaaa

SEQ ID NO: 3777099 - RNA, 21 nt, Salmonella typhimurium LT2
caguucacuccuaagagaaaa

SEQ ID NO: 3777100 - RNA, 23 nt, Salmonella typhimurium LT2
caguucagcagcaccacucccca

SEQ ID NO: 3777101 - RNA, 12 nt, Salmonella typhimurium LT2
caguucaggaac

SEQ ID NO: 3777102 - RNA, 14 nt, Salmonella typhimurium LT2
caguucauccagca

SEQ ID NO: 3777103 - RNA, 15 nt, Salmonella typhimurium LT2
caguucauccagcag

SEQ ID NO: 3777104 - RNA, 16 nt, Salmonella typhimurium LT2
caguucauccagcagc

SEQ ID NO: 3777105 - RNA, 13 nt, Salmonella typhimurium LT2
caguucauuccgc

SEQ ID NO: 3777106 - RNA, 21 nt, Salmonella typhimurium LT2
caguuccaucuccggcgacca

SEQ ID NO: 3777107 - RNA, 19 nt, Salmonella typhimurium LT2
caguuccgccacggcgucc

SEQ ID NO: 3777108 - RNA, 20 nt, Salmonella typhimurium LT2
caguuccgccagacucagcc

SEQ ID NO: 3777109 - RNA, 18 nt, Salmonella typhimurium LT2
caguucgccuucuucauc

SEQ ID NO: 3777110 - RNA, 17 nt, Salmonella typhimurium LT2
caguucguacuccugca

SEQ ID NO: 3777111 - RNA, 17 nt, Salmonella typhimurium LT2
caguucguagagcucca

SEQ ID NO: 3777112 - RNA, 14 nt, Salmonella typhimurium LT2
caguucguucugcg

SEQ ID NO: 3777113 - RNA, 16 nt, Salmonella typhimurium LT2
caguucguucugcguc

SEQ ID NO: 3777114 - RNA, 19 nt, Salmonella typhimurium LT2
caguucuucccugcaauau

SEQ ID NO: 3777115 - RNA, 16 nt, Salmonella typhimurium LT2
caguugaccaaacagc

SEQ ID NO: 3777116 - RNA, 19 nt, Salmonella typhimurium LT2
caguugaccaaacagcaau

SEQ ID NO: 3777117 - RNA, 14 nt, Salmonella typhimurium LT2
caguugauacauuu

SEQ ID NO: 3777118 - RNA, 16 nt, Salmonella typhimurium LT2
caguugauacauuuuu

SEQ ID NO: 3777119 - RNA, 18 nt, Salmonella typhimurium LT2
caguugauacauuuuuug

SEQ ID NO: 3777120 - RNA, 13 nt, Salmonella typhimurium LT2
caguugcagcacc

SEQ ID NO: 3777121 - RNA, 12 nt, Salmonella typhimurium LT2
caguugcagcgc

SEQ ID NO: 3777122 - RNA, 15 nt, Salmonella typhimurium LT2
caguugcagcguacg

SEQ ID NO: 3777123 - RNA, 17 nt, Salmonella typhimurium LT2
caguugcauacggucaa

SEQ ID NO: 3777124 - RNA, 15 nt, Salmonella typhimurium LT2
caguugccaggguuc

SEQ ID NO: 3777125 - RNA, 18 nt, Salmonella typhimurium LT2
caguugccccuuguugaa

SEQ ID NO: 3777126 - RNA, 14 nt, Salmonella typhimurium LT2
caguugcgacuggu

SEQ ID NO: 3777127 - RNA, 15 nt, Salmonella typhimurium LT2
caguugcgucagcgc

SEQ ID NO: 3777128 - RNA, 20 nt, Salmonella typhimurium LT2
caguugcgucuuagaaaacc

SEQ ID NO: 3777129 - RNA, 15 nt, Salmonella typhimurium LT2
caguuggcgaccgcu

SEQ ID NO: 3777130 - RNA, 17 nt, Salmonella typhimurium LT2
caguuggucgcguuuac

SEQ ID NO: 3777131 - RNA, 21 nt, Salmonella typhimurium LT2
caguuguacuuguugcuggca

SEQ ID NO: 3777132 - RNA, 23 nt, Salmonella typhimurium LT2
caguuuacgagugcguucuucca

SEQ ID NO: 3777133 - RNA, 12 nt, Salmonella typhimurium LT2
caguuuauccgc

SEQ ID NO: 3777134 - RNA, 15 nt, Salmonella typhimurium LT2
caguuuaucugcgug

SEQ ID NO: 3777135 - RNA, 17 nt, Salmonella typhimurium LT2
caguuuaucugcgugau

SEQ ID NO: 3777136 - RNA, 14 nt, Salmonella typhimurium LT2
caguuucaucaucg

SEQ ID NO: 3777137 - RNA, 19 nt, Salmonella typhimurium LT2
caguuucucgucauaguga

SEQ ID NO: 3777138 - RNA, 15 nt, Salmonella typhimurium LT2
caguuucuucgccca

SEQ ID NO: 3777139 - RNA, 20 nt, Salmonella typhimurium LT2
caguuucuucgcccacggca

SEQ ID NO: 3777140 - RNA, 22 nt, Salmonella typhimurium LT2
caguuucuucggcuucaccgau

SEQ ID NO: 3777141 - RNA, 18 nt, Salmonella typhimurium LT2
caguuuguaaccaacaaa

SEQ ID NO: 3777142 - RNA, 23 nt, Salmonella typhimurium LT2
caguuugucaugcgugcgccgcg

SEQ ID NO: 3777143 - RNA, 14 nt, Salmonella typhimurium LT2
caguuuuccagcgc

SEQ ID NO: 3777144 - RNA, 11 nt, Salmonella typhimurium LT2
caguuuuccuu

SEQ ID NO: 3777145 - RNA, 17 nt, Salmonella typhimurium LT2
caguuuuccuucagcag

SEQ ID NO: 3777146 - RNA, 18 nt, Salmonella typhimurium LT2
caguuuuccuucagcagc

SEQ ID NO: 3777147 - RNA, 19 nt, Salmonella typhimurium LT2
caguuuugaucgaaucucc

SEQ ID NO: 3777148 - RNA, 22 nt, Salmonella typhimurium LT2
caguuuuggcaaucacaagcug

SEQ ID NO: 3777149 - RNA, 15 nt, Salmonella typhimurium LT2
caguuuuuauaacua

SEQ ID NO: 3777150 - RNA, 23 nt, Salmonella typhimurium LT2
caguuuuuuacuuucaaaauacu

SEQ ID NO: 3777151 - RNA, 13 nt, Salmonella typhimurium LT2
caguuuuuuccag

SEQ ID NO: 3777152 - RNA, 16 nt, Salmonella typhimurium LT2
caguuuuuuccagcgc

SEQ ID NO: 3777153 - RNA, 12 nt, Salmonella typhimurium LT2
cauaaaaaaacg

SEQ ID NO: 3777154 - RNA, 12 nt, Salmonella typhimurium LT2
cauaaaaccauu

SEQ ID NO: 3777155 - RNA, 15 nt, Salmonella typhimurium LT2
cauaaaacccgcuuc

SEQ ID NO: 3777156 - RNA, 15 nt, Salmonella typhimurium LT2
cauaaaacgggucgc

SEQ ID NO: 3777157 - RNA, 16 nt, Salmonella typhimurium LT2
cauaaaauguuccaua

SEQ ID NO: 3777158 - RNA, 21 nt, Salmonella typhimurium LT2
cauaaacgacaucaauagcaa

SEQ ID NO: 3777159 - RNA, 17 nt, Salmonella typhimurium LT2
cauaaacggcaccugga

SEQ ID NO: 3777160 - RNA, 23 nt, Salmonella typhimurium LT2
cauaaacgucccgacgaauaaca

SEQ ID NO: 3777161 - RNA, 15 nt, Salmonella typhimurium LT2
cauaaagccucucuu

SEQ ID NO: 3777162 - RNA, 12 nt, Salmonella typhimurium LT2
cauaaagccuuu

SEQ ID NO: 3777163 - RNA, 21 nt, Salmonella typhimurium LT2
cauaaaggcuuuaaagcaggc

SEQ ID NO: 3777164 - RNA, 17 nt, Salmonella typhimurium LT2
cauaaaguagccaaugc

SEQ ID NO: 3777165 - RNA, 18 nt, Salmonella typhimurium LT2
cauaaagucagacaagua

SEQ ID NO: 3777166 - RNA, 20 nt, Salmonella typhimurium LT2
cauaaauaaaccgaaagggu

SEQ ID NO: 3777167 - RNA, 22 nt, Salmonella typhimurium LT2
cauaaauaaugccguuuuagcg

SEQ ID NO: 3777168 - RNA, 16 nt, Salmonella typhimurium LT2
cauaaauacguaacac

SEQ ID NO: 3777169 - RNA, 15 nt, Salmonella typhimurium LT2
cauaaauagccagca

SEQ ID NO: 3777170 - RNA, 16 nt, Salmonella typhimurium LT2
cauaaauaguggcaaa

SEQ ID NO: 3777171 - RNA, 15 nt, Salmonella typhimurium LT2
cauaaaugaucuucg

SEQ ID NO: 3777172 - RNA, 21 nt, Salmonella typhimurium LT2
cauaaaugcgaugaacaucga

SEQ ID NO: 3777173 - RNA, 17 nt, Salmonella typhimurium LT2
cauaaauugcagcgacc

SEQ ID NO: 3777174 - RNA, 23 nt, Salmonella typhimurium LT2
cauaaauuggcucagaauuuaaa

SEQ ID NO: 3777175 - RNA, 21 nt, Salmonella typhimurium LT2
cauaacaacuauuuuuccggc

SEQ ID NO: 3777176 - RNA, 16 nt, Salmonella typhimurium LT2
cauaacccuccugccu

SEQ ID NO: 3777177 - RNA, 17 nt, Salmonella typhimurium LT2
cauaacccuccugccuu

SEQ ID NO: 3777178 - RNA, 18 nt, Salmonella typhimurium LT2
cauaacccuucagcaacg

SEQ ID NO: 3777179 - RNA, 15 nt, Salmonella typhimurium LT2
cauaacgccgaugcc

SEQ ID NO: 3777180 - RNA, 20 nt, Salmonella typhimurium LT2
cauaacgcgcuggucagcag

SEQ ID NO: 3777181 - RNA, 17 nt, Salmonella typhimurium LT2
cauaacggcuacgcagc

SEQ ID NO: 3777182 - RNA, 18 nt, Salmonella typhimurium LT2
cauaacggcuacgcagcg

SEQ ID NO: 3777183 - RNA, 15 nt, Salmonella typhimurium LT2
cauaacggcugucca

SEQ ID NO: 3777184 - RNA, 23 nt, Salmonella typhimurium LT2
cauaacgggguauaacucagcgg

SEQ ID NO: 3777185 - RNA, 18 nt, Salmonella typhimurium LT2
cauaacgugccaucuuug

SEQ ID NO: 3777186 - RNA, 19 nt, Salmonella typhimurium LT2
cauaacguuguggaaugcc

SEQ ID NO: 3777187 - RNA, 14 nt, Salmonella typhimurium LT2
cauaacuugccgcc

SEQ ID NO: 3777188 - RNA, 15 nt, Salmonella typhimurium LT2
cauaacuugccgccu

SEQ ID NO: 3777189 - RNA, 20 nt, Salmonella typhimurium LT2
cauaagagauggaaugagca

SEQ ID NO: 3777190 - RNA, 21 nt, Salmonella typhimurium LT2
cauaagagauggaaugagcau

SEQ ID NO: 3777191 - RNA, 22 nt, Salmonella typhimurium LT2
cauaagcaaacagggggaagca

SEQ ID NO: 3777192 - RNA, 14 nt, Salmonella typhimurium LT2
cauaagcaauaggu

SEQ ID NO: 3777193 - RNA, 14 nt, Salmonella typhimurium LT2
cauaagccagcccu

SEQ ID NO: 3777194 - RNA, 22 nt, Salmonella typhimurium LT2
cauaagccgcguucugucgaua

SEQ ID NO: 3777195 - RNA, 13 nt, Salmonella typhimurium LT2
cauaagcgcgaau

SEQ ID NO: 3777196 - RNA, 14 nt, Salmonella typhimurium LT2
cauaagcgcggcgg

SEQ ID NO: 3777197 - RNA, 15 nt, Salmonella typhimurium LT2
cauaagcgcggcgga

SEQ ID NO: 3777198 - RNA, 14 nt, Salmonella typhimurium LT2
cauaauaaaaauac

SEQ ID NO: 3777199 - RNA, 17 nt, Salmonella typhimurium LT2
cauaauaaacugcaucc

SEQ ID NO: 3777200 - RNA, 14 nt, Salmonella typhimurium LT2
cauaauauccugca

SEQ ID NO: 3777201 - RNA, 21 nt, Salmonella typhimurium LT2
cauaaugauggggucacaggu

SEQ ID NO: 3777202 - RNA, 22 nt, Salmonella typhimurium LT2
cauaaugauggggucacagguu

SEQ ID NO: 3777203 - RNA, 18 nt, Salmonella typhimurium LT2
cauaaugauuguccagcc

SEQ ID NO: 3777204 - RNA, 14 nt, Salmonella typhimurium LT2
cauaaugcugccag

SEQ ID NO: 3777205 - RNA, 22 nt, Salmonella typhimurium LT2
cauaaugcugccagcaugauaa

SEQ ID NO: 3777206 - RNA, 14 nt, Salmonella typhimurium LT2
cauaauggaacugc

SEQ ID NO: 3777207 - RNA, 22 nt, Salmonella typhimurium LT2
cauaauggaacugccuggcuca

SEQ ID NO: 3777208 - RNA, 14 nt, Salmonella typhimurium LT2
cauaauggcccagc

SEQ ID NO: 3777209 - RNA, 14 nt, Salmonella typhimurium LT2
cauaaugucccugc

SEQ ID NO: 3777210 - RNA, 22 nt, Salmonella typhimurium LT2
cauaaugugaugcagacgggcg

SEQ ID NO: 3777211 - RNA, 20 nt, Salmonella typhimurium LT2
cauaauugcugcccgccgcc

SEQ ID NO: 3777212 - RNA, 21 nt, Salmonella typhimurium LT2
cauaauugcugcccgccgcca

SEQ ID NO: 3777213 - RNA, 20 nt, Salmonella typhimurium LT2
cauacacauucaggcuggca

SEQ ID NO: 3777214 - RNA, 24 nt, Salmonella typhimurium LT2
cauacacgccgggcacgcugacca

SEQ ID NO: 3777215 - RNA, 19 nt, Salmonella typhimurium LT2
cauacacugcauaaauauc

SEQ ID NO: 3777216 - RNA, 15 nt, Salmonella typhimurium LT2
cauacagcacuuccc

SEQ ID NO: 3777217 - RNA, 13 nt, Salmonella typhimurium LT2
cauacagcccgcg

SEQ ID NO: 3777218 - RNA, 14 nt, Salmonella typhimurium LT2
cauacauaaauccg

SEQ ID NO: 3777219 - RNA, 15 nt, Salmonella typhimurium LT2
cauacauacauacca

SEQ ID NO: 3777220 - RNA, 16 nt, Salmonella typhimurium LT2
cauaccacaacagaau

SEQ ID NO: 3777221 - RNA, 12 nt, Salmonella typhimurium LT2
cauaccagcgaa

SEQ ID NO: 3777222 - RNA, 19 nt, Salmonella typhimurium LT2
cauaccagcgaaaugcgaa

SEQ ID NO: 3777223 - RNA, 15 nt, Salmonella typhimurium LT2
cauaccaggcgcacc

SEQ ID NO: 3777224 - RNA, 23 nt, Salmonella typhimurium LT2
cauacccgcuuaccgcggucacc

SEQ ID NO: 3777225 - RNA, 23 nt, Salmonella typhimurium LT2
cauacccuuccaguugcgucagc

SEQ ID NO: 3777226 - RNA, 22 nt, Salmonella typhimurium LT2
cauacccuuccccaucaaaacu

SEQ ID NO: 3777227 - RNA, 15 nt, Salmonella typhimurium LT2
cauaccgaacagaaa

SEQ ID NO: 3777228 - RNA, 15 nt, Salmonella typhimurium LT2
cauaccgccaaucaa

SEQ ID NO: 3777229 - RNA, 14 nt, Salmonella typhimurium LT2
cauaccggugcgcc

SEQ ID NO: 3777230 - RNA, 15 nt, Salmonella typhimurium LT2
cauaccggugcgccc

SEQ ID NO: 3777231 - RNA, 19 nt, Salmonella typhimurium LT2
cauaccgguguagcuggca

SEQ ID NO: 3777232 - RNA, 15 nt, Salmonella typhimurium LT2
cauaccgucagauuc

SEQ ID NO: 3777233 - RNA, 12 nt, Salmonella typhimurium LT2
cauaccuccucu

SEQ ID NO: 3777234 - RNA, 17 nt, Salmonella typhimurium LT2
cauacgccacgcuccag

SEQ ID NO: 3777235 - RNA, 21 nt, Salmonella typhimurium LT2
cauacgcccacgcggcguacg

SEQ ID NO: 3777236 - RNA, 20 nt, Salmonella typhimurium LT2
cauacgggcaugaagaaaau

SEQ ID NO: 3777237 - RNA, 23 nt, Salmonella typhimurium LT2
cauacgggcaugaagaaaauacu

SEQ ID NO: 3777238 - RNA, 11 nt, Salmonella typhimurium LT2
cauacgggcuu

SEQ ID NO: 3777239 - RNA, 19 nt, Salmonella typhimurium LT2
cauacggguaaaggcauua

SEQ ID NO: 3777240 - RNA, 23 nt, Salmonella typhimurium LT2
cauacggucaaacagauccagcg

SEQ ID NO: 3777241 - RNA, 12 nt, Salmonella typhimurium LT2
cauacuauuucc

SEQ ID NO: 3777242 - RNA, 21 nt, Salmonella typhimurium LT2
cauacucacauucauaaaaga

SEQ ID NO: 3777243 - RNA, 23 nt, Salmonella typhimurium LT2
cauacucacauucauaaaagauc

SEQ ID NO: 3777244 - RNA, 15 nt, Salmonella typhimurium LT2
cauacucuccuccau

SEQ ID NO: 3777245 - RNA, 21 nt, Salmonella typhimurium LT2
cauacucuuggagagcaucau

SEQ ID NO: 3777246 - RNA, 15 nt, Salmonella typhimurium LT2
cauacugaagauaaa

SEQ ID NO: 3777247 - RNA, 16 nt, Salmonella typhimurium LT2
cauacugacggcgcuc

SEQ ID NO: 3777248 - RNA, 19 nt, Salmonella typhimurium LT2
cauacugauuucggaauga

SEQ ID NO: 3777249 - RNA, 14 nt, Salmonella typhimurium LT2
cauacugcccagcc

SEQ ID NO: 3777250 - RNA, 23 nt, Salmonella typhimurium LT2
cauacuggcgaugauacccugaa

SEQ ID NO: 3777251 - RNA, 13 nt, Salmonella typhimurium LT2
cauacuguugguc

SEQ ID NO: 3777252 - RNA, 15 nt, Salmonella typhimurium LT2
cauacuuacugcugu

SEQ ID NO: 3777253 - RNA, 16 nt, Salmonella typhimurium LT2
cauacuuacugcuguc

SEQ ID NO: 3777254 - RNA, 15 nt, Salmonella typhimurium LT2
cauacuuccucaccg

SEQ ID NO: 3777255 - RNA, 19 nt, Salmonella typhimurium LT2
cauacuuuaccggcccuuc

SEQ ID NO: 3777256 - RNA, 17 nt, Salmonella typhimurium LT2
cauagaaccacuuauuu

SEQ ID NO: 3777257 - RNA, 20 nt, Salmonella typhimurium LT2
cauagauaacuaugugcccg

SEQ ID NO: 3777258 - RNA, 19 nt, Salmonella typhimurium LT2
cauagaugguugcaugauu

SEQ ID NO: 3777259 - RNA, 13 nt, Salmonella typhimurium LT2
cauagcaucacca

SEQ ID NO: 3777260 - RNA, 14 nt, Salmonella typhimurium LT2
cauagcaucguuac

SEQ ID NO: 3777261 - RNA, 16 nt, Salmonella typhimurium LT2
cauagccaguggaaca

SEQ ID NO: 3777262 - RNA, 15 nt, Salmonella typhimurium LT2
cauagccgcgcguca

SEQ ID NO: 3777263 - RNA, 18 nt, Salmonella typhimurium LT2
cauagcgcacaacgucag

SEQ ID NO: 3777264 - RNA, 19 nt, Salmonella typhimurium LT2
cauagcgggcagcauugac

SEQ ID NO: 3777265 - RNA, 18 nt, Salmonella typhimurium LT2
cauagcgucaucaacaua

SEQ ID NO: 3777266 - RNA, 16 nt, Salmonella typhimurium LT2
cauagcguugauaugc

SEQ ID NO: 3777267 - RNA, 18 nt, Salmonella typhimurium LT2
cauagcugaauaaaaaau

SEQ ID NO: 3777268 - RNA, 22 nt, Salmonella typhimurium LT2
cauaggcgacaggcgugauagc

SEQ ID NO: 3777269 - RNA, 21 nt, Salmonella typhimurium LT2
cauagucgugcggguucaucc

SEQ ID NO: 3777270 - RNA, 21 nt, Salmonella typhimurium LT2
cauagugagcgacuucaaaaa

SEQ ID NO: 3777271 - RNA, 15 nt, Salmonella typhimurium LT2
cauaguuauuaacau

SEQ ID NO: 3777272 - RNA, 15 nt, Salmonella typhimurium LT2
cauaguuugcauaac

SEQ ID NO: 3777273 - RNA, 15 nt, Salmonella typhimurium LT2
cauaguuuuccagcc

SEQ ID NO: 3777274 - RNA, 12 nt, Salmonella typhimurium LT2
cauauaacagaa

SEQ ID NO: 3777275 - RNA, 16 nt, Salmonella typhimurium LT2
cauauaacuuucaaua

SEQ ID NO: 3777276 - RNA, 13 nt, Salmonella typhimurium LT2
cauauaauccugc

SEQ ID NO: 3777277 - RNA, 19 nt, Salmonella typhimurium LT2
cauauaccgcaccugggua

SEQ ID NO: 3777278 - RNA, 15 nt, Salmonella typhimurium LT2
cauauaugaaaucgc

SEQ ID NO: 3777279 - RNA, 22 nt, Salmonella typhimurium LT2
cauauauuccgggucguccuga

SEQ ID NO: 3777280 - RNA, 22 nt, Salmonella typhimurium LT2
cauaucaauauguuccggcguc

SEQ ID NO: 3777281 - RNA, 14 nt, Salmonella typhimurium LT2
cauaucaaucaacg

SEQ ID NO: 3777282 - RNA, 18 nt, Salmonella typhimurium LT2
cauaucaaucaacgguuc

SEQ ID NO: 3777283 - RNA, 20 nt, Salmonella typhimurium LT2
cauaucaguuaugacagaca

SEQ ID NO: 3777284 - RNA, 15 nt, Salmonella typhimurium LT2
cauauccaagccccu

SEQ ID NO: 3777285 - RNA, 12 nt, Salmonella typhimurium LT2
cauauccagcgc

SEQ ID NO: 3777286 - RNA, 22 nt, Salmonella typhimurium LT2
cauaucgaccuuuuucgcgccc

SEQ ID NO: 3777287 - RNA, 23 nt, Salmonella typhimurium LT2
cauaucgcaguugauacauuuuu

SEQ ID NO: 3777288 - RNA, 18 nt, Salmonella typhimurium LT2
cauaucgccauucacggc

SEQ ID NO: 3777289 - RNA, 23 nt, Salmonella typhimurium LT2
cauaucgucaucggucaguuugc

SEQ ID NO: 3777290 - RNA, 15 nt, Salmonella typhimurium LT2
cauaucugcgccgcc

SEQ ID NO: 3777291 - RNA, 21 nt, Salmonella typhimurium LT2
cauaucuguuuggcaagggua

SEQ ID NO: 3777292 - RNA, 22 nt, Salmonella typhimurium LT2
cauaugaguuauguauuuaauu

SEQ ID NO: 3777293 - RNA, 13 nt, Salmonella typhimurium LT2
cauaugcgcggcg

SEQ ID NO: 3777294 - RNA, 17 nt, Salmonella typhimurium LT2
cauauggcguuccgguu

SEQ ID NO: 3777295 - RNA, 20 nt, Salmonella typhimurium LT2
cauauucauaucgaagccca

SEQ ID NO: 3777296 - RNA, 13 nt, Salmonella typhimurium LT2
cauauucaugguu

SEQ ID NO: 3777297 - RNA, 20 nt, Salmonella typhimurium LT2
cauauuccagaagcgcuuug

SEQ ID NO: 3777298 - RNA, 15 nt, Salmonella typhimurium LT2
cauauucgccaccgc

SEQ ID NO: 3777299 - RNA, 14 nt, Salmonella typhimurium LT2
cauauugccgcaca

SEQ ID NO: 3777300 - RNA, 17 nt, Salmonella typhimurium LT2
cauauuguaccugccgc

SEQ ID NO: 3777301 - RNA, 22 nt, Salmonella typhimurium LT2
cauauuguauuggucuaucgcu

SEQ ID NO: 3777302 - RNA, 22 nt, Salmonella typhimurium LT2
cauauuuaucuaagaauuuaau

SEQ ID NO: 3777303 - RNA, 17 nt, Salmonella typhimurium LT2
cauauuucaagccgcag

SEQ ID NO: 3777304 - RNA, 21 nt, Salmonella typhimurium LT2
cauauuuucaacggcaucaau

SEQ ID NO: 3777305 - RNA, 23 nt, Salmonella typhimurium LT2
cauauuuuucuaaugucagcuca

SEQ ID NO: 3777306 - RNA, 14 nt, Salmonella typhimurium LT2
caucaaaauuaccu

SEQ ID NO: 3777307 - RNA, 18 nt, Salmonella typhimurium LT2
caucaaaauuaccuuuac

SEQ ID NO: 3777308 - RNA, 15 nt, Salmonella typhimurium LT2
caucaaagaaaacca

SEQ ID NO: 3777309 - RNA, 20 nt, Salmonella typhimurium LT2
caucaaauaauacgccggca

SEQ ID NO: 3777310 - RNA, 23 nt, Salmonella typhimurium LT2
caucaaauacgcgcgccgccugc

SEQ ID NO: 3777311 - RNA, 20 nt, Salmonella typhimurium LT2
caucaacuccggacguaccc

SEQ ID NO: 3777312 - RNA, 22 nt, Salmonella typhimurium LT2
caucaagcaugaggguuguuuu

SEQ ID NO: 3777313 - RNA, 16 nt, Salmonella typhimurium LT2
caucaauaaagccgca

SEQ ID NO: 3777314 - RNA, 23 nt, Salmonella typhimurium LT2
caucaauaauauacuggaagcua

SEQ ID NO: 3777315 - RNA, 18 nt, Salmonella typhimurium LT2
caucaauaauccggcaau

SEQ ID NO: 3777316 - RNA, 18 nt, Salmonella typhimurium LT2
caucaauacccggccccu

SEQ ID NO: 3777317 - RNA, 22 nt, Salmonella typhimurium LT2
caucaauaccggucggcaaauc

SEQ ID NO: 3777318 - RNA, 16 nt, Salmonella typhimurium LT2
caucaauaccguccag

SEQ ID NO: 3777319 - RNA, 14 nt, Salmonella typhimurium LT2
caucaauauuggug

SEQ ID NO: 3777320 - RNA, 13 nt, Salmonella typhimurium LT2
caucaaucaccuu

SEQ ID NO: 3777321 - RNA, 19 nt, Salmonella typhimurium LT2
caucaauggcgauuuuuag

SEQ ID NO: 3777322 - RNA, 17 nt, Salmonella typhimurium LT2
caucacaaaaucauugc

SEQ ID NO: 3777323 - RNA, 16 nt, Salmonella typhimurium LT2
caucacagccacacug

SEQ ID NO: 3777324 - RNA, 18 nt, Salmonella typhimurium LT2
caucacagccacacugcu

SEQ ID NO: 3777325 - RNA, 19 nt, Salmonella typhimurium LT2
caucacagccacacugcug

SEQ ID NO: 3777326 - RNA, 21 nt, Salmonella typhimurium LT2
caucacaugcggaagcaaaau

SEQ ID NO: 3777327 - RNA, 19 nt, Salmonella typhimurium LT2
caucacauguagcgcggca

SEQ ID NO: 3777328 - RNA, 21 nt, Salmonella typhimurium LT2
caucaccuccagcacgcgcug

SEQ ID NO: 3777329 - RNA, 19 nt, Salmonella typhimurium LT2
caucaccugaugucccauc

SEQ ID NO: 3777330 - RNA, 16 nt, Salmonella typhimurium LT2
caucaccuggcaacau

SEQ ID NO: 3777331 - RNA, 22 nt, Salmonella typhimurium LT2
caucacgcaaaugcagcggaau

SEQ ID NO: 3777332 - RNA, 16 nt, Salmonella typhimurium LT2
caucacggcagcaccg

SEQ ID NO: 3777333 - RNA, 19 nt, Salmonella typhimurium LT2
caucacguucgcgcauacc

SEQ ID NO: 3777334 - RNA, 20 nt, Salmonella typhimurium LT2
caucacuacggguucuugug

SEQ ID NO: 3777335 - RNA, 16 nt, Salmonella typhimurium LT2
caucacuggcguauug

SEQ ID NO: 3777336 - RNA, 19 nt, Salmonella typhimurium LT2
caucacuucgcgcauugcg

SEQ ID NO: 3777337 - RNA, 15 nt, Salmonella typhimurium LT2
caucacuuuuggcga

SEQ ID NO: 3777338 - RNA, 21 nt, Salmonella typhimurium LT2
caucagaaaaaagccaagcac

SEQ ID NO: 3777339 - RNA, 17 nt, Salmonella typhimurium LT2
caucagaaugcugguca

SEQ ID NO: 3777340 - RNA, 21 nt, Salmonella typhimurium LT2
caucagaccgagacccagcgc

SEQ ID NO: 3777341 - RNA, 17 nt, Salmonella typhimurium LT2
caucagaccgauaaaua

SEQ ID NO: 3777342 - RNA, 17 nt, Salmonella typhimurium LT2
caucagaccgccaagcg

SEQ ID NO: 3777343 - RNA, 15 nt, Salmonella typhimurium LT2
caucagacuguaugu

SEQ ID NO: 3777344 - RNA, 19 nt, Salmonella typhimurium LT2
caucagauggcgauucaua

SEQ ID NO: 3777345 - RNA, 16 nt, Salmonella typhimurium LT2
caucagauucaacagg

SEQ ID NO: 3777346 - RNA, 23 nt, Salmonella typhimurium LT2
caucagcaauuucucgcccgcca

SEQ ID NO: 3777347 - RNA, 14 nt, Salmonella typhimurium LT2
caucagcacaaaau

SEQ ID NO: 3777348 - RNA, 18 nt, Salmonella typhimurium LT2
caucagcacaaaauccca

SEQ ID NO: 3777349 - RNA, 16 nt, Salmonella typhimurium LT2
caucagccagcagcuc

SEQ ID NO: 3777350 - RNA, 17 nt, Salmonella typhimurium LT2
caucagccagcagcuca

SEQ ID NO: 3777351 - RNA, 12 nt, Salmonella typhimurium LT2
caucagccaggc

SEQ ID NO: 3777352 - RNA, 22 nt, Salmonella typhimurium LT2
caucagcccuaucgcugcgcug

SEQ ID NO: 3777353 - RNA, 15 nt, Salmonella typhimurium LT2
caucagccugaaaga

SEQ ID NO: 3777354 - RNA, 15 nt, Salmonella typhimurium LT2
caucagcgccggauc

SEQ ID NO: 3777355 - RNA, 18 nt, Salmonella typhimurium LT2
caucagcgcuaccagcgc

SEQ ID NO: 3777356 - RNA, 18 nt, Salmonella typhimurium LT2
caucagcgucagcaccag

SEQ ID NO: 3777357 - RNA, 20 nt, Salmonella typhimurium LT2
caucaggaaaugaaccagau

SEQ ID NO: 3777358 - RNA, 12 nt, Salmonella typhimurium LT2
caucaggcaacc

SEQ ID NO: 3777359 - RNA, 13 nt, Salmonella typhimurium LT2
caucaggcaaccc

SEQ ID NO: 3777360 - RNA, 23 nt, Salmonella typhimurium LT2
caucaggcaugaccugccggaug

SEQ ID NO: 3777361 - RNA, 20 nt, Salmonella typhimurium LT2
caucaggugaguaaauaaaa

SEQ ID NO: 3777362 - RNA, 13 nt, Salmonella typhimurium LT2
caucagucucaaa

SEQ ID NO: 3777363 - RNA, 21 nt, Salmonella typhimurium LT2
caucaguucagggcuaacgcc

SEQ ID NO: 3777364 - RNA, 16 nt, Salmonella typhimurium LT2
caucauaaauggcuga

SEQ ID NO: 3777365 - RNA, 16 nt, Salmonella typhimurium LT2
caucauaauccuuauu

SEQ ID NO: 3777366 - RNA, 19 nt, Salmonella typhimurium LT2
caucaucaucggcacagcc

SEQ ID NO: 3777367 - RNA, 12 nt, Salmonella typhimurium LT2
caucaucgccaa

SEQ ID NO: 3777368 - RNA, 12 nt, Salmonella typhimurium LT2
caucaucgccag

SEQ ID NO: 3777369 - RNA, 21 nt, Salmonella typhimurium LT2
caucaucgccagcuuaucgac

SEQ ID NO: 3777370 - RNA, 22 nt, Salmonella typhimurium LT2
caucaucgcuggugugcagcca

SEQ ID NO: 3777371 - RNA, 19 nt, Salmonella typhimurium LT2
caucaucggcacagccagu

SEQ ID NO: 3777372 - RNA, 16 nt, Salmonella typhimurium LT2
caucaucgucgcgccc

SEQ ID NO: 3777373 - RNA, 19 nt, Salmonella typhimurium LT2
caucaucugccauuucugc

SEQ ID NO: 3777374 - RNA, 20 nt, Salmonella typhimurium LT2
caucaucuuguccucaucau

SEQ ID NO: 3777375 - RNA, 21 nt, Salmonella typhimurium LT2
caucaucuuguccucaucauu

SEQ ID NO: 3777376 - RNA, 19 nt, Salmonella typhimurium LT2
caucaugacacuuuauucu

SEQ ID NO: 3777377 - RNA, 22 nt, Salmonella typhimurium LT2
caucaugacacuuuauucucug

SEQ ID NO: 3777378 - RNA, 23 nt, Salmonella typhimurium LT2
caucaugaugaucuucagcccgu

SEQ ID NO: 3777379 - RNA, 18 nt, Salmonella typhimurium LT2
caucaugccagccgacag

SEQ ID NO: 3777380 - RNA, 17 nt, Salmonella typhimurium LT2
caucaugcccacaggca

SEQ ID NO: 3777381 - RNA, 16 nt, Salmonella typhimurium LT2
caucauggcauacagc

SEQ ID NO: 3777382 - RNA, 17 nt, Salmonella typhimurium LT2
caucaugucacccacgc

SEQ ID NO: 3777383 - RNA, 14 nt, Salmonella typhimurium LT2
caucauuaauauaa

SEQ ID NO: 3777384 - RNA, 18 nt, Salmonella typhimurium LT2
caucauuaauauaauccu

SEQ ID NO: 3777385 - RNA, 22 nt, Salmonella typhimurium LT2
caucauuaccuacgcgauaaaa

SEQ ID NO: 3777386 - RNA, 23 nt, Salmonella typhimurium LT2
caucauuaccuuuuccggcggca

SEQ ID NO: 3777387 - RNA, 20 nt, Salmonella typhimurium LT2
caucauuacugcuuagcugu

SEQ ID NO: 3777388 - RNA, 15 nt, Salmonella typhimurium LT2
caucauucaacgcau

SEQ ID NO: 3777389 - RNA, 19 nt, Salmonella typhimurium LT2
caucauucaacgcaucaaa

SEQ ID NO: 3777390 - RNA, 15 nt, Salmonella typhimurium LT2
caucauucauccaga

SEQ ID NO: 3777391 - RNA, 14 nt, Salmonella typhimurium LT2
caucauucccauug

SEQ ID NO: 3777392 - RNA, 22 nt, Salmonella typhimurium LT2
caucauucgguuaggaauagca

SEQ ID NO: 3777393 - RNA, 17 nt, Salmonella typhimurium LT2
caucauugauacuguac

SEQ ID NO: 3777394 - RNA, 14 nt, Salmonella typhimurium LT2
caucauugcuguua

SEQ ID NO: 3777395 - RNA, 20 nt, Salmonella typhimurium LT2
caucauugucacuauucuua

SEQ ID NO: 3777396 - RNA, 21 nt, Salmonella typhimurium LT2
caucauuuccggcggcaaccc

SEQ ID NO: 3777397 - RNA, 15 nt, Salmonella typhimurium LT2
caucauuuucccacu

SEQ ID NO: 3777398 - RNA, 16 nt, Salmonella typhimurium LT2
caucauuuucccacug

SEQ ID NO: 3777399 - RNA, 12 nt, Salmonella typhimurium LT2
caucauuuuuau

SEQ ID NO: 3777400 - RNA, 17 nt, Salmonella typhimurium LT2
cauccaacugcgccuga

SEQ ID NO: 3777401 - RNA, 21 nt, Salmonella typhimurium LT2
cauccaacuuaugaaaaccug

SEQ ID NO: 3777402 - RNA, 17 nt, Salmonella typhimurium LT2
cauccaccaggcaugca

SEQ ID NO: 3777403 - RNA, 17 nt, Salmonella typhimurium LT2
cauccacgccagcuugg

SEQ ID NO: 3777404 - RNA, 17 nt, Salmonella typhimurium LT2
cauccacggcaucaaua

SEQ ID NO: 3777405 - RNA, 15 nt, Salmonella typhimurium LT2
cauccacguaaauag

SEQ ID NO: 3777406 - RNA, 19 nt, Salmonella typhimurium LT2
cauccagacaugcacaugg

SEQ ID NO: 3777407 - RNA, 11 nt, Salmonella typhimurium LT2
cauccagacca

SEQ ID NO: 3777408 - RNA, 16 nt, Salmonella typhimurium LT2
cauccagaccugagcc

SEQ ID NO: 3777409 - RNA, 14 nt, Salmonella typhimurium LT2
cauccagagcaguc

SEQ ID NO: 3777410 - RNA, 14 nt, Salmonella typhimurium LT2
cauccagaucggca

SEQ ID NO: 3777411 - RNA, 19 nt, Salmonella typhimurium LT2
cauccagauguagcgcggu

SEQ ID NO: 3777412 - RNA, 22 nt, Salmonella typhimurium LT2
cauccagcacagguacaggccg

SEQ ID NO: 3777413 - RNA, 15 nt, Salmonella typhimurium LT2
cauccagcaccaggc

SEQ ID NO: 3777414 - RNA, 16 nt, Salmonella typhimurium LT2
cauccagcgcgcggca

SEQ ID NO: 3777415 - RNA, 14 nt, Salmonella typhimurium LT2
cauccagcucaugu

SEQ ID NO: 3777416 - RNA, 22 nt, Salmonella typhimurium LT2
cauccagcuugccgucgcaggc

SEQ ID NO: 3777417 - RNA, 21 nt, Salmonella typhimurium LT2
cauccaggaaguaaauuauuc

SEQ ID NO: 3777418 - RNA, 22 nt, Salmonella typhimurium LT2
cauccaggguuuaaucacgcca

SEQ ID NO: 3777419 - RNA, 15 nt, Salmonella typhimurium LT2
cauccagucagcaau

SEQ ID NO: 3777420 - RNA, 18 nt, Salmonella typhimurium LT2
cauccaguuguuuauucc

SEQ ID NO: 3777421 - RNA, 19 nt, Salmonella typhimurium LT2
cauccaguuguuuauucca

SEQ ID NO: 3777422 - RNA, 15 nt, Salmonella typhimurium LT2
cauccaucacuccuu

SEQ ID NO: 3777423 - RNA, 23 nt, Salmonella typhimurium LT2
cauccaugccaagcggcaucucg

SEQ ID NO: 3777424 - RNA, 18 nt, Salmonella typhimurium LT2
cauccauguacuccuggu

SEQ ID NO: 3777425 - RNA, 10 nt, Salmonella typhimurium LT2
caucccagac

SEQ ID NO: 3777426 - RNA, 18 nt, Salmonella typhimurium LT2
caucccaggagauaucaa

SEQ ID NO: 3777427 - RNA, 23 nt, Salmonella typhimurium LT2
caucccauccgggccacucucca

SEQ ID NO: 3777428 - RNA, 20 nt, Salmonella typhimurium LT2
caucccaugcaccagcccca

SEQ ID NO: 3777429 - RNA, 14 nt, Salmonella typhimurium LT2
cauccccggcgccc

SEQ ID NO: 3777430 - RNA, 21 nt, Salmonella typhimurium LT2
caucccgauaauggcgccgau

SEQ ID NO: 3777431 - RNA, 21 nt, Salmonella typhimurium LT2
caucccgauuucgcuccacug

SEQ ID NO: 3777432 - RNA, 14 nt, Salmonella typhimurium LT2
caucccguagcguc

SEQ ID NO: 3777433 - RNA, 14 nt, Salmonella typhimurium LT2
caucccugauuuau

SEQ ID NO: 3777434 - RNA, 15 nt, Salmonella typhimurium LT2
caucccuuucauuuu

SEQ ID NO: 3777435 - RNA, 19 nt, Salmonella typhimurium LT2
cauccgcaagacacgcuuc

SEQ ID NO: 3777436 - RNA, 15 nt, Salmonella typhimurium LT2
cauccgccagcgccu

SEQ ID NO: 3777437 - RNA, 20 nt, Salmonella typhimurium LT2
cauccgcccgacaucaaacu

SEQ ID NO: 3777438 - RNA, 20 nt, Salmonella typhimurium LT2
cauccgccgagggcauugau

SEQ ID NO: 3777439 - RNA, 15 nt, Salmonella typhimurium LT2
cauccgcucccgcuu

SEQ ID NO: 3777440 - RNA, 20 nt, Salmonella typhimurium LT2
cauccggcaaaaugcccggc

SEQ ID NO: 3777441 - RNA, 21 nt, Salmonella typhimurium LT2
cauccggcaauuccgcaucag

SEQ ID NO: 3777442 - RNA, 17 nt, Salmonella typhimurium LT2
cauccggcaauuuauac

SEQ ID NO: 3777443 - RNA, 20 nt, Salmonella typhimurium LT2
cauccggcaauuuauaccgc

SEQ ID NO: 3777444 - RNA, 13 nt, Salmonella typhimurium LT2
cauccggcacagu

SEQ ID NO: 3777445 - RNA, 21 nt, Salmonella typhimurium LT2
cauccggcacgccaucgccug

SEQ ID NO: 3777446 - RNA, 16 nt, Salmonella typhimurium LT2
cauccggcacggucaa

SEQ ID NO: 3777447 - RNA, 15 nt, Salmonella typhimurium LT2
cauccggcauuuuuu

SEQ ID NO: 3777448 - RNA, 23 nt, Salmonella typhimurium LT2
cauccggcauuuuuuaugcccgc

SEQ ID NO: 3777449 - RNA, 22 nt, Salmonella typhimurium LT2
cauccggccuggcgcaacguuu

SEQ ID NO: 3777450 - RNA, 14 nt, Salmonella typhimurium LT2
cauccggccuguuc

SEQ ID NO: 3777451 - RNA, 23 nt, Salmonella typhimurium LT2
cauccggcgcugugcggcgugca

SEQ ID NO: 3777452 - RNA, 23 nt, Salmonella typhimurium LT2
cauccggcguguaaaccgccaga

SEQ ID NO: 3777453 - RNA, 18 nt, Salmonella typhimurium LT2
cauccgggccaacggcau

SEQ ID NO: 3777454 - RNA, 18 nt, Salmonella typhimurium LT2
cauccggguuaaaccagc

SEQ ID NO: 3777455 - RNA, 15 nt, Salmonella typhimurium LT2
cauccgugaccugcu

SEQ ID NO: 3777456 - RNA, 22 nt, Salmonella typhimurium LT2
cauccucauuuuguugcuccag

SEQ ID NO: 3777457 - RNA, 21 nt, Salmonella typhimurium LT2
cauccucuuggguuauuucga

SEQ ID NO: 3777458 - RNA, 13 nt, Salmonella typhimurium LT2
cauccugcaaaag

SEQ ID NO: 3777459 - RNA, 20 nt, Salmonella typhimurium LT2
cauccugcaaaaggaacagu

SEQ ID NO: 3777460 - RNA, 19 nt, Salmonella typhimurium LT2
cauccugcaacucaaaaua

SEQ ID NO: 3777461 - RNA, 21 nt, Salmonella typhimurium LT2
cauccugcgccauugcgggag

SEQ ID NO: 3777462 - RNA, 17 nt, Salmonella typhimurium LT2
cauccuguagcagugga

SEQ ID NO: 3777463 - RNA, 15 nt, Salmonella typhimurium LT2
cauccuguucaagca

SEQ ID NO: 3777464 - RNA, 19 nt, Salmonella typhimurium LT2
cauccuguuuuuucagcgc

SEQ ID NO: 3777465 - RNA, 19 nt, Salmonella typhimurium LT2
cauccuuuacgcugccucu

SEQ ID NO: 3777466 - RNA, 23 nt, Salmonella typhimurium LT2
cauccuuuacuauagauauuaaa

SEQ ID NO: 3777467 - RNA, 19 nt, Salmonella typhimurium LT2
caucgacaaaggcaagauc

SEQ ID NO: 3777468 - RNA, 21 nt, Salmonella typhimurium LT2
caucgacaagcuaauccccag

SEQ ID NO: 3777469 - RNA, 14 nt, Salmonella typhimurium LT2
caucgacagcgcca

SEQ ID NO: 3777470 - RNA, 20 nt, Salmonella typhimurium LT2
caucgacaguaccagcagaa

SEQ ID NO: 3777471 - RNA, 16 nt, Salmonella typhimurium LT2
caucgacccccaccau

SEQ ID NO: 3777472 - RNA, 17 nt, Salmonella typhimurium LT2
caucgacccccaccaug

SEQ ID NO: 3777473 - RNA, 12 nt, Salmonella typhimurium LT2
caucgacgccag

SEQ ID NO: 3777474 - RNA, 15 nt, Salmonella typhimurium LT2
caucgacuuaaaaga

SEQ ID NO: 3777475 - RNA, 16 nt, Salmonella typhimurium LT2
caucgauauaagcgcc

SEQ ID NO: 3777476 - RNA, 19 nt, Salmonella typhimurium LT2
caucgauuuugaccugaau

SEQ ID NO: 3777477 - RNA, 18 nt, Salmonella typhimurium LT2
caucgcaaauucaucgcc

SEQ ID NO: 3777478 - RNA, 16 nt, Salmonella typhimurium LT2
caucgcacucuccggc

SEQ ID NO: 3777479 - RNA, 20 nt, Salmonella typhimurium LT2
caucgcauauugcguaucgu

SEQ ID NO: 3777480 - RNA, 18 nt, Salmonella typhimurium LT2
caucgcauuaacguccau

SEQ ID NO: 3777481 - RNA, 13 nt, Salmonella typhimurium LT2
caucgccaacgcc

SEQ ID NO: 3777482 - RNA, 19 nt, Salmonella typhimurium LT2
caucgccacaugcggcagg

SEQ ID NO: 3777483 - RNA, 18 nt, Salmonella typhimurium LT2
caucgccaccgcauggaa

SEQ ID NO: 3777484 - RNA, 19 nt, Salmonella typhimurium LT2
caucgccacuaccagcgua

SEQ ID NO: 3777485 - RNA, 14 nt, Salmonella typhimurium LT2
caucgcccaugaca

SEQ ID NO: 3777486 - RNA, 21 nt, Salmonella typhimurium LT2
caucgcccugauggcgcgcca

SEQ ID NO: 3777487 - RNA, 20 nt, Salmonella typhimurium LT2
caucgccgauuucuucuggc

SEQ ID NO: 3777488 - RNA, 14 nt, Salmonella typhimurium LT2
caucgccgccgagu

SEQ ID NO: 3777489 - RNA, 19 nt, Salmonella typhimurium LT2
caucgccgccuccgccgcu

SEQ ID NO: 3777490 - RNA, 14 nt, Salmonella typhimurium LT2
caucgccgcuaugc

SEQ ID NO: 3777491 - RNA, 20 nt, Salmonella typhimurium LT2
caucgccggagccgccuggc

SEQ ID NO: 3777492 - RNA, 20 nt, Salmonella typhimurium LT2
caucgcgaauuucaaucgcc

SEQ ID NO: 3777493 - RNA, 23 nt, Salmonella typhimurium LT2
caucgcgcacuucgaaacgaucg

SEQ ID NO: 3777494 - RNA, 13 nt, Salmonella typhimurium LT2
caucgcgcagcag

SEQ ID NO: 3777495 - RNA, 21 nt, Salmonella typhimurium LT2
caucgcgccgccgggcuucac

SEQ ID NO: 3777496 - RNA, 15 nt, Salmonella typhimurium LT2
caucgcgccuccccu

SEQ ID NO: 3777497 - RNA, 14 nt, Salmonella typhimurium LT2
caucgcgcuuaacu

SEQ ID NO: 3777498 - RNA, 14 nt, Salmonella typhimurium LT2
caucgcggucagcg

SEQ ID NO: 3777499 - RNA, 16 nt, Salmonella typhimurium LT2
caucgcggucagcggc

SEQ ID NO: 3777500 - RNA, 20 nt, Salmonella typhimurium LT2
caucgcggucagcggcgcgc

SEQ ID NO: 3777501 - RNA, 18 nt, Salmonella typhimurium LT2
caucgcguugcaaucgcc

SEQ ID NO: 3777502 - RNA, 15 nt, Salmonella typhimurium LT2
caucgcuaaccggcg

SEQ ID NO: 3777503 - RNA, 18 nt, Salmonella typhimurium LT2
caucgcuaaccggcggcg

SEQ ID NO: 3777504 - RNA, 14 nt, Salmonella typhimurium LT2
caucgcucaaaaca

SEQ ID NO: 3777505 - RNA, 15 nt, Salmonella typhimurium LT2
caucgcucaucagcu

SEQ ID NO: 3777506 - RNA, 15 nt, Salmonella typhimurium LT2
caucgcucgcaccuc

SEQ ID NO: 3777507 - RNA, 23 nt, Salmonella typhimurium LT2
caucgcugaauuuggcggcgcgc

SEQ ID NO: 3777508 - RNA, 20 nt, Salmonella typhimurium LT2
caucgcuggcgcgcgcgccu

SEQ ID NO: 3777509 - RNA, 20 nt, Salmonella typhimurium LT2
caucgcuggucgcuaccaca

SEQ ID NO: 3777510 - RNA, 21 nt, Salmonella typhimurium LT2
caucgcuggugugcagccagu

SEQ ID NO: 3777511 - RNA, 16 nt, Salmonella typhimurium LT2
caucgcuuagcggcuc

SEQ ID NO: 3777512 - RNA, 19 nt, Salmonella typhimurium LT2
caucgcuucuacagccacc

SEQ ID NO: 3777513 - RNA, 21 nt, Salmonella typhimurium LT2
caucgcuuuuaggcugaaagc

SEQ ID NO: 3777514 - RNA, 18 nt, Salmonella typhimurium LT2
caucggcaaacaucugcu

SEQ ID NO: 3777515 - RNA, 12 nt, Salmonella typhimurium LT2
caucggcaaacg

SEQ ID NO: 3777516 - RNA, 19 nt, Salmonella typhimurium LT2
caucggcaaacgccgccug

SEQ ID NO: 3777517 - RNA, 16 nt, Salmonella typhimurium LT2
caucggcauaacccgc

SEQ ID NO: 3777518 - RNA, 13 nt, Salmonella typhimurium LT2
caucggcaucaaa

SEQ ID NO: 3777519 - RNA, 14 nt, Salmonella typhimurium LT2
caucggcaucgguc

SEQ ID NO: 3777520 - RNA, 17 nt, Salmonella typhimurium LT2
caucggcccacgcgcag

SEQ ID NO: 3777521 - RNA, 18 nt, Salmonella typhimurium LT2
caucggccgcuaucugcu

SEQ ID NO: 3777522 - RNA, 24 nt, Salmonella typhimurium LT2
caucggcgaguuuggugcccgcgu

SEQ ID NO: 3777523 - RNA, 16 nt, Salmonella typhimurium LT2
caucggcgcgcuggcg

SEQ ID NO: 3777524 - RNA, 15 nt, Salmonella typhimurium LT2
caucggcggcaaagc

SEQ ID NO: 3777525 - RNA, 16 nt, Salmonella typhimurium LT2
caucggcggcaaugcc

SEQ ID NO: 3777526 - RNA, 22 nt, Salmonella typhimurium LT2
caucggcuucgcuggucagcgc

SEQ ID NO: 3777527 - RNA, 21 nt, Salmonella typhimurium LT2
caucgggcuguuauucagcag

SEQ ID NO: 3777528 - RNA, 22 nt, Salmonella typhimurium LT2
caucggguacggaauaucccgc

SEQ ID NO: 3777529 - RNA, 23 nt, Salmonella typhimurium LT2
caucggugacaaucucaaugcca

SEQ ID NO: 3777530 - RNA, 18 nt, Salmonella typhimurium LT2
caucgguguacggcguca

SEQ ID NO: 3777531 - RNA, 14 nt, Salmonella typhimurium LT2
caucgguucugcga

SEQ ID NO: 3777532 - RNA, 17 nt, Salmonella typhimurium LT2
caucguaccaauaccca

SEQ ID NO: 3777533 - RNA, 15 nt, Salmonella typhimurium LT2
caucguauauaccca

SEQ ID NO: 3777534 - RNA, 22 nt, Salmonella typhimurium LT2
caucguauauacccaaaauaau

SEQ ID NO: 3777535 - RNA, 21 nt, Salmonella typhimurium LT2
caucgucgccagacccagcgc

SEQ ID NO: 3777536 - RNA, 23 nt, Salmonella typhimurium LT2
caucgugauagacggcugaaugu

SEQ ID NO: 3777537 - RNA, 21 nt, Salmonella typhimurium LT2
caucguggccgauauugccuu

SEQ ID NO: 3777538 - RNA, 19 nt, Salmonella typhimurium LT2
caucgugguuaauacauca

SEQ ID NO: 3777539 - RNA, 17 nt, Salmonella typhimurium LT2
caucguuugcaguuccg

SEQ ID NO: 3777540 - RNA, 22 nt, Salmonella typhimurium LT2
caucguuuugguggcgaucaua

SEQ ID NO: 3777541 - RNA, 20 nt, Salmonella typhimurium LT2
caucuaacacaaauucgcua

SEQ ID NO: 3777542 - RNA, 13 nt, Salmonella typhimurium LT2
caucuaccagguu

SEQ ID NO: 3777543 - RNA, 16 nt, Salmonella typhimurium LT2
caucuaccuucacaca

SEQ ID NO: 3777544 - RNA, 16 nt, Salmonella typhimurium LT2
caucuacuaucaucug

SEQ ID NO: 3777545 - RNA, 17 nt, Salmonella typhimurium LT2
caucuacuaucaucuga

SEQ ID NO: 3777546 - RNA, 16 nt, Salmonella typhimurium LT2
caucuauagccugcug

SEQ ID NO: 3777547 - RNA, 17 nt, Salmonella typhimurium LT2
caucuauuauuuuucua

SEQ ID NO: 3777548 - RNA, 22 nt, Salmonella typhimurium LT2
caucucaauaucguugccgccg

SEQ ID NO: 3777549 - RNA, 14 nt, Salmonella typhimurium LT2
caucuccagcgcau

SEQ ID NO: 3777550 - RNA, 21 nt, Salmonella typhimurium LT2
caucuccagcgcauugcccuu

SEQ ID NO: 3777551 - RNA, 14 nt, Salmonella typhimurium LT2
caucucccaggccg

SEQ ID NO: 3777552 - RNA, 19 nt, Salmonella typhimurium LT2
caucucccaggccgccacc

SEQ ID NO: 3777553 - RNA, 14 nt, Salmonella typhimurium LT2
caucuccggcgacc

SEQ ID NO: 3777554 - RNA, 19 nt, Salmonella typhimurium LT2
caucuccggcgaccaauua

SEQ ID NO: 3777555 - RNA, 23 nt, Salmonella typhimurium LT2
caucuccucgcgcguuugcaaua

SEQ ID NO: 3777556 - RNA, 21 nt, Salmonella typhimurium LT2
caucuccugacugccgccggc

SEQ ID NO: 3777557 - RNA, 17 nt, Salmonella typhimurium LT2
caucuccuggucuggcu

SEQ ID NO: 3777558 - RNA, 15 nt, Salmonella typhimurium LT2
caucuccuguaauga

SEQ ID NO: 3777559 - RNA, 16 nt, Salmonella typhimurium LT2
caucucgaguaaucac

SEQ ID NO: 3777560 - RNA, 18 nt, Salmonella typhimurium LT2
caucucgguuaugaccaa

SEQ ID NO: 3777561 - RNA, 16 nt, Salmonella typhimurium LT2
caucucguuaaaacgg

SEQ ID NO: 3777562 - RNA, 15 nt, Salmonella typhimurium LT2
caucucuggcggcgu

SEQ ID NO: 3777563 - RNA, 19 nt, Salmonella typhimurium LT2
caucucuucguucaggcgu

SEQ ID NO: 3777564 - RNA, 14 nt, Salmonella typhimurium LT2
caucugaccgugag

SEQ ID NO: 3777565 - RNA, 23 nt, Salmonella typhimurium LT2
caucugaccgugaguaucgaucg

SEQ ID NO: 3777566 - RNA, 16 nt, Salmonella typhimurium LT2
caucugccauuucugc

SEQ ID NO: 3777567 - RNA, 16 nt, Salmonella typhimurium LT2
caucugcgcauauucc

SEQ ID NO: 3777568 - RNA, 22 nt, Salmonella typhimurium LT2
caucugcggcaugaauugccgu

SEQ ID NO: 3777569 - RNA, 19 nt, Salmonella typhimurium LT2
caucugcggcuuucaucau

SEQ ID NO: 3777570 - RNA, 23 nt, Salmonella typhimurium LT2
caucugcggcuuucaucauucgc

SEQ ID NO: 3777571 - RNA, 17 nt, Salmonella typhimurium LT2
caucugcggucuccuga

SEQ ID NO: 3777572 - RNA, 20 nt, Salmonella typhimurium LT2
caucugcguugcgcgcguca

SEQ ID NO: 3777573 - RNA, 23 nt, Salmonella typhimurium LT2
caucugcuucaacagcggcggca

SEQ ID NO: 3777574 - RNA, 16 nt, Salmonella typhimurium LT2
caucuggcguugccug

SEQ ID NO: 3777575 - RNA, 22 nt, Salmonella typhimurium LT2
caucugggcugacaaaaauuua

SEQ ID NO: 3777576 - RNA, 14 nt, Salmonella typhimurium LT2
caucugucaucgcc

SEQ ID NO: 3777577 - RNA, 12 nt, Salmonella typhimurium LT2
caucuuauauuu

SEQ ID NO: 3777578 - RNA, 21 nt, Salmonella typhimurium LT2
caucuucaccgaugcccagcu

SEQ ID NO: 3777579 - RNA, 16 nt, Salmonella typhimurium LT2
caucuucacgcagcgu

SEQ ID NO: 3777580 - RNA, 17 nt, Salmonella typhimurium LT2
caucuucacuucacaaa

SEQ ID NO: 3777581 - RNA, 14 nt, Salmonella typhimurium LT2
caucuucuuuuucc

SEQ ID NO: 3777582 - RNA, 21 nt, Salmonella typhimurium LT2
caucuuugcaccgcuaaaaaa

SEQ ID NO: 3777583 - RNA, 20 nt, Salmonella typhimurium LT2
caucuuuuaaaaucagauug

SEQ ID NO: 3777584 - RNA, 17 nt, Salmonella typhimurium LT2
caucuuuuugcucaagc

SEQ ID NO: 3777585 - RNA, 13 nt, Salmonella typhimurium LT2
caucuuuuuucac

SEQ ID NO: 3777586 - RNA, 13 nt, Salmonella typhimurium LT2
caugaaaacgaau

SEQ ID NO: 3777587 - RNA, 19 nt, Salmonella typhimurium LT2
caugaaauggcaugagcag

SEQ ID NO: 3777588 - RNA, 23 nt, Salmonella typhimurium LT2
caugaacguuggcgauaaggucg

SEQ ID NO: 3777589 - RNA, 23 nt, Salmonella typhimurium LT2
caugaauaucaaaccacgcugag

SEQ ID NO: 3777590 - RNA, 18 nt, Salmonella typhimurium LT2
caugaaucaucacaauua

SEQ ID NO: 3777591 - RNA, 21 nt, Salmonella typhimurium LT2
caugaaugccccagcgcugcu

SEQ ID NO: 3777592 - RNA, 19 nt, Salmonella typhimurium LT2
caugaauucaacgcccccu

SEQ ID NO: 3777593 - RNA, 17 nt, Salmonella typhimurium LT2
caugacaauaacggccu

SEQ ID NO: 3777594 - RNA, 17 nt, Salmonella typhimurium LT2
caugacacuuuauucuc

SEQ ID NO: 3777595 - RNA, 15 nt, Salmonella typhimurium LT2
caugacaucagaagu

SEQ ID NO: 3777596 - RNA, 13 nt, Salmonella typhimurium LT2
caugacauccaug

SEQ ID NO: 3777597 - RNA, 14 nt, Salmonella typhimurium LT2
caugacauccauga

SEQ ID NO: 3777598 - RNA, 16 nt, Salmonella typhimurium LT2
caugacauucccauug

SEQ ID NO: 3777599 - RNA, 14 nt, Salmonella typhimurium LT2
caugaccaccagcg

SEQ ID NO: 3777600 - RNA, 12 nt, Salmonella typhimurium LT2
caugaccagcgc

SEQ ID NO: 3777601 - RNA, 14 nt, Salmonella typhimurium LT2
caugaccagcgccg

SEQ ID NO: 3777602 - RNA, 16 nt, Salmonella typhimurium LT2
caugaccagcgccgcg

SEQ ID NO: 3777603 - RNA, 16 nt, Salmonella typhimurium LT2
caugacccagcgcgac

SEQ ID NO: 3777604 - RNA, 20 nt, Salmonella typhimurium LT2
caugacgcaggcgcaaaaaa

SEQ ID NO: 3777605 - RNA, 21 nt, Salmonella typhimurium LT2
caugacgccaagcugcagaau

SEQ ID NO: 3777606 - RNA, 15 nt, Salmonella typhimurium LT2
caugacuacgaaucg

SEQ ID NO: 3777607 - RNA, 17 nt, Salmonella typhimurium LT2
caugacuuuaccgguuu

SEQ ID NO: 3777608 - RNA, 20 nt, Salmonella typhimurium LT2
caugagauaaugcuuucgcc

SEQ ID NO: 3777609 - RNA, 18 nt, Salmonella typhimurium LT2
caugauaaucagcacgcc

SEQ ID NO: 3777610 - RNA, 19 nt, Salmonella typhimurium LT2
caugauaguaucgcugcua

SEQ ID NO: 3777611 - RNA, 21 nt, Salmonella typhimurium LT2
caugauaucgagugaaccgga

SEQ ID NO: 3777612 - RNA, 16 nt, Salmonella typhimurium LT2
caugaucauacugccg

SEQ ID NO: 3777613 - RNA, 16 nt, Salmonella typhimurium LT2
caugauccagcggaac

SEQ ID NO: 3777614 - RNA, 22 nt, Salmonella typhimurium LT2
caugauccagcggaacucauca

SEQ ID NO: 3777615 - RNA, 16 nt, Salmonella typhimurium LT2
caugaucgccgccauc

SEQ ID NO: 3777616 - RNA, 20 nt, Salmonella typhimurium LT2
caugaucuauccaauaauaa

SEQ ID NO: 3777617 - RNA, 17 nt, Salmonella typhimurium LT2
caugaugagcgccauau

SEQ ID NO: 3777618 - RNA, 15 nt, Salmonella typhimurium LT2
caugaugaucgcgau

SEQ ID NO: 3777619 - RNA, 23 nt, Salmonella typhimurium LT2
caugaugaucgcgauagcgcuga

SEQ ID NO: 3777620 - RNA, 15 nt, Salmonella typhimurium LT2
caugaugaucuucag

SEQ ID NO: 3777621 - RNA, 16 nt, Salmonella typhimurium LT2
caugaugaucuucagc

SEQ ID NO: 3777622 - RNA, 13 nt, Salmonella typhimurium LT2
caugaugccaaau

SEQ ID NO: 3777623 - RNA, 20 nt, Salmonella typhimurium LT2
caugauggcgaacagcccca

SEQ ID NO: 3777624 - RNA, 22 nt, Salmonella typhimurium LT2
caugaugggcgcacagcgccau

SEQ ID NO: 3777625 - RNA, 17 nt, Salmonella typhimurium LT2
caugauucguggcucaa

SEQ ID NO: 3777626 - RNA, 12 nt, Salmonella typhimurium LT2
caugcaccagcc

SEQ ID NO: 3777627 - RNA, 16 nt, Salmonella typhimurium LT2
caugcagcucaagcgc

SEQ ID NO: 3777628 - RNA, 20 nt, Salmonella typhimurium LT2
caugcaggacggcggcgagc

SEQ ID NO: 3777629 - RNA, 22 nt, Salmonella typhimurium LT2
caugccaagcggcaucucgcca

SEQ ID NO: 3777630 - RNA, 22 nt, Salmonella typhimurium LT2
caugccagcaguuuuucaaucu

SEQ ID NO: 3777631 - RNA, 20 nt, Salmonella typhimurium LT2
caugcccaguuuacccagcg

SEQ ID NO: 3777632 - RNA, 14 nt, Salmonella typhimurium LT2
caugcccgccagcg

SEQ ID NO: 3777633 - RNA, 17 nt, Salmonella typhimurium LT2
caugcccggacgauguc

SEQ ID NO: 3777634 - RNA, 21 nt, Salmonella typhimurium LT2
caugccgaagacuccccugca

SEQ ID NO: 3777635 - RNA, 22 nt, Salmonella typhimurium LT2
caugccgaagacuccccugcag

SEQ ID NO: 3777636 - RNA, 17 nt, Salmonella typhimurium LT2
caugccgaccagggcgu

SEQ ID NO: 3777637 - RNA, 14 nt, Salmonella typhimurium LT2
caugccgccaaacu

SEQ ID NO: 3777638 - RNA, 15 nt, Salmonella typhimurium LT2
caugccgccacuucg

SEQ ID NO: 3777639 - RNA, 18 nt, Salmonella typhimurium LT2
caugccggcuuuccgcac

SEQ ID NO: 3777640 - RNA, 22 nt, Salmonella typhimurium LT2
caugccggugcgagaaaaagca

SEQ ID NO: 3777641 - RNA, 18 nt, Salmonella typhimurium LT2
caugcgacgugucgcgua

SEQ ID NO: 3777642 - RNA, 18 nt, Salmonella typhimurium LT2
caugcgaucgggcaaucc

SEQ ID NO: 3777643 - RNA, 21 nt, Salmonella typhimurium LT2
caugcgaucgggcaauccauu

SEQ ID NO: 3777644 - RNA, 12 nt, Salmonella typhimurium LT2
caugcgcggcau

SEQ ID NO: 3777645 - RNA, 16 nt, Salmonella typhimurium LT2
caugcggaaucacgca

SEQ ID NO: 3777646 - RNA, 21 nt, Salmonella typhimurium LT2
caugcggcagaggucgccgcu

SEQ ID NO: 3777647 - RNA, 23 nt, Salmonella typhimurium LT2
caugcguccgcccagaaagauca

SEQ ID NO: 3777648 - RNA, 21 nt, Salmonella typhimurium LT2
caugcuaaaacagauaacgaa

SEQ ID NO: 3777649 - RNA, 15 nt, Salmonella typhimurium LT2
caugcuauucagcag

SEQ ID NO: 3777650 - RNA, 19 nt, Salmonella typhimurium LT2
caugcuauucagcaguuca

SEQ ID NO: 3777651 - RNA, 18 nt, Salmonella typhimurium LT2
caugcucgcuuuccauua

SEQ ID NO: 3777652 - RNA, 21 nt, Salmonella typhimurium LT2
caugcugaccgaaccgcugua

SEQ ID NO: 3777653 - RNA, 23 nt, Salmonella typhimurium LT2
caugcugauaacuaauggcauuu

SEQ ID NO: 3777654 - RNA, 12 nt, Salmonella typhimurium LT2
caugcugcaccg

SEQ ID NO: 3777655 - RNA, 21 nt, Salmonella typhimurium LT2
caugcugcaccgcaucaaacu

SEQ ID NO: 3777656 - RNA, 12 nt, Salmonella typhimurium LT2
caugcuggauga

SEQ ID NO: 3777657 - RNA, 13 nt, Salmonella typhimurium LT2
caugcuuaucgcc

SEQ ID NO: 3777658 - RNA, 13 nt, Salmonella typhimurium LT2
cauggaagaaaau

SEQ ID NO: 3777659 - RNA, 17 nt, Salmonella typhimurium LT2
cauggaagaaaauauaa

SEQ ID NO: 3777660 - RNA, 20 nt, Salmonella typhimurium LT2
cauggaguuccaguucaucu

SEQ ID NO: 3777661 - RNA, 23 nt, Salmonella typhimurium LT2
cauggcaaaacuaaacccggccu

SEQ ID NO: 3777662 - RNA, 15 nt, Salmonella typhimurium LT2
cauggcagccccggc

SEQ ID NO: 3777663 - RNA, 17 nt, Salmonella typhimurium LT2
cauggcaggcagcacaa

SEQ ID NO: 3777664 - RNA, 14 nt, Salmonella typhimurium LT2
cauggcauacagcu

SEQ ID NO: 3777665 - RNA, 18 nt, Salmonella typhimurium LT2
cauggcauacagcucguc

SEQ ID NO: 3777666 - RNA, 13 nt, Salmonella typhimurium LT2
cauggcccaaaag

SEQ ID NO: 3777667 - RNA, 21 nt, Salmonella typhimurium LT2
cauggccggucuuaugcugcc

SEQ ID NO: 3777668 - RNA, 21 nt, Salmonella typhimurium LT2
cauggcgaacucuuccagauc

SEQ ID NO: 3777669 - RNA, 21 nt, Salmonella typhimurium LT2
cauggcgaauccguugaucgu

SEQ ID NO: 3777670 - RNA, 17 nt, Salmonella typhimurium LT2
cauggcgcgacauggcg

SEQ ID NO: 3777671 - RNA, 16 nt, Salmonella typhimurium LT2
cauggcgcgcgccgcc

SEQ ID NO: 3777672 - RNA, 21 nt, Salmonella typhimurium LT2
cauggcggacggcaaccgucc

SEQ ID NO: 3777673 - RNA, 13 nt, Salmonella typhimurium LT2
cauggcggccaga

SEQ ID NO: 3777674 - RNA, 19 nt, Salmonella typhimurium LT2
cauggcggcgacaaugcuc

SEQ ID NO: 3777675 - RNA, 20 nt, Salmonella typhimurium LT2
cauggcgucggcgacuuuca

SEQ ID NO: 3777676 - RNA, 23 nt, Salmonella typhimurium LT2
cauggcgucuuuuagucacucca

SEQ ID NO: 3777677 - RNA, 17 nt, Salmonella typhimurium LT2
cauggcguuauggcaaa

SEQ ID NO: 3777678 - RNA, 20 nt, Salmonella typhimurium LT2
cauggcuauuccacccgacc

SEQ ID NO: 3777679 - RNA, 19 nt, Salmonella typhimurium LT2
caugggacgggucuccauc

SEQ ID NO: 3777680 - RNA, 21 nt, Salmonella typhimurium LT2
caugggacgggucuccaucag

SEQ ID NO: 3777681 - RNA, 22 nt, Salmonella typhimurium LT2
caugggacgggucuccaucaga

SEQ ID NO: 3777682 - RNA, 20 nt, Salmonella typhimurium LT2
caugggcgcggcgaacuggu

SEQ ID NO: 3777683 - RNA, 18 nt, Salmonella typhimurium LT2
caugggcgggauccugca

SEQ ID NO: 3777684 - RNA, 19 nt, Salmonella typhimurium LT2
caugggcgucuuaaugcuc

SEQ ID NO: 3777685 - RNA, 16 nt, Salmonella typhimurium LT2
cauggguaaagcccau

SEQ ID NO: 3777686 - RNA, 21 nt, Salmonella typhimurium LT2
cauggguaaagcccaucgcca

SEQ ID NO: 3777687 - RNA, 15 nt, Salmonella typhimurium LT2
cauggguuagauaua

SEQ ID NO: 3777688 - RNA, 15 nt, Salmonella typhimurium LT2
cauggguuugaccca

SEQ ID NO: 3777689 - RNA, 15 nt, Salmonella typhimurium LT2
caugguacucaacau

SEQ ID NO: 3777690 - RNA, 22 nt, Salmonella typhimurium LT2
caugguaggccugauaagcgca

SEQ ID NO: 3777691 - RNA, 23 nt, Salmonella typhimurium LT2
cauggucgccguccauuucaaug

SEQ ID NO: 3777692 - RNA, 20 nt, Salmonella typhimurium LT2
cauggucggacggacccuga

SEQ ID NO: 3777693 - RNA, 22 nt, Salmonella typhimurium LT2
cauggucugaacuaauugccug

SEQ ID NO: 3777694 - RNA, 24 nt, Salmonella typhimurium LT2
caugguguugguacacagcacaau

SEQ ID NO: 3777695 - RNA, 20 nt, Salmonella typhimurium LT2
caugguuacgcgacgugcug

SEQ ID NO: 3777696 - RNA, 18 nt, Salmonella typhimurium LT2
caugguugaaaaaagccg

SEQ ID NO: 3777697 - RNA, 14 nt, Salmonella typhimurium LT2
cauguaaacuccau

SEQ ID NO: 3777698 - RNA, 14 nt, Salmonella typhimurium LT2
cauguaaccaaagc

SEQ ID NO: 3777699 - RNA, 20 nt, Salmonella typhimurium LT2
cauguaaccaaagcaccauu

SEQ ID NO: 3777700 - RNA, 21 nt, Salmonella typhimurium LT2
cauguaagcuggaaccugagu

SEQ ID NO: 3777701 - RNA, 20 nt, Salmonella typhimurium LT2
cauguacgcaggcggcuggc

SEQ ID NO: 3777702 - RNA, 19 nt, Salmonella typhimurium LT2
cauguagcgcggcagcgcg

SEQ ID NO: 3777703 - RNA, 20 nt, Salmonella typhimurium LT2
caugucaaauucaagccaua

SEQ ID NO: 3777704 - RNA, 11 nt, Salmonella typhimurium LT2
caugucaaggu

SEQ ID NO: 3777705 - RNA, 17 nt, Salmonella typhimurium LT2
cauguccagaucuucac

SEQ ID NO: 3777706 - RNA, 12 nt, Salmonella typhimurium LT2
cauguccaucag

SEQ ID NO: 3777707 - RNA, 14 nt, Salmonella typhimurium LT2
cauguccccaggug

SEQ ID NO: 3777708 - RNA, 16 nt, Salmonella typhimurium LT2
caugucguuagaacca

SEQ ID NO: 3777709 - RNA, 12 nt, Salmonella typhimurium LT2
caugucuucacu

SEQ ID NO: 3777710 - RNA, 14 nt, Salmonella typhimurium LT2
caugugcagcaucc

SEQ ID NO: 3777711 - RNA, 18 nt, Salmonella typhimurium LT2
cauguucaugcgcggcgg

SEQ ID NO: 3777712 - RNA, 17 nt, Salmonella typhimurium LT2
cauguucccaugucagc

SEQ ID NO: 3777713 - RNA, 15 nt, Salmonella typhimurium LT2
cauguucgaacaugc

SEQ ID NO: 3777714 - RNA, 21 nt, Salmonella typhimurium LT2
cauguugcggguuucugaaua

SEQ ID NO: 3777715 - RNA, 15 nt, Salmonella typhimurium LT2
cauguugcgguccuu

SEQ ID NO: 3777716 - RNA, 17 nt, Salmonella typhimurium LT2
cauguugcguaaauaaa

SEQ ID NO: 3777717 - RNA, 18 nt, Salmonella typhimurium LT2
cauguugcguaaauaaau

SEQ ID NO: 3777718 - RNA, 15 nt, Salmonella typhimurium LT2
cauguuuccccuucu

SEQ ID NO: 3777719 - RNA, 17 nt, Salmonella typhimurium LT2
cauguuuccccuucugg

SEQ ID NO: 3777720 - RNA, 15 nt, Salmonella typhimurium LT2
cauuaaaaaaacaug

SEQ ID NO: 3777721 - RNA, 20 nt, Salmonella typhimurium LT2
cauuaaaaaaggcagccgaa

SEQ ID NO: 3777722 - RNA, 19 nt, Salmonella typhimurium LT2
cauuaacccggccccgaca

SEQ ID NO: 3777723 - RNA, 17 nt, Salmonella typhimurium LT2
cauuaaccuugcccaug

SEQ ID NO: 3777724 - RNA, 13 nt, Salmonella typhimurium LT2
cauuaacguccau

SEQ ID NO: 3777725 - RNA, 17 nt, Salmonella typhimurium LT2
cauuaaucgccauugca

SEQ ID NO: 3777726 - RNA, 19 nt, Salmonella typhimurium LT2
cauuaaugucaugaagcuc

SEQ ID NO: 3777727 - RNA, 15 nt, Salmonella typhimurium LT2
cauuaauucaguccu

SEQ ID NO: 3777728 - RNA, 17 nt, Salmonella typhimurium LT2
cauuaauuucuuaccaa

SEQ ID NO: 3777729 - RNA, 22 nt, Salmonella typhimurium LT2
cauuaauuucuuaccaaaagca

SEQ ID NO: 3777730 - RNA, 22 nt, Salmonella typhimurium LT2
cauuacaggcaucuuccagcgu

SEQ ID NO: 3777731 - RNA, 13 nt, Salmonella typhimurium LT2
cauuacauccuca

SEQ ID NO: 3777732 - RNA, 14 nt, Salmonella typhimurium LT2
cauuacccaccgga

SEQ ID NO: 3777733 - RNA, 14 nt, Salmonella typhimurium LT2
cauuaccccagcau

SEQ ID NO: 3777734 - RNA, 17 nt, Salmonella typhimurium LT2
cauuaccccagcaucuc

SEQ ID NO: 3777735 - RNA, 21 nt, Salmonella typhimurium LT2
cauuaccccagcaucucacgu

SEQ ID NO: 3777736 - RNA, 13 nt, Salmonella typhimurium LT2
cauuaccuuuucc

SEQ ID NO: 3777737 - RNA, 14 nt, Salmonella typhimurium LT2
cauuacgaucugac

SEQ ID NO: 3777738 - RNA, 19 nt, Salmonella typhimurium LT2
cauuacgaucugacgaggc

SEQ ID NO: 3777739 - RNA, 14 nt, Salmonella typhimurium LT2
cauuacucgccugc

SEQ ID NO: 3777740 - RNA, 19 nt, Salmonella typhimurium LT2
cauuagcauucccuuaucu

SEQ ID NO: 3777741 - RNA, 14 nt, Salmonella typhimurium LT2
cauuagccgccagc

SEQ ID NO: 3777742 - RNA, 20 nt, Salmonella typhimurium LT2
cauuagcggcauugaagagu

SEQ ID NO: 3777743 - RNA, 16 nt, Salmonella typhimurium LT2
cauuagcggugcguca

SEQ ID NO: 3777744 - RNA, 21 nt, Salmonella typhimurium LT2
cauuaggccggacguugaaaa

SEQ ID NO: 3777745 - RNA, 15 nt, Salmonella typhimurium LT2
cauuauaagcgccaa

SEQ ID NO: 3777746 - RNA, 12 nt, Salmonella typhimurium LT2
cauuaucaccau

SEQ ID NO: 3777747 - RNA, 13 nt, Salmonella typhimurium LT2
cauuaucaccauu

SEQ ID NO: 3777748 - RNA, 19 nt, Salmonella typhimurium LT2
cauuaugaucgguuuuuuu

SEQ ID NO: 3777749 - RNA, 23 nt, Salmonella typhimurium LT2
cauuaugaucgguuuuuuuagaa

SEQ ID NO: 3777750 - RNA, 14 nt, Salmonella typhimurium LT2
cauuaugaugaguu

SEQ ID NO: 3777751 - RNA, 23 nt, Salmonella typhimurium LT2
cauuaugggcaaugauauagccu

SEQ ID NO: 3777752 - RNA, 16 nt, Salmonella typhimurium LT2
cauuauguaauaacug

SEQ ID NO: 3777753 - RNA, 17 nt, Salmonella typhimurium LT2
cauuauguaauaacuga

SEQ ID NO: 3777754 - RNA, 13 nt, Salmonella typhimurium LT2
cauuauucggcuu

SEQ ID NO: 3777755 - RNA, 21 nt, Salmonella typhimurium LT2
cauuauugucuuuguugccuu

SEQ ID NO: 3777756 - RNA, 20 nt, Salmonella typhimurium LT2
cauuauuuuagugaaaaaau

SEQ ID NO: 3777757 - RNA, 19 nt, Salmonella typhimurium LT2
cauucaacgcaucaaauac

SEQ ID NO: 3777758 - RNA, 16 nt, Salmonella typhimurium LT2
cauucaacgggcgaua

SEQ ID NO: 3777759 - RNA, 14 nt, Salmonella typhimurium LT2
cauucacggcgacc

SEQ ID NO: 3777760 - RNA, 14 nt, Salmonella typhimurium LT2
cauucagagcgucu

SEQ ID NO: 3777761 - RNA, 17 nt, Salmonella typhimurium LT2
cauucagcaacugcgua

SEQ ID NO: 3777762 - RNA, 22 nt, Salmonella typhimurium LT2
cauucagcacgcuuuggcaggc

SEQ ID NO: 3777763 - RNA, 19 nt, Salmonella typhimurium LT2
cauucaggcuggcaaagca

SEQ ID NO: 3777764 - RNA, 17 nt, Salmonella typhimurium LT2
cauucagggaaucagcg

SEQ ID NO: 3777765 - RNA, 17 nt, Salmonella typhimurium LT2
cauucaguacaauaccu

SEQ ID NO: 3777766 - RNA, 19 nt, Salmonella typhimurium LT2
cauucauugucuuuuucuc

SEQ ID NO: 3777767 - RNA, 12 nt, Salmonella typhimurium LT2
cauuccagccgg

SEQ ID NO: 3777768 - RNA, 20 nt, Salmonella typhimurium LT2
cauuccaggugucacucauc

SEQ ID NO: 3777769 - RNA, 14 nt, Salmonella typhimurium LT2
cauuccaucauguu

SEQ ID NO: 3777770 - RNA, 13 nt, Salmonella typhimurium LT2
cauuccccacgcc

SEQ ID NO: 3777771 - RNA, 16 nt, Salmonella typhimurium LT2
cauucccgccaauaac

SEQ ID NO: 3777772 - RNA, 17 nt, Salmonella typhimurium LT2
cauucccgccgagaaaa

SEQ ID NO: 3777773 - RNA, 12 nt, Salmonella typhimurium LT2
cauuccgccugc

SEQ ID NO: 3777774 - RNA, 22 nt, Salmonella typhimurium LT2
cauuccgcgcaaauacugaaau

SEQ ID NO: 3777775 - RNA, 21 nt, Salmonella typhimurium LT2
cauuccggcgcgaucaucgca

SEQ ID NO: 3777776 - RNA, 13 nt, Salmonella typhimurium LT2
cauuccuauuuuc

SEQ ID NO: 3777777 - RNA, 18 nt, Salmonella typhimurium LT2
cauuccuuuagcuuccag

SEQ ID NO: 3777778 - RNA, 17 nt, Salmonella typhimurium LT2
cauucgaauccuccugu

SEQ ID NO: 3777779 - RNA, 14 nt, Salmonella typhimurium LT2
cauucgaauucuga

SEQ ID NO: 3777780 - RNA, 15 nt, Salmonella typhimurium LT2
cauucgaauucugau

SEQ ID NO: 3777781 - RNA, 16 nt, Salmonella typhimurium LT2
cauucgaauucugaua

SEQ ID NO: 3777782 - RNA, 19 nt, Salmonella typhimurium LT2
cauucgaccacaacccacu

SEQ ID NO: 3777783 - RNA, 17 nt, Salmonella typhimurium LT2
cauucgacgcugaaccu

SEQ ID NO: 3777784 - RNA, 19 nt, Salmonella typhimurium LT2
cauucgagaugcauaaaaa

SEQ ID NO: 3777785 - RNA, 21 nt, Salmonella typhimurium LT2
cauucgagaugcauaaaaaaa

SEQ ID NO: 3777786 - RNA, 22 nt, Salmonella typhimurium LT2
cauucgccaccaggcucaaauu

SEQ ID NO: 3777787 - RNA, 17 nt, Salmonella typhimurium LT2
cauucgccagcggaucg

SEQ ID NO: 3777788 - RNA, 15 nt, Salmonella typhimurium LT2
cauucgccccagcau

SEQ ID NO: 3777789 - RNA, 19 nt, Salmonella typhimurium LT2
cauucggauaauccagacg

SEQ ID NO: 3777790 - RNA, 22 nt, Salmonella typhimurium LT2
cauucgggacaaacccccagcc

SEQ ID NO: 3777791 - RNA, 19 nt, Salmonella typhimurium LT2
cauucgguacggcgcugcu

SEQ ID NO: 3777792 - RNA, 17 nt, Salmonella typhimurium LT2
cauucuaccggcugugg

SEQ ID NO: 3777793 - RNA, 23 nt, Salmonella typhimurium LT2
cauucucaacccggacauccauc

SEQ ID NO: 3777794 - RNA, 20 nt, Salmonella typhimurium LT2
cauucucuguugccgcccgu

SEQ ID NO: 3777795 - RNA, 15 nt, Salmonella typhimurium LT2
cauucucuugccugc

SEQ ID NO: 3777796 - RNA, 21 nt, Salmonella typhimurium LT2
cauucucuuucgcuguaggcc

SEQ ID NO: 3777797 - RNA, 15 nt, Salmonella typhimurium LT2
cauucugaagccgau

SEQ ID NO: 3777798 - RNA, 21 nt, Salmonella typhimurium LT2
cauucugcaggcgggugcgca

SEQ ID NO: 3777799 - RNA, 19 nt, Salmonella typhimurium LT2
cauucugcuuaccagaccg

SEQ ID NO: 3777800 - RNA, 22 nt, Salmonella typhimurium LT2
cauucuguuuucgagccuugcc

SEQ ID NO: 3777801 - RNA, 23 nt, Salmonella typhimurium LT2
cauucuucagcgcguccuccagc

SEQ ID NO: 3777802 - RNA, 19 nt, Salmonella typhimurium LT2
cauucuugcgccgcaaacu

SEQ ID NO: 3777803 - RNA, 17 nt, Salmonella typhimurium LT2
cauugaaacgcaucaca

SEQ ID NO: 3777804 - RNA, 22 nt, Salmonella typhimurium LT2
cauugaccacuucaucgcugcu

SEQ ID NO: 3777805 - RNA, 19 nt, Salmonella typhimurium LT2
cauugacccucccugcgcu

SEQ ID NO: 3777806 - RNA, 16 nt, Salmonella typhimurium LT2
cauugagcagccgacc

SEQ ID NO: 3777807 - RNA, 15 nt, Salmonella typhimurium LT2
cauugagcauucuac

SEQ ID NO: 3777808 - RNA, 17 nt, Salmonella typhimurium LT2
cauugagcauucuacag

SEQ ID NO: 3777809 - RNA, 14 nt, Salmonella typhimurium LT2
cauugagcguaaua

SEQ ID NO: 3777810 - RNA, 17 nt, Salmonella typhimurium LT2
cauugaguuagugguca

SEQ ID NO: 3777811 - RNA, 16 nt, Salmonella typhimurium LT2
cauugauaaagcgcuc

SEQ ID NO: 3777812 - RNA, 14 nt, Salmonella typhimurium LT2
cauugauuuuucau

SEQ ID NO: 3777813 - RNA, 17 nt, Salmonella typhimurium LT2
cauugcaaugcaguucu

SEQ ID NO: 3777814 - RNA, 19 nt, Salmonella typhimurium LT2
cauugccauguuaauacca

SEQ ID NO: 3777815 - RNA, 23 nt, Salmonella typhimurium LT2
cauugccauguuaauaccagcgc

SEQ ID NO: 3777816 - RNA, 17 nt, Salmonella typhimurium LT2
cauugcccauucguaau

SEQ ID NO: 3777817 - RNA, 23 nt, Salmonella typhimurium LT2
cauugcccgcugcgcacggcaau

SEQ ID NO: 3777818 - RNA, 12 nt, Salmonella typhimurium LT2
cauugcccggcg

SEQ ID NO: 3777819 - RNA, 23 nt, Salmonella typhimurium LT2
cauugccgcgccgacauagcuga

SEQ ID NO: 3777820 - RNA, 19 nt, Salmonella typhimurium LT2
cauugccuuucaauacuuc

SEQ ID NO: 3777821 - RNA, 18 nt, Salmonella typhimurium LT2
cauugcgagaaaaaacuc

SEQ ID NO: 3777822 - RNA, 15 nt, Salmonella typhimurium LT2
cauugcgaguuaucu

SEQ ID NO: 3777823 - RNA, 22 nt, Salmonella typhimurium LT2
cauugcgcucuaucgccgcccg

SEQ ID NO: 3777824 - RNA, 17 nt, Salmonella typhimurium LT2
cauugcuauagcccacg

SEQ ID NO: 3777825 - RNA, 21 nt, Salmonella typhimurium LT2
cauugcucauaccgccgccca

SEQ ID NO: 3777826 - RNA, 15 nt, Salmonella typhimurium LT2
cauugcuuucuugaa

SEQ ID NO: 3777827 - RNA, 20 nt, Salmonella typhimurium LT2
cauuggaagagacacgcuga

SEQ ID NO: 3777828 - RNA, 13 nt, Salmonella typhimurium LT2
cauuggcaaugaa

SEQ ID NO: 3777829 - RNA, 17 nt, Salmonella typhimurium LT2
cauuggcccggcgcgcg

SEQ ID NO: 3777830 - RNA, 16 nt, Salmonella typhimurium LT2
cauuggcgucugcuga

SEQ ID NO: 3777831 - RNA, 15 nt, Salmonella typhimurium LT2
cauuggcguuaccgg

SEQ ID NO: 3777832 - RNA, 15 nt, Salmonella typhimurium LT2
cauugggccagcagc

SEQ ID NO: 3777833 - RNA, 16 nt, Salmonella typhimurium LT2
cauuggguaauuuuuu

SEQ ID NO: 3777834 - RNA, 23 nt, Salmonella typhimurium LT2
cauuggguaauuuuuugauauua

SEQ ID NO: 3777835 - RNA, 17 nt, Salmonella typhimurium LT2
cauuggucuggauugca

SEQ ID NO: 3777836 - RNA, 19 nt, Salmonella typhimurium LT2
cauugguggggcuaaguga

SEQ ID NO: 3777837 - RNA, 16 nt, Salmonella typhimurium LT2
cauugguuaucaaaaa

SEQ ID NO: 3777838 - RNA, 23 nt, Salmonella typhimurium LT2
cauuguccuuuaucugcccuuuc

SEQ ID NO: 3777839 - RNA, 13 nt, Salmonella typhimurium LT2
cauugucuuuuuc

SEQ ID NO: 3777840 - RNA, 18 nt, Salmonella typhimurium LT2
cauugugaggaaccucuu

SEQ ID NO: 3777841 - RNA, 22 nt, Salmonella typhimurium LT2
cauuguuccugcuggcaaaacg

SEQ ID NO: 3777842 - RNA, 17 nt, Salmonella typhimurium LT2
cauuguucuguccggaa

SEQ ID NO: 3777843 - RNA, 13 nt, Salmonella typhimurium LT2
cauuguuuacuuu

SEQ ID NO: 3777844 - RNA, 13 nt, Salmonella typhimurium LT2
cauuuaaucgccu

SEQ ID NO: 3777845 - RNA, 17 nt, Salmonella typhimurium LT2
cauuuaaucgccugcgc

SEQ ID NO: 3777846 - RNA, 13 nt, Salmonella typhimurium LT2
cauuuagcgccug

SEQ ID NO: 3777847 - RNA, 21 nt, Salmonella typhimurium LT2
cauuuauggguuccaguugca

SEQ ID NO: 3777848 - RNA, 12 nt, Salmonella typhimurium LT2
cauuucaagcag

SEQ ID NO: 3777849 - RNA, 13 nt, Salmonella typhimurium LT2
cauuucaaucgcc

SEQ ID NO: 3777850 - RNA, 23 nt, Salmonella typhimurium LT2
cauuucaaucgccaccacauuca

SEQ ID NO: 3777851 - RNA, 13 nt, Salmonella typhimurium LT2
cauuucaaugcau

SEQ ID NO: 3777852 - RNA, 20 nt, Salmonella typhimurium LT2
cauuucacgauacuguugca

SEQ ID NO: 3777853 - RNA, 16 nt, Salmonella typhimurium LT2
cauuucacuauaaaaa

SEQ ID NO: 3777854 - RNA, 17 nt, Salmonella typhimurium LT2
cauuucaggcaaaaaaa

SEQ ID NO: 3777855 - RNA, 11 nt, Salmonella typhimurium LT2
cauuucaucag

SEQ ID NO: 3777856 - RNA, 13 nt, Salmonella typhimurium LT2
cauuucccuuccc

SEQ ID NO: 3777857 - RNA, 14 nt, Salmonella typhimurium LT2
cauuuccggcgcgc

SEQ ID NO: 3777858 - RNA, 23 nt, Salmonella typhimurium LT2
cauuuccggcgcgccuaaaccaa

SEQ ID NO: 3777859 - RNA, 15 nt, Salmonella typhimurium LT2
cauuuccguuaaucu

SEQ ID NO: 3777860 - RNA, 16 nt, Salmonella typhimurium LT2
cauuuccguuaaucug

SEQ ID NO: 3777861 - RNA, 15 nt, Salmonella typhimurium LT2
cauuuccugauuuuu

SEQ ID NO: 3777862 - RNA, 17 nt, Salmonella typhimurium LT2
cauuuccugcauuaacg

SEQ ID NO: 3777863 - RNA, 16 nt, Salmonella typhimurium LT2
cauuucgcccucgcca

SEQ ID NO: 3777864 - RNA, 16 nt, Salmonella typhimurium LT2
cauuucucaaaaacac

SEQ ID NO: 3777865 - RNA, 18 nt, Salmonella typhimurium LT2
cauuucucaaaaacacca

SEQ ID NO: 3777866 - RNA, 20 nt, Salmonella typhimurium LT2
cauuucuccugcaucugcgc

SEQ ID NO: 3777867 - RNA, 17 nt, Salmonella typhimurium LT2
cauuucugccugauggc

SEQ ID NO: 3777868 - RNA, 16 nt, Salmonella typhimurium LT2
cauuucuucuucaagc

SEQ ID NO: 3777869 - RNA, 17 nt, Salmonella typhimurium LT2
cauuucuuguugacgac

SEQ ID NO: 3777870 - RNA, 21 nt, Salmonella typhimurium LT2
cauuugaacucuuccagauac

SEQ ID NO: 3777871 - RNA, 14 nt, Salmonella typhimurium LT2
cauuugaucucaug

SEQ ID NO: 3777872 - RNA, 21 nt, Salmonella typhimurium LT2
cauuugaugaaccgagauaca

SEQ ID NO: 3777873 - RNA, 11 nt, Salmonella typhimurium LT2
cauuugcaaug

SEQ ID NO: 3777874 - RNA, 15 nt, Salmonella typhimurium LT2
cauuugcaauggccc

SEQ ID NO: 3777875 - RNA, 16 nt, Salmonella typhimurium LT2
cauuugccugccgcag

SEQ ID NO: 3777876 - RNA, 23 nt, Salmonella typhimurium LT2
cauuugcgacaucagccagccgc

SEQ ID NO: 3777877 - RNA, 16 nt, Salmonella typhimurium LT2
cauuugcuuucaucaa

SEQ ID NO: 3777878 - RNA, 17 nt, Salmonella typhimurium LT2
cauuuggcuuaaauaau

SEQ ID NO: 3777879 - RNA, 21 nt, Salmonella typhimurium LT2
cauuuggguucacgggcauca

SEQ ID NO: 3777880 - RNA, 22 nt, Salmonella typhimurium LT2
cauuuggguucacgggcaucau

SEQ ID NO: 3777881 - RNA, 14 nt, Salmonella typhimurium LT2
cauuuguacaaaaa

SEQ ID NO: 3777882 - RNA, 15 nt, Salmonella typhimurium LT2
cauuuguacaaaaaa

SEQ ID NO: 3777883 - RNA, 19 nt, Salmonella typhimurium LT2
cauuuguagcggcaacagc

SEQ ID NO: 3777884 - RNA, 13 nt, Salmonella typhimurium LT2
cauuuguuccucg

SEQ ID NO: 3777885 - RNA, 20 nt, Salmonella typhimurium LT2
cauuuguuccucgaaacgcu

SEQ ID NO: 3777886 - RNA, 16 nt, Salmonella typhimurium LT2
cauuuuauccaacagc

SEQ ID NO: 3777887 - RNA, 13 nt, Salmonella typhimurium LT2
cauuuucaauguc

SEQ ID NO: 3777888 - RNA, 15 nt, Salmonella typhimurium LT2
cauuuuccgcugucu

SEQ ID NO: 3777889 - RNA, 22 nt, Salmonella typhimurium LT2
cauuuuccgcugucuauccacu

SEQ ID NO: 3777890 - RNA, 16 nt, Salmonella typhimurium LT2
cauuuucggcagcgcg

SEQ ID NO: 3777891 - RNA, 20 nt, Salmonella typhimurium LT2
cauuuucggcagcgcgaaca

SEQ ID NO: 3777892 - RNA, 17 nt, Salmonella typhimurium LT2
cauuuugcgguuuuaau

SEQ ID NO: 3777893 - RNA, 22 nt, Salmonella typhimurium LT2
cauuuugcgguuuuaauuucca

SEQ ID NO: 3777894 - RNA, 21 nt, Salmonella typhimurium LT2
cauuuugcuggaaaaauaaga

SEQ ID NO: 3777895 - RNA, 18 nt, Salmonella typhimurium LT2
cauuuuggggaaaauacc

SEQ ID NO: 3777896 - RNA, 18 nt, Salmonella typhimurium LT2
cauuuuucgaucuucucc

SEQ ID NO: 3777897 - RNA, 12 nt, Salmonella typhimurium LT2
cauuuuugcccg

SEQ ID NO: 3777898 - RNA, 22 nt, Salmonella typhimurium LT2
cauuuuuggugacguguuugau

SEQ ID NO: 3777899 - RNA, 14 nt, Salmonella typhimurium LT2
cauuuuuucagccu

SEQ ID NO: 3777900 - RNA, 21 nt, Salmonella typhimurium LT2
cauuuuuugacaacaaaaaga

SEQ ID NO: 3777901 - RNA, 14 nt, Salmonella typhimurium LT2
ccaaaaauaaaagg

SEQ ID NO: 3777902 - RNA, 18 nt, Salmonella typhimurium LT2
ccaaaacccagaaucagc

SEQ ID NO: 3777903 - RNA, 13 nt, Salmonella typhimurium LT2
ccaaaaugccgcc

SEQ ID NO: 3777904 - RNA, 17 nt, Salmonella typhimurium LT2
ccaaaaugcggcauccg

SEQ ID NO: 3777905 - RNA, 23 nt, Salmonella typhimurium LT2
ccaaaauggcaaguaaaauaacc

SEQ ID NO: 3777906 - RNA, 21 nt, Salmonella typhimurium LT2
ccaaaauucacgcuucucugg

SEQ ID NO: 3777907 - RNA, 13 nt, Salmonella typhimurium LT2
ccaaacagcggcu

SEQ ID NO: 3777908 - RNA, 19 nt, Salmonella typhimurium LT2
ccaaacaucgcucgcgcca

SEQ ID NO: 3777909 - RNA, 22 nt, Salmonella typhimurium LT2
ccaaaccacugauggaguuuca

SEQ ID NO: 3777910 - RNA, 13 nt, Salmonella typhimurium LT2
ccaaaccagaccc

SEQ ID NO: 3777911 - RNA, 22 nt, Salmonella typhimurium LT2
ccaaaccagacucaccccuucu

SEQ ID NO: 3777912 - RNA, 16 nt, Salmonella typhimurium LT2
ccaaacccgccacagg

SEQ ID NO: 3777913 - RNA, 18 nt, Salmonella typhimurium LT2
ccaaacccgccacaggcc

SEQ ID NO: 3777914 - RNA, 20 nt, Salmonella typhimurium LT2
ccaaaccugagcauauaaau

SEQ ID NO: 3777915 - RNA, 19 nt, Salmonella typhimurium LT2
ccaaacgcggucaggguga

SEQ ID NO: 3777916 - RNA, 12 nt, Salmonella typhimurium LT2
ccaaacggcagc

SEQ ID NO: 3777917 - RNA, 18 nt, Salmonella typhimurium LT2
ccaaacugcgcgccgccc

SEQ ID NO: 3777918 - RNA, 23 nt, Salmonella typhimurium LT2
ccaaacugcggaauuuuauccug

SEQ ID NO: 3777919 - RNA, 15 nt, Salmonella typhimurium LT2
ccaaagcgcugcugc

SEQ ID NO: 3777920 - RNA, 17 nt, Salmonella typhimurium LT2
ccaaagcgcugcugcuc

SEQ ID NO: 3777921 - RNA, 17 nt, Salmonella typhimurium LT2
ccaaagcgguaauuaau

SEQ ID NO: 3777922 - RNA, 15 nt, Salmonella typhimurium LT2
ccaaagcguaaacag

SEQ ID NO: 3777923 - RNA, 16 nt, Salmonella typhimurium LT2
ccaaagggagcagacu

SEQ ID NO: 3777924 - RNA, 19 nt, Salmonella typhimurium LT2
ccaaagggagcagacugua

SEQ ID NO: 3777925 - RNA, 15 nt, Salmonella typhimurium LT2
ccaaaguuaaucagc

SEQ ID NO: 3777926 - RNA, 20 nt, Salmonella typhimurium LT2
ccaaauaaaagccgccaugu

SEQ ID NO: 3777927 - RNA, 15 nt, Salmonella typhimurium LT2
ccaaauaacccaggg

SEQ ID NO: 3777928 - RNA, 15 nt, Salmonella typhimurium LT2
ccaaauagcgccaga

SEQ ID NO: 3777929 - RNA, 16 nt, Salmonella typhimurium LT2
ccaaauaguccagcag

SEQ ID NO: 3777930 - RNA, 20 nt, Salmonella typhimurium LT2
ccaaauaguccagcagccau

SEQ ID NO: 3777931 - RNA, 15 nt, Salmonella typhimurium LT2
ccaaaucaauagaau

SEQ ID NO: 3777932 - RNA, 18 nt, Salmonella typhimurium LT2
ccaaaucaugccgccaaa

SEQ ID NO: 3777933 - RNA, 20 nt, Salmonella typhimurium LT2
ccaaaucucccccggcacca

SEQ ID NO: 3777934 - RNA, 18 nt, Salmonella typhimurium LT2
ccaaaucuguucugucca

SEQ ID NO: 3777935 - RNA, 21 nt, Salmonella typhimurium LT2
ccaaaugccugccguuuuuaa

SEQ ID NO: 3777936 - RNA, 17 nt, Salmonella typhimurium LT2
ccaaauuacgcacacuu

SEQ ID NO: 3777937 - RNA, 13 nt, Salmonella typhimurium LT2
ccaacaacccauu

SEQ ID NO: 3777938 - RNA, 21 nt, Salmonella typhimurium LT2
ccaacaaggauauccgccagu

SEQ ID NO: 3777939 - RNA, 13 nt, Salmonella typhimurium LT2
ccaacaaucgccc

SEQ ID NO: 3777940 - RNA, 15 nt, Salmonella typhimurium LT2
ccaacaaugccacgc

SEQ ID NO: 3777941 - RNA, 20 nt, Salmonella typhimurium LT2
ccaacaaugccacgccccua

SEQ ID NO: 3777942 - RNA, 15 nt, Salmonella typhimurium LT2
ccaacacggcgcuca

SEQ ID NO: 3777943 - RNA, 18 nt, Salmonella typhimurium LT2
ccaacacggcgcucagga

SEQ ID NO: 3777944 - RNA, 17 nt, Salmonella typhimurium LT2
ccaacagaagauccuca

SEQ ID NO: 3777945 - RNA, 19 nt, Salmonella typhimurium LT2
ccaacagcagacagccgau

SEQ ID NO: 3777946 - RNA, 15 nt, Salmonella typhimurium LT2
ccaacaguauagaaa

SEQ ID NO: 3777947 - RNA, 15 nt, Salmonella typhimurium LT2
ccaacauacaugccu

SEQ ID NO: 3777948 - RNA, 21 nt, Salmonella typhimurium LT2
ccaacauacaugccugcgcca

SEQ ID NO: 3777949 - RNA, 17 nt, Salmonella typhimurium LT2
ccaacaucaugucccca

SEQ ID NO: 3777950 - RNA, 16 nt, Salmonella typhimurium LT2
ccaaccguuuugcaau

SEQ ID NO: 3777951 - RNA, 18 nt, Salmonella typhimurium LT2
ccaaccguuuugcaaugc

SEQ ID NO: 3777952 - RNA, 13 nt, Salmonella typhimurium LT2
ccaacgcaaugcg

SEQ ID NO: 3777953 - RNA, 15 nt, Salmonella typhimurium LT2
ccaacgcagucaaaa

SEQ ID NO: 3777954 - RNA, 14 nt, Salmonella typhimurium LT2
ccaacgccaacaua

SEQ ID NO: 3777955 - RNA, 15 nt, Salmonella typhimurium LT2
ccaacgccggcaaca

SEQ ID NO: 3777956 - RNA, 22 nt, Salmonella typhimurium LT2
ccaacggcgacgcccgccaucu

SEQ ID NO: 3777957 - RNA, 19 nt, Salmonella typhimurium LT2
ccaacggucgugcgagaua

SEQ ID NO: 3777958 - RNA, 17 nt, Salmonella typhimurium LT2
ccaacguugaagagcua

SEQ ID NO: 3777959 - RNA, 21 nt, Salmonella typhimurium LT2
ccaacguugaagagcuacucu

SEQ ID NO: 3777960 - RNA, 12 nt, Salmonella typhimurium LT2
ccaacguugugc

SEQ ID NO: 3777961 - RNA, 21 nt, Salmonella typhimurium LT2
ccaacucccccauggagagcg

SEQ ID NO: 3777962 - RNA, 16 nt, Salmonella typhimurium LT2
ccaacugccaaaccac

SEQ ID NO: 3777963 - RNA, 17 nt, Salmonella typhimurium LT2
ccaacugcgccugaaga

SEQ ID NO: 3777964 - RNA, 17 nt, Salmonella typhimurium LT2
ccaacugucgccauccu

SEQ ID NO: 3777965 - RNA, 17 nt, Salmonella typhimurium LT2
ccaacuuaugaaaaccu

SEQ ID NO: 3777966 - RNA, 12 nt, Salmonella typhimurium LT2
ccaagaaugaaa

SEQ ID NO: 3777967 - RNA, 21 nt, Salmonella typhimurium LT2
ccaagaucgccaagcugugau

SEQ ID NO: 3777968 - RNA, 14 nt, Salmonella typhimurium LT2
ccaagcacaaaaag

SEQ ID NO: 3777969 - RNA, 21 nt, Salmonella typhimurium LT2
ccaagcaccuagguuccagcu

SEQ ID NO: 3777970 - RNA, 14 nt, Salmonella typhimurium LT2
ccaagcagcgccac

SEQ ID NO: 3777971 - RNA, 16 nt, Salmonella typhimurium LT2
ccaagcaggaaccccu

SEQ ID NO: 3777972 - RNA, 14 nt, Salmonella typhimurium LT2
ccaagcggcaauaa

SEQ ID NO: 3777973 - RNA, 22 nt, Salmonella typhimurium LT2
ccaaggcaaaguaucccuuccu

SEQ ID NO: 3777974 - RNA, 18 nt, Salmonella typhimurium LT2
ccaaguaacacggcgaca

SEQ ID NO: 3777975 - RNA, 18 nt, Salmonella typhimurium LT2
ccaaguaauaaagagaac

SEQ ID NO: 3777976 - RNA, 12 nt, Salmonella typhimurium LT2
ccaauaagaacu

SEQ ID NO: 3777977 - RNA, 16 nt, Salmonella typhimurium LT2
ccaauaaugcaggcua

SEQ ID NO: 3777978 - RNA, 19 nt, Salmonella typhimurium LT2
ccaauaaugccgccgucgc

SEQ ID NO: 3777979 - RNA, 20 nt, Salmonella typhimurium LT2
ccaauaauuaguuuuaccgg

SEQ ID NO: 3777980 - RNA, 17 nt, Salmonella typhimurium LT2
ccaauacccagcgccaa

SEQ ID NO: 3777981 - RNA, 15 nt, Salmonella typhimurium LT2
ccaauaccggcguaa

SEQ ID NO: 3777982 - RNA, 23 nt, Salmonella typhimurium LT2
ccaauacgccagccuaucgccau

SEQ ID NO: 3777983 - RNA, 17 nt, Salmonella typhimurium LT2
ccaauauagccgauggc

SEQ ID NO: 3777984 - RNA, 14 nt, Salmonella typhimurium LT2
ccaauauccccagc

SEQ ID NO: 3777985 - RNA, 17 nt, Salmonella typhimurium LT2
ccaauaugaugcuugcu

SEQ ID NO: 3777986 - RNA, 19 nt, Salmonella typhimurium LT2
ccaauauuaauguauuauu

SEQ ID NO: 3777987 - RNA, 16 nt, Salmonella typhimurium LT2
ccaaucaacgccgcca

SEQ ID NO: 3777988 - RNA, 17 nt, Salmonella typhimurium LT2
ccaaucaacgccgccag

SEQ ID NO: 3777989 - RNA, 16 nt, Salmonella typhimurium LT2
ccaaucacgcagagua

SEQ ID NO: 3777990 - RNA, 17 nt, Salmonella typhimurium LT2
ccaaucacuaacgguac

SEQ ID NO: 3777991 - RNA, 13 nt, Salmonella typhimurium LT2
ccaaucagcccca

SEQ ID NO: 3777992 - RNA, 17 nt, Salmonella typhimurium LT2
ccaaucagcggguauug

SEQ ID NO: 3777993 - RNA, 17 nt, Salmonella typhimurium LT2
ccaaucgccgccgccag

SEQ ID NO: 3777994 - RNA, 14 nt, Salmonella typhimurium LT2
ccaaucugacacag

SEQ ID NO: 3777995 - RNA, 12 nt, Salmonella typhimurium LT2
ccaaugagcugc

SEQ ID NO: 3777996 - RNA, 13 nt, Salmonella typhimurium LT2
ccaaugcagcgcg

SEQ ID NO: 3777997 - RNA, 20 nt, Salmonella typhimurium LT2
ccaaugccgccuuuaucgac

SEQ ID NO: 3777998 - RNA, 19 nt, Salmonella typhimurium LT2
ccaaugccugacgccacca

SEQ ID NO: 3777999 - RNA, 18 nt, Salmonella typhimurium LT2
ccaaugcguuguuccuga

SEQ ID NO: 3778000 - RNA, 22 nt, Salmonella typhimurium LT2
ccaaugcuuagucagccuuaau

SEQ ID NO: 3778001 - RNA, 18 nt, Salmonella typhimurium LT2
ccaauguacguaaaacca

SEQ ID NO: 3778002 - RNA, 18 nt, Salmonella typhimurium LT2
ccaaugucauauuuguga

SEQ ID NO: 3778003 - RNA, 19 nt, Salmonella typhimurium LT2
ccaauuacccucgcgcuca

SEQ ID NO: 3778004 - RNA, 17 nt, Salmonella typhimurium LT2
ccaauuccugccagaga

SEQ ID NO: 3778005 - RNA, 21 nt, Salmonella typhimurium LT2
ccaauugccacauagcaucca

SEQ ID NO: 3778006 - RNA, 20 nt, Salmonella typhimurium LT2
ccaauugcugcaucgugagc

SEQ ID NO: 3778007 - RNA, 12 nt, Salmonella typhimurium LT2
ccaauuuuucac

SEQ ID NO: 3778008 - RNA, 21 nt, Salmonella typhimurium LT2
ccacaaaaggauacagcgccg

SEQ ID NO: 3778009 - RNA, 14 nt, Salmonella typhimurium LT2
ccacaaacgccgga

SEQ ID NO: 3778010 - RNA, 19 nt, Salmonella typhimurium LT2
ccacaaacgccgucacaaa

SEQ ID NO: 3778011 - RNA, 21 nt, Salmonella typhimurium LT2
ccacaaagagugccagaaaca

SEQ ID NO: 3778012 - RNA, 14 nt, Salmonella typhimurium LT2
ccacaaauuuugau

SEQ ID NO: 3778013 - RNA, 14 nt, Salmonella typhimurium LT2
ccacaacggagaua

SEQ ID NO: 3778014 - RNA, 18 nt, Salmonella typhimurium LT2
ccacaacgugauaaccaa

SEQ ID NO: 3778015 - RNA, 22 nt, Salmonella typhimurium LT2
ccacaagagcagcaacccugcc

SEQ ID NO: 3778016 - RNA, 23 nt, Salmonella typhimurium LT2
ccacaagagcagcaacccugccg

SEQ ID NO: 3778017 - RNA, 14 nt, Salmonella typhimurium LT2
ccacaagcugugcc

SEQ ID NO: 3778018 - RNA, 16 nt, Salmonella typhimurium LT2
ccacaaguuuauccgg

SEQ ID NO: 3778019 - RNA, 14 nt, Salmonella typhimurium LT2
ccacaaucccgcca

SEQ ID NO: 3778020 - RNA, 18 nt, Salmonella typhimurium LT2
ccacaccuucuucgccaa

SEQ ID NO: 3778021 - RNA, 21 nt, Salmonella typhimurium LT2
ccacacgcuuauccagccacu

SEQ ID NO: 3778022 - RNA, 13 nt, Salmonella typhimurium LT2
ccacacugcugug

SEQ ID NO: 3778023 - RNA, 16 nt, Salmonella typhimurium LT2
ccacagauuaugcagc

SEQ ID NO: 3778024 - RNA, 22 nt, Salmonella typhimurium LT2
ccacagcauaccgugugcagug

SEQ ID NO: 3778025 - RNA, 17 nt, Salmonella typhimurium LT2
ccacagccgcauuuuuu

SEQ ID NO: 3778026 - RNA, 20 nt, Salmonella typhimurium LT2
ccacagccgcauuuuuucuu

SEQ ID NO: 3778027 - RNA, 23 nt, Salmonella typhimurium LT2
ccacaggaccacguucccgauuc

SEQ ID NO: 3778028 - RNA, 17 nt, Salmonella typhimurium LT2
ccacaggcagggcgaug

SEQ ID NO: 3778029 - RNA, 16 nt, Salmonella typhimurium LT2
ccacaggccaacauag

SEQ ID NO: 3778030 - RNA, 12 nt, Salmonella typhimurium LT2
ccacaggcgucg

SEQ ID NO: 3778031 - RNA, 9 nt, Salmonella typhimurium LT2
ccacaggcu

SEQ ID NO: 3778032 - RNA, 22 nt, Salmonella typhimurium LT2
ccacagguaaaauugccgccaa

SEQ ID NO: 3778033 - RNA, 17 nt, Salmonella typhimurium LT2
ccacagucgucuggcgc

SEQ ID NO: 3778034 - RNA, 16 nt, Salmonella typhimurium LT2
ccacaguuaacgccaa

SEQ ID NO: 3778035 - RNA, 22 nt, Salmonella typhimurium LT2
ccacaguugguucugcucaaug

SEQ ID NO: 3778036 - RNA, 15 nt, Salmonella typhimurium LT2
ccacauagcauccag

SEQ ID NO: 3778037 - RNA, 17 nt, Salmonella typhimurium LT2
ccacauagcauccagac

SEQ ID NO: 3778038 - RNA, 17 nt, Salmonella typhimurium LT2
ccacauauaacaaacgc

SEQ ID NO: 3778039 - RNA, 19 nt, Salmonella typhimurium LT2
ccacauauaaguaacuggu

SEQ ID NO: 3778040 - RNA, 14 nt, Salmonella typhimurium LT2
ccacaucagaccgc

SEQ ID NO: 3778041 - RNA, 19 nt, Salmonella typhimurium LT2
ccacaucagaccgccaagc

SEQ ID NO: 3778042 - RNA, 22 nt, Salmonella typhimurium LT2
ccacaucagaccgccaagcgcg

SEQ ID NO: 3778043 - RNA, 13 nt, Salmonella typhimurium LT2
ccacaugaacucg

SEQ ID NO: 3778044 - RNA, 22 nt, Salmonella typhimurium LT2
ccacaugaacucgacuuuuucc

SEQ ID NO: 3778045 - RNA, 23 nt, Salmonella typhimurium LT2
ccacaugccggugcgagaaaaag

SEQ ID NO: 3778046 - RNA, 15 nt, Salmonella typhimurium LT2
ccacauugaccccau

SEQ ID NO: 3778047 - RNA, 11 nt, Salmonella typhimurium LT2
ccacauuucaa

SEQ ID NO: 3778048 - RNA, 11 nt, Salmonella typhimurium LT2
ccaccaccauc

SEQ ID NO: 3778049 - RNA, 13 nt, Salmonella typhimurium LT2
ccaccacgcagcc

SEQ ID NO: 3778050 - RNA, 13 nt, Salmonella typhimurium LT2
ccaccacgcccaa

SEQ ID NO: 3778051 - RNA, 13 nt, Salmonella typhimurium LT2
ccaccacggcgca

SEQ ID NO: 3778052 - RNA, 20 nt, Salmonella typhimurium LT2
ccaccacugauuccagagcg

SEQ ID NO: 3778053 - RNA, 12 nt, Salmonella typhimurium LT2
ccaccagaaccu

SEQ ID NO: 3778054 - RNA, 23 nt, Salmonella typhimurium LT2
ccaccagcccaucuuucgccagc

SEQ ID NO: 3778055 - RNA, 23 nt, Salmonella typhimurium LT2
ccaccagccgauaacucuucauc

SEQ ID NO: 3778056 - RNA, 17 nt, Salmonella typhimurium LT2
ccaccagccuaaaaaca

SEQ ID NO: 3778057 - RNA, 18 nt, Salmonella typhimurium LT2
ccaccagccuaaaaacag

SEQ ID NO: 3778058 - RNA, 18 nt, Salmonella typhimurium LT2
ccaccagcgccagcgacu

SEQ ID NO: 3778059 - RNA, 13 nt, Salmonella typhimurium LT2
ccaccagcgccau

SEQ ID NO: 3778060 - RNA, 19 nt, Salmonella typhimurium LT2
ccaccagcgguuggaucuc

SEQ ID NO: 3778061 - RNA, 21 nt, Salmonella typhimurium LT2
ccaccagcgguuggaucucac

SEQ ID NO: 3778062 - RNA, 22 nt, Salmonella typhimurium LT2
ccaccaggauaaaggccgggaa

SEQ ID NO: 3778063 - RNA, 13 nt, Salmonella typhimurium LT2
ccaccagucccug

SEQ ID NO: 3778064 - RNA, 23 nt, Salmonella typhimurium LT2
ccaccauaaaaccauucaaauuc

SEQ ID NO: 3778065 - RNA, 15 nt, Salmonella typhimurium LT2
ccaccauaggccagc

SEQ ID NO: 3778066 - RNA, 15 nt, Salmonella typhimurium LT2
ccaccauauucgcca

SEQ ID NO: 3778067 - RNA, 14 nt, Salmonella typhimurium LT2
ccaccauccggcaa

SEQ ID NO: 3778068 - RNA, 18 nt, Salmonella typhimurium LT2
ccaccaucgucgccagac

SEQ ID NO: 3778069 - RNA, 19 nt, Salmonella typhimurium LT2
ccaccaucuucaagcuuua

SEQ ID NO: 3778070 - RNA, 13 nt, Salmonella typhimurium LT2
ccaccccacagca

SEQ ID NO: 3778071 - RNA, 22 nt, Salmonella typhimurium LT2
ccaccccagguuauucaggugg

SEQ ID NO: 3778072 - RNA, 15 nt, Salmonella typhimurium LT2
ccacccgccugcgcc

SEQ ID NO: 3778073 - RNA, 10 nt, Salmonella typhimurium LT2
ccacccgcgu

SEQ ID NO: 3778074 - RNA, 17 nt, Salmonella typhimurium LT2
ccacccggcuuuuuuau

SEQ ID NO: 3778075 - RNA, 22 nt, Salmonella typhimurium LT2
ccacccgggccggaagagcgca

SEQ ID NO: 3778076 - RNA, 23 nt, Salmonella typhimurium LT2
ccacccuacaucuccuuaacaca

SEQ ID NO: 3778077 - RNA, 11 nt, Salmonella typhimurium LT2
ccaccgaauuc

SEQ ID NO: 3778078 - RNA, 17 nt, Salmonella typhimurium LT2
ccaccgccgccaccaaa

SEQ ID NO: 3778079 - RNA, 18 nt, Salmonella typhimurium LT2
ccaccgccgccaccaaaa

SEQ ID NO: 3778080 - RNA, 15 nt, Salmonella typhimurium LT2
ccaccgcuccgcgca

SEQ ID NO: 3778081 - RNA, 23 nt, Salmonella typhimurium LT2
ccaccggaccuaauaaccagccc

SEQ ID NO: 3778082 - RNA, 23 nt, Salmonella typhimurium LT2
ccaccggagcggcguccgccagc

SEQ ID NO: 3778083 - RNA, 14 nt, Salmonella typhimurium LT2
ccaccgggccguca

SEQ ID NO: 3778084 - RNA, 22 nt, Salmonella typhimurium LT2
ccaccggguccagucgcgccgc

SEQ ID NO: 3778085 - RNA, 15 nt, Salmonella typhimurium LT2
ccaccguaacuaaaa

SEQ ID NO: 3778086 - RNA, 21 nt, Salmonella typhimurium LT2
ccaccguaugugcgccgugca

SEQ ID NO: 3778087 - RNA, 13 nt, Salmonella typhimurium LT2
ccaccguauuuuu

SEQ ID NO: 3778088 - RNA, 15 nt, Salmonella typhimurium LT2
ccaccguuauuucca

SEQ ID NO: 3778089 - RNA, 22 nt, Salmonella typhimurium LT2
ccaccugaaccucuucaccggu

SEQ ID NO: 3778090 - RNA, 18 nt, Salmonella typhimurium LT2
ccaccugaauaacccgca

SEQ ID NO: 3778091 - RNA, 16 nt, Salmonella typhimurium LT2
ccaccugaucgccgac

SEQ ID NO: 3778092 - RNA, 22 nt, Salmonella typhimurium LT2
ccaccugcauggggaaauacug

SEQ ID NO: 3778093 - RNA, 19 nt, Salmonella typhimurium LT2
ccaccuguuucgccaggcc

SEQ ID NO: 3778094 - RNA, 21 nt, Salmonella typhimurium LT2
ccaccuuaaucgacuucaugc

SEQ ID NO: 3778095 - RNA, 13 nt, Salmonella typhimurium LT2
ccaccuuccaggg

SEQ ID NO: 3778096 - RNA, 16 nt, Salmonella typhimurium LT2
ccacgaaagucuguuc

SEQ ID NO: 3778097 - RNA, 17 nt, Salmonella typhimurium LT2
ccacgaacaguucgguc

SEQ ID NO: 3778098 - RNA, 15 nt, Salmonella typhimurium LT2
ccacgaaugccgaua

SEQ ID NO: 3778099 - RNA, 16 nt, Salmonella typhimurium LT2
ccacgacaauauccuc

SEQ ID NO: 3778100 - RNA, 18 nt, Salmonella typhimurium LT2
ccacgacagaacccggcu

SEQ ID NO: 3778101 - RNA, 18 nt, Salmonella typhimurium LT2
ccacgaccuacaccguau

SEQ ID NO: 3778102 - RNA, 17 nt, Salmonella typhimurium LT2
ccacgacgaccgccaga

SEQ ID NO: 3778103 - RNA, 14 nt, Salmonella typhimurium LT2
ccacgaguggcgcg

SEQ ID NO: 3778104 - RNA, 17 nt, Salmonella typhimurium LT2
ccacgaguuaucgauuc

SEQ ID NO: 3778105 - RNA, 17 nt, Salmonella typhimurium LT2
ccacgauaaccagaccc

SEQ ID NO: 3778106 - RNA, 19 nt, Salmonella typhimurium LT2
ccacgauggucggcgcugg

SEQ ID NO: 3778107 - RNA, 21 nt, Salmonella typhimurium LT2
ccacgauuaaccccccggcga

SEQ ID NO: 3778108 - RNA, 14 nt, Salmonella typhimurium LT2
ccacgcaaaccgcu

SEQ ID NO: 3778109 - RNA, 17 nt, Salmonella typhimurium LT2
ccacgcaaucucuuccg

SEQ ID NO: 3778110 - RNA, 20 nt, Salmonella typhimurium LT2
ccacgcacaguacgcccggc

SEQ ID NO: 3778111 - RNA, 18 nt, Salmonella typhimurium LT2
ccacgcacgccggccccg

SEQ ID NO: 3778112 - RNA, 11 nt, Salmonella typhimurium LT2
ccacgcagccg

SEQ ID NO: 3778113 - RNA, 22 nt, Salmonella typhimurium LT2
ccacgccaaccaucggcacacu

SEQ ID NO: 3778114 - RNA, 21 nt, Salmonella typhimurium LT2
ccacgccaauacgggagagcg

SEQ ID NO: 3778115 - RNA, 18 nt, Salmonella typhimurium LT2
ccacgccaauaugcgcaa

SEQ ID NO: 3778116 - RNA, 20 nt, Salmonella typhimurium LT2
ccacgccaauaugcgcaagg

SEQ ID NO: 3778117 - RNA, 13 nt, Salmonella typhimurium LT2
ccacgccacaaua

SEQ ID NO: 3778118 - RNA, 15 nt, Salmonella typhimurium LT2
ccacgccaccgccgc

SEQ ID NO: 3778119 - RNA, 18 nt, Salmonella typhimurium LT2
ccacgccaccgccgccac

SEQ ID NO: 3778120 - RNA, 17 nt, Salmonella typhimurium LT2
ccacgccagccagccag

SEQ ID NO: 3778121 - RNA, 18 nt, Salmonella typhimurium LT2
ccacgccagccagccagu

SEQ ID NO: 3778122 - RNA, 21 nt, Salmonella typhimurium LT2
ccacgccauaauggcccagcg

SEQ ID NO: 3778123 - RNA, 17 nt, Salmonella typhimurium LT2
ccacgccauggccgcag

SEQ ID NO: 3778124 - RNA, 18 nt, Salmonella typhimurium LT2
ccacgccccuaaggcagc

SEQ ID NO: 3778125 - RNA, 20 nt, Salmonella typhimurium LT2
ccacgccgaccaccagcuug

SEQ ID NO: 3778126 - RNA, 20 nt, Salmonella typhimurium LT2
ccacgccgagaaacaccaga

SEQ ID NO: 3778127 - RNA, 20 nt, Salmonella typhimurium LT2
ccacgccgcacacagcggaa

SEQ ID NO: 3778128 - RNA, 14 nt, Salmonella typhimurium LT2
ccacgccgccgcgu

SEQ ID NO: 3778129 - RNA, 18 nt, Salmonella typhimurium LT2
ccacgccgcuaucgacca

SEQ ID NO: 3778130 - RNA, 14 nt, Salmonella typhimurium LT2
ccacgccguagcug

SEQ ID NO: 3778131 - RNA, 14 nt, Salmonella typhimurium LT2
ccacgccguccgga

SEQ ID NO: 3778132 - RNA, 19 nt, Salmonella typhimurium LT2
ccacgccuuucacgccgaa

SEQ ID NO: 3778133 - RNA, 14 nt, Salmonella typhimurium LT2
ccacgcgacgccag

SEQ ID NO: 3778134 - RNA, 16 nt, Salmonella typhimurium LT2
ccacgcgagcugccag

SEQ ID NO: 3778135 - RNA, 15 nt, Salmonella typhimurium LT2
ccacgcgccagccgu

SEQ ID NO: 3778136 - RNA, 14 nt, Salmonella typhimurium LT2
ccacgcgccgccga

SEQ ID NO: 3778137 - RNA, 18 nt, Salmonella typhimurium LT2
ccacgcgcucgugcaaau

SEQ ID NO: 3778138 - RNA, 14 nt, Salmonella typhimurium LT2
ccacgcucacuuuu

SEQ ID NO: 3778139 - RNA, 15 nt, Salmonella typhimurium LT2
ccacgcuccagcgga

SEQ ID NO: 3778140 - RNA, 15 nt, Salmonella typhimurium LT2
ccacgcuccaucaua

SEQ ID NO: 3778141 - RNA, 17 nt, Salmonella typhimurium LT2
ccacgcucgcuggugcc

SEQ ID NO: 3778142 - RNA, 14 nt, Salmonella typhimurium LT2
ccacgcuuuuccuu

SEQ ID NO: 3778143 - RNA, 19 nt, Salmonella typhimurium LT2
ccacgcuuuuuaccggcga

SEQ ID NO: 3778144 - RNA, 22 nt, Salmonella typhimurium LT2
ccacggacaucggcuucgcugg

SEQ ID NO: 3778145 - RNA, 12 nt, Salmonella typhimurium LT2
ccacggagagcg

SEQ ID NO: 3778146 - RNA, 19 nt, Salmonella typhimurium LT2
ccacggauauuuaccgccg

SEQ ID NO: 3778147 - RNA, 20 nt, Salmonella typhimurium LT2
ccacggauauuuaccgccgc

SEQ ID NO: 3778148 - RNA, 20 nt, Salmonella typhimurium LT2
ccacggaugauccucauaaa

SEQ ID NO: 3778149 - RNA, 18 nt, Salmonella typhimurium LT2
ccacggccaacuuauccg

SEQ ID NO: 3778150 - RNA, 12 nt, Salmonella typhimurium LT2
ccacggccagca

SEQ ID NO: 3778151 - RNA, 15 nt, Salmonella typhimurium LT2
ccacggccagcagcc

SEQ ID NO: 3778152 - RNA, 23 nt, Salmonella typhimurium LT2
ccacggcguagcgagaaggcuuu

SEQ ID NO: 3778153 - RNA, 18 nt, Salmonella typhimurium LT2
ccacggcuucagcggcgc

SEQ ID NO: 3778154 - RNA, 11 nt, Salmonella typhimurium LT2
ccacgguaauu

SEQ ID NO: 3778155 - RNA, 16 nt, Salmonella typhimurium LT2
ccacgguguaccccgc

SEQ ID NO: 3778156 - RNA, 22 nt, Salmonella typhimurium LT2
ccacgguguggcccagcgcggu

SEQ ID NO: 3778157 - RNA, 16 nt, Salmonella typhimurium LT2
ccacgguucucaccgu

SEQ ID NO: 3778158 - RNA, 18 nt, Salmonella typhimurium LT2
ccacgguucucaccgugg

SEQ ID NO: 3778159 - RNA, 17 nt, Salmonella typhimurium LT2
ccacguaacucggcagc

SEQ ID NO: 3778160 - RNA, 21 nt, Salmonella typhimurium LT2
ccacgucggauaagguguagc

SEQ ID NO: 3778161 - RNA, 18 nt, Salmonella typhimurium LT2
ccacgugcggacguagcg

SEQ ID NO: 3778162 - RNA, 14 nt, Salmonella typhimurium LT2
ccacuaacuggcaa

SEQ ID NO: 3778163 - RNA, 15 nt, Salmonella typhimurium LT2
ccacuaacuggcaau

SEQ ID NO: 3778164 - RNA, 13 nt, Salmonella typhimurium LT2
ccacuacgcagcu

SEQ ID NO: 3778165 - RNA, 18 nt, Salmonella typhimurium LT2
ccacuacgcagcuccagc

SEQ ID NO: 3778166 - RNA, 14 nt, Salmonella typhimurium LT2
ccacuagcgccgcc

SEQ ID NO: 3778167 - RNA, 21 nt, Salmonella typhimurium LT2
ccacucagcgcuguuuuuccg

SEQ ID NO: 3778168 - RNA, 15 nt, Salmonella typhimurium LT2
ccacucauccagcaa

SEQ ID NO: 3778169 - RNA, 16 nt, Salmonella typhimurium LT2
ccacuccaucgccuga

SEQ ID NO: 3778170 - RNA, 14 nt, Salmonella typhimurium LT2
ccacuccgccacaa

SEQ ID NO: 3778171 - RNA, 18 nt, Salmonella typhimurium LT2
ccacuccgccaguacaua

SEQ ID NO: 3778172 - RNA, 15 nt, Salmonella typhimurium LT2
ccacucgauucccau

SEQ ID NO: 3778173 - RNA, 20 nt, Salmonella typhimurium LT2
ccacugauaguccaucaccu

SEQ ID NO: 3778174 - RNA, 22 nt, Salmonella typhimurium LT2
ccacugauggaguuucaucagc

SEQ ID NO: 3778175 - RNA, 17 nt, Salmonella typhimurium LT2
ccacugcccgccgccac

SEQ ID NO: 3778176 - RNA, 17 nt, Salmonella typhimurium LT2
ccacuggauuaucgaaa

SEQ ID NO: 3778177 - RNA, 13 nt, Salmonella typhimurium LT2
ccacuggcccccu

SEQ ID NO: 3778178 - RNA, 17 nt, Salmonella typhimurium LT2
ccacugguaggcaucca

SEQ ID NO: 3778179 - RNA, 18 nt, Salmonella typhimurium LT2
ccacuggugacaucgcca

SEQ ID NO: 3778180 - RNA, 15 nt, Salmonella typhimurium LT2
ccacuguauuccguu

SEQ ID NO: 3778181 - RNA, 14 nt, Salmonella typhimurium LT2
ccacugugauacac

SEQ ID NO: 3778182 - RNA, 19 nt, Salmonella typhimurium LT2
ccacuuaacguuaccuuua

SEQ ID NO: 3778183 - RNA, 21 nt, Salmonella typhimurium LT2
ccacuucaacgccgcgcuucu

SEQ ID NO: 3778184 - RNA, 19 nt, Salmonella typhimurium LT2
ccacuuccagcgcgccguc

SEQ ID NO: 3778185 - RNA, 13 nt, Salmonella typhimurium LT2
ccacuucgccggu

SEQ ID NO: 3778186 - RNA, 18 nt, Salmonella typhimurium LT2
ccacuucugacagaauau

SEQ ID NO: 3778187 - RNA, 21 nt, Salmonella typhimurium LT2
ccacuucuuccagcggcaggc

SEQ ID NO: 3778188 - RNA, 19 nt, Salmonella typhimurium LT2
ccacuugauucugcagcga

SEQ ID NO: 3778189 - RNA, 20 nt, Salmonella typhimurium LT2
ccacuuggcgaucaccagca

SEQ ID NO: 3778190 - RNA, 21 nt, Salmonella typhimurium LT2
ccacuuuaccgcucacaaugc

SEQ ID NO: 3778191 - RNA, 14 nt, Salmonella typhimurium LT2
ccacuuucagcucc

SEQ ID NO: 3778192 - RNA, 21 nt, Salmonella typhimurium LT2
ccacuuucucggcuuuccagc

SEQ ID NO: 3778193 - RNA, 13 nt, Salmonella typhimurium LT2
ccacuuugcgcuc

SEQ ID NO: 3778194 - RNA, 16 nt, Salmonella typhimurium LT2
ccacuuugcgcuccug

SEQ ID NO: 3778195 - RNA, 15 nt, Salmonella typhimurium LT2
ccacuuugggccgaa

SEQ ID NO: 3778196 - RNA, 16 nt, Salmonella typhimurium LT2
ccagaaaaagggaaaa

SEQ ID NO: 3778197 - RNA, 20 nt, Salmonella typhimurium LT2
ccagaaaaccgacagcaaua

SEQ ID NO: 3778198 - RNA, 15 nt, Salmonella typhimurium LT2
ccagaaagaucagca

SEQ ID NO: 3778199 - RNA, 21 nt, Salmonella typhimurium LT2
ccagaacaucaucuucugucc

SEQ ID NO: 3778200 - RNA, 21 nt, Salmonella typhimurium LT2
ccagaaccucaccguccgcca

SEQ ID NO: 3778201 - RNA, 18 nt, Salmonella typhimurium LT2
ccagaaccugcucggcua

SEQ ID NO: 3778202 - RNA, 21 nt, Salmonella typhimurium LT2
ccagaacugcgaaaucaccga

SEQ ID NO: 3778203 - RNA, 13 nt, Salmonella typhimurium LT2
ccagaacugcgua

SEQ ID NO: 3778204 - RNA, 12 nt, Salmonella typhimurium LT2
ccagaagaaaau

SEQ ID NO: 3778205 - RNA, 12 nt, Salmonella typhimurium LT2
ccagaagcacuu

SEQ ID NO: 3778206 - RNA, 14 nt, Salmonella typhimurium LT2
ccagaagcacuucu

SEQ ID NO: 3778207 - RNA, 18 nt, Salmonella typhimurium LT2
ccagaagcgcuuugccaa

SEQ ID NO: 3778208 - RNA, 20 nt, Salmonella typhimurium LT2
ccagaagcgcuuugccaaug

SEQ ID NO: 3778209 - RNA, 12 nt, Salmonella typhimurium LT2
ccagaaguagca

SEQ ID NO: 3778210 - RNA, 19 nt, Salmonella typhimurium LT2
ccagaaguagcagagaaaa

SEQ ID NO: 3778211 - RNA, 23 nt, Salmonella typhimurium LT2
ccagaaguagcagagaaaagguu

SEQ ID NO: 3778212 - RNA, 18 nt, Salmonella typhimurium LT2
ccagaauacacuucucaa

SEQ ID NO: 3778213 - RNA, 15 nt, Salmonella typhimurium LT2
ccagaauacgccgcc

SEQ ID NO: 3778214 - RNA, 16 nt, Salmonella typhimurium LT2
ccagaaucaccucuuu

SEQ ID NO: 3778215 - RNA, 13 nt, Salmonella typhimurium LT2
ccagaaucacguc

SEQ ID NO: 3778216 - RNA, 14 nt, Salmonella typhimurium LT2
ccagaaucagugac

SEQ ID NO: 3778217 - RNA, 16 nt, Salmonella typhimurium LT2
ccagaaucguggcgcc

SEQ ID NO: 3778218 - RNA, 18 nt, Salmonella typhimurium LT2
ccagaaugcccagcaagg

SEQ ID NO: 3778219 - RNA, 22 nt, Salmonella typhimurium LT2
ccagaauuuccuucgcuuccug

SEQ ID NO: 3778220 - RNA, 23 nt, Salmonella typhimurium LT2
ccagacaaaaucuuuccagcucc

SEQ ID NO: 3778221 - RNA, 21 nt, Salmonella typhimurium LT2
ccagacaaaauucagacucaa

SEQ ID NO: 3778222 - RNA, 17 nt, Salmonella typhimurium LT2
ccagacaaacaccgccu

SEQ ID NO: 3778223 - RNA, 17 nt, Salmonella typhimurium LT2
ccagacacuggaaacag

SEQ ID NO: 3778224 - RNA, 15 nt, Salmonella typhimurium LT2
ccagacagauaacac

SEQ ID NO: 3778225 - RNA, 19 nt, Salmonella typhimurium LT2
ccagacagauaacaccagc

SEQ ID NO: 3778226 - RNA, 18 nt, Salmonella typhimurium LT2
ccagacagucgccgcuuc

SEQ ID NO: 3778227 - RNA, 17 nt, Salmonella typhimurium LT2
ccagacaugcacauggu

SEQ ID NO: 3778228 - RNA, 23 nt, Salmonella typhimurium LT2
ccagaccaccgggacugguggca

SEQ ID NO: 3778229 - RNA, 19 nt, Salmonella typhimurium LT2
ccagaccauucaaccagcc

SEQ ID NO: 3778230 - RNA, 23 nt, Salmonella typhimurium LT2
ccagacccacuaacugccgcuga

SEQ ID NO: 3778231 - RNA, 14 nt, Salmonella typhimurium LT2
ccagaccgcuuaac

SEQ ID NO: 3778232 - RNA, 21 nt, Salmonella typhimurium LT2
ccagaccggauugcccgcggc

SEQ ID NO: 3778233 - RNA, 19 nt, Salmonella typhimurium LT2
ccagaccggcaugauggcg

SEQ ID NO: 3778234 - RNA, 18 nt, Salmonella typhimurium LT2
ccagaccguaugccagcc

SEQ ID NO: 3778235 - RNA, 14 nt, Salmonella typhimurium LT2
ccagacgaauaauc

SEQ ID NO: 3778236 - RNA, 14 nt, Salmonella typhimurium LT2
ccagacgccgcgcc

SEQ ID NO: 3778237 - RNA, 14 nt, Salmonella typhimurium LT2
ccagacgcgcagca

SEQ ID NO: 3778238 - RNA, 19 nt, Salmonella typhimurium LT2
ccagacgcugauagccacg

SEQ ID NO: 3778239 - RNA, 15 nt, Salmonella typhimurium LT2
ccagacgggccaggc

SEQ ID NO: 3778240 - RNA, 13 nt, Salmonella typhimurium LT2
ccagacuaaucca

SEQ ID NO: 3778241 - RNA, 16 nt, Salmonella typhimurium LT2
ccagacucaccccuuc

SEQ ID NO: 3778242 - RNA, 22 nt, Salmonella typhimurium LT2
ccagacugagcaaacucaauga

SEQ ID NO: 3778243 - RNA, 16 nt, Salmonella typhimurium LT2
ccagacugugauggcg

SEQ ID NO: 3778244 - RNA, 17 nt, Salmonella typhimurium LT2
ccagagcgcgcuggcaa

SEQ ID NO: 3778245 - RNA, 19 nt, Salmonella typhimurium LT2
ccagaggguaauuucuucc

SEQ ID NO: 3778246 - RNA, 22 nt, Salmonella typhimurium LT2
ccagaguaaccacgauaaagac

SEQ ID NO: 3778247 - RNA, 14 nt, Salmonella typhimurium LT2
ccagagucaccagc

SEQ ID NO: 3778248 - RNA, 14 nt, Salmonella typhimurium LT2
ccagaguuuuaaaa

SEQ ID NO: 3778249 - RNA, 16 nt, Salmonella typhimurium LT2
ccagauaaaucagccc

SEQ ID NO: 3778250 - RNA, 15 nt, Salmonella typhimurium LT2
ccagauaacgcgcau

SEQ ID NO: 3778251 - RNA, 14 nt, Salmonella typhimurium LT2
ccagauaaggcuca

SEQ ID NO: 3778252 - RNA, 18 nt, Salmonella typhimurium LT2
ccagauaauuaugccugu

SEQ ID NO: 3778253 - RNA, 23 nt, Salmonella typhimurium LT2
ccagauacaaaucucaggguguu

SEQ ID NO: 3778254 - RNA, 15 nt, Salmonella typhimurium LT2
ccagauaccccgcca

SEQ ID NO: 3778255 - RNA, 17 nt, Salmonella typhimurium LT2
ccagauagcccucuucc

SEQ ID NO: 3778256 - RNA, 21 nt, Salmonella typhimurium LT2
ccagauagcgcugcgccagau

SEQ ID NO: 3778257 - RNA, 12 nt, Salmonella typhimurium LT2
ccagaucauuac

SEQ ID NO: 3778258 - RNA, 19 nt, Salmonella typhimurium LT2
ccagaucgauauccgugcg

SEQ ID NO: 3778259 - RNA, 17 nt, Salmonella typhimurium LT2
ccagaucgcgucugaca

SEQ ID NO: 3778260 - RNA, 17 nt, Salmonella typhimurium LT2
ccagaucugcauccggg

SEQ ID NO: 3778261 - RNA, 12 nt, Salmonella typhimurium LT2
ccagaugcgcca

SEQ ID NO: 3778262 - RNA, 16 nt, Salmonella typhimurium LT2
ccagaugcgccaguac

SEQ ID NO: 3778263 - RNA, 23 nt, Salmonella typhimurium LT2
ccagaugcgccaguacguuaugc

SEQ ID NO: 3778264 - RNA, 15 nt, Salmonella typhimurium LT2
ccagaugcgccgcgc

SEQ ID NO: 3778265 - RNA, 12 nt, Salmonella typhimurium LT2
ccagaugcgcuu

SEQ ID NO: 3778266 - RNA, 23 nt, Salmonella typhimurium LT2
ccagaugcuuaaugcucugcugu

SEQ ID NO: 3778267 - RNA, 18 nt, Salmonella typhimurium LT2
ccagauggauaaccugcc

SEQ ID NO: 3778268 - RNA, 20 nt, Salmonella typhimurium LT2
ccagauggcgguucgccaca

SEQ ID NO: 3778269 - RNA, 15 nt, Salmonella typhimurium LT2
ccagaugucgccaga

SEQ ID NO: 3778270 - RNA, 18 nt, Salmonella typhimurium LT2
ccagaugucgcggauaug

SEQ ID NO: 3778271 - RNA, 15 nt, Salmonella typhimurium LT2
ccagauguugagcaa

SEQ ID NO: 3778272 - RNA, 23 nt, Salmonella typhimurium LT2
ccagauguugagcaaugggaagg

SEQ ID NO: 3778273 - RNA, 19 nt, Salmonella typhimurium LT2
ccagauguugauacagaaa

SEQ ID NO: 3778274 - RNA, 17 nt, Salmonella typhimurium LT2
ccagauuaucggccagc

SEQ ID NO: 3778275 - RNA, 22 nt, Salmonella typhimurium LT2
ccagauuaucggccagcgccag

SEQ ID NO: 3778276 - RNA, 13 nt, Salmonella typhimurium LT2
ccagauucugaug

SEQ ID NO: 3778277 - RNA, 23 nt, Salmonella typhimurium LT2
ccagauugcucagguuauacugu

SEQ ID NO: 3778278 - RNA, 20 nt, Salmonella typhimurium LT2
ccagauugucgcaaaccacc

SEQ ID NO: 3778279 - RNA, 22 nt, Salmonella typhimurium LT2
ccagauugucgcaaaccaccgg

SEQ ID NO: 3778280 - RNA, 19 nt, Salmonella typhimurium LT2
ccagauuucgcaacagcau

SEQ ID NO: 3778281 - RNA, 20 nt, Salmonella typhimurium LT2
ccagauuuuccaggccgcca

SEQ ID NO: 3778282 - RNA, 13 nt, Salmonella typhimurium LT2
ccagcaaaauaau

SEQ ID NO: 3778283 - RNA, 11 nt, Salmonella typhimurium LT2
ccagcaaaauu

SEQ ID NO: 3778284 - RNA, 22 nt, Salmonella typhimurium LT2
ccagcaaaucaauuugauggcu

SEQ ID NO: 3778285 - RNA, 22 nt, Salmonella typhimurium LT2
ccagcaaaucgcccaucacaug

SEQ ID NO: 3778286 - RNA, 15 nt, Salmonella typhimurium LT2
ccagcaacagcguac

SEQ ID NO: 3778287 - RNA, 17 nt, Salmonella typhimurium LT2
ccagcaacccaccugcc

SEQ ID NO: 3778288 - RNA, 19 nt, Salmonella typhimurium LT2
ccagcaacgcgcuaaaugc

SEQ ID NO: 3778289 - RNA, 16 nt, Salmonella typhimurium LT2
ccagcaacugaccauc

SEQ ID NO: 3778290 - RNA, 18 nt, Salmonella typhimurium LT2
ccagcaaggcugccgcca

SEQ ID NO: 3778291 - RNA, 23 nt, Salmonella typhimurium LT2
ccagcaaguauuggcugccgaca

SEQ ID NO: 3778292 - RNA, 15 nt, Salmonella typhimurium LT2
ccagcaauaacacag

SEQ ID NO: 3778293 - RNA, 22 nt, Salmonella typhimurium LT2
ccagcaauaacacaggcggcgc

SEQ ID NO: 3778294 - RNA, 16 nt, Salmonella typhimurium LT2
ccagcaauaacaggca

SEQ ID NO: 3778295 - RNA, 16 nt, Salmonella typhimurium LT2
ccagcaaugauuuuau

SEQ ID NO: 3778296 - RNA, 19 nt, Salmonella typhimurium LT2
ccagcaaugcacugcgaaa

SEQ ID NO: 3778297 - RNA, 18 nt, Salmonella typhimurium LT2
ccagcaaugccgccgcca

SEQ ID NO: 3778298 - RNA, 15 nt, Salmonella typhimurium LT2
ccagcacagcccagu

SEQ ID NO: 3778299 - RNA, 12 nt, Salmonella typhimurium LT2
ccagcacauuac

SEQ ID NO: 3778300 - RNA, 22 nt, Salmonella typhimurium LT2
ccagcacauuacaggcaucuuc

SEQ ID NO: 3778301 - RNA, 19 nt, Salmonella typhimurium LT2
ccagcacauugagcguaau

SEQ ID NO: 3778302 - RNA, 16 nt, Salmonella typhimurium LT2
ccagcaccaacgccgc

SEQ ID NO: 3778303 - RNA, 12 nt, Salmonella typhimurium LT2
ccagcaccagcg

SEQ ID NO: 3778304 - RNA, 13 nt, Salmonella typhimurium LT2
ccagcaccaggcg

SEQ ID NO: 3778305 - RNA, 15 nt, Salmonella typhimurium LT2
ccagcaccaucuuuu

SEQ ID NO: 3778306 - RNA, 16 nt, Salmonella typhimurium LT2
ccagcaccaucuuuuc

SEQ ID NO: 3778307 - RNA, 14 nt, Salmonella typhimurium LT2
ccagcaccauggcu

SEQ ID NO: 3778308 - RNA, 22 nt, Salmonella typhimurium LT2
ccagcaccucaucccccagccg

SEQ ID NO: 3778309 - RNA, 18 nt, Salmonella typhimurium LT2
ccagcacgcaggcauccg

SEQ ID NO: 3778310 - RNA, 12 nt, Salmonella typhimurium LT2
ccagcacgccua

SEQ ID NO: 3778311 - RNA, 22 nt, Salmonella typhimurium LT2
ccagcacgcuuucaaaaugcgc

SEQ ID NO: 3778312 - RNA, 19 nt, Salmonella typhimurium LT2
ccagcacuaacagcagcaa

SEQ ID NO: 3778313 - RNA, 9 nt, Salmonella typhimurium LT2
ccagcagca

SEQ ID NO: 3778314 - RNA, 15 nt, Salmonella typhimurium LT2
ccagcagcauaaaac

SEQ ID NO: 3778315 - RNA, 21 nt, Salmonella typhimurium LT2
ccagcagcauaaaaccgccgc

SEQ ID NO: 3778316 - RNA, 10 nt, Salmonella typhimurium LT2
ccagcagcca

SEQ ID NO: 3778317 - RNA, 13 nt, Salmonella typhimurium LT2
ccagcagcgccag

SEQ ID NO: 3778318 - RNA, 14 nt, Salmonella typhimurium LT2
ccagcagcggcggg

SEQ ID NO: 3778319 - RNA, 20 nt, Salmonella typhimurium LT2
ccagcaggguauuugcgccc

SEQ ID NO: 3778320 - RNA, 16 nt, Salmonella typhimurium LT2
ccagcagguaucccaa

SEQ ID NO: 3778321 - RNA, 21 nt, Salmonella typhimurium LT2
ccagcaggucgcacuccucug

SEQ ID NO: 3778322 - RNA, 22 nt, Salmonella typhimurium LT2
ccagcaggugcggacugggcug

SEQ ID NO: 3778323 - RNA, 15 nt, Salmonella typhimurium LT2
ccagcauacaaagca

SEQ ID NO: 3778324 - RNA, 23 nt, Salmonella typhimurium LT2
ccagcauagucgcuccccauaaa

SEQ ID NO: 3778325 - RNA, 17 nt, Salmonella typhimurium LT2
ccagcauauaaauaccg

SEQ ID NO: 3778326 - RNA, 14 nt, Salmonella typhimurium LT2
ccagcauauccacc

SEQ ID NO: 3778327 - RNA, 20 nt, Salmonella typhimurium LT2
ccagcauauuaacagugagu

SEQ ID NO: 3778328 - RNA, 21 nt, Salmonella typhimurium LT2
ccagcauauuuuccggcgucu

SEQ ID NO: 3778329 - RNA, 22 nt, Salmonella typhimurium LT2
ccagcauauuuuccggcgucug

SEQ ID NO: 3778330 - RNA, 18 nt, Salmonella typhimurium LT2
ccagcaucaauagcagcu

SEQ ID NO: 3778331 - RNA, 22 nt, Salmonella typhimurium LT2
ccagcaucaauagcagcuucac

SEQ ID NO: 3778332 - RNA, 13 nt, Salmonella typhimurium LT2
ccagcaucacgug

SEQ ID NO: 3778333 - RNA, 20 nt, Salmonella typhimurium LT2
ccagcaucaugggcucauca

SEQ ID NO: 3778334 - RNA, 13 nt, Salmonella typhimurium LT2
ccagcaucgacca

SEQ ID NO: 3778335 - RNA, 21 nt, Salmonella typhimurium LT2
ccagcaucgguagaaugaaug

SEQ ID NO: 3778336 - RNA, 16 nt, Salmonella typhimurium LT2
ccagcaugagccagcc

SEQ ID NO: 3778337 - RNA, 17 nt, Salmonella typhimurium LT2
ccagcaugagccagccc

SEQ ID NO: 3778338 - RNA, 20 nt, Salmonella typhimurium LT2
ccagcaugagccagcccuca

SEQ ID NO: 3778339 - RNA, 15 nt, Salmonella typhimurium LT2
ccagcaugcccgcca

SEQ ID NO: 3778340 - RNA, 22 nt, Salmonella typhimurium LT2
ccagcauggcgucggcgacuuu

SEQ ID NO: 3778341 - RNA, 19 nt, Salmonella typhimurium LT2
ccagcauggucuccagcaa

SEQ ID NO: 3778342 - RNA, 20 nt, Salmonella typhimurium LT2
ccagcauggucuccagcaaa

SEQ ID NO: 3778343 - RNA, 15 nt, Salmonella typhimurium LT2
ccagcauuaccagca

SEQ ID NO: 3778344 - RNA, 23 nt, Salmonella typhimurium LT2
ccagcauuucaaucgcacccgcc

SEQ ID NO: 3778345 - RNA, 9 nt, Salmonella typhimurium LT2
ccagccaaa

SEQ ID NO: 3778346 - RNA, 12 nt, Salmonella typhimurium LT2
ccagccacaaga

SEQ ID NO: 3778347 - RNA, 18 nt, Salmonella typhimurium LT2
ccagccacaagagcagca

SEQ ID NO: 3778348 - RNA, 14 nt, Salmonella typhimurium LT2
ccagccacugcgcc

SEQ ID NO: 3778349 - RNA, 12 nt, Salmonella typhimurium LT2
ccagccagccgu

SEQ ID NO: 3778350 - RNA, 15 nt, Salmonella typhimurium LT2
ccagccagcgccagc

SEQ ID NO: 3778351 - RNA, 18 nt, Salmonella typhimurium LT2
ccagccagggaucaagca

SEQ ID NO: 3778352 - RNA, 21 nt, Salmonella typhimurium LT2
ccagccaguuagcgaccgcgc

SEQ ID NO: 3778353 - RNA, 14 nt, Salmonella typhimurium LT2
ccagccaugccagc

SEQ ID NO: 3778354 - RNA, 23 nt, Salmonella typhimurium LT2
ccagccauggcccaaaagguagc

SEQ ID NO: 3778355 - RNA, 19 nt, Salmonella typhimurium LT2
ccagcccaauacgccagcc

SEQ ID NO: 3778356 - RNA, 14 nt, Salmonella typhimurium LT2
ccagccccaccguc

SEQ ID NO: 3778357 - RNA, 15 nt, Salmonella typhimurium LT2
ccagcccccugccag

SEQ ID NO: 3778358 - RNA, 23 nt, Salmonella typhimurium LT2
ccagcccggaaauaaacgccagu

SEQ ID NO: 3778359 - RNA, 13 nt, Salmonella typhimurium LT2
ccagcccggcgca

SEQ ID NO: 3778360 - RNA, 22 nt, Salmonella typhimurium LT2
ccagcccuaaaaauagcaccag

SEQ ID NO: 3778361 - RNA, 19 nt, Salmonella typhimurium LT2
ccagcccucaacauugccg

SEQ ID NO: 3778362 - RNA, 17 nt, Salmonella typhimurium LT2
ccagccgaucagcgcca

SEQ ID NO: 3778363 - RNA, 17 nt, Salmonella typhimurium LT2
ccagccgaucaucacga

SEQ ID NO: 3778364 - RNA, 15 nt, Salmonella typhimurium LT2
ccagccgcagcucau

SEQ ID NO: 3778365 - RNA, 19 nt, Salmonella typhimurium LT2
ccagccgcaucuuauauuu

SEQ ID NO: 3778366 - RNA, 19 nt, Salmonella typhimurium LT2
ccagccgcgccaucuccuc

SEQ ID NO: 3778367 - RNA, 13 nt, Salmonella typhimurium LT2
ccagccgcugccu

SEQ ID NO: 3778368 - RNA, 23 nt, Salmonella typhimurium LT2
ccagccggaaaucaauuccgguu

SEQ ID NO: 3778369 - RNA, 23 nt, Salmonella typhimurium LT2
ccagccggagagcaguacgccaa

SEQ ID NO: 3778370 - RNA, 17 nt, Salmonella typhimurium LT2
ccagccgggcaggaaaa

SEQ ID NO: 3778371 - RNA, 18 nt, Salmonella typhimurium LT2
ccagccguucaccagcca

SEQ ID NO: 3778372 - RNA, 15 nt, Salmonella typhimurium LT2
ccagccuaaaaacag

SEQ ID NO: 3778373 - RNA, 16 nt, Salmonella typhimurium LT2
ccagccuaccugccgc

SEQ ID NO: 3778374 - RNA, 19 nt, Salmonella typhimurium LT2
ccagccuaccugccgccau

SEQ ID NO: 3778375 - RNA, 16 nt, Salmonella typhimurium LT2
ccagccuaucgccaua

SEQ ID NO: 3778376 - RNA, 19 nt, Salmonella typhimurium LT2
ccagccugaacaucuucca

SEQ ID NO: 3778377 - RNA, 21 nt, Salmonella typhimurium LT2
ccagccugaggaugauacugc

SEQ ID NO: 3778378 - RNA, 23 nt, Salmonella typhimurium LT2
ccagcgaaaugacagccaccagc

SEQ ID NO: 3778379 - RNA, 14 nt, Salmonella typhimurium LT2
ccagcgaaccgcag

SEQ ID NO: 3778380 - RNA, 15 nt, Salmonella typhimurium LT2
ccagcgaaccgcagc

SEQ ID NO: 3778381 - RNA, 14 nt, Salmonella typhimurium LT2
ccagcgaauaauga

SEQ ID NO: 3778382 - RNA, 13 nt, Salmonella typhimurium LT2
ccagcgacaguag

SEQ ID NO: 3778383 - RNA, 23 nt, Salmonella typhimurium LT2
ccagcgacaguaguaucauccau

SEQ ID NO: 3778384 - RNA, 16 nt, Salmonella typhimurium LT2
ccagcgacaucccaga

SEQ ID NO: 3778385 - RNA, 20 nt, Salmonella typhimurium LT2
ccagcgaccaccgucccagu

SEQ ID NO: 3778386 - RNA, 15 nt, Salmonella typhimurium LT2
ccagcgacgcccagu

SEQ ID NO: 3778387 - RNA, 20 nt, Salmonella typhimurium LT2
ccagcgacuccggauagaga

SEQ ID NO: 3778388 - RNA, 15 nt, Salmonella typhimurium LT2
ccagcgagccuucca

SEQ ID NO: 3778389 - RNA, 17 nt, Salmonella typhimurium LT2
ccagcgauaaacgccag

SEQ ID NO: 3778390 - RNA, 19 nt, Salmonella typhimurium LT2
ccagcgauaaacgccagcc

SEQ ID NO: 3778391 - RNA, 12 nt, Salmonella typhimurium LT2
ccagcgauccag

SEQ ID NO: 3778392 - RNA, 17 nt, Salmonella typhimurium LT2
ccagcgaugagcgccag

SEQ ID NO: 3778393 - RNA, 22 nt, Salmonella typhimurium LT2
ccagcgaugagcgccagcaaca

SEQ ID NO: 3778394 - RNA, 20 nt, Salmonella typhimurium LT2
ccagcgcaaccugcgcccgc

SEQ ID NO: 3778395 - RNA, 15 nt, Salmonella typhimurium LT2
ccagcgcaggcaacg

SEQ ID NO: 3778396 - RNA, 17 nt, Salmonella typhimurium LT2
ccagcgcauuaccgccg

SEQ ID NO: 3778397 - RNA, 18 nt, Salmonella typhimurium LT2
ccagcgcauuaccgccgc

SEQ ID NO: 3778398 - RNA, 16 nt, Salmonella typhimurium LT2
ccagcgccaaucacua

SEQ ID NO: 3778399 - RNA, 17 nt, Salmonella typhimurium LT2
ccagcgccagccgcgcc

SEQ ID NO: 3778400 - RNA, 15 nt, Salmonella typhimurium LT2
ccagcgccaguacuu

SEQ ID NO: 3778401 - RNA, 15 nt, Salmonella typhimurium LT2
ccagcgcccccagca

SEQ ID NO: 3778402 - RNA, 12 nt, Salmonella typhimurium LT2
ccagcgccggac

SEQ ID NO: 3778403 - RNA, 16 nt, Salmonella typhimurium LT2
ccagcgccggacugac

SEQ ID NO: 3778404 - RNA, 21 nt, Salmonella typhimurium LT2
ccagcgccgggaaaaucagug

SEQ ID NO: 3778405 - RNA, 19 nt, Salmonella typhimurium LT2
ccagcgccgggauauccuc

SEQ ID NO: 3778406 - RNA, 21 nt, Salmonella typhimurium LT2
ccagcgcgaauuugccccaga

SEQ ID NO: 3778407 - RNA, 24 nt, Salmonella typhimurium LT2
ccagcgcgaauuugccccagauac

SEQ ID NO: 3778408 - RNA, 11 nt, Salmonella typhimurium LT2
ccagcgcgcca

SEQ ID NO: 3778409 - RNA, 11 nt, Salmonella typhimurium LT2
ccagcgcgccc

SEQ ID NO: 3778410 - RNA, 13 nt, Salmonella typhimurium LT2
ccagcgcgcggca

SEQ ID NO: 3778411 - RNA, 20 nt, Salmonella typhimurium LT2
ccagcgcgcgugggaacagc

SEQ ID NO: 3778412 - RNA, 23 nt, Salmonella typhimurium LT2
ccagcgcguaaauaccuuccggc

SEQ ID NO: 3778413 - RNA, 16 nt, Salmonella typhimurium LT2
ccagcgcgugaaccgu

SEQ ID NO: 3778414 - RNA, 16 nt, Salmonella typhimurium LT2
ccagcgcguuuuccau

SEQ ID NO: 3778415 - RNA, 18 nt, Salmonella typhimurium LT2
ccagcgcuauccaggccg

SEQ ID NO: 3778416 - RNA, 18 nt, Salmonella typhimurium LT2
ccagcgcugacaucaucc

SEQ ID NO: 3778417 - RNA, 17 nt, Salmonella typhimurium LT2
ccagcgcuucuguuaaa

SEQ ID NO: 3778418 - RNA, 22 nt, Salmonella typhimurium LT2
ccagcgcuucuguuaaaaaauu

SEQ ID NO: 3778419 - RNA, 19 nt, Salmonella typhimurium LT2
ccagcggaauccccgccgc

SEQ ID NO: 3778420 - RNA, 21 nt, Salmonella typhimurium LT2
ccagcggaauccccgccgcca

SEQ ID NO: 3778421 - RNA, 22 nt, Salmonella typhimurium LT2
ccagcggaugucggucaucagg

SEQ ID NO: 3778422 - RNA, 16 nt, Salmonella typhimurium LT2
ccagcggcaccagcac

SEQ ID NO: 3778423 - RNA, 14 nt, Salmonella typhimurium LT2
ccagcggccacagc

SEQ ID NO: 3778424 - RNA, 19 nt, Salmonella typhimurium LT2
ccagcggccagggcgucaa

SEQ ID NO: 3778425 - RNA, 14 nt, Salmonella typhimurium LT2
ccagcggcccgcgc

SEQ ID NO: 3778426 - RNA, 19 nt, Salmonella typhimurium LT2
ccagcggcgacaguaacug

SEQ ID NO: 3778427 - RNA, 23 nt, Salmonella typhimurium LT2
ccagcggcguuuuuuccugcugg

SEQ ID NO: 3778428 - RNA, 19 nt, Salmonella typhimurium LT2
ccagcgggcugcaagggaa

SEQ ID NO: 3778429 - RNA, 20 nt, Salmonella typhimurium LT2
ccagcgggcuggcauucauu

SEQ ID NO: 3778430 - RNA, 20 nt, Salmonella typhimurium LT2
ccagcgguuucaggccagac

SEQ ID NO: 3778431 - RNA, 22 nt, Salmonella typhimurium LT2
ccagcgguuucaggccagacug

SEQ ID NO: 3778432 - RNA, 14 nt, Salmonella typhimurium LT2
ccagcgguuucaua

SEQ ID NO: 3778433 - RNA, 18 nt, Salmonella typhimurium LT2
ccagcguacaucuuccau

SEQ ID NO: 3778434 - RNA, 21 nt, Salmonella typhimurium LT2
ccagcguacguaacuucuugg

SEQ ID NO: 3778435 - RNA, 20 nt, Salmonella typhimurium LT2
ccagcguaucgcucugcuuc

SEQ ID NO: 3778436 - RNA, 20 nt, Salmonella typhimurium LT2
ccagcguaugauagcgagca

SEQ ID NO: 3778437 - RNA, 17 nt, Salmonella typhimurium LT2
ccagcgucaacugcgcc

SEQ ID NO: 3778438 - RNA, 15 nt, Salmonella typhimurium LT2
ccagcgucacaggcu

SEQ ID NO: 3778439 - RNA, 13 nt, Salmonella typhimurium LT2
ccagcgugaaccu

SEQ ID NO: 3778440 - RNA, 16 nt, Salmonella typhimurium LT2
ccagcgugacccagac

SEQ ID NO: 3778441 - RNA, 19 nt, Salmonella typhimurium LT2
ccagcgugacccagacaaa

SEQ ID NO: 3778442 - RNA, 16 nt, Salmonella typhimurium LT2
ccagcguuaaacuggc

SEQ ID NO: 3778443 - RNA, 18 nt, Salmonella typhimurium LT2
ccagcguugaauaucgua

SEQ ID NO: 3778444 - RNA, 16 nt, Salmonella typhimurium LT2
ccagcguugaccagcc

SEQ ID NO: 3778445 - RNA, 21 nt, Salmonella typhimurium LT2
ccagcuaaaaagcugucgcca

SEQ ID NO: 3778446 - RNA, 22 nt, Salmonella typhimurium LT2
ccagcuaaaccacggaaugaag

SEQ ID NO: 3778447 - RNA, 15 nt, Salmonella typhimurium LT2
ccagcuaaccuguuc

SEQ ID NO: 3778448 - RNA, 15 nt, Salmonella typhimurium LT2
ccagcuauccagcuu

SEQ ID NO: 3778449 - RNA, 19 nt, Salmonella typhimurium LT2
ccagcuauuuuucaccaua

SEQ ID NO: 3778450 - RNA, 22 nt, Salmonella typhimurium LT2
ccagcucaaaugacgaauaccg

SEQ ID NO: 3778451 - RNA, 15 nt, Salmonella typhimurium LT2
ccagcucaaccgcgc

SEQ ID NO: 3778452 - RNA, 14 nt, Salmonella typhimurium LT2
ccagcucaacgccu

SEQ ID NO: 3778453 - RNA, 23 nt, Salmonella typhimurium LT2
ccagcucaccgagacugcccggc

SEQ ID NO: 3778454 - RNA, 13 nt, Salmonella typhimurium LT2
ccagcucauagga

SEQ ID NO: 3778455 - RNA, 14 nt, Salmonella typhimurium LT2
ccagcucauuuuua

SEQ ID NO: 3778456 - RNA, 15 nt, Salmonella typhimurium LT2
ccagcuccauagaaa

SEQ ID NO: 3778457 - RNA, 16 nt, Salmonella typhimurium LT2
ccagcuccauccacca

SEQ ID NO: 3778458 - RNA, 15 nt, Salmonella typhimurium LT2
ccagcucccgcguca

SEQ ID NO: 3778459 - RNA, 17 nt, Salmonella typhimurium LT2
ccagcucgucggccagc

SEQ ID NO: 3778460 - RNA, 15 nt, Salmonella typhimurium LT2
ccagcucguuauuuc

SEQ ID NO: 3778461 - RNA, 20 nt, Salmonella typhimurium LT2
ccagcucuacaucgccgcga

SEQ ID NO: 3778462 - RNA, 14 nt, Salmonella typhimurium LT2
ccagcucugccggu

SEQ ID NO: 3778463 - RNA, 23 nt, Salmonella typhimurium LT2
ccagcucugccgguuggccggcc

SEQ ID NO: 3778464 - RNA, 14 nt, Salmonella typhimurium LT2
ccagcucuucuucg

SEQ ID NO: 3778465 - RNA, 15 nt, Salmonella typhimurium LT2
ccagcucuucuucgc

SEQ ID NO: 3778466 - RNA, 21 nt, Salmonella typhimurium LT2
ccagcucuuuaggcaggaaau

SEQ ID NO: 3778467 - RNA, 14 nt, Salmonella typhimurium LT2
ccagcucuuucaau

SEQ ID NO: 3778468 - RNA, 14 nt, Salmonella typhimurium LT2
ccagcucuuuucug

SEQ ID NO: 3778469 - RNA, 19 nt, Salmonella typhimurium LT2
ccagcugaaacagaauaaa

SEQ ID NO: 3778470 - RNA, 20 nt, Salmonella typhimurium LT2
ccagcugcgcgcuauuccag

SEQ ID NO: 3778471 - RNA, 18 nt, Salmonella typhimurium LT2
ccagcuguuuaagcgccu

SEQ ID NO: 3778472 - RNA, 13 nt, Salmonella typhimurium LT2
ccagcuuaucuga

SEQ ID NO: 3778473 - RNA, 14 nt, Salmonella typhimurium LT2
ccagcuucaggccg

SEQ ID NO: 3778474 - RNA, 15 nt, Salmonella typhimurium LT2
ccagcuucaucauca

SEQ ID NO: 3778475 - RNA, 21 nt, Salmonella typhimurium LT2
ccagcuucaucaucagcagca

SEQ ID NO: 3778476 - RNA, 19 nt, Salmonella typhimurium LT2
ccagcuuggguauagagca

SEQ ID NO: 3778477 - RNA, 17 nt, Salmonella typhimurium LT2
ccaggaaauaaucgagu

SEQ ID NO: 3778478 - RNA, 20 nt, Salmonella typhimurium LT2
ccaggaacaggcccgccaga

SEQ ID NO: 3778479 - RNA, 23 nt, Salmonella typhimurium LT2
ccaggaacgguacggucgucaua

SEQ ID NO: 3778480 - RNA, 19 nt, Salmonella typhimurium LT2
ccaggaagaguaucucucu

SEQ ID NO: 3778481 - RNA, 23 nt, Salmonella typhimurium LT2
ccaggaaguaaauuauuccuuga

SEQ ID NO: 3778482 - RNA, 17 nt, Salmonella typhimurium LT2
ccaggacaacgccggua

SEQ ID NO: 3778483 - RNA, 22 nt, Salmonella typhimurium LT2
ccaggacaacgccgguacgcag

SEQ ID NO: 3778484 - RNA, 23 nt, Salmonella typhimurium LT2
ccaggacaacgccgguacgcagc

SEQ ID NO: 3778485 - RNA, 21 nt, Salmonella typhimurium LT2
ccaggagauaucaaaaguauc

SEQ ID NO: 3778486 - RNA, 15 nt, Salmonella typhimurium LT2
ccaggagcaaaccga

SEQ ID NO: 3778487 - RNA, 15 nt, Salmonella typhimurium LT2
ccaggauaauaauga

SEQ ID NO: 3778488 - RNA, 14 nt, Salmonella typhimurium LT2
ccaggauacacaug

SEQ ID NO: 3778489 - RNA, 13 nt, Salmonella typhimurium LT2
ccaggaucgccgc

SEQ ID NO: 3778490 - RNA, 15 nt, Salmonella typhimurium LT2
ccaggaucgccgcug

SEQ ID NO: 3778491 - RNA, 15 nt, Salmonella typhimurium LT2
ccaggaugccaacca

SEQ ID NO: 3778492 - RNA, 14 nt, Salmonella typhimurium LT2
ccaggcaaaccagc

SEQ ID NO: 3778493 - RNA, 22 nt, Salmonella typhimurium LT2
ccaggcaaagauuaccgggccc

SEQ ID NO: 3778494 - RNA, 16 nt, Salmonella typhimurium LT2
ccaggcaaagcucaac

SEQ ID NO: 3778495 - RNA, 22 nt, Salmonella typhimurium LT2
ccaggcaaaugauuaucuccau

SEQ ID NO: 3778496 - RNA, 20 nt, Salmonella typhimurium LT2
ccaggcaagguuaacgucag

SEQ ID NO: 3778497 - RNA, 16 nt, Salmonella typhimurium LT2
ccaggcacuugagaaa

SEQ ID NO: 3778498 - RNA, 19 nt, Salmonella typhimurium LT2
ccaggcagauccaaauggc

SEQ ID NO: 3778499 - RNA, 20 nt, Salmonella typhimurium LT2
ccaggcagcaccucaauaug

SEQ ID NO: 3778500 - RNA, 19 nt, Salmonella typhimurium LT2
ccaggcagcguggcgagcu

SEQ ID NO: 3778501 - RNA, 16 nt, Salmonella typhimurium LT2
ccaggcauaaaaaaag

SEQ ID NO: 3778502 - RNA, 13 nt, Salmonella typhimurium LT2
ccaggcauagaaa

SEQ ID NO: 3778503 - RNA, 12 nt, Salmonella typhimurium LT2
ccaggccaaaag

SEQ ID NO: 3778504 - RNA, 18 nt, Salmonella typhimurium LT2
ccaggccaauuccgccau

SEQ ID NO: 3778505 - RNA, 11 nt, Salmonella typhimurium LT2
ccaggccagcg

SEQ ID NO: 3778506 - RNA, 13 nt, Salmonella typhimurium LT2
ccaggccaucaga

SEQ ID NO: 3778507 - RNA, 15 nt, Salmonella typhimurium LT2
ccaggccgccaccgc

SEQ ID NO: 3778508 - RNA, 18 nt, Salmonella typhimurium LT2
ccaggccgccaccgccuc

SEQ ID NO: 3778509 - RNA, 20 nt, Salmonella typhimurium LT2
ccaggccgccaccgccucgc

SEQ ID NO: 3778510 - RNA, 12 nt, Salmonella typhimurium LT2
ccaggccgcgcc

SEQ ID NO: 3778511 - RNA, 13 nt, Salmonella typhimurium LT2
ccaggccggcaua

SEQ ID NO: 3778512 - RNA, 15 nt, Salmonella typhimurium LT2
ccaggccgguaaagu

SEQ ID NO: 3778513 - RNA, 21 nt, Salmonella typhimurium LT2
ccaggccguagcgcaucuccu

SEQ ID NO: 3778514 - RNA, 21 nt, Salmonella typhimurium LT2
ccaggccgucggcgccagcca

SEQ ID NO: 3778515 - RNA, 13 nt, Salmonella typhimurium LT2
ccaggccugagcc

SEQ ID NO: 3778516 - RNA, 18 nt, Salmonella typhimurium LT2
ccaggcgaugaauuccug

SEQ ID NO: 3778517 - RNA, 17 nt, Salmonella typhimurium LT2
ccaggcgaugagcguga

SEQ ID NO: 3778518 - RNA, 21 nt, Salmonella typhimurium LT2
ccaggcgcaaggcgucgcugg

SEQ ID NO: 3778519 - RNA, 18 nt, Salmonella typhimurium LT2
ccaggcgcagcaaacggc

SEQ ID NO: 3778520 - RNA, 14 nt, Salmonella typhimurium LT2
ccaggcgcgcaccg

SEQ ID NO: 3778521 - RNA, 17 nt, Salmonella typhimurium LT2
ccaggcgcgcagcugcc

SEQ ID NO: 3778522 - RNA, 23 nt, Salmonella typhimurium LT2
ccaggcgcugcuggcagcgcuga

SEQ ID NO: 3778523 - RNA, 20 nt, Salmonella typhimurium LT2
ccaggcggauaaaacagaaa

SEQ ID NO: 3778524 - RNA, 22 nt, Salmonella typhimurium LT2
ccaggcggcuuuuucaucaucg

SEQ ID NO: 3778525 - RNA, 15 nt, Salmonella typhimurium LT2
ccaggcguccaguug

SEQ ID NO: 3778526 - RNA, 22 nt, Salmonella typhimurium LT2
ccaggcuauaguggauggccca

SEQ ID NO: 3778527 - RNA, 12 nt, Salmonella typhimurium LT2
ccaggcuaucca

SEQ ID NO: 3778528 - RNA, 19 nt, Salmonella typhimurium LT2
ccaggcuggcgcagccgcu

SEQ ID NO: 3778529 - RNA, 15 nt, Salmonella typhimurium LT2
ccaggcuucgcgcag

SEQ ID NO: 3778530 - RNA, 18 nt, Salmonella typhimurium LT2
ccagggaugcgccacagc

SEQ ID NO: 3778531 - RNA, 17 nt, Salmonella typhimurium LT2
ccagggcgaugccccca

SEQ ID NO: 3778532 - RNA, 19 nt, Salmonella typhimurium LT2
ccagggcgggauccccugc

SEQ ID NO: 3778533 - RNA, 18 nt, Salmonella typhimurium LT2
ccagggcugcuggccuuc

SEQ ID NO: 3778534 - RNA, 21 nt, Salmonella typhimurium LT2
ccaggguuaaaaaucgcuaua

SEQ ID NO: 3778535 - RNA, 18 nt, Salmonella typhimurium LT2
ccagguaaauccgccagu

SEQ ID NO: 3778536 - RNA, 19 nt, Salmonella typhimurium LT2
ccagguaacauacaaaaag

SEQ ID NO: 3778537 - RNA, 19 nt, Salmonella typhimurium LT2
ccagguacuuacgcagccg

SEQ ID NO: 3778538 - RNA, 21 nt, Salmonella typhimurium LT2
ccagguacuuacgcagccggu

SEQ ID NO: 3778539 - RNA, 16 nt, Salmonella typhimurium LT2
ccagguauuuagccac

SEQ ID NO: 3778540 - RNA, 18 nt, Salmonella typhimurium LT2
ccaggucaucaccuccag

SEQ ID NO: 3778541 - RNA, 23 nt, Salmonella typhimurium LT2
ccaggucgccgaugucaguucag

SEQ ID NO: 3778542 - RNA, 18 nt, Salmonella typhimurium LT2
ccaggugacuuugcccuu

SEQ ID NO: 3778543 - RNA, 16 nt, Salmonella typhimurium LT2
ccagguggugcaggcu

SEQ ID NO: 3778544 - RNA, 22 nt, Salmonella typhimurium LT2
ccagguuauagaccuguuccau

SEQ ID NO: 3778545 - RNA, 16 nt, Salmonella typhimurium LT2
ccagguuauucaggug

SEQ ID NO: 3778546 - RNA, 17 nt, Salmonella typhimurium LT2
ccagguucaagcuggaa

SEQ ID NO: 3778547 - RNA, 12 nt, Salmonella typhimurium LT2
ccagguucagca

SEQ ID NO: 3778548 - RNA, 17 nt, Salmonella typhimurium LT2
ccagguugaugcaaaug

SEQ ID NO: 3778549 - RNA, 22 nt, Salmonella typhimurium LT2
ccaguaaaaucgggccuccgcg

SEQ ID NO: 3778550 - RNA, 14 nt, Salmonella typhimurium LT2
ccaguaaccaccac

SEQ ID NO: 3778551 - RNA, 20 nt, Salmonella typhimurium LT2
ccaguaacgcguccaacugg

SEQ ID NO: 3778552 - RNA, 15 nt, Salmonella typhimurium LT2
ccaguaacgcuggaa

SEQ ID NO: 3778553 - RNA, 20 nt, Salmonella typhimurium LT2
ccaguaacucaucgccagcc

SEQ ID NO: 3778554 - RNA, 17 nt, Salmonella typhimurium LT2
ccaguaagagaacaaua

SEQ ID NO: 3778555 - RNA, 15 nt, Salmonella typhimurium LT2
ccaguaagggcagcc

SEQ ID NO: 3778556 - RNA, 15 nt, Salmonella typhimurium LT2
ccaguaauuuuuccg

SEQ ID NO: 3778557 - RNA, 17 nt, Salmonella typhimurium LT2
ccaguacaaacaaauaa

SEQ ID NO: 3778558 - RNA, 19 nt, Salmonella typhimurium LT2
ccaguacaaacaaauaaau

SEQ ID NO: 3778559 - RNA, 13 nt, Salmonella typhimurium LT2
ccaguaccgccgc

SEQ ID NO: 3778560 - RNA, 20 nt, Salmonella typhimurium LT2
ccaguacgccaggcuaagau

SEQ ID NO: 3778561 - RNA, 21 nt, Salmonella typhimurium LT2
ccaguacgucaacaaugcuuu

SEQ ID NO: 3778562 - RNA, 15 nt, Salmonella typhimurium LT2
ccaguacuuuggccu

SEQ ID NO: 3778563 - RNA, 12 nt, Salmonella typhimurium LT2
ccaguagcagcg

SEQ ID NO: 3778564 - RNA, 18 nt, Salmonella typhimurium LT2
ccaguagcgcgacgccaa

SEQ ID NO: 3778565 - RNA, 14 nt, Salmonella typhimurium LT2
ccaguagcugcucc

SEQ ID NO: 3778566 - RNA, 23 nt, Salmonella typhimurium LT2
ccaguauaauuucaggcugcuca

SEQ ID NO: 3778567 - RNA, 21 nt, Salmonella typhimurium LT2
ccagucaacgaggugaauaaa

SEQ ID NO: 3778568 - RNA, 14 nt, Salmonella typhimurium LT2
ccagucaauaaaac

SEQ ID NO: 3778569 - RNA, 14 nt, Salmonella typhimurium LT2
ccaguccccuuuuc

SEQ ID NO: 3778570 - RNA, 14 nt, Salmonella typhimurium LT2
ccagucccuguucg

SEQ ID NO: 3778571 - RNA, 22 nt, Salmonella typhimurium LT2
ccagucccuguucgccacccgc

SEQ ID NO: 3778572 - RNA, 21 nt, Salmonella typhimurium LT2
ccaguccuccggcugaagccc

SEQ ID NO: 3778573 - RNA, 18 nt, Salmonella typhimurium LT2
ccaguccugccccugcca

SEQ ID NO: 3778574 - RNA, 15 nt, Salmonella typhimurium LT2
ccagucgcuccacca

SEQ ID NO: 3778575 - RNA, 16 nt, Salmonella typhimurium LT2
ccagucgcuccaccac

SEQ ID NO: 3778576 - RNA, 23 nt, Salmonella typhimurium LT2
ccagucggacagcgacacuccgc

SEQ ID NO: 3778577 - RNA, 20 nt, Salmonella typhimurium LT2
ccagucgggaaacucgccgc

SEQ ID NO: 3778578 - RNA, 13 nt, Salmonella typhimurium LT2
ccagugaaauaaa

SEQ ID NO: 3778579 - RNA, 14 nt, Salmonella typhimurium LT2
ccagugaauacugc

SEQ ID NO: 3778580 - RNA, 19 nt, Salmonella typhimurium LT2
ccagugaauccaccacgua

SEQ ID NO: 3778581 - RNA, 21 nt, Salmonella typhimurium LT2
ccagugacacguaccugccug

SEQ ID NO: 3778582 - RNA, 15 nt, Salmonella typhimurium LT2
ccagugaucggcugg

SEQ ID NO: 3778583 - RNA, 22 nt, Salmonella typhimurium LT2
ccagugcccgaacgcaauacug

SEQ ID NO: 3778584 - RNA, 14 nt, Salmonella typhimurium LT2
ccagugcggcgaga

SEQ ID NO: 3778585 - RNA, 15 nt, Salmonella typhimurium LT2
ccagugcggcgagau

SEQ ID NO: 3778586 - RNA, 14 nt, Salmonella typhimurium LT2
ccagugggcgucaa

SEQ ID NO: 3778587 - RNA, 23 nt, Salmonella typhimurium LT2
ccagugguuccauuccagaacga

SEQ ID NO: 3778588 - RNA, 15 nt, Salmonella typhimurium LT2
ccaguguuguucucu

SEQ ID NO: 3778589 - RNA, 16 nt, Salmonella typhimurium LT2
ccaguuauagcgcaga

SEQ ID NO: 3778590 - RNA, 14 nt, Salmonella typhimurium LT2
ccaguuaucacggu

SEQ ID NO: 3778591 - RNA, 19 nt, Salmonella typhimurium LT2
ccaguuauccuuaauaugu

SEQ ID NO: 3778592 - RNA, 18 nt, Salmonella typhimurium LT2
ccaguuauuaaucaagcc

SEQ ID NO: 3778593 - RNA, 22 nt, Salmonella typhimurium LT2
ccaguucaauauccagcccgcg

SEQ ID NO: 3778594 - RNA, 14 nt, Salmonella typhimurium LT2
ccaguucacgguaa

SEQ ID NO: 3778595 - RNA, 12 nt, Salmonella typhimurium LT2
ccaguucacucc

SEQ ID NO: 3778596 - RNA, 16 nt, Salmonella typhimurium LT2
ccaguucauuaacauc

SEQ ID NO: 3778597 - RNA, 19 nt, Salmonella typhimurium LT2
ccaguucauucgccaccag

SEQ ID NO: 3778598 - RNA, 19 nt, Salmonella typhimurium LT2
ccaguucgccuucuucauc

SEQ ID NO: 3778599 - RNA, 17 nt, Salmonella typhimurium LT2
ccaguucgcgauaggcc

SEQ ID NO: 3778600 - RNA, 15 nt, Salmonella typhimurium LT2
ccaguucucaaucgc

SEQ ID NO: 3778601 - RNA, 17 nt, Salmonella typhimurium LT2
ccaguucuggcugcgcu

SEQ ID NO: 3778602 - RNA, 17 nt, Salmonella typhimurium LT2
ccaguugcauacauaaa

SEQ ID NO: 3778603 - RNA, 17 nt, Salmonella typhimurium LT2
ccaguugcgaagccacu

SEQ ID NO: 3778604 - RNA, 20 nt, Salmonella typhimurium LT2
ccaguugcucauaacggcua

SEQ ID NO: 3778605 - RNA, 19 nt, Salmonella typhimurium LT2
ccaguuggcagggcugaau

SEQ ID NO: 3778606 - RNA, 20 nt, Salmonella typhimurium LT2
ccaguuggcguaccaucagc

SEQ ID NO: 3778607 - RNA, 20 nt, Salmonella typhimurium LT2
ccaguuguccgcuggucagc

SEQ ID NO: 3778608 - RNA, 15 nt, Salmonella typhimurium LT2
ccaguuguucgauaa

SEQ ID NO: 3778609 - RNA, 14 nt, Salmonella typhimurium LT2
ccaguuguuuauuc

SEQ ID NO: 3778610 - RNA, 14 nt, Salmonella typhimurium LT2
ccaguuuacgcgua

SEQ ID NO: 3778611 - RNA, 13 nt, Salmonella typhimurium LT2
ccaguuuauccgc

SEQ ID NO: 3778612 - RNA, 17 nt, Salmonella typhimurium LT2
ccaguuuauccgccguc

SEQ ID NO: 3778613 - RNA, 18 nt, Salmonella typhimurium LT2
ccaguuucaaugcccagg

SEQ ID NO: 3778614 - RNA, 14 nt, Salmonella typhimurium LT2
ccaguuuccugacc

SEQ ID NO: 3778615 - RNA, 18 nt, Salmonella typhimurium LT2
ccaguuuccugacccgcu

SEQ ID NO: 3778616 - RNA, 19 nt, Salmonella typhimurium LT2
ccaguuuccugacccgcuc

SEQ ID NO: 3778617 - RNA, 20 nt, Salmonella typhimurium LT2
ccaguuucgccagcggcagc

SEQ ID NO: 3778618 - RNA, 20 nt, Salmonella typhimurium LT2
ccaguuugcguucacagcac

SEQ ID NO: 3778619 - RNA, 21 nt, Salmonella typhimurium LT2
ccaguuugcguucacagcacc

SEQ ID NO: 3778620 - RNA, 13 nt, Salmonella typhimurium LT2
ccaguuuuuauac

SEQ ID NO: 3778621 - RNA, 17 nt, Salmonella typhimurium LT2
ccaguuuuuuccagcgc

SEQ ID NO: 3778622 - RNA, 12 nt, Salmonella typhimurium LT2
ccauaaaaugau

SEQ ID NO: 3778623 - RNA, 17 nt, Salmonella typhimurium LT2
ccauaaagcgaauaauu

SEQ ID NO: 3778624 - RNA, 17 nt, Salmonella typhimurium LT2
ccauaacaacuauuuuu

SEQ ID NO: 3778625 - RNA, 18 nt, Salmonella typhimurium LT2
ccauaacauaucuccucu

SEQ ID NO: 3778626 - RNA, 13 nt, Salmonella typhimurium LT2
ccauaacccggcu

SEQ ID NO: 3778627 - RNA, 18 nt, Salmonella typhimurium LT2
ccauaacgggaagccgua

SEQ ID NO: 3778628 - RNA, 18 nt, Salmonella typhimurium LT2
ccauaauaaugccaaaau

SEQ ID NO: 3778629 - RNA, 22 nt, Salmonella typhimurium LT2
ccauaauauaaggaucggaaga

SEQ ID NO: 3778630 - RNA, 21 nt, Salmonella typhimurium LT2
ccauaaugaucguaugcagcc

SEQ ID NO: 3778631 - RNA, 14 nt, Salmonella typhimurium LT2
ccauacacaccagc

SEQ ID NO: 3778632 - RNA, 15 nt, Salmonella typhimurium LT2
ccauacacaccagca

SEQ ID NO: 3778633 - RNA, 18 nt, Salmonella typhimurium LT2
ccauacacaccagcagga

SEQ ID NO: 3778634 - RNA, 20 nt, Salmonella typhimurium LT2
ccauacacugcauaaauauc

SEQ ID NO: 3778635 - RNA, 21 nt, Salmonella typhimurium LT2
ccauacacugcauaaauaucu

SEQ ID NO: 3778636 - RNA, 15 nt, Salmonella typhimurium LT2
ccauacccggcuccc

SEQ ID NO: 3778637 - RNA, 16 nt, Salmonella typhimurium LT2
ccauacccggcuccca

SEQ ID NO: 3778638 - RNA, 19 nt, Salmonella typhimurium LT2
ccauacccuguucagcacc

SEQ ID NO: 3778639 - RNA, 16 nt, Salmonella typhimurium LT2
ccauacccuguuugau

SEQ ID NO: 3778640 - RNA, 19 nt, Salmonella typhimurium LT2
ccauaccggacuccaggca

SEQ ID NO: 3778641 - RNA, 20 nt, Salmonella typhimurium LT2
ccauacgcccacgcggcgua

SEQ ID NO: 3778642 - RNA, 20 nt, Salmonella typhimurium LT2
ccauacuauccaacagaagg

SEQ ID NO: 3778643 - RNA, 17 nt, Salmonella typhimurium LT2
ccauacugacuuaauaa

SEQ ID NO: 3778644 - RNA, 21 nt, Salmonella typhimurium LT2
ccauacuggcgaauagcgccu

SEQ ID NO: 3778645 - RNA, 16 nt, Salmonella typhimurium LT2
ccauacuuacugcugu

SEQ ID NO: 3778646 - RNA, 22 nt, Salmonella typhimurium LT2
ccauagcguuuaaaaagcugca

SEQ ID NO: 3778647 - RNA, 23 nt, Salmonella typhimurium LT2
ccauagcguuuaaaaagcugcau

SEQ ID NO: 3778648 - RNA, 16 nt, Salmonella typhimurium LT2
ccauagggcagggugc

SEQ ID NO: 3778649 - RNA, 15 nt, Salmonella typhimurium LT2
ccauaggucagcgcu

SEQ ID NO: 3778650 - RNA, 14 nt, Salmonella typhimurium LT2
ccauaguccaugcc

SEQ ID NO: 3778651 - RNA, 19 nt, Salmonella typhimurium LT2
ccauauaacagaauaagcc

SEQ ID NO: 3778652 - RNA, 14 nt, Salmonella typhimurium LT2
ccauauaugaaauc

SEQ ID NO: 3778653 - RNA, 14 nt, Salmonella typhimurium LT2
ccauaucaaucaac

SEQ ID NO: 3778654 - RNA, 21 nt, Salmonella typhimurium LT2
ccauaucaguuaugacagaca

SEQ ID NO: 3778655 - RNA, 17 nt, Salmonella typhimurium LT2
ccauaucgaccuuuuuc

SEQ ID NO: 3778656 - RNA, 22 nt, Salmonella typhimurium LT2
ccauaugcccccgcgcaggcgg

SEQ ID NO: 3778657 - RNA, 13 nt, Salmonella typhimurium LT2
ccauauucaguuu

SEQ ID NO: 3778658 - RNA, 12 nt, Salmonella typhimurium LT2
ccauauugcugu

SEQ ID NO: 3778659 - RNA, 18 nt, Salmonella typhimurium LT2
ccauauuuaugcagcgcg

SEQ ID NO: 3778660 - RNA, 12 nt, Salmonella typhimurium LT2
ccauauuuucca

SEQ ID NO: 3778661 - RNA, 21 nt, Salmonella typhimurium LT2
ccaucaaauaauacgccggca

SEQ ID NO: 3778662 - RNA, 18 nt, Salmonella typhimurium LT2
ccaucaauccauuucgcc

SEQ ID NO: 3778663 - RNA, 16 nt, Salmonella typhimurium LT2
ccaucacaugcggaug

SEQ ID NO: 3778664 - RNA, 14 nt, Salmonella typhimurium LT2
ccaucaccucuucg

SEQ ID NO: 3778665 - RNA, 13 nt, Salmonella typhimurium LT2
ccauucaccugcc

SEQ ID NO: 3778666 - RNA, 14 nt, Salmonella typhimurium LT2
ccauucccaccaua

SEQ ID NO: 3778667 - RNA, 17 nt, Salmonella typhimurium LT2
ccauucccgauaaugac

SEQ ID NO: 3778668 - RNA, 20 nt, Salmonella typhimurium LT2
ccauucccgauaaugaccga

SEQ ID NO: 3778669 - RNA, 14 nt, Salmonella typhimurium LT2
ccauucccguaaaa

SEQ ID NO: 3778670 - RNA, 22 nt, Salmonella typhimurium LT2
ccauucgccagcccgaucaucu

SEQ ID NO: 3778671 - RNA, 18 nt, Salmonella typhimurium LT2
ccauucgcucgauaauau

SEQ ID NO: 3778672 - RNA, 16 nt, Salmonella typhimurium LT2
ccauucggccugcggu

SEQ ID NO: 3778673 - RNA, 13 nt, Salmonella typhimurium LT2
ccauucuucaaca

SEQ ID NO: 3778674 - RNA, 23 nt, Salmonella typhimurium LT2
ccauucuuucgucacuaacucca

SEQ ID NO: 3778675 - RNA, 13 nt, Salmonella typhimurium LT2
ccauugagcagcc

SEQ ID NO: 3778676 - RNA, 14 nt, Salmonella typhimurium LT2
ccauugagcagccg

SEQ ID NO: 3778677 - RNA, 16 nt, Salmonella typhimurium LT2
ccauugaugccugccc

SEQ ID NO: 3778678 - RNA, 22 nt, Salmonella typhimurium LT2
ccauugauuguugccgucgcug

SEQ ID NO: 3778679 - RNA, 13 nt, Salmonella typhimurium LT2
ccauugccagaua

SEQ ID NO: 3778680 - RNA, 12 nt, Salmonella typhimurium LT2
ccauugcccauu

SEQ ID NO: 3778681 - RNA, 11 nt, Salmonella typhimurium LT2
ccauugccgcg

SEQ ID NO: 3778682 - RNA, 19 nt, Salmonella typhimurium LT2
ccauugcgaguuaucuuuu

SEQ ID NO: 3778683 - RNA, 14 nt, Salmonella typhimurium LT2
ccauugcguauuuc

SEQ ID NO: 3778684 - RNA, 16 nt, Salmonella typhimurium LT2
ccauugcugacaaaau

SEQ ID NO: 3778685 - RNA, 21 nt, Salmonella typhimurium LT2
ccauugcugcuauauaacaua

SEQ ID NO: 3778686 - RNA, 16 nt, Salmonella typhimurium LT2
ccauugcuuuuuugau

SEQ ID NO: 3778687 - RNA, 18 nt, Salmonella typhimurium LT2
ccauuggcucggcgucau

SEQ ID NO: 3778688 - RNA, 22 nt, Salmonella typhimurium LT2
ccauuggucuggauugcagaga

SEQ ID NO: 3778689 - RNA, 23 nt, Salmonella typhimurium LT2
ccauuguugucauuguaaaaccg

SEQ ID NO: 3778690 - RNA, 13 nt, Salmonella typhimurium LT2
ccauuuauaaaau

SEQ ID NO: 3778691 - RNA, 12 nt, Salmonella typhimurium LT2
ccauuucagccc

SEQ ID NO: 3778692 - RNA, 18 nt, Salmonella typhimurium LT2
ccauuuccggcgcgccua

SEQ ID NO: 3778693 - RNA, 18 nt, Salmonella typhimurium LT2
ccauuucuucuucaagcc

SEQ ID NO: 3778694 - RNA, 22 nt, Salmonella typhimurium LT2
ccauuugaacucuuccagauac

SEQ ID NO: 3778695 - RNA, 17 nt, Salmonella typhimurium LT2
ccauuugccagauagcg

SEQ ID NO: 3778696 - RNA, 16 nt, Salmonella typhimurium LT2
ccauuuggcuuaaaua

SEQ ID NO: 3778697 - RNA, 12 nt, Salmonella typhimurium LT2
ccauuuuaaccu

SEQ ID NO: 3778698 - RNA, 23 nt, Salmonella typhimurium LT2
ccauuuuggggaaaauaccggua

SEQ ID NO: 3778699 - RNA, 10 nt, Salmonella typhimurium LT2
ccauuuuuac

SEQ ID NO: 3778700 - RNA, 19 nt, Salmonella typhimurium LT2
ccauuuuucgaucuucucc

SEQ ID NO: 3778701 - RNA, 19 nt, Salmonella typhimurium LT2
cccaaacgucguaaaaccu

SEQ ID NO: 3778702 - RNA, 15 nt, Salmonella typhimurium LT2
cccaacaccagcacu

SEQ ID NO: 3778703 - RNA, 19 nt, Salmonella typhimurium LT2
cccaacagcgaccacgcca

SEQ ID NO: 3778704 - RNA, 14 nt, Salmonella typhimurium LT2
cccaaccagcccag

SEQ ID NO: 3778705 - RNA, 12 nt, Salmonella typhimurium LT2
cccaaccagugg

SEQ ID NO: 3778706 - RNA, 14 nt, Salmonella typhimurium LT2
cccaacccgaccag

SEQ ID NO: 3778707 - RNA, 15 nt, Salmonella typhimurium LT2
cccaacgaccauaaa

SEQ ID NO: 3778708 - RNA, 17 nt, Salmonella typhimurium LT2
cccaacgagagcacuac

SEQ ID NO: 3778709 - RNA, 23 nt, Salmonella typhimurium LT2
cccaacgcuucggcgaucgcuuu

SEQ ID NO: 3778710 - RNA, 22 nt, Salmonella typhimurium LT2
cccaacggaugcgccaucccau

SEQ ID NO: 3778711 - RNA, 16 nt, Salmonella typhimurium LT2
cccaacugagcgccaa

SEQ ID NO: 3778712 - RNA, 22 nt, Salmonella typhimurium LT2
cccaauaacuguggguugccau

SEQ ID NO: 3778713 - RNA, 15 nt, Salmonella typhimurium LT2
cccaauaccacaacc

SEQ ID NO: 3778714 - RNA, 13 nt, Salmonella typhimurium LT2
cccaauaccggcg

SEQ ID NO: 3778715 - RNA, 22 nt, Salmonella typhimurium LT2
cccaauacgccagccuaucgcc

SEQ ID NO: 3778716 - RNA, 22 nt, Salmonella typhimurium LT2
cccaaucagguuugagcggugg

SEQ ID NO: 3778717 - RNA, 15 nt, Salmonella typhimurium LT2
cccacaaccgacgca

SEQ ID NO: 3778718 - RNA, 16 nt, Salmonella typhimurium LT2
cccacaacgcaccaac

SEQ ID NO: 3778719 - RNA, 14 nt, Salmonella typhimurium LT2
cccacaccacagcc

SEQ ID NO: 3778720 - RNA, 18 nt, Salmonella typhimurium LT2
cccacacuaccaucggcg

SEQ ID NO: 3778721 - RNA, 22 nt, Salmonella typhimurium LT2
cccacacugaauuacugcguaa

SEQ ID NO: 3778722 - RNA, 19 nt, Salmonella typhimurium LT2
cccacagcuugccguagcg

SEQ ID NO: 3778723 - RNA, 12 nt, Salmonella typhimurium LT2
cccaccaccauu

SEQ ID NO: 3778724 - RNA, 13 nt, Salmonella typhimurium LT2
cccaccagccgca

SEQ ID NO: 3778725 - RNA, 12 nt, Salmonella typhimurium LT2
cccaccauguca

SEQ ID NO: 3778726 - RNA, 17 nt, Salmonella typhimurium LT2
cccaccauuccgauagc

SEQ ID NO: 3778727 - RNA, 15 nt, Salmonella typhimurium LT2
cccaccgauuucagc

SEQ ID NO: 3778728 - RNA, 12 nt, Salmonella typhimurium LT2
cccaccgcgcac

SEQ ID NO: 3778729 - RNA, 18 nt, Salmonella typhimurium LT2
cccaccggaccgccgagc

SEQ ID NO: 3778730 - RNA, 15 nt, Salmonella typhimurium LT2
cccaccugcagcagc

SEQ ID NO: 3778731 - RNA, 21 nt, Salmonella typhimurium LT2
cccacgauacgucccugcugg

SEQ ID NO: 3778732 - RNA, 12 nt, Salmonella typhimurium LT2
cccacgccaucg

SEQ ID NO: 3778733 - RNA, 15 nt, Salmonella typhimurium LT2
cccacgggccgccau

SEQ ID NO: 3778734 - RNA, 13 nt, Salmonella typhimurium LT2
cccacgucauccg

SEQ ID NO: 3778735 - RNA, 13 nt, Salmonella typhimurium LT2
cccacugaccugc

SEQ ID NO: 3778736 - RNA, 20 nt, Salmonella typhimurium LT2
cccacuuggcgaucaccagc

SEQ ID NO: 3778737 - RNA, 21 nt, Salmonella typhimurium LT2
cccacuuggcgaucaccagca

SEQ ID NO: 3778738 - RNA, 16 nt, Salmonella typhimurium LT2
cccacuuucagcuccg

SEQ ID NO: 3778739 - RNA, 16 nt, Salmonella typhimurium LT2
cccacuuugcucacca

SEQ ID NO: 3778740 - RNA, 18 nt, Salmonella typhimurium LT2
cccacuuugcucaccacg

SEQ ID NO: 3778741 - RNA, 20 nt, Salmonella typhimurium LT2
cccagaaaaugcucaguaug

SEQ ID NO: 3778742 - RNA, 16 nt, Salmonella typhimurium LT2
cccagaaucguggcgc

SEQ ID NO: 3778743 - RNA, 12 nt, Salmonella typhimurium LT2
cccagacacaga

SEQ ID NO: 3778744 - RNA, 23 nt, Salmonella typhimurium LT2
cccagacgcguuguccaacuguc

SEQ ID NO: 3778745 - RNA, 21 nt, Salmonella typhimurium LT2
cccagacggcgauacugcucc

SEQ ID NO: 3778746 - RNA, 20 nt, Salmonella typhimurium LT2
cccagagucaccagcacuac

SEQ ID NO: 3778747 - RNA, 20 nt, Salmonella typhimurium LT2
cccagaugaaaaaucggcaa

SEQ ID NO: 3778748 - RNA, 15 nt, Salmonella typhimurium LT2
cccagcagagaucuu

SEQ ID NO: 3778749 - RNA, 22 nt, Salmonella typhimurium LT2
cccagcagagaucuuucacccc

SEQ ID NO: 3778750 - RNA, 13 nt, Salmonella typhimurium LT2
cccagcagcagaa

SEQ ID NO: 3778751 - RNA, 15 nt, Salmonella typhimurium LT2
cccagcagcagccgg

SEQ ID NO: 3778752 - RNA, 20 nt, Salmonella typhimurium LT2
cccagcauauccaccaccag

SEQ ID NO: 3778753 - RNA, 14 nt, Salmonella typhimurium LT2
cccagcauauuaac

SEQ ID NO: 3778754 - RNA, 16 nt, Salmonella typhimurium LT2
cccagcaucccgcugg

SEQ ID NO: 3778755 - RNA, 17 nt, Salmonella typhimurium LT2
cccagcaugagccagcc

SEQ ID NO: 3778756 - RNA, 13 nt, Salmonella typhimurium LT2
cccagccacgcgu

SEQ ID NO: 3778757 - RNA, 20 nt, Salmonella typhimurium LT2
cccagccagagauccacauu

SEQ ID NO: 3778758 - RNA, 22 nt, Salmonella typhimurium LT2
cccagcccaucggucgcgcgca

SEQ ID NO: 3778759 - RNA, 20 nt, Salmonella typhimurium LT2
cccagccccccuaaagcuca

SEQ ID NO: 3778760 - RNA, 21 nt, Salmonella typhimurium LT2
cccagccccccuaaagcucau

SEQ ID NO: 3778761 - RNA, 14 nt, Salmonella typhimurium LT2
cccagcccugugcc

SEQ ID NO: 3778762 - RNA, 14 nt, Salmonella typhimurium LT2
cccagccgaugacc

SEQ ID NO: 3778763 - RNA, 12 nt, Salmonella typhimurium LT2
cccagccgcagc

SEQ ID NO: 3778764 - RNA, 21 nt, Salmonella typhimurium LT2
cccagccgugaauggucacau

SEQ ID NO: 3778765 - RNA, 14 nt, Salmonella typhimurium LT2
cccagcgaacuggc

SEQ ID NO: 3778766 - RNA, 21 nt, Salmonella typhimurium LT2
cccagcgaauuaugacggaug

SEQ ID NO: 3778767 - RNA, 19 nt, Salmonella typhimurium LT2
cccagcgauccagccgcag

SEQ ID NO: 3778768 - RNA, 14 nt, Salmonella typhimurium LT2
cccagcgccagccg

SEQ ID NO: 3778769 - RNA, 19 nt, Salmonella typhimurium LT2
cccagcgccagccgcgcca

SEQ ID NO: 3778770 - RNA, 11 nt, Salmonella typhimurium LT2
cccccagcuga

SEQ ID NO: 3778771 - RNA, 12 nt, Salmonella typhimurium LT2
cccccaguuccu

SEQ ID NO: 3778772 - RNA, 19 nt, Salmonella typhimurium LT2
cccccaucgccagcacuuc

SEQ ID NO: 3778773 - RNA, 19 nt, Salmonella typhimurium LT2
ccccccgcacagcacauag

SEQ ID NO: 3778774 - RNA, 13 nt, Salmonella typhimurium LT2
ccccccuaccgga

SEQ ID NO: 3778775 - RNA, 17 nt, Salmonella typhimurium LT2
ccccccuuuacccacca

SEQ ID NO: 3778776 - RNA, 21 nt, Salmonella typhimurium LT2
cccccgcacagcacauagaag

SEQ ID NO: 3778777 - RNA, 17 nt, Salmonella typhimurium LT2
cccccguuuucuggaac

SEQ ID NO: 3778778 - RNA, 19 nt, Salmonella typhimurium LT2
ccccgaaagucaucugcca

SEQ ID NO: 3778779 - RNA, 20 nt, Salmonella typhimurium LT2
ccccgaugucgccacgccgc

SEQ ID NO: 3778780 - RNA, 15 nt, Salmonella typhimurium LT2
ccccgccaccgccgc

SEQ ID NO: 3778781 - RNA, 16 nt, Salmonella typhimurium LT2
ccccgccaccgccgcu

SEQ ID NO: 3778782 - RNA, 24 nt, Salmonella typhimurium LT2
ccccgccauaauacacaauacgcc

SEQ ID NO: 3778783 - RNA, 12 nt, Salmonella typhimurium LT2
ccccgccccagc

SEQ ID NO: 3778784 - RNA, 11 nt, Salmonella typhimurium LT2
ccccgccgcca

SEQ ID NO: 3778785 - RNA, 12 nt, Salmonella typhimurium LT2
ccccgccgccau

SEQ ID NO: 3778786 - RNA, 18 nt, Salmonella typhimurium LT2
ccccgcuucgucgccauc

SEQ ID NO: 3778787 - RNA, 20 nt, Salmonella typhimurium LT2
ccccgcuuucagcguugcag

SEQ ID NO: 3778788 - RNA, 22 nt, Salmonella typhimurium LT2
ccccggaauggcgaaccacggc

SEQ ID NO: 3778789 - RNA, 17 nt, Salmonella typhimurium LT2
ccccggaucaccggcau

SEQ ID NO: 3778790 - RNA, 15 nt, Salmonella typhimurium LT2
ccccggccucgcccg

SEQ ID NO: 3778791 - RNA, 17 nt, Salmonella typhimurium LT2
ccccggcgcccggaggg

SEQ ID NO: 3778792 - RNA, 18 nt, Salmonella typhimurium LT2
ccccggucaacgcgccgc

SEQ ID NO: 3778793 - RNA, 22 nt, Salmonella typhimurium LT2
ccccggucaacgcgccgccaac

SEQ ID NO: 3778794 - RNA, 23 nt, Salmonella typhimurium LT2
ccccggucggguguucucauccc

SEQ ID NO: 3778795 - RNA, 16 nt, Salmonella typhimurium LT2
ccccgugacuuuccag

SEQ ID NO: 3778796 - RNA, 19 nt, Salmonella typhimurium LT2
ccccgugauucacccgcgu

SEQ ID NO: 3778797 - RNA, 16 nt, Salmonella typhimurium LT2
ccccuaccgaggcagg

SEQ ID NO: 3778798 - RNA, 19 nt, Salmonella typhimurium LT2
ccccuccagccagcgccag

SEQ ID NO: 3778799 - RNA, 18 nt, Salmonella typhimurium LT2
ccccucggcagcaauacg

SEQ ID NO: 3778800 - RNA, 20 nt, Salmonella typhimurium LT2
ccccucggcagcaauacgcc

SEQ ID NO: 3778801 - RNA, 23 nt, Salmonella typhimurium LT2
ccccucggcagcaauacgcccgc

SEQ ID NO: 3778802 - RNA, 19 nt, Salmonella typhimurium LT2
ccccucuuccaucagccag

SEQ ID NO: 3778803 - RNA, 18 nt, Salmonella typhimurium LT2
ccccucuuuuaagccgua

SEQ ID NO: 3778804 - RNA, 20 nt, Salmonella typhimurium LT2
ccccugaugcguauccagcg

SEQ ID NO: 3778805 - RNA, 12 nt, Salmonella typhimurium LT2
ccccugcaauuc

SEQ ID NO: 3778806 - RNA, 22 nt, Salmonella typhimurium LT2
ccccuggguagaguaacccuuc

SEQ ID NO: 3778807 - RNA, 20 nt, Salmonella typhimurium LT2
ccccuguuccagggcuucca

SEQ ID NO: 3778808 - RNA, 11 nt, Salmonella typhimurium LT2
ccccuuccccc

SEQ ID NO: 3778809 - RNA, 12 nt, Salmonella typhimurium LT2
ccccuucccccg

SEQ ID NO: 3778810 - RNA, 22 nt, Salmonella typhimurium LT2
ccccuucuuuaucuucugcugc

SEQ ID NO: 3778811 - RNA, 18 nt, Salmonella typhimurium LT2
ccccuuucgcaaucaugc

SEQ ID NO: 3778812 - RNA, 14 nt, Salmonella typhimurium LT2
ccccuuuuuugcug

SEQ ID NO: 3778813 - RNA, 18 nt, Salmonella typhimurium LT2
ccccuuuuuugcuggcaa

SEQ ID NO: 3778814 - RNA, 19 nt, Salmonella typhimurium LT2
cccgaaagucaucugccag

SEQ ID NO: 3778815 - RNA, 22 nt, Salmonella typhimurium LT2
cccgaaaugguuccaggcgcgc

SEQ ID NO: 3778816 - RNA, 12 nt, Salmonella typhimurium LT2
cccgaaccugcg

SEQ ID NO: 3778817 - RNA, 13 nt, Salmonella typhimurium LT2
cccgaaguggugg

SEQ ID NO: 3778818 - RNA, 15 nt, Salmonella typhimurium LT2
cccgacaccagccgu

SEQ ID NO: 3778819 - RNA, 20 nt, Salmonella typhimurium LT2
cccgacacggcucgccuuug

SEQ ID NO: 3778820 - RNA, 14 nt, Salmonella typhimurium LT2
cccgacagcggcgc

SEQ ID NO: 3778821 - RNA, 22 nt, Salmonella typhimurium LT2
cccgacaggguuugccagcacc

SEQ ID NO: 3778822 - RNA, 14 nt, Salmonella typhimurium LT2
cccgaccaggacaa

SEQ ID NO: 3778823 - RNA, 17 nt, Salmonella typhimurium LT2
cccgacgaauaacaaaa

SEQ ID NO: 3778824 - RNA, 14 nt, Salmonella typhimurium LT2
cccgacgcgccacu

SEQ ID NO: 3778825 - RNA, 14 nt, Salmonella typhimurium LT2
cccgacgcgcgaua

SEQ ID NO: 3778826 - RNA, 22 nt, Salmonella typhimurium LT2
cccgacggcaggcggcaaucag

SEQ ID NO: 3778827 - RNA, 19 nt, Salmonella typhimurium LT2
cccgacuaccggcaccagc

SEQ ID NO: 3778828 - RNA, 23 nt, Salmonella typhimurium LT2
cccgagcgacgcccugcccauga

SEQ ID NO: 3778829 - RNA, 17 nt, Salmonella typhimurium LT2
cccgagcggccaaaggg

SEQ ID NO: 3778830 - RNA, 18 nt, Salmonella typhimurium LT2
cccgagcggccaaaggga

SEQ ID NO: 3778831 - RNA, 15 nt, Salmonella typhimurium LT2
cccgauaaaccaggc

SEQ ID NO: 3778832 - RNA, 14 nt, Salmonella typhimurium LT2
cccgauaagcgccg

SEQ ID NO: 3778833 - RNA, 13 nt, Salmonella typhimurium LT2
cccgauacccuga

SEQ ID NO: 3778834 - RNA, 13 nt, Salmonella typhimurium LT2
cccgauagcgccg

SEQ ID NO: 3778835 - RNA, 16 nt, Salmonella typhimurium LT2
cccgaucaucuccugu

SEQ ID NO: 3778836 - RNA, 12 nt, Salmonella typhimurium LT2
cccgaucuucau

SEQ ID NO: 3778837 - RNA, 18 nt, Salmonella typhimurium LT2
cccgauggcguaagcuua

SEQ ID NO: 3778838 - RNA, 15 nt, Salmonella typhimurium LT2
cccgauucgcaugaa

SEQ ID NO: 3778839 - RNA, 18 nt, Salmonella typhimurium LT2
cccgauucgcaugaauuc

SEQ ID NO: 3778840 - RNA, 20 nt, Salmonella typhimurium LT2
cccgauucgcaugaauucaa

SEQ ID NO: 3778841 - RNA, 14 nt, Salmonella typhimurium LT2
cccgauucugccag

SEQ ID NO: 3778842 - RNA, 11 nt, Salmonella typhimurium LT2
cccgcaaaagc

SEQ ID NO: 3778843 - RNA, 18 nt, Salmonella typhimurium LT2
cccgcaaacagagcgccg

SEQ ID NO: 3778844 - RNA, 22 nt, Salmonella typhimurium LT2
cccgcaaaccacgucugcgcuu

SEQ ID NO: 3778845 - RNA, 19 nt, Salmonella typhimurium LT2
cccgcaaacuggccacagc

SEQ ID NO: 3778846 - RNA, 14 nt, Salmonella typhimurium LT2
cccgcacucgcgcu

SEQ ID NO: 3778847 - RNA, 15 nt, Salmonella typhimurium LT2
cccgcacucgcgcuu

SEQ ID NO: 3778848 - RNA, 15 nt, Salmonella typhimurium LT2
cccgcagccacuccc

SEQ ID NO: 3778849 - RNA, 13 nt, Salmonella typhimurium LT2
cccgcagccggaa

SEQ ID NO: 3778850 - RNA, 20 nt, Salmonella typhimurium LT2
cccgcaguagcuaaugauua

SEQ ID NO: 3778851 - RNA, 15 nt, Salmonella typhimurium LT2
cccgcauauuuuucu

SEQ ID NO: 3778852 - RNA, 17 nt, Salmonella typhimurium LT2
cccgcaugguaaacgca

SEQ ID NO: 3778853 - RNA, 18 nt, Salmonella typhimurium LT2
cccgcauucgcggcaagc

SEQ ID NO: 3778854 - RNA, 15 nt, Salmonella typhimurium LT2
cccgccaaaccggcg

SEQ ID NO: 3778855 - RNA, 16 nt, Salmonella typhimurium LT2
cccgccaccaucuccu

SEQ ID NO: 3778856 - RNA, 18 nt, Salmonella typhimurium LT2
cccgccaccaucuccuga

SEQ ID NO: 3778857 - RNA, 14 nt, Salmonella typhimurium LT2
cccgccaccgccgc

SEQ ID NO: 3778858 - RNA, 15 nt, Salmonella typhimurium LT2
cccgccagaccgaca

SEQ ID NO: 3778859 - RNA, 12 nt, Salmonella typhimurium LT2
cccgccagcaca

SEQ ID NO: 3778860 - RNA, 15 nt, Salmonella typhimurium LT2
cccgccagcauacaa

SEQ ID NO: 3778861 - RNA, 14 nt, Salmonella typhimurium LT2
cccgccagcggcgc

SEQ ID NO: 3778862 - RNA, 16 nt, Salmonella typhimurium LT2
cccgccagcugcgcgc

SEQ ID NO: 3778863 - RNA, 13 nt, Salmonella typhimurium LT2
cccgccaggguau

SEQ ID NO: 3778864 - RNA, 13 nt, Salmonella typhimurium LT2
cccgccaucgccg

SEQ ID NO: 3778865 - RNA, 19 nt, Salmonella typhimurium LT2
cccgccaucguccagccau

SEQ ID NO: 3778866 - RNA, 14 nt, Salmonella typhimurium LT2
cccgccaucuucac

SEQ ID NO: 3778867 - RNA, 16 nt, Salmonella typhimurium LT2
cccgcccugcccgcca

SEQ ID NO: 3778868 - RNA, 21 nt, Salmonella typhimurium LT2
cccgccgcacacgccgugcac

SEQ ID NO: 3778869 - RNA, 15 nt, Salmonella typhimurium LT2
cccgccgccaccaug

SEQ ID NO: 3778870 - RNA, 12 nt, Salmonella typhimurium LT2
cccgccgccauc

SEQ ID NO: 3778871 - RNA, 18 nt, Salmonella typhimurium LT2
cccgccgcgaccaacagc

SEQ ID NO: 3778872 - RNA, 23 nt, Salmonella typhimurium LT2
cccgccgcgauguuugcucgcca

SEQ ID NO: 3778873 - RNA, 22 nt, Salmonella typhimurium LT2
cccgccgcggcgguuauccucc

SEQ ID NO: 3778874 - RNA, 23 nt, Salmonella typhimurium LT2
cccgccgcggcgguuauccuccg

SEQ ID NO: 3778875 - RNA, 14 nt, Salmonella typhimurium LT2
cccugauggcgcgc

SEQ ID NO: 3778876 - RNA, 21 nt, Salmonella typhimurium LT2
cccugcaaacuguguacgcca

SEQ ID NO: 3778877 - RNA, 15 nt, Salmonella typhimurium LT2
cccugcaacgccugc

SEQ ID NO: 3778878 - RNA, 14 nt, Salmonella typhimurium LT2
cccugccaauucaa

SEQ ID NO: 3778879 - RNA, 16 nt, Salmonella typhimurium LT2
cccugccaauucaaca

SEQ ID NO: 3778880 - RNA, 13 nt, Salmonella typhimurium LT2
cccugccaccagc

SEQ ID NO: 3778881 - RNA, 20 nt, Salmonella typhimurium LT2
cccugccagcguaagcgccc

SEQ ID NO: 3778882 - RNA, 14 nt, Salmonella typhimurium LT2
cccugcccgccagg

SEQ ID NO: 3778883 - RNA, 24 nt, Salmonella typhimurium LT2
cccugccggaaaaugcgccaggaa

SEQ ID NO: 3778884 - RNA, 15 nt, Salmonella typhimurium LT2
cccugccggcggcag

SEQ ID NO: 3778885 - RNA, 20 nt, Salmonella typhimurium LT2
cccugccgucucaaccagca

SEQ ID NO: 3778886 - RNA, 18 nt, Salmonella typhimurium LT2
cccugcgaacagcgcucc

SEQ ID NO: 3778887 - RNA, 19 nt, Salmonella typhimurium LT2
cccugcgaacagcgcucca

SEQ ID NO: 3778888 - RNA, 23 nt, Salmonella typhimurium LT2
cccugcgaacagcgcuccacgcg

SEQ ID NO: 3778889 - RNA, 16 nt, Salmonella typhimurium LT2
cccugcgaggccuuuu

SEQ ID NO: 3778890 - RNA, 15 nt, Salmonella typhimurium LT2
cccugcgcauacguc

SEQ ID NO: 3778891 - RNA, 19 nt, Salmonella typhimurium LT2
cccugcgccucaagcgcuu

SEQ ID NO: 3778892 - RNA, 17 nt, Salmonella typhimurium LT2
cccugcgcuuucaacca

SEQ ID NO: 3778893 - RNA, 18 nt, Salmonella typhimurium LT2
cccugcgcuuucaaccac

SEQ ID NO: 3778894 - RNA, 16 nt, Salmonella typhimurium LT2
cccugcgguagcgccg

SEQ ID NO: 3778895 - RNA, 23 nt, Salmonella typhimurium LT2
cccugcgucacgauaguuuuaau

SEQ ID NO: 3778896 - RNA, 13 nt, Salmonella typhimurium LT2
cccugcucccaca

SEQ ID NO: 3778897 - RNA, 14 nt, Salmonella typhimurium LT2
cccugcuccugcca

SEQ ID NO: 3778898 - RNA, 20 nt, Salmonella typhimurium LT2
cccugcuggcgaaccaccag

SEQ ID NO: 3778899 - RNA, 21 nt, Salmonella typhimurium LT2
cccugcuggcgaaccaccagc

SEQ ID NO: 3778900 - RNA, 16 nt, Salmonella typhimurium LT2
cccuggacgcgagcca

SEQ ID NO: 3778901 - RNA, 22 nt, Salmonella typhimurium LT2
cccuggccggaauacguaauac

SEQ ID NO: 3778902 - RNA, 14 nt, Salmonella typhimurium LT2
cccuggcgcgccag

SEQ ID NO: 3778903 - RNA, 15 nt, Salmonella typhimurium LT2
cccuggcugguuaau

SEQ ID NO: 3778904 - RNA, 19 nt, Salmonella typhimurium LT2
cccugggccucgccccuuc

SEQ ID NO: 3778905 - RNA, 20 nt, Salmonella typhimurium LT2
cccuguaggguggcuuuauu

SEQ ID NO: 3778906 - RNA, 18 nt, Salmonella typhimurium LT2
cccuguauuuuuuccauu

SEQ ID NO: 3778907 - RNA, 20 nt, Salmonella typhimurium LT2
cccugucaaagcauugugca

SEQ ID NO: 3778908 - RNA, 14 nt, Salmonella typhimurium LT2
cccuguucaaaagc

SEQ ID NO: 3778909 - RNA, 18 nt, Salmonella typhimurium LT2
cccuguuuuuucgccgcg

SEQ ID NO: 3778910 - RNA, 14 nt, Salmonella typhimurium LT2
cccuuaucaaaggc

SEQ ID NO: 3778911 - RNA, 18 nt, Salmonella typhimurium LT2
cccuucaucagccagcau

SEQ ID NO: 3778912 - RNA, 19 nt, Salmonella typhimurium LT2
cccuucaugcagcccgcac

SEQ ID NO: 3778913 - RNA, 16 nt, Salmonella typhimurium LT2
cccuuccagacagcuu

SEQ ID NO: 3778914 - RNA, 14 nt, Salmonella typhimurium LT2
cccuuccagcucuu

SEQ ID NO: 3778915 - RNA, 12 nt, Salmonella typhimurium LT2
cccuucccagcc

SEQ ID NO: 3778916 - RNA, 23 nt, Salmonella typhimurium LT2
cccuucccccaaaaugccgccca

SEQ ID NO: 3778917 - RNA, 18 nt, Salmonella typhimurium LT2
cccuuccgccacggcuuu

SEQ ID NO: 3778918 - RNA, 20 nt, Salmonella typhimurium LT2
cccuuccguauugagcagcg

SEQ ID NO: 3778919 - RNA, 18 nt, Salmonella typhimurium LT2
cccuucgccuucgccggc

SEQ ID NO: 3778920 - RNA, 21 nt, Salmonella typhimurium LT2
cccuucgcggaauuucaggaa

SEQ ID NO: 3778921 - RNA, 16 nt, Salmonella typhimurium LT2
cccuucgcuguccauu

SEQ ID NO: 3778922 - RNA, 19 nt, Salmonella typhimurium LT2
cccuucgggcagucuccuc

SEQ ID NO: 3778923 - RNA, 18 nt, Salmonella typhimurium LT2
cccuucguuuuauuugau

SEQ ID NO: 3778924 - RNA, 16 nt, Salmonella typhimurium LT2
cccuucuaccgucagc

SEQ ID NO: 3778925 - RNA, 21 nt, Salmonella typhimurium LT2
cccuucucauggacacacuau

SEQ ID NO: 3778926 - RNA, 18 nt, Salmonella typhimurium LT2
cccuucuucuggcucaga

SEQ ID NO: 3778927 - RNA, 19 nt, Salmonella typhimurium LT2
cccuucuuuaucuucugcu

SEQ ID NO: 3778928 - RNA, 15 nt, Salmonella typhimurium LT2
cccuucuuuuacugc

SEQ ID NO: 3778929 - RNA, 21 nt, Salmonella typhimurium LT2
cccuucuuuuacugccccgcc

SEQ ID NO: 3778930 - RNA, 19 nt, Salmonella typhimurium LT2
cccuuguuauccuaaaucu

SEQ ID NO: 3778931 - RNA, 23 nt, Salmonella typhimurium LT2
cccuuguuauccuaaaucugcca

SEQ ID NO: 3778932 - RNA, 16 nt, Salmonella typhimurium LT2
cccuuuacccaccagc

SEQ ID NO: 3778933 - RNA, 20 nt, Salmonella typhimurium LT2
cccuuuaggcggcgccgcgc

SEQ ID NO: 3778934 - RNA, 13 nt, Salmonella typhimurium LT2
cccuuucaguuca

SEQ ID NO: 3778935 - RNA, 19 nt, Salmonella typhimurium LT2
cccuuucauuucugccugc

SEQ ID NO: 3778936 - RNA, 19 nt, Salmonella typhimurium LT2
cccuuucgacgucaccauc

SEQ ID NO: 3778937 - RNA, 19 nt, Salmonella typhimurium LT2
cccuuucgguucgccgcgc

SEQ ID NO: 3778938 - RNA, 11 nt, Salmonella typhimurium LT2
cccuuuuucaa

SEQ ID NO: 3778939 - RNA, 13 nt, Salmonella typhimurium LT2
cccuuuuugcauu

SEQ ID NO: 3778940 - RNA, 20 nt, Salmonella typhimurium LT2
ccgaaaggguauacaaaaaa

SEQ ID NO: 3778941 - RNA, 20 nt, Salmonella typhimurium LT2
ccgaacaacaauacgcguca

SEQ ID NO: 3778942 - RNA, 20 nt, Salmonella typhimurium LT2
ccgaacagaacagugaguua

SEQ ID NO: 3778943 - RNA, 13 nt, Salmonella typhimurium LT2
ccgaacaggccau

SEQ ID NO: 3778944 - RNA, 16 nt, Salmonella typhimurium LT2
ccgaacuuacaguaac

SEQ ID NO: 3778945 - RNA, 18 nt, Salmonella typhimurium LT2
ccgaagaacagauucauu

SEQ ID NO: 3778946 - RNA, 11 nt, Salmonella typhimurium LT2
ccgaagccaac

SEQ ID NO: 3778947 - RNA, 20 nt, Salmonella typhimurium LT2
ccgaauaagcgacagcgcca

SEQ ID NO: 3778948 - RNA, 20 nt, Salmonella typhimurium LT2
ccgaauagcgacaaaugaag

SEQ ID NO: 3778949 - RNA, 14 nt, Salmonella typhimurium LT2
ccgaaucaauuccu

SEQ ID NO: 3778950 - RNA, 12 nt, Salmonella typhimurium LT2
ccgaaucaggcg

SEQ ID NO: 3778951 - RNA, 13 nt, Salmonella typhimurium LT2
ccgaaucgccgcu

SEQ ID NO: 3778952 - RNA, 12 nt, Salmonella typhimurium LT2
ccgaaucuugca

SEQ ID NO: 3778953 - RNA, 22 nt, Salmonella typhimurium LT2
ccgaaugacgggccuacgcgca

SEQ ID NO: 3778954 - RNA, 21 nt, Salmonella typhimurium LT2
ccgaauggcggcuucgccauc

SEQ ID NO: 3778955 - RNA, 23 nt, Salmonella typhimurium LT2
ccgacaaacuucaucgccacgcc

SEQ ID NO: 3778956 - RNA, 20 nt, Salmonella typhimurium LT2
ccgacaauauucgccgcgau

SEQ ID NO: 3778957 - RNA, 22 nt, Salmonella typhimurium LT2
ccgacaauuuugauaagagaaa

SEQ ID NO: 3778958 - RNA, 12 nt, Salmonella typhimurium LT2
ccgacaggaugu

SEQ ID NO: 3778959 - RNA, 14 nt, Salmonella typhimurium LT2
ccgacaggaugucc

SEQ ID NO: 3778960 - RNA, 19 nt, Salmonella typhimurium LT2
ccgacaggcgcgaaacgcc

SEQ ID NO: 3778961 - RNA, 16 nt, Salmonella typhimurium LT2
ccgacaggguuugcca

SEQ ID NO: 3778962 - RNA, 20 nt, Salmonella typhimurium LT2
ccgacagguuaacaaaggua

SEQ ID NO: 3778963 - RNA, 21 nt, Salmonella typhimurium LT2
ccgacauagcugaacaauccc

SEQ ID NO: 3778964 - RNA, 13 nt, Salmonella typhimurium LT2
ccgacaucgccag

SEQ ID NO: 3778965 - RNA, 18 nt, Salmonella typhimurium LT2
ccgacaugacgccgcagc

SEQ ID NO: 3778966 - RNA, 18 nt, Salmonella typhimurium LT2
ccgaccaauugcaggcag

SEQ ID NO: 3778967 - RNA, 15 nt, Salmonella typhimurium LT2
ccgaccaccagcuug

SEQ ID NO: 3778968 - RNA, 17 nt, Salmonella typhimurium LT2
ccgaccaccagcuuguu

SEQ ID NO: 3778969 - RNA, 17 nt, Salmonella typhimurium LT2
ccgaccacuucaacgcc

SEQ ID NO: 3778970 - RNA, 15 nt, Salmonella typhimurium LT2
ccgaccauuacccac

SEQ ID NO: 3778971 - RNA, 15 nt, Salmonella typhimurium LT2
ccgaccgucggcgca

SEQ ID NO: 3778972 - RNA, 22 nt, Salmonella typhimurium LT2
ccgaccuggcggucggcuuugu

SEQ ID NO: 3778973 - RNA, 17 nt, Salmonella typhimurium LT2
ccgacgaaauagcguuc

SEQ ID NO: 3778974 - RNA, 21 nt, Salmonella typhimurium LT2
ccgacgaccggcgcagcgccc

SEQ ID NO: 3778975 - RNA, 19 nt, Salmonella typhimurium LT2
ccgacgauaaacagauaug

SEQ ID NO: 3778976 - RNA, 15 nt, Salmonella typhimurium LT2
ccgacgcucuuccuc

SEQ ID NO: 3778977 - RNA, 19 nt, Salmonella typhimurium LT2
ccgacggcuucuucacgca

SEQ ID NO: 3778978 - RNA, 18 nt, Salmonella typhimurium LT2
ccgacgguuauugcgcug

SEQ ID NO: 3778979 - RNA, 20 nt, Salmonella typhimurium LT2
ccgcagugaagaauggcgcc

SEQ ID NO: 3778980 - RNA, 16 nt, Salmonella typhimurium LT2
ccgcauaacgcgcugg

SEQ ID NO: 3778981 - RNA, 18 nt, Salmonella typhimurium LT2
ccgcauaauccagcaggu

SEQ ID NO: 3778982 - RNA, 15 nt, Salmonella typhimurium LT2
ccgcauaugcggcga

SEQ ID NO: 3778983 - RNA, 15 nt, Salmonella typhimurium LT2
ccgcaucacggcagc

SEQ ID NO: 3778984 - RNA, 23 nt, Salmonella typhimurium LT2
ccgcaucauucaucucgauaccg

SEQ ID NO: 3778985 - RNA, 13 nt, Salmonella typhimurium LT2
ccgcauccccaua

SEQ ID NO: 3778986 - RNA, 14 nt, Salmonella typhimurium LT2
ccgcaucgaccaua

SEQ ID NO: 3778987 - RNA, 19 nt, Salmonella typhimurium LT2
ccgcaucgcccgcccccaa

SEQ ID NO: 3778988 - RNA, 12 nt, Salmonella typhimurium LT2
ccgcaucggccc

SEQ ID NO: 3778989 - RNA, 13 nt, Salmonella typhimurium LT2
ccgcaucggcgca

SEQ ID NO: 3778990 - RNA, 20 nt, Salmonella typhimurium LT2
ccgcaucguucaacucgcua

SEQ ID NO: 3778991 - RNA, 18 nt, Salmonella typhimurium LT2
ccgcauugguuucgccua

SEQ ID NO: 3778992 - RNA, 16 nt, Salmonella typhimurium LT2
ccgcauuuuuucuuca

SEQ ID NO: 3778993 - RNA, 22 nt, Salmonella typhimurium LT2
ccgccaaaauccggcccagcga

SEQ ID NO: 3778994 - RNA, 14 nt, Salmonella typhimurium LT2
ccgccaaacgcggu

SEQ ID NO: 3778995 - RNA, 22 nt, Salmonella typhimurium LT2
ccgccaaagcaaaccaucgucg

SEQ ID NO: 3778996 - RNA, 16 nt, Salmonella typhimurium LT2
ccgccaacgauacagc

SEQ ID NO: 3778997 - RNA, 13 nt, Salmonella typhimurium LT2
ccgccaacgccaa

SEQ ID NO: 3778998 - RNA, 13 nt, Salmonella typhimurium LT2
ccgccaagcgcgg

SEQ ID NO: 3778999 - RNA, 23 nt, Salmonella typhimurium LT2
ccgccaauauccggcacgccagc

SEQ ID NO: 3779000 - RNA, 21 nt, Salmonella typhimurium LT2
ccgccaaucaacgccgccagg

SEQ ID NO: 3779001 - RNA, 17 nt, Salmonella typhimurium LT2
ccgccaauuccugccag

SEQ ID NO: 3779002 - RNA, 18 nt, Salmonella typhimurium LT2
ccgccaauuccugccaga

SEQ ID NO: 3779003 - RNA, 15 nt, Salmonella typhimurium LT2
ccgccacaggccaac

SEQ ID NO: 3779004 - RNA, 13 nt, Salmonella typhimurium LT2
ccgccaccacaaa

SEQ ID NO: 3779005 - RNA, 14 nt, Salmonella typhimurium LT2
ccgccaccacaaag

SEQ ID NO: 3779006 - RNA, 11 nt, Salmonella typhimurium LT2
ccgccaccacg

SEQ ID NO: 3779007 - RNA, 12 nt, Salmonella typhimurium LT2
ccgccaccagca

SEQ ID NO: 3779008 - RNA, 18 nt, Salmonella typhimurium LT2
ccgccaccuuucugcucc

SEQ ID NO: 3779009 - RNA, 15 nt, Salmonella typhimurium LT2
ccgccacggcaagaa

SEQ ID NO: 3779010 - RNA, 17 nt, Salmonella typhimurium LT2
ccgccagacucagccag

SEQ ID NO: 3779011 - RNA, 22 nt, Salmonella typhimurium LT2
ccgccagacucagccaggucug

SEQ ID NO: 3779012 - RNA, 16 nt, Salmonella typhimurium LT2
ccgccagaggcggcgc

SEQ ID NO: 3779013 - RNA, 16 nt, Salmonella typhimurium LT2
ccgccagauccuggcu

SEQ ID NO: 3779014 - RNA, 15 nt, Salmonella typhimurium LT2
ccgccagcaaugccg

SEQ ID NO: 3779015 - RNA, 14 nt, Salmonella typhimurium LT2
ccgccagcaccagg

SEQ ID NO: 3779016 - RNA, 11 nt, Salmonella typhimurium LT2
ccgccagcagc

SEQ ID NO: 3779017 - RNA, 21 nt, Salmonella typhimurium LT2
ccgccagcauacaaagcagau

SEQ ID NO: 3779018 - RNA, 11 nt, Salmonella typhimurium LT2
ccgccagccag

SEQ ID NO: 3779019 - RNA, 10 nt, Salmonella typhimurium LT2
ccgccagcgc

SEQ ID NO: 3779020 - RNA, 19 nt, Salmonella typhimurium LT2
ccgccagcgcaacgcgcau

SEQ ID NO: 3779021 - RNA, 13 nt, Salmonella typhimurium LT2
ccgccagcgccgc

SEQ ID NO: 3779022 - RNA, 12 nt, Salmonella typhimurium LT2
ccgccagcgccu

SEQ ID NO: 3779023 - RNA, 15 nt, Salmonella typhimurium LT2
ccgccagcggcgcca

SEQ ID NO: 3779024 - RNA, 16 nt, Salmonella typhimurium LT2
ccgccagcgggccggu

SEQ ID NO: 3779025 - RNA, 18 nt, Salmonella typhimurium LT2
ccgccagugcauagcagc

SEQ ID NO: 3779026 - RNA, 21 nt, Salmonella typhimurium LT2
ccgccaguuuguaaccaacaa

SEQ ID NO: 3779027 - RNA, 15 nt, Salmonella typhimurium LT2
ccgccauaagaaugu

SEQ ID NO: 3779028 - RNA, 13 nt, Salmonella typhimurium LT2
ccgccauagccua

SEQ ID NO: 3779029 - RNA, 20 nt, Salmonella typhimurium LT2
ccgccauaggucagcgcuuc

SEQ ID NO: 3779030 - RNA, 16 nt, Salmonella typhimurium LT2
ccgccaucagacaggc

SEQ ID NO: 3779031 - RNA, 19 nt, Salmonella typhimurium LT2
ccgccaucagacaggcaug

SEQ ID NO: 3779032 - RNA, 11 nt, Salmonella typhimurium LT2
ccgccaucaug

SEQ ID NO: 3779033 - RNA, 14 nt, Salmonella typhimurium LT2
ccgccauccggcaa

SEQ ID NO: 3779034 - RNA, 17 nt, Salmonella typhimurium LT2
ccgccauccggcacagc

SEQ ID NO: 3779035 - RNA, 15 nt, Salmonella typhimurium LT2
ccgccauccggcacu

SEQ ID NO: 3779036 - RNA, 15 nt, Salmonella typhimurium LT2
ccgccauccggcagu

SEQ ID NO: 3779037 - RNA, 14 nt, Salmonella typhimurium LT2
ccgccauccggcau

SEQ ID NO: 3779038 - RNA, 14 nt, Salmonella typhimurium LT2
ccgccaucgacagc

SEQ ID NO: 3779039 - RNA, 17 nt, Salmonella typhimurium LT2
ccgccaucggcgcguaa

SEQ ID NO: 3779040 - RNA, 16 nt, Salmonella typhimurium LT2
ccgccaucguccagcc

SEQ ID NO: 3779041 - RNA, 17 nt, Salmonella typhimurium LT2
ccgccaucuccggcagc

SEQ ID NO: 3779042 - RNA, 20 nt, Salmonella typhimurium LT2
ccgccaugaaaaaaacgcau

SEQ ID NO: 3779043 - RNA, 12 nt, Salmonella typhimurium LT2
ccgcccaggcca

SEQ ID NO: 3779044 - RNA, 13 nt, Salmonella typhimurium LT2
ccgcccagucacg

SEQ ID NO: 3779045 - RNA, 15 nt, Salmonella typhimurium LT2
ccgcccaucaauacc

SEQ ID NO: 3779046 - RNA, 21 nt, Salmonella typhimurium LT2
ccgccccaaaucucccccggc

SEQ ID NO: 3779047 - RNA, 16 nt, Salmonella typhimurium LT2
ccgccccagcagcagc

SEQ ID NO: 3779048 - RNA, 14 nt, Salmonella typhimurium LT2
ccgcccccuccagu

SEQ ID NO: 3779049 - RNA, 21 nt, Salmonella typhimurium LT2
ccgcccgcggcgaucaccacg

SEQ ID NO: 3779050 - RNA, 12 nt, Salmonella typhimurium LT2
ccgcccugcagg

SEQ ID NO: 3779051 - RNA, 23 nt, Salmonella typhimurium LT2
ccgcccuucacaaccaucgucug

SEQ ID NO: 3779052 - RNA, 20 nt, Salmonella typhimurium LT2
ccgccgaacagacggcggcu

SEQ ID NO: 3779053 - RNA, 14 nt, Salmonella typhimurium LT2
ccgccgcacaggcg

SEQ ID NO: 3779054 - RNA, 17 nt, Salmonella typhimurium LT2
ccgccgccaaacugcgc

SEQ ID NO: 3779055 - RNA, 13 nt, Salmonella typhimurium LT2
ccgccgccagccu

SEQ ID NO: 3779056 - RNA, 14 nt, Salmonella typhimurium LT2
ccgccgccagccug

SEQ ID NO: 3779057 - RNA, 18 nt, Salmonella typhimurium LT2
ccgccgccaucgccagua

SEQ ID NO: 3779058 - RNA, 14 nt, Salmonella typhimurium LT2
ccgccgccgggccg

SEQ ID NO: 3779059 - RNA, 16 nt, Salmonella typhimurium LT2
ccgccgccgggccgcc

SEQ ID NO: 3779060 - RNA, 13 nt, Salmonella typhimurium LT2
ccgccgccgugcc

SEQ ID NO: 3779061 - RNA, 14 nt, Salmonella typhimurium LT2
ccgccgccgugccu

SEQ ID NO: 3779062 - RNA, 15 nt, Salmonella typhimurium LT2
ccgccgccugccaga

SEQ ID NO: 3779063 - RNA, 14 nt, Salmonella typhimurium LT2
ccgccgccuucugc

SEQ ID NO: 3779064 - RNA, 20 nt, Salmonella typhimurium LT2
ccgccgcgucugaccgccgc

SEQ ID NO: 3779065 - RNA, 18 nt, Salmonella typhimurium LT2
ccgccgcuauuaccccgc

SEQ ID NO: 3779066 - RNA, 15 nt, Salmonella typhimurium LT2
ccgccggauggcggc

SEQ ID NO: 3779067 - RNA, 22 nt, Salmonella typhimurium LT2
ccgccggcgaggauaauacgaa

SEQ ID NO: 3779068 - RNA, 15 nt, Salmonella typhimurium LT2
ccgccgggcaacacg

SEQ ID NO: 3779069 - RNA, 23 nt, Salmonella typhimurium LT2
ccgccggggcucccacucuucca

SEQ ID NO: 3779070 - RNA, 21 nt, Salmonella typhimurium LT2
ccgccggguauugugccccgc

SEQ ID NO: 3779071 - RNA, 21 nt, Salmonella typhimurium LT2
ccgccuaacagcgccgcgccg

SEQ ID NO: 3779072 - RNA, 15 nt, Salmonella typhimurium LT2
ccgccuaacccaccg

SEQ ID NO: 3779073 - RNA, 12 nt, Salmonella typhimurium LT2
ccgccuccagca

SEQ ID NO: 3779074 - RNA, 13 nt, Salmonella typhimurium LT2
ccgccuccgccgc

SEQ ID NO: 3779075 - RNA, 20 nt, Salmonella typhimurium LT2
ccgccucgcgauccgccagc

SEQ ID NO: 3779076 - RNA, 16 nt, Salmonella typhimurium LT2
ccgccugccgcgccgc

SEQ ID NO: 3779077 - RNA, 18 nt, Salmonella typhimurium LT2
ccgccugccgcgccgccg

SEQ ID NO: 3779078 - RNA, 16 nt, Salmonella typhimurium LT2
ccgccugccugcaacg

SEQ ID NO: 3779079 - RNA, 18 nt, Salmonella typhimurium LT2
ccgccugcgccagcgccg

SEQ ID NO: 3779080 - RNA, 20 nt, Salmonella typhimurium LT2
ccgccuggaacccaggcacc

SEQ ID NO: 3779081 - RNA, 15 nt, Salmonella typhimurium LT2
ccgccuuaccgcggu

SEQ ID NO: 3779082 - RNA, 23 nt, Salmonella typhimurium LT2
ccgccuuccgcgguacgaaucgc

SEQ ID NO: 3779083 - RNA, 18 nt, Salmonella typhimurium LT2
ccgccuugcggcgccagg

SEQ ID NO: 3779084 - RNA, 12 nt, Salmonella typhimurium LT2
ccgcuuuuccug

SEQ ID NO: 3779085 - RNA, 20 nt, Salmonella typhimurium LT2
ccgcuuuucggcguuuaucc

SEQ ID NO: 3779086 - RNA, 20 nt, Salmonella typhimurium LT2
ccgcuuuuuguagacucgcg

SEQ ID NO: 3779087 - RNA, 22 nt, Salmonella typhimurium LT2
ccgcuuuuuuuauucagugcca

SEQ ID NO: 3779088 - RNA, 23 nt, Salmonella typhimurium LT2
ccggaaaccuguucccggcagac

SEQ ID NO: 3779089 - RNA, 22 nt, Salmonella typhimurium LT2
ccggaaagaauaaucgccgccg

SEQ ID NO: 3779090 - RNA, 21 nt, Salmonella typhimurium LT2
ccggaaaggauauaagcgcca

SEQ ID NO: 3779091 - RNA, 20 nt, Salmonella typhimurium LT2
ccggaaauaaacgccagugg

SEQ ID NO: 3779092 - RNA, 12 nt, Salmonella typhimurium LT2
ccggaaaucaca

SEQ ID NO: 3779093 - RNA, 13 nt, Salmonella typhimurium LT2
ccggaaaucugca

SEQ ID NO: 3779094 - RNA, 20 nt, Salmonella typhimurium LT2
ccggaacaggcuuuucaggc

SEQ ID NO: 3779095 - RNA, 13 nt, Salmonella typhimurium LT2
ccggaacgggcau

SEQ ID NO: 3779096 - RNA, 17 nt, Salmonella typhimurium LT2
ccggaagacguuucaga

SEQ ID NO: 3779097 - RNA, 14 nt, Salmonella typhimurium LT2
ccggaagucauuau

SEQ ID NO: 3779098 - RNA, 18 nt, Salmonella typhimurium LT2
ccggaauagcaggcauca

SEQ ID NO: 3779099 - RNA, 21 nt, Salmonella typhimurium LT2
ccggaaucgccugcgucgccc

SEQ ID NO: 3779100 - RNA, 13 nt, Salmonella typhimurium LT2
ccggaaugcgaau

SEQ ID NO: 3779101 - RNA, 15 nt, Salmonella typhimurium LT2
ccggaauuugcuucu

SEQ ID NO: 3779102 - RNA, 16 nt, Salmonella typhimurium LT2
ccggacaguucgccaa

SEQ ID NO: 3779103 - RNA, 21 nt, Salmonella typhimurium LT2
ccggaccuaauaaccagcccc

SEQ ID NO: 3779104 - RNA, 16 nt, Salmonella typhimurium LT2
ccggacgcaucgccgg

SEQ ID NO: 3779105 - RNA, 15 nt, Salmonella typhimurium LT2
ccggacgccguccag

SEQ ID NO: 3779106 - RNA, 14 nt, Salmonella typhimurium LT2
ccggacggcgcagc

SEQ ID NO: 3779107 - RNA, 17 nt, Salmonella typhimurium LT2
ccggacggcgcagcgcg

SEQ ID NO: 3779108 - RNA, 15 nt, Salmonella typhimurium LT2
ccggacguacccagg

SEQ ID NO: 3779109 - RNA, 17 nt, Salmonella typhimurium LT2
ccggagccggucggcgc

SEQ ID NO: 3779110 - RNA, 20 nt, Salmonella typhimurium LT2
ccggaguagguugccgggug

SEQ ID NO: 3779111 - RNA, 16 nt, Salmonella typhimurium LT2
ccggauaacggcgcga

SEQ ID NO: 3779112 - RNA, 14 nt, Salmonella typhimurium LT2
ccggauaagacgcu

SEQ ID NO: 3779113 - RNA, 22 nt, Salmonella typhimurium LT2
ccggauaagacgcuacgcgucg

SEQ ID NO: 3779114 - RNA, 21 nt, Salmonella typhimurium LT2
ccggauaagcauuagcgccau

SEQ ID NO: 3779115 - RNA, 19 nt, Salmonella typhimurium LT2
ccggauaagcgcagcgcca

SEQ ID NO: 3779116 - RNA, 22 nt, Salmonella typhimurium LT2
ccggauaagcgcagcgccauca

SEQ ID NO: 3779117 - RNA, 20 nt, Salmonella typhimurium LT2
ccggauaagcguagcgccau

SEQ ID NO: 3779118 - RNA, 19 nt, Salmonella typhimurium LT2
ccggauaagcgucagcgcc

SEQ ID NO: 3779119 - RNA, 14 nt, Salmonella typhimurium LT2
ccggauaaggcgcc

SEQ ID NO: 3779120 - RNA, 22 nt, Salmonella typhimurium LT2
ccggauaaggcggagccgccau

SEQ ID NO: 3779121 - RNA, 18 nt, Salmonella typhimurium LT2
ccggauaauccagacaaa

SEQ ID NO: 3779122 - RNA, 21 nt, Salmonella typhimurium LT2
ccggauacucgacgcacucca

SEQ ID NO: 3779123 - RNA, 13 nt, Salmonella typhimurium LT2
ccggauagcgcug

SEQ ID NO: 3779124 - RNA, 15 nt, Salmonella typhimurium LT2
ccggauagcgcuguc

SEQ ID NO: 3779125 - RNA, 19 nt, Salmonella typhimurium LT2
ccggauagcguagcgccau

SEQ ID NO: 3779126 - RNA, 22 nt, Salmonella typhimurium LT2
ccggauaguuacccggcaacgu

SEQ ID NO: 3779127 - RNA, 16 nt, Salmonella typhimurium LT2
ccggaucaccggcauu

SEQ ID NO: 3779128 - RNA, 20 nt, Salmonella typhimurium LT2
ccggaucaccggcauuucac

SEQ ID NO: 3779129 - RNA, 13 nt, Salmonella typhimurium LT2
ccggaucgcguuu

SEQ ID NO: 3779130 - RNA, 20 nt, Salmonella typhimurium LT2
ccggaugaaacgcauccagc

SEQ ID NO: 3779131 - RNA, 18 nt, Salmonella typhimurium LT2
ccggaugacgcuucgcuu

SEQ ID NO: 3779132 - RNA, 22 nt, Salmonella typhimurium LT2
ccggaugaggcgcagccgccau

SEQ ID NO: 3779133 - RNA, 16 nt, Salmonella typhimurium LT2
ccggaugcaccaucuc

SEQ ID NO: 3779134 - RNA, 20 nt, Salmonella typhimurium LT2
ccggaugcgacuccaggaac

SEQ ID NO: 3779135 - RNA, 18 nt, Salmonella typhimurium LT2
ccggaugcgccgugcuug

SEQ ID NO: 3779136 - RNA, 16 nt, Salmonella typhimurium LT2
ccggaugcgccucauc

SEQ ID NO: 3779137 - RNA, 22 nt, Salmonella typhimurium LT2
ccggauggcaguacagggcgau

SEQ ID NO: 3779138 - RNA, 19 nt, Salmonella typhimurium LT2
ccggauggcgcuaaugcuu

SEQ ID NO: 3779139 - RNA, 22 nt, Salmonella typhimurium LT2
ccggauggcgcuaaugcuuauc

SEQ ID NO: 3779140 - RNA, 23 nt, Salmonella typhimurium LT2
ccggauggcgcugucgcuuauuc

SEQ ID NO: 3779141 - RNA, 23 nt, Salmonella typhimurium LT2
ccggauggcggcauaaacgccuu

SEQ ID NO: 3779142 - RNA, 21 nt, Salmonella typhimurium LT2
ccggauggcggcggaaaggac

SEQ ID NO: 3779143 - RNA, 23 nt, Salmonella typhimurium LT2
ccggauggcggcgugaacgccuu

SEQ ID NO: 3779144 - RNA, 16 nt, Salmonella typhimurium LT2
ccggauggcggcugau

SEQ ID NO: 3779145 - RNA, 23 nt, Salmonella typhimurium LT2
ccggauggggcaucagccgccau

SEQ ID NO: 3779146 - RNA, 16 nt, Salmonella typhimurium LT2
ccggaugugagcgcau

SEQ ID NO: 3779147 - RNA, 22 nt, Salmonella typhimurium LT2
ccggauuaaggcguuugcgccg

SEQ ID NO: 3779148 - RNA, 15 nt, Salmonella typhimurium LT2
ccggauuacgcgucu

SEQ ID NO: 3779149 - RNA, 21 nt, Salmonella typhimurium LT2
ccggauuagcgacagcgcuau

SEQ ID NO: 3779150 - RNA, 13 nt, Salmonella typhimurium LT2
ccggauuuaccag

SEQ ID NO: 3779151 - RNA, 13 nt, Salmonella typhimurium LT2
ccggauuuuaaau

SEQ ID NO: 3779152 - RNA, 18 nt, Salmonella typhimurium LT2
ccggcaaagaagcuuaca

SEQ ID NO: 3779153 - RNA, 24 nt, Salmonella typhimurium LT2
ccggcaacagguaccccgccaccg

SEQ ID NO: 3779154 - RNA, 19 nt, Salmonella typhimurium LT2
ccggcaaucauucuuauuc

SEQ ID NO: 3779155 - RNA, 13 nt, Salmonella typhimurium LT2
ccggcaaucgccu

SEQ ID NO: 3779156 - RNA, 21 nt, Salmonella typhimurium LT2
ccggcaauuaccgccagcggc

SEQ ID NO: 3779157 - RNA, 21 nt, Salmonella typhimurium LT2
ccggcacaccggccauugccg

SEQ ID NO: 3779158 - RNA, 23 nt, Salmonella typhimurium LT2
ccggcacauauuccggcgcuggc

SEQ ID NO: 3779159 - RNA, 13 nt, Salmonella typhimurium LT2
ccggcaccagcca

SEQ ID NO: 3779160 - RNA, 12 nt, Salmonella typhimurium LT2
ccggcacccagu

SEQ ID NO: 3779161 - RNA, 18 nt, Salmonella typhimurium LT2
ccggcacggucaaucauc

SEQ ID NO: 3779162 - RNA, 12 nt, Salmonella typhimurium LT2
ccggcacucacc

SEQ ID NO: 3779163 - RNA, 18 nt, Salmonella typhimurium LT2
ccggcacuggcgcuggcu

SEQ ID NO: 3779164 - RNA, 18 nt, Salmonella typhimurium LT2
ccggcagacggcugggcu

SEQ ID NO: 3779165 - RNA, 18 nt, Salmonella typhimurium LT2
ccggcagcgucguccagc

SEQ ID NO: 3779166 - RNA, 16 nt, Salmonella typhimurium LT2
ccggcagcuuuugcgc

SEQ ID NO: 3779167 - RNA, 15 nt, Salmonella typhimurium LT2
ccggcaggcagcgcc

SEQ ID NO: 3779168 - RNA, 14 nt, Salmonella typhimurium LT2
ccggcaggcgucau

SEQ ID NO: 3779169 - RNA, 19 nt, Salmonella typhimurium LT2
ccggcagguagucauauuc

SEQ ID NO: 3779170 - RNA, 19 nt, Salmonella typhimurium LT2
ccggcaguccgucgagcgc

SEQ ID NO: 3779171 - RNA, 21 nt, Salmonella typhimurium LT2
ccggcaguccgucgagcgcgg

SEQ ID NO: 3779172 - RNA, 23 nt, Salmonella typhimurium LT2
ccggcaguccuugcagccagaac

SEQ ID NO: 3779173 - RNA, 22 nt, Salmonella typhimurium LT2
ccggcaguuauuuuacgggcgu

SEQ ID NO: 3779174 - RNA, 18 nt, Salmonella typhimurium LT2
ccggcaguugcugucgcu

SEQ ID NO: 3779175 - RNA, 19 nt, Salmonella typhimurium LT2
ccggcaguuuaagcgccga

SEQ ID NO: 3779176 - RNA, 18 nt, Salmonella typhimurium LT2
ccggcauauggauauuca

SEQ ID NO: 3779177 - RNA, 19 nt, Salmonella typhimurium LT2
ccggcaucacaaaccagac

SEQ ID NO: 3779178 - RNA, 22 nt, Salmonella typhimurium LT2
ccggcaucacaaaccagacgcg

SEQ ID NO: 3779179 - RNA, 21 nt, Salmonella typhimurium LT2
ccggcaugaagacguucuauc

SEQ ID NO: 3779180 - RNA, 20 nt, Salmonella typhimurium LT2
ccggcaugauggcgaacagc

SEQ ID NO: 3779181 - RNA, 19 nt, Salmonella typhimurium LT2
ccggcauuucaccgccaau

SEQ ID NO: 3779182 - RNA, 13 nt, Salmonella typhimurium LT2
ccggcauuucacu

SEQ ID NO: 3779183 - RNA, 16 nt, Salmonella typhimurium LT2
ccggccacagcgccag

SEQ ID NO: 3779184 - RNA, 19 nt, Salmonella typhimurium LT2
ccggccagccugcgccagc

SEQ ID NO: 3779185 - RNA, 15 nt, Salmonella typhimurium LT2
ccggccagcgacagg

SEQ ID NO: 3779186 - RNA, 22 nt, Salmonella typhimurium LT2
ccggccucagugaaucgcauca

SEQ ID NO: 3779187 - RNA, 17 nt, Salmonella typhimurium LT2
ccgguacguuaaccgga

SEQ ID NO: 3779188 - RNA, 14 nt, Salmonella typhimurium LT2
ccgguacuggagac

SEQ ID NO: 3779189 - RNA, 20 nt, Salmonella typhimurium LT2
ccgguagagaacgaaauaug

SEQ ID NO: 3779190 - RNA, 14 nt, Salmonella typhimurium LT2
ccgguagcauccgc

SEQ ID NO: 3779191 - RNA, 15 nt, Salmonella typhimurium LT2
ccgguagccagccaa

SEQ ID NO: 3779192 - RNA, 15 nt, Salmonella typhimurium LT2
ccgguagccaggcgc

SEQ ID NO: 3779193 - RNA, 19 nt, Salmonella typhimurium LT2
ccgguagcuucagcggcgc

SEQ ID NO: 3779194 - RNA, 17 nt, Salmonella typhimurium LT2
ccgguauuaaagcgcgg

SEQ ID NO: 3779195 - RNA, 18 nt, Salmonella typhimurium LT2
ccgguauuuuucaccuca

SEQ ID NO: 3779196 - RNA, 13 nt, Salmonella typhimurium LT2
ccggucauccagc

SEQ ID NO: 3779197 - RNA, 22 nt, Salmonella typhimurium LT2
ccggucaucgcggaaagcaaug

SEQ ID NO: 3779198 - RNA, 14 nt, Salmonella typhimurium LT2
ccggucgcgccagc

SEQ ID NO: 3779199 - RNA, 21 nt, Salmonella typhimurium LT2
ccggucggguguucucauccc

SEQ ID NO: 3779200 - RNA, 18 nt, Salmonella typhimurium LT2
ccggugaaaaacaucggc

SEQ ID NO: 3779201 - RNA, 14 nt, Salmonella typhimurium LT2
ccggugagcgccgc

SEQ ID NO: 3779202 - RNA, 20 nt, Salmonella typhimurium LT2
ccggugauggugcagccccg

SEQ ID NO: 3779203 - RNA, 19 nt, Salmonella typhimurium LT2
ccggugccauuccagccgg

SEQ ID NO: 3779204 - RNA, 23 nt, Salmonella typhimurium LT2
ccggugccguuaauuuucacgca

SEQ ID NO: 3779205 - RNA, 13 nt, Salmonella typhimurium LT2
ccggugcgcccca

SEQ ID NO: 3779206 - RNA, 19 nt, Salmonella typhimurium LT2
ccggugcgggaagcgcgca

SEQ ID NO: 3779207 - RNA, 16 nt, Salmonella typhimurium LT2
ccgguggcgcugcgcu

SEQ ID NO: 3779208 - RNA, 18 nt, Salmonella typhimurium LT2
ccgguggcgcuggcgcuu

SEQ ID NO: 3779209 - RNA, 15 nt, Salmonella typhimurium LT2
ccgguguagcuggca

SEQ ID NO: 3779210 - RNA, 19 nt, Salmonella typhimurium LT2
ccgguuauaccgccauccg

SEQ ID NO: 3779211 - RNA, 20 nt, Salmonella typhimurium LT2
ccgguuccggcauaaauaau

SEQ ID NO: 3779212 - RNA, 15 nt, Salmonella typhimurium LT2
ccgguucgcggcaga

SEQ ID NO: 3779213 - RNA, 22 nt, Salmonella typhimurium LT2
ccgguucggacgguaccugaag

SEQ ID NO: 3779214 - RNA, 17 nt, Salmonella typhimurium LT2
ccgguucggcaucgccc

SEQ ID NO: 3779215 - RNA, 20 nt, Salmonella typhimurium LT2
ccgguugcgcugguuggcgc

SEQ ID NO: 3779216 - RNA, 17 nt, Salmonella typhimurium LT2
ccgguuucaauccaugu

SEQ ID NO: 3779217 - RNA, 19 nt, Salmonella typhimurium LT2
ccgguuugcgguaugcguu

SEQ ID NO: 3779218 - RNA, 14 nt, Salmonella typhimurium LT2
ccgguuuuuuccug

SEQ ID NO: 3779219 - RNA, 21 nt, Salmonella typhimurium LT2
ccgguuuuuuuaugccgcuua

SEQ ID NO: 3779220 - RNA, 22 nt, Salmonella typhimurium LT2
ccgguuuuuuuugccugaaaug

SEQ ID NO: 3779221 - RNA, 18 nt, Salmonella typhimurium LT2
ccguaaacgccugcacca

SEQ ID NO: 3779222 - RNA, 13 nt, Salmonella typhimurium LT2
ccguaaaguuccc

SEQ ID NO: 3779223 - RNA, 14 nt, Salmonella typhimurium LT2
ccguaaauuccuug

SEQ ID NO: 3779224 - RNA, 13 nt, Salmonella typhimurium LT2
ccguaacgaacgc

SEQ ID NO: 3779225 - RNA, 18 nt, Salmonella typhimurium LT2
ccguaacgccgucggcag

SEQ ID NO: 3779226 - RNA, 21 nt, Salmonella typhimurium LT2
ccguaacgugcuccagcgccu

SEQ ID NO: 3779227 - RNA, 19 nt, Salmonella typhimurium LT2
ccguaagcggcggaccagc

SEQ ID NO: 3779228 - RNA, 23 nt, Salmonella typhimurium LT2
ccguaauacuuccggcugcggua

SEQ ID NO: 3779229 - RNA, 11 nt, Salmonella typhimurium LT2
ccguaauccaa

SEQ ID NO: 3779230 - RNA, 15 nt, Salmonella typhimurium LT2
ccguacacaaucauc

SEQ ID NO: 3779231 - RNA, 14 nt, Salmonella typhimurium LT2
ccguaccgcggcgc

SEQ ID NO: 3779232 - RNA, 21 nt, Salmonella typhimurium LT2
ccguaccgcggcgcugcagau

SEQ ID NO: 3779233 - RNA, 22 nt, Salmonella typhimurium LT2
ccguacgcgucacaaucgcgcc

SEQ ID NO: 3779234 - RNA, 15 nt, Salmonella typhimurium LT2
ccguacggcgucgug

SEQ ID NO: 3779235 - RNA, 21 nt, Salmonella typhimurium LT2
ccguagauaagcgccacgucg

SEQ ID NO: 3779236 - RNA, 16 nt, Salmonella typhimurium LT2
ccguagcccuggaauc

SEQ ID NO: 3779237 - RNA, 19 nt, Salmonella typhimurium LT2
ccguagccgggugcgcguc

SEQ ID NO: 3779238 - RNA, 15 nt, Salmonella typhimurium LT2
ccguagcgacgccau

SEQ ID NO: 3779239 - RNA, 19 nt, Salmonella typhimurium LT2
ccguagcguacuuucaaac

SEQ ID NO: 3779240 - RNA, 16 nt, Salmonella typhimurium LT2
ccguagcugcgcgccg

SEQ ID NO: 3779241 - RNA, 21 nt, Salmonella typhimurium LT2
ccguaguuugauugccggaug

SEQ ID NO: 3779242 - RNA, 16 nt, Salmonella typhimurium LT2
ccguauaccagcguca

SEQ ID NO: 3779243 - RNA, 13 nt, Salmonella typhimurium LT2
ccguauagcccau

SEQ ID NO: 3779244 - RNA, 15 nt, Salmonella typhimurium LT2
ccguauagccgcgcg

SEQ ID NO: 3779245 - RNA, 11 nt, Salmonella typhimurium LT2
ccguaucacug

SEQ ID NO: 3779246 - RNA, 18 nt, Salmonella typhimurium LT2
ccguaucagcaagcgcca

SEQ ID NO: 3779247 - RNA, 14 nt, Salmonella typhimurium LT2
ccguauccagacca

SEQ ID NO: 3779248 - RNA, 15 nt, Salmonella typhimurium LT2
ccguauccgccacca

SEQ ID NO: 3779249 - RNA, 19 nt, Salmonella typhimurium LT2
ccguauccgccaccaugau

SEQ ID NO: 3779250 - RNA, 19 nt, Salmonella typhimurium LT2
ccguaugacguggccagca

SEQ ID NO: 3779251 - RNA, 20 nt, Salmonella typhimurium LT2
ccguauucuuugcgccuuau

SEQ ID NO: 3779252 - RNA, 20 nt, Salmonella typhimurium LT2
ccguauugagcagcggcugg

SEQ ID NO: 3779253 - RNA, 14 nt, Salmonella typhimurium LT2
ccguauugccagau

SEQ ID NO: 3779254 - RNA, 18 nt, Salmonella typhimurium LT2
ccgucaaaacgcccaucc

SEQ ID NO: 3779255 - RNA, 23 nt, Salmonella typhimurium LT2
ccgucaaaaugaucagaccaucg

SEQ ID NO: 3779256 - RNA, 16 nt, Salmonella typhimurium LT2
ccgucaacacgcagac

SEQ ID NO: 3779257 - RNA, 18 nt, Salmonella typhimurium LT2
ccgucaaugccgggcaga

SEQ ID NO: 3779258 - RNA, 20 nt, Salmonella typhimurium LT2
ccgucaaugccgggcagacg

SEQ ID NO: 3779259 - RNA, 19 nt, Salmonella typhimurium LT2
ccgucacgccgacgacagg

SEQ ID NO: 3779260 - RNA, 18 nt, Salmonella typhimurium LT2
ccgucagagcgaggccca

SEQ ID NO: 3779261 - RNA, 15 nt, Salmonella typhimurium LT2
ccgucagcagcaccg

SEQ ID NO: 3779262 - RNA, 12 nt, Salmonella typhimurium LT2
ccgucagccacu

SEQ ID NO: 3779263 - RNA, 20 nt, Salmonella typhimurium LT2
ccgucauaaaaucaaucugc

SEQ ID NO: 3779264 - RNA, 20 nt, Salmonella typhimurium LT2
ccgucauauagccgcgcagu

SEQ ID NO: 3779265 - RNA, 16 nt, Salmonella typhimurium LT2
ccgucauccagcagca

SEQ ID NO: 3779266 - RNA, 17 nt, Salmonella typhimurium LT2
ccgucauccugcaacuc

SEQ ID NO: 3779267 - RNA, 15 nt, Salmonella typhimurium LT2
ccgucaucgcccagg

SEQ ID NO: 3779268 - RNA, 14 nt, Salmonella typhimurium LT2
ccgucaucgcucau

SEQ ID NO: 3779269 - RNA, 19 nt, Salmonella typhimurium LT2
ccgucaugcugggcgguaa

SEQ ID NO: 3779270 - RNA, 16 nt, Salmonella typhimurium LT2
ccgucaugcuucaccu

SEQ ID NO: 3779271 - RNA, 18 nt, Salmonella typhimurium LT2
ccguccagaccgucauga

SEQ ID NO: 3779272 - RNA, 11 nt, Salmonella typhimurium LT2
ccguccagcac

SEQ ID NO: 3779273 - RNA, 13 nt, Salmonella typhimurium LT2
ccgucccagcgga

SEQ ID NO: 3779274 - RNA, 22 nt, Salmonella typhimurium LT2
ccgucccuaagccggcaggcag

SEQ ID NO: 3779275 - RNA, 22 nt, Salmonella typhimurium LT2
ccgucccuuccgccaccagguu

SEQ ID NO: 3779276 - RNA, 16 nt, Salmonella typhimurium LT2
ccgucgacaaagccaa

SEQ ID NO: 3779277 - RNA, 18 nt, Salmonella typhimurium LT2
ccgucgaccagcguaccg

SEQ ID NO: 3779278 - RNA, 17 nt, Salmonella typhimurium LT2
ccgucgauaaaauccuc

SEQ ID NO: 3779279 - RNA, 15 nt, Salmonella typhimurium LT2
ccgucgcccguccgc

SEQ ID NO: 3779280 - RNA, 13 nt, Salmonella typhimurium LT2
ccgucgccgauac

SEQ ID NO: 3779281 - RNA, 13 nt, Salmonella typhimurium LT2
ccgucgccuccag

SEQ ID NO: 3779282 - RNA, 16 nt, Salmonella typhimurium LT2
ccgucgccuguuucug

SEQ ID NO: 3779283 - RNA, 15 nt, Salmonella typhimurium LT2
ccgucgcugacuuca

SEQ ID NO: 3779284 - RNA, 19 nt, Salmonella typhimurium LT2
ccgucgugacuaauagcca

SEQ ID NO: 3779285 - RNA, 21 nt, Salmonella typhimurium LT2
ccgucgugacuaauagccaaa

SEQ ID NO: 3779286 - RNA, 20 nt, Salmonella typhimurium LT2
ccgucguuaaucagcgcggu

SEQ ID NO: 3779287 - RNA, 23 nt, Salmonella typhimurium LT2
ccgucguuaaucagcgcgguggg

SEQ ID NO: 3779288 - RNA, 18 nt, Salmonella typhimurium LT2
ccgucuuacgaucccacg

SEQ ID NO: 3779289 - RNA, 14 nt, Salmonella typhimurium LT2
ccgucuucauccau

SEQ ID NO: 3779290 - RNA, 20 nt, Salmonella typhimurium LT2
ccgucuuuuagcaucaggac

SEQ ID NO: 3779291 - RNA, 14 nt, Salmonella typhimurium LT2
ccucacggagaaaa

SEQ ID NO: 3779292 - RNA, 21 nt, Salmonella typhimurium LT2
ccucacgucccguagccugau

SEQ ID NO: 3779293 - RNA, 11 nt, Salmonella typhimurium LT2
ccucacuccag

SEQ ID NO: 3779294 - RNA, 17 nt, Salmonella typhimurium LT2
ccucacuggagacggau

SEQ ID NO: 3779295 - RNA, 12 nt, Salmonella typhimurium LT2
ccucacuguuga

SEQ ID NO: 3779296 - RNA, 12 nt, Salmonella typhimurium LT2
ccucagaauccg

SEQ ID NO: 3779297 - RNA, 17 nt, Salmonella typhimurium LT2
ccucagcaaaaucacgc

SEQ ID NO: 3779298 - RNA, 11 nt, Salmonella typhimurium LT2
ccucagccacg

SEQ ID NO: 3779299 - RNA, 21 nt, Salmonella typhimurium LT2
ccucauaaauagccagcauca

SEQ ID NO: 3779300 - RNA, 20 nt, Salmonella typhimurium LT2
ccucauacagcccgcgcaga

SEQ ID NO: 3779301 - RNA, 14 nt, Salmonella typhimurium LT2
ccucauauuuguau

SEQ ID NO: 3779302 - RNA, 19 nt, Salmonella typhimurium LT2
ccucauauuuguaucuggu

SEQ ID NO: 3779303 - RNA, 19 nt, Salmonella typhimurium LT2
ccucaucccccagccgcag

SEQ ID NO: 3779304 - RNA, 15 nt, Salmonella typhimurium LT2
ccucaucggcaaaca

SEQ ID NO: 3779305 - RNA, 16 nt, Salmonella typhimurium LT2
ccucaucugcuucaac

SEQ ID NO: 3779306 - RNA, 17 nt, Salmonella typhimurium LT2
ccucaugcuuaucgcca

SEQ ID NO: 3779307 - RNA, 23 nt, Salmonella typhimurium LT2
ccucaugcuuaucgccaaaccag

SEQ ID NO: 3779308 - RNA, 20 nt, Salmonella typhimurium LT2
ccucauggaacuuauccaca

SEQ ID NO: 3779309 - RNA, 14 nt, Salmonella typhimurium LT2
ccucauucagcggc

SEQ ID NO: 3779310 - RNA, 20 nt, Salmonella typhimurium LT2
ccucauucagcggcugcgcc

SEQ ID NO: 3779311 - RNA, 16 nt, Salmonella typhimurium LT2
ccucauuuuguugcuc

SEQ ID NO: 3779312 - RNA, 21 nt, Salmonella typhimurium LT2
ccucauuuuguugcuccagca

SEQ ID NO: 3779313 - RNA, 22 nt, Salmonella typhimurium LT2
ccucauuuuguugcuccagcau

SEQ ID NO: 3779314 - RNA, 22 nt, Salmonella typhimurium LT2
ccuccacgcccagcgccgggaa

SEQ ID NO: 3779315 - RNA, 16 nt, Salmonella typhimurium LT2
ccuccagccagcgcca

SEQ ID NO: 3779316 - RNA, 17 nt, Salmonella typhimurium LT2
ccuccagccagcgccag

SEQ ID NO: 3779317 - RNA, 14 nt, Salmonella typhimurium LT2
ccuccagcgacccu

SEQ ID NO: 3779318 - RNA, 22 nt, Salmonella typhimurium LT2
ccuccagcgaggccucuccucg

SEQ ID NO: 3779319 - RNA, 19 nt, Salmonella typhimurium LT2
ccuccaggcuacccacccc

SEQ ID NO: 3779320 - RNA, 20 nt, Salmonella typhimurium LT2
ccuccaguaauucccggcag

SEQ ID NO: 3779321 - RNA, 14 nt, Salmonella typhimurium LT2
ccuccauacacugc

SEQ ID NO: 3779322 - RNA, 16 nt, Salmonella typhimurium LT2
ccuccauacacugcau

SEQ ID NO: 3779323 - RNA, 14 nt, Salmonella typhimurium LT2
ccuccauccaggua

SEQ ID NO: 3779324 - RNA, 17 nt, Salmonella typhimurium LT2
ccuccauggcuugucgc

SEQ ID NO: 3779325 - RNA, 13 nt, Salmonella typhimurium LT2
ccuccccaggcgc

SEQ ID NO: 3779326 - RNA, 17 nt, Salmonella typhimurium LT2
ccucccccucaaucggc

SEQ ID NO: 3779327 - RNA, 13 nt, Salmonella typhimurium LT2
ccuccgccaccag

SEQ ID NO: 3779328 - RNA, 14 nt, Salmonella typhimurium LT2
ccuccgccaccagc

SEQ ID NO: 3779329 - RNA, 16 nt, Salmonella typhimurium LT2
ccuccgccgaucagca

SEQ ID NO: 3779330 - RNA, 22 nt, Salmonella typhimurium LT2
ccuccgcguagcccagcgccgc

SEQ ID NO: 3779331 - RNA, 23 nt, Salmonella typhimurium LT2
ccuccgcguagcccagcgccgca

SEQ ID NO: 3779332 - RNA, 17 nt, Salmonella typhimurium LT2
ccuccggaugacgccgc

SEQ ID NO: 3779333 - RNA, 18 nt, Salmonella typhimurium LT2
ccuccggcugaagcccca

SEQ ID NO: 3779334 - RNA, 13 nt, Salmonella typhimurium LT2
ccuccggcuucag

SEQ ID NO: 3779335 - RNA, 19 nt, Salmonella typhimurium LT2
ccuccggugaagguaauuu

SEQ ID NO: 3779336 - RNA, 17 nt, Salmonella typhimurium LT2
ccuccucauucagcggc

SEQ ID NO: 3779337 - RNA, 12 nt, Salmonella typhimurium LT2
ccuccucucuuc

SEQ ID NO: 3779338 - RNA, 15 nt, Salmonella typhimurium LT2
ccuccugcagacucc

SEQ ID NO: 3779339 - RNA, 19 nt, Salmonella typhimurium LT2
ccuccugccgaugccgccg

SEQ ID NO: 3779340 - RNA, 20 nt, Salmonella typhimurium LT2
ccuccuuguaagggaggugc

SEQ ID NO: 3779341 - RNA, 19 nt, Salmonella typhimurium LT2
ccuccuugugggcagcgaa

SEQ ID NO: 3779342 - RNA, 14 nt, Salmonella typhimurium LT2
ccucgaaguauuac

SEQ ID NO: 3779343 - RNA, 23 nt, Salmonella typhimurium LT2
ccucgaaugcuggggcggcgcca

SEQ ID NO: 3779344 - RNA, 21 nt, Salmonella typhimurium LT2
ccucgauggcauuguccuuua

SEQ ID NO: 3779345 - RNA, 21 nt, Salmonella typhimurium LT2
ccucgauuaccguguuuaccu

SEQ ID NO: 3779346 - RNA, 23 nt, Salmonella typhimurium LT2
ccucgauuaccguguuuaccuuu

SEQ ID NO: 3779347 - RNA, 17 nt, Salmonella typhimurium LT2
ccucgcaaaacauggcu

SEQ ID NO: 3779348 - RNA, 13 nt, Salmonella typhimurium LT2
ccucgcauccucc

SEQ ID NO: 3779349 - RNA, 19 nt, Salmonella typhimurium LT2
ccucgcauccuccauccag

SEQ ID NO: 3779350 - RNA, 18 nt, Salmonella typhimurium LT2
ccucgccaaagcgcugcu

SEQ ID NO: 3779351 - RNA, 17 nt, Salmonella typhimurium LT2
ccucgccccuucggggc

SEQ ID NO: 3779352 - RNA, 16 nt, Salmonella typhimurium LT2
ccucgcgauccgccag

SEQ ID NO: 3779353 - RNA, 16 nt, Salmonella typhimurium LT2
ccucgcgcaccccggc

SEQ ID NO: 3779354 - RNA, 17 nt, Salmonella typhimurium LT2
ccucgcgcaccccggcc

SEQ ID NO: 3779355 - RNA, 17 nt, Salmonella typhimurium LT2
ccucgcguagcgccaac

SEQ ID NO: 3779356 - RNA, 13 nt, Salmonella typhimurium LT2
ccucgcucaccgg

SEQ ID NO: 3779357 - RNA, 14 nt, Salmonella typhimurium LT2
ccucgcucaccggc

SEQ ID NO: 3779358 - RNA, 23 nt, Salmonella typhimurium LT2
ccucgcucucuuucaccagcgcc

SEQ ID NO: 3779359 - RNA, 14 nt, Salmonella typhimurium LT2
ccucgcugacgcca

SEQ ID NO: 3779360 - RNA, 15 nt, Salmonella typhimurium LT2
ccucgcugacgccag

SEQ ID NO: 3779361 - RNA, 23 nt, Salmonella typhimurium LT2
ccucgcugacgccagccagccgu

SEQ ID NO: 3779362 - RNA, 17 nt, Salmonella typhimurium LT2
ccucgcuuaaaccacca

SEQ ID NO: 3779363 - RNA, 20 nt, Salmonella typhimurium LT2
ccucggcaacauaccgggua

SEQ ID NO: 3779364 - RNA, 20 nt, Salmonella typhimurium LT2
ccucgguauguccugccgca

SEQ ID NO: 3779365 - RNA, 14 nt, Salmonella typhimurium LT2
ccucgguuuauccc

SEQ ID NO: 3779366 - RNA, 14 nt, Salmonella typhimurium LT2
ccucgucagugaac

SEQ ID NO: 3779367 - RNA, 22 nt, Salmonella typhimurium LT2
ccucgucaugcucgcuuuccau

SEQ ID NO: 3779368 - RNA, 16 nt, Salmonella typhimurium LT2
ccucguucggcgcacc

SEQ ID NO: 3779369 - RNA, 16 nt, Salmonella typhimurium LT2
ccucguuuaaugcgaa

SEQ ID NO: 3779370 - RNA, 20 nt, Salmonella typhimurium LT2
ccucguuugcugagcagcca

SEQ ID NO: 3779371 - RNA, 21 nt, Salmonella typhimurium LT2
ccucguuugcugagcagccag

SEQ ID NO: 3779372 - RNA, 22 nt, Salmonella typhimurium LT2
ccucuaccggaaaacagccgcc

SEQ ID NO: 3779373 - RNA, 13 nt, Salmonella typhimurium LT2
ccucuaucuucuc

SEQ ID NO: 3779374 - RNA, 22 nt, Salmonella typhimurium LT2
ccucuccugaagccagcgcccg

SEQ ID NO: 3779375 - RNA, 21 nt, Salmonella typhimurium LT2
ccucucuaugaaugccggaug

SEQ ID NO: 3779376 - RNA, 18 nt, Salmonella typhimurium LT2
ccucucuccgccugcggu

SEQ ID NO: 3779377 - RNA, 12 nt, Salmonella typhimurium LT2
ccucucuuccuc

SEQ ID NO: 3779378 - RNA, 15 nt, Salmonella typhimurium LT2
ccucucuuccuccug

SEQ ID NO: 3779379 - RNA, 16 nt, Salmonella typhimurium LT2
ccucucuuccuccuga

SEQ ID NO: 3779380 - RNA, 14 nt, Salmonella typhimurium LT2
ccucucuucucgcu

SEQ ID NO: 3779381 - RNA, 18 nt, Salmonella typhimurium LT2
ccucugccguagcguacu

SEQ ID NO: 3779382 - RNA, 14 nt, Salmonella typhimurium LT2
ccucugugccggcg

SEQ ID NO: 3779383 - RNA, 13 nt, Salmonella typhimurium LT2
ccucuuaucaggc

SEQ ID NO: 3779384 - RNA, 16 nt, Salmonella typhimurium LT2
ccucuuccaucagcca

SEQ ID NO: 3779385 - RNA, 19 nt, Salmonella typhimurium LT2
ccucuuccaucagccaggc

SEQ ID NO: 3779386 - RNA, 14 nt, Salmonella typhimurium LT2
ccucuuccgccagg

SEQ ID NO: 3779387 - RNA, 18 nt, Salmonella typhimurium LT2
ccucuuccgccaggucgc

SEQ ID NO: 3779388 - RNA, 16 nt, Salmonella typhimurium LT2
ccucuucgcaauaggg

SEQ ID NO: 3779389 - RNA, 21 nt, Salmonella typhimurium LT2
ccucuugucaggcaaaaauaa

SEQ ID NO: 3779390 - RNA, 16 nt, Salmonella typhimurium LT2
ccucuuucagccggcu

SEQ ID NO: 3779391 - RNA, 17 nt, Salmonella typhimurium LT2
ccucuuucaugcggucu

SEQ ID NO: 3779392 - RNA, 21 nt, Salmonella typhimurium LT2
ccucuuuuuagcagcaauaau

SEQ ID NO: 3779393 - RNA, 22 nt, Salmonella typhimurium LT2
ccucuuuuucaacguccaccag

SEQ ID NO: 3779394 - RNA, 12 nt, Salmonella typhimurium LT2
ccucuuuuucau

SEQ ID NO: 3779395 - RNA, 16 nt, Salmonella typhimurium LT2
ccugccaggccggacu

SEQ ID NO: 3779396 - RNA, 13 nt, Salmonella typhimurium LT2
ccugccaguccgc

SEQ ID NO: 3779397 - RNA, 16 nt, Salmonella typhimurium LT2
ccugccaguccgcccg

SEQ ID NO: 3779398 - RNA, 18 nt, Salmonella typhimurium LT2
ccugccauagcaucacca

SEQ ID NO: 3779399 - RNA, 19 nt, Salmonella typhimurium LT2
ccugcccacuuugccauga

SEQ ID NO: 3779400 - RNA, 23 nt, Salmonella typhimurium LT2
ccugcccgccacccuccgggccg

SEQ ID NO: 3779401 - RNA, 15 nt, Salmonella typhimurium LT2
ccugcccuuucuuca

SEQ ID NO: 3779402 - RNA, 15 nt, Salmonella typhimurium LT2
ccugccggacugaua

SEQ ID NO: 3779403 - RNA, 18 nt, Salmonella typhimurium LT2
ccugccggauggcggcgc

SEQ ID NO: 3779404 - RNA, 17 nt, Salmonella typhimurium LT2
ccugccggauuuuucau

SEQ ID NO: 3779405 - RNA, 22 nt, Salmonella typhimurium LT2
ccugccggauuuuucauagcag

SEQ ID NO: 3779406 - RNA, 20 nt, Salmonella typhimurium LT2
ccugccguccugaucaaggc

SEQ ID NO: 3779407 - RNA, 20 nt, Salmonella typhimurium LT2
ccugccgucgcggcuuucag

SEQ ID NO: 3779408 - RNA, 17 nt, Salmonella typhimurium LT2
ccugccguuuauuauuu

SEQ ID NO: 3779409 - RNA, 19 nt, Salmonella typhimurium LT2
ccugccguuuuccagccgu

SEQ ID NO: 3779410 - RNA, 13 nt, Salmonella typhimurium LT2
ccugccucaacau

SEQ ID NO: 3779411 - RNA, 17 nt, Salmonella typhimurium LT2
ccugcgaagaugagcca

SEQ ID NO: 3779412 - RNA, 20 nt, Salmonella typhimurium LT2
ccugcgagcuguagcgaagg

SEQ ID NO: 3779413 - RNA, 20 nt, Salmonella typhimurium LT2
ccugcgcauacgucaugccu

SEQ ID NO: 3779414 - RNA, 14 nt, Salmonella typhimurium LT2
ccugcgccagccgg

SEQ ID NO: 3779415 - RNA, 15 nt, Salmonella typhimurium LT2
ccugcgccagccgga

SEQ ID NO: 3779416 - RNA, 13 nt, Salmonella typhimurium LT2
ccugcgccagcgg

SEQ ID NO: 3779417 - RNA, 22 nt, Salmonella typhimurium LT2
ccugcgccaguucauccagcag

SEQ ID NO: 3779418 - RNA, 17 nt, Salmonella typhimurium LT2
ccugcgcgacgcccacc

SEQ ID NO: 3779419 - RNA, 24 nt, Salmonella typhimurium LT2
ccugcgcgacgcccaccagucccu

SEQ ID NO: 3779420 - RNA, 15 nt, Salmonella typhimurium LT2
ccugcgcgccuugcg

SEQ ID NO: 3779421 - RNA, 19 nt, Salmonella typhimurium LT2
ccugcgcucauauacccug

SEQ ID NO: 3779422 - RNA, 11 nt, Salmonella typhimurium LT2
ccugcgcugac

SEQ ID NO: 3779423 - RNA, 17 nt, Salmonella typhimurium LT2
ccugcgcugauuuucuc

SEQ ID NO: 3779424 - RNA, 17 nt, Salmonella typhimurium LT2
ccugcgcugucaccagc

SEQ ID NO: 3779425 - RNA, 23 nt, Salmonella typhimurium LT2
ccugcgcuuuggguuaaugccag

SEQ ID NO: 3779426 - RNA, 21 nt, Salmonella typhimurium LT2
ccugcgggcuuagggucagug

SEQ ID NO: 3779427 - RNA, 16 nt, Salmonella typhimurium LT2
ccugcgguaaacgcuc

SEQ ID NO: 3779428 - RNA, 22 nt, Salmonella typhimurium LT2
ccugcgucacgauaguuuuaau

SEQ ID NO: 3779429 - RNA, 16 nt, Salmonella typhimurium LT2
ccugcgucgccccaau

SEQ ID NO: 3779430 - RNA, 15 nt, Salmonella typhimurium LT2
ccugcucaagcugua

SEQ ID NO: 3779431 - RNA, 13 nt, Salmonella typhimurium LT2
ccugcucaaucgc

SEQ ID NO: 3779432 - RNA, 14 nt, Salmonella typhimurium LT2
ccugcucaaucgca

SEQ ID NO: 3779433 - RNA, 12 nt, Salmonella typhimurium LT2
ccugcucaggcu

SEQ ID NO: 3779434 - RNA, 18 nt, Salmonella typhimurium LT2
ccugcuccaccagcgcau

SEQ ID NO: 3779435 - RNA, 12 nt, Salmonella typhimurium LT2
ccugcucccaga

SEQ ID NO: 3779436 - RNA, 16 nt, Salmonella typhimurium LT2
ccugcucccagauuaa

SEQ ID NO: 3779437 - RNA, 13 nt, Salmonella typhimurium LT2
ccugcucgccugu

SEQ ID NO: 3779438 - RNA, 18 nt, Salmonella typhimurium LT2
ccugcugccagccgccgc

SEQ ID NO: 3779439 - RNA, 20 nt, Salmonella typhimurium LT2
ccugcugccagccgccgccg

SEQ ID NO: 3779440 - RNA, 21 nt, Salmonella typhimurium LT2
ccugcugccagccgccgccgg

SEQ ID NO: 3779441 - RNA, 17 nt, Salmonella typhimurium LT2
ccugcugcuggacagga

SEQ ID NO: 3779442 - RNA, 23 nt, Salmonella typhimurium LT2
ccugcuggaaaggccgcgaaccg

SEQ ID NO: 3779443 - RNA, 16 nt, Salmonella typhimurium LT2
ccugcuggcaaaacgc

SEQ ID NO: 3779444 - RNA, 21 nt, Salmonella typhimurium LT2
ccugcuggcgcuacguuuguc

SEQ ID NO: 3779445 - RNA, 19 nt, Salmonella typhimurium LT2
ccugcuggucgccgcccau

SEQ ID NO: 3779446 - RNA, 16 nt, Salmonella typhimurium LT2
ccugcugguuauuauc

SEQ ID NO: 3779447 - RNA, 16 nt, Salmonella typhimurium LT2
ccugcuuaaacagaau

SEQ ID NO: 3779448 - RNA, 11 nt, Salmonella typhimurium LT2
ccugcuucaga

SEQ ID NO: 3779449 - RNA, 19 nt, Salmonella typhimurium LT2
ccugcuugucgaucaucag

SEQ ID NO: 3779450 - RNA, 20 nt, Salmonella typhimurium LT2
ccugcuugucgaucaucaga

SEQ ID NO: 3779451 - RNA, 18 nt, Salmonella typhimurium LT2
ccugcuuuuucagcgagg

SEQ ID NO: 3779452 - RNA, 20 nt, Salmonella typhimurium LT2
ccugcuuuuucaucauacug

SEQ ID NO: 3779453 - RNA, 23 nt, Salmonella typhimurium LT2
ccuggaaaaaagcgcccagcgcc

SEQ ID NO: 3779454 - RNA, 20 nt, Salmonella typhimurium LT2
ccuggaagacuucacgccau

SEQ ID NO: 3779455 - RNA, 22 nt, Salmonella typhimurium LT2
ccuggagagcagcgccagcgac

SEQ ID NO: 3779456 - RNA, 15 nt, Salmonella typhimurium LT2
ccuggaggaacagcg

SEQ ID NO: 3779457 - RNA, 15 nt, Salmonella typhimurium LT2
ccuggaugacacagg

SEQ ID NO: 3779458 - RNA, 14 nt, Salmonella typhimurium LT2
ccuggaugcuuaaa

SEQ ID NO: 3779459 - RNA, 22 nt, Salmonella typhimurium LT2
ccuggauuagucugccauuucc

SEQ ID NO: 3779460 - RNA, 14 nt, Salmonella typhimurium LT2
ccuggauuuuaccu

SEQ ID NO: 3779461 - RNA, 16 nt, Salmonella typhimurium LT2
ccuggcagcuugccuu

SEQ ID NO: 3779462 - RNA, 16 nt, Salmonella typhimurium LT2
ccuggcagguauuaau

SEQ ID NO: 3779463 - RNA, 21 nt, Salmonella typhimurium LT2
ccuggcagguauuaauccugc

SEQ ID NO: 3779464 - RNA, 17 nt, Salmonella typhimurium LT2
ccuggcaguucagucgg

SEQ ID NO: 3779465 - RNA, 13 nt, Salmonella typhimurium LT2
ccuggcaguuuau

SEQ ID NO: 3779466 - RNA, 19 nt, Salmonella typhimurium LT2
ccuggcccggcaguugcug

SEQ ID NO: 3779467 - RNA, 18 nt, Salmonella typhimurium LT2
ccuggccgauaugaauaa

SEQ ID NO: 3779468 - RNA, 20 nt, Salmonella typhimurium LT2
ccuggccgguaaauuucacu

SEQ ID NO: 3779469 - RNA, 22 nt, Salmonella typhimurium LT2
ccuggcgaauaaaauucagcgc

SEQ ID NO: 3779470 - RNA, 14 nt, Salmonella typhimurium LT2
ccuggcgcaguggc

SEQ ID NO: 3779471 - RNA, 21 nt, Salmonella typhimurium LT2
ccuggcgugcgauuugcucaa

SEQ ID NO: 3779472 - RNA, 17 nt, Salmonella typhimurium LT2
ccuggcguguccccacc

SEQ ID NO: 3779473 - RNA, 20 nt, Salmonella typhimurium LT2
ccuggcucaauccaggugga

SEQ ID NO: 3779474 - RNA, 16 nt, Salmonella typhimurium LT2
ccuggcugaaccaggc

SEQ ID NO: 3779475 - RNA, 19 nt, Salmonella typhimurium LT2
ccuggcuuaccugcucugg

SEQ ID NO: 3779476 - RNA, 19 nt, Salmonella typhimurium LT2
ccugggcgaaaacgcccgc

SEQ ID NO: 3779477 - RNA, 22 nt, Salmonella typhimurium LT2
ccuggguauuuuuuagcgccaa

SEQ ID NO: 3779478 - RNA, 18 nt, Salmonella typhimurium LT2
ccugguaagcgcagcgcc

SEQ ID NO: 3779479 - RNA, 20 nt, Salmonella typhimurium LT2
ccugguaagcgcagcgccac

SEQ ID NO: 3779480 - RNA, 18 nt, Salmonella typhimurium LT2
ccuggucuauucguucuc

SEQ ID NO: 3779481 - RNA, 22 nt, Salmonella typhimurium LT2
ccugguguguaaauuuguuuaa

SEQ ID NO: 3779482 - RNA, 22 nt, Salmonella typhimurium LT2
ccugguuaacccgguuuauccc

SEQ ID NO: 3779483 - RNA, 15 nt, Salmonella typhimurium LT2
ccuguaaacagaugc

SEQ ID NO: 3779484 - RNA, 16 nt, Salmonella typhimurium LT2
ccuguaaacagaugcu

SEQ ID NO: 3779485 - RNA, 14 nt, Salmonella typhimurium LT2
ccuguaaaccgccu

SEQ ID NO: 3779486 - RNA, 12 nt, Salmonella typhimurium LT2
ccuguaaagcuu

SEQ ID NO: 3779487 - RNA, 21 nt, Salmonella typhimurium LT2
ccuguaacaacuguuuuucac

SEQ ID NO: 3779488 - RNA, 14 nt, Salmonella typhimurium LT2
ccuguaacacacug

SEQ ID NO: 3779489 - RNA, 18 nt, Salmonella typhimurium LT2
ccuguaaccuuaaaaggc

SEQ ID NO: 3779490 - RNA, 20 nt, Salmonella typhimurium LT2
ccuguaacgcauaagcgcga

SEQ ID NO: 3779491 - RNA, 19 nt, Salmonella typhimurium LT2
ccuguaaugucuggugcag

SEQ ID NO: 3779492 - RNA, 14 nt, Salmonella typhimurium LT2
ccuguaccaccacg

SEQ ID NO: 3779493 - RNA, 19 nt, Salmonella typhimurium LT2
ccuguacccgguacuuucu

SEQ ID NO: 3779494 - RNA, 17 nt, Salmonella typhimurium LT2
ccuguaccgggcagaca

SEQ ID NO: 3779495 - RNA, 21 nt, Salmonella typhimurium LT2
ccuguagggcacugggcgaua

SEQ ID NO: 3779496 - RNA, 13 nt, Salmonella typhimurium LT2
ccuguauuuuuuc

SEQ ID NO: 3779497 - RNA, 15 nt, Salmonella typhimurium LT2
ccugucaucaucaag

SEQ ID NO: 3779498 - RNA, 16 nt, Salmonella typhimurium LT2
ccugucgaucauccac

SEQ ID NO: 3779499 - RNA, 20 nt, Salmonella typhimurium LT2
ccuuguuauccuaaaucugc

SEQ ID NO: 3779500 - RNA, 22 nt, Salmonella typhimurium LT2
ccuuguucaauagagcgcagca

SEQ ID NO: 3779501 - RNA, 12 nt, Salmonella typhimurium LT2
ccuuguuuuaac

SEQ ID NO: 3779502 - RNA, 18 nt, Salmonella typhimurium LT2
ccuuuaaccucuuuuuca

SEQ ID NO: 3779503 - RNA, 22 nt, Salmonella typhimurium LT2
ccuuuaacgccuucauauuaaa

SEQ ID NO: 3779504 - RNA, 19 nt, Salmonella typhimurium LT2
ccuuuaaucgagccuuuca

SEQ ID NO: 3779505 - RNA, 21 nt, Salmonella typhimurium LT2
ccuuuaauuccgccgggcaac

SEQ ID NO: 3779506 - RNA, 22 nt, Salmonella typhimurium LT2
ccuuuaccccucuuucacagcu

SEQ ID NO: 3779507 - RNA, 17 nt, Salmonella typhimurium LT2
ccuuuacuguugccuuu

SEQ ID NO: 3779508 - RNA, 20 nt, Salmonella typhimurium LT2
ccuuuaggcggcgccgcgcc

SEQ ID NO: 3779509 - RNA, 22 nt, Salmonella typhimurium LT2
ccuuuauauuuuucccuggccg

SEQ ID NO: 3779510 - RNA, 18 nt, Salmonella typhimurium LT2
ccuuucaaaaaagagaag

SEQ ID NO: 3779511 - RNA, 17 nt, Salmonella typhimurium LT2
ccuuucaccaucagcau

SEQ ID NO: 3779512 - RNA, 23 nt, Salmonella typhimurium LT2
ccuuucagagcgucuuuuauccc

SEQ ID NO: 3779513 - RNA, 23 nt, Salmonella typhimurium LT2
ccuuucauuucugccugcuucag

SEQ ID NO: 3779514 - RNA, 11 nt, Salmonella typhimurium LT2
ccuuucauuuu

SEQ ID NO: 3779515 - RNA, 20 nt, Salmonella typhimurium LT2
ccuuucggggcggauuuuuu

SEQ ID NO: 3779516 - RNA, 22 nt, Salmonella typhimurium LT2
ccuuucgguucgccgcgcgcau

SEQ ID NO: 3779517 - RNA, 13 nt, Salmonella typhimurium LT2
ccuuucuucaacg

SEQ ID NO: 3779518 - RNA, 18 nt, Salmonella typhimurium LT2
ccuuucuucaacggcgcc

SEQ ID NO: 3779519 - RNA, 12 nt, Salmonella typhimurium LT2
ccuuucuucacg

SEQ ID NO: 3779520 - RNA, 12 nt, Salmonella typhimurium LT2
ccuuugcccuca

SEQ ID NO: 3779521 - RNA, 14 nt, Salmonella typhimurium LT2
ccuuugcccucaaa

SEQ ID NO: 3779522 - RNA, 12 nt, Salmonella typhimurium LT2
ccuuugccuuuc

SEQ ID NO: 3779523 - RNA, 24 nt, Salmonella typhimurium LT2
ccuuugcgcgcgauauccaccuga

SEQ ID NO: 3779524 - RNA, 21 nt, Salmonella typhimurium LT2
ccuuuggcaccguuagugauu

SEQ ID NO: 3779525 - RNA, 22 nt, Salmonella typhimurium LT2
ccuuuggccuggagaucagcau

SEQ ID NO: 3779526 - RNA, 23 nt, Salmonella typhimurium LT2
ccuuugggaaaauaaaugcuuug

SEQ ID NO: 3779527 - RNA, 17 nt, Salmonella typhimurium LT2
ccuuugguggaguuuuc

SEQ ID NO: 3779528 - RNA, 22 nt, Salmonella typhimurium LT2
ccuuugucgaaauugccgcccg

SEQ ID NO: 3779529 - RNA, 13 nt, Salmonella typhimurium LT2
ccuuuguggcagg

SEQ ID NO: 3779530 - RNA, 13 nt, Salmonella typhimurium LT2
ccuuuuaauuuuc

SEQ ID NO: 3779531 - RNA, 18 nt, Salmonella typhimurium LT2
ccuuuuaccggcgaaguc

SEQ ID NO: 3779532 - RNA, 21 nt, Salmonella typhimurium LT2
ccuuuuagcgcguuaccgcuc

SEQ ID NO: 3779533 - RNA, 18 nt, Salmonella typhimurium LT2
ccuuuucccccagcaucu

SEQ ID NO: 3779534 - RNA, 15 nt, Salmonella typhimurium LT2
ccuuuuccggcggca

SEQ ID NO: 3779535 - RNA, 19 nt, Salmonella typhimurium LT2
ccuuuucgcagcaauucug

SEQ ID NO: 3779536 - RNA, 17 nt, Salmonella typhimurium LT2
ccuuuuguuuuugcccc

SEQ ID NO: 3779537 - RNA, 20 nt, Salmonella typhimurium LT2
ccuuuuuauggcccgccagc

SEQ ID NO: 3779538 - RNA, 15 nt, Salmonella typhimurium LT2
ccuuuuucaacagca

SEQ ID NO: 3779539 - RNA, 22 nt, Salmonella typhimurium LT2
ccuuuuugauccguuucagaaa

SEQ ID NO: 3779540 - RNA, 20 nt, Salmonella typhimurium LT2
ccuuuuuugguuauccagca

SEQ ID NO: 3779541 - RNA, 18 nt, Salmonella typhimurium LT2
ccuuuuuugugaauauca

SEQ ID NO: 3779542 - RNA, 12 nt, Salmonella typhimurium LT2
cgaaaaaaagau

SEQ ID NO: 3779543 - RNA, 16 nt, Salmonella typhimurium LT2
cgaaaaaccaggcaac

SEQ ID NO: 3779544 - RNA, 22 nt, Salmonella typhimurium LT2
cgaaaaccaagcgcaugguaga

SEQ ID NO: 3779545 - RNA, 19 nt, Salmonella typhimurium LT2
cgaaaauaaacgcuugacu

SEQ ID NO: 3779546 - RNA, 13 nt, Salmonella typhimurium LT2
cgaaaauauauuc

SEQ ID NO: 3779547 - RNA, 12 nt, Salmonella typhimurium LT2
cgaaaaucaucc

SEQ ID NO: 3779548 - RNA, 18 nt, Salmonella typhimurium LT2
cgaaaaugguuuugccca

SEQ ID NO: 3779549 - RNA, 20 nt, Salmonella typhimurium LT2
cgaaacacgaauaauucuca

SEQ ID NO: 3779550 - RNA, 15 nt, Salmonella typhimurium LT2
cgaaacaggcggcag

SEQ ID NO: 3779551 - RNA, 23 nt, Salmonella typhimurium LT2
cgaaacgaaucucaucagacugu

SEQ ID NO: 3779552 - RNA, 13 nt, Salmonella typhimurium LT2
cgaaacgcagcau

SEQ ID NO: 3779553 - RNA, 21 nt, Salmonella typhimurium LT2
cgaaacgcauacgcagcacuu

SEQ ID NO: 3779554 - RNA, 13 nt, Salmonella typhimurium LT2
cgaaacggcagcg

SEQ ID NO: 3779555 - RNA, 14 nt, Salmonella typhimurium LT2
cgaaacguugcuua

SEQ ID NO: 3779556 - RNA, 18 nt, Salmonella typhimurium LT2
cgaaacguugcuuauuca

SEQ ID NO: 3779557 - RNA, 17 nt, Salmonella typhimurium LT2
cgaaagaaacgccgacc

SEQ ID NO: 3779558 - RNA, 19 nt, Salmonella typhimurium LT2
cgaaagcacuucucgcgca

SEQ ID NO: 3779559 - RNA, 17 nt, Salmonella typhimurium LT2
cgaaaggguauacaaaa

SEQ ID NO: 3779560 - RNA, 18 nt, Salmonella typhimurium LT2
cgaaagucaucugccagu

SEQ ID NO: 3779561 - RNA, 15 nt, Salmonella typhimurium LT2
cgaaagucuguucgu

SEQ ID NO: 3779562 - RNA, 20 nt, Salmonella typhimurium LT2
cgaaauacggacgccagaua

SEQ ID NO: 3779563 - RNA, 20 nt, Salmonella typhimurium LT2
cgaaauagacguuuccguug

SEQ ID NO: 3779564 - RNA, 17 nt, Salmonella typhimurium LT2
cgaaauauuaucgccau

SEQ ID NO: 3779565 - RNA, 14 nt, Salmonella typhimurium LT2
cgaaaucaaagacc

SEQ ID NO: 3779566 - RNA, 20 nt, Salmonella typhimurium LT2
cgaaaucaaagaccuccgcc

SEQ ID NO: 3779567 - RNA, 20 nt, Salmonella typhimurium LT2
cgaaaugacagccaccagcg

SEQ ID NO: 3779568 - RNA, 21 nt, Salmonella typhimurium LT2
cgaaauggaucggcuugccuu

SEQ ID NO: 3779569 - RNA, 16 nt, Salmonella typhimurium LT2
cgaaaugguuccaggc

SEQ ID NO: 3779570 - RNA, 23 nt, Salmonella typhimurium LT2
cgaaaugguuccaggcgcgcacc

SEQ ID NO: 3779571 - RNA, 18 nt, Salmonella typhimurium LT2
cgaaauuggccaucaggu

SEQ ID NO: 3779572 - RNA, 17 nt, Salmonella typhimurium LT2
cgaacaaacuccagcac

SEQ ID NO: 3779573 - RNA, 18 nt, Salmonella typhimurium LT2
cgaacaaacuccagcacg

SEQ ID NO: 3779574 - RNA, 19 nt, Salmonella typhimurium LT2
cgaacaaguaguuguuaua

SEQ ID NO: 3779575 - RNA, 21 nt, Salmonella typhimurium LT2
cgaacagacguuacaucuccu

SEQ ID NO: 3779576 - RNA, 12 nt, Salmonella typhimurium LT2
cgaacagccagg

SEQ ID NO: 3779577 - RNA, 13 nt, Salmonella typhimurium LT2
cgaacagcgcucc

SEQ ID NO: 3779578 - RNA, 17 nt, Salmonella typhimurium LT2
cgaacagcgcuccacgc

SEQ ID NO: 3779579 - RNA, 14 nt, Salmonella typhimurium LT2
cgaacaguucgguc

SEQ ID NO: 3779580 - RNA, 19 nt, Salmonella typhimurium LT2
cgaacauccuugcacgcca

SEQ ID NO: 3779581 - RNA, 20 nt, Salmonella typhimurium LT2
cgaacaucugcguugcgcgc

SEQ ID NO: 3779582 - RNA, 22 nt, Salmonella typhimurium LT2
cgaaccaacgacccccaccaug

SEQ ID NO: 3779583 - RNA, 23 nt, Salmonella typhimurium LT2
cgaaccaacgacccccaccaugu

SEQ ID NO: 3779584 - RNA, 13 nt, Salmonella typhimurium LT2
cgaaccaccagcc

SEQ ID NO: 3779585 - RNA, 20 nt, Salmonella typhimurium LT2
cgaaccaucauuaauauaau

SEQ ID NO: 3779586 - RNA, 23 nt, Salmonella typhimurium LT2
cgaaccaucgacccccaccaugu

SEQ ID NO: 3779587 - RNA, 16 nt, Salmonella typhimurium LT2
cgaaccauuucuuuug

SEQ ID NO: 3779588 - RNA, 17 nt, Salmonella typhimurium LT2
cgaacccaucagggaaa

SEQ ID NO: 3779589 - RNA, 18 nt, Salmonella typhimurium LT2
cgaaccguaaacgccugc

SEQ ID NO: 3779590 - RNA, 20 nt, Salmonella typhimurium LT2
cgaaccugguacaccagacg

SEQ ID NO: 3779591 - RNA, 19 nt, Salmonella typhimurium LT2
cgaaccuuaagcgcgaaau

SEQ ID NO: 3779592 - RNA, 20 nt, Salmonella typhimurium LT2
cgaacgccgacaucacgcaa

SEQ ID NO: 3779593 - RNA, 15 nt, Salmonella typhimurium LT2
cgaacgcgaaggcca

SEQ ID NO: 3779594 - RNA, 22 nt, Salmonella typhimurium LT2
cgaacgcgaaggccagcaccag

SEQ ID NO: 3779595 - RNA, 13 nt, Salmonella typhimurium LT2
cgaacgcgaugcg

SEQ ID NO: 3779596 - RNA, 13 nt, Salmonella typhimurium LT2
cgaacgcgcgucg

SEQ ID NO: 3779597 - RNA, 21 nt, Salmonella typhimurium LT2
cgaacgcggcuuauccggcuu

SEQ ID NO: 3779598 - RNA, 23 nt, Salmonella typhimurium LT2
cgaacgcggcuuauccggcuuac

SEQ ID NO: 3779599 - RNA, 17 nt, Salmonella typhimurium LT2
cgaacggauaaacggcg

SEQ ID NO: 3779600 - RNA, 16 nt, Salmonella typhimurium LT2
cgaacggccugaucga

SEQ ID NO: 3779601 - RNA, 23 nt, Salmonella typhimurium LT2
cgaacggcuuuccagcagccaga

SEQ ID NO: 3779602 - RNA, 19 nt, Salmonella typhimurium LT2
cgacaggguuugccagcac

SEQ ID NO: 3779603 - RNA, 16 nt, Salmonella typhimurium LT2
cgacaguaaaacccaa

SEQ ID NO: 3779604 - RNA, 13 nt, Salmonella typhimurium LT2
cgacaguaacugc

SEQ ID NO: 3779605 - RNA, 14 nt, Salmonella typhimurium LT2
cgacaguaacugca

SEQ ID NO: 3779606 - RNA, 12 nt, Salmonella typhimurium LT2
cgacaguaccag

SEQ ID NO: 3779607 - RNA, 15 nt, Salmonella typhimurium LT2
cgacaguaccagcag

SEQ ID NO: 3779608 - RNA, 16 nt, Salmonella typhimurium LT2
cgacaguaccagcaga

SEQ ID NO: 3779609 - RNA, 15 nt, Salmonella typhimurium LT2
cgacauagccuuugu

SEQ ID NO: 3779610 - RNA, 12 nt, Salmonella typhimurium LT2
cgacaucagcca

SEQ ID NO: 3779611 - RNA, 12 nt, Salmonella typhimurium LT2
cgacaucgccaa

SEQ ID NO: 3779612 - RNA, 16 nt, Salmonella typhimurium LT2
cgacaucgccaaccgc

SEQ ID NO: 3779613 - RNA, 12 nt, Salmonella typhimurium LT2
cgacaucgccag

SEQ ID NO: 3779614 - RNA, 15 nt, Salmonella typhimurium LT2
cgacaucucaggcaa

SEQ ID NO: 3779615 - RNA, 21 nt, Salmonella typhimurium LT2
cgacaucucaggcaagacaca

SEQ ID NO: 3779616 - RNA, 20 nt, Salmonella typhimurium LT2
cgacaucugcacauacgcca

SEQ ID NO: 3779617 - RNA, 21 nt, Salmonella typhimurium LT2
cgacaugcgcaugugaguauc

SEQ ID NO: 3779618 - RNA, 19 nt, Salmonella typhimurium LT2
cgacauggcgguaaucgcg

SEQ ID NO: 3779619 - RNA, 17 nt, Salmonella typhimurium LT2
cgacaugucaugacuua

SEQ ID NO: 3779620 - RNA, 13 nt, Salmonella typhimurium LT2
cgaccaauauccg

SEQ ID NO: 3779621 - RNA, 16 nt, Salmonella typhimurium LT2
cgaccacccgcggcca

SEQ ID NO: 3779622 - RNA, 13 nt, Salmonella typhimurium LT2
cgaccacgccacc

SEQ ID NO: 3779623 - RNA, 17 nt, Salmonella typhimurium LT2
cgaccacgccaccgccg

SEQ ID NO: 3779624 - RNA, 15 nt, Salmonella typhimurium LT2
cgaccacgcccagcu

SEQ ID NO: 3779625 - RNA, 17 nt, Salmonella typhimurium LT2
cgaccacuucaacgccg

SEQ ID NO: 3779626 - RNA, 15 nt, Salmonella typhimurium LT2
cgaccagauaucccg

SEQ ID NO: 3779627 - RNA, 19 nt, Salmonella typhimurium LT2
cgaccagcguuaaacuggc

SEQ ID NO: 3779628 - RNA, 13 nt, Salmonella typhimurium LT2
cgaccaggaucag

SEQ ID NO: 3779629 - RNA, 19 nt, Salmonella typhimurium LT2
cgaccaguuuagcuaaauc

SEQ ID NO: 3779630 - RNA, 21 nt, Salmonella typhimurium LT2
cgaccauaaauagccgaccgc

SEQ ID NO: 3779631 - RNA, 18 nt, Salmonella typhimurium LT2
cgaccaugguucccgcca

SEQ ID NO: 3779632 - RNA, 20 nt, Salmonella typhimurium LT2
cgaccaugguucccgccacu

SEQ ID NO: 3779633 - RNA, 22 nt, Salmonella typhimurium LT2
cgacccggcguuuucagaucca

SEQ ID NO: 3779634 - RNA, 16 nt, Salmonella typhimurium LT2
cgaccgaucaucaucc

SEQ ID NO: 3779635 - RNA, 11 nt, Salmonella typhimurium LT2
cgaccgccaua

SEQ ID NO: 3779636 - RNA, 13 nt, Salmonella typhimurium LT2
cgaccggcagccg

SEQ ID NO: 3779637 - RNA, 15 nt, Salmonella typhimurium LT2
cgaccggggcguuca

SEQ ID NO: 3779638 - RNA, 21 nt, Salmonella typhimurium LT2
cgaccgugagaaucgaucagc

SEQ ID NO: 3779639 - RNA, 24 nt, Salmonella typhimurium LT2
cgaccgugauucgcccguuguccg

SEQ ID NO: 3779640 - RNA, 17 nt, Salmonella typhimurium LT2
cgaccguuuccgccagu

SEQ ID NO: 3779641 - RNA, 15 nt, Salmonella typhimurium LT2
cgaccuacaagauuu

SEQ ID NO: 3779642 - RNA, 12 nt, Salmonella typhimurium LT2
cgaccugcagcu

SEQ ID NO: 3779643 - RNA, 17 nt, Salmonella typhimurium LT2
cgaccugcauauuuuuc

SEQ ID NO: 3779644 - RNA, 13 nt, Salmonella typhimurium LT2
cgaccuuaauuuc

SEQ ID NO: 3779645 - RNA, 17 nt, Salmonella typhimurium LT2
cgaccuucacgccgcca

SEQ ID NO: 3779646 - RNA, 20 nt, Salmonella typhimurium LT2
cgacgaccggcgcagcgccc

SEQ ID NO: 3779647 - RNA, 20 nt, Salmonella typhimurium LT2
cgacgagguuuccggcggga

SEQ ID NO: 3779648 - RNA, 22 nt, Salmonella typhimurium LT2
cgacgagguuuccggcgggagc

SEQ ID NO: 3779649 - RNA, 15 nt, Salmonella typhimurium LT2
cgacgauagucagcg

SEQ ID NO: 3779650 - RNA, 17 nt, Salmonella typhimurium LT2
cgacgcaacucacgcca

SEQ ID NO: 3779651 - RNA, 15 nt, Salmonella typhimurium LT2
cgacgcacgagaucc

SEQ ID NO: 3779652 - RNA, 16 nt, Salmonella typhimurium LT2
cgacgccaaacccgcc

SEQ ID NO: 3779653 - RNA, 18 nt, Salmonella typhimurium LT2
cgacgccaaacccgccac

SEQ ID NO: 3779654 - RNA, 17 nt, Salmonella typhimurium LT2
cgacgccauuccccagc

SEQ ID NO: 3779655 - RNA, 20 nt, Salmonella typhimurium LT2
cgacgcccugcccaugaagc

SEQ ID NO: 3779656 - RNA, 13 nt, Salmonella typhimurium LT2
cgacgccuucuuc

SEQ ID NO: 3779657 - RNA, 16 nt, Salmonella typhimurium LT2
cgacgccuuucuucac

SEQ ID NO: 3779658 - RNA, 15 nt, Salmonella typhimurium LT2
cgacgcgauagcgca

SEQ ID NO: 3779659 - RNA, 23 nt, Salmonella typhimurium LT2
cgacgcggcuuuugcccgcgucg

SEQ ID NO: 3779660 - RNA, 19 nt, Salmonella typhimurium LT2
cgacgcguagguguuacgc

SEQ ID NO: 3779661 - RNA, 17 nt, Salmonella typhimurium LT2
cgacgcucuuccucaau

SEQ ID NO: 3779662 - RNA, 18 nt, Salmonella typhimurium LT2
cgacgcuuaccgcgucuu

SEQ ID NO: 3779663 - RNA, 16 nt, Salmonella typhimurium LT2
cgacgcuuaucagccc

SEQ ID NO: 3779664 - RNA, 23 nt, Salmonella typhimurium LT2
cgacgcuuugcuguacauaucca

SEQ ID NO: 3779665 - RNA, 13 nt, Salmonella typhimurium LT2
cgacggcaggcgg

SEQ ID NO: 3779666 - RNA, 18 nt, Salmonella typhimurium LT2
cgacggcaggggcgugau

SEQ ID NO: 3779667 - RNA, 15 nt, Salmonella typhimurium LT2
cgacggccaguugcu

SEQ ID NO: 3779668 - RNA, 21 nt, Salmonella typhimurium LT2
cgacggucuuuuucgacggca

SEQ ID NO: 3779669 - RNA, 20 nt, Salmonella typhimurium LT2
cgacggugaugacccgcagc

SEQ ID NO: 3779670 - RNA, 13 nt, Salmonella typhimurium LT2
cgacgucaauaaa

SEQ ID NO: 3779671 - RNA, 17 nt, Salmonella typhimurium LT2
cgacguccagcgcguga

SEQ ID NO: 3779672 - RNA, 13 nt, Salmonella typhimurium LT2
cgacgugacgcgc

SEQ ID NO: 3779673 - RNA, 22 nt, Salmonella typhimurium LT2
cgacgugacucagcggccauug

SEQ ID NO: 3779674 - RNA, 16 nt, Salmonella typhimurium LT2
cgacguuuucaauauc

SEQ ID NO: 3779675 - RNA, 19 nt, Salmonella typhimurium LT2
cgacuaucagaaaaaauua

SEQ ID NO: 3779676 - RNA, 17 nt, Salmonella typhimurium LT2
cgacuaucgccgcccca

SEQ ID NO: 3779677 - RNA, 14 nt, Salmonella typhimurium LT2
cgacucacgcgcgc

SEQ ID NO: 3779678 - RNA, 17 nt, Salmonella typhimurium LT2
cgacucauccagcaucg

SEQ ID NO: 3779679 - RNA, 13 nt, Salmonella typhimurium LT2
cgacuccagaaua

SEQ ID NO: 3779680 - RNA, 19 nt, Salmonella typhimurium LT2
cgacucccaggcgcgcagc

SEQ ID NO: 3779681 - RNA, 15 nt, Salmonella typhimurium LT2
cgacuccggauagag

SEQ ID NO: 3779682 - RNA, 13 nt, Salmonella typhimurium LT2
cgacucgagcgaa

SEQ ID NO: 3779683 - RNA, 17 nt, Salmonella typhimurium LT2
cgacucucccggcgccc

SEQ ID NO: 3779684 - RNA, 14 nt, Salmonella typhimurium LT2
cgacugaccagacc

SEQ ID NO: 3779685 - RNA, 15 nt, Salmonella typhimurium LT2
cgacugaccagaccg

SEQ ID NO: 3779686 - RNA, 13 nt, Salmonella typhimurium LT2
cgacugccaccac

SEQ ID NO: 3779687 - RNA, 14 nt, Salmonella typhimurium LT2
cgacugccaccacg

SEQ ID NO: 3779688 - RNA, 16 nt, Salmonella typhimurium LT2
cgacuggauacaggcg

SEQ ID NO: 3779689 - RNA, 16 nt, Salmonella typhimurium LT2
cgacugguaacggcga

SEQ ID NO: 3779690 - RNA, 21 nt, Salmonella typhimurium LT2
cgacugguaaugucauccagc

SEQ ID NO: 3779691 - RNA, 18 nt, Salmonella typhimurium LT2
cgacuuaaaagaaucccc

SEQ ID NO: 3779692 - RNA, 13 nt, Salmonella typhimurium LT2
cgacuuaucuucc

SEQ ID NO: 3779693 - RNA, 20 nt, Salmonella typhimurium LT2
cgacuucacgggucauuaag

SEQ ID NO: 3779694 - RNA, 21 nt, Salmonella typhimurium LT2
cgacuuucacgaaaccggcga

SEQ ID NO: 3779695 - RNA, 18 nt, Salmonella typhimurium LT2
cgacuuuucacuuauaaa

SEQ ID NO: 3779696 - RNA, 23 nt, Salmonella typhimurium LT2
cgacuuuuggcacgacuuuuccu

SEQ ID NO: 3779697 - RNA, 19 nt, Salmonella typhimurium LT2
cgacuuuuuccggcuguuu

SEQ ID NO: 3779698 - RNA, 20 nt, Salmonella typhimurium LT2
cgacuuuuuucaaauccagc

SEQ ID NO: 3779699 - RNA, 14 nt, Salmonella typhimurium LT2
cgagaaaaaacuca

SEQ ID NO: 3779700 - RNA, 14 nt, Salmonella typhimurium LT2
cgagaaacaccaga

SEQ ID NO: 3779701 - RNA, 21 nt, Salmonella typhimurium LT2
cgagaacguaaaagacgaagc

SEQ ID NO: 3779702 - RNA, 16 nt, Salmonella typhimurium LT2
cgagaagcccagcuca

SEQ ID NO: 3779703 - RNA, 20 nt, Salmonella typhimurium LT2
cgagaagcccggccacagcg

SEQ ID NO: 3779704 - RNA, 22 nt, Salmonella typhimurium LT2
cgagaccaccguuauuuccaaa

SEQ ID NO: 3779705 - RNA, 15 nt, Salmonella typhimurium LT2
cgagacggcggaaag

SEQ ID NO: 3779706 - RNA, 17 nt, Salmonella typhimurium LT2
cgagacucaaagaaaac

SEQ ID NO: 3779707 - RNA, 18 nt, Salmonella typhimurium LT2
cgauacuccauugucggc

SEQ ID NO: 3779708 - RNA, 13 nt, Salmonella typhimurium LT2
cgauacucugccc

SEQ ID NO: 3779709 - RNA, 15 nt, Salmonella typhimurium LT2
cgauacugacgagcg

SEQ ID NO: 3779710 - RNA, 19 nt, Salmonella typhimurium LT2
cgauagagaccgcuuuagc

SEQ ID NO: 3779711 - RNA, 19 nt, Salmonella typhimurium LT2
cgauagagaguuccuccug

SEQ ID NO: 3779712 - RNA, 14 nt, Salmonella typhimurium LT2
cgauagcauuuuua

SEQ ID NO: 3779713 - RNA, 20 nt, Salmonella typhimurium LT2
cgauagcauuuuuacucagc

SEQ ID NO: 3779714 - RNA, 23 nt, Salmonella typhimurium LT2
cgauagcccggcauguccaucag

SEQ ID NO: 3779715 - RNA, 18 nt, Salmonella typhimurium LT2
cgauagcgaccugcggac

SEQ ID NO: 3779716 - RNA, 15 nt, Salmonella typhimurium LT2
cgauagcgccccaaa

SEQ ID NO: 3779717 - RNA, 20 nt, Salmonella typhimurium LT2
cgauagcugaagugcggaua

SEQ ID NO: 3779718 - RNA, 18 nt, Salmonella typhimurium LT2
cgauaguccauuuuccua

SEQ ID NO: 3779719 - RNA, 20 nt, Salmonella typhimurium LT2
cgauaguguaaacgcgccau

SEQ ID NO: 3779720 - RNA, 15 nt, Salmonella typhimurium LT2
cgauauaagcgccgu

SEQ ID NO: 3779721 - RNA, 16 nt, Salmonella typhimurium LT2
cgauauaaugccugga

SEQ ID NO: 3779722 - RNA, 16 nt, Salmonella typhimurium LT2
cgauauaccaugccgc

SEQ ID NO: 3779723 - RNA, 22 nt, Salmonella typhimurium LT2
cgauauagagcccucuauccac

SEQ ID NO: 3779724 - RNA, 16 nt, Salmonella typhimurium LT2
cgauaucauucucuac

SEQ ID NO: 3779725 - RNA, 17 nt, Salmonella typhimurium LT2
cgauauccacaauguug

SEQ ID NO: 3779726 - RNA, 17 nt, Salmonella typhimurium LT2
cgauauccgugccgccg

SEQ ID NO: 3779727 - RNA, 16 nt, Salmonella typhimurium LT2
cgauaucgauaaucaa

SEQ ID NO: 3779728 - RNA, 23 nt, Salmonella typhimurium LT2
cgauaugaauaauuucggcggcg

SEQ ID NO: 3779729 - RNA, 21 nt, Salmonella typhimurium LT2
cgauauggaagaaaaaggagc

SEQ ID NO: 3779730 - RNA, 17 nt, Salmonella typhimurium LT2
cgauauguggacgccau

SEQ ID NO: 3779731 - RNA, 14 nt, Salmonella typhimurium LT2
cgauauuuuucuug

SEQ ID NO: 3779732 - RNA, 12 nt, Salmonella typhimurium LT2
cgaucaccacgc

SEQ ID NO: 3779733 - RNA, 15 nt, Salmonella typhimurium LT2
cgaucaccagcaccg

SEQ ID NO: 3779734 - RNA, 12 nt, Salmonella typhimurium LT2
cgaucaccagcg

SEQ ID NO: 3779735 - RNA, 18 nt, Salmonella typhimurium LT2
cgaucaccagcgcaucgc

SEQ ID NO: 3779736 - RNA, 20 nt, Salmonella typhimurium LT2
cgaucacggcgaaucgccug

SEQ ID NO: 3779737 - RNA, 19 nt, Salmonella typhimurium LT2
cgaucagcgcauugagguu

SEQ ID NO: 3779738 - RNA, 12 nt, Salmonella typhimurium LT2
cgaucagcgcca

SEQ ID NO: 3779739 - RNA, 13 nt, Salmonella typhimurium LT2
cgaucagcgccac

SEQ ID NO: 3779740 - RNA, 15 nt, Salmonella typhimurium LT2
cgaucagcgccacca

SEQ ID NO: 3779741 - RNA, 19 nt, Salmonella typhimurium LT2
cgaucagcgccaccacaaa

SEQ ID NO: 3779742 - RNA, 13 nt, Salmonella typhimurium LT2
cgaucaggcaggu

SEQ ID NO: 3779743 - RNA, 22 nt, Salmonella typhimurium LT2
cgaucaucaucccuagggugga

SEQ ID NO: 3779744 - RNA, 13 nt, Salmonella typhimurium LT2
cgaucaucauucc

SEQ ID NO: 3779745 - RNA, 22 nt, Salmonella typhimurium LT2
cgaucaugaaucgcgcgcgcca

SEQ ID NO: 3779746 - RNA, 15 nt, Salmonella typhimurium LT2
cgauccagccccagc

SEQ ID NO: 3779747 - RNA, 13 nt, Salmonella typhimurium LT2
cgauccaggucuu

SEQ ID NO: 3779748 - RNA, 23 nt, Salmonella typhimurium LT2
cgauccccucuuccaucagccag

SEQ ID NO: 3779749 - RNA, 16 nt, Salmonella typhimurium LT2
cgauccgaagaacaga

SEQ ID NO: 3779750 - RNA, 17 nt, Salmonella typhimurium LT2
cgauccggcgcgguauu

SEQ ID NO: 3779751 - RNA, 21 nt, Salmonella typhimurium LT2
cgauccguuccggauauuuau

SEQ ID NO: 3779752 - RNA, 22 nt, Salmonella typhimurium LT2
cgauccuucaaucgguacgcca

SEQ ID NO: 3779753 - RNA, 22 nt, Salmonella typhimurium LT2
cgauccuuuguaccuuuacccc

SEQ ID NO: 3779754 - RNA, 16 nt, Salmonella typhimurium LT2
cgaucgcuaaucagga

SEQ ID NO: 3779755 - RNA, 22 nt, Salmonella typhimurium LT2
cgaucgcuggacgucgucacca

SEQ ID NO: 3779756 - RNA, 22 nt, Salmonella typhimurium LT2
cgaucgcuuucgcuuucucuuc

SEQ ID NO: 3779757 - RNA, 20 nt, Salmonella typhimurium LT2
cgaucgguuuguuaugcgga

SEQ ID NO: 3779758 - RNA, 18 nt, Salmonella typhimurium LT2
cgaucguaaucacccgcu

SEQ ID NO: 3779759 - RNA, 18 nt, Salmonella typhimurium LT2
cgaucguagcaucucuuc

SEQ ID NO: 3779760 - RNA, 21 nt, Salmonella typhimurium LT2
cgaucgugauaaagcugacgc

SEQ ID NO: 3779761 - RNA, 17 nt, Salmonella typhimurium LT2
cgaucuacgguaucugc

SEQ ID NO: 3779762 - RNA, 18 nt, Salmonella typhimurium LT2
cgaucuauuucauaauaa

SEQ ID NO: 3779763 - RNA, 18 nt, Salmonella typhimurium LT2
cgaucucaagcgccgccg

SEQ ID NO: 3779764 - RNA, 21 nt, Salmonella typhimurium LT2
cgaucucaagcgccgccgcau

SEQ ID NO: 3779765 - RNA, 16 nt, Salmonella typhimurium LT2
cgaucuccaucuccag

SEQ ID NO: 3779766 - RNA, 14 nt, Salmonella typhimurium LT2
cgaucucccagccg

SEQ ID NO: 3779767 - RNA, 16 nt, Salmonella typhimurium LT2
cgaucucccagccggg

SEQ ID NO: 3779768 - RNA, 16 nt, Salmonella typhimurium LT2
cgaucuccgccgucgu

SEQ ID NO: 3779769 - RNA, 20 nt, Salmonella typhimurium LT2
cgaucucguuuuugucucuu

SEQ ID NO: 3779770 - RNA, 12 nt, Salmonella typhimurium LT2
cgaucugugucg

SEQ ID NO: 3779771 - RNA, 14 nt, Salmonella typhimurium LT2
cgaugaaaaagagg

SEQ ID NO: 3779772 - RNA, 19 nt, Salmonella typhimurium LT2
cgaugacgacuuuuugcug

SEQ ID NO: 3779773 - RNA, 17 nt, Salmonella typhimurium LT2
cgaugacgccugccaga

SEQ ID NO: 3779774 - RNA, 20 nt, Salmonella typhimurium LT2
cgaugacgcgcagaauucug

SEQ ID NO: 3779775 - RNA, 20 nt, Salmonella typhimurium LT2
cgaugacucauauuuaaacc

SEQ ID NO: 3779776 - RNA, 13 nt, Salmonella typhimurium LT2
cgaugagcgccag

SEQ ID NO: 3779777 - RNA, 20 nt, Salmonella typhimurium LT2
cgaugagcgcgaaaucaaag

SEQ ID NO: 3779778 - RNA, 13 nt, Salmonella typhimurium LT2
cgaugagcgugac

SEQ ID NO: 3779779 - RNA, 17 nt, Salmonella typhimurium LT2
cgaugagcguggcguag

SEQ ID NO: 3779780 - RNA, 15 nt, Salmonella typhimurium LT2
cgaugauagugucca

SEQ ID NO: 3779781 - RNA, 19 nt, Salmonella typhimurium LT2
cgaugaucgucgcgaucgc

SEQ ID NO: 3779782 - RNA, 14 nt, Salmonella typhimurium LT2
cgaugaugauuaau

SEQ ID NO: 3779783 - RNA, 23 nt, Salmonella typhimurium LT2
cgaugaugauuaaugcugcacca

SEQ ID NO: 3779784 - RNA, 23 nt, Salmonella typhimurium LT2
cgaugcacaacacgcuuuucagc

SEQ ID NO: 3779785 - RNA, 12 nt, Salmonella typhimurium LT2
cgaugcacgcca

SEQ ID NO: 3779786 - RNA, 14 nt, Salmonella typhimurium LT2
cgaugcccggcaau

SEQ ID NO: 3779787 - RNA, 19 nt, Salmonella typhimurium LT2
cgaugcccgguaagcgcaa

SEQ ID NO: 3779788 - RNA, 21 nt, Salmonella typhimurium LT2
cgaugcggaaauagcggugcc

SEQ ID NO: 3779789 - RNA, 14 nt, Salmonella typhimurium LT2
cgaugcggauccgg

SEQ ID NO: 3779790 - RNA, 17 nt, Salmonella typhimurium LT2
cgaugcgguucaacgcg

SEQ ID NO: 3779791 - RNA, 15 nt, Salmonella typhimurium LT2
cgaugcguucaaaaa

SEQ ID NO: 3779792 - RNA, 18 nt, Salmonella typhimurium LT2
cgaugcucagggcauccg

SEQ ID NO: 3779793 - RNA, 22 nt, Salmonella typhimurium LT2
cgaugcucagggcauccgccgc

SEQ ID NO: 3779794 - RNA, 18 nt, Salmonella typhimurium LT2
cgaugcugcuucaguaaa

SEQ ID NO: 3779795 - RNA, 23 nt, Salmonella typhimurium LT2
cgaugcuggugaagacgcugcaa

SEQ ID NO: 3779796 - RNA, 22 nt, Salmonella typhimurium LT2
cgauggaaagaacacaggcagc

SEQ ID NO: 3779797 - RNA, 18 nt, Salmonella typhimurium LT2
cgauggagucgccgguug

SEQ ID NO: 3779798 - RNA, 14 nt, Salmonella typhimurium LT2
cgauggagugcaau

SEQ ID NO: 3779799 - RNA, 14 nt, Salmonella typhimurium LT2
cgauggcaaauaau

SEQ ID NO: 3779800 - RNA, 16 nt, Salmonella typhimurium LT2
cgauggcaaauaauac

SEQ ID NO: 3779801 - RNA, 21 nt, Salmonella typhimurium LT2
cgauggccgacauugaccagu

SEQ ID NO: 3779802 - RNA, 23 nt, Salmonella typhimurium LT2
cgaugguaugcgaagguggcgga

SEQ ID NO: 3779803 - RNA, 17 nt, Salmonella typhimurium LT2
cgaugucguccugcgcg

SEQ ID NO: 3779804 - RNA, 21 nt, Salmonella typhimurium LT2
cgaugucguccugcgcgacgc

SEQ ID NO: 3779805 - RNA, 15 nt, Salmonella typhimurium LT2
cgauguuaaagguca

SEQ ID NO: 3779806 - RNA, 20 nt, Salmonella typhimurium LT2
cgauguucggguaaacgcug

SEQ ID NO: 3779807 - RNA, 21 nt, Salmonella typhimurium LT2
cgauuaaugcuccaauaaaua

SEQ ID NO: 3779808 - RNA, 22 nt, Salmonella typhimurium LT2
cgauuaaugcuccaauaaauau

SEQ ID NO: 3779809 - RNA, 16 nt, Salmonella typhimurium LT2
cgauucaaucugguga

SEQ ID NO: 3779810 - RNA, 17 nt, Salmonella typhimurium LT2
cgauuccgugucugaau

SEQ ID NO: 3779811 - RNA, 23 nt, Salmonella typhimurium LT2
cgcagaucguauccggcggcaaa

SEQ ID NO: 3779812 - RNA, 15 nt, Salmonella typhimurium LT2
cgcagcaagaacaga

SEQ ID NO: 3779813 - RNA, 24 nt, Salmonella typhimurium LT2
cgcagcaauucugcuggcugaucg

SEQ ID NO: 3779814 - RNA, 17 nt, Salmonella typhimurium LT2
cgcagcacaugcaauuu

SEQ ID NO: 3779815 - RNA, 18 nt, Salmonella typhimurium LT2
cgcagcaggccaucauug

SEQ ID NO: 3779816 - RNA, 15 nt, Salmonella typhimurium LT2
cgcagcauaucgccg

SEQ ID NO: 3779817 - RNA, 17 nt, Salmonella typhimurium LT2
cgcagcauaucgccguu

SEQ ID NO: 3779818 - RNA, 22 nt, Salmonella typhimurium LT2
cgcagcaucauaaaucgacauc

SEQ ID NO: 3779819 - RNA, 23 nt, Salmonella typhimurium LT2
cgcagccacggcgcacacgccca

SEQ ID NO: 3779820 - RNA, 14 nt, Salmonella typhimurium LT2
cgcagccagcgccc

SEQ ID NO: 3779821 - RNA, 22 nt, Salmonella typhimurium LT2
cgcagccaguacgcguucuacg

SEQ ID NO: 3779822 - RNA, 13 nt, Salmonella typhimurium LT2
cgcagccccagcg

SEQ ID NO: 3779823 - RNA, 17 nt, Salmonella typhimurium LT2
cgcagccgcaaucagcg

SEQ ID NO: 3779824 - RNA, 18 nt, Salmonella typhimurium LT2
cgcagccggucagcguca

SEQ ID NO: 3779825 - RNA, 17 nt, Salmonella typhimurium LT2
cgcagccugauggcgac

SEQ ID NO: 3779826 - RNA, 19 nt, Salmonella typhimurium LT2
cgcagcgacuucaggcgcu

SEQ ID NO: 3779827 - RNA, 20 nt, Salmonella typhimurium LT2
cgcagcgacuucaggcgcua

SEQ ID NO: 3779828 - RNA, 15 nt, Salmonella typhimurium LT2
cgcagcgauauuucu

SEQ ID NO: 3779829 - RNA, 15 nt, Salmonella typhimurium LT2
cgcagcgcaacgccu

SEQ ID NO: 3779830 - RNA, 18 nt, Salmonella typhimurium LT2
cgcagcgccaucaggccc

SEQ ID NO: 3779831 - RNA, 19 nt, Salmonella typhimurium LT2
cgcagcgccaucaggccua

SEQ ID NO: 3779832 - RNA, 14 nt, Salmonella typhimurium LT2
cgcagcgccauccg

SEQ ID NO: 3779833 - RNA, 19 nt, Salmonella typhimurium LT2
cgcagcgccauccggcaaa

SEQ ID NO: 3779834 - RNA, 11 nt, Salmonella typhimurium LT2
cgcagcgccga

SEQ ID NO: 3779835 - RNA, 22 nt, Salmonella typhimurium LT2
cgcagcgccuuauccaguacaa

SEQ ID NO: 3779836 - RNA, 13 nt, Salmonella typhimurium LT2
cgcagcgcggcgc

SEQ ID NO: 3779837 - RNA, 23 nt, Salmonella typhimurium LT2
cgcagcgcuuugccgcugcugcc

SEQ ID NO: 3779838 - RNA, 19 nt, Salmonella typhimurium LT2
cgcagcggcauuggcguua

SEQ ID NO: 3779839 - RNA, 23 nt, Salmonella typhimurium LT2
cgcagcguucgaaugcuuccggc

SEQ ID NO: 3779840 - RNA, 16 nt, Salmonella typhimurium LT2
cgcagcuccagcucag

SEQ ID NO: 3779841 - RNA, 23 nt, Salmonella typhimurium LT2
cgcagcucugugugacguugccg

SEQ ID NO: 3779842 - RNA, 19 nt, Salmonella typhimurium LT2
cgcagcugccacaccacau

SEQ ID NO: 3779843 - RNA, 16 nt, Salmonella typhimurium LT2
cgcagcuucaucauuc

SEQ ID NO: 3779844 - RNA, 19 nt, Salmonella typhimurium LT2
cgcaggacggcccguaaua

SEQ ID NO: 3779845 - RNA, 21 nt, Salmonella typhimurium LT2
cgcaggauaaagaccggcaca

SEQ ID NO: 3779846 - RNA, 22 nt, Salmonella typhimurium LT2
cgcaggauaaagaccggcacaa

SEQ ID NO: 3779847 - RNA, 17 nt, Salmonella typhimurium LT2
cgcaggcaacgccguga

SEQ ID NO: 3779848 - RNA, 14 nt, Salmonella typhimurium LT2
cgcaggcauccggu

SEQ ID NO: 3779849 - RNA, 15 nt, Salmonella typhimurium LT2
cgcaggcauccgguu

SEQ ID NO: 3779850 - RNA, 14 nt, Salmonella typhimurium LT2
cgcaggccaggcgu

SEQ ID NO: 3779851 - RNA, 19 nt, Salmonella typhimurium LT2
cgcaggcccgauaagcgcc

SEQ ID NO: 3779852 - RNA, 17 nt, Salmonella typhimurium LT2
cgcaggcccggcaggca

SEQ ID NO: 3779853 - RNA, 18 nt, Salmonella typhimurium LT2
cgcaggccggauaagcga

SEQ ID NO: 3779854 - RNA, 16 nt, Salmonella typhimurium LT2
cgcaggccguuggcuu

SEQ ID NO: 3779855 - RNA, 13 nt, Salmonella typhimurium LT2
cgcaggcgauagc

SEQ ID NO: 3779856 - RNA, 12 nt, Salmonella typhimurium LT2
cgcaggcggcca

SEQ ID NO: 3779857 - RNA, 16 nt, Salmonella typhimurium LT2
cgcaggcggucagcac

SEQ ID NO: 3779858 - RNA, 15 nt, Salmonella typhimurium LT2
cgcaggcuugcccau

SEQ ID NO: 3779859 - RNA, 12 nt, Salmonella typhimurium LT2
cgcagggcugcu

SEQ ID NO: 3779860 - RNA, 20 nt, Salmonella typhimurium LT2
cgcaggguuucgauauccag

SEQ ID NO: 3779861 - RNA, 15 nt, Salmonella typhimurium LT2
cgcagguaaaaucca

SEQ ID NO: 3779862 - RNA, 13 nt, Salmonella typhimurium LT2
cgcaggucgccag

SEQ ID NO: 3779863 - RNA, 14 nt, Salmonella typhimurium LT2
cgcaggucgccaga

SEQ ID NO: 3779864 - RNA, 18 nt, Salmonella typhimurium LT2
cgcaguaauacgccgccg

SEQ ID NO: 3779865 - RNA, 22 nt, Salmonella typhimurium LT2
cgcaguaaucaccgucuccggc

SEQ ID NO: 3779866 - RNA, 20 nt, Salmonella typhimurium LT2
cgcaguaauuucuugcgcca

SEQ ID NO: 3779867 - RNA, 14 nt, Salmonella typhimurium LT2
cgcaguacggcgca

SEQ ID NO: 3779868 - RNA, 22 nt, Salmonella typhimurium LT2
cgcagucagccuugaccgccug

SEQ ID NO: 3779869 - RNA, 22 nt, Salmonella typhimurium LT2
cgcaguccagaugcgccagauu

SEQ ID NO: 3779870 - RNA, 19 nt, Salmonella typhimurium LT2
cgcagugaagaauggcgcc

SEQ ID NO: 3779871 - RNA, 14 nt, Salmonella typhimurium LT2
cgcaguucaauauu

SEQ ID NO: 3779872 - RNA, 16 nt, Salmonella typhimurium LT2
cgcaguucaauauuca

SEQ ID NO: 3779873 - RNA, 17 nt, Salmonella typhimurium LT2
cgcaguucgccaccagg

SEQ ID NO: 3779874 - RNA, 17 nt, Salmonella typhimurium LT2
cgcaguugggcgcgcga

SEQ ID NO: 3779875 - RNA, 19 nt, Salmonella typhimurium LT2
cgcaguugggcgcgcgacu

SEQ ID NO: 3779876 - RNA, 17 nt, Salmonella typhimurium LT2
cgcaguuuguggcgugu

SEQ ID NO: 3779877 - RNA, 18 nt, Salmonella typhimurium LT2
cgcauaauagcgccagaa

SEQ ID NO: 3779878 - RNA, 16 nt, Salmonella typhimurium LT2
cgcauaauccagcagg

SEQ ID NO: 3779879 - RNA, 21 nt, Salmonella typhimurium LT2
cgcauaaugacguccaggccg

SEQ ID NO: 3779880 - RNA, 17 nt, Salmonella typhimurium LT2
cgcauaccuucaugcau

SEQ ID NO: 3779881 - RNA, 13 nt, Salmonella typhimurium LT2
cgcauacgcagca

SEQ ID NO: 3779882 - RNA, 15 nt, Salmonella typhimurium LT2
cgcauauuccggcga

SEQ ID NO: 3779883 - RNA, 23 nt, Salmonella typhimurium LT2
cgcauauuuuuuaccgcccgcuu

SEQ ID NO: 3779884 - RNA, 19 nt, Salmonella typhimurium LT2
cgcaucaacgccaggcaga

SEQ ID NO: 3779885 - RNA, 17 nt, Salmonella typhimurium LT2
cgcaucaaugcccagcg

SEQ ID NO: 3779886 - RNA, 12 nt, Salmonella typhimurium LT2
cgcaucaauguc

SEQ ID NO: 3779887 - RNA, 16 nt, Salmonella typhimurium LT2
cgcaucacggcagcac

SEQ ID NO: 3779888 - RNA, 16 nt, Salmonella typhimurium LT2
cgcaucacuggcguau

SEQ ID NO: 3779889 - RNA, 22 nt, Salmonella typhimurium LT2
cgcaucaggaucuucaucccau

SEQ ID NO: 3779890 - RNA, 22 nt, Salmonella typhimurium LT2
cgcaucagggcgacgucagacg

SEQ ID NO: 3779891 - RNA, 19 nt, Salmonella typhimurium LT2
cgcauccacguaaauagag

SEQ ID NO: 3779892 - RNA, 14 nt, Salmonella typhimurium LT2
cgcauccagggagu

SEQ ID NO: 3779893 - RNA, 16 nt, Salmonella typhimurium LT2
cgcauccaguuguuua

SEQ ID NO: 3779894 - RNA, 18 nt, Salmonella typhimurium LT2
cgcauccggccagcgaca

SEQ ID NO: 3779895 - RNA, 23 nt, Salmonella typhimurium LT2
cgcauccggcuacgggcgguuaa

SEQ ID NO: 3779896 - RNA, 16 nt, Salmonella typhimurium LT2
cgcauccgguaaacgc

SEQ ID NO: 3779897 - RNA, 18 nt, Salmonella typhimurium LT2
cgcauccucuuuccguua

SEQ ID NO: 3779898 - RNA, 17 nt, Salmonella typhimurium LT2
cgcauccuguaccacca

SEQ ID NO: 3779899 - RNA, 14 nt, Salmonella typhimurium LT2
cgcaucgcccgccc

SEQ ID NO: 3779900 - RNA, 20 nt, Salmonella typhimurium LT2
cgcaucugacaucagaaaau

SEQ ID NO: 3779901 - RNA, 14 nt, Salmonella typhimurium LT2
cgcaucuuuuuccc

SEQ ID NO: 3779902 - RNA, 23 nt, Salmonella typhimurium LT2
cgcaugaaacgccagaucguuaa

SEQ ID NO: 3779903 - RNA, 22 nt, Salmonella typhimurium LT2
cgcauggaagaaaauauaaucu

SEQ ID NO: 3779904 - RNA, 18 nt, Salmonella typhimurium LT2
cgcauggacgucgacgcc

SEQ ID NO: 3779905 - RNA, 15 nt, Salmonella typhimurium LT2
cgcauggcagggcga

SEQ ID NO: 3779906 - RNA, 14 nt, Salmonella typhimurium LT2
cgcaugguaaacgc

SEQ ID NO: 3779907 - RNA, 18 nt, Salmonella typhimurium LT2
cgcaugucguauccccag

SEQ ID NO: 3779908 - RNA, 14 nt, Salmonella typhimurium LT2
cgcauguuccgcua

SEQ ID NO: 3779909 - RNA, 15 nt, Salmonella typhimurium LT2
cgcauuaaaaugaug

SEQ ID NO: 3779910 - RNA, 16 nt, Salmonella typhimurium LT2
cgcauuccccaccaca

SEQ ID NO: 3779911 - RNA, 17 nt, Salmonella typhimurium LT2
cgcauucucgccgugac

SEQ ID NO: 3779912 - RNA, 20 nt, Salmonella typhimurium LT2
cgcauucuucagcgcguccu

SEQ ID NO: 3779913 - RNA, 17 nt, Salmonella typhimurium LT2
cgcauugcgucccagca

SEQ ID NO: 3779914 - RNA, 23 nt, Salmonella typhimurium LT2
cgcauugucauaauauucauauc

SEQ ID NO: 3779915 - RNA, 22 nt, Salmonella typhimurium LT2
cgccagcauaugcacacgaagc

SEQ ID NO: 3779916 - RNA, 13 nt, Salmonella typhimurium LT2
cgccagcauggcg

SEQ ID NO: 3779917 - RNA, 14 nt, Salmonella typhimurium LT2
cgccagcauuucaa

SEQ ID NO: 3779918 - RNA, 21 nt, Salmonella typhimurium LT2
cgccagccacaagagcagcaa

SEQ ID NO: 3779919 - RNA, 23 nt, Salmonella typhimurium LT2
cgccagccagccaguuagcgacc

SEQ ID NO: 3779920 - RNA, 19 nt, Salmonella typhimurium LT2
cgccagccagcucaccagc

SEQ ID NO: 3779921 - RNA, 14 nt, Salmonella typhimurium LT2
cgccagccaguccg

SEQ ID NO: 3779922 - RNA, 15 nt, Salmonella typhimurium LT2
cgccagccaguccgu

SEQ ID NO: 3779923 - RNA, 23 nt, Salmonella typhimurium LT2
cgccagcccugcgaucaucauuc

SEQ ID NO: 3779924 - RNA, 18 nt, Salmonella typhimurium LT2
cgccagccgaucaucgua

SEQ ID NO: 3779925 - RNA, 23 nt, Salmonella typhimurium LT2
cgccagccugacgaccauugcca

SEQ ID NO: 3779926 - RNA, 21 nt, Salmonella typhimurium LT2
cgccagcgcgcguacccugcg

SEQ ID NO: 3779927 - RNA, 22 nt, Salmonella typhimurium LT2
cgccagcggauugccauacacg

SEQ ID NO: 3779928 - RNA, 17 nt, Salmonella typhimurium LT2
cgccagcggcagcgcgg

SEQ ID NO: 3779929 - RNA, 17 nt, Salmonella typhimurium LT2
cgccagcggccagcgua

SEQ ID NO: 3779930 - RNA, 22 nt, Salmonella typhimurium LT2
cgccagcggccagcguaccugc

SEQ ID NO: 3779931 - RNA, 13 nt, Salmonella typhimurium LT2
cgccagcggcgcc

SEQ ID NO: 3779932 - RNA, 17 nt, Salmonella typhimurium LT2
cgccagcgggccgguaa

SEQ ID NO: 3779933 - RNA, 18 nt, Salmonella typhimurium LT2
cgccagcgguguuugcca

SEQ ID NO: 3779934 - RNA, 22 nt, Salmonella typhimurium LT2
cgccagcgguguuugccagacg

SEQ ID NO: 3779935 - RNA, 23 nt, Salmonella typhimurium LT2
cgccagcgucuguuucaacacau

SEQ ID NO: 3779936 - RNA, 18 nt, Salmonella typhimurium LT2
cgccagcgugcuuaaucc

SEQ ID NO: 3779937 - RNA, 13 nt, Salmonella typhimurium LT2
cgccagcucaugc

SEQ ID NO: 3779938 - RNA, 23 nt, Salmonella typhimurium LT2
cgccagcuccauagaaaucagca

SEQ ID NO: 3779939 - RNA, 16 nt, Salmonella typhimurium LT2
cgccagcugcgcgcua

SEQ ID NO: 3779940 - RNA, 19 nt, Salmonella typhimurium LT2
cgccagcuuaucgaccagc

SEQ ID NO: 3779941 - RNA, 18 nt, Salmonella typhimurium LT2
cgccaggauugccugaug

SEQ ID NO: 3779942 - RNA, 18 nt, Salmonella typhimurium LT2
cgccaggcacgccggcaa

SEQ ID NO: 3779943 - RNA, 11 nt, Salmonella typhimurium LT2
cgccaggccaa

SEQ ID NO: 3779944 - RNA, 19 nt, Salmonella typhimurium LT2
cgccaggccaucgccgcca

SEQ ID NO: 3779945 - RNA, 16 nt, Salmonella typhimurium LT2
cgccaggcgcagcaaa

SEQ ID NO: 3779946 - RNA, 14 nt, Salmonella typhimurium LT2
cgccaggcggccug

SEQ ID NO: 3779947 - RNA, 22 nt, Salmonella typhimurium LT2
cgccagggcgggauccccugcu

SEQ ID NO: 3779948 - RNA, 17 nt, Salmonella typhimurium LT2
cgccaggguaucaucaa

SEQ ID NO: 3779949 - RNA, 19 nt, Salmonella typhimurium LT2
cgccagguacuuacgcagc

SEQ ID NO: 3779950 - RNA, 23 nt, Salmonella typhimurium LT2
cgccaggucggcuuuuuuaugcc

SEQ ID NO: 3779951 - RNA, 22 nt, Salmonella typhimurium LT2
cgccaggucucauagcgcccca

SEQ ID NO: 3779952 - RNA, 14 nt, Salmonella typhimurium LT2
cgccagguuaucca

SEQ ID NO: 3779953 - RNA, 19 nt, Salmonella typhimurium LT2
cgccagguuuuacgugccg

SEQ ID NO: 3779954 - RNA, 19 nt, Salmonella typhimurium LT2
cgccaguaaugccgugccg

SEQ ID NO: 3779955 - RNA, 23 nt, Salmonella typhimurium LT2
cgccaguaauuuuucucccagca

SEQ ID NO: 3779956 - RNA, 17 nt, Salmonella typhimurium LT2
cgccagucaccagcagc

SEQ ID NO: 3779957 - RNA, 18 nt, Salmonella typhimurium LT2
cgccagugaauccaccac

SEQ ID NO: 3779958 - RNA, 11 nt, Salmonella typhimurium LT2
cgccagugaca

SEQ ID NO: 3779959 - RNA, 21 nt, Salmonella typhimurium LT2
cgccagugcauagcagcgccc

SEQ ID NO: 3779960 - RNA, 22 nt, Salmonella typhimurium LT2
cgccagugcuuuuaacgcuucc

SEQ ID NO: 3779961 - RNA, 17 nt, Salmonella typhimurium LT2
cgccaguucaauaucca

SEQ ID NO: 3779962 - RNA, 14 nt, Salmonella typhimurium LT2
cgccaguucagcgu

SEQ ID NO: 3779963 - RNA, 16 nt, Salmonella typhimurium LT2
cgccaguucagcgucu

SEQ ID NO: 3779964 - RNA, 18 nt, Salmonella typhimurium LT2
cgccaguucauccagcag

SEQ ID NO: 3779965 - RNA, 17 nt, Salmonella typhimurium LT2
cgccaguucauucgcca

SEQ ID NO: 3779966 - RNA, 21 nt, Salmonella typhimurium LT2
cgccaguucauucgccaccag

SEQ ID NO: 3779967 - RNA, 17 nt, Salmonella typhimurium LT2
cgccaguuccaucauug

SEQ ID NO: 3779968 - RNA, 14 nt, Salmonella typhimurium LT2
cgccaguuccgcca

SEQ ID NO: 3779969 - RNA, 18 nt, Salmonella typhimurium LT2
cgccaguuccgccacggc

SEQ ID NO: 3779970 - RNA, 19 nt, Salmonella typhimurium LT2
cgccaguuccgccacggcg

SEQ ID NO: 3779971 - RNA, 20 nt, Salmonella typhimurium LT2
cgccaguugggcagaaacgu

SEQ ID NO: 3779972 - RNA, 15 nt, Salmonella typhimurium LT2
cgccauaaagcugua

SEQ ID NO: 3779973 - RNA, 21 nt, Salmonella typhimurium LT2
cgccauaaaucagauccacgc

SEQ ID NO: 3779974 - RNA, 20 nt, Salmonella typhimurium LT2
cgccauaagcgaacaggccg

SEQ ID NO: 3779975 - RNA, 21 nt, Salmonella typhimurium LT2
cgccauaagcgaacaggccga

SEQ ID NO: 3779976 - RNA, 17 nt, Salmonella typhimurium LT2
cgccauaauccacaacg

SEQ ID NO: 3779977 - RNA, 23 nt, Salmonella typhimurium LT2
cgccauaaugcuuaauucauaac

SEQ ID NO: 3779978 - RNA, 13 nt, Salmonella typhimurium LT2
cgccauacccggc

SEQ ID NO: 3779979 - RNA, 16 nt, Salmonella typhimurium LT2
cgccauacuuacugcu

SEQ ID NO: 3779980 - RNA, 15 nt, Salmonella typhimurium LT2
cgccauagccggcga

SEQ ID NO: 3779981 - RNA, 19 nt, Salmonella typhimurium LT2
cgccauagccggcgauagc

SEQ ID NO: 3779982 - RNA, 16 nt, Salmonella typhimurium LT2
cgccauauacgccacg

SEQ ID NO: 3779983 - RNA, 20 nt, Salmonella typhimurium LT2
cgccauauaggcauguuccu

SEQ ID NO: 3779984 - RNA, 15 nt, Salmonella typhimurium LT2
cgccauauccaagcc

SEQ ID NO: 3779985 - RNA, 17 nt, Salmonella typhimurium LT2
cgccauauccccgccau

SEQ ID NO: 3779986 - RNA, 15 nt, Salmonella typhimurium LT2
cgccauauccgcaga

SEQ ID NO: 3779987 - RNA, 22 nt, Salmonella typhimurium LT2
cgccauauccgcagacuuuagc

SEQ ID NO: 3779988 - RNA, 13 nt, Salmonella typhimurium LT2
cgccauaucggca

SEQ ID NO: 3779989 - RNA, 18 nt, Salmonella typhimurium LT2
cgccaucaacagcaggca

SEQ ID NO: 3779990 - RNA, 18 nt, Salmonella typhimurium LT2
cgccaucaacagcggaga

SEQ ID NO: 3779991 - RNA, 18 nt, Salmonella typhimurium LT2
cgccaucaacuccuccgg

SEQ ID NO: 3779992 - RNA, 23 nt, Salmonella typhimurium LT2
cgccaucaauuuugcgccuaccg

SEQ ID NO: 3779993 - RNA, 12 nt, Salmonella typhimurium LT2
cgccaucaccag

SEQ ID NO: 3779994 - RNA, 14 nt, Salmonella typhimurium LT2
cgccaucagcauca

SEQ ID NO: 3779995 - RNA, 16 nt, Salmonella typhimurium LT2
cgccaucagccgcgcu

SEQ ID NO: 3779996 - RNA, 14 nt, Salmonella typhimurium LT2
cgccaucagcgcga

SEQ ID NO: 3779997 - RNA, 12 nt, Salmonella typhimurium LT2
cgccaucaggca

SEQ ID NO: 3779998 - RNA, 22 nt, Salmonella typhimurium LT2
cgccaucaggcaauucggcccu

SEQ ID NO: 3779999 - RNA, 17 nt, Salmonella typhimurium LT2
cgccaucaggcauaaac

SEQ ID NO: 3780000 - RNA, 14 nt, Salmonella typhimurium LT2
cgccaucaggcaug

SEQ ID NO: 3780001 - RNA, 15 nt, Salmonella typhimurium LT2
cgccaucaggcaugc

SEQ ID NO: 3780002 - RNA, 20 nt, Salmonella typhimurium LT2
cgccaucaggcaugccaaac

SEQ ID NO: 3780003 - RNA, 21 nt, Salmonella typhimurium LT2
cgccaucaggcaugccaaacc

SEQ ID NO: 3780004 - RNA, 12 nt, Salmonella typhimurium LT2
cgccaucaggcc

SEQ ID NO: 3780005 - RNA, 15 nt, Salmonella typhimurium LT2
cgccaucaggccuac

SEQ ID NO: 3780006 - RNA, 13 nt, Salmonella typhimurium LT2
cgccaucaggcga

SEQ ID NO: 3780007 - RNA, 18 nt, Salmonella typhimurium LT2
cgccaucaggcuggguaa

SEQ ID NO: 3780008 - RNA, 13 nt, Salmonella typhimurium LT2
cgccauccaccag

SEQ ID NO: 3780009 - RNA, 14 nt, Salmonella typhimurium LT2
cgccauccaccagg

SEQ ID NO: 3780010 - RNA, 12 nt, Salmonella typhimurium LT2
cgccauccacgg

SEQ ID NO: 3780011 - RNA, 11 nt, Salmonella typhimurium LT2
cgccauccggc

SEQ ID NO: 3780012 - RNA, 14 nt, Salmonella typhimurium LT2
cgccauccggcaac

SEQ ID NO: 3780013 - RNA, 21 nt, Salmonella typhimurium LT2
cgccauccggcaauuuauacc

SEQ ID NO: 3780014 - RNA, 14 nt, Salmonella typhimurium LT2
cgccauccggcaca

SEQ ID NO: 3780015 - RNA, 14 nt, Salmonella typhimurium LT2
cgccauccggcagu

SEQ ID NO: 3780016 - RNA, 17 nt, Salmonella typhimurium LT2
cgccauccggcauuuuu

SEQ ID NO: 3780017 - RNA, 13 nt, Salmonella typhimurium LT2
cgccauccggccu

SEQ ID NO: 3780018 - RNA, 14 nt, Salmonella typhimurium LT2
cgccauccggccug

SEQ ID NO: 3780019 - RNA, 21 nt, Salmonella typhimurium LT2
cgccgaaaauauacaccugac

SEQ ID NO: 3780020 - RNA, 22 nt, Salmonella typhimurium LT2
cgccgaacgauugacccgccgc

SEQ ID NO: 3780021 - RNA, 15 nt, Salmonella typhimurium LT2
cgccgaagcaggcgg

SEQ ID NO: 3780022 - RNA, 18 nt, Salmonella typhimurium LT2
cgccgacaaauccuccgg

SEQ ID NO: 3780023 - RNA, 22 nt, Salmonella typhimurium LT2
cgccgacaaauccuccggcgcg

SEQ ID NO: 3780024 - RNA, 17 nt, Salmonella typhimurium LT2
cgccgacaucgccaccg

SEQ ID NO: 3780025 - RNA, 17 nt, Salmonella typhimurium LT2
cgccgacauucccugcg

SEQ ID NO: 3780026 - RNA, 13 nt, Salmonella typhimurium LT2
cgccgaccaccag

SEQ ID NO: 3780027 - RNA, 14 nt, Salmonella typhimurium LT2
cgccgaccaccagc

SEQ ID NO: 3780028 - RNA, 21 nt, Salmonella typhimurium LT2
cgccgaccacuucaacgccgc

SEQ ID NO: 3780029 - RNA, 16 nt, Salmonella typhimurium LT2
cgccgaccccggcggg

SEQ ID NO: 3780030 - RNA, 16 nt, Salmonella typhimurium LT2
cgccgacgacaggcag

SEQ ID NO: 3780031 - RNA, 14 nt, Salmonella typhimurium LT2
cgccgacucacgca

SEQ ID NO: 3780032 - RNA, 16 nt, Salmonella typhimurium LT2
cgccgacucacgcagc

SEQ ID NO: 3780033 - RNA, 17 nt, Salmonella typhimurium LT2
cgccgacucacgcagcg

SEQ ID NO: 3780034 - RNA, 22 nt, Salmonella typhimurium LT2
cgccgacugccaccgucgcggc

SEQ ID NO: 3780035 - RNA, 16 nt, Salmonella typhimurium LT2
cgccgaguaauuugaa

SEQ ID NO: 3780036 - RNA, 21 nt, Salmonella typhimurium LT2
cgccgauaaccagcgcgccgc

SEQ ID NO: 3780037 - RNA, 21 nt, Salmonella typhimurium LT2
cgccgaucagcaccacgcccg

SEQ ID NO: 3780038 - RNA, 19 nt, Salmonella typhimurium LT2
cgccgaugcacaacacgcu

SEQ ID NO: 3780039 - RNA, 20 nt, Salmonella typhimurium LT2
cgccgcaaacuccaccacgu

SEQ ID NO: 3780040 - RNA, 16 nt, Salmonella typhimurium LT2
cgccgcaaccaaagcc

SEQ ID NO: 3780041 - RNA, 23 nt, Salmonella typhimurium LT2
cgccgcaaccaaagccggcgcca

SEQ ID NO: 3780042 - RNA, 15 nt, Salmonella typhimurium LT2
cgccgcaagcggcgu

SEQ ID NO: 3780043 - RNA, 17 nt, Salmonella typhimurium LT2
cgccgcacacagcggaa

SEQ ID NO: 3780044 - RNA, 14 nt, Salmonella typhimurium LT2
cgccgcacacgccg

SEQ ID NO: 3780045 - RNA, 23 nt, Salmonella typhimurium LT2
cgccgcacacguauaaacgccgc

SEQ ID NO: 3780046 - RNA, 15 nt, Salmonella typhimurium LT2
cgccgcaccacugcu

SEQ ID NO: 3780047 - RNA, 12 nt, Salmonella typhimurium LT2
cgccgcacuuca

SEQ ID NO: 3780048 - RNA, 16 nt, Salmonella typhimurium LT2
cgccgcagcuccaugu

SEQ ID NO: 3780049 - RNA, 18 nt, Salmonella typhimurium LT2
cgccgcaggacagcgaca

SEQ ID NO: 3780050 - RNA, 13 nt, Salmonella typhimurium LT2
cgccgcagggcgc

SEQ ID NO: 3780051 - RNA, 22 nt, Salmonella typhimurium LT2
cgccgcauccuguaccaccacg

SEQ ID NO: 3780052 - RNA, 13 nt, Salmonella typhimurium LT2
cgccgcaucgcgg

SEQ ID NO: 3780053 - RNA, 17 nt, Salmonella typhimurium LT2
cgccgcauugguaaauc

SEQ ID NO: 3780054 - RNA, 21 nt, Salmonella typhimurium LT2
cgccgccaaacugcgcgccgc

SEQ ID NO: 3780055 - RNA, 13 nt, Salmonella typhimurium LT2
cgccgccaccaug

SEQ ID NO: 3780056 - RNA, 13 nt, Salmonella typhimurium LT2
cgccgccagccga

SEQ ID NO: 3780057 - RNA, 14 nt, Salmonella typhimurium LT2
cgccgccagcgucu

SEQ ID NO: 3780058 - RNA, 13 nt, Salmonella typhimurium LT2
cgccgccagcuca

SEQ ID NO: 3780059 - RNA, 20 nt, Salmonella typhimurium LT2
cgccgccaggauaauaauga

SEQ ID NO: 3780060 - RNA, 13 nt, Salmonella typhimurium LT2
cgccgccaggucu

SEQ ID NO: 3780061 - RNA, 14 nt, Salmonella typhimurium LT2
cgccgccaggucuu

SEQ ID NO: 3780062 - RNA, 18 nt, Salmonella typhimurium LT2
cgccgccagguuauccag

SEQ ID NO: 3780063 - RNA, 14 nt, Salmonella typhimurium LT2
cgccgccaucacca

SEQ ID NO: 3780064 - RNA, 14 nt, Salmonella typhimurium LT2
cgccgccauccggc

SEQ ID NO: 3780065 - RNA, 16 nt, Salmonella typhimurium LT2
cgccgccauccggcaa

SEQ ID NO: 3780066 - RNA, 16 nt, Salmonella typhimurium LT2
cgccgccauccggcac

SEQ ID NO: 3780067 - RNA, 14 nt, Salmonella typhimurium LT2
cgccgccaucgcca

SEQ ID NO: 3780068 - RNA, 14 nt, Salmonella typhimurium LT2
cgccgccaucguuc

SEQ ID NO: 3780069 - RNA, 15 nt, Salmonella typhimurium LT2
cgccgccaugacgca

SEQ ID NO: 3780070 - RNA, 13 nt, Salmonella typhimurium LT2
cgccgcccagcac

SEQ ID NO: 3780071 - RNA, 12 nt, Salmonella typhimurium LT2
cgccgcccauca

SEQ ID NO: 3780072 - RNA, 20 nt, Salmonella typhimurium LT2
cgccgcccccaugccgccug

SEQ ID NO: 3780073 - RNA, 16 nt, Salmonella typhimurium LT2
cgccgcccggcuucca

SEQ ID NO: 3780074 - RNA, 15 nt, Salmonella typhimurium LT2
cgccgccgaacagac

SEQ ID NO: 3780075 - RNA, 14 nt, Salmonella typhimurium LT2
cgccgccgccaacg

SEQ ID NO: 3780076 - RNA, 15 nt, Salmonella typhimurium LT2
cgccgccgccaacgc

SEQ ID NO: 3780077 - RNA, 14 nt, Salmonella typhimurium LT2
cgccgccgccaucg

SEQ ID NO: 3780078 - RNA, 13 nt, Salmonella typhimurium LT2
cgccgccgggccg

SEQ ID NO: 3780079 - RNA, 13 nt, Salmonella typhimurium LT2
cgccgccgggcuu

SEQ ID NO: 3780080 - RNA, 17 nt, Salmonella typhimurium LT2
cgccgccuaucgccagc

SEQ ID NO: 3780081 - RNA, 13 nt, Salmonella typhimurium LT2
cgccgccuccccc

SEQ ID NO: 3780082 - RNA, 15 nt, Salmonella typhimurium LT2
cgccgccucccccuc

SEQ ID NO: 3780083 - RNA, 18 nt, Salmonella typhimurium LT2
cgccgccucgaucuccuc

SEQ ID NO: 3780084 - RNA, 15 nt, Salmonella typhimurium LT2
cgccgccucgcguag

SEQ ID NO: 3780085 - RNA, 13 nt, Salmonella typhimurium LT2
cgccgccucuuca

SEQ ID NO: 3780086 - RNA, 12 nt, Salmonella typhimurium LT2
cgccgccugaug

SEQ ID NO: 3780087 - RNA, 14 nt, Salmonella typhimurium LT2
cgccgccugcgcca

SEQ ID NO: 3780088 - RNA, 20 nt, Salmonella typhimurium LT2
cgccgccugcuccgggcggu

SEQ ID NO: 3780089 - RNA, 16 nt, Salmonella typhimurium LT2
cgccgccuuagcgacc

SEQ ID NO: 3780090 - RNA, 20 nt, Salmonella typhimurium LT2
cgccgcgauagaccacgcca

SEQ ID NO: 3780091 - RNA, 17 nt, Salmonella typhimurium LT2
cgccgcgaugcaucuug

SEQ ID NO: 3780092 - RNA, 21 nt, Salmonella typhimurium LT2
cgccgcgauguuugcucgcca

SEQ ID NO: 3780093 - RNA, 21 nt, Salmonella typhimurium LT2
cgccgcgcagcaucugauagc

SEQ ID NO: 3780094 - RNA, 13 nt, Salmonella typhimurium LT2
cgccgcgcaggcg

SEQ ID NO: 3780095 - RNA, 13 nt, Salmonella typhimurium LT2
cgccgcgccaucg

SEQ ID NO: 3780096 - RNA, 14 nt, Salmonella typhimurium LT2
cgccgcgccgcccc

SEQ ID NO: 3780097 - RNA, 15 nt, Salmonella typhimurium LT2
cgccgcgccgcccca

SEQ ID NO: 3780098 - RNA, 23 nt, Salmonella typhimurium LT2
cgccgcgccggacuccagcaacg

SEQ ID NO: 3780099 - RNA, 18 nt, Salmonella typhimurium LT2
cgccgcgccuaccagcgc

SEQ ID NO: 3780100 - RNA, 20 nt, Salmonella typhimurium LT2
cgccgcgcggaucgccaucg

SEQ ID NO: 3780101 - RNA, 16 nt, Salmonella typhimurium LT2
cgccgcgcuggauagc

SEQ ID NO: 3780102 - RNA, 11 nt, Salmonella typhimurium LT2
cgccgcggcga

SEQ ID NO: 3780103 - RNA, 22 nt, Salmonella typhimurium LT2
cgccgcggcgguuauccuccgg

SEQ ID NO: 3780104 - RNA, 16 nt, Salmonella typhimurium LT2
cgccgcgggcagcagc

SEQ ID NO: 3780105 - RNA, 22 nt, Salmonella typhimurium LT2
cgccgcguaaauccacauucca

SEQ ID NO: 3780106 - RNA, 17 nt, Salmonella typhimurium LT2
cgccgcuaucgccgacc

SEQ ID NO: 3780107 - RNA, 18 nt, Salmonella typhimurium LT2
cgccgcuaucgccgaccc

SEQ ID NO: 3780108 - RNA, 22 nt, Salmonella typhimurium LT2
cgccgcucgaaucgccaugccg

SEQ ID NO: 3780109 - RNA, 16 nt, Salmonella typhimurium LT2
cgccgcugcgagcagc

SEQ ID NO: 3780110 - RNA, 18 nt, Salmonella typhimurium LT2
cgccgcugcgagcagcga

SEQ ID NO: 3780111 - RNA, 23 nt, Salmonella typhimurium LT2
cgccgcuggcgcuuugccguucu

SEQ ID NO: 3780112 - RNA, 21 nt, Salmonella typhimurium LT2
cgccgcuggucaacacgcggu

SEQ ID NO: 3780113 - RNA, 18 nt, Salmonella typhimurium LT2
cgccgcuguaauaccagc

SEQ ID NO: 3780114 - RNA, 18 nt, Salmonella typhimurium LT2
cgccgcuguucagcagaa

SEQ ID NO: 3780115 - RNA, 17 nt, Salmonella typhimurium LT2
cgccgcuuauagcggcc

SEQ ID NO: 3780116 - RNA, 14 nt, Salmonella typhimurium LT2
cgccgcuuccaggc

SEQ ID NO: 3780117 - RNA, 15 nt, Salmonella typhimurium LT2
cgccgcuuccaggcg

SEQ ID NO: 3780118 - RNA, 15 nt, Salmonella typhimurium LT2
cgccgcuuccggcag

SEQ ID NO: 3780119 - RNA, 17 nt, Salmonella typhimurium LT2
cgccgcuuuucaggggu

SEQ ID NO: 3780120 - RNA, 18 nt, Salmonella typhimurium LT2
cgccgcuuuuuccgccgc

SEQ ID NO: 3780121 - RNA, 22 nt, Salmonella typhimurium LT2
cgccggaaagaauaaucgccgc

SEQ ID NO: 3780122 - RNA, 16 nt, Salmonella typhimurium LT2
cgccggaacccgcgac

SEQ ID NO: 3780123 - RNA, 23 nt, Salmonella typhimurium LT2
cgccggacaguucgccaacgcgu

SEQ ID NO: 3780124 - RNA, 19 nt, Salmonella typhimurium LT2
cgccuggaugacgaacagg

SEQ ID NO: 3780125 - RNA, 21 nt, Salmonella typhimurium LT2
cgccuggcagaaguccccagc

SEQ ID NO: 3780126 - RNA, 19 nt, Salmonella typhimurium LT2
cgccuggcaguucagucgg

SEQ ID NO: 3780127 - RNA, 19 nt, Salmonella typhimurium LT2
cgccuggccaggcuuucuu

SEQ ID NO: 3780128 - RNA, 18 nt, Salmonella typhimurium LT2
cgccuggcggcagaccgc

SEQ ID NO: 3780129 - RNA, 18 nt, Salmonella typhimurium LT2
cgccugggauaagcagaa

SEQ ID NO: 3780130 - RNA, 17 nt, Salmonella typhimurium LT2
cgccugggauagcgcug

SEQ ID NO: 3780131 - RNA, 17 nt, Salmonella typhimurium LT2
cgccugggggggaaacc

SEQ ID NO: 3780132 - RNA, 23 nt, Salmonella typhimurium LT2
cgccuguaaugucuggugcagca

SEQ ID NO: 3780133 - RNA, 14 nt, Salmonella typhimurium LT2
cgccuguccggccu

SEQ ID NO: 3780134 - RNA, 22 nt, Salmonella typhimurium LT2
cgccugugcuuucgccaccagc

SEQ ID NO: 3780135 - RNA, 23 nt, Salmonella typhimurium LT2
cgccugugcuuucgccaccagcg

SEQ ID NO: 3780136 - RNA, 21 nt, Salmonella typhimurium LT2
cgccugugguuuaaaacggug

SEQ ID NO: 3780137 - RNA, 14 nt, Salmonella typhimurium LT2
cgccuguuaauggu

SEQ ID NO: 3780138 - RNA, 15 nt, Salmonella typhimurium LT2
cgccuguuucugcgc

SEQ ID NO: 3780139 - RNA, 21 nt, Salmonella typhimurium LT2
cgccuguuugacgaaaucgca

SEQ ID NO: 3780140 - RNA, 20 nt, Salmonella typhimurium LT2
cgccuuacccggccuacaca

SEQ ID NO: 3780141 - RNA, 14 nt, Salmonella typhimurium LT2
cgccuuacguaccg

SEQ ID NO: 3780142 - RNA, 15 nt, Salmonella typhimurium LT2
cgccuuagcgaccgc

SEQ ID NO: 3780143 - RNA, 14 nt, Salmonella typhimurium LT2
cgccuuaucaagcc

SEQ ID NO: 3780144 - RNA, 19 nt, Salmonella typhimurium LT2
cgccuuauccgaccuacaa

SEQ ID NO: 3780145 - RNA, 14 nt, Salmonella typhimurium LT2
cgccuuauccggcc

SEQ ID NO: 3780146 - RNA, 19 nt, Salmonella typhimurium LT2
cgccuuauccggccuacaa

SEQ ID NO: 3780147 - RNA, 20 nt, Salmonella typhimurium LT2
cgccuuauccggccuacaac

SEQ ID NO: 3780148 - RNA, 18 nt, Salmonella typhimurium LT2
cgccuuauccggccuacg

SEQ ID NO: 3780149 - RNA, 18 nt, Salmonella typhimurium LT2
cgccuuauccggccugcc

SEQ ID NO: 3780150 - RNA, 22 nt, Salmonella typhimurium LT2
cgccuuauccggccugucgcug

SEQ ID NO: 3780151 - RNA, 19 nt, Salmonella typhimurium LT2
cgccuuauccugccuacag

SEQ ID NO: 3780152 - RNA, 20 nt, Salmonella typhimurium LT2
cgccuuauccugccuacagg

SEQ ID NO: 3780153 - RNA, 14 nt, Salmonella typhimurium LT2
cgccuuauucaggc

SEQ ID NO: 3780154 - RNA, 23 nt, Salmonella typhimurium LT2
cgccuuauucgguuuauccccgc

SEQ ID NO: 3780155 - RNA, 16 nt, Salmonella typhimurium LT2
cgccuucagcgcgccc

SEQ ID NO: 3780156 - RNA, 18 nt, Salmonella typhimurium LT2
cgccuuccgcaccgccag

SEQ ID NO: 3780157 - RNA, 19 nt, Salmonella typhimurium LT2
cgccuuccgcaccgccagu

SEQ ID NO: 3780158 - RNA, 21 nt, Salmonella typhimurium LT2
cgccuuccggccacuccgcca

SEQ ID NO: 3780159 - RNA, 16 nt, Salmonella typhimurium LT2
cgccuuccugcaggcg

SEQ ID NO: 3780160 - RNA, 13 nt, Salmonella typhimurium LT2
cgccuuccugcca

SEQ ID NO: 3780161 - RNA, 15 nt, Salmonella typhimurium LT2
cgccuuccugccagc

SEQ ID NO: 3780162 - RNA, 21 nt, Salmonella typhimurium LT2
cgccuucgauuaguccgucgg

SEQ ID NO: 3780163 - RNA, 20 nt, Salmonella typhimurium LT2
cgccuucgcggugaucccag

SEQ ID NO: 3780164 - RNA, 15 nt, Salmonella typhimurium LT2
cgccuucuucaucuu

SEQ ID NO: 3780165 - RNA, 23 nt, Salmonella typhimurium LT2
cgccuugacaggaaacagguacu

SEQ ID NO: 3780166 - RNA, 19 nt, Salmonella typhimurium LT2
cgccuugaggcguuuuagc

SEQ ID NO: 3780167 - RNA, 15 nt, Salmonella typhimurium LT2
cgccuugcgauaacc

SEQ ID NO: 3780168 - RNA, 18 nt, Salmonella typhimurium LT2
cgccuugcgauaacccgc

SEQ ID NO: 3780169 - RNA, 22 nt, Salmonella typhimurium LT2
cgccuugucgaaauggccaucc

SEQ ID NO: 3780170 - RNA, 14 nt, Salmonella typhimurium LT2
cgccuuuacccuua

SEQ ID NO: 3780171 - RNA, 17 nt, Salmonella typhimurium LT2
cgccuuuacgcccggua

SEQ ID NO: 3780172 - RNA, 20 nt, Salmonella typhimurium LT2
cgccuuucgcgaccaccagg

SEQ ID NO: 3780173 - RNA, 15 nt, Salmonella typhimurium LT2
cgccuuuucccccag

SEQ ID NO: 3780174 - RNA, 23 nt, Salmonella typhimurium LT2
cgccuuuuuuaaauuugaccucg

SEQ ID NO: 3780175 - RNA, 20 nt, Salmonella typhimurium LT2
cgccuuuuuucaccggcacc

SEQ ID NO: 3780176 - RNA, 18 nt, Salmonella typhimurium LT2
cgcgaaaacagcuggcga

SEQ ID NO: 3780177 - RNA, 23 nt, Salmonella typhimurium LT2
cgcgaaaauaccccagcgcgccg

SEQ ID NO: 3780178 - RNA, 18 nt, Salmonella typhimurium LT2
cgcgaaacugcugccgca

SEQ ID NO: 3780179 - RNA, 19 nt, Salmonella typhimurium LT2
cgcgaacauuacauccuca

SEQ ID NO: 3780180 - RNA, 16 nt, Salmonella typhimurium LT2
cgcgaacgccaggcca

SEQ ID NO: 3780181 - RNA, 16 nt, Salmonella typhimurium LT2
cgcgaacggcaucuac

SEQ ID NO: 3780182 - RNA, 19 nt, Salmonella typhimurium LT2
cgcgaacggcaucuacugc

SEQ ID NO: 3780183 - RNA, 14 nt, Salmonella typhimurium LT2
cgcgaagcggcgcc

SEQ ID NO: 3780184 - RNA, 19 nt, Salmonella typhimurium LT2
cgcgaaggccagcaccagc

SEQ ID NO: 3780185 - RNA, 16 nt, Salmonella typhimurium LT2
cgcgaauacucgcgcu

SEQ ID NO: 3780186 - RNA, 22 nt, Salmonella typhimurium LT2
cgcgaauagugauaccagccaa

SEQ ID NO: 3780187 - RNA, 18 nt, Salmonella typhimurium LT2
cgcgaauaucuuuauccu

SEQ ID NO: 3780188 - RNA, 13 nt, Salmonella typhimurium LT2
cgcgaauccgcca

SEQ ID NO: 3780189 - RNA, 21 nt, Salmonella typhimurium LT2
cgcgaaucgccucuucgaccg

SEQ ID NO: 3780190 - RNA, 22 nt, Salmonella typhimurium LT2
cgcgaauuuuauuaagcaggcc

SEQ ID NO: 3780191 - RNA, 17 nt, Salmonella typhimurium LT2
cgcgacaaaaagcgcgc

SEQ ID NO: 3780192 - RNA, 19 nt, Salmonella typhimurium LT2
cgcgacaaaaagcgcgccg

SEQ ID NO: 3780193 - RNA, 13 nt, Salmonella typhimurium LT2
cgcgacagcgcgc

SEQ ID NO: 3780194 - RNA, 15 nt, Salmonella typhimurium LT2
cgcgacagcgcgcca

SEQ ID NO: 3780195 - RNA, 14 nt, Salmonella typhimurium LT2
cgcgacauggcggu

SEQ ID NO: 3780196 - RNA, 16 nt, Salmonella typhimurium LT2
cgcgacauggcgguaa

SEQ ID NO: 3780197 - RNA, 17 nt, Salmonella typhimurium LT2
cgcgaccaacagcauca

SEQ ID NO: 3780198 - RNA, 15 nt, Salmonella typhimurium LT2
cgcgaccacgccagc

SEQ ID NO: 3780199 - RNA, 19 nt, Salmonella typhimurium LT2
cgcgaccacgccagccagc

SEQ ID NO: 3780200 - RNA, 16 nt, Salmonella typhimurium LT2
cgcgaccagcgcacca

SEQ ID NO: 3780201 - RNA, 20 nt, Salmonella typhimurium LT2
cgcgaccaggaaaccgguaa

SEQ ID NO: 3780202 - RNA, 14 nt, Salmonella typhimurium LT2
cgcgaccaguucac

SEQ ID NO: 3780203 - RNA, 13 nt, Salmonella typhimurium LT2
cgcgaccgcauca

SEQ ID NO: 3780204 - RNA, 15 nt, Salmonella typhimurium LT2
cgcgaccucaucaaa

SEQ ID NO: 3780205 - RNA, 19 nt, Salmonella typhimurium LT2
cgcgacgcccaccaguccc

SEQ ID NO: 3780206 - RNA, 17 nt, Salmonella typhimurium LT2
cgcgacggaccggcagc

SEQ ID NO: 3780207 - RNA, 14 nt, Salmonella typhimurium LT2
cgcgacguccgcca

SEQ ID NO: 3780208 - RNA, 19 nt, Salmonella typhimurium LT2
cgcgacucccaggcgcgca

SEQ ID NO: 3780209 - RNA, 21 nt, Salmonella typhimurium LT2
cgcgacucccaggcgcgcagc

SEQ ID NO: 3780210 - RNA, 22 nt, Salmonella typhimurium LT2
cgcgacuggaacgucaucauua

SEQ ID NO: 3780211 - RNA, 21 nt, Salmonella typhimurium LT2
cgcgacuuaucuuccacgccg

SEQ ID NO: 3780212 - RNA, 18 nt, Salmonella typhimurium LT2
cgcgacuuuuuucaccca

SEQ ID NO: 3780213 - RNA, 22 nt, Salmonella typhimurium LT2
cgcgagaagcccggccacagcg

SEQ ID NO: 3780214 - RNA, 14 nt, Salmonella typhimurium LT2
cgcgagaaucgcca

SEQ ID NO: 3780215 - RNA, 21 nt, Salmonella typhimurium LT2
cgcgagccuuuuaucaaugca

SEQ ID NO: 3780216 - RNA, 17 nt, Salmonella typhimurium LT2
cgcgagcgugaucucau

SEQ ID NO: 3780217 - RNA, 17 nt, Salmonella typhimurium LT2
cgcgaguauucgcgccc

SEQ ID NO: 3780218 - RNA, 18 nt, Salmonella typhimurium LT2
cgcgagugaucccaacau

SEQ ID NO: 3780219 - RNA, 16 nt, Salmonella typhimurium LT2
cgcgagugcaggauca

SEQ ID NO: 3780220 - RNA, 21 nt, Salmonella typhimurium LT2
cgcgauaaaaaacgcccagau

SEQ ID NO: 3780221 - RNA, 13 nt, Salmonella typhimurium LT2
cgcgauagcgcug

SEQ ID NO: 3780222 - RNA, 14 nt, Salmonella typhimurium LT2
cgcgauagcgcuga

SEQ ID NO: 3780223 - RNA, 15 nt, Salmonella typhimurium LT2
cgcgauauccaccac

SEQ ID NO: 3780224 - RNA, 15 nt, Salmonella typhimurium LT2
cgcgauauccaccug

SEQ ID NO: 3780225 - RNA, 13 nt, Salmonella typhimurium LT2
cgcgauaucugcc

SEQ ID NO: 3780226 - RNA, 18 nt, Salmonella typhimurium LT2
cgcgauaugucucuccag

SEQ ID NO: 3780227 - RNA, 14 nt, Salmonella typhimurium LT2
cgcgcucagcgucu

SEQ ID NO: 3780228 - RNA, 23 nt, Salmonella typhimurium LT2
cgcgcucaguucauuauuucaug

SEQ ID NO: 3780229 - RNA, 22 nt, Salmonella typhimurium LT2
cgcgcucauacgaucgcgcaca

SEQ ID NO: 3780230 - RNA, 22 nt, Salmonella typhimurium LT2
cgcgcuccugcucuuccgguac

SEQ ID NO: 3780231 - RNA, 12 nt, Salmonella typhimurium LT2
cgcgcucgccag

SEQ ID NO: 3780232 - RNA, 13 nt, Salmonella typhimurium LT2
cgcgcucgccagc

SEQ ID NO: 3780233 - RNA, 13 nt, Salmonella typhimurium LT2
cgcgcucggcagc

SEQ ID NO: 3780234 - RNA, 17 nt, Salmonella typhimurium LT2
cgcgcucggcagcagcg

SEQ ID NO: 3780235 - RNA, 18 nt, Salmonella typhimurium LT2
cgcgcucugggucggcac

SEQ ID NO: 3780236 - RNA, 16 nt, Salmonella typhimurium LT2
cgcgcucuuccgccag

SEQ ID NO: 3780237 - RNA, 21 nt, Salmonella typhimurium LT2
cgcgcucuuccgccagcgcca

SEQ ID NO: 3780238 - RNA, 23 nt, Salmonella typhimurium LT2
cgcgcugaccuucagccagaguu

SEQ ID NO: 3780239 - RNA, 14 nt, Salmonella typhimurium LT2
cgcgcugaucgcca

SEQ ID NO: 3780240 - RNA, 19 nt, Salmonella typhimurium LT2
cgcgcuggcaagcgccagc

SEQ ID NO: 3780241 - RNA, 12 nt, Salmonella typhimurium LT2
cgcgcuggcaau

SEQ ID NO: 3780242 - RNA, 16 nt, Salmonella typhimurium LT2
cgcgcuggcgcgccug

SEQ ID NO: 3780243 - RNA, 16 nt, Salmonella typhimurium LT2
cgcgcuguaacuucac

SEQ ID NO: 3780244 - RNA, 15 nt, Salmonella typhimurium LT2
cgcgcuuccugccag

SEQ ID NO: 3780245 - RNA, 17 nt, Salmonella typhimurium LT2
cgcgcuuucuggcgcag

SEQ ID NO: 3780246 - RNA, 15 nt, Salmonella typhimurium LT2
cgcgcuuuucgccag

SEQ ID NO: 3780247 - RNA, 19 nt, Salmonella typhimurium LT2
cgcgcuuuucgccagcgca

SEQ ID NO: 3780248 - RNA, 14 nt, Salmonella typhimurium LT2
cgcggaaagccuuc

SEQ ID NO: 3780249 - RNA, 19 nt, Salmonella typhimurium LT2
cgcggaacuggugaaacag

SEQ ID NO: 3780250 - RNA, 13 nt, Salmonella typhimurium LT2
cgcggaaggcgcc

SEQ ID NO: 3780251 - RNA, 24 nt, Salmonella typhimurium LT2
cgcggaaguuaccgcgccaggcgg

SEQ ID NO: 3780252 - RNA, 13 nt, Salmonella typhimurium LT2
cgcggacacgaua

SEQ ID NO: 3780253 - RNA, 19 nt, Salmonella typhimurium LT2
cgcggaccuuuugccgccc

SEQ ID NO: 3780254 - RNA, 22 nt, Salmonella typhimurium LT2
cgcggauaccuaacagccgcgg

SEQ ID NO: 3780255 - RNA, 19 nt, Salmonella typhimurium LT2
cgcggauagacgauauagc

SEQ ID NO: 3780256 - RNA, 18 nt, Salmonella typhimurium LT2
cgcggauaugcagcagcc

SEQ ID NO: 3780257 - RNA, 17 nt, Salmonella typhimurium LT2
cgcggaugguggcguaa

SEQ ID NO: 3780258 - RNA, 15 nt, Salmonella typhimurium LT2
cgcggauugccgccc

SEQ ID NO: 3780259 - RNA, 19 nt, Salmonella typhimurium LT2
cgcggcaaccagcccauga

SEQ ID NO: 3780260 - RNA, 15 nt, Salmonella typhimurium LT2
cgcggcaauggcuua

SEQ ID NO: 3780261 - RNA, 22 nt, Salmonella typhimurium LT2
cgcggcacacuuucaucagccg

SEQ ID NO: 3780262 - RNA, 14 nt, Salmonella typhimurium LT2
cgcggcagccggaa

SEQ ID NO: 3780263 - RNA, 19 nt, Salmonella typhimurium LT2
cgcggcagcgcugcggaua

SEQ ID NO: 3780264 - RNA, 15 nt, Salmonella typhimurium LT2
cgcggcaggccggca

SEQ ID NO: 3780265 - RNA, 18 nt, Salmonella typhimurium LT2
cgcggcauaaauccggug

SEQ ID NO: 3780266 - RNA, 23 nt, Salmonella typhimurium LT2
cgcggcauauuuuuuccccgcuu

SEQ ID NO: 3780267 - RNA, 15 nt, Salmonella typhimurium LT2
cgcggcaucagccug

SEQ ID NO: 3780268 - RNA, 17 nt, Salmonella typhimurium LT2
cgcggcauuaaaugcgc

SEQ ID NO: 3780269 - RNA, 18 nt, Salmonella typhimurium LT2
cgcggcauuucccuuccc

SEQ ID NO: 3780270 - RNA, 13 nt, Salmonella typhimurium LT2
cgcggccaaaacc

SEQ ID NO: 3780271 - RNA, 16 nt, Salmonella typhimurium LT2
cgcggccaaaacccac

SEQ ID NO: 3780272 - RNA, 20 nt, Salmonella typhimurium LT2
cgcggccaaaacccaccagc

SEQ ID NO: 3780273 - RNA, 22 nt, Salmonella typhimurium LT2
cgcggccaaaacccaccagcag

SEQ ID NO: 3780274 - RNA, 16 nt, Salmonella typhimurium LT2
cgcggccaucacgcug

SEQ ID NO: 3780275 - RNA, 15 nt, Salmonella typhimurium LT2
cgcggcgaaccggca

SEQ ID NO: 3780276 - RNA, 23 nt, Salmonella typhimurium LT2
cgcggcgccgaagcaggcggaga

SEQ ID NO: 3780277 - RNA, 19 nt, Salmonella typhimurium LT2
cgcggcgcuacggcgcaca

SEQ ID NO: 3780278 - RNA, 22 nt, Salmonella typhimurium LT2
cgcggcgcugaguuucucccgc

SEQ ID NO: 3780279 - RNA, 21 nt, Salmonella typhimurium LT2
cgcggcggacaacgcuccagc

SEQ ID NO: 3780280 - RNA, 22 nt, Salmonella typhimurium LT2
cgcggcgguucauccugcgcca

SEQ ID NO: 3780281 - RNA, 18 nt, Salmonella typhimurium LT2
cgcggcguaccgcgcgcc

SEQ ID NO: 3780282 - RNA, 12 nt, Salmonella typhimurium LT2
cgcggcguacgc

SEQ ID NO: 3780283 - RNA, 14 nt, Salmonella typhimurium LT2
cgcggcgucgccgc

SEQ ID NO: 3780284 - RNA, 23 nt, Salmonella typhimurium LT2
cgcggcucaccagcugacgcagc

SEQ ID NO: 3780285 - RNA, 20 nt, Salmonella typhimurium LT2
cgcggcugguaacaguccgu

SEQ ID NO: 3780286 - RNA, 13 nt, Salmonella typhimurium LT2
cgcgggaaacacu

SEQ ID NO: 3780287 - RNA, 18 nt, Salmonella typhimurium LT2
cgcgggcgcuaaaccggc

SEQ ID NO: 3780288 - RNA, 12 nt, Salmonella typhimurium LT2
cgcggggaacac

SEQ ID NO: 3780289 - RNA, 20 nt, Salmonella typhimurium LT2
cgcggguuuuuacuuuccau

SEQ ID NO: 3780290 - RNA, 16 nt, Salmonella typhimurium LT2
cgcgguaaguacggca

SEQ ID NO: 3780291 - RNA, 18 nt, Salmonella typhimurium LT2
cgcgguauucauaccuuu

SEQ ID NO: 3780292 - RNA, 19 nt, Salmonella typhimurium LT2
cgcgguauuucgccgccgc

SEQ ID NO: 3780293 - RNA, 14 nt, Salmonella typhimurium LT2
cgcggucagcggcg

SEQ ID NO: 3780294 - RNA, 23 nt, Salmonella typhimurium LT2
cgcggucagggugaaucccgcca

SEQ ID NO: 3780295 - RNA, 17 nt, Salmonella typhimurium LT2
cgcgguccacaggccgu

SEQ ID NO: 3780296 - RNA, 15 nt, Salmonella typhimurium LT2
cgcggucgccugccg

SEQ ID NO: 3780297 - RNA, 22 nt, Salmonella typhimurium LT2
cgcggucgggauauaugcaaaa

SEQ ID NO: 3780298 - RNA, 18 nt, Salmonella typhimurium LT2
cgcggucuuuuaaaagac

SEQ ID NO: 3780299 - RNA, 23 nt, Salmonella typhimurium LT2
cgcggugaaugcgcggcugcgga

SEQ ID NO: 3780300 - RNA, 18 nt, Salmonella typhimurium LT2
cgcggugauccuccugca

SEQ ID NO: 3780301 - RNA, 13 nt, Salmonella typhimurium LT2
cgcgguuaacagc

SEQ ID NO: 3780302 - RNA, 21 nt, Salmonella typhimurium LT2
cgcgguucaguuucuccggcg

SEQ ID NO: 3780303 - RNA, 21 nt, Salmonella typhimurium LT2
cgcgguucuguuccgcuaucu

SEQ ID NO: 3780304 - RNA, 22 nt, Salmonella typhimurium LT2
cgcgguugacggcuacuccggc

SEQ ID NO: 3780305 - RNA, 16 nt, Salmonella typhimurium LT2
cgcguaacgccuccac

SEQ ID NO: 3780306 - RNA, 23 nt, Salmonella typhimurium LT2
cgcguaauacgauccucgccauu

SEQ ID NO: 3780307 - RNA, 17 nt, Salmonella typhimurium LT2
cgcguaaucgcgaauaa

SEQ ID NO: 3780308 - RNA, 19 nt, Salmonella typhimurium LT2
cgcguaaucucccacccgc

SEQ ID NO: 3780309 - RNA, 23 nt, Salmonella typhimurium LT2
cgcguaauuugcgacauggcgac

SEQ ID NO: 3780310 - RNA, 12 nt, Salmonella typhimurium LT2
cgcguaccagcg

SEQ ID NO: 3780311 - RNA, 20 nt, Salmonella typhimurium LT2
cgcguacuuucgccaguuca

SEQ ID NO: 3780312 - RNA, 18 nt, Salmonella typhimurium LT2
cgcguagcccacagguag

SEQ ID NO: 3780313 - RNA, 14 nt, Salmonella typhimurium LT2
cgcguagcccagcg

SEQ ID NO: 3780314 - RNA, 17 nt, Salmonella typhimurium LT2
cgcguauaacgccgccc

SEQ ID NO: 3780315 - RNA, 19 nt, Salmonella typhimurium LT2
cgcgucaacggcgcggcgu

SEQ ID NO: 3780316 - RNA, 23 nt, Salmonella typhimurium LT2
cgcgucacaaaaacacccgcagc

SEQ ID NO: 3780317 - RNA, 17 nt, Salmonella typhimurium LT2
cgcgucacaacagccgg

SEQ ID NO: 3780318 - RNA, 23 nt, Salmonella typhimurium LT2
cgcgucacaaucgcgccugccag

SEQ ID NO: 3780319 - RNA, 18 nt, Salmonella typhimurium LT2
cgcgucagcgccuccgcg

SEQ ID NO: 3780320 - RNA, 16 nt, Salmonella typhimurium LT2
cgcgucagggcgauaa

SEQ ID NO: 3780321 - RNA, 20 nt, Salmonella typhimurium LT2
cgcgucaucggcgcgcuggc

SEQ ID NO: 3780322 - RNA, 14 nt, Salmonella typhimurium LT2
cgcguccagcggca

SEQ ID NO: 3780323 - RNA, 17 nt, Salmonella typhimurium LT2
cgcguccagcggcaagc

SEQ ID NO: 3780324 - RNA, 15 nt, Salmonella typhimurium LT2
cgcguccauuacucu

SEQ ID NO: 3780325 - RNA, 13 nt, Salmonella typhimurium LT2
cgcgucccucucc

SEQ ID NO: 3780326 - RNA, 15 nt, Salmonella typhimurium LT2
cgcgucccucuccag

SEQ ID NO: 3780327 - RNA, 16 nt, Salmonella typhimurium LT2
cgcgucccucuccagg

SEQ ID NO: 3780328 - RNA, 13 nt, Salmonella typhimurium LT2
cgcguccggggcc

SEQ ID NO: 3780329 - RNA, 14 nt, Salmonella typhimurium LT2
cgcguccggggcca

SEQ ID NO: 3780330 - RNA, 22 nt, Salmonella typhimurium LT2
cgcgucgcagguuaucggccag

SEQ ID NO: 3780331 - RNA, 22 nt, Salmonella typhimurium LT2
cgcucccgcgaggaauacggaa

SEQ ID NO: 3780332 - RNA, 19 nt, Salmonella typhimurium LT2
cgcucccggaaccgaccgc

SEQ ID NO: 3780333 - RNA, 23 nt, Salmonella typhimurium LT2
cgcuccgacaaacuucaucgcca

SEQ ID NO: 3780334 - RNA, 12 nt, Salmonella typhimurium LT2
cgcuccggcagg

SEQ ID NO: 3780335 - RNA, 20 nt, Salmonella typhimurium LT2
cgcuccguacgcgucacaau

SEQ ID NO: 3780336 - RNA, 23 nt, Salmonella typhimurium LT2
cgcuccguacgcgucacaaucgc

SEQ ID NO: 3780337 - RNA, 19 nt, Salmonella typhimurium LT2
cgcucgacuggucgcagcc

SEQ ID NO: 3780338 - RNA, 24 nt, Salmonella typhimurium LT2
cgcucgccagcauacgucugcgcu

SEQ ID NO: 3780339 - RNA, 14 nt, Salmonella typhimurium LT2
cgcucgccagcccg

SEQ ID NO: 3780340 - RNA, 15 nt, Salmonella typhimurium LT2
cgcucgccagcgcag

SEQ ID NO: 3780341 - RNA, 13 nt, Salmonella typhimurium LT2
cgcucgccgccuc

SEQ ID NO: 3780342 - RNA, 22 nt, Salmonella typhimurium LT2
cgcucgcggaagcgaccggcgu

SEQ ID NO: 3780343 - RNA, 20 nt, Salmonella typhimurium LT2
cgcucgcuuacgcggcgcgc

SEQ ID NO: 3780344 - RNA, 20 nt, Salmonella typhimurium LT2
cgcucggcauacaccgccag

SEQ ID NO: 3780345 - RNA, 21 nt, Salmonella typhimurium LT2
cgcucggcauacaccgccagc

SEQ ID NO: 3780346 - RNA, 18 nt, Salmonella typhimurium LT2
cgcucggugacggaaacc

SEQ ID NO: 3780347 - RNA, 16 nt, Salmonella typhimurium LT2
cgcucuaucgccgccc

SEQ ID NO: 3780348 - RNA, 19 nt, Salmonella typhimurium LT2
cgcucuccuacaccaccag

SEQ ID NO: 3780349 - RNA, 20 nt, Salmonella typhimurium LT2
cgcucuccuacaccaccagc

SEQ ID NO: 3780350 - RNA, 13 nt, Salmonella typhimurium LT2
cgcucucuuuuuu

SEQ ID NO: 3780351 - RNA, 19 nt, Salmonella typhimurium LT2
cgcucuuccgccagcgcca

SEQ ID NO: 3780352 - RNA, 14 nt, Salmonella typhimurium LT2
cgcucuugccuggc

SEQ ID NO: 3780353 - RNA, 20 nt, Salmonella typhimurium LT2
cgcucuuuuucuugucucca

SEQ ID NO: 3780354 - RNA, 23 nt, Salmonella typhimurium LT2
cgcugaaaaugacuucaucgcca

SEQ ID NO: 3780355 - RNA, 19 nt, Salmonella typhimurium LT2
cgcugaacgacuacugaaa

SEQ ID NO: 3780356 - RNA, 13 nt, Salmonella typhimurium LT2
cgcugaagcccgc

SEQ ID NO: 3780357 - RNA, 14 nt, Salmonella typhimurium LT2
cgcugaagcccgcg

SEQ ID NO: 3780358 - RNA, 16 nt, Salmonella typhimurium LT2
cgcugaagcccgcgau

SEQ ID NO: 3780359 - RNA, 23 nt, Salmonella typhimurium LT2
cgcugaaguaauguucaggguua

SEQ ID NO: 3780360 - RNA, 21 nt, Salmonella typhimurium LT2
cgcugacaaaucggcuccggc

SEQ ID NO: 3780361 - RNA, 16 nt, Salmonella typhimurium LT2
cgcugacacgcgcagu

SEQ ID NO: 3780362 - RNA, 13 nt, Salmonella typhimurium LT2
cgcugacaucauc

SEQ ID NO: 3780363 - RNA, 15 nt, Salmonella typhimurium LT2
cgcugaccacgccgc

SEQ ID NO: 3780364 - RNA, 16 nt, Salmonella typhimurium LT2
cgcugacgccagccag

SEQ ID NO: 3780365 - RNA, 11 nt, Salmonella typhimurium LT2
cgcugagaaaa

SEQ ID NO: 3780366 - RNA, 12 nt, Salmonella typhimurium LT2
cgcugagaaaaa

SEQ ID NO: 3780367 - RNA, 23 nt, Salmonella typhimurium LT2
cgcugagucuaacccguugccga

SEQ ID NO: 3780368 - RNA, 17 nt, Salmonella typhimurium LT2
cgcugauaaucguauca

SEQ ID NO: 3780369 - RNA, 20 nt, Salmonella typhimurium LT2
cgcugauacgcuggcacagg

SEQ ID NO: 3780370 - RNA, 19 nt, Salmonella typhimurium LT2
cgcugauagccacggcgca

SEQ ID NO: 3780371 - RNA, 20 nt, Salmonella typhimurium LT2
cgcugauagccacggcgcau

SEQ ID NO: 3780372 - RNA, 18 nt, Salmonella typhimurium LT2
cgcugaugugcggccugg

SEQ ID NO: 3780373 - RNA, 15 nt, Salmonella typhimurium LT2
cgcugcaaaaugaug

SEQ ID NO: 3780374 - RNA, 15 nt, Salmonella typhimurium LT2
cgcugcaaaucacca

SEQ ID NO: 3780375 - RNA, 15 nt, Salmonella typhimurium LT2
cgcugcaacccgccg

SEQ ID NO: 3780376 - RNA, 18 nt, Salmonella typhimurium LT2
cgcugcaacccgccgcca

SEQ ID NO: 3780377 - RNA, 18 nt, Salmonella typhimurium LT2
cgcugcacaaucgccagc

SEQ ID NO: 3780378 - RNA, 16 nt, Salmonella typhimurium LT2
cgcugcagauuuugcu

SEQ ID NO: 3780379 - RNA, 20 nt, Salmonella typhimurium LT2
cgcugcaucguuugcaguuc

SEQ ID NO: 3780380 - RNA, 22 nt, Salmonella typhimurium LT2
cgcugcaucguuugcaguuccg

SEQ ID NO: 3780381 - RNA, 22 nt, Salmonella typhimurium LT2
cgcugccacaauggcaggcagc

SEQ ID NO: 3780382 - RNA, 20 nt, Salmonella typhimurium LT2
cgcugccacacucucuccag

SEQ ID NO: 3780383 - RNA, 14 nt, Salmonella typhimurium LT2
cgcugccgcccuuu

SEQ ID NO: 3780384 - RNA, 21 nt, Salmonella typhimurium LT2
cgcugccuuccgggcggcugu

SEQ ID NO: 3780385 - RNA, 16 nt, Salmonella typhimurium LT2
cgcugcgagcagcgaa

SEQ ID NO: 3780386 - RNA, 23 nt, Salmonella typhimurium LT2
cgcugcgcauuagcaauaaucuc

SEQ ID NO: 3780387 - RNA, 18 nt, Salmonella typhimurium LT2
cgcugcgccagauccggc

SEQ ID NO: 3780388 - RNA, 12 nt, Salmonella typhimurium LT2
cgcugcgccgca

SEQ ID NO: 3780389 - RNA, 14 nt, Salmonella typhimurium LT2
cgcugcgcucgccc

SEQ ID NO: 3780390 - RNA, 18 nt, Salmonella typhimurium LT2
cgcugcgcuuaccgggcc

SEQ ID NO: 3780391 - RNA, 23 nt, Salmonella typhimurium LT2
cgcugcgcuuaccgggccgacag

SEQ ID NO: 3780392 - RNA, 20 nt, Salmonella typhimurium LT2
cgcugcgcuuaccgggccua

SEQ ID NO: 3780393 - RNA, 20 nt, Salmonella typhimurium LT2
cgcugcgcuuaucaggccua

SEQ ID NO: 3780394 - RNA, 16 nt, Salmonella typhimurium LT2
cgcugcgcuuauccgc

SEQ ID NO: 3780395 - RNA, 13 nt, Salmonella typhimurium LT2
cgcugcgucaggc

SEQ ID NO: 3780396 - RNA, 16 nt, Salmonella typhimurium LT2
cgcugcgugcgcgcca

SEQ ID NO: 3780397 - RNA, 20 nt, Salmonella typhimurium LT2
cgcugcgugcgcgccaccgg

SEQ ID NO: 3780398 - RNA, 18 nt, Salmonella typhimurium LT2
cgcugcguuugccgccuu

SEQ ID NO: 3780399 - RNA, 12 nt, Salmonella typhimurium LT2
cgcugcuccggc

SEQ ID NO: 3780400 - RNA, 13 nt, Salmonella typhimurium LT2
cgcugcuccggcu

SEQ ID NO: 3780401 - RNA, 14 nt, Salmonella typhimurium LT2
cgcugcuccggcuu

SEQ ID NO: 3780402 - RNA, 21 nt, Salmonella typhimurium LT2
cgcugcugcggcgucccccaa

SEQ ID NO: 3780403 - RNA, 18 nt, Salmonella typhimurium LT2
cgcugcuggcagcgcuga

SEQ ID NO: 3780404 - RNA, 19 nt, Salmonella typhimurium LT2
cgcugcuggcagcgcugaa

SEQ ID NO: 3780405 - RNA, 18 nt, Salmonella typhimurium LT2
cgcuggaaccagguuucc

SEQ ID NO: 3780406 - RNA, 20 nt, Salmonella typhimurium LT2
cgcuggaaucauccaccaga

SEQ ID NO: 3780407 - RNA, 23 nt, Salmonella typhimurium LT2
cgcuggacgucgucaccacggug

SEQ ID NO: 3780408 - RNA, 16 nt, Salmonella typhimurium LT2
cgcuggcaauaaagca

SEQ ID NO: 3780409 - RNA, 21 nt, Salmonella typhimurium LT2
cgcuggcaauaaagcagggcg

SEQ ID NO: 3780410 - RNA, 22 nt, Salmonella typhimurium LT2
cgcuggcaauaaagcagggcgg

SEQ ID NO: 3780411 - RNA, 15 nt, Salmonella typhimurium LT2
cgcuggcacuggcag

SEQ ID NO: 3780412 - RNA, 14 nt, Salmonella typhimurium LT2
cgcuggccuccagc

SEQ ID NO: 3780413 - RNA, 20 nt, Salmonella typhimurium LT2
cgcuggccuccagcacuucc

SEQ ID NO: 3780414 - RNA, 13 nt, Salmonella typhimurium LT2
cgcuggcgcugca

SEQ ID NO: 3780415 - RNA, 11 nt, Salmonella typhimurium LT2
cgcuggcguac

SEQ ID NO: 3780416 - RNA, 12 nt, Salmonella typhimurium LT2
cgcuggcgugac

SEQ ID NO: 3780417 - RNA, 16 nt, Salmonella typhimurium LT2
cgcugguaaauccggc

SEQ ID NO: 3780418 - RNA, 14 nt, Salmonella typhimurium LT2
cgcuggucagcgca

SEQ ID NO: 3780419 - RNA, 14 nt, Salmonella typhimurium LT2
cgcuggucagcgcg

SEQ ID NO: 3780420 - RNA, 17 nt, Salmonella typhimurium LT2
cgcuggucagcgcgcca

SEQ ID NO: 3780421 - RNA, 18 nt, Salmonella typhimurium LT2
cgcuggugacaucgccgg

SEQ ID NO: 3780422 - RNA, 22 nt, Salmonella typhimurium LT2
cgcuggugcuacgggcgcuguc

SEQ ID NO: 3780423 - RNA, 22 nt, Salmonella typhimurium LT2
cgcugguuggcgcgcucgcauu

SEQ ID NO: 3780424 - RNA, 17 nt, Salmonella typhimurium LT2
cgcuguaccgccauccg

SEQ ID NO: 3780425 - RNA, 15 nt, Salmonella typhimurium LT2
cgcuguaccggcagg

SEQ ID NO: 3780426 - RNA, 13 nt, Salmonella typhimurium LT2
cgcuguaggccgg

SEQ ID NO: 3780427 - RNA, 16 nt, Salmonella typhimurium LT2
cgcuguaguaaacggc

SEQ ID NO: 3780428 - RNA, 19 nt, Salmonella typhimurium LT2
cgcugucacuccggcugca

SEQ ID NO: 3780429 - RNA, 23 nt, Salmonella typhimurium LT2
cgcuguccagauagggccaggcg

SEQ ID NO: 3780430 - RNA, 14 nt, Salmonella typhimurium LT2
cgcugucgauaaua

SEQ ID NO: 3780431 - RNA, 16 nt, Salmonella typhimurium LT2
cgcugucgccacgcac

SEQ ID NO: 3780432 - RNA, 14 nt, Salmonella typhimurium LT2
cgcugucggcguug

SEQ ID NO: 3780433 - RNA, 18 nt, Salmonella typhimurium LT2
cgcugucguuccacacgu

SEQ ID NO: 3780434 - RNA, 15 nt, Salmonella typhimurium LT2
cgcugucuauccacu

SEQ ID NO: 3780435 - RNA, 19 nt, Salmonella typhimurium LT2
cggaaccaaaugcccagcu

SEQ ID NO: 3780436 - RNA, 19 nt, Salmonella typhimurium LT2
cggaaccauuuuccccaga

SEQ ID NO: 3780437 - RNA, 14 nt, Salmonella typhimurium LT2
cggaacccagcaaa

SEQ ID NO: 3780438 - RNA, 20 nt, Salmonella typhimurium LT2
cggaaccuguucaugccaga

SEQ ID NO: 3780439 - RNA, 22 nt, Salmonella typhimurium LT2
cggaacgccccucgguuuaucc

SEQ ID NO: 3780440 - RNA, 14 nt, Salmonella typhimurium LT2
cggaacggagagca

SEQ ID NO: 3780441 - RNA, 21 nt, Salmonella typhimurium LT2
cggaacgucuuuuuccagcag

SEQ ID NO: 3780442 - RNA, 23 nt, Salmonella typhimurium LT2
cggaacgucuuuuuccagcagcu

SEQ ID NO: 3780443 - RNA, 19 nt, Salmonella typhimurium LT2
cggaacucacuugucuucu

SEQ ID NO: 3780444 - RNA, 22 nt, Salmonella typhimurium LT2
cggaacucacuugucuucuuuc

SEQ ID NO: 3780445 - RNA, 18 nt, Salmonella typhimurium LT2
cggaagacuggcgcagca

SEQ ID NO: 3780446 - RNA, 21 nt, Salmonella typhimurium LT2
cggaagacuggcgcagcaaac

SEQ ID NO: 3780447 - RNA, 19 nt, Salmonella typhimurium LT2
cggaagaguuguugaccaa

SEQ ID NO: 3780448 - RNA, 14 nt, Salmonella typhimurium LT2
cggaagauccuguu

SEQ ID NO: 3780449 - RNA, 14 nt, Salmonella typhimurium LT2
cggaagaucgccau

SEQ ID NO: 3780450 - RNA, 15 nt, Salmonella typhimurium LT2
cggaaguauccugga

SEQ ID NO: 3780451 - RNA, 16 nt, Salmonella typhimurium LT2
cggaaguuaccgcgcc

SEQ ID NO: 3780452 - RNA, 21 nt, Salmonella typhimurium LT2
cggaaguuaccgcgccaggcg

SEQ ID NO: 3780453 - RNA, 15 nt, Salmonella typhimurium LT2
cggaauaccgucaaa

SEQ ID NO: 3780454 - RNA, 13 nt, Salmonella typhimurium LT2
cggaauauugaga

SEQ ID NO: 3780455 - RNA, 20 nt, Salmonella typhimurium LT2
cggaaucacggcaacgccuu

SEQ ID NO: 3780456 - RNA, 19 nt, Salmonella typhimurium LT2
cggaaucgcgauccagccc

SEQ ID NO: 3780457 - RNA, 15 nt, Salmonella typhimurium LT2
cggaaugagagaagg

SEQ ID NO: 3780458 - RNA, 20 nt, Salmonella typhimurium LT2
cggaaugccguauaccagcg

SEQ ID NO: 3780459 - RNA, 18 nt, Salmonella typhimurium LT2
cggaauugguagacgcgc

SEQ ID NO: 3780460 - RNA, 15 nt, Salmonella typhimurium LT2
cggacaacgcuccag

SEQ ID NO: 3780461 - RNA, 17 nt, Salmonella typhimurium LT2
cggacaacgcuccagca

SEQ ID NO: 3780462 - RNA, 14 nt, Salmonella typhimurium LT2
cggacacccgcagc

SEQ ID NO: 3780463 - RNA, 16 nt, Salmonella typhimurium LT2
cggacacccgcagccg

SEQ ID NO: 3780464 - RNA, 20 nt, Salmonella typhimurium LT2
cggacacgcugguaaucauu

SEQ ID NO: 3780465 - RNA, 15 nt, Salmonella typhimurium LT2
cggacagaaaaaaua

SEQ ID NO: 3780466 - RNA, 21 nt, Salmonella typhimurium LT2
cggacauuuauuucacuggcc

SEQ ID NO: 3780467 - RNA, 16 nt, Salmonella typhimurium LT2
cggaccagacgaccgu

SEQ ID NO: 3780468 - RNA, 13 nt, Salmonella typhimurium LT2
cggaccagcgugc

SEQ ID NO: 3780469 - RNA, 14 nt, Salmonella typhimurium LT2
cggaccccucuucu

SEQ ID NO: 3780470 - RNA, 17 nt, Salmonella typhimurium LT2
cggaccccucuucuuuu

SEQ ID NO: 3780471 - RNA, 22 nt, Salmonella typhimurium LT2
cggaccggcagcgucggcuuca

SEQ ID NO: 3780472 - RNA, 16 nt, Salmonella typhimurium LT2
cggaccgguauuacca

SEQ ID NO: 3780473 - RNA, 20 nt, Salmonella typhimurium LT2
cggacgaaccuggcgguaaa

SEQ ID NO: 3780474 - RNA, 19 nt, Salmonella typhimurium LT2
cggacgaacgcuaugcgcc

SEQ ID NO: 3780475 - RNA, 15 nt, Salmonella typhimurium LT2
cggacgagcgcguca

SEQ ID NO: 3780476 - RNA, 15 nt, Salmonella typhimurium LT2
cggacgccgggugau

SEQ ID NO: 3780477 - RNA, 19 nt, Salmonella typhimurium LT2
cggacggcaaccguccgcu

SEQ ID NO: 3780478 - RNA, 20 nt, Salmonella typhimurium LT2
cggacggcgcagcgcgcgac

SEQ ID NO: 3780479 - RNA, 21 nt, Salmonella typhimurium LT2
cggacggcgcagcgcgcgacc

SEQ ID NO: 3780480 - RNA, 16 nt, Salmonella typhimurium LT2
cggacgguaccugaag

SEQ ID NO: 3780481 - RNA, 17 nt, Salmonella typhimurium LT2
cggacgguaccugaagc

SEQ ID NO: 3780482 - RNA, 12 nt, Salmonella typhimurium LT2
cggacucagggu

SEQ ID NO: 3780483 - RNA, 16 nt, Salmonella typhimurium LT2
cggacucagggugaca

SEQ ID NO: 3780484 - RNA, 12 nt, Salmonella typhimurium LT2
cggacuccagca

SEQ ID NO: 3780485 - RNA, 22 nt, Salmonella typhimurium LT2
cggacuccagcaacgccgcauc

SEQ ID NO: 3780486 - RNA, 15 nt, Salmonella typhimurium LT2
cggacucgcuggaca

SEQ ID NO: 3780487 - RNA, 16 nt, Salmonella typhimurium LT2
cggacucgcuggacau

SEQ ID NO: 3780488 - RNA, 21 nt, Salmonella typhimurium LT2
cggacugauagcgaggcagca

SEQ ID NO: 3780489 - RNA, 20 nt, Salmonella typhimurium LT2
cggagaaaagcgaaaauaaa

SEQ ID NO: 3780490 - RNA, 23 nt, Salmonella typhimurium LT2
cggagaaauagacgagcgaaaaa

SEQ ID NO: 3780491 - RNA, 14 nt, Salmonella typhimurium LT2
cggagaacggcaca

SEQ ID NO: 3780492 - RNA, 22 nt, Salmonella typhimurium LT2
cggagaacggcacaauagcgcu

SEQ ID NO: 3780493 - RNA, 17 nt, Salmonella typhimurium LT2
cggagaagacgccgccg

SEQ ID NO: 3780494 - RNA, 15 nt, Salmonella typhimurium LT2
cggagaccuuuuuca

SEQ ID NO: 3780495 - RNA, 18 nt, Salmonella typhimurium LT2
cggagagacguucauuuc

SEQ ID NO: 3780496 - RNA, 17 nt, Salmonella typhimurium LT2
cggagagagcaacuggc

SEQ ID NO: 3780497 - RNA, 21 nt, Salmonella typhimurium LT2
cggagauauagaccagcgccg

SEQ ID NO: 3780498 - RNA, 23 nt, Salmonella typhimurium LT2
cggagaugaucguuuccagcauc

SEQ ID NO: 3780499 - RNA, 17 nt, Salmonella typhimurium LT2
cggagauuaacagcgcg

SEQ ID NO: 3780500 - RNA, 23 nt, Salmonella typhimurium LT2
cggagauuaacagcgcgaccagc

SEQ ID NO: 3780501 - RNA, 14 nt, Salmonella typhimurium LT2
cggagcaaaaaacg

SEQ ID NO: 3780502 - RNA, 22 nt, Salmonella typhimurium LT2
cggagcaaaaaacgagaacacc

SEQ ID NO: 3780503 - RNA, 15 nt, Salmonella typhimurium LT2
cggagcaucauuuuc

SEQ ID NO: 3780504 - RNA, 22 nt, Salmonella typhimurium LT2
cggagccugggaucgcaucauc

SEQ ID NO: 3780505 - RNA, 15 nt, Salmonella typhimurium LT2
cggagcggcguccgc

SEQ ID NO: 3780506 - RNA, 17 nt, Salmonella typhimurium LT2
cggagcggcguccgcca

SEQ ID NO: 3780507 - RNA, 15 nt, Salmonella typhimurium LT2
cggaggagugcgcca

SEQ ID NO: 3780508 - RNA, 14 nt, Salmonella typhimurium LT2
cggaggcacugccu

SEQ ID NO: 3780509 - RNA, 19 nt, Salmonella typhimurium LT2
cggaggccagauucaccac

SEQ ID NO: 3780510 - RNA, 16 nt, Salmonella typhimurium LT2
cggaggccuucuuguu

SEQ ID NO: 3780511 - RNA, 15 nt, Salmonella typhimurium LT2
cggaggggcgauggu

SEQ ID NO: 3780512 - RNA, 20 nt, Salmonella typhimurium LT2
cggagguuuucucauccagc

SEQ ID NO: 3780513 - RNA, 22 nt, Salmonella typhimurium LT2
cggaguaaguguagcgccgccu

SEQ ID NO: 3780514 - RNA, 18 nt, Salmonella typhimurium LT2
cggaguagacccacauau

SEQ ID NO: 3780515 - RNA, 22 nt, Salmonella typhimurium LT2
cggaguggccgcaaaugauaau

SEQ ID NO: 3780516 - RNA, 20 nt, Salmonella typhimurium LT2
cggauaaaaacccugccgaa

SEQ ID NO: 3780517 - RNA, 23 nt, Salmonella typhimurium LT2
cggauaaacgccccuucaucagc

SEQ ID NO: 3780518 - RNA, 22 nt, Salmonella typhimurium LT2
cggauaaauagugacgccgcca

SEQ ID NO: 3780519 - RNA, 17 nt, Salmonella typhimurium LT2
cggauaagcgcagcgcc

SEQ ID NO: 3780520 - RNA, 19 nt, Salmonella typhimurium LT2
cggauaagcguaagcgcca

SEQ ID NO: 3780521 - RNA, 20 nt, Salmonella typhimurium LT2
cggauaagcgucagcgccau

SEQ ID NO: 3780522 - RNA, 20 nt, Salmonella typhimurium LT2
cggauaaggcgcagccgcca

SEQ ID NO: 3780523 - RNA, 17 nt, Salmonella typhimurium LT2
cggauaagguguuuacg

SEQ ID NO: 3780524 - RNA, 14 nt, Salmonella typhimurium LT2
cggauaaguaaguu

SEQ ID NO: 3780525 - RNA, 21 nt, Salmonella typhimurium LT2
cggauaagucgcgugaggcgu

SEQ ID NO: 3780526 - RNA, 13 nt, Salmonella typhimurium LT2
cggauacuccugc

SEQ ID NO: 3780527 - RNA, 22 nt, Salmonella typhimurium LT2
cggauacugugucgggccaggc

SEQ ID NO: 3780528 - RNA, 14 nt, Salmonella typhimurium LT2
cggauagcaacgcg

SEQ ID NO: 3780529 - RNA, 23 nt, Salmonella typhimurium LT2
cggauagcuacgauaaagcuggg

SEQ ID NO: 3780530 - RNA, 14 nt, Salmonella typhimurium LT2
cggauauguuugac

SEQ ID NO: 3780531 - RNA, 12 nt, Salmonella typhimurium LT2
cggauauucugc

SEQ ID NO: 3780532 - RNA, 14 nt, Salmonella typhimurium LT2
cggauauuuauacu

SEQ ID NO: 3780533 - RNA, 15 nt, Salmonella typhimurium LT2
cggaucaaaaaggug

SEQ ID NO: 3780534 - RNA, 14 nt, Salmonella typhimurium LT2
cggaucaaucacca

SEQ ID NO: 3780535 - RNA, 15 nt, Salmonella typhimurium LT2
cggaucaaucaccac

SEQ ID NO: 3780536 - RNA, 15 nt, Salmonella typhimurium LT2
cggaucaccggcauu

SEQ ID NO: 3780537 - RNA, 17 nt, Salmonella typhimurium LT2
cggaucacgauauguuu

SEQ ID NO: 3780538 - RNA, 20 nt, Salmonella typhimurium LT2
cggaucagccugagcgccag

SEQ ID NO: 3780539 - RNA, 17 nt, Salmonella typhimurium LT2
cggcaggcagcgccagc

SEQ ID NO: 3780540 - RNA, 20 nt, Salmonella typhimurium LT2
cggcaggccggagcugauac

SEQ ID NO: 3780541 - RNA, 19 nt, Salmonella typhimurium LT2
cggcaggccggcagccugc

SEQ ID NO: 3780542 - RNA, 19 nt, Salmonella typhimurium LT2
cggcaggccuaacacaugc

SEQ ID NO: 3780543 - RNA, 22 nt, Salmonella typhimurium LT2
cggcaggccuaacacaugcaag

SEQ ID NO: 3780544 - RNA, 19 nt, Salmonella typhimurium LT2
cggcaggccuuucggcagc

SEQ ID NO: 3780545 - RNA, 17 nt, Salmonella typhimurium LT2
cggcaggcuggcgguaa

SEQ ID NO: 3780546 - RNA, 19 nt, Salmonella typhimurium LT2
cggcaggcuggcgguaaca

SEQ ID NO: 3780547 - RNA, 22 nt, Salmonella typhimurium LT2
cggcagggauucgcucaccgcg

SEQ ID NO: 3780548 - RNA, 23 nt, Salmonella typhimurium LT2
cggcaggugauggcggcuuggcu

SEQ ID NO: 3780549 - RNA, 16 nt, Salmonella typhimurium LT2
cggcaguaagccagcg

SEQ ID NO: 3780550 - RNA, 20 nt, Salmonella typhimurium LT2
cggcagucacuuucagauuu

SEQ ID NO: 3780551 - RNA, 17 nt, Salmonella typhimurium LT2
cggcaguccgucgagcg

SEQ ID NO: 3780552 - RNA, 12 nt, Salmonella typhimurium LT2
cggcagucgcua

SEQ ID NO: 3780553 - RNA, 21 nt, Salmonella typhimurium LT2
cggcagugccgguugccugau

SEQ ID NO: 3780554 - RNA, 20 nt, Salmonella typhimurium LT2
cggcaguguuucccaacaau

SEQ ID NO: 3780555 - RNA, 14 nt, Salmonella typhimurium LT2
cggcauaagccagc

SEQ ID NO: 3780556 - RNA, 17 nt, Salmonella typhimurium LT2
cggcauaagccagcccu

SEQ ID NO: 3780557 - RNA, 13 nt, Salmonella typhimurium LT2
cggcauaaucagg

SEQ ID NO: 3780558 - RNA, 21 nt, Salmonella typhimurium LT2
cggcauaaucugucgguaaug

SEQ ID NO: 3780559 - RNA, 17 nt, Salmonella typhimurium LT2
cggcauacaccgccagc

SEQ ID NO: 3780560 - RNA, 21 nt, Salmonella typhimurium LT2
cggcauacaccgccagcgucu

SEQ ID NO: 3780561 - RNA, 11 nt, Salmonella typhimurium LT2
cggcauagcug

SEQ ID NO: 3780562 - RNA, 16 nt, Salmonella typhimurium LT2
cggcauauccggcgca

SEQ ID NO: 3780563 - RNA, 21 nt, Salmonella typhimurium LT2
cggcauauggauauucauugc

SEQ ID NO: 3780564 - RNA, 18 nt, Salmonella typhimurium LT2
cggcaucaauaacggcaa

SEQ ID NO: 3780565 - RNA, 22 nt, Salmonella typhimurium LT2
cggcaucacaaaccagacgcgu

SEQ ID NO: 3780566 - RNA, 13 nt, Salmonella typhimurium LT2
cggcaucacgccg

SEQ ID NO: 3780567 - RNA, 14 nt, Salmonella typhimurium LT2
cggcaucagauggc

SEQ ID NO: 3780568 - RNA, 16 nt, Salmonella typhimurium LT2
cggcaucauucugcag

SEQ ID NO: 3780569 - RNA, 15 nt, Salmonella typhimurium LT2
cggcauccaaccgaa

SEQ ID NO: 3780570 - RNA, 14 nt, Salmonella typhimurium LT2
cggcaucgaacggg

SEQ ID NO: 3780571 - RNA, 17 nt, Salmonella typhimurium LT2
cggcaucgcuacggcga

SEQ ID NO: 3780572 - RNA, 15 nt, Salmonella typhimurium LT2
cggcaucggaaccgg

SEQ ID NO: 3780573 - RNA, 14 nt, Salmonella typhimurium LT2
cggcaucucaucuu

SEQ ID NO: 3780574 - RNA, 15 nt, Salmonella typhimurium LT2
cggcaucucuucguu

SEQ ID NO: 3780575 - RNA, 19 nt, Salmonella typhimurium LT2
cggcaucuuuaaccgccug

SEQ ID NO: 3780576 - RNA, 19 nt, Salmonella typhimurium LT2
cggcaugaauugccguggu

SEQ ID NO: 3780577 - RNA, 15 nt, Salmonella typhimurium LT2
cggcaugacaucaga

SEQ ID NO: 3780578 - RNA, 20 nt, Salmonella typhimurium LT2
cggcaugauagggcgccugu

SEQ ID NO: 3780579 - RNA, 20 nt, Salmonella typhimurium LT2
cggcaugaugggcgcacagc

SEQ ID NO: 3780580 - RNA, 19 nt, Salmonella typhimurium LT2
cggcauggcguuauggcaa

SEQ ID NO: 3780581 - RNA, 17 nt, Salmonella typhimurium LT2
cggcauggggucaggug

SEQ ID NO: 3780582 - RNA, 20 nt, Salmonella typhimurium LT2
cggcauggguaaagcccauc

SEQ ID NO: 3780583 - RNA, 15 nt, Salmonella typhimurium LT2
cggcauguccggcga

SEQ ID NO: 3780584 - RNA, 18 nt, Salmonella typhimurium LT2
cggcauguccggcgacuc

SEQ ID NO: 3780585 - RNA, 23 nt, Salmonella typhimurium LT2
cggcauguccggcgacuccagaa

SEQ ID NO: 3780586 - RNA, 18 nt, Salmonella typhimurium LT2
cggcaugucgccagccag

SEQ ID NO: 3780587 - RNA, 16 nt, Salmonella typhimurium LT2
cggcauuaauuucuug

SEQ ID NO: 3780588 - RNA, 22 nt, Salmonella typhimurium LT2
cggcauuggcguuaccggcagg

SEQ ID NO: 3780589 - RNA, 21 nt, Salmonella typhimurium LT2
cggcauuucaccgccaauaac

SEQ ID NO: 3780590 - RNA, 22 nt, Salmonella typhimurium LT2
cggcauuuuuaaugauguaguc

SEQ ID NO: 3780591 - RNA, 19 nt, Salmonella typhimurium LT2
cggccaaaacccaccagca

SEQ ID NO: 3780592 - RNA, 14 nt, Salmonella typhimurium LT2
cggccaaagcgcga

SEQ ID NO: 3780593 - RNA, 19 nt, Salmonella typhimurium LT2
cggccaacuuauccgacgc

SEQ ID NO: 3780594 - RNA, 15 nt, Salmonella typhimurium LT2
cggccacaauugcca

SEQ ID NO: 3780595 - RNA, 14 nt, Salmonella typhimurium LT2
cggccacagcgcca

SEQ ID NO: 3780596 - RNA, 15 nt, Salmonella typhimurium LT2
cggccacaggcgucg

SEQ ID NO: 3780597 - RNA, 15 nt, Salmonella typhimurium LT2
cggccaccaggccug

SEQ ID NO: 3780598 - RNA, 14 nt, Salmonella typhimurium LT2
cggccagcgcaggc

SEQ ID NO: 3780599 - RNA, 16 nt, Salmonella typhimurium LT2
cggccagcgcaggcug

SEQ ID NO: 3780600 - RNA, 20 nt, Salmonella typhimurium LT2
cggccaggcaaagauccacc

SEQ ID NO: 3780601 - RNA, 22 nt, Salmonella typhimurium LT2
cggccaggcaaagauccaccag

SEQ ID NO: 3780602 - RNA, 19 nt, Salmonella typhimurium LT2
cggccaguguacauagcuu

SEQ ID NO: 3780603 - RNA, 18 nt, Salmonella typhimurium LT2
cggccaguugcuucauau

SEQ ID NO: 3780604 - RNA, 23 nt, Salmonella typhimurium LT2
cggccaguugcuucauaucgcca

SEQ ID NO: 3780605 - RNA, 23 nt, Salmonella typhimurium LT2
cggccauaauacgcuugcgccag

SEQ ID NO: 3780606 - RNA, 12 nt, Salmonella typhimurium LT2
cggccauaucca

SEQ ID NO: 3780607 - RNA, 22 nt, Salmonella typhimurium LT2
cggccaucuggcguugccugcu

SEQ ID NO: 3780608 - RNA, 18 nt, Salmonella typhimurium LT2
cggccauugccgcgccga

SEQ ID NO: 3780609 - RNA, 21 nt, Salmonella typhimurium LT2
cggcccacucauccagcaaaa

SEQ ID NO: 3780610 - RNA, 17 nt, Salmonella typhimurium LT2
cggccccaauuugcugu

SEQ ID NO: 3780611 - RNA, 20 nt, Salmonella typhimurium LT2
cggcccgggagaacgccggg

SEQ ID NO: 3780612 - RNA, 19 nt, Salmonella typhimurium LT2
cggcccguacugaacccgg

SEQ ID NO: 3780613 - RNA, 13 nt, Salmonella typhimurium LT2
cggccgaggcagc

SEQ ID NO: 3780614 - RNA, 17 nt, Salmonella typhimurium LT2
cggccgaggcagcggga

SEQ ID NO: 3780615 - RNA, 23 nt, Salmonella typhimurium LT2
cggccgcuaucugcuccgccagc

SEQ ID NO: 3780616 - RNA, 18 nt, Salmonella typhimurium LT2
cggccuaagaccagcacc

SEQ ID NO: 3780617 - RNA, 22 nt, Salmonella typhimurium LT2
cggccuaagaccagcaccaucu

SEQ ID NO: 3780618 - RNA, 15 nt, Salmonella typhimurium LT2
cggccuacaacucag

SEQ ID NO: 3780619 - RNA, 16 nt, Salmonella typhimurium LT2
cggccuacaacucagc

SEQ ID NO: 3780620 - RNA, 19 nt, Salmonella typhimurium LT2
cggccuacaacucagcgua

SEQ ID NO: 3780621 - RNA, 18 nt, Salmonella typhimurium LT2
cggccuacaagccgccuc

SEQ ID NO: 3780622 - RNA, 14 nt, Salmonella typhimurium LT2
cggccuaccgcugg

SEQ ID NO: 3780623 - RNA, 13 nt, Salmonella typhimurium LT2
cggccucccagcu

SEQ ID NO: 3780624 - RNA, 19 nt, Salmonella typhimurium LT2
cggccucgcccgcgaugau

SEQ ID NO: 3780625 - RNA, 22 nt, Salmonella typhimurium LT2
cggccucuuuuuagcagcaaua

SEQ ID NO: 3780626 - RNA, 21 nt, Salmonella typhimurium LT2
cggccugcgcuggaacugauc

SEQ ID NO: 3780627 - RNA, 18 nt, Salmonella typhimurium LT2
cggccugcguuaacggcu

SEQ ID NO: 3780628 - RNA, 14 nt, Salmonella typhimurium LT2
cggccuggcgcagc

SEQ ID NO: 3780629 - RNA, 18 nt, Salmonella typhimurium LT2
cggccuguaaacagaugc

SEQ ID NO: 3780630 - RNA, 18 nt, Salmonella typhimurium LT2
cggccugucuccgcagca

SEQ ID NO: 3780631 - RNA, 19 nt, Salmonella typhimurium LT2
cggccuguuaaugcaauau

SEQ ID NO: 3780632 - RNA, 21 nt, Salmonella typhimurium LT2
cggcgaaaaaccaggcaacag

SEQ ID NO: 3780633 - RNA, 19 nt, Salmonella typhimurium LT2
cggcgaaaagcuggcugac

SEQ ID NO: 3780634 - RNA, 23 nt, Salmonella typhimurium LT2
cggcgaaacgccuuauccggccu

SEQ ID NO: 3780635 - RNA, 15 nt, Salmonella typhimurium LT2
cggcgaaccggcauc

SEQ ID NO: 3780636 - RNA, 20 nt, Salmonella typhimurium LT2
cggcgaacgcgcgcgcuguc

SEQ ID NO: 3780637 - RNA, 18 nt, Salmonella typhimurium LT2
cggcgaacgcuggcuggg

SEQ ID NO: 3780638 - RNA, 21 nt, Salmonella typhimurium LT2
cggcgaacgcuggcuggguaa

SEQ ID NO: 3780639 - RNA, 18 nt, Salmonella typhimurium LT2
cggcgaauuaaucgucga

SEQ ID NO: 3780640 - RNA, 14 nt, Salmonella typhimurium LT2
cggcgacagcgacc

SEQ ID NO: 3780641 - RNA, 14 nt, Salmonella typhimurium LT2
cggcgaccagcaaa

SEQ ID NO: 3780642 - RNA, 21 nt, Salmonella typhimurium LT2
cggcuccggcaaaauggcgau

SEQ ID NO: 3780643 - RNA, 18 nt, Salmonella typhimurium LT2
cggcuccuaccgccgcgu

SEQ ID NO: 3780644 - RNA, 17 nt, Salmonella typhimurium LT2
cggcucgaacuguucug

SEQ ID NO: 3780645 - RNA, 16 nt, Salmonella typhimurium LT2
cggcucgccacggcca

SEQ ID NO: 3780646 - RNA, 22 nt, Salmonella typhimurium LT2
cggcucgccuuugcgcccguac

SEQ ID NO: 3780647 - RNA, 15 nt, Salmonella typhimurium LT2
cggcucgcguugcgu

SEQ ID NO: 3780648 - RNA, 15 nt, Salmonella typhimurium LT2
cggcucgguuuaucc

SEQ ID NO: 3780649 - RNA, 20 nt, Salmonella typhimurium LT2
cggcucgguuuauccccgcu

SEQ ID NO: 3780650 - RNA, 16 nt, Salmonella typhimurium LT2
cggcucugcaucauuc

SEQ ID NO: 3780651 - RNA, 14 nt, Salmonella typhimurium LT2
cggcugaaccaccc

SEQ ID NO: 3780652 - RNA, 13 nt, Salmonella typhimurium LT2
cggcugaagcccc

SEQ ID NO: 3780653 - RNA, 16 nt, Salmonella typhimurium LT2
cggcugaccugaacgc

SEQ ID NO: 3780654 - RNA, 15 nt, Salmonella typhimurium LT2
cggcugacgcgcuau

SEQ ID NO: 3780655 - RNA, 21 nt, Salmonella typhimurium LT2
cggcugaggcuuugagcguca

SEQ ID NO: 3780656 - RNA, 15 nt, Salmonella typhimurium LT2
cggcugaugcagaua

SEQ ID NO: 3780657 - RNA, 22 nt, Salmonella typhimurium LT2
cggcugauggcguuccacccag

SEQ ID NO: 3780658 - RNA, 13 nt, Salmonella typhimurium LT2
cggcugcaaagca

SEQ ID NO: 3780659 - RNA, 17 nt, Salmonella typhimurium LT2
cggcugcaccagcguua

SEQ ID NO: 3780660 - RNA, 17 nt, Salmonella typhimurium LT2
cggcugcaucugcaucu

SEQ ID NO: 3780661 - RNA, 11 nt, Salmonella typhimurium LT2
cggcugccagc

SEQ ID NO: 3780662 - RNA, 13 nt, Salmonella typhimurium LT2
cggcugccgauag

SEQ ID NO: 3780663 - RNA, 16 nt, Salmonella typhimurium LT2
cggcugcgccugcggg

SEQ ID NO: 3780664 - RNA, 20 nt, Salmonella typhimurium LT2
cggcugcgccuuacccggcc

SEQ ID NO: 3780665 - RNA, 24 nt, Salmonella typhimurium LT2
cggcugcgguacgccuugagcaaa

SEQ ID NO: 3780666 - RNA, 21 nt, Salmonella typhimurium LT2
cggcugcuuuuggcggcaaca

SEQ ID NO: 3780667 - RNA, 17 nt, Salmonella typhimurium LT2
cggcuggguuuccggau

SEQ ID NO: 3780668 - RNA, 21 nt, Salmonella typhimurium LT2
cggcugguaagagagccuuau

SEQ ID NO: 3780669 - RNA, 13 nt, Salmonella typhimurium LT2
cggcuguagccag

SEQ ID NO: 3780670 - RNA, 19 nt, Salmonella typhimurium LT2
cggcuguagccagccugaa

SEQ ID NO: 3780671 - RNA, 21 nt, Salmonella typhimurium LT2
cggcuguauguaggguacagc

SEQ ID NO: 3780672 - RNA, 16 nt, Salmonella typhimurium LT2
cggcuguucaccacgu

SEQ ID NO: 3780673 - RNA, 15 nt, Salmonella typhimurium LT2
cggcuuaacgccagu

SEQ ID NO: 3780674 - RNA, 18 nt, Salmonella typhimurium LT2
cggcuuaaugcccggccc

SEQ ID NO: 3780675 - RNA, 22 nt, Salmonella typhimurium LT2
cggcuuacaacauuguuacguu

SEQ ID NO: 3780676 - RNA, 17 nt, Salmonella typhimurium LT2
cggcuuacggcuauucu

SEQ ID NO: 3780677 - RNA, 18 nt, Salmonella typhimurium LT2
cggcuuauccggcuuacg

SEQ ID NO: 3780678 - RNA, 22 nt, Salmonella typhimurium LT2
cggcuuaucguuaaggccugcg

SEQ ID NO: 3780679 - RNA, 14 nt, Salmonella typhimurium LT2
cggcuucagcgaca

SEQ ID NO: 3780680 - RNA, 16 nt, Salmonella typhimurium LT2
cggcuucagcggcgca

SEQ ID NO: 3780681 - RNA, 14 nt, Salmonella typhimurium LT2
cggcuuccggcagc

SEQ ID NO: 3780682 - RNA, 23 nt, Salmonella typhimurium LT2
cggcuuccguuuuguugccgccc

SEQ ID NO: 3780683 - RNA, 20 nt, Salmonella typhimurium LT2
cggcuucuuccggccccggg

SEQ ID NO: 3780684 - RNA, 14 nt, Salmonella typhimurium LT2
cggcuugccuucau

SEQ ID NO: 3780685 - RNA, 23 nt, Salmonella typhimurium LT2
cggcuugucauccuguucaucca

SEQ ID NO: 3780686 - RNA, 15 nt, Salmonella typhimurium LT2
cggcuuucaucauuc

SEQ ID NO: 3780687 - RNA, 16 nt, Salmonella typhimurium LT2
cggcuuuccgcaccgc

SEQ ID NO: 3780688 - RNA, 21 nt, Salmonella typhimurium LT2
cggcuuucgggaucgccauca

SEQ ID NO: 3780689 - RNA, 21 nt, Salmonella typhimurium LT2
cggcuuucuguuccgaaauaa

SEQ ID NO: 3780690 - RNA, 21 nt, Salmonella typhimurium LT2
cggcuuuugguuccuucagcu

SEQ ID NO: 3780691 - RNA, 23 nt, Salmonella typhimurium LT2
cggcuuuuugcuuuuuauagcuc

SEQ ID NO: 3780692 - RNA, 22 nt, Salmonella typhimurium LT2
cgggaaaacggccagugaaaua

SEQ ID NO: 3780693 - RNA, 22 nt, Salmonella typhimurium LT2
cgggaaaaggaccacaagcugu

SEQ ID NO: 3780694 - RNA, 20 nt, Salmonella typhimurium LT2
cgggaaaagguuccggcgau

SEQ ID NO: 3780695 - RNA, 21 nt, Salmonella typhimurium LT2
cgggaaaaucagugaacaccc

SEQ ID NO: 3780696 - RNA, 19 nt, Salmonella typhimurium LT2
cgggaaacucgccgccaug

SEQ ID NO: 3780697 - RNA, 19 nt, Salmonella typhimurium LT2
cgggaaagugguuaacagc

SEQ ID NO: 3780698 - RNA, 15 nt, Salmonella typhimurium LT2
cgggaacagauaaau

SEQ ID NO: 3780699 - RNA, 22 nt, Salmonella typhimurium LT2
cgggaagaugugccacuccgcc

SEQ ID NO: 3780700 - RNA, 15 nt, Salmonella typhimurium LT2
cgggaaguccuucuc

SEQ ID NO: 3780701 - RNA, 17 nt, Salmonella typhimurium LT2
cgggacaaacccccagc

SEQ ID NO: 3780702 - RNA, 21 nt, Salmonella typhimurium LT2
cgggacaaacccccagccauu

SEQ ID NO: 3780703 - RNA, 16 nt, Salmonella typhimurium LT2
cgggacggcggucgcu

SEQ ID NO: 3780704 - RNA, 22 nt, Salmonella typhimurium LT2
cgggagagcguauccagcaccu

SEQ ID NO: 3780705 - RNA, 19 nt, Salmonella typhimurium LT2
cgggagauuuccggcacca

SEQ ID NO: 3780706 - RNA, 20 nt, Salmonella typhimurium LT2
cgggagcaugaucggccaga

SEQ ID NO: 3780707 - RNA, 12 nt, Salmonella typhimurium LT2
cgggagcuugcc

SEQ ID NO: 3780708 - RNA, 23 nt, Salmonella typhimurium LT2
cgggauaaaacaccacaaagucg

SEQ ID NO: 3780709 - RNA, 13 nt, Salmonella typhimurium LT2
cgggauacggcga

SEQ ID NO: 3780710 - RNA, 19 nt, Salmonella typhimurium LT2
cgggauacggcgagaccau

SEQ ID NO: 3780711 - RNA, 16 nt, Salmonella typhimurium LT2
cgggauagccuuccac

SEQ ID NO: 3780712 - RNA, 23 nt, Salmonella typhimurium LT2
cgggaucagcggcugcaaagcau

SEQ ID NO: 3780713 - RNA, 16 nt, Salmonella typhimurium LT2
cgggauccugcaaaau

SEQ ID NO: 3780714 - RNA, 15 nt, Salmonella typhimurium LT2
cgggaucgaaccgcc

SEQ ID NO: 3780715 - RNA, 16 nt, Salmonella typhimurium LT2
cgggaucgaaccgccg

SEQ ID NO: 3780716 - RNA, 22 nt, Salmonella typhimurium LT2
cgggaucgccagaucgaacagc

SEQ ID NO: 3780717 - RNA, 17 nt, Salmonella typhimurium LT2
cgggaugggaacacagc

SEQ ID NO: 3780718 - RNA, 15 nt, Salmonella typhimurium LT2
cgggaugguuaaauu

SEQ ID NO: 3780719 - RNA, 20 nt, Salmonella typhimurium LT2
cgggaugguuaaauucauau

SEQ ID NO: 3780720 - RNA, 18 nt, Salmonella typhimurium LT2
cgggaugucaucggucau

SEQ ID NO: 3780721 - RNA, 18 nt, Salmonella typhimurium LT2
cgggauuggaucgacgcu

SEQ ID NO: 3780722 - RNA, 19 nt, Salmonella typhimurium LT2
cgggauuguauaccgcuuu

SEQ ID NO: 3780723 - RNA, 16 nt, Salmonella typhimurium LT2
cgggcaaaaugcgucg

SEQ ID NO: 3780724 - RNA, 15 nt, Salmonella typhimurium LT2
cgggcaaacagcacu

SEQ ID NO: 3780725 - RNA, 14 nt, Salmonella typhimurium LT2
cgggcaacacacgc

SEQ ID NO: 3780726 - RNA, 15 nt, Salmonella typhimurium LT2
cgggcaaugccacca

SEQ ID NO: 3780727 - RNA, 21 nt, Salmonella typhimurium LT2
cgggcaaugccaccagcgcca

SEQ ID NO: 3780728 - RNA, 14 nt, Salmonella typhimurium LT2
cgggcaauuucucg

SEQ ID NO: 3780729 - RNA, 15 nt, Salmonella typhimurium LT2
cgggcacgcugacca

SEQ ID NO: 3780730 - RNA, 23 nt, Salmonella typhimurium LT2
cgggcacuccggcucgcacauau

SEQ ID NO: 3780731 - RNA, 13 nt, Salmonella typhimurium LT2
cgggcagacgacc

SEQ ID NO: 3780732 - RNA, 18 nt, Salmonella typhimurium LT2
cgggcauacucuccucca

SEQ ID NO: 3780733 - RNA, 18 nt, Salmonella typhimurium LT2
cgggcauucaguuugcaa

SEQ ID NO: 3780734 - RNA, 14 nt, Salmonella typhimurium LT2
cgggccagacgcuu

SEQ ID NO: 3780735 - RNA, 19 nt, Salmonella typhimurium LT2
cgggcccguugccuggcga

SEQ ID NO: 3780736 - RNA, 18 nt, Salmonella typhimurium LT2
cgggccgaaaucccggag

SEQ ID NO: 3780737 - RNA, 19 nt, Salmonella typhimurium LT2
cgggccgccaucuccggca

SEQ ID NO: 3780738 - RNA, 13 nt, Salmonella typhimurium LT2
cgggccgcgcugc

SEQ ID NO: 3780739 - RNA, 13 nt, Salmonella typhimurium LT2
cgggccgcggcgc

SEQ ID NO: 3780740 - RNA, 21 nt, Salmonella typhimurium LT2
cgggccguaaaguucccagcg

SEQ ID NO: 3780741 - RNA, 20 nt, Salmonella typhimurium LT2
cgggccguugcugcgcaacg

SEQ ID NO: 3780742 - RNA, 15 nt, Salmonella typhimurium LT2
cgggccugagcgcgc

SEQ ID NO: 3780743 - RNA, 20 nt, Salmonella typhimurium LT2
cgggccugauaagcacaggc

SEQ ID NO: 3780744 - RNA, 21 nt, Salmonella typhimurium LT2
cgggccugauaagcacaggcc

SEQ ID NO: 3780745 - RNA, 22 nt, Salmonella typhimurium LT2
cgguaucaaugcgacagcggca

SEQ ID NO: 3780746 - RNA, 19 nt, Salmonella typhimurium LT2
cgguaugaaggaccaacaa

SEQ ID NO: 3780747 - RNA, 15 nt, Salmonella typhimurium LT2
cgguaugccuuccag

SEQ ID NO: 3780748 - RNA, 22 nt, Salmonella typhimurium LT2
cgguauuaagccuuuuuaaaua

SEQ ID NO: 3780749 - RNA, 15 nt, Salmonella typhimurium LT2
cgguauuauccgccg

SEQ ID NO: 3780750 - RNA, 19 nt, Salmonella typhimurium LT2
cgguauuccaucaaaagcu

SEQ ID NO: 3780751 - RNA, 18 nt, Salmonella typhimurium LT2
cgguauuuauccagcagg

SEQ ID NO: 3780752 - RNA, 20 nt, Salmonella typhimurium LT2
cgguauuuuucaccucacuc

SEQ ID NO: 3780753 - RNA, 22 nt, Salmonella typhimurium LT2
cggucaaacagauccagcgccg

SEQ ID NO: 3780754 - RNA, 20 nt, Salmonella typhimurium LT2
cggucaacugaauuucaucc

SEQ ID NO: 3780755 - RNA, 15 nt, Salmonella typhimurium LT2
cggucaauacaucac

SEQ ID NO: 3780756 - RNA, 16 nt, Salmonella typhimurium LT2
cggucaauacaucacg

SEQ ID NO: 3780757 - RNA, 15 nt, Salmonella typhimurium LT2
cggucaaucaucaga

SEQ ID NO: 3780758 - RNA, 16 nt, Salmonella typhimurium LT2
cggucaaucaucagaa

SEQ ID NO: 3780759 - RNA, 13 nt, Salmonella typhimurium LT2
cggucacccggca

SEQ ID NO: 3780760 - RNA, 12 nt, Salmonella typhimurium LT2
cggucacgcgau

SEQ ID NO: 3780761 - RNA, 14 nt, Salmonella typhimurium LT2
cggucagauaaaua

SEQ ID NO: 3780762 - RNA, 17 nt, Salmonella typhimurium LT2
cggucagauuaaucagg

SEQ ID NO: 3780763 - RNA, 19 nt, Salmonella typhimurium LT2
cggucagcacagcgaugau

SEQ ID NO: 3780764 - RNA, 22 nt, Salmonella typhimurium LT2
cggucagcggcgcgccgcucga

SEQ ID NO: 3780765 - RNA, 23 nt, Salmonella typhimurium LT2
cggucagggcuuacucccuggug

SEQ ID NO: 3780766 - RNA, 22 nt, Salmonella typhimurium LT2
cggucaggguaauagagggcgc

SEQ ID NO: 3780767 - RNA, 14 nt, Salmonella typhimurium LT2
cggucaguuugccc

SEQ ID NO: 3780768 - RNA, 17 nt, Salmonella typhimurium LT2
cggucauaaccggccga

SEQ ID NO: 3780769 - RNA, 15 nt, Salmonella typhimurium LT2
cggucauccagcggu

SEQ ID NO: 3780770 - RNA, 17 nt, Salmonella typhimurium LT2
cggucauguuccaacaa

SEQ ID NO: 3780771 - RNA, 18 nt, Salmonella typhimurium LT2
cggucauuaauccccggc

SEQ ID NO: 3780772 - RNA, 22 nt, Salmonella typhimurium LT2
cggucauucauugucuuuuucu

SEQ ID NO: 3780773 - RNA, 15 nt, Salmonella typhimurium LT2
cgguccacaggccgu

SEQ ID NO: 3780774 - RNA, 15 nt, Salmonella typhimurium LT2
cggucgacaccagcg

SEQ ID NO: 3780775 - RNA, 19 nt, Salmonella typhimurium LT2
cggucgacaccagcgauaa

SEQ ID NO: 3780776 - RNA, 17 nt, Salmonella typhimurium LT2
cggucgccugccgcaug

SEQ ID NO: 3780777 - RNA, 16 nt, Salmonella typhimurium LT2
cggucgcuucaaucgu

SEQ ID NO: 3780778 - RNA, 23 nt, Salmonella typhimurium LT2
cggucguaaacacgacgccgccg

SEQ ID NO: 3780779 - RNA, 23 nt, Salmonella typhimurium LT2
cggucuccagcaacagcgcgucc

SEQ ID NO: 3780780 - RNA, 20 nt, Salmonella typhimurium LT2
cggucuccugaacgcccggc

SEQ ID NO: 3780781 - RNA, 19 nt, Salmonella typhimurium LT2
cggucuggaugcguucaaa

SEQ ID NO: 3780782 - RNA, 13 nt, Salmonella typhimurium LT2
cggucuucaacac

SEQ ID NO: 3780783 - RNA, 15 nt, Salmonella typhimurium LT2
cggucuuucaacaua

SEQ ID NO: 3780784 - RNA, 22 nt, Salmonella typhimurium LT2
cggugacgauacggcccagacc

SEQ ID NO: 3780785 - RNA, 17 nt, Salmonella typhimurium LT2
cggugacggaaaccagc

SEQ ID NO: 3780786 - RNA, 17 nt, Salmonella typhimurium LT2
cggugagaaacgcgcca

SEQ ID NO: 3780787 - RNA, 14 nt, Salmonella typhimurium LT2
cggugagcgccgcg

SEQ ID NO: 3780788 - RNA, 15 nt, Salmonella typhimurium LT2
cggugaggggggauu

SEQ ID NO: 3780789 - RNA, 24 nt, Salmonella typhimurium LT2
cggugauauuuuagccaucccggc

SEQ ID NO: 3780790 - RNA, 13 nt, Salmonella typhimurium LT2
cggugaucccagg

SEQ ID NO: 3780791 - RNA, 21 nt, Salmonella typhimurium LT2
cggugaucccaggccggcaua

SEQ ID NO: 3780792 - RNA, 20 nt, Salmonella typhimurium LT2
cggugauccuccugcagacu

SEQ ID NO: 3780793 - RNA, 23 nt, Salmonella typhimurium LT2
cggugaugacuaaaucagcaucc

SEQ ID NO: 3780794 - RNA, 23 nt, Salmonella typhimurium LT2
cggugaugaucaauaacgccggu

SEQ ID NO: 3780795 - RNA, 19 nt, Salmonella typhimurium LT2
cggugccauuccagccggu

SEQ ID NO: 3780796 - RNA, 14 nt, Salmonella typhimurium LT2
cggugccugccgcc

SEQ ID NO: 3780797 - RNA, 22 nt, Salmonella typhimurium LT2
cggugcgagaaaaagcaauaau

SEQ ID NO: 3780798 - RNA, 17 nt, Salmonella typhimurium LT2
cggugcggcaagcgcgc

SEQ ID NO: 3780799 - RNA, 21 nt, Salmonella typhimurium LT2
cggugcgguuacguccggcau

SEQ ID NO: 3780800 - RNA, 17 nt, Salmonella typhimurium LT2
cggugcguuuaaagaga

SEQ ID NO: 3780801 - RNA, 17 nt, Salmonella typhimurium LT2
cggugcguuucaucuac

SEQ ID NO: 3780802 - RNA, 16 nt, Salmonella typhimurium LT2
cggugcucaauaaaag

SEQ ID NO: 3780803 - RNA, 14 nt, Salmonella typhimurium LT2
cggugcucuuuugu

SEQ ID NO: 3780804 - RNA, 20 nt, Salmonella typhimurium LT2
cggugcuguagcugcccgga

SEQ ID NO: 3780805 - RNA, 23 nt, Salmonella typhimurium LT2
cgguggauacguucgaacgacuc

SEQ ID NO: 3780806 - RNA, 14 nt, Salmonella typhimurium LT2
cgguggcgaaaacg

SEQ ID NO: 3780807 - RNA, 13 nt, Salmonella typhimurium LT2
cgguggcgcuggc

SEQ ID NO: 3780808 - RNA, 18 nt, Salmonella typhimurium LT2
cgguggguagcggcaauu

SEQ ID NO: 3780809 - RNA, 16 nt, Salmonella typhimurium LT2
cgguggucaucgcggc

SEQ ID NO: 3780810 - RNA, 17 nt, Salmonella typhimurium LT2
cgguguaaacaggcuuc

SEQ ID NO: 3780811 - RNA, 14 nt, Salmonella typhimurium LT2
cgguguaccccgcc

SEQ ID NO: 3780812 - RNA, 14 nt, Salmonella typhimurium LT2
cggugucagacacc

SEQ ID NO: 3780813 - RNA, 16 nt, Salmonella typhimurium LT2
cgguguggcccagcgc

SEQ ID NO: 3780814 - RNA, 16 nt, Salmonella typhimurium LT2
cgguguuaaccagaua

SEQ ID NO: 3780815 - RNA, 11 nt, Salmonella typhimurium LT2
cgguuaacaua

SEQ ID NO: 3780816 - RNA, 17 nt, Salmonella typhimurium LT2
cgguuacguucggcaaa

SEQ ID NO: 3780817 - RNA, 20 nt, Salmonella typhimurium LT2
cgguuaucuggcgcaaccgg

SEQ ID NO: 3780818 - RNA, 17 nt, Salmonella typhimurium LT2
cgguucagucagcgcga

SEQ ID NO: 3780819 - RNA, 13 nt, Salmonella typhimurium LT2
cgguucauccugc

SEQ ID NO: 3780820 - RNA, 15 nt, Salmonella typhimurium LT2
cgguuccaacagcga

SEQ ID NO: 3780821 - RNA, 14 nt, Salmonella typhimurium LT2
cgguucgccgcgcg

SEQ ID NO: 3780822 - RNA, 16 nt, Salmonella typhimurium LT2
cgguucugggcaguuu

SEQ ID NO: 3780823 - RNA, 15 nt, Salmonella typhimurium LT2
cgguucuucccacuc

SEQ ID NO: 3780824 - RNA, 20 nt, Salmonella typhimurium LT2
cgguugacggcuacuccggc

SEQ ID NO: 3780825 - RNA, 15 nt, Salmonella typhimurium LT2
cgguugcaauuccgc

SEQ ID NO: 3780826 - RNA, 16 nt, Salmonella typhimurium LT2
cgguugccaaugcgga

SEQ ID NO: 3780827 - RNA, 15 nt, Salmonella typhimurium LT2
cgguugccugcguca

SEQ ID NO: 3780828 - RNA, 18 nt, Salmonella typhimurium LT2
cgguugccuuucgccagc

SEQ ID NO: 3780829 - RNA, 19 nt, Salmonella typhimurium LT2
cgguuggaucucaccacug

SEQ ID NO: 3780830 - RNA, 22 nt, Salmonella typhimurium LT2
cgguugucaaauuugcugccau

SEQ ID NO: 3780831 - RNA, 16 nt, Salmonella typhimurium LT2
cgguuguuuuucagau

SEQ ID NO: 3780832 - RNA, 15 nt, Salmonella typhimurium LT2
cgguuuaagccgcug

SEQ ID NO: 3780833 - RNA, 15 nt, Salmonella typhimurium LT2
cgguuuaagcggaua

SEQ ID NO: 3780834 - RNA, 13 nt, Salmonella typhimurium LT2
cgguuuacgccau

SEQ ID NO: 3780835 - RNA, 16 nt, Salmonella typhimurium LT2
cgguuuagccgccaga

SEQ ID NO: 3780836 - RNA, 19 nt, Salmonella typhimurium LT2
cgguuuauaccgaaacagu

SEQ ID NO: 3780837 - RNA, 13 nt, Salmonella typhimurium LT2
cgguuucaggcca

SEQ ID NO: 3780838 - RNA, 14 nt, Salmonella typhimurium LT2
cgguuuccauggca

SEQ ID NO: 3780839 - RNA, 21 nt, Salmonella typhimurium LT2
cgguuucuacuuccaccaccu

SEQ ID NO: 3780840 - RNA, 21 nt, Salmonella typhimurium LT2
cgguuuuauccccuucaggaa

SEQ ID NO: 3780841 - RNA, 21 nt, Salmonella typhimurium LT2
cgguuuuauuaacgugcugcc

SEQ ID NO: 3780842 - RNA, 17 nt, Salmonella typhimurium LT2
cguaaaaaaacaucaua

SEQ ID NO: 3780843 - RNA, 22 nt, Salmonella typhimurium LT2
cguaaaaauuguuccuguaaag

SEQ ID NO: 3780844 - RNA, 14 nt, Salmonella typhimurium LT2
cguaaaaccgcgcu

SEQ ID NO: 3780845 - RNA, 15 nt, Salmonella typhimurium LT2
cguaaaacuuuucug

SEQ ID NO: 3780846 - RNA, 19 nt, Salmonella typhimurium LT2
cguaaaagcgauaaagaca

SEQ ID NO: 3780847 - RNA, 13 nt, Salmonella typhimurium LT2
cguaaacaaugga

SEQ ID NO: 3780848 - RNA, 16 nt, Salmonella typhimurium LT2
cguaaacacguuaucu

SEQ ID NO: 3780849 - RNA, 15 nt, Salmonella typhimurium LT2
cguaguggcauggca

SEQ ID NO: 3780850 - RNA, 15 nt, Salmonella typhimurium LT2
cguauaauccagcuu

SEQ ID NO: 3780851 - RNA, 23 nt, Salmonella typhimurium LT2
cguauaccagcgucagcgggcca

SEQ ID NO: 3780852 - RNA, 23 nt, Salmonella typhimurium LT2
cguauccauucucaucagaccgu

SEQ ID NO: 3780853 - RNA, 19 nt, Salmonella typhimurium LT2
cguauccccagucuuccug

SEQ ID NO: 3780854 - RNA, 20 nt, Salmonella typhimurium LT2
cguauccccagucuuccugc

SEQ ID NO: 3780855 - RNA, 20 nt, Salmonella typhimurium LT2
cguaucggugcguuuaaaga

SEQ ID NO: 3780856 - RNA, 22 nt, Salmonella typhimurium LT2
cguaugacguggccagcaugcc

SEQ ID NO: 3780857 - RNA, 14 nt, Salmonella typhimurium LT2
cguaugcagccagg

SEQ ID NO: 3780858 - RNA, 19 nt, Salmonella typhimurium LT2
cguaugcugauaaagagca

SEQ ID NO: 3780859 - RNA, 14 nt, Salmonella typhimurium LT2
cguauuagcaaauc

SEQ ID NO: 3780860 - RNA, 19 nt, Salmonella typhimurium LT2
cguauuccacggaauacga

SEQ ID NO: 3780861 - RNA, 12 nt, Salmonella typhimurium LT2
cguauucccccu

SEQ ID NO: 3780862 - RNA, 17 nt, Salmonella typhimurium LT2
cguauucggaauaaugu

SEQ ID NO: 3780863 - RNA, 22 nt, Salmonella typhimurium LT2
cguauucuuugcgccuuauuca

SEQ ID NO: 3780864 - RNA, 17 nt, Salmonella typhimurium LT2
cguauugagcagcggcu

SEQ ID NO: 3780865 - RNA, 17 nt, Salmonella typhimurium LT2
cguauuucacuuuugcc

SEQ ID NO: 3780866 - RNA, 16 nt, Salmonella typhimurium LT2
cgucaaaaauaaaaaa

SEQ ID NO: 3780867 - RNA, 16 nt, Salmonella typhimurium LT2
cgucaaaacagauucc

SEQ ID NO: 3780868 - RNA, 18 nt, Salmonella typhimurium LT2
cgucaaaaccaaacagcg

SEQ ID NO: 3780869 - RNA, 20 nt, Salmonella typhimurium LT2
cgucaaaauaagcaccggcg

SEQ ID NO: 3780870 - RNA, 17 nt, Salmonella typhimurium LT2
cgucaaacaguucagac

SEQ ID NO: 3780871 - RNA, 19 nt, Salmonella typhimurium LT2
cgucaaagaguuccugugc

SEQ ID NO: 3780872 - RNA, 19 nt, Salmonella typhimurium LT2
cgucaacaccugcaucacg

SEQ ID NO: 3780873 - RNA, 14 nt, Salmonella typhimurium LT2
cgucaacgaccaga

SEQ ID NO: 3780874 - RNA, 17 nt, Salmonella typhimurium LT2
cgucaacggcgcggcgu

SEQ ID NO: 3780875 - RNA, 12 nt, Salmonella typhimurium LT2
cgucaagacgcu

SEQ ID NO: 3780876 - RNA, 14 nt, Salmonella typhimurium LT2
cgucaagaucgcgc

SEQ ID NO: 3780877 - RNA, 19 nt, Salmonella typhimurium LT2
cgucaauaaagccgcccau

SEQ ID NO: 3780878 - RNA, 13 nt, Salmonella typhimurium LT2
cgucaauaacagg

SEQ ID NO: 3780879 - RNA, 15 nt, Salmonella typhimurium LT2
cgucaaugcccggca

SEQ ID NO: 3780880 - RNA, 17 nt, Salmonella typhimurium LT2
cgucaaugcccggcagu

SEQ ID NO: 3780881 - RNA, 18 nt, Salmonella typhimurium LT2
cgucaaugccgggcagac

SEQ ID NO: 3780882 - RNA, 15 nt, Salmonella typhimurium LT2
cgucaaugcugcuuu

SEQ ID NO: 3780883 - RNA, 16 nt, Salmonella typhimurium LT2
cgucaauuuccucgac

SEQ ID NO: 3780884 - RNA, 21 nt, Salmonella typhimurium LT2
cgucacaauaucgagaugacc

SEQ ID NO: 3780885 - RNA, 13 nt, Salmonella typhimurium LT2
cgucacaaucgcg

SEQ ID NO: 3780886 - RNA, 22 nt, Salmonella typhimurium LT2
cgucacaggcuucgacaaacag

SEQ ID NO: 3780887 - RNA, 18 nt, Salmonella typhimurium LT2
cgucaccaccgcaggcag

SEQ ID NO: 3780888 - RNA, 20 nt, Salmonella typhimurium LT2
cgucaccaccgcaggcagcg

SEQ ID NO: 3780889 - RNA, 15 nt, Salmonella typhimurium LT2
cgucaccacgcgcac

SEQ ID NO: 3780890 - RNA, 23 nt, Salmonella typhimurium LT2
cgucaccacgguguaccccgccu

SEQ ID NO: 3780891 - RNA, 17 nt, Salmonella typhimurium LT2
cgucaccaucagcguca

SEQ ID NO: 3780892 - RNA, 15 nt, Salmonella typhimurium LT2
cgucaccgaauagcg

SEQ ID NO: 3780893 - RNA, 13 nt, Salmonella typhimurium LT2
cgucaccgccagu

SEQ ID NO: 3780894 - RNA, 15 nt, Salmonella typhimurium LT2
cgucaccgccgcgcu

SEQ ID NO: 3780895 - RNA, 15 nt, Salmonella typhimurium LT2
cgucaccgggcugca

SEQ ID NO: 3780896 - RNA, 18 nt, Salmonella typhimurium LT2
cgucaccugauagcgggu

SEQ ID NO: 3780897 - RNA, 19 nt, Salmonella typhimurium LT2
cgucacgaaugucgcguca

SEQ ID NO: 3780898 - RNA, 12 nt, Salmonella typhimurium LT2
cgucacgaccgg

SEQ ID NO: 3780899 - RNA, 21 nt, Salmonella typhimurium LT2
cgucacgccuucauagagaag

SEQ ID NO: 3780900 - RNA, 18 nt, Salmonella typhimurium LT2
cgucacgcguucgaccgu

SEQ ID NO: 3780901 - RNA, 19 nt, Salmonella typhimurium LT2
cgucacgguuuauccccgc

SEQ ID NO: 3780902 - RNA, 21 nt, Salmonella typhimurium LT2
cgucacgguuuauccccgcug

SEQ ID NO: 3780903 - RNA, 16 nt, Salmonella typhimurium LT2
cgucacgucagcgucg

SEQ ID NO: 3780904 - RNA, 14 nt, Salmonella typhimurium LT2
cgucacucacauuc

SEQ ID NO: 3780905 - RNA, 18 nt, Salmonella typhimurium LT2
cgucacugucagcaucag

SEQ ID NO: 3780906 - RNA, 15 nt, Salmonella typhimurium LT2
cgucagaaauccgcg

SEQ ID NO: 3780907 - RNA, 22 nt, Salmonella typhimurium LT2
cgucagacggcuccagcgccag

SEQ ID NO: 3780908 - RNA, 11 nt, Salmonella typhimurium LT2
cgucagauucu

SEQ ID NO: 3780909 - RNA, 15 nt, Salmonella typhimurium LT2
cgucagcaacaccac

SEQ ID NO: 3780910 - RNA, 22 nt, Salmonella typhimurium LT2
cgucagcaacaccaccgcccgc

SEQ ID NO: 3780911 - RNA, 24 nt, Salmonella typhimurium LT2
cgucagcacuucccacuguaaauu

SEQ ID NO: 3780912 - RNA, 13 nt, Salmonella typhimurium LT2
cgucagcauggua

SEQ ID NO: 3780913 - RNA, 13 nt, Salmonella typhimurium LT2
cgucagccgccau

SEQ ID NO: 3780914 - RNA, 21 nt, Salmonella typhimurium LT2
cgucagcgauacgcacaucaa

SEQ ID NO: 3780915 - RNA, 17 nt, Salmonella typhimurium LT2
cgucagcgccauccggc

SEQ ID NO: 3780916 - RNA, 15 nt, Salmonella typhimurium LT2
cgucagcgccuccgc

SEQ ID NO: 3780917 - RNA, 15 nt, Salmonella typhimurium LT2
cgucagcggcugcua

SEQ ID NO: 3780918 - RNA, 20 nt, Salmonella typhimurium LT2
cgucagcguuuccggcgcuu

SEQ ID NO: 3780919 - RNA, 16 nt, Salmonella typhimurium LT2
cgucaggcgaagcucc

SEQ ID NO: 3780920 - RNA, 14 nt, Salmonella typhimurium LT2
cgucaggcgauagc

SEQ ID NO: 3780921 - RNA, 15 nt, Salmonella typhimurium LT2
cgucaggguuaucgu

SEQ ID NO: 3780922 - RNA, 20 nt, Salmonella typhimurium LT2
cgucagguuuaaucggcgug

SEQ ID NO: 3780923 - RNA, 19 nt, Salmonella typhimurium LT2
cgucagguuuuuugugagu

SEQ ID NO: 3780924 - RNA, 21 nt, Salmonella typhimurium LT2
cgucagugagcccuccuccag

SEQ ID NO: 3780925 - RNA, 15 nt, Salmonella typhimurium LT2
cgucauaacgcgcau

SEQ ID NO: 3780926 - RNA, 16 nt, Salmonella typhimurium LT2
cgucauauugccgccu

SEQ ID NO: 3780927 - RNA, 17 nt, Salmonella typhimurium LT2
cgucaucagauaggcgg

SEQ ID NO: 3780928 - RNA, 12 nt, Salmonella typhimurium LT2
cgucaucccggu

SEQ ID NO: 3780929 - RNA, 19 nt, Salmonella typhimurium LT2
cgucauccgcguaaucgcg

SEQ ID NO: 3780930 - RNA, 13 nt, Salmonella typhimurium LT2
cgucauccugcaa

SEQ ID NO: 3780931 - RNA, 21 nt, Salmonella typhimurium LT2
cgucaucgcucaucucaagcc

SEQ ID NO: 3780932 - RNA, 17 nt, Salmonella typhimurium LT2
cgucaucggcgcgcugg

SEQ ID NO: 3780933 - RNA, 16 nt, Salmonella typhimurium LT2
cgucaucgggcuguua

SEQ ID NO: 3780934 - RNA, 13 nt, Salmonella typhimurium LT2
cgucaugccgcca

SEQ ID NO: 3780935 - RNA, 15 nt, Salmonella typhimurium LT2
cgucaugcucgcuuu

SEQ ID NO: 3780936 - RNA, 18 nt, Salmonella typhimurium LT2
cgucaugcucgcuuucca

SEQ ID NO: 3780937 - RNA, 16 nt, Salmonella typhimurium LT2
cgucauuaaagcgcuc

SEQ ID NO: 3780938 - RNA, 13 nt, Salmonella typhimurium LT2
cgucauuacggua

SEQ ID NO: 3780939 - RNA, 22 nt, Salmonella typhimurium LT2
cguccaacuggcuuucauccaa

SEQ ID NO: 3780940 - RNA, 15 nt, Salmonella typhimurium LT2
cguccacaccuucca

SEQ ID NO: 3780941 - RNA, 15 nt, Salmonella typhimurium LT2
cguccacauccccgc

SEQ ID NO: 3780942 - RNA, 18 nt, Salmonella typhimurium LT2
cguccaccagcacaggcg

SEQ ID NO: 3780943 - RNA, 15 nt, Salmonella typhimurium LT2
cguccagacuccuuu

SEQ ID NO: 3780944 - RNA, 14 nt, Salmonella typhimurium LT2
cguccagacucugc

SEQ ID NO: 3780945 - RNA, 13 nt, Salmonella typhimurium LT2
cguccagcccggc

SEQ ID NO: 3780946 - RNA, 16 nt, Salmonella typhimurium LT2
cguccagcccggcgga

SEQ ID NO: 3780947 - RNA, 12 nt, Salmonella typhimurium LT2
cguccaggcucg

SEQ ID NO: 3780948 - RNA, 14 nt, Salmonella typhimurium LT2
cguccagggugaac

SEQ ID NO: 3780949 - RNA, 19 nt, Salmonella typhimurium LT2
cguccaguccugccccugc

SEQ ID NO: 3780950 - RNA, 16 nt, Salmonella typhimurium LT2
cguccauaagcgcggc

SEQ ID NO: 3780951 - RNA, 14 nt, Salmonella typhimurium LT2
cguccauccgggua

SEQ ID NO: 3780952 - RNA, 16 nt, Salmonella typhimurium LT2
cguccauuacucucau

SEQ ID NO: 3780953 - RNA, 22 nt, Salmonella typhimurium LT2
cgucccacaugaacucgacuuu

SEQ ID NO: 3780954 - RNA, 21 nt, Salmonella typhimurium LT2
cguuauaaggccugccguccu

SEQ ID NO: 3780955 - RNA, 19 nt, Salmonella typhimurium LT2
cguuauacaucgcuuucca

SEQ ID NO: 3780956 - RNA, 20 nt, Salmonella typhimurium LT2
cguuaucaaaaaaaaccaga

SEQ ID NO: 3780957 - RNA, 15 nt, Salmonella typhimurium LT2
cguuauccagcagcc

SEQ ID NO: 3780958 - RNA, 21 nt, Salmonella typhimurium LT2
cguuaucgggaugccagaucu

SEQ ID NO: 3780959 - RNA, 16 nt, Salmonella typhimurium LT2
cguuaucuguaauuga

SEQ ID NO: 3780960 - RNA, 16 nt, Salmonella typhimurium LT2
cguuauucuccaggcu

SEQ ID NO: 3780961 - RNA, 18 nt, Salmonella typhimurium LT2
cguuauugaccaucgcca

SEQ ID NO: 3780962 - RNA, 20 nt, Salmonella typhimurium LT2
cguuauugaccaucgccagc

SEQ ID NO: 3780963 - RNA, 13 nt, Salmonella typhimurium LT2
cguucaaaucgca

SEQ ID NO: 3780964 - RNA, 21 nt, Salmonella typhimurium LT2
cguucaagacagguguuaaug

SEQ ID NO: 3780965 - RNA, 23 nt, Salmonella typhimurium LT2
cguucaauaaaacggcuuuucuu

SEQ ID NO: 3780966 - RNA, 15 nt, Salmonella typhimurium LT2
cguucacgccgccau

SEQ ID NO: 3780967 - RNA, 19 nt, Salmonella typhimurium LT2
cguucagauaggcgcgaaa

SEQ ID NO: 3780968 - RNA, 12 nt, Salmonella typhimurium LT2
cguucagcaucg

SEQ ID NO: 3780969 - RNA, 12 nt, Salmonella typhimurium LT2
cguucagccagc

SEQ ID NO: 3780970 - RNA, 13 nt, Salmonella typhimurium LT2
cguucagcgccgg

SEQ ID NO: 3780971 - RNA, 20 nt, Salmonella typhimurium LT2
cguucagggauaccacgcca

SEQ ID NO: 3780972 - RNA, 17 nt, Salmonella typhimurium LT2
cguucauccaugauggc

SEQ ID NO: 3780973 - RNA, 16 nt, Salmonella typhimurium LT2
cguucaucggcauaca

SEQ ID NO: 3780974 - RNA, 15 nt, Salmonella typhimurium LT2
cguucauucccgcca

SEQ ID NO: 3780975 - RNA, 13 nt, Salmonella typhimurium LT2
cguuccagcagcg

SEQ ID NO: 3780976 - RNA, 22 nt, Salmonella typhimurium LT2
cguuccauuccagaaucuggcc

SEQ ID NO: 3780977 - RNA, 19 nt, Salmonella typhimurium LT2
cguuccgcaaucgcugccu

SEQ ID NO: 3780978 - RNA, 15 nt, Salmonella typhimurium LT2
cguuccgcucagcgu

SEQ ID NO: 3780979 - RNA, 14 nt, Salmonella typhimurium LT2
cguucgaaucagcu

SEQ ID NO: 3780980 - RNA, 21 nt, Salmonella typhimurium LT2
cguucgcauauucugcgaaag

SEQ ID NO: 3780981 - RNA, 16 nt, Salmonella typhimurium LT2
cguucgcgacaaagcu

SEQ ID NO: 3780982 - RNA, 19 nt, Salmonella typhimurium LT2
cguucgcggggguuguuca

SEQ ID NO: 3780983 - RNA, 22 nt, Salmonella typhimurium LT2
cguucggaaucggacacuugca

SEQ ID NO: 3780984 - RNA, 22 nt, Salmonella typhimurium LT2
cguucggcaaaacgccgcagaa

SEQ ID NO: 3780985 - RNA, 18 nt, Salmonella typhimurium LT2
cguucguugauagcgacg

SEQ ID NO: 3780986 - RNA, 22 nt, Salmonella typhimurium LT2
cguucuaucagguaucccgcca

SEQ ID NO: 3780987 - RNA, 20 nt, Salmonella typhimurium LT2
cguucucacggucuccugaa

SEQ ID NO: 3780988 - RNA, 22 nt, Salmonella typhimurium LT2
cguucucacggucuccugaacu

SEQ ID NO: 3780989 - RNA, 20 nt, Salmonella typhimurium LT2
cguucugcugugccgggaaa

SEQ ID NO: 3780990 - RNA, 14 nt, Salmonella typhimurium LT2
cguugacgggcgac

SEQ ID NO: 3780991 - RNA, 22 nt, Salmonella typhimurium LT2
cguugaguauugacgaaaagau

SEQ ID NO: 3780992 - RNA, 19 nt, Salmonella typhimurium LT2
cguugaguuugacugccag

SEQ ID NO: 3780993 - RNA, 15 nt, Salmonella typhimurium LT2
cguugauagcgacgc

SEQ ID NO: 3780994 - RNA, 23 nt, Salmonella typhimurium LT2
cguugauaucuucaagcggacgu

SEQ ID NO: 3780995 - RNA, 13 nt, Salmonella typhimurium LT2
cguugaucuccgc

SEQ ID NO: 3780996 - RNA, 14 nt, Salmonella typhimurium LT2
cguugauggcguaa

SEQ ID NO: 3780997 - RNA, 22 nt, Salmonella typhimurium LT2
cguugaugugcccguuccaggc

SEQ ID NO: 3780998 - RNA, 19 nt, Salmonella typhimurium LT2
cguugccaauagcaaugaa

SEQ ID NO: 3780999 - RNA, 13 nt, Salmonella typhimurium LT2
cguugccagaguu

SEQ ID NO: 3781000 - RNA, 15 nt, Salmonella typhimurium LT2
cguugccgaacgcgg

SEQ ID NO: 3781001 - RNA, 12 nt, Salmonella typhimurium LT2
cguugccgccaa

SEQ ID NO: 3781002 - RNA, 12 nt, Salmonella typhimurium LT2
cguugccgccgu

SEQ ID NO: 3781003 - RNA, 18 nt, Salmonella typhimurium LT2
cguugcgaaucagguaca

SEQ ID NO: 3781004 - RNA, 23 nt, Salmonella typhimurium LT2
cguugcgacaaccuguaggccgg

SEQ ID NO: 3781005 - RNA, 18 nt, Salmonella typhimurium LT2
cguugcgccaugcucauu

SEQ ID NO: 3781006 - RNA, 19 nt, Salmonella typhimurium LT2
cguugcgcccaucaucauc

SEQ ID NO: 3781007 - RNA, 21 nt, Salmonella typhimurium LT2
cguugcgcugaaguaauguuc

SEQ ID NO: 3781008 - RNA, 19 nt, Salmonella typhimurium LT2
cguugcguguuguacagca

SEQ ID NO: 3781009 - RNA, 18 nt, Salmonella typhimurium LT2
cguugcuggacauauucc

SEQ ID NO: 3781010 - RNA, 12 nt, Salmonella typhimurium LT2
cguugcuuuaua

SEQ ID NO: 3781011 - RNA, 19 nt, Salmonella typhimurium LT2
cguuggaaagcugcugcuu

SEQ ID NO: 3781012 - RNA, 13 nt, Salmonella typhimurium LT2
cguuggccgccag

SEQ ID NO: 3781013 - RNA, 15 nt, Salmonella typhimurium LT2
cguuggccgccucgc

SEQ ID NO: 3781014 - RNA, 16 nt, Salmonella typhimurium LT2
cguugucauggcgcca

SEQ ID NO: 3781015 - RNA, 21 nt, Salmonella typhimurium LT2
cguugucauggcgccaccagc

SEQ ID NO: 3781016 - RNA, 19 nt, Salmonella typhimurium LT2
cguuguccaacugucgcca

SEQ ID NO: 3781017 - RNA, 22 nt, Salmonella typhimurium LT2
cguuguccaguaaggcaaguuc

SEQ ID NO: 3781018 - RNA, 19 nt, Salmonella typhimurium LT2
cguugucggcucauccagc

SEQ ID NO: 3781019 - RNA, 20 nt, Salmonella typhimurium LT2
cguugugcgcuuuggcugcc

SEQ ID NO: 3781020 - RNA, 17 nt, Salmonella typhimurium LT2
cguuguguccagggugu

SEQ ID NO: 3781021 - RNA, 21 nt, Salmonella typhimurium LT2
cguuguuucucuuccgccagc

SEQ ID NO: 3781022 - RNA, 16 nt, Salmonella typhimurium LT2
cguuuaaaaagcugca

SEQ ID NO: 3781023 - RNA, 12 nt, Salmonella typhimurium LT2
cguuuaaagcgc

SEQ ID NO: 3781024 - RNA, 16 nt, Salmonella typhimurium LT2
cguuuaacgacggaaa

SEQ ID NO: 3781025 - RNA, 16 nt, Salmonella typhimurium LT2
cguuuaagcaugguga

SEQ ID NO: 3781026 - RNA, 20 nt, Salmonella typhimurium LT2
cguuuaaugcgaaaaauaac

SEQ ID NO: 3781027 - RNA, 15 nt, Salmonella typhimurium LT2
cguuuaaugucacca

SEQ ID NO: 3781028 - RNA, 13 nt, Salmonella typhimurium LT2
cguuuaccgccgc

SEQ ID NO: 3781029 - RNA, 14 nt, Salmonella typhimurium LT2
cguuuacgccgcca

SEQ ID NO: 3781030 - RNA, 15 nt, Salmonella typhimurium LT2
cguuuacgccgccau

SEQ ID NO: 3781031 - RNA, 14 nt, Salmonella typhimurium LT2
cguuuagcgccagc

SEQ ID NO: 3781032 - RNA, 22 nt, Salmonella typhimurium LT2
cguuucauuuuucccaucaauc

SEQ ID NO: 3781033 - RNA, 12 nt, Salmonella typhimurium LT2
cguuuccagacu

SEQ ID NO: 3781034 - RNA, 16 nt, Salmonella typhimurium LT2
cguuuccugcgccagc

SEQ ID NO: 3781035 - RNA, 20 nt, Salmonella typhimurium LT2
cguuucgggcgcaugcugcc

SEQ ID NO: 3781036 - RNA, 15 nt, Salmonella typhimurium LT2
cguuucguguaaaug

SEQ ID NO: 3781037 - RNA, 16 nt, Salmonella typhimurium LT2
cguuucguguaaauga

SEQ ID NO: 3781038 - RNA, 13 nt, Salmonella typhimurium LT2
cguuucuacaaua

SEQ ID NO: 3781039 - RNA, 23 nt, Salmonella typhimurium LT2
cguuugaaauaccaggcggcuuu

SEQ ID NO: 3781040 - RNA, 18 nt, Salmonella typhimurium LT2
cguuugacggauuuuuuu

SEQ ID NO: 3781041 - RNA, 22 nt, Salmonella typhimurium LT2
cguuugcagaaaauuaugaaua

SEQ ID NO: 3781042 - RNA, 14 nt, Salmonella typhimurium LT2
cguuugcagccaga

SEQ ID NO: 3781043 - RNA, 14 nt, Salmonella typhimurium LT2
cguuugcgccgcca

SEQ ID NO: 3781044 - RNA, 15 nt, Salmonella typhimurium LT2
cguuugcgccgccau

SEQ ID NO: 3781045 - RNA, 22 nt, Salmonella typhimurium LT2
cguuugcgcgaggucgagcuca

SEQ ID NO: 3781046 - RNA, 18 nt, Salmonella typhimurium LT2
cguuugcugagcagccag

SEQ ID NO: 3781047 - RNA, 21 nt, Salmonella typhimurium LT2
cguuugcugagcagccagccc

SEQ ID NO: 3781048 - RNA, 16 nt, Salmonella typhimurium LT2
cguuuggcuuauccgc

SEQ ID NO: 3781049 - RNA, 21 nt, Salmonella typhimurium LT2
cguuuguaacagcaggacccg

SEQ ID NO: 3781050 - RNA, 20 nt, Salmonella typhimurium LT2
cguuuguuugucgauuuccg

SEQ ID NO: 3781051 - RNA, 14 nt, Salmonella typhimurium LT2
cguuuuacaccagc

SEQ ID NO: 3781052 - RNA, 15 nt, Salmonella typhimurium LT2
cguuuuacaccagcu

SEQ ID NO: 3781053 - RNA, 15 nt, Salmonella typhimurium LT2
cguuuuagccguuca

SEQ ID NO: 3781054 - RNA, 13 nt, Salmonella typhimurium LT2
cguuuuauaagcc

SEQ ID NO: 3781055 - RNA, 21 nt, Salmonella typhimurium LT2
cguuuuauacaccugaucggc

SEQ ID NO: 3781056 - RNA, 13 nt, Salmonella typhimurium LT2
cguuuucaauaau

SEQ ID NO: 3781057 - RNA, 21 nt, Salmonella typhimurium LT2
cguuuucaauaucggcggaaa

SEQ ID NO: 3781058 - RNA, 22 nt, Salmonella typhimurium LT2
cguuuucauaucugcgccgcca

SEQ ID NO: 3781059 - RNA, 17 nt, Salmonella typhimurium LT2
cguuuucauccauugcu

SEQ ID NO: 3781060 - RNA, 15 nt, Salmonella typhimurium LT2
cguuuucaugcacga

SEQ ID NO: 3781061 - RNA, 18 nt, Salmonella typhimurium LT2
cguuuucauuagccgcca

SEQ ID NO: 3781062 - RNA, 20 nt, Salmonella typhimurium LT2
cguuuucauuagccgccagc

SEQ ID NO: 3781063 - RNA, 15 nt, Salmonella typhimurium LT2
cguuuuccagcucac

SEQ ID NO: 3781064 - RNA, 20 nt, Salmonella typhimurium LT2
cguuuucccggcaauuaccg

SEQ ID NO: 3781065 - RNA, 12 nt, Salmonella typhimurium LT2
cguuuugcaaug

SEQ ID NO: 3781066 - RNA, 13 nt, Salmonella typhimurium LT2
cguuuugcagcgc

SEQ ID NO: 3781067 - RNA, 17 nt, Salmonella typhimurium LT2
cguuuugcgacuucaga

SEQ ID NO: 3781068 - RNA, 20 nt, Salmonella typhimurium LT2
cguuuuggggagcugcgaaa

SEQ ID NO: 3781069 - RNA, 24 nt, Salmonella typhimurium LT2
cguuuuucaucaagagauauccca

SEQ ID NO: 3781070 - RNA, 22 nt, Salmonella typhimurium LT2
cguuuuucugcccauuucagca

SEQ ID NO: 3781071 - RNA, 15 nt, Salmonella typhimurium LT2
cguuuuuguuuaaaa

SEQ ID NO: 3781072 - RNA, 19 nt, Salmonella typhimurium LT2
cguuuuuuuguuuuaccug

SEQ ID NO: 3781073 - RNA, 14 nt, Salmonella typhimurium LT2
cuaaaaaaaugccc

SEQ ID NO: 3781074 - RNA, 16 nt, Salmonella typhimurium LT2
cuaaaauacccgaccc

SEQ ID NO: 3781075 - RNA, 16 nt, Salmonella typhimurium LT2
cuaaacagcaaaucgg

SEQ ID NO: 3781076 - RNA, 21 nt, Salmonella typhimurium LT2
cuaaaccacaugaccagcgcc

SEQ ID NO: 3781077 - RNA, 13 nt, Salmonella typhimurium LT2
cuaaaccacggaa

SEQ ID NO: 3781078 - RNA, 14 nt, Salmonella typhimurium LT2
cuaaaccacggaau

SEQ ID NO: 3781079 - RNA, 20 nt, Salmonella typhimurium LT2
cuaaacuaaugccuggcagu

SEQ ID NO: 3781080 - RNA, 18 nt, Salmonella typhimurium LT2
cuaaacucaacugggcga

SEQ ID NO: 3781081 - RNA, 13 nt, Salmonella typhimurium LT2
cuaaacucaucuu

SEQ ID NO: 3781082 - RNA, 15 nt, Salmonella typhimurium LT2
cuaaacucaucuuua

SEQ ID NO: 3781083 - RNA, 16 nt, Salmonella typhimurium LT2
cuaaagagcgccugac

SEQ ID NO: 3781084 - RNA, 23 nt, Salmonella typhimurium LT2
cuaaagcgcugaguggcgggcgu

SEQ ID NO: 3781085 - RNA, 19 nt, Salmonella typhimurium LT2
cuaaauaaauaccaaagaa

SEQ ID NO: 3781086 - RNA, 23 nt, Salmonella typhimurium LT2
cuaaaucaauacaggcgaccggg

SEQ ID NO: 3781087 - RNA, 23 nt, Salmonella typhimurium LT2
cuaaaucagugauggauuucaca

SEQ ID NO: 3781088 - RNA, 14 nt, Salmonella typhimurium LT2
cuaaauccuugagu

SEQ ID NO: 3781089 - RNA, 21 nt, Salmonella typhimurium LT2
cuaaauggcauagccugauau

SEQ ID NO: 3781090 - RNA, 17 nt, Salmonella typhimurium LT2
cuaaaugggcaggagau

SEQ ID NO: 3781091 - RNA, 19 nt, Salmonella typhimurium LT2
cuaaauugggaugaugcca

SEQ ID NO: 3781092 - RNA, 19 nt, Salmonella typhimurium LT2
cuaacacaugcaagucgaa

SEQ ID NO: 3781093 - RNA, 12 nt, Salmonella typhimurium LT2
cuaacagcagca

SEQ ID NO: 3781094 - RNA, 22 nt, Salmonella typhimurium LT2
cuaacagcagcaacaaaccgau

SEQ ID NO: 3781095 - RNA, 22 nt, Salmonella typhimurium LT2
cuaacaucauucccguaucuuc

SEQ ID NO: 3781096 - RNA, 16 nt, Salmonella typhimurium LT2
cuaaccaacugagcua

SEQ ID NO: 3781097 - RNA, 22 nt, Salmonella typhimurium LT2
cuaacccaccgauaaaguuaaa

SEQ ID NO: 3781098 - RNA, 19 nt, Salmonella typhimurium LT2
cuaaccgaugcccggcaau

SEQ ID NO: 3781099 - RNA, 15 nt, Salmonella typhimurium LT2
cuaacgaggccacca

SEQ ID NO: 3781100 - RNA, 23 nt, Salmonella typhimurium LT2
cuaacgcaacggaaggaaauaac

SEQ ID NO: 3781101 - RNA, 17 nt, Salmonella typhimurium LT2
cuaacgcccucucuccg

SEQ ID NO: 3781102 - RNA, 16 nt, Salmonella typhimurium LT2
cuaacgucagcgccac

SEQ ID NO: 3781103 - RNA, 18 nt, Salmonella typhimurium LT2
cuaacgucgccaucaggc

SEQ ID NO: 3781104 - RNA, 19 nt, Salmonella typhimurium LT2
cuaacgucgccaucaggcg

SEQ ID NO: 3781105 - RNA, 20 nt, Salmonella typhimurium LT2
cuaacgucuuauccggccua

SEQ ID NO: 3781106 - RNA, 19 nt, Salmonella typhimurium LT2
cuaacgugaaccuccugug

SEQ ID NO: 3781107 - RNA, 20 nt, Salmonella typhimurium LT2
cuaacugcggcuuacccuga

SEQ ID NO: 3781108 - RNA, 14 nt, Salmonella typhimurium LT2
cuaacuggaaaaag

SEQ ID NO: 3781109 - RNA, 16 nt, Salmonella typhimurium LT2
cuaacugggucaaaaa

SEQ ID NO: 3781110 - RNA, 20 nt, Salmonella typhimurium LT2
cuaacugguacguccauccg

SEQ ID NO: 3781111 - RNA, 19 nt, Salmonella typhimurium LT2
cuaacuuaccaguuauagc

SEQ ID NO: 3781112 - RNA, 13 nt, Salmonella typhimurium LT2
cuaagagaaaacc

SEQ ID NO: 3781113 - RNA, 21 nt, Salmonella typhimurium LT2
cuaagagccuaucccaccagg

SEQ ID NO: 3781114 - RNA, 21 nt, Salmonella typhimurium LT2
cuaagagugacgguuuucacu

SEQ ID NO: 3781115 - RNA, 20 nt, Salmonella typhimurium LT2
cuaagaugacugcuuuuucu

SEQ ID NO: 3781116 - RNA, 16 nt, Salmonella typhimurium LT2
cuaagcagaacggcga

SEQ ID NO: 3781117 - RNA, 21 nt, Salmonella typhimurium LT2
cuaagcagaacggcgauacuc

SEQ ID NO: 3781118 - RNA, 16 nt, Salmonella typhimurium LT2
cuaagccggcaggcag

SEQ ID NO: 3781119 - RNA, 20 nt, Salmonella typhimurium LT2
cuaaggcggugucaucuucu

SEQ ID NO: 3781120 - RNA, 22 nt, Salmonella typhimurium LT2
cuaaguggauagaguuaaaagg

SEQ ID NO: 3781121 - RNA, 12 nt, Salmonella typhimurium LT2
cuaauaacacaa

SEQ ID NO: 3781122 - RNA, 17 nt, Salmonella typhimurium LT2
cuaauaaccagccccag

SEQ ID NO: 3781123 - RNA, 20 nt, Salmonella typhimurium LT2
cuaauacgagcgggucagga

SEQ ID NO: 3781124 - RNA, 19 nt, Salmonella typhimurium LT2
cuaauauccaccagcccau

SEQ ID NO: 3781125 - RNA, 20 nt, Salmonella typhimurium LT2
cuaauauccagccacguugu

SEQ ID NO: 3781126 - RNA, 18 nt, Salmonella typhimurium LT2
cuaaucacccacuucuca

SEQ ID NO: 3781127 - RNA, 20 nt, Salmonella typhimurium LT2
cuaaucaggacaucaaaggc

SEQ ID NO: 3781128 - RNA, 20 nt, Salmonella typhimurium LT2
cuaauccccauuuuuuucag

SEQ ID NO: 3781129 - RNA, 22 nt, Salmonella typhimurium LT2
cuaauccccauuuuuuucagcc

SEQ ID NO: 3781130 - RNA, 20 nt, Salmonella typhimurium LT2
cuaaucucgccgguuuauuu

SEQ ID NO: 3781131 - RNA, 17 nt, Salmonella typhimurium LT2
cuaaugagccagaugga

SEQ ID NO: 3781132 - RNA, 16 nt, Salmonella typhimurium LT2
cuaaugauuaucuuuu

SEQ ID NO: 3781133 - RNA, 21 nt, Salmonella typhimurium LT2
cuaaugauuaucuuuuuuagu

SEQ ID NO: 3781134 - RNA, 15 nt, Salmonella typhimurium LT2
cuaaugcaauaaacu

SEQ ID NO: 3781135 - RNA, 18 nt, Salmonella typhimurium LT2
cuaauggcgguugccacu

SEQ ID NO: 3781136 - RNA, 19 nt, Salmonella typhimurium LT2
cuaauuaaucugucgaugc

SEQ ID NO: 3781137 - RNA, 12 nt, Salmonella typhimurium LT2
cuaauuccagga

SEQ ID NO: 3781138 - RNA, 17 nt, Salmonella typhimurium LT2
cuaauucucccugccag

SEQ ID NO: 3781139 - RNA, 22 nt, Salmonella typhimurium LT2
cuaauucuucguaggcaacaau

SEQ ID NO: 3781140 - RNA, 12 nt, Salmonella typhimurium LT2
cuaauuugcgau

SEQ ID NO: 3781141 - RNA, 18 nt, Salmonella typhimurium LT2
cuacaaauuacacaauau

SEQ ID NO: 3781142 - RNA, 20 nt, Salmonella typhimurium LT2
cuacaacucagcguaacugu

SEQ ID NO: 3781143 - RNA, 16 nt, Salmonella typhimurium LT2
cuacaagauuugcaau

SEQ ID NO: 3781144 - RNA, 20 nt, Salmonella typhimurium LT2
cuacacaagcuaaaaaccgc

SEQ ID NO: 3781145 - RNA, 13 nt, Salmonella typhimurium LT2
cuacacaucaucu

SEQ ID NO: 3781146 - RNA, 16 nt, Salmonella typhimurium LT2
cuacacgaauaccucu

SEQ ID NO: 3781147 - RNA, 21 nt, Salmonella typhimurium LT2
cuacagacgcauuaaaaugau

SEQ ID NO: 3781148 - RNA, 17 nt, Salmonella typhimurium LT2
cuacagggcguuuuaua

SEQ ID NO: 3781149 - RNA, 16 nt, Salmonella typhimurium LT2
cuaccaacugagcuaa

SEQ ID NO: 3781150 - RNA, 20 nt, Salmonella typhimurium LT2
cuaccacgccgcuacugccg

SEQ ID NO: 3781151 - RNA, 14 nt, Salmonella typhimurium LT2
cuaccagacacagu

SEQ ID NO: 3781152 - RNA, 19 nt, Salmonella typhimurium LT2
cuaccagcgcuauccaggc

SEQ ID NO: 3781153 - RNA, 20 nt, Salmonella typhimurium LT2
cuaccagcguaccgauaauu

SEQ ID NO: 3781154 - RNA, 14 nt, Salmonella typhimurium LT2
cuaccaggcaaagc

SEQ ID NO: 3781155 - RNA, 18 nt, Salmonella typhimurium LT2
cuaccagguugcucaucu

SEQ ID NO: 3781156 - RNA, 15 nt, Salmonella typhimurium LT2
cuaccccuucugcca

SEQ ID NO: 3781157 - RNA, 19 nt, Salmonella typhimurium LT2
cuacccgguguaaaaaaug

SEQ ID NO: 3781158 - RNA, 16 nt, Salmonella typhimurium LT2
cuacccuuucacccgc

SEQ ID NO: 3781159 - RNA, 14 nt, Salmonella typhimurium LT2
cuaccgaggcaggg

SEQ ID NO: 3781160 - RNA, 17 nt, Salmonella typhimurium LT2
cuaccgccacuuccgcu

SEQ ID NO: 3781161 - RNA, 17 nt, Salmonella typhimurium LT2
cuauguuugcugagaau

SEQ ID NO: 3781162 - RNA, 15 nt, Salmonella typhimurium LT2
cuauguuuuuaucag

SEQ ID NO: 3781163 - RNA, 13 nt, Salmonella typhimurium LT2
cuauuaaucaccu

SEQ ID NO: 3781164 - RNA, 14 nt, Salmonella typhimurium LT2
cuauucaauaucau

SEQ ID NO: 3781165 - RNA, 12 nt, Salmonella typhimurium LT2
cuauucagcagu

SEQ ID NO: 3781166 - RNA, 15 nt, Salmonella typhimurium LT2
cuauucagcaguuca

SEQ ID NO: 3781167 - RNA, 12 nt, Salmonella typhimurium LT2
cuauucccaggc

SEQ ID NO: 3781168 - RNA, 21 nt, Salmonella typhimurium LT2
cuauuccgcgguguccugcuu

SEQ ID NO: 3781169 - RNA, 22 nt, Salmonella typhimurium LT2
cuauuccgcgguguccugcuug

SEQ ID NO: 3781170 - RNA, 15 nt, Salmonella typhimurium LT2
cuauucguucucuga

SEQ ID NO: 3781171 - RNA, 22 nt, Salmonella typhimurium LT2
cuauuggaguuaaggauauaua

SEQ ID NO: 3781172 - RNA, 21 nt, Salmonella typhimurium LT2
cuauuugcgcaucauuuuuau

SEQ ID NO: 3781173 - RNA, 23 nt, Salmonella typhimurium LT2
cuauuuggccugcagaauuucua

SEQ ID NO: 3781174 - RNA, 19 nt, Salmonella typhimurium LT2
cuauuuuaaauucccagcg

SEQ ID NO: 3781175 - RNA, 21 nt, Salmonella typhimurium LT2
cuauuuuggagaaacggugcu

SEQ ID NO: 3781176 - RNA, 13 nt, Salmonella typhimurium LT2
cuauuuuuucaau

SEQ ID NO: 3781177 - RNA, 16 nt, Salmonella typhimurium LT2
cuauuuuuugcuggcg

SEQ ID NO: 3781178 - RNA, 13 nt, Salmonella typhimurium LT2
cuauuuuuuuaua

SEQ ID NO: 3781179 - RNA, 21 nt, Salmonella typhimurium LT2
cucaacaaacuuaauuauuaa

SEQ ID NO: 3781180 - RNA, 18 nt, Salmonella typhimurium LT2
cucaacacauaacgcccg

SEQ ID NO: 3781181 - RNA, 21 nt, Salmonella typhimurium LT2
cucaacacauaacgcccgaca

SEQ ID NO: 3781182 - RNA, 13 nt, Salmonella typhimurium LT2
cucaacaucauua

SEQ ID NO: 3781183 - RNA, 19 nt, Salmonella typhimurium LT2
cucaacauugccggcauca

SEQ ID NO: 3781184 - RNA, 21 nt, Salmonella typhimurium LT2
cucaacauugccggcaucauu

SEQ ID NO: 3781185 - RNA, 21 nt, Salmonella typhimurium LT2
cucaaccaccaccgauaaacg

SEQ ID NO: 3781186 - RNA, 21 nt, Salmonella typhimurium LT2
cucaacccggacauccauccg

SEQ ID NO: 3781187 - RNA, 13 nt, Salmonella typhimurium LT2
cucaacgcccugc

SEQ ID NO: 3781188 - RNA, 23 nt, Salmonella typhimurium LT2
cucaacgcgcccagauuggugau

SEQ ID NO: 3781189 - RNA, 18 nt, Salmonella typhimurium LT2
cucaacgcguucauccag

SEQ ID NO: 3781190 - RNA, 18 nt, Salmonella typhimurium LT2
cucaagacgguuguuuuu

SEQ ID NO: 3781191 - RNA, 17 nt, Salmonella typhimurium LT2
cucaagcccgcgucguu

SEQ ID NO: 3781192 - RNA, 14 nt, Salmonella typhimurium LT2
cucaagcgcagcac

SEQ ID NO: 3781193 - RNA, 22 nt, Salmonella typhimurium LT2
cucaagcgccgccgcauuuugc

SEQ ID NO: 3781194 - RNA, 16 nt, Salmonella typhimurium LT2
cucaagcggcaccaca

SEQ ID NO: 3781195 - RNA, 19 nt, Salmonella typhimurium LT2
cucaagcggcaccacauua

SEQ ID NO: 3781196 - RNA, 21 nt, Salmonella typhimurium LT2
cucaaggcuauuagccaaagc

SEQ ID NO: 3781197 - RNA, 22 nt, Salmonella typhimurium LT2
cucaagugucgauaaccuggau

SEQ ID NO: 3781198 - RNA, 16 nt, Salmonella typhimurium LT2
cucaauaucguugccg

SEQ ID NO: 3781199 - RNA, 22 nt, Salmonella typhimurium LT2
cucaauccuucuaccuucaccc

SEQ ID NO: 3781200 - RNA, 14 nt, Salmonella typhimurium LT2
cucaaucugaugau

SEQ ID NO: 3781201 - RNA, 15 nt, Salmonella typhimurium LT2
cucaaucugaugaug

SEQ ID NO: 3781202 - RNA, 15 nt, Salmonella typhimurium LT2
cucaaugauuuccgc

SEQ ID NO: 3781203 - RNA, 19 nt, Salmonella typhimurium LT2
cucaauggcgcgccagcca

SEQ ID NO: 3781204 - RNA, 17 nt, Salmonella typhimurium LT2
cucaaugguuucacgcu

SEQ ID NO: 3781205 - RNA, 13 nt, Salmonella typhimurium LT2
cucaauguccuga

SEQ ID NO: 3781206 - RNA, 15 nt, Salmonella typhimurium LT2
cucaauuauuaaucu

SEQ ID NO: 3781207 - RNA, 15 nt, Salmonella typhimurium LT2
cucaauugaggccgu

SEQ ID NO: 3781208 - RNA, 19 nt, Salmonella typhimurium LT2
cucacauucauugccgcca

SEQ ID NO: 3781209 - RNA, 21 nt, Salmonella typhimurium LT2
cucacauucauugccgccagu

SEQ ID NO: 3781210 - RNA, 22 nt, Salmonella typhimurium LT2
cucaccagcacgcaggcauccg

SEQ ID NO: 3781211 - RNA, 20 nt, Salmonella typhimurium LT2
cucaccgagacugcccggca

SEQ ID NO: 3781212 - RNA, 21 nt, Salmonella typhimurium LT2
cucaccgcuaaucccagcgcg

SEQ ID NO: 3781213 - RNA, 22 nt, Salmonella typhimurium LT2
cucaccgcuaaucccagcgcgc

SEQ ID NO: 3781214 - RNA, 15 nt, Salmonella typhimurium LT2
cucaccggccccgga

SEQ ID NO: 3781215 - RNA, 17 nt, Salmonella typhimurium LT2
cucaccgggcaggauac

SEQ ID NO: 3781216 - RNA, 21 nt, Salmonella typhimurium LT2
cucaccgggcaggauacggcg

SEQ ID NO: 3781217 - RNA, 18 nt, Salmonella typhimurium LT2
cucaccguagcuccagac

SEQ ID NO: 3781218 - RNA, 19 nt, Salmonella typhimurium LT2
cucaccguagcuccagacc

SEQ ID NO: 3781219 - RNA, 17 nt, Salmonella typhimurium LT2
cucaccuccgccaccag

SEQ ID NO: 3781220 - RNA, 14 nt, Salmonella typhimurium LT2
cucaccugaugcga

SEQ ID NO: 3781221 - RNA, 24 nt, Salmonella typhimurium LT2
cucacgaauaagaaucagaugcuc

SEQ ID NO: 3781222 - RNA, 17 nt, Salmonella typhimurium LT2
cucacgacuuucaccag

SEQ ID NO: 3781223 - RNA, 16 nt, Salmonella typhimurium LT2
cucacgauaaugaacc

SEQ ID NO: 3781224 - RNA, 17 nt, Salmonella typhimurium LT2
cucacgcaacaacaggc

SEQ ID NO: 3781225 - RNA, 13 nt, Salmonella typhimurium LT2
cucacgcaaugcc

SEQ ID NO: 3781226 - RNA, 16 nt, Salmonella typhimurium LT2
cucacggauauugccc

SEQ ID NO: 3781227 - RNA, 19 nt, Salmonella typhimurium LT2
cucacggcacgcccuucgu

SEQ ID NO: 3781228 - RNA, 14 nt, Salmonella typhimurium LT2
cucacggucuccug

SEQ ID NO: 3781229 - RNA, 22 nt, Salmonella typhimurium LT2
cucacgguuucuacuuccacca

SEQ ID NO: 3781230 - RNA, 15 nt, Salmonella typhimurium LT2
cucacguucagcgcg

SEQ ID NO: 3781231 - RNA, 18 nt, Salmonella typhimurium LT2
cucacugccgacgcccuc

SEQ ID NO: 3781232 - RNA, 13 nt, Salmonella typhimurium LT2
cucacuguugaua

SEQ ID NO: 3781233 - RNA, 20 nt, Salmonella typhimurium LT2
cucagaaaauuauuuuaaau

SEQ ID NO: 3781234 - RNA, 22 nt, Salmonella typhimurium LT2
cucagacaguagcggcgaggca

SEQ ID NO: 3781235 - RNA, 19 nt, Salmonella typhimurium LT2
cucagaccauauucacgca

SEQ ID NO: 3781236 - RNA, 14 nt, Salmonella typhimurium LT2
cucagaucggcaga

SEQ ID NO: 3781237 - RNA, 16 nt, Salmonella typhimurium LT2
cucagauugaacgcug

SEQ ID NO: 3781238 - RNA, 23 nt, Salmonella typhimurium LT2
cucagcaguuuguccauuucuug

SEQ ID NO: 3781239 - RNA, 23 nt, Salmonella typhimurium LT2
cucagcauagcgcugaaacggga

SEQ ID NO: 3781240 - RNA, 21 nt, Salmonella typhimurium LT2
cucagcauguccgccuaccag

SEQ ID NO: 3781241 - RNA, 18 nt, Salmonella typhimurium LT2
cucagcauuggugagaga

SEQ ID NO: 3781242 - RNA, 16 nt, Salmonella typhimurium LT2
cucagccagaaacggu

SEQ ID NO: 3781243 - RNA, 12 nt, Salmonella typhimurium LT2
cucagccaggcg

SEQ ID NO: 3781244 - RNA, 14 nt, Salmonella typhimurium LT2
cucagccccaggcc

SEQ ID NO: 3781245 - RNA, 23 nt, Salmonella typhimurium LT2
cucagcgccacgcccaacauaaa

SEQ ID NO: 3781246 - RNA, 13 nt, Salmonella typhimurium LT2
cucagcgccccag

SEQ ID NO: 3781247 - RNA, 17 nt, Salmonella typhimurium LT2
cucagcgucaucacagg

SEQ ID NO: 3781248 - RNA, 19 nt, Salmonella typhimurium LT2
cucagcuaaaaacagcgca

SEQ ID NO: 3781249 - RNA, 13 nt, Salmonella typhimurium LT2
cucaggaucgccg

SEQ ID NO: 3781250 - RNA, 22 nt, Salmonella typhimurium LT2
cucaggcggggaguggugaucg

SEQ ID NO: 3781251 - RNA, 13 nt, Salmonella typhimurium LT2
cucagggcaaagu

SEQ ID NO: 3781252 - RNA, 18 nt, Salmonella typhimurium LT2
cucagggcgaaaaugauc

SEQ ID NO: 3781253 - RNA, 17 nt, Salmonella typhimurium LT2
cucagggucagaauaca

SEQ ID NO: 3781254 - RNA, 17 nt, Salmonella typhimurium LT2
cucagggugacagaaga

SEQ ID NO: 3781255 - RNA, 23 nt, Salmonella typhimurium LT2
cucagguucgggccaccuuccag

SEQ ID NO: 3781256 - RNA, 19 nt, Salmonella typhimurium LT2
cucagucacuucaaccuuu

SEQ ID NO: 3781257 - RNA, 14 nt, Salmonella typhimurium LT2
cucagucagucccg

SEQ ID NO: 3781258 - RNA, 16 nt, Salmonella typhimurium LT2
cucaguucauuauuuc

SEQ ID NO: 3781259 - RNA, 16 nt, Salmonella typhimurium LT2
cucaguugcguuccca

SEQ ID NO: 3781260 - RNA, 21 nt, Salmonella typhimurium LT2
cucaguugcguucccaguucc

SEQ ID NO: 3781261 - RNA, 19 nt, Salmonella typhimurium LT2
cucaguugguuagagcaca

SEQ ID NO: 3781262 - RNA, 21 nt, Salmonella typhimurium LT2
cucaguuugcugguuaacucu

SEQ ID NO: 3781263 - RNA, 19 nt, Salmonella typhimurium LT2
cucauaaauagccagcauc

SEQ ID NO: 3781264 - RNA, 18 nt, Salmonella typhimurium LT2
cucccuggcagugaucca

SEQ ID NO: 3781265 - RNA, 21 nt, Salmonella typhimurium LT2
cucccuuugacaaccugccgu

SEQ ID NO: 3781266 - RNA, 18 nt, Salmonella typhimurium LT2
cuccgacaaacuucaucg

SEQ ID NO: 3781267 - RNA, 18 nt, Salmonella typhimurium LT2
cuccgagacucaaagaaa

SEQ ID NO: 3781268 - RNA, 13 nt, Salmonella typhimurium LT2
cuccgcaauuucc

SEQ ID NO: 3781269 - RNA, 18 nt, Salmonella typhimurium LT2
cuccgcaccuucaucauu

SEQ ID NO: 3781270 - RNA, 13 nt, Salmonella typhimurium LT2
cuccgcagcuuca

SEQ ID NO: 3781271 - RNA, 13 nt, Salmonella typhimurium LT2
cuccgccccgccu

SEQ ID NO: 3781272 - RNA, 23 nt, Salmonella typhimurium LT2
cuccgccgucguaauaauaugcc

SEQ ID NO: 3781273 - RNA, 20 nt, Salmonella typhimurium LT2
cuccgccuggaacccaggca

SEQ ID NO: 3781274 - RNA, 16 nt, Salmonella typhimurium LT2
cuccgcgagcagccag

SEQ ID NO: 3781275 - RNA, 19 nt, Salmonella typhimurium LT2
cuccgcgauggucuucuuu

SEQ ID NO: 3781276 - RNA, 22 nt, Salmonella typhimurium LT2
cuccgcgauggucuucuuucag

SEQ ID NO: 3781277 - RNA, 16 nt, Salmonella typhimurium LT2
cuccgcgcaaucgccg

SEQ ID NO: 3781278 - RNA, 19 nt, Salmonella typhimurium LT2
cuccgcgcauguaaccaaa

SEQ ID NO: 3781279 - RNA, 21 nt, Salmonella typhimurium LT2
cuccgcgcauguaaccaaagc

SEQ ID NO: 3781280 - RNA, 13 nt, Salmonella typhimurium LT2
cuccgcgcuggca

SEQ ID NO: 3781281 - RNA, 18 nt, Salmonella typhimurium LT2
cuccgcguagcccagcgc

SEQ ID NO: 3781282 - RNA, 20 nt, Salmonella typhimurium LT2
cuccgcguagcccagcgccg

SEQ ID NO: 3781283 - RNA, 13 nt, Salmonella typhimurium LT2
cuccgcuauaaaa

SEQ ID NO: 3781284 - RNA, 16 nt, Salmonella typhimurium LT2
cuccgcuauaaaaauu

SEQ ID NO: 3781285 - RNA, 14 nt, Salmonella typhimurium LT2
cuccggacguaccc

SEQ ID NO: 3781286 - RNA, 15 nt, Salmonella typhimurium LT2
cuccggcaagccugu

SEQ ID NO: 3781287 - RNA, 13 nt, Salmonella typhimurium LT2
cuccggcacuggc

SEQ ID NO: 3781288 - RNA, 14 nt, Salmonella typhimurium LT2
cuccggcagcgaau

SEQ ID NO: 3781289 - RNA, 18 nt, Salmonella typhimurium LT2
cuccggccugccugguaa

SEQ ID NO: 3781290 - RNA, 14 nt, Salmonella typhimurium LT2
cuccggcugaagcc

SEQ ID NO: 3781291 - RNA, 19 nt, Salmonella typhimurium LT2
cuccgggauagcaaucucg

SEQ ID NO: 3781292 - RNA, 21 nt, Salmonella typhimurium LT2
cuccgggccgugauccugguc

SEQ ID NO: 3781293 - RNA, 18 nt, Salmonella typhimurium LT2
cuccgggcucauauuauc

SEQ ID NO: 3781294 - RNA, 14 nt, Salmonella typhimurium LT2
cuccguaggccccg

SEQ ID NO: 3781295 - RNA, 16 nt, Salmonella typhimurium LT2
cuccuaagagaaaacc

SEQ ID NO: 3781296 - RNA, 21 nt, Salmonella typhimurium LT2
cuccuacaccaccagcccggc

SEQ ID NO: 3781297 - RNA, 14 nt, Salmonella typhimurium LT2
cuccuccagcgcgu

SEQ ID NO: 3781298 - RNA, 12 nt, Salmonella typhimurium LT2
cuccuccaucag

SEQ ID NO: 3781299 - RNA, 18 nt, Salmonella typhimurium LT2
cuccucucuuccuccuga

SEQ ID NO: 3781300 - RNA, 11 nt, Salmonella typhimurium LT2
cuccucugcca

SEQ ID NO: 3781301 - RNA, 18 nt, Salmonella typhimurium LT2
cuccugaagccagcgccc

SEQ ID NO: 3781302 - RNA, 22 nt, Salmonella typhimurium LT2
cuccugaauagcuuucaccggu

SEQ ID NO: 3781303 - RNA, 20 nt, Salmonella typhimurium LT2
cuccugacauagcucacgca

SEQ ID NO: 3781304 - RNA, 17 nt, Salmonella typhimurium LT2
cuccugacugccgccgg

SEQ ID NO: 3781305 - RNA, 21 nt, Salmonella typhimurium LT2
cuccugauaaccuauuuugca

SEQ ID NO: 3781306 - RNA, 23 nt, Salmonella typhimurium LT2
cuccugauaucgauauaaugccu

SEQ ID NO: 3781307 - RNA, 20 nt, Salmonella typhimurium LT2
cuccugccagauuuucuuua

SEQ ID NO: 3781308 - RNA, 19 nt, Salmonella typhimurium LT2
cuccugccuuuuugacgcu

SEQ ID NO: 3781309 - RNA, 18 nt, Salmonella typhimurium LT2
cuccugcgauagcugcug

SEQ ID NO: 3781310 - RNA, 11 nt, Salmonella typhimurium LT2
cuccugcuccu

SEQ ID NO: 3781311 - RNA, 16 nt, Salmonella typhimurium LT2
cuccuggauuuuaccu

SEQ ID NO: 3781312 - RNA, 18 nt, Salmonella typhimurium LT2
cuccuggcuuaccugcuc

SEQ ID NO: 3781313 - RNA, 15 nt, Salmonella typhimurium LT2
cuccuguaacagggg

SEQ ID NO: 3781314 - RNA, 23 nt, Salmonella typhimurium LT2
cuccuguaagucagguagcguca

SEQ ID NO: 3781315 - RNA, 15 nt, Salmonella typhimurium LT2
cuccugugaagacau

SEQ ID NO: 3781316 - RNA, 20 nt, Salmonella typhimurium LT2
cuccuguugaagauuagccg

SEQ ID NO: 3781317 - RNA, 21 nt, Salmonella typhimurium LT2
cuccuuguaagggaggugcuc

SEQ ID NO: 3781318 - RNA, 16 nt, Salmonella typhimurium LT2
cucgaaacgcugcgcu

SEQ ID NO: 3781319 - RNA, 23 nt, Salmonella typhimurium LT2
cucgacaggaguauagcggcguu

SEQ ID NO: 3781320 - RNA, 17 nt, Salmonella typhimurium LT2
cucgaccaguuuuuccg

SEQ ID NO: 3781321 - RNA, 17 nt, Salmonella typhimurium LT2
cucgaccccuucgccuu

SEQ ID NO: 3781322 - RNA, 15 nt, Salmonella typhimurium LT2
cucgacgcacuccag

SEQ ID NO: 3781323 - RNA, 13 nt, Salmonella typhimurium LT2
cucgacgccuucu

SEQ ID NO: 3781324 - RNA, 20 nt, Salmonella typhimurium LT2
cucgaggaacuguucagcca

SEQ ID NO: 3781325 - RNA, 23 nt, Salmonella typhimurium LT2
cucgauagcugaagugcggauag

SEQ ID NO: 3781326 - RNA, 22 nt, Salmonella typhimurium LT2
cucgaugcgccgaggcauccag

SEQ ID NO: 3781327 - RNA, 20 nt, Salmonella typhimurium LT2
cucgauggcauuguccuuua

SEQ ID NO: 3781328 - RNA, 22 nt, Salmonella typhimurium LT2
cucgauggcuuucuaccugcaa

SEQ ID NO: 3781329 - RNA, 17 nt, Salmonella typhimurium LT2
cucgauuaccguguuua

SEQ ID NO: 3781330 - RNA, 13 nt, Salmonella typhimurium LT2
cucgcaaaacaug

SEQ ID NO: 3781331 - RNA, 17 nt, Salmonella typhimurium LT2
cucgcacucgccgccaa

SEQ ID NO: 3781332 - RNA, 21 nt, Salmonella typhimurium LT2
cucgcagguacgacacccgau

SEQ ID NO: 3781333 - RNA, 19 nt, Salmonella typhimurium LT2
cucgccaaaucaugcccaa

SEQ ID NO: 3781334 - RNA, 17 nt, Salmonella typhimurium LT2
cucgccaaugccgcaac

SEQ ID NO: 3781335 - RNA, 19 nt, Salmonella typhimurium LT2
cucgccaccggcacaucca

SEQ ID NO: 3781336 - RNA, 20 nt, Salmonella typhimurium LT2
cucgccacgguuggcccagc

SEQ ID NO: 3781337 - RNA, 22 nt, Salmonella typhimurium LT2
cucgccagcauacgucugcgcu

SEQ ID NO: 3781338 - RNA, 16 nt, Salmonella typhimurium LT2
cucgcccagaauuucc

SEQ ID NO: 3781339 - RNA, 12 nt, Salmonella typhimurium LT2
cucgcccagcac

SEQ ID NO: 3781340 - RNA, 22 nt, Salmonella typhimurium LT2
cucgcccauuugcgagaaaaag

SEQ ID NO: 3781341 - RNA, 13 nt, Salmonella typhimurium LT2
cucgcccgccaga

SEQ ID NO: 3781342 - RNA, 22 nt, Salmonella typhimurium LT2
cucgcccuucgggccgccgcaa

SEQ ID NO: 3781343 - RNA, 20 nt, Salmonella typhimurium LT2
cucgccgacggucaaacuga

SEQ ID NO: 3781344 - RNA, 16 nt, Salmonella typhimurium LT2
cucgccgccucccccu

SEQ ID NO: 3781345 - RNA, 17 nt, Salmonella typhimurium LT2
cucgccgccucccccuc

SEQ ID NO: 3781346 - RNA, 18 nt, Salmonella typhimurium LT2
cucgccgccucccccuca

SEQ ID NO: 3781347 - RNA, 18 nt, Salmonella typhimurium LT2
cucgccgcguuuaagccc

SEQ ID NO: 3781348 - RNA, 17 nt, Salmonella typhimurium LT2
cucgccugcgcuuugug

SEQ ID NO: 3781349 - RNA, 16 nt, Salmonella typhimurium LT2
cucgcgauccgccagc

SEQ ID NO: 3781350 - RNA, 19 nt, Salmonella typhimurium LT2
cucgcgcagaaucagcgug

SEQ ID NO: 3781351 - RNA, 19 nt, Salmonella typhimurium LT2
cucgcgcucaagcgaaaaa

SEQ ID NO: 3781352 - RNA, 13 nt, Salmonella typhimurium LT2
cucgcgcugugua

SEQ ID NO: 3781353 - RNA, 22 nt, Salmonella typhimurium LT2
cucgcggcaguaagccagcggg

SEQ ID NO: 3781354 - RNA, 21 nt, Salmonella typhimurium LT2
cucgcggcggaccgcaacguc

SEQ ID NO: 3781355 - RNA, 18 nt, Salmonella typhimurium LT2
cucgcgggcauacucucc

SEQ ID NO: 3781356 - RNA, 18 nt, Salmonella typhimurium LT2
cucgcguaccagaaacag

SEQ ID NO: 3781357 - RNA, 14 nt, Salmonella typhimurium LT2
cucgcguccccagc

SEQ ID NO: 3781358 - RNA, 23 nt, Salmonella typhimurium LT2
cucgcguccccagccgaugaccc

SEQ ID NO: 3781359 - RNA, 23 nt, Salmonella typhimurium LT2
cucgcguugagggguuucaauuc

SEQ ID NO: 3781360 - RNA, 12 nt, Salmonella typhimurium LT2
cucgcuaaugcc

SEQ ID NO: 3781361 - RNA, 13 nt, Salmonella typhimurium LT2
cucgcuaaugccc

SEQ ID NO: 3781362 - RNA, 16 nt, Salmonella typhimurium LT2
cucgcuaaugcccggc

SEQ ID NO: 3781363 - RNA, 16 nt, Salmonella typhimurium LT2
cucgcuacgcucgccc

SEQ ID NO: 3781364 - RNA, 20 nt, Salmonella typhimurium LT2
cucgcugauacgcaccagcu

SEQ ID NO: 3781365 - RNA, 23 nt, Salmonella typhimurium LT2
cucgcugauacgcuggcacagga

SEQ ID NO: 3781366 - RNA, 15 nt, Salmonella typhimurium LT2
cucgcugauggagau

SEQ ID NO: 3781367 - RNA, 17 nt, Salmonella typhimurium LT2
cugaaacggaucaaaaa

SEQ ID NO: 3781368 - RNA, 13 nt, Salmonella typhimurium LT2
cugaaagcaagua

SEQ ID NO: 3781369 - RNA, 12 nt, Salmonella typhimurium LT2
cugaaagcgccu

SEQ ID NO: 3781370 - RNA, 15 nt, Salmonella typhimurium LT2
cugaaauaaaagcaa

SEQ ID NO: 3781371 - RNA, 12 nt, Salmonella typhimurium LT2
cugaaaugcccg

SEQ ID NO: 3781372 - RNA, 17 nt, Salmonella typhimurium LT2
cugaacaaucgccugac

SEQ ID NO: 3781373 - RNA, 23 nt, Salmonella typhimurium LT2
cugaacauacuuucucuccuuca

SEQ ID NO: 3781374 - RNA, 13 nt, Salmonella typhimurium LT2
cugaaccaggccg

SEQ ID NO: 3781375 - RNA, 20 nt, Salmonella typhimurium LT2
cugaacgccgcguuuuagca

SEQ ID NO: 3781376 - RNA, 19 nt, Salmonella typhimurium LT2
cugaacgggugguuucccu

SEQ ID NO: 3781377 - RNA, 15 nt, Salmonella typhimurium LT2
cugaacguaguuggu

SEQ ID NO: 3781378 - RNA, 17 nt, Salmonella typhimurium LT2
cugaacuguaaccggcg

SEQ ID NO: 3781379 - RNA, 22 nt, Salmonella typhimurium LT2
cugaagaaaaggaauaccugcg

SEQ ID NO: 3781380 - RNA, 16 nt, Salmonella typhimurium LT2
cugaagauaaaauugu

SEQ ID NO: 3781381 - RNA, 19 nt, Salmonella typhimurium LT2
cugaagauaaacagcagcg

SEQ ID NO: 3781382 - RNA, 21 nt, Salmonella typhimurium LT2
cugaagauaaacagcagcgcg

SEQ ID NO: 3781383 - RNA, 17 nt, Salmonella typhimurium LT2
cugaagauguucaggua

SEQ ID NO: 3781384 - RNA, 19 nt, Salmonella typhimurium LT2
cugaagcagugugaugcgu

SEQ ID NO: 3781385 - RNA, 22 nt, Salmonella typhimurium LT2
cugaagccagcaaucagcccau

SEQ ID NO: 3781386 - RNA, 13 nt, Salmonella typhimurium LT2
cugaagccauccu

SEQ ID NO: 3781387 - RNA, 19 nt, Salmonella typhimurium LT2
cugaagcguaacagcgcua

SEQ ID NO: 3781388 - RNA, 20 nt, Salmonella typhimurium LT2
cugaagcguaacagcgcuau

SEQ ID NO: 3781389 - RNA, 11 nt, Salmonella typhimurium LT2
cugaagcguau

SEQ ID NO: 3781390 - RNA, 15 nt, Salmonella typhimurium LT2
cugaagcguauuucu

SEQ ID NO: 3781391 - RNA, 22 nt, Salmonella typhimurium LT2
cugaagcugccgucccagcgga

SEQ ID NO: 3781392 - RNA, 22 nt, Salmonella typhimurium LT2
cugaaggcgcuaugcugaucau

SEQ ID NO: 3781393 - RNA, 15 nt, Salmonella typhimurium LT2
cugaagguuuuuccc

SEQ ID NO: 3781394 - RNA, 17 nt, Salmonella typhimurium LT2
cugaaguaucgacgcag

SEQ ID NO: 3781395 - RNA, 18 nt, Salmonella typhimurium LT2
cugaauaacccgcagccc

SEQ ID NO: 3781396 - RNA, 15 nt, Salmonella typhimurium LT2
cugaauaauauguaa

SEQ ID NO: 3781397 - RNA, 15 nt, Salmonella typhimurium LT2
cugaauaaugaccuc

SEQ ID NO: 3781398 - RNA, 21 nt, Salmonella typhimurium LT2
cugaauaaugguaaauuuauc

SEQ ID NO: 3781399 - RNA, 18 nt, Salmonella typhimurium LT2
cugaauacggguaaugca

SEQ ID NO: 3781400 - RNA, 17 nt, Salmonella typhimurium LT2
cugaauagcuuucaccg

SEQ ID NO: 3781401 - RNA, 18 nt, Salmonella typhimurium LT2
cugaauaguagcugagag

SEQ ID NO: 3781402 - RNA, 17 nt, Salmonella typhimurium LT2
cugaauaucgucaguau

SEQ ID NO: 3781403 - RNA, 18 nt, Salmonella typhimurium LT2
cugaauauucggcuccag

SEQ ID NO: 3781404 - RNA, 13 nt, Salmonella typhimurium LT2
cugaaucaauagc

SEQ ID NO: 3781405 - RNA, 19 nt, Salmonella typhimurium LT2
cugaaucaauagcuggguc

SEQ ID NO: 3781406 - RNA, 23 nt, Salmonella typhimurium LT2
cugaaucagauacggcuccagca

SEQ ID NO: 3781407 - RNA, 16 nt, Salmonella typhimurium LT2
cugaaucguagcgugc

SEQ ID NO: 3781408 - RNA, 19 nt, Salmonella typhimurium LT2
cugaaucugcggcugcgug

SEQ ID NO: 3781409 - RNA, 14 nt, Salmonella typhimurium LT2
cugaaugacgccgu

SEQ ID NO: 3781410 - RNA, 14 nt, Salmonella typhimurium LT2
cugaaugccaucca

SEQ ID NO: 3781411 - RNA, 20 nt, Salmonella typhimurium LT2
cugaauguucucgcuugccg

SEQ ID NO: 3781412 - RNA, 16 nt, Salmonella typhimurium LT2
cugaauuaucaggguu

SEQ ID NO: 3781413 - RNA, 21 nt, Salmonella typhimurium LT2
cugaauuuaauggucuuaaau

SEQ ID NO: 3781414 - RNA, 18 nt, Salmonella typhimurium LT2
cugacaaaucggcuccgg

SEQ ID NO: 3781415 - RNA, 18 nt, Salmonella typhimurium LT2
cugacaaggcgaucucaa

SEQ ID NO: 3781416 - RNA, 20 nt, Salmonella typhimurium LT2
cugacagagcucgucaaaaa

SEQ ID NO: 3781417 - RNA, 23 nt, Salmonella typhimurium LT2
cugacagagcucgucaaaaauca

SEQ ID NO: 3781418 - RNA, 16 nt, Salmonella typhimurium LT2
cugacagccaaacugc

SEQ ID NO: 3781419 - RNA, 17 nt, Salmonella typhimurium LT2
cugacagccaaacugcu

SEQ ID NO: 3781420 - RNA, 16 nt, Salmonella typhimurium LT2
cugacagcgcgcgaau

SEQ ID NO: 3781421 - RNA, 13 nt, Salmonella typhimurium LT2
cugacauaaucau

SEQ ID NO: 3781422 - RNA, 16 nt, Salmonella typhimurium LT2
cugacauaaucaugaa

SEQ ID NO: 3781423 - RNA, 17 nt, Salmonella typhimurium LT2
cugaccacgacgaccgc

SEQ ID NO: 3781424 - RNA, 23 nt, Salmonella typhimurium LT2
cugaccagacagucgccgcuucg

SEQ ID NO: 3781425 - RNA, 13 nt, Salmonella typhimurium LT2
cugaccagcgacg

SEQ ID NO: 3781426 - RNA, 16 nt, Salmonella typhimurium LT2
cugaccaucaacaaug

SEQ ID NO: 3781427 - RNA, 15 nt, Salmonella typhimurium LT2
cugaccgcauuuucu

SEQ ID NO: 3781428 - RNA, 20 nt, Salmonella typhimurium LT2
cugaccgcgaucgcuggacg

SEQ ID NO: 3781429 - RNA, 17 nt, Salmonella typhimurium LT2
cugaccgcguuuccacg

SEQ ID NO: 3781430 - RNA, 13 nt, Salmonella typhimurium LT2
cugaccuuaaucc

SEQ ID NO: 3781431 - RNA, 17 nt, Salmonella typhimurium LT2
cugaccuuaauccagcc

SEQ ID NO: 3781432 - RNA, 18 nt, Salmonella typhimurium LT2
cugaccuuuuucauccuc

SEQ ID NO: 3781433 - RNA, 17 nt, Salmonella typhimurium LT2
cugacgaauagcgcgcu

SEQ ID NO: 3781434 - RNA, 22 nt, Salmonella typhimurium LT2
cugacgacacuuuuugccgagc

SEQ ID NO: 3781435 - RNA, 16 nt, Salmonella typhimurium LT2
cugacgaccauugcca

SEQ ID NO: 3781436 - RNA, 17 nt, Salmonella typhimurium LT2
cugacgacucucccauc

SEQ ID NO: 3781437 - RNA, 15 nt, Salmonella typhimurium LT2
cugacgaguggcgga

SEQ ID NO: 3781438 - RNA, 15 nt, Salmonella typhimurium LT2
cugacgaucaaccgg

SEQ ID NO: 3781439 - RNA, 15 nt, Salmonella typhimurium LT2
cugacgccagccagc

SEQ ID NO: 3781440 - RNA, 18 nt, Salmonella typhimurium LT2
cugacgcccaucagcauc

SEQ ID NO: 3781441 - RNA, 13 nt, Salmonella typhimurium LT2
cugacgcgcagcg

SEQ ID NO: 3781442 - RNA, 20 nt, Salmonella typhimurium LT2
cugacgcgcagcgauauagc

SEQ ID NO: 3781443 - RNA, 13 nt, Salmonella typhimurium LT2
cugacgcgccugg

SEQ ID NO: 3781444 - RNA, 22 nt, Salmonella typhimurium LT2
cugacgcguuuuuucaugaauc

SEQ ID NO: 3781445 - RNA, 13 nt, Salmonella typhimurium LT2
cugacggagcaaa

SEQ ID NO: 3781446 - RNA, 19 nt, Salmonella typhimurium LT2
cugacggccugucuccgca

SEQ ID NO: 3781447 - RNA, 21 nt, Salmonella typhimurium LT2
cugacgggcauuguuaaucca

SEQ ID NO: 3781448 - RNA, 16 nt, Salmonella typhimurium LT2
cugacguaaauucuga

SEQ ID NO: 3781449 - RNA, 22 nt, Salmonella typhimurium LT2
cugacguuacgcggugcgccgu

SEQ ID NO: 3781450 - RNA, 16 nt, Salmonella typhimurium LT2
cugacguugcgggccu

SEQ ID NO: 3781451 - RNA, 16 nt, Salmonella typhimurium LT2
cugacguuggccgccg

SEQ ID NO: 3781452 - RNA, 13 nt, Salmonella typhimurium LT2
cugacuauccaca

SEQ ID NO: 3781453 - RNA, 18 nt, Salmonella typhimurium LT2
cugacuauccacagcgaa

SEQ ID NO: 3781454 - RNA, 13 nt, Salmonella typhimurium LT2
cugacuaucuuua

SEQ ID NO: 3781455 - RNA, 20 nt, Salmonella typhimurium LT2
cugacucgcgcaauauucca

SEQ ID NO: 3781456 - RNA, 22 nt, Salmonella typhimurium LT2
cugacugccguauaauccagcu

SEQ ID NO: 3781457 - RNA, 14 nt, Salmonella typhimurium LT2
cugacugcugucau

SEQ ID NO: 3781458 - RNA, 21 nt, Salmonella typhimurium LT2
cugacugguuuguugcgucug

SEQ ID NO: 3781459 - RNA, 13 nt, Salmonella typhimurium LT2
cugacuguaauuu

SEQ ID NO: 3781460 - RNA, 15 nt, Salmonella typhimurium LT2
cugagaaaaagcgaa

SEQ ID NO: 3781461 - RNA, 19 nt, Salmonella typhimurium LT2
cugagaaaaagcgaagcgg

SEQ ID NO: 3781462 - RNA, 19 nt, Salmonella typhimurium LT2
cugagaaaaauacgccaga

SEQ ID NO: 3781463 - RNA, 17 nt, Salmonella typhimurium LT2
cugagaacuauuugccu

SEQ ID NO: 3781464 - RNA, 20 nt, Salmonella typhimurium LT2
cugagaauuuccaguucaau

SEQ ID NO: 3781465 - RNA, 16 nt, Salmonella typhimurium LT2
cugagacgccugcaga

SEQ ID NO: 3781466 - RNA, 18 nt, Salmonella typhimurium LT2
cugagacgcgaaacgaaa

SEQ ID NO: 3781467 - RNA, 19 nt, Salmonella typhimurium LT2
cugagacucaguagcgcau

SEQ ID NO: 3781468 - RNA, 13 nt, Salmonella typhimurium LT2
cugagaucaaaca

SEQ ID NO: 3781469 - RNA, 16 nt, Salmonella typhimurium LT2
cugagcaaucaguuca

SEQ ID NO: 3781470 - RNA, 12 nt, Salmonella typhimurium LT2
cugagcagccag

SEQ ID NO: 3781471 - RNA, 12 nt, Salmonella typhimurium LT2
cugcaaccgacg

SEQ ID NO: 3781472 - RNA, 19 nt, Salmonella typhimurium LT2
cugcaaccgacgaacaaaa

SEQ ID NO: 3781473 - RNA, 17 nt, Salmonella typhimurium LT2
cugcaacgccugcggau

SEQ ID NO: 3781474 - RNA, 17 nt, Salmonella typhimurium LT2
cugcaacuccugggcaa

SEQ ID NO: 3781475 - RNA, 22 nt, Salmonella typhimurium LT2
cugcaaugguaaaacgcuggcc

SEQ ID NO: 3781476 - RNA, 15 nt, Salmonella typhimurium LT2
cugcaauuucuuuuc

SEQ ID NO: 3781477 - RNA, 15 nt, Salmonella typhimurium LT2
cugcacccaucuuua

SEQ ID NO: 3781478 - RNA, 12 nt, Salmonella typhimurium LT2
cugcaccgccug

SEQ ID NO: 3781479 - RNA, 18 nt, Salmonella typhimurium LT2
cugcaccuuuuuuuccag

SEQ ID NO: 3781480 - RNA, 20 nt, Salmonella typhimurium LT2
cugcaccuuuuuuuccagcg

SEQ ID NO: 3781481 - RNA, 23 nt, Salmonella typhimurium LT2
cugcacgccgcgcucgcucauca

SEQ ID NO: 3781482 - RNA, 17 nt, Salmonella typhimurium LT2
cugcacggcgucaucca

SEQ ID NO: 3781483 - RNA, 14 nt, Salmonella typhimurium LT2
cugcacucgauggc

SEQ ID NO: 3781484 - RNA, 23 nt, Salmonella typhimurium LT2
cugcacuucaaugucguuaucgc

SEQ ID NO: 3781485 - RNA, 17 nt, Salmonella typhimurium LT2
cugcacuuccagccacg

SEQ ID NO: 3781486 - RNA, 22 nt, Salmonella typhimurium LT2
cugcagaaucccgauaaucaau

SEQ ID NO: 3781487 - RNA, 20 nt, Salmonella typhimurium LT2
cugcagacccacuuucagcu

SEQ ID NO: 3781488 - RNA, 23 nt, Salmonella typhimurium LT2
cugcagacccacuuucagcuccg

SEQ ID NO: 3781489 - RNA, 18 nt, Salmonella typhimurium LT2
cugcagacugccggcaaa

SEQ ID NO: 3781490 - RNA, 23 nt, Salmonella typhimurium LT2
cugcagaugcugcugcgcggcca

SEQ ID NO: 3781491 - RNA, 14 nt, Salmonella typhimurium LT2
cugcagauuauuuc

SEQ ID NO: 3781492 - RNA, 22 nt, Salmonella typhimurium LT2
cugcagauuuugcucccuggug

SEQ ID NO: 3781493 - RNA, 19 nt, Salmonella typhimurium LT2
cugcagcgccaggaaggua

SEQ ID NO: 3781494 - RNA, 23 nt, Salmonella typhimurium LT2
cugcaggcgggugcgcagcccca

SEQ ID NO: 3781495 - RNA, 20 nt, Salmonella typhimurium LT2
cugcaggcggugcgcagcca

SEQ ID NO: 3781496 - RNA, 16 nt, Salmonella typhimurium LT2
cugcagggugaagaug

SEQ ID NO: 3781497 - RNA, 22 nt, Salmonella typhimurium LT2
cugcaggguuugcgcagacugc

SEQ ID NO: 3781498 - RNA, 14 nt, Salmonella typhimurium LT2
cugcaggucacgau

SEQ ID NO: 3781499 - RNA, 17 nt, Salmonella typhimurium LT2
cugcaggugcguuggcu

SEQ ID NO: 3781500 - RNA, 13 nt, Salmonella typhimurium LT2
cugcauaaacgcg

SEQ ID NO: 3781501 - RNA, 14 nt, Salmonella typhimurium LT2
cugcauacucacau

SEQ ID NO: 3781502 - RNA, 21 nt, Salmonella typhimurium LT2
cugcauacucacauucauaaa

SEQ ID NO: 3781503 - RNA, 16 nt, Salmonella typhimurium LT2
cugcauaggcuuuacc

SEQ ID NO: 3781504 - RNA, 16 nt, Salmonella typhimurium LT2
cugcaucaacaggcga

SEQ ID NO: 3781505 - RNA, 13 nt, Salmonella typhimurium LT2
cugcauccgcuuu

SEQ ID NO: 3781506 - RNA, 21 nt, Salmonella typhimurium LT2
cugcauccgcuuucucggcga

SEQ ID NO: 3781507 - RNA, 19 nt, Salmonella typhimurium LT2
cugcaucgugagcgcguca

SEQ ID NO: 3781508 - RNA, 20 nt, Salmonella typhimurium LT2
cugcaucguuugcaguuccg

SEQ ID NO: 3781509 - RNA, 21 nt, Salmonella typhimurium LT2
cugcaucugcggucuccugaa

SEQ ID NO: 3781510 - RNA, 16 nt, Salmonella typhimurium LT2
cugcaucuuacugacc

SEQ ID NO: 3781511 - RNA, 15 nt, Salmonella typhimurium LT2
cugcauugccugauu

SEQ ID NO: 3781512 - RNA, 12 nt, Salmonella typhimurium LT2
cugcauuucuug

SEQ ID NO: 3781513 - RNA, 12 nt, Salmonella typhimurium LT2
cugccaaccauc

SEQ ID NO: 3781514 - RNA, 21 nt, Salmonella typhimurium LT2
cugccaaccaucaacuccgga

SEQ ID NO: 3781515 - RNA, 16 nt, Salmonella typhimurium LT2
cugccaccgucgcggc

SEQ ID NO: 3781516 - RNA, 15 nt, Salmonella typhimurium LT2
cugccagaccggcga

SEQ ID NO: 3781517 - RNA, 13 nt, Salmonella typhimurium LT2
cugccagcacagc

SEQ ID NO: 3781518 - RNA, 15 nt, Salmonella typhimurium LT2
cugccagcaccagca

SEQ ID NO: 3781519 - RNA, 16 nt, Salmonella typhimurium LT2
cugccagcaccagcag

SEQ ID NO: 3781520 - RNA, 22 nt, Salmonella typhimurium LT2
cugccagcaugauaauggcaua

SEQ ID NO: 3781521 - RNA, 15 nt, Salmonella typhimurium LT2
cugccagccagcggg

SEQ ID NO: 3781522 - RNA, 18 nt, Salmonella typhimurium LT2
cugccagccagcgggcug

SEQ ID NO: 3781523 - RNA, 21 nt, Salmonella typhimurium LT2
cugccagccgccgccggacug

SEQ ID NO: 3781524 - RNA, 20 nt, Salmonella typhimurium LT2
cugccaggacgauauccacg

SEQ ID NO: 3781525 - RNA, 20 nt, Salmonella typhimurium LT2
cugccaggcauaccuccucu

SEQ ID NO: 3781526 - RNA, 15 nt, Salmonella typhimurium LT2
cugccagggcaucgc

SEQ ID NO: 3781527 - RNA, 22 nt, Salmonella typhimurium LT2
cugccagguuauuucgcgcagu

SEQ ID NO: 3781528 - RNA, 18 nt, Salmonella typhimurium LT2
cugccaguagauggcgcu

SEQ ID NO: 3781529 - RNA, 18 nt, Salmonella typhimurium LT2
cugccaguccgcccgccu

SEQ ID NO: 3781530 - RNA, 18 nt, Salmonella typhimurium LT2
cugccauagcaucaccag

SEQ ID NO: 3781531 - RNA, 17 nt, Salmonella typhimurium LT2
cugccauagccgguaug

SEQ ID NO: 3781532 - RNA, 12 nt, Salmonella typhimurium LT2
cugccaucaucc

SEQ ID NO: 3781533 - RNA, 13 nt, Salmonella typhimurium LT2
cugccaucaucca

SEQ ID NO: 3781534 - RNA, 15 nt, Salmonella typhimurium LT2
cugccaucauccagu

SEQ ID NO: 3781535 - RNA, 15 nt, Salmonella typhimurium LT2
cugccaugccugaug

SEQ ID NO: 3781536 - RNA, 17 nt, Salmonella typhimurium LT2
cugccauuaucaccauu

SEQ ID NO: 3781537 - RNA, 23 nt, Salmonella typhimurium LT2
cugccauuaucaccauucccagc

SEQ ID NO: 3781538 - RNA, 17 nt, Salmonella typhimurium LT2
cugccauuguuccggcg

SEQ ID NO: 3781539 - RNA, 13 nt, Salmonella typhimurium LT2
cugcccacccggg

SEQ ID NO: 3781540 - RNA, 13 nt, Salmonella typhimurium LT2
cugcccaccuucg

SEQ ID NO: 3781541 - RNA, 16 nt, Salmonella typhimurium LT2
cugcccagagaauauu

SEQ ID NO: 3781542 - RNA, 14 nt, Salmonella typhimurium LT2
cugcccagccgcca

SEQ ID NO: 3781543 - RNA, 15 nt, Salmonella typhimurium LT2
cugcccccggcgccu

SEQ ID NO: 3781544 - RNA, 17 nt, Salmonella typhimurium LT2
cugccccggugagcgcc

SEQ ID NO: 3781545 - RNA, 18 nt, Salmonella typhimurium LT2
cugccccggugagcgccg

SEQ ID NO: 3781546 - RNA, 13 nt, Salmonella typhimurium LT2
cugcccgccaggg

SEQ ID NO: 3781547 - RNA, 11 nt, Salmonella typhimurium LT2
cugcccgccgc

SEQ ID NO: 3781548 - RNA, 13 nt, Salmonella typhimurium LT2
cugcccgccgcca

SEQ ID NO: 3781549 - RNA, 17 nt, Salmonella typhimurium LT2
cugcccgccgccaccau

SEQ ID NO: 3781550 - RNA, 19 nt, Salmonella typhimurium LT2
cugcccgccgccaccaugu

SEQ ID NO: 3781551 - RNA, 15 nt, Salmonella typhimurium LT2
cugcccgccgccagc

SEQ ID NO: 3781552 - RNA, 17 nt, Salmonella typhimurium LT2
cugcccgccgccagccu

SEQ ID NO: 3781553 - RNA, 16 nt, Salmonella typhimurium LT2
cugcccgcgccaucca

SEQ ID NO: 3781554 - RNA, 15 nt, Salmonella typhimurium LT2
cugcccuguuccagg

SEQ ID NO: 3781555 - RNA, 18 nt, Salmonella typhimurium LT2
cugcccuuucagagcguc

SEQ ID NO: 3781556 - RNA, 18 nt, Salmonella typhimurium LT2
cugcccuuucuucaacgg

SEQ ID NO: 3781557 - RNA, 13 nt, Salmonella typhimurium LT2
cugcccuuuuagc

SEQ ID NO: 3781558 - RNA, 17 nt, Salmonella typhimurium LT2
cugcccuuuuagcacuu

SEQ ID NO: 3781559 - RNA, 19 nt, Salmonella typhimurium LT2
cugccgacaaagagcuccc

SEQ ID NO: 3781560 - RNA, 14 nt, Salmonella typhimurium LT2
cugccgacaggcag

SEQ ID NO: 3781561 - RNA, 22 nt, Salmonella typhimurium LT2
cugccgacgcccucaauaucuu

SEQ ID NO: 3781562 - RNA, 17 nt, Salmonella typhimurium LT2
cugccgacuacgccucc

SEQ ID NO: 3781563 - RNA, 14 nt, Salmonella typhimurium LT2
cugccgcaaacgcc

SEQ ID NO: 3781564 - RNA, 15 nt, Salmonella typhimurium LT2
cugccgcagccgcuc

SEQ ID NO: 3781565 - RNA, 14 nt, Salmonella typhimurium LT2
cugccgcaucugac

SEQ ID NO: 3781566 - RNA, 22 nt, Salmonella typhimurium LT2
cugccgccauaacgccggcgcu

SEQ ID NO: 3781567 - RNA, 12 nt, Salmonella typhimurium LT2
cugccgccaucg

SEQ ID NO: 3781568 - RNA, 13 nt, Salmonella typhimurium LT2
cugccgccaucgc

SEQ ID NO: 3781569 - RNA, 20 nt, Salmonella typhimurium LT2
cugccgccauuugcgcggcu

SEQ ID NO: 3781570 - RNA, 16 nt, Salmonella typhimurium LT2
cugccgcccaucgcca

SEQ ID NO: 3781571 - RNA, 17 nt, Salmonella typhimurium LT2
cugccgcccaucgccac

SEQ ID NO: 3781572 - RNA, 18 nt, Salmonella typhimurium LT2
cugccgccguaacgugcu

SEQ ID NO: 3781573 - RNA, 22 nt, Salmonella typhimurium LT2
cugccggaaaccuguucccggc

SEQ ID NO: 3781574 - RNA, 14 nt, Salmonella typhimurium LT2
cugccggacugcuc

SEQ ID NO: 3781575 - RNA, 15 nt, Salmonella typhimurium LT2
cugcguugcgcgcgu

SEQ ID NO: 3781576 - RNA, 20 nt, Salmonella typhimurium LT2
cugcguugcuauggcaacaa

SEQ ID NO: 3781577 - RNA, 20 nt, Salmonella typhimurium LT2
cugcguugcucgccagccug

SEQ ID NO: 3781578 - RNA, 20 nt, Salmonella typhimurium LT2
cugcguugggugcagcguca

SEQ ID NO: 3781579 - RNA, 21 nt, Salmonella typhimurium LT2
cugcguuugaaauaccaggcg

SEQ ID NO: 3781580 - RNA, 15 nt, Salmonella typhimurium LT2
cugcguuugccgccu

SEQ ID NO: 3781581 - RNA, 22 nt, Salmonella typhimurium LT2
cugcguuugccgccuugucuca

SEQ ID NO: 3781582 - RNA, 19 nt, Salmonella typhimurium LT2
cugcuaaacgaaccgucau

SEQ ID NO: 3781583 - RNA, 17 nt, Salmonella typhimurium LT2
cugcuaguagcggaaua

SEQ ID NO: 3781584 - RNA, 21 nt, Salmonella typhimurium LT2
cugcucacgguuuagcucugu

SEQ ID NO: 3781585 - RNA, 22 nt, Salmonella typhimurium LT2
cugcucauaacccuccugccuu

SEQ ID NO: 3781586 - RNA, 18 nt, Salmonella typhimurium LT2
cugcucauuucagcgagu

SEQ ID NO: 3781587 - RNA, 19 nt, Salmonella typhimurium LT2
cugcuccaguuucgccagc

SEQ ID NO: 3781588 - RNA, 22 nt, Salmonella typhimurium LT2
cugcuccggcuuaaugcccggc

SEQ ID NO: 3781589 - RNA, 19 nt, Salmonella typhimurium LT2
cugcuccguccacgcgagc

SEQ ID NO: 3781590 - RNA, 23 nt, Salmonella typhimurium LT2
cugcucgauaccuuccgggccgg

SEQ ID NO: 3781591 - RNA, 13 nt, Salmonella typhimurium LT2
cugcucgccagua

SEQ ID NO: 3781592 - RNA, 14 nt, Salmonella typhimurium LT2
cugcucgguaucgu

SEQ ID NO: 3781593 - RNA, 19 nt, Salmonella typhimurium LT2
cugcucguuaaauccuccc

SEQ ID NO: 3781594 - RNA, 20 nt, Salmonella typhimurium LT2
cugcucguuaaauccuccca

SEQ ID NO: 3781595 - RNA, 20 nt, Salmonella typhimurium LT2
cugcucuucuugcggugaga

SEQ ID NO: 3781596 - RNA, 18 nt, Salmonella typhimurium LT2
cugcucuuugacaaacgc

SEQ ID NO: 3781597 - RNA, 20 nt, Salmonella typhimurium LT2
cugcugaacacaaugaaucc

SEQ ID NO: 3781598 - RNA, 20 nt, Salmonella typhimurium LT2
cugcugaccuuaauccagcc

SEQ ID NO: 3781599 - RNA, 19 nt, Salmonella typhimurium LT2
cugcugacguaaauucuga

SEQ ID NO: 3781600 - RNA, 11 nt, Salmonella typhimurium LT2
cugcugauaac

SEQ ID NO: 3781601 - RNA, 15 nt, Salmonella typhimurium LT2
cugcugauaauacug

SEQ ID NO: 3781602 - RNA, 22 nt, Salmonella typhimurium LT2
cugcugauaguccaguacccgc

SEQ ID NO: 3781603 - RNA, 13 nt, Salmonella typhimurium LT2
cugcugaugccag

SEQ ID NO: 3781604 - RNA, 20 nt, Salmonella typhimurium LT2
cugcugcaacgucgcgcccu

SEQ ID NO: 3781605 - RNA, 14 nt, Salmonella typhimurium LT2
cugcugccagccgc

SEQ ID NO: 3781606 - RNA, 18 nt, Salmonella typhimurium LT2
cugcugccagccgccgcc

SEQ ID NO: 3781607 - RNA, 15 nt, Salmonella typhimurium LT2
cugcugccgcagcac

SEQ ID NO: 3781608 - RNA, 13 nt, Salmonella typhimurium LT2
cugcugcgcggcc

SEQ ID NO: 3781609 - RNA, 16 nt, Salmonella typhimurium LT2
cugcugcgcggccaga

SEQ ID NO: 3781610 - RNA, 21 nt, Salmonella typhimurium LT2
cugcugcucccucacgcguca

SEQ ID NO: 3781611 - RNA, 23 nt, Salmonella typhimurium LT2
cugcugcuugcuuuucaucacca

SEQ ID NO: 3781612 - RNA, 16 nt, Salmonella typhimurium LT2
cugcuggcagcgcuga

SEQ ID NO: 3781613 - RNA, 14 nt, Salmonella typhimurium LT2
cugcuggccuucca

SEQ ID NO: 3781614 - RNA, 17 nt, Salmonella typhimurium LT2
cugcuggcgaugauaau

SEQ ID NO: 3781615 - RNA, 14 nt, Salmonella typhimurium LT2
cugcuggcgcguca

SEQ ID NO: 3781616 - RNA, 19 nt, Salmonella typhimurium LT2
cugcuggguacgugcaaac

SEQ ID NO: 3781617 - RNA, 18 nt, Salmonella typhimurium LT2
cugcugggucugcugggc

SEQ ID NO: 3781618 - RNA, 15 nt, Salmonella typhimurium LT2
cugcugguagagcau

SEQ ID NO: 3781619 - RNA, 16 nt, Salmonella typhimurium LT2
cugcuguaacagacgc

SEQ ID NO: 3781620 - RNA, 22 nt, Salmonella typhimurium LT2
cugcuguagcugucccagcguc

SEQ ID NO: 3781621 - RNA, 21 nt, Salmonella typhimurium LT2
cugcuguaugauuucacccag

SEQ ID NO: 3781622 - RNA, 22 nt, Salmonella typhimurium LT2
cugcuguguccaggucaucacc

SEQ ID NO: 3781623 - RNA, 15 nt, Salmonella typhimurium LT2
cugcuguuaccggac

SEQ ID NO: 3781624 - RNA, 16 nt, Salmonella typhimurium LT2
cugcuuaaacagaauu

SEQ ID NO: 3781625 - RNA, 22 nt, Salmonella typhimurium LT2
cugcuuaucgauaucugccugc

SEQ ID NO: 3781626 - RNA, 12 nt, Salmonella typhimurium LT2
cugcuucagcca

SEQ ID NO: 3781627 - RNA, 14 nt, Salmonella typhimurium LT2
cugcuuccugccgc

SEQ ID NO: 3781628 - RNA, 18 nt, Salmonella typhimurium LT2
cugcuucggaaugacaaa

SEQ ID NO: 3781629 - RNA, 14 nt, Salmonella typhimurium LT2
cugcuucgucuucg

SEQ ID NO: 3781630 - RNA, 13 nt, Salmonella typhimurium LT2
cugcuucugcccc

SEQ ID NO: 3781631 - RNA, 13 nt, Salmonella typhimurium LT2
cugcuucuggcuu

SEQ ID NO: 3781632 - RNA, 12 nt, Salmonella typhimurium LT2
cugcuuggccug

SEQ ID NO: 3781633 - RNA, 23 nt, Salmonella typhimurium LT2
cugcuugucacgaaguuccagua

SEQ ID NO: 3781634 - RNA, 17 nt, Salmonella typhimurium LT2
cugcuuucuaccagccu

SEQ ID NO: 3781635 - RNA, 19 nt, Salmonella typhimurium LT2
cugcuuucuaccagccugg

SEQ ID NO: 3781636 - RNA, 12 nt, Salmonella typhimurium LT2
cugcuuuuucua

SEQ ID NO: 3781637 - RNA, 13 nt, Salmonella typhimurium LT2
cugcuuuuucuag

SEQ ID NO: 3781638 - RNA, 20 nt, Salmonella typhimurium LT2
cuggaaacagccaaucauaa

SEQ ID NO: 3781639 - RNA, 18 nt, Salmonella typhimurium LT2
cuggaacaggccaaaccc

SEQ ID NO: 3781640 - RNA, 22 nt, Salmonella typhimurium LT2
cuggaacaguaaucgcacggcu

SEQ ID NO: 3781641 - RNA, 21 nt, Salmonella typhimurium LT2
cuggaaccagugaauacugcg

SEQ ID NO: 3781642 - RNA, 22 nt, Salmonella typhimurium LT2
cuggaacgcgucggcgcgggga

SEQ ID NO: 3781643 - RNA, 22 nt, Salmonella typhimurium LT2
cuggaacugaucguggccacac

SEQ ID NO: 3781644 - RNA, 15 nt, Salmonella typhimurium LT2
cuggaacuggcucca

SEQ ID NO: 3781645 - RNA, 14 nt, Salmonella typhimurium LT2
cuggaacugucccg

SEQ ID NO: 3781646 - RNA, 22 nt, Salmonella typhimurium LT2
cuggaauaaccggugccaaagu

SEQ ID NO: 3781647 - RNA, 20 nt, Salmonella typhimurium LT2
cuggaauagcgugggcagac

SEQ ID NO: 3781648 - RNA, 17 nt, Salmonella typhimurium LT2
cuggaaucuaccgccau

SEQ ID NO: 3781649 - RNA, 20 nt, Salmonella typhimurium LT2
cuggaauuugucgucaugcg

SEQ ID NO: 3781650 - RNA, 20 nt, Salmonella typhimurium LT2
cuggacaugcuccgccccgc

SEQ ID NO: 3781651 - RNA, 15 nt, Salmonella typhimurium LT2
cuggagaacgagaaa

SEQ ID NO: 3781652 - RNA, 15 nt, Salmonella typhimurium LT2
cuggagaccaccggc

SEQ ID NO: 3781653 - RNA, 21 nt, Salmonella typhimurium LT2
cuggagaccaccggcaaagcg

SEQ ID NO: 3781654 - RNA, 21 nt, Salmonella typhimurium LT2
cuggagcgcauuuuacugccg

SEQ ID NO: 3781655 - RNA, 18 nt, Salmonella typhimurium LT2
cuggagcguaagcgcggu

SEQ ID NO: 3781656 - RNA, 16 nt, Salmonella typhimurium LT2
cuggagggguuucccc

SEQ ID NO: 3781657 - RNA, 19 nt, Salmonella typhimurium LT2
cuggagggguuucccccuc

SEQ ID NO: 3781658 - RNA, 14 nt, Salmonella typhimurium LT2
cuggauaaaagguc

SEQ ID NO: 3781659 - RNA, 19 nt, Salmonella typhimurium LT2
cuggauaagcgcagcgcca

SEQ ID NO: 3781660 - RNA, 17 nt, Salmonella typhimurium LT2
cuggauacguuccagca

SEQ ID NO: 3781661 - RNA, 13 nt, Salmonella typhimurium LT2
cuggauagagcau

SEQ ID NO: 3781662 - RNA, 23 nt, Salmonella typhimurium LT2
cuggauagagcaucaaccuccua

SEQ ID NO: 3781663 - RNA, 16 nt, Salmonella typhimurium LT2
cuggauagccucguug

SEQ ID NO: 3781664 - RNA, 21 nt, Salmonella typhimurium LT2
cuggaucacuuuugccgucag

SEQ ID NO: 3781665 - RNA, 12 nt, Salmonella typhimurium LT2
cuggaugauaaa

SEQ ID NO: 3781666 - RNA, 18 nt, Salmonella typhimurium LT2
cuggauuacaaaaauaga

SEQ ID NO: 3781667 - RNA, 14 nt, Salmonella typhimurium LT2
cuggauuaucaaua

SEQ ID NO: 3781668 - RNA, 23 nt, Salmonella typhimurium LT2
cuggauuuggcugccgagcagau

SEQ ID NO: 3781669 - RNA, 17 nt, Salmonella typhimurium LT2
cuggcaaaacgcaucca

SEQ ID NO: 3781670 - RNA, 22 nt, Salmonella typhimurium LT2
cuggcaaaacgcauccagcgca

SEQ ID NO: 3781671 - RNA, 13 nt, Salmonella typhimurium LT2
cuggcaaacaagc

SEQ ID NO: 3781672 - RNA, 19 nt, Salmonella typhimurium LT2
cuggcaaaccggucggcgu

SEQ ID NO: 3781673 - RNA, 22 nt, Salmonella typhimurium LT2
cuggcaaagcgucauguaaugc

SEQ ID NO: 3781674 - RNA, 23 nt, Salmonella typhimurium LT2
cuggcaaagcgucauguaaugcu

SEQ ID NO: 3781675 - RNA, 24 nt, Salmonella typhimurium LT2
cuggcaacauagcaucguuaccgc

SEQ ID NO: 3781676 - RNA, 13 nt, Salmonella typhimurium LT2
cuggcaagcgcca

SEQ ID NO: 3781677 - RNA, 21 nt, Salmonella typhimurium LT2
cuggcaagcgccagcauggcg

SEQ ID NO: 3781678 - RNA, 13 nt, Salmonella typhimurium LT2
cuggucauccccg

SEQ ID NO: 3781679 - RNA, 23 nt, Salmonella typhimurium LT2
cuggucgagauacugcaacgcca

SEQ ID NO: 3781680 - RNA, 16 nt, Salmonella typhimurium LT2
cuggucgccagcgccg

SEQ ID NO: 3781681 - RNA, 13 nt, Salmonella typhimurium LT2
cuggucgggcagg

SEQ ID NO: 3781682 - RNA, 21 nt, Salmonella typhimurium LT2
cuggugaaacguguuuauccc

SEQ ID NO: 3781683 - RNA, 15 nt, Salmonella typhimurium LT2
cuggugacaucgcca

SEQ ID NO: 3781684 - RNA, 17 nt, Salmonella typhimurium LT2
cuggugacgaugauaac

SEQ ID NO: 3781685 - RNA, 18 nt, Salmonella typhimurium LT2
cuggugacgaugauaaca

SEQ ID NO: 3781686 - RNA, 18 nt, Salmonella typhimurium LT2
cuggugcagcaagcggcu

SEQ ID NO: 3781687 - RNA, 12 nt, Salmonella typhimurium LT2
cuggugcccggu

SEQ ID NO: 3781688 - RNA, 22 nt, Salmonella typhimurium LT2
cuggugcgacaccacgcaggcg

SEQ ID NO: 3781689 - RNA, 13 nt, Salmonella typhimurium LT2
cugguggaacggc

SEQ ID NO: 3781690 - RNA, 19 nt, Salmonella typhimurium LT2
cugguggcaagauaagccg

SEQ ID NO: 3781691 - RNA, 15 nt, Salmonella typhimurium LT2
cugguggucuacggc

SEQ ID NO: 3781692 - RNA, 22 nt, Salmonella typhimurium LT2
cugguguaaaccaggcauuuuc

SEQ ID NO: 3781693 - RNA, 24 nt, Salmonella typhimurium LT2
cugguuaaugccuucgccgccgcu

SEQ ID NO: 3781694 - RNA, 13 nt, Salmonella typhimurium LT2
cugguucaacauc

SEQ ID NO: 3781695 - RNA, 20 nt, Salmonella typhimurium LT2
cugguucaacaucagcgcua

SEQ ID NO: 3781696 - RNA, 14 nt, Salmonella typhimurium LT2
cugguugaccggaa

SEQ ID NO: 3781697 - RNA, 18 nt, Salmonella typhimurium LT2
cugguugcccauggcauc

SEQ ID NO: 3781698 - RNA, 22 nt, Salmonella typhimurium LT2
cugguugucacggaucuucuuc

SEQ ID NO: 3781699 - RNA, 16 nt, Salmonella typhimurium LT2
cugguuucccugccuc

SEQ ID NO: 3781700 - RNA, 15 nt, Salmonella typhimurium LT2
cugguuugucgauuu

SEQ ID NO: 3781701 - RNA, 13 nt, Salmonella typhimurium LT2
cugguuuuccgcu

SEQ ID NO: 3781702 - RNA, 18 nt, Salmonella typhimurium LT2
cugguuuugcguaaucca

SEQ ID NO: 3781703 - RNA, 12 nt, Salmonella typhimurium LT2
cuguaaaaggga

SEQ ID NO: 3781704 - RNA, 21 nt, Salmonella typhimurium LT2
cuguaaaccgccuccaggccg

SEQ ID NO: 3781705 - RNA, 13 nt, Salmonella typhimurium LT2
cuguaaauguucc

SEQ ID NO: 3781706 - RNA, 14 nt, Salmonella typhimurium LT2
cuguaacaggggau

SEQ ID NO: 3781707 - RNA, 15 nt, Salmonella typhimurium LT2
cuguaacaguauccg

SEQ ID NO: 3781708 - RNA, 17 nt, Salmonella typhimurium LT2
cuguaacuucacgccau

SEQ ID NO: 3781709 - RNA, 23 nt, Salmonella typhimurium LT2
cuguaauagauaugaaagaagga

SEQ ID NO: 3781710 - RNA, 17 nt, Salmonella typhimurium LT2
cuguaaugucuggugca

SEQ ID NO: 3781711 - RNA, 23 nt, Salmonella typhimurium LT2
cuguaauucucccaaauuuuuuu

SEQ ID NO: 3781712 - RNA, 19 nt, Salmonella typhimurium LT2
cuguacauaacaucucacu

SEQ ID NO: 3781713 - RNA, 14 nt, Salmonella typhimurium LT2
cuguaccaccacgc

SEQ ID NO: 3781714 - RNA, 22 nt, Salmonella typhimurium LT2
cuguaccguuuuguaggccgga

SEQ ID NO: 3781715 - RNA, 13 nt, Salmonella typhimurium LT2
cuguacgacugga

SEQ ID NO: 3781716 - RNA, 17 nt, Salmonella typhimurium LT2
cuguacgacuggauaca

SEQ ID NO: 3781717 - RNA, 15 nt, Salmonella typhimurium LT2
cuguacgccacggcu

SEQ ID NO: 3781718 - RNA, 21 nt, Salmonella typhimurium LT2
cuguacgccacggcuuaaauc

SEQ ID NO: 3781719 - RNA, 15 nt, Salmonella typhimurium LT2
cuguacgcccagccg

SEQ ID NO: 3781720 - RNA, 16 nt, Salmonella typhimurium LT2
cuguacgcccagccgu

SEQ ID NO: 3781721 - RNA, 13 nt, Salmonella typhimurium LT2
cuguacgccucuu

SEQ ID NO: 3781722 - RNA, 14 nt, Salmonella typhimurium LT2
cuguacgccucuuu

SEQ ID NO: 3781723 - RNA, 14 nt, Salmonella typhimurium LT2
cuguacgcgggaaa

SEQ ID NO: 3781724 - RNA, 19 nt, Salmonella typhimurium LT2
cuguacgcgggaaauaccu

SEQ ID NO: 3781725 - RNA, 18 nt, Salmonella typhimurium LT2
cuguacgcugaacaaccc

SEQ ID NO: 3781726 - RNA, 18 nt, Salmonella typhimurium LT2
cuguagauaccuacuuua

SEQ ID NO: 3781727 - RNA, 13 nt, Salmonella typhimurium LT2
cuguagccagccu

SEQ ID NO: 3781728 - RNA, 16 nt, Salmonella typhimurium LT2
cuguagcgccgcuucc

SEQ ID NO: 3781729 - RNA, 20 nt, Salmonella typhimurium LT2
cuguagcgccgcuuccaggc

SEQ ID NO: 3781730 - RNA, 22 nt, Salmonella typhimurium LT2
cuguagcgcuuuuuccagcgca

SEQ ID NO: 3781731 - RNA, 23 nt, Salmonella typhimurium LT2
cuguagcgucucaucaaaaaggc

SEQ ID NO: 3781732 - RNA, 19 nt, Salmonella typhimurium LT2
cuguagcguuucgcgcgcg

SEQ ID NO: 3781733 - RNA, 22 nt, Salmonella typhimurium LT2
cuguagggcacugggcgauacc

SEQ ID NO: 3781734 - RNA, 13 nt, Salmonella typhimurium LT2
cuguauaaauaaa

SEQ ID NO: 3781735 - RNA, 22 nt, Salmonella typhimurium LT2
cuguauacauacauacauacca

SEQ ID NO: 3781736 - RNA, 18 nt, Salmonella typhimurium LT2
cugucaaaacccagccca

SEQ ID NO: 3781737 - RNA, 14 nt, Salmonella typhimurium LT2
cugucaccagcagc

SEQ ID NO: 3781738 - RNA, 15 nt, Salmonella typhimurium LT2
cugucagaacccugu

SEQ ID NO: 3781739 - RNA, 18 nt, Salmonella typhimurium LT2
cugucauaggcgacaggc

SEQ ID NO: 3781740 - RNA, 12 nt, Salmonella typhimurium LT2
cugucaucauca

SEQ ID NO: 3781741 - RNA, 21 nt, Salmonella typhimurium LT2
cugucaucaucaaguaccgug

SEQ ID NO: 3781742 - RNA, 23 nt, Salmonella typhimurium LT2
cugucaucgaaggcgauaccggu

SEQ ID NO: 3781743 - RNA, 19 nt, Salmonella typhimurium LT2
cugucauugggagcaaagc

SEQ ID NO: 3781744 - RNA, 20 nt, Salmonella typhimurium LT2
cuguccacgacagaacccgg

SEQ ID NO: 3781745 - RNA, 17 nt, Salmonella typhimurium LT2
cuguccagaucuuccca

SEQ ID NO: 3781746 - RNA, 20 nt, Salmonella typhimurium LT2
cuguccauaccggacuccag

SEQ ID NO: 3781747 - RNA, 15 nt, Salmonella typhimurium LT2
cugucccagcgcacg

SEQ ID NO: 3781748 - RNA, 13 nt, Salmonella typhimurium LT2
cugucccagcguc

SEQ ID NO: 3781749 - RNA, 16 nt, Salmonella typhimurium LT2
cugucccccagggaug

SEQ ID NO: 3781750 - RNA, 21 nt, Salmonella typhimurium LT2
cuguccgccuuaucaggccug

SEQ ID NO: 3781751 - RNA, 22 nt, Salmonella typhimurium LT2
cuguccgggcguuucagcuucc

SEQ ID NO: 3781752 - RNA, 18 nt, Salmonella typhimurium LT2
cugucgaccgcuccacuc

SEQ ID NO: 3781753 - RNA, 12 nt, Salmonella typhimurium LT2
cugucgacuggc

SEQ ID NO: 3781754 - RNA, 19 nt, Salmonella typhimurium LT2
cugucgauaaacucaugcg

SEQ ID NO: 3781755 - RNA, 21 nt, Salmonella typhimurium LT2
cugucgauaauauccagcacg

SEQ ID NO: 3781756 - RNA, 21 nt, Salmonella typhimurium LT2
cugucgaucauccacccggcu

SEQ ID NO: 3781757 - RNA, 17 nt, Salmonella typhimurium LT2
cugucgauccccucuuc

SEQ ID NO: 3781758 - RNA, 20 nt, Salmonella typhimurium LT2
cugucgauuuccggcggcag

SEQ ID NO: 3781759 - RNA, 13 nt, Salmonella typhimurium LT2
cugucgccaccac

SEQ ID NO: 3781760 - RNA, 14 nt, Salmonella typhimurium LT2
cugucgccaccacu

SEQ ID NO: 3781761 - RNA, 15 nt, Salmonella typhimurium LT2
cugucgccaccacuc

SEQ ID NO: 3781762 - RNA, 20 nt, Salmonella typhimurium LT2
cugucgccgcguaaauccac

SEQ ID NO: 3781763 - RNA, 23 nt, Salmonella typhimurium LT2
cugucgccugcugcuggacagga

SEQ ID NO: 3781764 - RNA, 14 nt, Salmonella typhimurium LT2
cugucgcuuauucg

SEQ ID NO: 3781765 - RNA, 18 nt, Salmonella typhimurium LT2
cugucggagagcggcaug

SEQ ID NO: 3781766 - RNA, 15 nt, Salmonella typhimurium LT2
cugucggcagaaccu

SEQ ID NO: 3781767 - RNA, 16 nt, Salmonella typhimurium LT2
cugucggcgagguacu

SEQ ID NO: 3781768 - RNA, 22 nt, Salmonella typhimurium LT2
cugucggcgagguacugcauaa

SEQ ID NO: 3781769 - RNA, 17 nt, Salmonella typhimurium LT2
cugucggcgguaaaccg

SEQ ID NO: 3781770 - RNA, 14 nt, Salmonella typhimurium LT2
cugucguacuccag

SEQ ID NO: 3781771 - RNA, 12 nt, Salmonella typhimurium LT2
cugucguagccg

SEQ ID NO: 3781772 - RNA, 22 nt, Salmonella typhimurium LT2
cugucucuauuaaccgggacuc

SEQ ID NO: 3781773 - RNA, 22 nt, Salmonella typhimurium LT2
cugucugaaucaaugcaucuuc

SEQ ID NO: 3781774 - RNA, 18 nt, Salmonella typhimurium LT2
cugucugucgcgggcgaa

SEQ ID NO: 3781775 - RNA, 22 nt, Salmonella typhimurium LT2
cugucuuacacugauaccccag

SEQ ID NO: 3781776 - RNA, 14 nt, Salmonella typhimurium LT2
cugucuuguuuuuc

SEQ ID NO: 3781777 - RNA, 11 nt, Salmonella typhimurium LT2
cugugaaaacg

SEQ ID NO: 3781778 - RNA, 16 nt, Salmonella typhimurium LT2
cugugagccuaaaaca

SEQ ID NO: 3781779 - RNA, 13 nt, Salmonella typhimurium LT2
cugugaggaaagc

SEQ ID NO: 3781780 - RNA, 21 nt, Salmonella typhimurium LT2
cugugaggaaagcgaaaauaa

SEQ ID NO: 3781781 - RNA, 19 nt, Salmonella typhimurium LT2
cugugccacauuuaugucg

SEQ ID NO: 3781782 - RNA, 18 nt, Salmonella typhimurium LT2
cuuacuuuccaaaaucca

SEQ ID NO: 3781783 - RNA, 22 nt, Salmonella typhimurium LT2
cuuacuuuccaaaauccaggga

SEQ ID NO: 3781784 - RNA, 17 nt, Salmonella typhimurium LT2
cuuagcagcauaaacau

SEQ ID NO: 3781785 - RNA, 13 nt, Salmonella typhimurium LT2
cuuagcuguuacg

SEQ ID NO: 3781786 - RNA, 17 nt, Salmonella typhimurium LT2
cuuaggggcucuuuuuu

SEQ ID NO: 3781787 - RNA, 18 nt, Salmonella typhimurium LT2
cuuaguaucauauuuucu

SEQ ID NO: 3781788 - RNA, 14 nt, Salmonella typhimurium LT2
cuuauaaauaagaa

SEQ ID NO: 3781789 - RNA, 23 nt, Salmonella typhimurium LT2
cuuauaaaucagcuuugcggcca

SEQ ID NO: 3781790 - RNA, 20 nt, Salmonella typhimurium LT2
cuuauaggcgcaucugaaaa

SEQ ID NO: 3781791 - RNA, 18 nt, Salmonella typhimurium LT2
cuuaucaacuucuucauc

SEQ ID NO: 3781792 - RNA, 22 nt, Salmonella typhimurium LT2
cuuaucaggccgacaaaugacg

SEQ ID NO: 3781793 - RNA, 13 nt, Salmonella typhimurium LT2
cuuaucaggccua

SEQ ID NO: 3781794 - RNA, 14 nt, Salmonella typhimurium LT2
cuuauccagccacu

SEQ ID NO: 3781795 - RNA, 17 nt, Salmonella typhimurium LT2
cuuauccaguacaagca

SEQ ID NO: 3781796 - RNA, 20 nt, Salmonella typhimurium LT2
cuuaucccacaacuguucuu

SEQ ID NO: 3781797 - RNA, 18 nt, Salmonella typhimurium LT2
cuuaucccugcggcuggu

SEQ ID NO: 3781798 - RNA, 14 nt, Salmonella typhimurium LT2
cuuauccgcgugga

SEQ ID NO: 3781799 - RNA, 20 nt, Salmonella typhimurium LT2
cuuauccggccuacaagccg

SEQ ID NO: 3781800 - RNA, 22 nt, Salmonella typhimurium LT2
cuuauccggccuacaagccgcc

SEQ ID NO: 3781801 - RNA, 23 nt, Salmonella typhimurium LT2
cuuauccggccuacaagccgccu

SEQ ID NO: 3781802 - RNA, 22 nt, Salmonella typhimurium LT2
cuuauccggccuauagcuaaug

SEQ ID NO: 3781803 - RNA, 17 nt, Salmonella typhimurium LT2
cuuauccggccuccaaa

SEQ ID NO: 3781804 - RNA, 17 nt, Salmonella typhimurium LT2
cuuaucgaccagcguua

SEQ ID NO: 3781805 - RNA, 11 nt, Salmonella typhimurium LT2
cuuaucgccaa

SEQ ID NO: 3781806 - RNA, 15 nt, Salmonella typhimurium LT2
cuuaucgccaaagau

SEQ ID NO: 3781807 - RNA, 12 nt, Salmonella typhimurium LT2
cuuaucgccgua

SEQ ID NO: 3781808 - RNA, 15 nt, Salmonella typhimurium LT2
cuuaucugcaauaaa

SEQ ID NO: 3781809 - RNA, 19 nt, Salmonella typhimurium LT2
cuuaucuuucagcgccgga

SEQ ID NO: 3781810 - RNA, 12 nt, Salmonella typhimurium LT2
cuuaugcccggc

SEQ ID NO: 3781811 - RNA, 23 nt, Salmonella typhimurium LT2
cuuaugcugccagcgaaccgcag

SEQ ID NO: 3781812 - RNA, 20 nt, Salmonella typhimurium LT2
cuuauggauaagcgucgcca

SEQ ID NO: 3781813 - RNA, 13 nt, Salmonella typhimurium LT2
cuuauguacaacc

SEQ ID NO: 3781814 - RNA, 21 nt, Salmonella typhimurium LT2
cuuauucgcucugagucgcca

SEQ ID NO: 3781815 - RNA, 16 nt, Salmonella typhimurium LT2
cuuauucgguuuaucc

SEQ ID NO: 3781816 - RNA, 17 nt, Salmonella typhimurium LT2
cuuauugaugacgcuua

SEQ ID NO: 3781817 - RNA, 15 nt, Salmonella typhimurium LT2
cuuauuucuccugcg

SEQ ID NO: 3781818 - RNA, 18 nt, Salmonella typhimurium LT2
cuuauuucuccugcgcca

SEQ ID NO: 3781819 - RNA, 20 nt, Salmonella typhimurium LT2
cuuauuuggguaauaaagaa

SEQ ID NO: 3781820 - RNA, 13 nt, Salmonella typhimurium LT2
cuuauuuguauug

SEQ ID NO: 3781821 - RNA, 12 nt, Salmonella typhimurium LT2
cuucaaauccgg

SEQ ID NO: 3781822 - RNA, 22 nt, Salmonella typhimurium LT2
cuucaaaugauuuuuauaaaau

SEQ ID NO: 3781823 - RNA, 18 nt, Salmonella typhimurium LT2
cuucaacaccgacauccg

SEQ ID NO: 3781824 - RNA, 19 nt, Salmonella typhimurium LT2
cuucaacagcggcggcagu

SEQ ID NO: 3781825 - RNA, 20 nt, Salmonella typhimurium LT2
cuucaaccugagauggcaca

SEQ ID NO: 3781826 - RNA, 19 nt, Salmonella typhimurium LT2
cuucaacgcaggcgaaauc

SEQ ID NO: 3781827 - RNA, 15 nt, Salmonella typhimurium LT2
cuucaacgccgcgcu

SEQ ID NO: 3781828 - RNA, 15 nt, Salmonella typhimurium LT2
cuucaagaaguucca

SEQ ID NO: 3781829 - RNA, 17 nt, Salmonella typhimurium LT2
cuucaagcguuuccaga

SEQ ID NO: 3781830 - RNA, 14 nt, Salmonella typhimurium LT2
cuucaaucgccaaa

SEQ ID NO: 3781831 - RNA, 17 nt, Salmonella typhimurium LT2
cuucaaugggaaaaauu

SEQ ID NO: 3781832 - RNA, 18 nt, Salmonella typhimurium LT2
cuucaaugucguuaucgc

SEQ ID NO: 3781833 - RNA, 23 nt, Salmonella typhimurium LT2
cuucaauuugccggaacucagcu

SEQ ID NO: 3781834 - RNA, 19 nt, Salmonella typhimurium LT2
cuucaauuuuccagauagc

SEQ ID NO: 3781835 - RNA, 18 nt, Salmonella typhimurium LT2
cuucacaaacaauuuccc

SEQ ID NO: 3781836 - RNA, 14 nt, Salmonella typhimurium LT2
cuucaccacgccau

SEQ ID NO: 3781837 - RNA, 24 nt, Salmonella typhimurium LT2
cuucacccacugcacgcgaucguc

SEQ ID NO: 3781838 - RNA, 23 nt, Salmonella typhimurium LT2
cuucacccuucuucuggcucaga

SEQ ID NO: 3781839 - RNA, 17 nt, Salmonella typhimurium LT2
cuucaccucagucgcuu

SEQ ID NO: 3781840 - RNA, 19 nt, Salmonella typhimurium LT2
cuucacgaagucuggcugc

SEQ ID NO: 3781841 - RNA, 21 nt, Salmonella typhimurium LT2
cuucacgaagucuggcugcaa

SEQ ID NO: 3781842 - RNA, 21 nt, Salmonella typhimurium LT2
cuucacgagcggucaggccag

SEQ ID NO: 3781843 - RNA, 23 nt, Salmonella typhimurium LT2
cuucacgauauaguccugaugaa

SEQ ID NO: 3781844 - RNA, 20 nt, Salmonella typhimurium LT2
cuucacgcuaaucccgcucg

SEQ ID NO: 3781845 - RNA, 17 nt, Salmonella typhimurium LT2
cuucacgcuggugcgcg

SEQ ID NO: 3781846 - RNA, 18 nt, Salmonella typhimurium LT2
cuucacggucaaacgcgg

SEQ ID NO: 3781847 - RNA, 16 nt, Salmonella typhimurium LT2
cuucacgucggcgacc

SEQ ID NO: 3781848 - RNA, 17 nt, Salmonella typhimurium LT2
cuucacuucacaaacaa

SEQ ID NO: 3781849 - RNA, 20 nt, Salmonella typhimurium LT2
cuucacuuucaagccagccg

SEQ ID NO: 3781850 - RNA, 19 nt, Salmonella typhimurium LT2
cuucagaacggcucgggug

SEQ ID NO: 3781851 - RNA, 18 nt, Salmonella typhimurium LT2
cuucagaggccuuuugca

SEQ ID NO: 3781852 - RNA, 14 nt, Salmonella typhimurium LT2
cuucagcaucaucu

SEQ ID NO: 3781853 - RNA, 16 nt, Salmonella typhimurium LT2
cuucagcaucaucucc

SEQ ID NO: 3781854 - RNA, 19 nt, Salmonella typhimurium LT2
cuucagcaucaucucccag

SEQ ID NO: 3781855 - RNA, 15 nt, Salmonella typhimurium LT2
cuucagccagacgcu

SEQ ID NO: 3781856 - RNA, 20 nt, Salmonella typhimurium LT2
cuucagccagaguuuuaaaa

SEQ ID NO: 3781857 - RNA, 14 nt, Salmonella typhimurium LT2
cuucagccagcugc

SEQ ID NO: 3781858 - RNA, 17 nt, Salmonella typhimurium LT2
cuucagccagcugcugg

SEQ ID NO: 3781859 - RNA, 21 nt, Salmonella typhimurium LT2
cuucagccggauauucgguga

SEQ ID NO: 3781860 - RNA, 13 nt, Salmonella typhimurium LT2
cuucagcgcgccc

SEQ ID NO: 3781861 - RNA, 20 nt, Salmonella typhimurium LT2
cuucagcggcgcguugccgc

SEQ ID NO: 3781862 - RNA, 16 nt, Salmonella typhimurium LT2
cuucagcguugucccg

SEQ ID NO: 3781863 - RNA, 18 nt, Salmonella typhimurium LT2
cuucagguuuuuaagcug

SEQ ID NO: 3781864 - RNA, 12 nt, Salmonella typhimurium LT2
cuucaguaacca

SEQ ID NO: 3781865 - RNA, 13 nt, Salmonella typhimurium LT2
cuucagucuacua

SEQ ID NO: 3781866 - RNA, 18 nt, Salmonella typhimurium LT2
cuucagugugcucguuuu

SEQ ID NO: 3781867 - RNA, 16 nt, Salmonella typhimurium LT2
cuucauagucgcuuuu

SEQ ID NO: 3781868 - RNA, 15 nt, Salmonella typhimurium LT2
cuucauauuucaagc

SEQ ID NO: 3781869 - RNA, 19 nt, Salmonella typhimurium LT2
cuucaucaaagaaauaccc

SEQ ID NO: 3781870 - RNA, 18 nt, Salmonella typhimurium LT2
cuucauccggauaaagcc

SEQ ID NO: 3781871 - RNA, 12 nt, Salmonella typhimurium LT2
cuucaucgccac

SEQ ID NO: 3781872 - RNA, 16 nt, Salmonella typhimurium LT2
cuucaucgccacgcca

SEQ ID NO: 3781873 - RNA, 19 nt, Salmonella typhimurium LT2
cuucaucguuuauuucguc

SEQ ID NO: 3781874 - RNA, 13 nt, Salmonella typhimurium LT2
cuucaugcacaaa

SEQ ID NO: 3781875 - RNA, 14 nt, Salmonella typhimurium LT2
cuucaugcagcgcg

SEQ ID NO: 3781876 - RNA, 12 nt, Salmonella typhimurium LT2
cuucaugccucg

SEQ ID NO: 3781877 - RNA, 19 nt, Salmonella typhimurium LT2
cuucaugugguaggcuuca

SEQ ID NO: 3781878 - RNA, 18 nt, Salmonella typhimurium LT2
cuuccacacggcauucac

SEQ ID NO: 3781879 - RNA, 18 nt, Salmonella typhimurium LT2
cuuccaccaccuccugcu

SEQ ID NO: 3781880 - RNA, 15 nt, Salmonella typhimurium LT2
cuuccacgcacgccg

SEQ ID NO: 3781881 - RNA, 17 nt, Salmonella typhimurium LT2
cuuccacgcacgccggc

SEQ ID NO: 3781882 - RNA, 20 nt, Salmonella typhimurium LT2
cuuccacugcaucucuucca

SEQ ID NO: 3781883 - RNA, 12 nt, Salmonella typhimurium LT2
cuuccacugcgg

SEQ ID NO: 3781884 - RNA, 19 nt, Salmonella typhimurium LT2
cuuccacugcggcauuacg

SEQ ID NO: 3781885 - RNA, 20 nt, Salmonella typhimurium LT2
cuuccacugguaggcaucca

SEQ ID NO: 3781886 - RNA, 18 nt, Salmonella typhimurium LT2
cuucuaauuuuuccagca

SEQ ID NO: 3781887 - RNA, 12 nt, Salmonella typhimurium LT2
cuucuaccguca

SEQ ID NO: 3781888 - RNA, 15 nt, Salmonella typhimurium LT2
cuucuaccugcacau

SEQ ID NO: 3781889 - RNA, 21 nt, Salmonella typhimurium LT2
cuucucacggauccagaacug

SEQ ID NO: 3781890 - RNA, 18 nt, Salmonella typhimurium LT2
cuucucgaaguucucaau

SEQ ID NO: 3781891 - RNA, 21 nt, Salmonella typhimurium LT2
cuucucugucgagcaucucca

SEQ ID NO: 3781892 - RNA, 14 nt, Salmonella typhimurium LT2
cuucugcugacauu

SEQ ID NO: 3781893 - RNA, 16 nt, Salmonella typhimurium LT2
cuucugcugacauucc

SEQ ID NO: 3781894 - RNA, 19 nt, Salmonella typhimurium LT2
cuucugcugacauuccuuu

SEQ ID NO: 3781895 - RNA, 16 nt, Salmonella typhimurium LT2
cuucugguugucacgg

SEQ ID NO: 3781896 - RNA, 20 nt, Salmonella typhimurium LT2
cuucugucugcgugaagaca

SEQ ID NO: 3781897 - RNA, 11 nt, Salmonella typhimurium LT2
cuucuuagaau

SEQ ID NO: 3781898 - RNA, 16 nt, Salmonella typhimurium LT2
cuucuuagaauagcau

SEQ ID NO: 3781899 - RNA, 17 nt, Salmonella typhimurium LT2
cuucuucaagccaggcu

SEQ ID NO: 3781900 - RNA, 15 nt, Salmonella typhimurium LT2
cuucuucacuaaaaa

SEQ ID NO: 3781901 - RNA, 14 nt, Salmonella typhimurium LT2
cuucuucaggcuug

SEQ ID NO: 3781902 - RNA, 17 nt, Salmonella typhimurium LT2
cuucuucaguuccgcca

SEQ ID NO: 3781903 - RNA, 19 nt, Salmonella typhimurium LT2
cuucuucaguuccgccaga

SEQ ID NO: 3781904 - RNA, 13 nt, Salmonella typhimurium LT2
cuucuucauauuu

SEQ ID NO: 3781905 - RNA, 14 nt, Salmonella typhimurium LT2
cuucuucaucuuca

SEQ ID NO: 3781906 - RNA, 12 nt, Salmonella typhimurium LT2
cuucuuccagcg

SEQ ID NO: 3781907 - RNA, 16 nt, Salmonella typhimurium LT2
cuucuuccagcgugug

SEQ ID NO: 3781908 - RNA, 16 nt, Salmonella typhimurium LT2
cuucuuccggcugcca

SEQ ID NO: 3781909 - RNA, 15 nt, Salmonella typhimurium LT2
cuucuucgcggccgc

SEQ ID NO: 3781910 - RNA, 19 nt, Salmonella typhimurium LT2
cuucuucgucgucuucauc

SEQ ID NO: 3781911 - RNA, 15 nt, Salmonella typhimurium LT2
cuucuucuaccaccu

SEQ ID NO: 3781912 - RNA, 18 nt, Salmonella typhimurium LT2
cuucuucuaccaccuuau

SEQ ID NO: 3781913 - RNA, 21 nt, Salmonella typhimurium LT2
cuucuugguaccaaacagcag

SEQ ID NO: 3781914 - RNA, 14 nt, Salmonella typhimurium LT2
cuucuuuagauaau

SEQ ID NO: 3781915 - RNA, 17 nt, Salmonella typhimurium LT2
cuucuuuaucuucugcu

SEQ ID NO: 3781916 - RNA, 21 nt, Salmonella typhimurium LT2
cuucuuuaucuucugcugcuc

SEQ ID NO: 3781917 - RNA, 13 nt, Salmonella typhimurium LT2
cuucuuucaucau

SEQ ID NO: 3781918 - RNA, 23 nt, Salmonella typhimurium LT2
cuucuuugaccagcgacgaugaa

SEQ ID NO: 3781919 - RNA, 22 nt, Salmonella typhimurium LT2
cuugaagccuuucuguucuuug

SEQ ID NO: 3781920 - RNA, 15 nt, Salmonella typhimurium LT2
cuugaccagcacuuc

SEQ ID NO: 3781921 - RNA, 18 nt, Salmonella typhimurium LT2
cuugacgcuuugcauuau

SEQ ID NO: 3781922 - RNA, 22 nt, Salmonella typhimurium LT2
cuugacucaaaaagaggaaagc

SEQ ID NO: 3781923 - RNA, 18 nt, Salmonella typhimurium LT2
cuugacucugaagcggga

SEQ ID NO: 3781924 - RNA, 20 nt, Salmonella typhimurium LT2
cuugagaaauuauuuuaaau

SEQ ID NO: 3781925 - RNA, 22 nt, Salmonella typhimurium LT2
cuugagcaggcuuacgauauuu

SEQ ID NO: 3781926 - RNA, 22 nt, Salmonella typhimurium LT2
cuugaguuuuccgccauuggcg

SEQ ID NO: 3781927 - RNA, 20 nt, Salmonella typhimurium LT2
cuugauagcgaucagcgcca

SEQ ID NO: 3781928 - RNA, 18 nt, Salmonella typhimurium LT2
cuugaucaucagggcgaa

SEQ ID NO: 3781929 - RNA, 17 nt, Salmonella typhimurium LT2
cuugauccuguaacgca

SEQ ID NO: 3781930 - RNA, 20 nt, Salmonella typhimurium LT2
cuugcaacccauacagccca

SEQ ID NO: 3781931 - RNA, 18 nt, Salmonella typhimurium LT2
cuugcacaauacuuuuug

SEQ ID NO: 3781932 - RNA, 19 nt, Salmonella typhimurium LT2
cuugcacgccaaaaaguga

SEQ ID NO: 3781933 - RNA, 22 nt, Salmonella typhimurium LT2
cuugcagccagaacucaucuuc

SEQ ID NO: 3781934 - RNA, 14 nt, Salmonella typhimurium LT2
cuugcaugaccauc

SEQ ID NO: 3781935 - RNA, 20 nt, Salmonella typhimurium LT2
cuugccacuacgcagcucca

SEQ ID NO: 3781936 - RNA, 15 nt, Salmonella typhimurium LT2
cuugccacuggccuc

SEQ ID NO: 3781937 - RNA, 13 nt, Salmonella typhimurium LT2
cuugccagcgaga

SEQ ID NO: 3781938 - RNA, 18 nt, Salmonella typhimurium LT2
cuugccgccugccugcaa

SEQ ID NO: 3781939 - RNA, 15 nt, Salmonella typhimurium LT2
cuugccguuuuucuc

SEQ ID NO: 3781940 - RNA, 18 nt, Salmonella typhimurium LT2
cuugccguuuuucucauc

SEQ ID NO: 3781941 - RNA, 16 nt, Salmonella typhimurium LT2
cuugcgagcgucaguc

SEQ ID NO: 3781942 - RNA, 20 nt, Salmonella typhimurium LT2
cuugcgaucgggauuccagu

SEQ ID NO: 3781943 - RNA, 21 nt, Salmonella typhimurium LT2
cuugcgccagcgcgcguaccc

SEQ ID NO: 3781944 - RNA, 17 nt, Salmonella typhimurium LT2
cuugcgccgcaaacuca

SEQ ID NO: 3781945 - RNA, 21 nt, Salmonella typhimurium LT2
cuugcgccgccauccggcaag

SEQ ID NO: 3781946 - RNA, 21 nt, Salmonella typhimurium LT2
cuugcggaaagaagaauaagc

SEQ ID NO: 3781947 - RNA, 13 nt, Salmonella typhimurium LT2
cuugcggcugcau

SEQ ID NO: 3781948 - RNA, 14 nt, Salmonella typhimurium LT2
cuugcggcugccag

SEQ ID NO: 3781949 - RNA, 15 nt, Salmonella typhimurium LT2
cuugcggcugccagu

SEQ ID NO: 3781950 - RNA, 16 nt, Salmonella typhimurium LT2
cuugcggugagaaacg

SEQ ID NO: 3781951 - RNA, 22 nt, Salmonella typhimurium LT2
cuugcucguaccaggccccugc

SEQ ID NO: 3781952 - RNA, 14 nt, Salmonella typhimurium LT2
cuugcucucaggca

SEQ ID NO: 3781953 - RNA, 17 nt, Salmonella typhimurium LT2
cuugcugcuaugaaaaa

SEQ ID NO: 3781954 - RNA, 18 nt, Salmonella typhimurium LT2
cuugcuuuucaucaccau

SEQ ID NO: 3781955 - RNA, 18 nt, Salmonella typhimurium LT2
cuuggcgaucaccagcac

SEQ ID NO: 3781956 - RNA, 18 nt, Salmonella typhimurium LT2
cuugguaccaaacagcag

SEQ ID NO: 3781957 - RNA, 12 nt, Salmonella typhimurium LT2
cuuggucauaau

SEQ ID NO: 3781958 - RNA, 21 nt, Salmonella typhimurium LT2
cuugguuguuuccauuuuuac

SEQ ID NO: 3781959 - RNA, 19 nt, Salmonella typhimurium LT2
cuuguaagggaggugcucu

SEQ ID NO: 3781960 - RNA, 23 nt, Salmonella typhimurium LT2
cuuguaagggaggugcucuccca

SEQ ID NO: 3781961 - RNA, 22 nt, Salmonella typhimurium LT2
cuuguaaguuacuaaaaguaaa

SEQ ID NO: 3781962 - RNA, 19 nt, Salmonella typhimurium LT2
cuuguagcgcugcccaauc

SEQ ID NO: 3781963 - RNA, 16 nt, Salmonella typhimurium LT2
cuuguauagacaagua

SEQ ID NO: 3781964 - RNA, 20 nt, Salmonella typhimurium LT2
cuugucaggcucuaauaacu

SEQ ID NO: 3781965 - RNA, 19 nt, Salmonella typhimurium LT2
cuugucgaaauggccaucc

SEQ ID NO: 3781966 - RNA, 22 nt, Salmonella typhimurium LT2
cuugucugggcauuaccccagc

SEQ ID NO: 3781967 - RNA, 15 nt, Salmonella typhimurium LT2
cuugugaugagcuca

SEQ ID NO: 3781968 - RNA, 15 nt, Salmonella typhimurium LT2
cuugugcuuccagcu

SEQ ID NO: 3781969 - RNA, 20 nt, Salmonella typhimurium LT2
cuuguuaaccggguuuuucg

SEQ ID NO: 3781970 - RNA, 15 nt, Salmonella typhimurium LT2
cuuguuauaaacagc

SEQ ID NO: 3781971 - RNA, 14 nt, Salmonella typhimurium LT2
cuuguucgcagguc

SEQ ID NO: 3781972 - RNA, 15 nt, Salmonella typhimurium LT2
cuuguucuuccauug

SEQ ID NO: 3781973 - RNA, 23 nt, Salmonella typhimurium LT2
cuuguugaacacuaaccagcgcg

SEQ ID NO: 3781974 - RNA, 21 nt, Salmonella typhimurium LT2
cuuguuuaauggcagaauaaa

SEQ ID NO: 3781975 - RNA, 16 nt, Salmonella typhimurium LT2
cuuuaaaguaucaaca

SEQ ID NO: 3781976 - RNA, 14 nt, Salmonella typhimurium LT2
cuuuaaccgccugc

SEQ ID NO: 3781977 - RNA, 15 nt, Salmonella typhimurium LT2
cuuuaaccgccugcu

SEQ ID NO: 3781978 - RNA, 18 nt, Salmonella typhimurium LT2
cuuuaaccgccugcucaa

SEQ ID NO: 3781979 - RNA, 19 nt, Salmonella typhimurium LT2
cuuuaaccggacgcuuaau

SEQ ID NO: 3781980 - RNA, 20 nt, Salmonella typhimurium LT2
cuuuaagccgauugaauaau

SEQ ID NO: 3781981 - RNA, 19 nt, Salmonella typhimurium LT2
cuuuaaucaccauggcgcc

SEQ ID NO: 3781982 - RNA, 20 nt, Salmonella typhimurium LT2
cuuuaaucacccgcgccagc

SEQ ID NO: 3781983 - RNA, 21 nt, Salmonella typhimurium LT2
cuuuaaucacccgcgccagca

SEQ ID NO: 3781984 - RNA, 13 nt, Salmonella typhimurium LT2
cuuuaauuccgcc

SEQ ID NO: 3781985 - RNA, 13 nt, Salmonella typhimurium LT2
cuuuacaccccac

SEQ ID NO: 3781986 - RNA, 14 nt, Salmonella typhimurium LT2
cuuuacaccccacu

SEQ ID NO: 3781987 - RNA, 15 nt, Salmonella typhimurium LT2
cuuuacaccccacua

SEQ ID NO: 3781988 - RNA, 23 nt, Salmonella typhimurium LT2
cuuuacccggcgcaaacuucgca

SEQ ID NO: 3781989 - RNA, 19 nt, Salmonella typhimurium LT2
cuuuacccgggccaucuuu

SEQ ID NO: 3781990 - RNA, 23 nt, Salmonella typhimurium LT2
cuuuuaaccacgcaaucucuucc

SEQ ID NO: 3781991 - RNA, 19 nt, Salmonella typhimurium LT2
cuuuuaaggcggcaaagau

SEQ ID NO: 3781992 - RNA, 21 nt, Salmonella typhimurium LT2
cuuuuaaggcggcaaagauaa

SEQ ID NO: 3781993 - RNA, 17 nt, Salmonella typhimurium LT2
cuuuuaagguuaauucu

SEQ ID NO: 3781994 - RNA, 18 nt, Salmonella typhimurium LT2
cuuuuacaaaacaaccgu

SEQ ID NO: 3781995 - RNA, 23 nt, Salmonella typhimurium LT2
cuuuuacaggccggacaggcgac

SEQ ID NO: 3781996 - RNA, 19 nt, Salmonella typhimurium LT2
cuuuuacagggcggcagga

SEQ ID NO: 3781997 - RNA, 16 nt, Salmonella typhimurium LT2
cuuuuacccuucaugu

SEQ ID NO: 3781998 - RNA, 12 nt, Salmonella typhimurium LT2
cuuuuacugccc

SEQ ID NO: 3781999 - RNA, 19 nt, Salmonella typhimurium LT2
cuuuuaguuacgcacgcca

SEQ ID NO: 3782000 - RNA, 15 nt, Salmonella typhimurium LT2
cuuuuauccccacua

SEQ ID NO: 3782001 - RNA, 18 nt, Salmonella typhimurium LT2
cuuuuauuucaucuauua

SEQ ID NO: 3782002 - RNA, 21 nt, Salmonella typhimurium LT2
cuuuucacccaacauuuuuag

SEQ ID NO: 3782003 - RNA, 21 nt, Salmonella typhimurium LT2
cuuuucagcccaggcuuuagu

SEQ ID NO: 3782004 - RNA, 15 nt, Salmonella typhimurium LT2
cuuuucagcgccaga

SEQ ID NO: 3782005 - RNA, 22 nt, Salmonella typhimurium LT2
cuuuucauccacagcgccagaa

SEQ ID NO: 3782006 - RNA, 21 nt, Salmonella typhimurium LT2
cuuuucauucagcgcgauaaa

SEQ ID NO: 3782007 - RNA, 14 nt, Salmonella typhimurium LT2
cuuuuccagcgccu

SEQ ID NO: 3782008 - RNA, 13 nt, Salmonella typhimurium LT2
cuuuuccgccucg

SEQ ID NO: 3782009 - RNA, 14 nt, Salmonella typhimurium LT2
cuuuuccucuucuu

SEQ ID NO: 3782010 - RNA, 14 nt, Salmonella typhimurium LT2
cuuuuccugcugcc

SEQ ID NO: 3782011 - RNA, 16 nt, Salmonella typhimurium LT2
cuuuucggguaaauca

SEQ ID NO: 3782012 - RNA, 17 nt, Salmonella typhimurium LT2
cuuuucggguguccacu

SEQ ID NO: 3782013 - RNA, 23 nt, Salmonella typhimurium LT2
cuuuucuccccgacggcuucuuc

SEQ ID NO: 3782014 - RNA, 15 nt, Salmonella typhimurium LT2
cuuuucuuuccugca

SEQ ID NO: 3782015 - RNA, 23 nt, Salmonella typhimurium LT2
cuuuugauacucugcuuuuucac

SEQ ID NO: 3782016 - RNA, 18 nt, Salmonella typhimurium LT2
cuuuugcagcaaauacag

SEQ ID NO: 3782017 - RNA, 22 nt, Salmonella typhimurium LT2
cuuuugcccgguggcgcugcgc

SEQ ID NO: 3782018 - RNA, 18 nt, Salmonella typhimurium LT2
cuuuugccgucaggucau

SEQ ID NO: 3782019 - RNA, 19 nt, Salmonella typhimurium LT2
cuuuugcgccuuccaguuc

SEQ ID NO: 3782020 - RNA, 19 nt, Salmonella typhimurium LT2
cuuuugcgcguuccccaac

SEQ ID NO: 3782021 - RNA, 20 nt, Salmonella typhimurium LT2
cuuuugcgcguuccccaaca

SEQ ID NO: 3782022 - RNA, 20 nt, Salmonella typhimurium LT2
cuuuuggcguaauggcggga

SEQ ID NO: 3782023 - RNA, 19 nt, Salmonella typhimurium LT2
cuuuuguaucccguagccg

SEQ ID NO: 3782024 - RNA, 19 nt, Salmonella typhimurium LT2
cuuuugugcccguuuuaca

SEQ ID NO: 3782025 - RNA, 13 nt, Salmonella typhimurium LT2
cuuuuuaaaauga

SEQ ID NO: 3782026 - RNA, 15 nt, Salmonella typhimurium LT2
cuuuuuaaaaugacc

SEQ ID NO: 3782027 - RNA, 18 nt, Salmonella typhimurium LT2
cuuuuuaauucacaacug

SEQ ID NO: 3782028 - RNA, 19 nt, Salmonella typhimurium LT2
cuuuuuaauucacaacuga

SEQ ID NO: 3782029 - RNA, 14 nt, Salmonella typhimurium LT2
cuuuuuagcagcaa

SEQ ID NO: 3782030 - RNA, 18 nt, Salmonella typhimurium LT2
cuuuuuaggcuauaaaaa

SEQ ID NO: 3782031 - RNA, 16 nt, Salmonella typhimurium LT2
cuuuuuauuacuuucu

SEQ ID NO: 3782032 - RNA, 15 nt, Salmonella typhimurium LT2
cuuuuuauuuuauaa

SEQ ID NO: 3782033 - RNA, 15 nt, Salmonella typhimurium LT2
cuuuuuauuuuucug

SEQ ID NO: 3782034 - RNA, 22 nt, Salmonella typhimurium LT2
cuuuuucaacagcacccaggca

SEQ ID NO: 3782035 - RNA, 13 nt, Salmonella typhimurium LT2
cuuuuucagaucu

SEQ ID NO: 3782036 - RNA, 12 nt, Salmonella typhimurium LT2
cuuuuucaggca

SEQ ID NO: 3782037 - RNA, 20 nt, Salmonella typhimurium LT2
cuuuuucauagaaccacuua

SEQ ID NO: 3782038 - RNA, 17 nt, Salmonella typhimurium LT2
cuuuuucauauuuuccu

SEQ ID NO: 3782039 - RNA, 20 nt, Salmonella typhimurium LT2
cuuuuucaucaucuguugca

SEQ ID NO: 3782040 - RNA, 12 nt, Salmonella typhimurium LT2
cuuuuuccagca

SEQ ID NO: 3782041 - RNA, 22 nt, Salmonella typhimurium LT2
cuuuuucccggugcgugcgccg

SEQ ID NO: 3782042 - RNA, 21 nt, Salmonella typhimurium LT2
cuuuuuccgccugaucuuucu

SEQ ID NO: 3782043 - RNA, 16 nt, Salmonella typhimurium LT2
cuuuuuccugccauug

SEQ ID NO: 3782044 - RNA, 16 nt, Salmonella typhimurium LT2
cuuuuucgcucuuauc

SEQ ID NO: 3782045 - RNA, 13 nt, Salmonella typhimurium LT2
cuuuuugagcggc

SEQ ID NO: 3782046 - RNA, 16 nt, Salmonella typhimurium LT2
cuuuuugaucuaaaaa

SEQ ID NO: 3782047 - RNA, 19 nt, Salmonella typhimurium LT2
cuuuuugcgccacuuuucc

SEQ ID NO: 3782048 - RNA, 15 nt, Salmonella typhimurium LT2
cuuuuuuauugccug

SEQ ID NO: 3782049 - RNA, 13 nt, Salmonella typhimurium LT2
cuuuuuucaccag

SEQ ID NO: 3782050 - RNA, 16 nt, Salmonella typhimurium LT2
cuuuuuuuccagcguc

SEQ ID NO: 3782051 - RNA, 15 nt, Salmonella typhimurium LT2
cuuuuuuugugcgcu

SEQ ID NO: 3782052 - RNA, 17 nt, Salmonella typhimurium LT2
gaaaaaacucaggaaau

SEQ ID NO: 3782053 - RNA, 21 nt, Salmonella typhimurium LT2
gaaaaaagcgcccagcgccgg

SEQ ID NO: 3782054 - RNA, 19 nt, Salmonella typhimurium LT2
gaaaaaauacugauaaaaa

SEQ ID NO: 3782055 - RNA, 23 nt, Salmonella typhimurium LT2
gaaaaaauacugauaaaaaacag

SEQ ID NO: 3782056 - RNA, 20 nt, Salmonella typhimurium LT2
gaaaaaauaguaaaguuuau

SEQ ID NO: 3782057 - RNA, 19 nt, Salmonella typhimurium LT2
gaaaaacgggagauuguua

SEQ ID NO: 3782058 - RNA, 17 nt, Salmonella typhimurium LT2
gaaaaagaagaaaaaau

SEQ ID NO: 3782059 - RNA, 18 nt, Salmonella typhimurium LT2
gaaaaagaccaauacuga

SEQ ID NO: 3782060 - RNA, 19 nt, Salmonella typhimurium LT2
gaaaaagccaaaaggcgcc

SEQ ID NO: 3782061 - RNA, 16 nt, Salmonella typhimurium LT2
gaaaaagggaauaaua

SEQ ID NO: 3782062 - RNA, 17 nt, Salmonella typhimurium LT2
gaaaaagucauuuucau

SEQ ID NO: 3782063 - RNA, 19 nt, Salmonella typhimurium LT2
gaaaaauagacacaaaugc

SEQ ID NO: 3782064 - RNA, 20 nt, Salmonella typhimurium LT2
gaaaaauaucgaugcuuauu

SEQ ID NO: 3782065 - RNA, 13 nt, Salmonella typhimurium LT2
gaaaaaucagcau

SEQ ID NO: 3782066 - RNA, 16 nt, Salmonella typhimurium LT2
gaaaaaugaauaccaa

SEQ ID NO: 3782067 - RNA, 23 nt, Salmonella typhimurium LT2
gaaaaaugaauaccaagucucaa

SEQ ID NO: 3782068 - RNA, 13 nt, Salmonella typhimurium LT2
gaaaaauguguug

SEQ ID NO: 3782069 - RNA, 18 nt, Salmonella typhimurium LT2
gaaaaauguucagcgacc

SEQ ID NO: 3782070 - RNA, 19 nt, Salmonella typhimurium LT2
gaaaaauuccgcagagcug

SEQ ID NO: 3782071 - RNA, 18 nt, Salmonella typhimurium LT2
gaaaacaaggcgcuacca

SEQ ID NO: 3782072 - RNA, 16 nt, Salmonella typhimurium LT2
gaaaacagcgccggca

SEQ ID NO: 3782073 - RNA, 17 nt, Salmonella typhimurium LT2
gaaaaccauaauaaugc

SEQ ID NO: 3782074 - RNA, 15 nt, Salmonella typhimurium LT2
gaaaacccgccacca

SEQ ID NO: 3782075 - RNA, 21 nt, Salmonella typhimurium LT2
gaaaacgcaucugggcugaca

SEQ ID NO: 3782076 - RNA, 22 nt, Salmonella typhimurium LT2
gaaaacgccugcgucuaaccag

SEQ ID NO: 3782077 - RNA, 23 nt, Salmonella typhimurium LT2
gaaaacgcuuuccaguugcggca

SEQ ID NO: 3782078 - RNA, 22 nt, Salmonella typhimurium LT2
gaaaacggccagugaaauaaau

SEQ ID NO: 3782079 - RNA, 20 nt, Salmonella typhimurium LT2
gaaaacggugaauagcuaug

SEQ ID NO: 3782080 - RNA, 20 nt, Salmonella typhimurium LT2
gaaaacuuuccaaccuguua

SEQ ID NO: 3782081 - RNA, 12 nt, Salmonella typhimurium LT2
gaaaagaaccga

SEQ ID NO: 3782082 - RNA, 16 nt, Salmonella typhimurium LT2
gaaaagaccaguggac

SEQ ID NO: 3782083 - RNA, 12 nt, Salmonella typhimurium LT2
gaaaagcagagg

SEQ ID NO: 3782084 - RNA, 14 nt, Salmonella typhimurium LT2
gaaaagccggaaua

SEQ ID NO: 3782085 - RNA, 19 nt, Salmonella typhimurium LT2
gaaaagccggaauauugag

SEQ ID NO: 3782086 - RNA, 14 nt, Salmonella typhimurium LT2
gaaaagcgaccauu

SEQ ID NO: 3782087 - RNA, 20 nt, Salmonella typhimurium LT2
gaaaagcgggggcgacagcc

SEQ ID NO: 3782088 - RNA, 16 nt, Salmonella typhimurium LT2
gaaaagcuggcugaca

SEQ ID NO: 3782089 - RNA, 21 nt, Salmonella typhimurium LT2
gaaaaggccuggcugagaaaa

SEQ ID NO: 3782090 - RNA, 23 nt, Salmonella typhimurium LT2
gaaaaggguggugaaucagaagc

SEQ ID NO: 3782091 - RNA, 21 nt, Salmonella typhimurium LT2
gaaaagguuccggcgaucacc

SEQ ID NO: 3782092 - RNA, 18 nt, Salmonella typhimurium LT2
gaaaaguauauaucccgc

SEQ ID NO: 3782093 - RNA, 22 nt, Salmonella typhimurium LT2
gaacguccagcggccaguguac

SEQ ID NO: 3782094 - RNA, 17 nt, Salmonella typhimurium LT2
gaacgucuuuuuccagc

SEQ ID NO: 3782095 - RNA, 21 nt, Salmonella typhimurium LT2
gaacgucuuuuuccagcagcu

SEQ ID NO: 3782096 - RNA, 22 nt, Salmonella typhimurium LT2
gaacuacaugucuccucagaug

SEQ ID NO: 3782097 - RNA, 19 nt, Salmonella typhimurium LT2
gaacuaugcugagcauaaa

SEQ ID NO: 3782098 - RNA, 17 nt, Salmonella typhimurium LT2
gaacucacauauucaau

SEQ ID NO: 3782099 - RNA, 21 nt, Salmonella typhimurium LT2
gaacucacauauucaauaaua

SEQ ID NO: 3782100 - RNA, 13 nt, Salmonella typhimurium LT2
gaacucaucauca

SEQ ID NO: 3782101 - RNA, 17 nt, Salmonella typhimurium LT2
gaacucaucaucaauac

SEQ ID NO: 3782102 - RNA, 19 nt, Salmonella typhimurium LT2
gaacucaucggaaaaauag

SEQ ID NO: 3782103 - RNA, 13 nt, Salmonella typhimurium LT2
gaacuccagcgcg

SEQ ID NO: 3782104 - RNA, 23 nt, Salmonella typhimurium LT2
gaacucgaagcggucagugauuu

SEQ ID NO: 3782105 - RNA, 16 nt, Salmonella typhimurium LT2
gaacucgucuuauccg

SEQ ID NO: 3782106 - RNA, 21 nt, Salmonella typhimurium LT2
gaacucugcuuuuauuuucag

SEQ ID NO: 3782107 - RNA, 17 nt, Salmonella typhimurium LT2
gaacucuucgcaaccgg

SEQ ID NO: 3782108 - RNA, 15 nt, Salmonella typhimurium LT2
gaacucuuucagacc

SEQ ID NO: 3782109 - RNA, 20 nt, Salmonella typhimurium LT2
gaacugacguuagucauauu

SEQ ID NO: 3782110 - RNA, 13 nt, Salmonella typhimurium LT2
gaacugauggcgc

SEQ ID NO: 3782111 - RNA, 22 nt, Salmonella typhimurium LT2
gaacugauggcgcuaagccagc

SEQ ID NO: 3782112 - RNA, 21 nt, Salmonella typhimurium LT2
gaacugcaaauaccacaucag

SEQ ID NO: 3782113 - RNA, 11 nt, Salmonella typhimurium LT2
gaacugcagcg

SEQ ID NO: 3782114 - RNA, 19 nt, Salmonella typhimurium LT2
gaacugcagcgcgucgacc

SEQ ID NO: 3782115 - RNA, 19 nt, Salmonella typhimurium LT2
gaacuggcgcgaugacuca

SEQ ID NO: 3782116 - RNA, 14 nt, Salmonella typhimurium LT2
gaacuguucagcca

SEQ ID NO: 3782117 - RNA, 17 nt, Salmonella typhimurium LT2
gaacuuccgccaccacc

SEQ ID NO: 3782118 - RNA, 17 nt, Salmonella typhimurium LT2
gaacuuguaaaaaugcc

SEQ ID NO: 3782119 - RNA, 21 nt, Salmonella typhimurium LT2
gaagaaaaaauuaaaauucau

SEQ ID NO: 3782120 - RNA, 12 nt, Salmonella typhimurium LT2
gaagaaaccgca

SEQ ID NO: 3782121 - RNA, 18 nt, Salmonella typhimurium LT2
gaagaacacgccgccuau

SEQ ID NO: 3782122 - RNA, 17 nt, Salmonella typhimurium LT2
gaagaaggcuccggcac

SEQ ID NO: 3782123 - RNA, 17 nt, Salmonella typhimurium LT2
gaagacacaacgugcca

SEQ ID NO: 3782124 - RNA, 21 nt, Salmonella typhimurium LT2
gaagacagcguaguuuauucu

SEQ ID NO: 3782125 - RNA, 16 nt, Salmonella typhimurium LT2
gaagaccguuuaaacg

SEQ ID NO: 3782126 - RNA, 22 nt, Salmonella typhimurium LT2
gaagagaagcuuuuucuuuauu

SEQ ID NO: 3782127 - RNA, 14 nt, Salmonella typhimurium LT2
gaagagaccugugu

SEQ ID NO: 3782128 - RNA, 16 nt, Salmonella typhimurium LT2
gaagagauuaacgacc

SEQ ID NO: 3782129 - RNA, 15 nt, Salmonella typhimurium LT2
gaagaggaugcuccg

SEQ ID NO: 3782130 - RNA, 19 nt, Salmonella typhimurium LT2
gaagagucgauacgcugaa

SEQ ID NO: 3782131 - RNA, 14 nt, Salmonella typhimurium LT2
gaagaguucaacgc

SEQ ID NO: 3782132 - RNA, 17 nt, Salmonella typhimurium LT2
gaagauaaacagcagcg

SEQ ID NO: 3782133 - RNA, 19 nt, Salmonella typhimurium LT2
gaagauaaacagcagcgcg

SEQ ID NO: 3782134 - RNA, 13 nt, Salmonella typhimurium LT2
gaagaucagcaga

SEQ ID NO: 3782135 - RNA, 14 nt, Salmonella typhimurium LT2
gaagaucagcagag

SEQ ID NO: 3782136 - RNA, 22 nt, Salmonella typhimurium LT2
gaagaucguuauccagcagcca

SEQ ID NO: 3782137 - RNA, 16 nt, Salmonella typhimurium LT2
gaagaugguaauauua

SEQ ID NO: 3782138 - RNA, 22 nt, Salmonella typhimurium LT2
gaagauuaauccggucauccag

SEQ ID NO: 3782139 - RNA, 16 nt, Salmonella typhimurium LT2
gaagauuaucgucuau

SEQ ID NO: 3782140 - RNA, 17 nt, Salmonella typhimurium LT2
gaagauuaucgucuauc

SEQ ID NO: 3782141 - RNA, 18 nt, Salmonella typhimurium LT2
gaagauuucuuaauuccu

SEQ ID NO: 3782142 - RNA, 22 nt, Salmonella typhimurium LT2
gaagauuucuuaauuccucaga

SEQ ID NO: 3782143 - RNA, 17 nt, Salmonella typhimurium LT2
gaagauuuuuauucccg

SEQ ID NO: 3782144 - RNA, 13 nt, Salmonella typhimurium LT2
gaagcaagugcug

SEQ ID NO: 3782145 - RNA, 17 nt, Salmonella typhimurium LT2
gaagcacgacacaaaag

SEQ ID NO: 3782146 - RNA, 12 nt, Salmonella typhimurium LT2
gaagcagcagac

SEQ ID NO: 3782147 - RNA, 16 nt, Salmonella typhimurium LT2
gaagcagcuuauccgg

SEQ ID NO: 3782148 - RNA, 16 nt, Salmonella typhimurium LT2
gaagcagcuugcugcu

SEQ ID NO: 3782149 - RNA, 22 nt, Salmonella typhimurium LT2
gaagcauaaaaagacuaucuuc

SEQ ID NO: 3782150 - RNA, 18 nt, Salmonella typhimurium LT2
gaagcauccguuucccuc

SEQ ID NO: 3782151 - RNA, 15 nt, Salmonella typhimurium LT2
gaagcaucuuuccgg

SEQ ID NO: 3782152 - RNA, 20 nt, Salmonella typhimurium LT2
gaagccacaaucugauaauc

SEQ ID NO: 3782153 - RNA, 21 nt, Salmonella typhimurium LT2
gaagccaccggauugccuucu

SEQ ID NO: 3782154 - RNA, 18 nt, Salmonella typhimurium LT2
gaagcccaugauggugaa

SEQ ID NO: 3782155 - RNA, 22 nt, Salmonella typhimurium LT2
gaagcccaugauggugaacaga

SEQ ID NO: 3782156 - RNA, 15 nt, Salmonella typhimurium LT2
gaagcccggccacag

SEQ ID NO: 3782157 - RNA, 17 nt, Salmonella typhimurium LT2
gaagcccggccacagcg

SEQ ID NO: 3782158 - RNA, 16 nt, Salmonella typhimurium LT2
gaagccgccgccaucg

SEQ ID NO: 3782159 - RNA, 17 nt, Salmonella typhimurium LT2
gaagcgacgacacggcg

SEQ ID NO: 3782160 - RNA, 16 nt, Salmonella typhimurium LT2
gaagcgauguaagagg

SEQ ID NO: 3782161 - RNA, 19 nt, Salmonella typhimurium LT2
gaagcgauguauuuaucca

SEQ ID NO: 3782162 - RNA, 20 nt, Salmonella typhimurium LT2
gaagcgauguauuuauccac

SEQ ID NO: 3782163 - RNA, 17 nt, Salmonella typhimurium LT2
gaagcgauuuauccacc

SEQ ID NO: 3782164 - RNA, 19 nt, Salmonella typhimurium LT2
gaagcgauuuauccaccgc

SEQ ID NO: 3782165 - RNA, 16 nt, Salmonella typhimurium LT2
gaagcgcacuuuccau

SEQ ID NO: 3782166 - RNA, 15 nt, Salmonella typhimurium LT2
gaagcgccaucaggc

SEQ ID NO: 3782167 - RNA, 18 nt, Salmonella typhimurium LT2
gaagcgccaucaggcacu

SEQ ID NO: 3782168 - RNA, 14 nt, Salmonella typhimurium LT2
gaagcgccauccga

SEQ ID NO: 3782169 - RNA, 21 nt, Salmonella typhimurium LT2
gaagcggaaaggacguucuuc

SEQ ID NO: 3782170 - RNA, 17 nt, Salmonella typhimurium LT2
gaagcggcacugcucuu

SEQ ID NO: 3782171 - RNA, 16 nt, Salmonella typhimurium LT2
gaagcgguaaaaccgg

SEQ ID NO: 3782172 - RNA, 22 nt, Salmonella typhimurium LT2
gaagcgguaguuaagcgucagc

SEQ ID NO: 3782173 - RNA, 17 nt, Salmonella typhimurium LT2
gaagcguaacagcgcua

SEQ ID NO: 3782174 - RNA, 15 nt, Salmonella typhimurium LT2
gaagcgucauccggc

SEQ ID NO: 3782175 - RNA, 18 nt, Salmonella typhimurium LT2
gaagcguuucucuugugc

SEQ ID NO: 3782176 - RNA, 21 nt, Salmonella typhimurium LT2
gaagcuacagggaauaugcug

SEQ ID NO: 3782177 - RNA, 15 nt, Salmonella typhimurium LT2
gaagcucagccaggc

SEQ ID NO: 3782178 - RNA, 17 nt, Salmonella typhimurium LT2
gaagcucaugugcagca

SEQ ID NO: 3782179 - RNA, 17 nt, Salmonella typhimurium LT2
gaagcugccgucccagc

SEQ ID NO: 3782180 - RNA, 16 nt, Salmonella typhimurium LT2
gaagcugcgcagcacu

SEQ ID NO: 3782181 - RNA, 13 nt, Salmonella typhimurium LT2
gaagcuuaccacc

SEQ ID NO: 3782182 - RNA, 18 nt, Salmonella typhimurium LT2
gaaggaaacgccaggcac

SEQ ID NO: 3782183 - RNA, 14 nt, Salmonella typhimurium LT2
gaaggaaauaacgu

SEQ ID NO: 3782184 - RNA, 19 nt, Salmonella typhimurium LT2
gaaggauuauuggcaucau

SEQ ID NO: 3782185 - RNA, 14 nt, Salmonella typhimurium LT2
gaaggcaacugauc

SEQ ID NO: 3782186 - RNA, 16 nt, Salmonella typhimurium LT2
gaaggcaacugauccu

SEQ ID NO: 3782187 - RNA, 13 nt, Salmonella typhimurium LT2
gaaggcaucuuca

SEQ ID NO: 3782188 - RNA, 21 nt, Salmonella typhimurium LT2
gaaggcaucuucagacaguuu

SEQ ID NO: 3782189 - RNA, 22 nt, Salmonella typhimurium LT2
gaaggcauggggauuaagcgag

SEQ ID NO: 3782190 - RNA, 23 nt, Salmonella typhimurium LT2
gaaggccagugguaaaaaaguga

SEQ ID NO: 3782191 - RNA, 19 nt, Salmonella typhimurium LT2
gaaggcgaguuucgcauca

SEQ ID NO: 3782192 - RNA, 15 nt, Salmonella typhimurium LT2
gaaggcgcuaugcug

SEQ ID NO: 3782193 - RNA, 14 nt, Salmonella typhimurium LT2
gaaggcuccggcac

SEQ ID NO: 3782194 - RNA, 17 nt, Salmonella typhimurium LT2
gaaggcuucacgccaca

SEQ ID NO: 3782195 - RNA, 19 nt, Salmonella typhimurium LT2
gaaggcuuuggccucagca

SEQ ID NO: 3782196 - RNA, 15 nt, Salmonella typhimurium LT2
gaagggauucccauc

SEQ ID NO: 3782197 - RNA, 10 nt, Salmonella typhimurium LT2
gaauggcuuc

SEQ ID NO: 3782198 - RNA, 15 nt, Salmonella typhimurium LT2
gaauggucggcugcu

SEQ ID NO: 3782199 - RNA, 14 nt, Salmonella typhimurium LT2
gaauguagcgaccu

SEQ ID NO: 3782200 - RNA, 18 nt, Salmonella typhimurium LT2
gaauguccacuccggcgu

SEQ ID NO: 3782201 - RNA, 20 nt, Salmonella typhimurium LT2
gaauguuccccguugagaau

SEQ ID NO: 3782202 - RNA, 22 nt, Salmonella typhimurium LT2
gaauuaacuuauucguauugac

SEQ ID NO: 3782203 - RNA, 23 nt, Salmonella typhimurium LT2
gaauuacggacgauacaccuuca

SEQ ID NO: 3782204 - RNA, 22 nt, Salmonella typhimurium LT2
gaauucaaagaacagggggcgc

SEQ ID NO: 3782205 - RNA, 15 nt, Salmonella typhimurium LT2
gaauuccaguccuuu

SEQ ID NO: 3782206 - RNA, 18 nt, Salmonella typhimurium LT2
gaauuccuuuuuccgcca

SEQ ID NO: 3782207 - RNA, 16 nt, Salmonella typhimurium LT2
gaauugauaaagaucu

SEQ ID NO: 3782208 - RNA, 18 nt, Salmonella typhimurium LT2
gaauugauauuccgcgcu

SEQ ID NO: 3782209 - RNA, 17 nt, Salmonella typhimurium LT2
gaauugccauuguucgc

SEQ ID NO: 3782210 - RNA, 13 nt, Salmonella typhimurium LT2
gaauugguagacg

SEQ ID NO: 3782211 - RNA, 15 nt, Salmonella typhimurium LT2
gaauuguuugaaaag

SEQ ID NO: 3782212 - RNA, 20 nt, Salmonella typhimurium LT2
gaauuguuugaaaaggaaaa

SEQ ID NO: 3782213 - RNA, 17 nt, Salmonella typhimurium LT2
gaauuuaaucucacaaa

SEQ ID NO: 3782214 - RNA, 13 nt, Salmonella typhimurium LT2
gaauuucaggaag

SEQ ID NO: 3782215 - RNA, 22 nt, Salmonella typhimurium LT2
gaauuucaggguagcauugccg

SEQ ID NO: 3782216 - RNA, 19 nt, Salmonella typhimurium LT2
gaauuucuucaucccagcu

SEQ ID NO: 3782217 - RNA, 19 nt, Salmonella typhimurium LT2
gaauuuggucguaagaauu

SEQ ID NO: 3782218 - RNA, 22 nt, Salmonella typhimurium LT2
gaauuugucccuguuccaucuc

SEQ ID NO: 3782219 - RNA, 22 nt, Salmonella typhimurium LT2
gaauuuguugguuuaaacucug

SEQ ID NO: 3782220 - RNA, 20 nt, Salmonella typhimurium LT2
gaauuuuauuaagcaggccg

SEQ ID NO: 3782221 - RNA, 17 nt, Salmonella typhimurium LT2
gacaaaaagugaaaaaa

SEQ ID NO: 3782222 - RNA, 14 nt, Salmonella typhimurium LT2
gacaaaaauaccac

SEQ ID NO: 3782223 - RNA, 14 nt, Salmonella typhimurium LT2
gacaaaaaucugaa

SEQ ID NO: 3782224 - RNA, 18 nt, Salmonella typhimurium LT2
gacaaaaauggauagagu

SEQ ID NO: 3782225 - RNA, 23 nt, Salmonella typhimurium LT2
gacaaaacuuuuggugcccaucg

SEQ ID NO: 3782226 - RNA, 19 nt, Salmonella typhimurium LT2
gacaaaagauuuaucaauu

SEQ ID NO: 3782227 - RNA, 18 nt, Salmonella typhimurium LT2
gacaaacagcgcgcccgc

SEQ ID NO: 3782228 - RNA, 16 nt, Salmonella typhimurium LT2
gacaaagagcucccca

SEQ ID NO: 3782229 - RNA, 17 nt, Salmonella typhimurium LT2
gacaaagcucaccugcu

SEQ ID NO: 3782230 - RNA, 17 nt, Salmonella typhimurium LT2
gacaaaggcaagauccg

SEQ ID NO: 3782231 - RNA, 23 nt, Salmonella typhimurium LT2
gacaaaggcaagauccggacuga

SEQ ID NO: 3782232 - RNA, 19 nt, Salmonella typhimurium LT2
gacaaaugaagccugggau

SEQ ID NO: 3782233 - RNA, 17 nt, Salmonella typhimurium LT2
gacaacaaaaagauauu

SEQ ID NO: 3782234 - RNA, 15 nt, Salmonella typhimurium LT2
gacaaccagcgaaau

SEQ ID NO: 3782235 - RNA, 22 nt, Salmonella typhimurium LT2
gacaaccagcgaaaugacagcc

SEQ ID NO: 3782236 - RNA, 23 nt, Salmonella typhimurium LT2
gacaacguaaacggcagccgcca

SEQ ID NO: 3782237 - RNA, 20 nt, Salmonella typhimurium LT2
gacaacuucuuugcuauccg

SEQ ID NO: 3782238 - RNA, 21 nt, Salmonella typhimurium LT2
gacaaggcgaucucaagcgcc

SEQ ID NO: 3782239 - RNA, 18 nt, Salmonella typhimurium LT2
gacaaggcgauucaaaac

SEQ ID NO: 3782240 - RNA, 17 nt, Salmonella typhimurium LT2
gacaauaucucccgguu

SEQ ID NO: 3782241 - RNA, 20 nt, Salmonella typhimurium LT2
gacaauauucgccgcgauaa

SEQ ID NO: 3782242 - RNA, 16 nt, Salmonella typhimurium LT2
gacaaucaaucuggcc

SEQ ID NO: 3782243 - RNA, 20 nt, Salmonella typhimurium LT2
gacaauccgcgaaugguuca

SEQ ID NO: 3782244 - RNA, 23 nt, Salmonella typhimurium LT2
gacaaucgucacuucaauuugcc

SEQ ID NO: 3782245 - RNA, 20 nt, Salmonella typhimurium LT2
gacaaugaagcauaaaaaga

SEQ ID NO: 3782246 - RNA, 16 nt, Salmonella typhimurium LT2
gacaaugaauauuauu

SEQ ID NO: 3782247 - RNA, 21 nt, Salmonella typhimurium LT2
gacaaugacgguuuauaugcu

SEQ ID NO: 3782248 - RNA, 15 nt, Salmonella typhimurium LT2
gacaaugaucagacg

SEQ ID NO: 3782249 - RNA, 23 nt, Salmonella typhimurium LT2
gacaauuuugauaagagaaaaua

SEQ ID NO: 3782250 - RNA, 15 nt, Salmonella typhimurium LT2
gacacacuugauacu

SEQ ID NO: 3782251 - RNA, 20 nt, Salmonella typhimurium LT2
gacacaguauucaccuggaa

SEQ ID NO: 3782252 - RNA, 17 nt, Salmonella typhimurium LT2
gacacauaaagcccaga

SEQ ID NO: 3782253 - RNA, 13 nt, Salmonella typhimurium LT2
gacaccagcccug

SEQ ID NO: 3782254 - RNA, 13 nt, Salmonella typhimurium LT2
gacacccgcagcc

SEQ ID NO: 3782255 - RNA, 14 nt, Salmonella typhimurium LT2
gacacgccaguuca

SEQ ID NO: 3782256 - RNA, 21 nt, Salmonella typhimurium LT2
gacacgcgcgcugcgccugga

SEQ ID NO: 3782257 - RNA, 21 nt, Salmonella typhimurium LT2
gacacgcucauaaauugcagc

SEQ ID NO: 3782258 - RNA, 23 nt, Salmonella typhimurium LT2
gacacgcugcauauaacuuucaa

SEQ ID NO: 3782259 - RNA, 18 nt, Salmonella typhimurium LT2
gacacuaucacagaugac

SEQ ID NO: 3782260 - RNA, 15 nt, Salmonella typhimurium LT2
gacacuaucuccuuc

SEQ ID NO: 3782261 - RNA, 17 nt, Salmonella typhimurium LT2
gacacucauccagacca

SEQ ID NO: 3782262 - RNA, 22 nt, Salmonella typhimurium LT2
gacacugauauaccguccagac

SEQ ID NO: 3782263 - RNA, 17 nt, Salmonella typhimurium LT2
gacacuggaaacagcca

SEQ ID NO: 3782264 - RNA, 16 nt, Salmonella typhimurium LT2
gacagaaaaaauagua

SEQ ID NO: 3782265 - RNA, 13 nt, Salmonella typhimurium LT2
gacagaacaggau

SEQ ID NO: 3782266 - RNA, 13 nt, Salmonella typhimurium LT2
gacagaacccggc

SEQ ID NO: 3782267 - RNA, 18 nt, Salmonella typhimurium LT2
gacagaacuuggcuuccu

SEQ ID NO: 3782268 - RNA, 16 nt, Salmonella typhimurium LT2
gacagacguugcgcca

SEQ ID NO: 3782269 - RNA, 17 nt, Salmonella typhimurium LT2
gacagacguugcgccac

SEQ ID NO: 3782270 - RNA, 16 nt, Salmonella typhimurium LT2
gacagagaaccugaac

SEQ ID NO: 3782271 - RNA, 24 nt, Salmonella typhimurium LT2
gacagaugcagguucccgcccugc

SEQ ID NO: 3782272 - RNA, 19 nt, Salmonella typhimurium LT2
gacagauuggucagcagcc

SEQ ID NO: 3782273 - RNA, 23 nt, Salmonella typhimurium LT2
gacagauuuuguacuuuugccag

SEQ ID NO: 3782274 - RNA, 17 nt, Salmonella typhimurium LT2
gacagcaacaucuauca

SEQ ID NO: 3782275 - RNA, 13 nt, Salmonella typhimurium LT2
gacagcaaugagc

SEQ ID NO: 3782276 - RNA, 14 nt, Salmonella typhimurium LT2
gacagcaaugagca

SEQ ID NO: 3782277 - RNA, 15 nt, Salmonella typhimurium LT2
gacagccaccagcgu

SEQ ID NO: 3782278 - RNA, 21 nt, Salmonella typhimurium LT2
gacagcccuauaacagcgcca

SEQ ID NO: 3782279 - RNA, 17 nt, Salmonella typhimurium LT2
gacagccuauuaaucac

SEQ ID NO: 3782280 - RNA, 23 nt, Salmonella typhimurium LT2
gacagcgacacuccgcgcaugua

SEQ ID NO: 3782281 - RNA, 13 nt, Salmonella typhimurium LT2
gacagcgccauca

SEQ ID NO: 3782282 - RNA, 17 nt, Salmonella typhimurium LT2
gacagcgccauccggca

SEQ ID NO: 3782283 - RNA, 22 nt, Salmonella typhimurium LT2
gacagcgcgcaaaaaccggagc

SEQ ID NO: 3782284 - RNA, 14 nt, Salmonella typhimurium LT2
gacagcgcgcguca

SEQ ID NO: 3782285 - RNA, 15 nt, Salmonella typhimurium LT2
gacagcgcuggcugu

SEQ ID NO: 3782286 - RNA, 16 nt, Salmonella typhimurium LT2
gacaggcagcgucagc

SEQ ID NO: 3782287 - RNA, 18 nt, Salmonella typhimurium LT2
gacaggcggcagcuuacu

SEQ ID NO: 3782288 - RNA, 21 nt, Salmonella typhimurium LT2
gacagggucgcaauaccggcg

SEQ ID NO: 3782289 - RNA, 23 nt, Salmonella typhimurium LT2
gacaggguuugccagcaccagca

SEQ ID NO: 3782290 - RNA, 15 nt, Salmonella typhimurium LT2
gacagguguuaaugu

SEQ ID NO: 3782291 - RNA, 19 nt, Salmonella typhimurium LT2
gacaguaaaacccaauaac

SEQ ID NO: 3782292 - RNA, 16 nt, Salmonella typhimurium LT2
gacaguaguaucaucc

SEQ ID NO: 3782293 - RNA, 21 nt, Salmonella typhimurium LT2
gacaguccgggccgugacaca

SEQ ID NO: 3782294 - RNA, 23 nt, Salmonella typhimurium LT2
gacagucgcagagcccagcgcga

SEQ ID NO: 3782295 - RNA, 17 nt, Salmonella typhimurium LT2
gacagugaacggcauaa

SEQ ID NO: 3782296 - RNA, 21 nt, Salmonella typhimurium LT2
gacaguuuuuugucuguaaaa

SEQ ID NO: 3782297 - RNA, 15 nt, Salmonella typhimurium LT2
gacauaaucaugaac

SEQ ID NO: 3782298 - RNA, 15 nt, Salmonella typhimurium LT2
gacauacauaacgcg

SEQ ID NO: 3782299 - RNA, 15 nt, Salmonella typhimurium LT2
gacauacuuuaccgg

SEQ ID NO: 3782300 - RNA, 11 nt, Salmonella typhimurium LT2
aaaaauacuga

SEQ ID NO: 3782301 - RNA, 17 nt, Salmonella typhimurium LT2
aaaaauacugauaaaaa

SEQ ID NO: 3782302 - RNA, 18 nt, Salmonella typhimurium LT2
aaaaauagccgguugagu

SEQ ID NO: 3782303 - RNA, 13 nt, Salmonella typhimurium LT2
aaaaauauagcca

SEQ ID NO: 3782304 - RNA, 18 nt, Salmonella typhimurium LT2
aaaaauaucugaauaacc

SEQ ID NO: 3782305 - RNA, 19 nt, Salmonella typhimurium LT2
aaaaauaucugaauaacca

SEQ ID NO: 3782306 - RNA, 18 nt, Salmonella typhimurium LT2
aaaaauaugcaauuaaua

SEQ ID NO: 3782307 - RNA, 18 nt, Salmonella typhimurium LT2
aaaaauauguguuugaug

SEQ ID NO: 3782308 - RNA, 13 nt, Salmonella typhimurium LT2
aaaaaucagcaau

SEQ ID NO: 3782309 - RNA, 21 nt, Salmonella typhimurium LT2
aaaaaucaugcucauaaugga

SEQ ID NO: 3782310 - RNA, 14 nt, Salmonella typhimurium LT2
aaaaauccggauca

SEQ ID NO: 3782311 - RNA, 14 nt, Salmonella typhimurium LT2
aaaaaugauaagca

SEQ ID NO: 3782312 - RNA, 23 nt, Salmonella typhimurium LT2
aaaaaugauaagcacuauuauau

SEQ ID NO: 3782313 - RNA, 15 nt, Salmonella typhimurium LT2
aaaaaugauguguuu

SEQ ID NO: 3782314 - RNA, 20 nt, Salmonella typhimurium LT2
aaaaauuacaacaggaugga

SEQ ID NO: 3782315 - RNA, 20 nt, Salmonella typhimurium LT2
aaaaauuacgaaaaggucuu

SEQ ID NO: 3782316 - RNA, 13 nt, Salmonella typhimurium LT2
aaaaauucuuuua

SEQ ID NO: 3782317 - RNA, 14 nt, Salmonella typhimurium LT2
aaaaauuuuuauag

SEQ ID NO: 3782318 - RNA, 20 nt, Salmonella typhimurium LT2
aaaacaccuaacccaccaua

SEQ ID NO: 3782319 - RNA, 17 nt, Salmonella typhimurium LT2
aaaacacgucuggaaac

SEQ ID NO: 3782320 - RNA, 19 nt, Salmonella typhimurium LT2
aaaacacuaccagacacag

SEQ ID NO: 3782321 - RNA, 18 nt, Salmonella typhimurium LT2
aaaacagcauaauaaagc

SEQ ID NO: 3782322 - RNA, 19 nt, Salmonella typhimurium LT2
aaaacagcaugguguuagu

SEQ ID NO: 3782323 - RNA, 11 nt, Salmonella typhimurium LT2
aaaacagccau

SEQ ID NO: 3782324 - RNA, 18 nt, Salmonella typhimurium LT2
aaaacagccgccauggcg

SEQ ID NO: 3782325 - RNA, 15 nt, Salmonella typhimurium LT2
aaaacaucgccccgg

SEQ ID NO: 3782326 - RNA, 21 nt, Salmonella typhimurium LT2
aaaaccagaauuuguugguuu

SEQ ID NO: 3782327 - RNA, 16 nt, Salmonella typhimurium LT2
aaaaccagaccuccac

SEQ ID NO: 3782328 - RNA, 16 nt, Salmonella typhimurium LT2
aaaaccaggcaacaga

SEQ ID NO: 3782329 - RNA, 19 nt, Salmonella typhimurium LT2
aaaaccaggcgaaaauagg

SEQ ID NO: 3782330 - RNA, 19 nt, Salmonella typhimurium LT2
aaaaccauaauaaugccaa

SEQ ID NO: 3782331 - RNA, 19 nt, Salmonella typhimurium LT2
aaaaccauugcuaaaaaua

SEQ ID NO: 3782332 - RNA, 21 nt, Salmonella typhimurium LT2
aaaaccauugcuaaaaauacg

SEQ ID NO: 3782333 - RNA, 15 nt, Salmonella typhimurium LT2
aaaacccaauaacug

SEQ ID NO: 3782334 - RNA, 16 nt, Salmonella typhimurium LT2
aaaaccccaucccggc

SEQ ID NO: 3782335 - RNA, 19 nt, Salmonella typhimurium LT2
aaaacccgcagccggauag

SEQ ID NO: 3782336 - RNA, 18 nt, Salmonella typhimurium LT2
aaaacccguuaaauacca

SEQ ID NO: 3782337 - RNA, 16 nt, Salmonella typhimurium LT2
aaaaccgacagcaaua

SEQ ID NO: 3782338 - RNA, 23 nt, Salmonella typhimurium LT2
aaaaccgaucucccagccgggca

SEQ ID NO: 3782339 - RNA, 23 nt, Salmonella typhimurium LT2
aaaaccggcauacacgccgggca

SEQ ID NO: 3782340 - RNA, 18 nt, Salmonella typhimurium LT2
aaaaccguugucguccgu

SEQ ID NO: 3782341 - RNA, 16 nt, Salmonella typhimurium LT2
aaaaccuaaauaaaua

SEQ ID NO: 3782342 - RNA, 16 nt, Salmonella typhimurium LT2
aaaaccugcaaaaaaa

SEQ ID NO: 3782343 - RNA, 13 nt, Salmonella typhimurium LT2
aaaacgagaacac

SEQ ID NO: 3782344 - RNA, 15 nt, Salmonella typhimurium LT2
aaaacgauauugccu

SEQ ID NO: 3782345 - RNA, 16 nt, Salmonella typhimurium LT2
aaaacgcgucccaugg

SEQ ID NO: 3782346 - RNA, 14 nt, Salmonella typhimurium LT2
aaaacggccaguga

SEQ ID NO: 3782347 - RNA, 16 nt, Salmonella typhimurium LT2
aaaacggcucaucagu

SEQ ID NO: 3782348 - RNA, 22 nt, Salmonella typhimurium LT2
aaaacgguaugaaggaccaaca

SEQ ID NO: 3782349 - RNA, 16 nt, Salmonella typhimurium LT2
aaaacgugauugcuga

SEQ ID NO: 3782350 - RNA, 20 nt, Salmonella typhimurium LT2
aaaacguugacuuaaaaagc

SEQ ID NO: 3782351 - RNA, 21 nt, Salmonella typhimurium LT2
aaaacguuugcaaauagguuu

SEQ ID NO: 3782352 - RNA, 15 nt, Salmonella typhimurium LT2
aaaacugccaucaau

SEQ ID NO: 3782353 - RNA, 13 nt, Salmonella typhimurium LT2
aaaacuucgauaa

SEQ ID NO: 3782354 - RNA, 18 nt, Salmonella typhimurium LT2
aaaacuucgauaauaaaa

SEQ ID NO: 3782355 - RNA, 14 nt, Salmonella typhimurium LT2
aaaagaaaaauauc

SEQ ID NO: 3782356 - RNA, 11 nt, Salmonella typhimurium LT2
aaaagaaaaca

SEQ ID NO: 3782357 - RNA, 15 nt, Salmonella typhimurium LT2
aaaagaagaaaaaau

SEQ ID NO: 3782358 - RNA, 20 nt, Salmonella typhimurium LT2
aaaagaccauccgguuuuaa

SEQ ID NO: 3782359 - RNA, 18 nt, Salmonella typhimurium LT2
aaaagaccccgccaggcg

SEQ ID NO: 3782360 - RNA, 24 nt, Salmonella typhimurium LT2
aaaagaccuggggguaacacaaaa

SEQ ID NO: 3782361 - RNA, 22 nt, Salmonella typhimurium LT2
aaaagacggcuuuugguuccuu

SEQ ID NO: 3782362 - RNA, 14 nt, Salmonella typhimurium LT2
aaaagagaaaaaau

SEQ ID NO: 3782363 - RNA, 15 nt, Salmonella typhimurium LT2
aaaagaguaaaguua

SEQ ID NO: 3782364 - RNA, 23 nt, Salmonella typhimurium LT2
aaaagaguaaaguuauucacgua

SEQ ID NO: 3782365 - RNA, 17 nt, Salmonella typhimurium LT2
aaaagauauuauaaaau

SEQ ID NO: 3782366 - RNA, 12 nt, Salmonella typhimurium LT2
aaaagauugcug

SEQ ID NO: 3782367 - RNA, 21 nt, Salmonella typhimurium LT2
aaaagcacaucaggaaaugaa

SEQ ID NO: 3782368 - RNA, 18 nt, Salmonella typhimurium LT2
aaaagcaucguaccuuca

SEQ ID NO: 3782369 - RNA, 18 nt, Salmonella typhimurium LT2
aaaagccaagcacaaaaa

SEQ ID NO: 3782370 - RNA, 17 nt, Salmonella typhimurium LT2
aaaagccagauaaagca

SEQ ID NO: 3782371 - RNA, 22 nt, Salmonella typhimurium LT2
aaaagccagcacggcuucacgu

SEQ ID NO: 3782372 - RNA, 14 nt, Salmonella typhimurium LT2
aaaagcccucucac

SEQ ID NO: 3782373 - RNA, 16 nt, Salmonella typhimurium LT2
aaaagcccuuaucgcc

SEQ ID NO: 3782374 - RNA, 14 nt, Salmonella typhimurium LT2
aaaagcgaaaauaa

SEQ ID NO: 3782375 - RNA, 19 nt, Salmonella typhimurium LT2
aaaagcgccacgcgucagg

SEQ ID NO: 3782376 - RNA, 20 nt, Salmonella typhimurium LT2
aaaagcgccacgcgucaggu

SEQ ID NO: 3782377 - RNA, 15 nt, Salmonella typhimurium LT2
aaaagcgcccagcgc

SEQ ID NO: 3782378 - RNA, 15 nt, Salmonella typhimurium LT2
aaaagcgcgggcugg

SEQ ID NO: 3782379 - RNA, 13 nt, Salmonella typhimurium LT2
aaaagcugauuaa

SEQ ID NO: 3782380 - RNA, 19 nt, Salmonella typhimurium LT2
aaaagcuguagcauaaaug

SEQ ID NO: 3782381 - RNA, 20 nt, Salmonella typhimurium LT2
aaaagcuguagcauaaaugc

SEQ ID NO: 3782382 - RNA, 15 nt, Salmonella typhimurium LT2
aaaagcugucgccac

SEQ ID NO: 3782383 - RNA, 18 nt, Salmonella typhimurium LT2
aaaagcugucgccaccuu

SEQ ID NO: 3782384 - RNA, 17 nt, Salmonella typhimurium LT2
aaaagcuucguuaagaa

SEQ ID NO: 3782385 - RNA, 15 nt, Salmonella typhimurium LT2
aaaaggcaauaaagu

SEQ ID NO: 3782386 - RNA, 22 nt, Salmonella typhimurium LT2
aaaaggcagauucuucugccuu

SEQ ID NO: 3782387 - RNA, 14 nt, Salmonella typhimurium LT2
aaaaggcagccagg

SEQ ID NO: 3782388 - RNA, 19 nt, Salmonella typhimurium LT2
aaaaggccuggcugagaaa

SEQ ID NO: 3782389 - RNA, 20 nt, Salmonella typhimurium LT2
aaaaggcgacgaugugcaua

SEQ ID NO: 3782390 - RNA, 21 nt, Salmonella typhimurium LT2
aaaaggucgauauuuaaugag

SEQ ID NO: 3782391 - RNA, 19 nt, Salmonella typhimurium LT2
aaaagguggguuccagcgc

SEQ ID NO: 3782392 - RNA, 16 nt, Salmonella typhimurium LT2
aaaaguauauaucccg

SEQ ID NO: 3782393 - RNA, 14 nt, Salmonella typhimurium LT2
aaaaguauggcggu

SEQ ID NO: 3782394 - RNA, 18 nt, Salmonella typhimurium LT2
aaaaguauggcgguuccg

SEQ ID NO: 3782395 - RNA, 23 nt, Salmonella typhimurium LT2
aaaagugauucacuuucuugcca

SEQ ID NO: 3782396 - RNA, 13 nt, Salmonella typhimurium LT2
aaaagugccagca

SEQ ID NO: 3782397 - RNA, 21 nt, Salmonella typhimurium LT2
aaaagugcgcacucagaaaau

SEQ ID NO: 3782398 - RNA, 17 nt, Salmonella typhimurium LT2
aaaaguuugaccagcaa

SEQ ID NO: 3782399 - RNA, 19 nt, Salmonella typhimurium LT2
aaaaguuugaccagcaaua

SEQ ID NO: 3782400 - RNA, 21 nt, Salmonella typhimurium LT2
aaaaguuugaccagcaauaaa

SEQ ID NO: 3782401 - RNA, 22 nt, Salmonella typhimurium LT2
aaaaguuugcugcgucacgcgu

SEQ ID NO: 3782402 - RNA, 15 nt, Salmonella typhimurium LT2
aaaauaaaaaaggca

SEQ ID NO: 3782403 - RNA, 12 nt, Salmonella typhimurium LT2
aaaauaaaauua

SEQ ID NO: 3782404 - RNA, 21 nt, Salmonella typhimurium LT2
aaaccgcaccguuccgccacc

SEQ ID NO: 3782405 - RNA, 15 nt, Salmonella typhimurium LT2
aaaccgcagaaaaag

SEQ ID NO: 3782406 - RNA, 20 nt, Salmonella typhimurium LT2
aaaccgcauaacgcgcuggu

SEQ ID NO: 3782407 - RNA, 14 nt, Salmonella typhimurium LT2
aaaccgcccugcag

SEQ ID NO: 3782408 - RNA, 21 nt, Salmonella typhimurium LT2
aaaccgcgcggcauaaauccg

SEQ ID NO: 3782409 - RNA, 23 nt, Salmonella typhimurium LT2
aaaccgcguuacccugcgaaucc

SEQ ID NO: 3782410 - RNA, 22 nt, Salmonella typhimurium LT2
aaaccggcgcgccuuccagcaa

SEQ ID NO: 3782411 - RNA, 23 nt, Salmonella typhimurium LT2
aaaccggcgcgccuuccagcaau

SEQ ID NO: 3782412 - RNA, 19 nt, Salmonella typhimurium LT2
aaaccggcggucaugcugg

SEQ ID NO: 3782413 - RNA, 14 nt, Salmonella typhimurium LT2
aaaccggcugccag

SEQ ID NO: 3782414 - RNA, 20 nt, Salmonella typhimurium LT2
aaaccgggcggguguucccu

SEQ ID NO: 3782415 - RNA, 15 nt, Salmonella typhimurium LT2
aaaccggggagcuau

SEQ ID NO: 3782416 - RNA, 17 nt, Salmonella typhimurium LT2
aaaccggucauauugcc

SEQ ID NO: 3782417 - RNA, 22 nt, Salmonella typhimurium LT2
aaaccguagcuuugcgccagau

SEQ ID NO: 3782418 - RNA, 14 nt, Salmonella typhimurium LT2
aaaccuaccggcau

SEQ ID NO: 3782419 - RNA, 12 nt, Salmonella typhimurium LT2
aaaccuccggcu

SEQ ID NO: 3782420 - RNA, 15 nt, Salmonella typhimurium LT2
aaaccugaugcguca

SEQ ID NO: 3782421 - RNA, 18 nt, Salmonella typhimurium LT2
aaaccuguucccggcaga

SEQ ID NO: 3782422 - RNA, 15 nt, Salmonella typhimurium LT2
aaaccuuucuucucu

SEQ ID NO: 3782423 - RNA, 22 nt, Salmonella typhimurium LT2
aaaccuuucuucucuucuucaa

SEQ ID NO: 3782424 - RNA, 13 nt, Salmonella typhimurium LT2
aaacgaaacccaa

SEQ ID NO: 3782425 - RNA, 21 nt, Salmonella typhimurium LT2
aaacgaaacccaaauaaccag

SEQ ID NO: 3782426 - RNA, 21 nt, Salmonella typhimurium LT2
aaacgaaucaccucgcuuccc

SEQ ID NO: 3782427 - RNA, 21 nt, Salmonella typhimurium LT2
aaacgacagcgccaucagcau

SEQ ID NO: 3782428 - RNA, 14 nt, Salmonella typhimurium LT2
aaacgacauaaccg

SEQ ID NO: 3782429 - RNA, 19 nt, Salmonella typhimurium LT2
aaacgcaaugccaucaggc

SEQ ID NO: 3782430 - RNA, 22 nt, Salmonella typhimurium LT2
aaacgcauccaggcgaaauaga

SEQ ID NO: 3782431 - RNA, 19 nt, Salmonella typhimurium LT2
aaacgccagcccuuccagc

SEQ ID NO: 3782432 - RNA, 22 nt, Salmonella typhimurium LT2
aaacgccagcccuuccagcgga

SEQ ID NO: 3782433 - RNA, 20 nt, Salmonella typhimurium LT2
aaacgccaggcacgccggca

SEQ ID NO: 3782434 - RNA, 18 nt, Salmonella typhimurium LT2
aaacgccaggcgcugcgu

SEQ ID NO: 3782435 - RNA, 19 nt, Salmonella typhimurium LT2
aaacgcccccagauagaac

SEQ ID NO: 3782436 - RNA, 20 nt, Salmonella typhimurium LT2
aaacgccccuucaucagcca

SEQ ID NO: 3782437 - RNA, 23 nt, Salmonella typhimurium LT2
aaacgccccuucaucagccagca

SEQ ID NO: 3782438 - RNA, 14 nt, Salmonella typhimurium LT2
aaacgccucauccg

SEQ ID NO: 3782439 - RNA, 23 nt, Salmonella typhimurium LT2
aaacgccugcccgguuaaggggc

SEQ ID NO: 3782440 - RNA, 20 nt, Salmonella typhimurium LT2
aaacgccuggagugacuaaa

SEQ ID NO: 3782441 - RNA, 16 nt, Salmonella typhimurium LT2
aaacgccuuauccggc

SEQ ID NO: 3782442 - RNA, 16 nt, Salmonella typhimurium LT2
aaacgcgccgcugcgu

SEQ ID NO: 3782443 - RNA, 15 nt, Salmonella typhimurium LT2
aaacgcgcucgccag

SEQ ID NO: 3782444 - RNA, 19 nt, Salmonella typhimurium LT2
aaacgcgcucgccagcgca

SEQ ID NO: 3782445 - RNA, 20 nt, Salmonella typhimurium LT2
aaacgcgcucgccagcgcag

SEQ ID NO: 3782446 - RNA, 23 nt, Salmonella typhimurium LT2
aaacgcggccaucacgcugcggu

SEQ ID NO: 3782447 - RNA, 23 nt, Salmonella typhimurium LT2
aaacgcggccuggaagcgcccag

SEQ ID NO: 3782448 - RNA, 21 nt, Salmonella typhimurium LT2
aaacgcguagcggguucuuuc

SEQ ID NO: 3782449 - RNA, 16 nt, Salmonella typhimurium LT2
aaacgcgucagcguuu

SEQ ID NO: 3782450 - RNA, 23 nt, Salmonella typhimurium LT2
aaacgcuaugccuggauguauaa

SEQ ID NO: 3782451 - RNA, 17 nt, Salmonella typhimurium LT2
aaacgcucaaauauccc

SEQ ID NO: 3782452 - RNA, 17 nt, Salmonella typhimurium LT2
aaacgcuccggcaggca

SEQ ID NO: 3782453 - RNA, 15 nt, Salmonella typhimurium LT2
aaacgcucgcgcugu

SEQ ID NO: 3782454 - RNA, 20 nt, Salmonella typhimurium LT2
aaacgcucgcgcuguucgcu

SEQ ID NO: 3782455 - RNA, 18 nt, Salmonella typhimurium LT2
aaacgcucgcuuaaugag

SEQ ID NO: 3782456 - RNA, 19 nt, Salmonella typhimurium LT2
aaacgcuuauggauaagcg

SEQ ID NO: 3782457 - RNA, 23 nt, Salmonella typhimurium LT2
aaacgcuucuauuucuuuauucu

SEQ ID NO: 3782458 - RNA, 17 nt, Salmonella typhimurium LT2
aaacggccugcgcugga

SEQ ID NO: 3782459 - RNA, 23 nt, Salmonella typhimurium LT2
aaacggcgguuuuuuuauccauu

SEQ ID NO: 3782460 - RNA, 14 nt, Salmonella typhimurium LT2
aaacggcuuuaauc

SEQ ID NO: 3782461 - RNA, 23 nt, Salmonella typhimurium LT2
aaacgguaagaguucacguagcu

SEQ ID NO: 3782462 - RNA, 15 nt, Salmonella typhimurium LT2
aaacgguaugaaaca

SEQ ID NO: 3782463 - RNA, 19 nt, Salmonella typhimurium LT2
aaacgucaugcuguuaccg

SEQ ID NO: 3782464 - RNA, 14 nt, Salmonella typhimurium LT2
aaacgucgaacaua

SEQ ID NO: 3782465 - RNA, 16 nt, Salmonella typhimurium LT2
aaacgucguaaaaccu

SEQ ID NO: 3782466 - RNA, 13 nt, Salmonella typhimurium LT2
aaacgugaaauau

SEQ ID NO: 3782467 - RNA, 20 nt, Salmonella typhimurium LT2
aaacguguuuauccccgcug

SEQ ID NO: 3782468 - RNA, 16 nt, Salmonella typhimurium LT2
aaacguugaugauaaa

SEQ ID NO: 3782469 - RNA, 22 nt, Salmonella typhimurium LT2
aaacguugcuggacauauucca

SEQ ID NO: 3782470 - RNA, 18 nt, Salmonella typhimurium LT2
aaacuaaguaaggaggaa

SEQ ID NO: 3782471 - RNA, 20 nt, Salmonella typhimurium LT2
aaacuacuggcugguuucuc

SEQ ID NO: 3782472 - RNA, 13 nt, Salmonella typhimurium LT2
aaacuauuuuuag

SEQ ID NO: 3782473 - RNA, 19 nt, Salmonella typhimurium LT2
aaacuauuuuuagcccuug

SEQ ID NO: 3782474 - RNA, 14 nt, Salmonella typhimurium LT2
aaacucaaucaggc

SEQ ID NO: 3782475 - RNA, 13 nt, Salmonella typhimurium LT2
aaacucagagaga

SEQ ID NO: 3782476 - RNA, 20 nt, Salmonella typhimurium LT2
aaacucagcgccagcgcuga

SEQ ID NO: 3782477 - RNA, 23 nt, Salmonella typhimurium LT2
aaacucagcgccagcgcugacau

SEQ ID NO: 3782478 - RNA, 16 nt, Salmonella typhimurium LT2
aaacuccaccugaucg

SEQ ID NO: 3782479 - RNA, 14 nt, Salmonella typhimurium LT2
aaacuccagcggca

SEQ ID NO: 3782480 - RNA, 15 nt, Salmonella typhimurium LT2
aaacucccggcggaa

SEQ ID NO: 3782481 - RNA, 18 nt, Salmonella typhimurium LT2
aaacucgccgccaugacg

SEQ ID NO: 3782482 - RNA, 21 nt, Salmonella typhimurium LT2
aaacugauaguuuaaauccag

SEQ ID NO: 3782483 - RNA, 14 nt, Salmonella typhimurium LT2
aaacugcugacaau

SEQ ID NO: 3782484 - RNA, 14 nt, Salmonella typhimurium LT2
aaacuggauaagcg

SEQ ID NO: 3782485 - RNA, 15 nt, Salmonella typhimurium LT2
aaacuggccacagca

SEQ ID NO: 3782486 - RNA, 16 nt, Salmonella typhimurium LT2
aaacuuaauuauuaau

SEQ ID NO: 3782487 - RNA, 12 nt, Salmonella typhimurium LT2
aaacuuaucauu

SEQ ID NO: 3782488 - RNA, 23 nt, Salmonella typhimurium LT2
aaacuucgauaauaaaauauuau

SEQ ID NO: 3782489 - RNA, 12 nt, Salmonella typhimurium LT2
aaacuuuuaaau

SEQ ID NO: 3782490 - RNA, 18 nt, Salmonella typhimurium LT2
aaagaaaguagaucacca

SEQ ID NO: 3782491 - RNA, 21 nt, Salmonella typhimurium LT2
aaagaagaaaccgcagaaaaa

SEQ ID NO: 3782492 - RNA, 16 nt, Salmonella typhimurium LT2
aaagaaucgccaggcg

SEQ ID NO: 3782493 - RNA, 17 nt, Salmonella typhimurium LT2
aaagaaugaaaaaaaau

SEQ ID NO: 3782494 - RNA, 16 nt, Salmonella typhimurium LT2
aaagaauuacugaaua

SEQ ID NO: 3782495 - RNA, 15 nt, Salmonella typhimurium LT2
aaagaccaauacuga

SEQ ID NO: 3782496 - RNA, 17 nt, Salmonella typhimurium LT2
aaagaccccgccaggcg

SEQ ID NO: 3782497 - RNA, 16 nt, Salmonella typhimurium LT2
aaagaccgacaucgcc

SEQ ID NO: 3782498 - RNA, 16 nt, Salmonella typhimurium LT2
aaagaccuccgcccgg

SEQ ID NO: 3782499 - RNA, 21 nt, Salmonella typhimurium LT2
aaagaccuggggguaacacaa

SEQ ID NO: 3782500 - RNA, 14 nt, Salmonella typhimurium LT2
aaagaccuucuugc

SEQ ID NO: 3782501 - RNA, 18 nt, Salmonella typhimurium LT2
aaagagaaaaaauucaac

SEQ ID NO: 3782502 - RNA, 22 nt, Salmonella typhimurium LT2
aaagagaaaaagaagaaaaaau

SEQ ID NO: 3782503 - RNA, 19 nt, Salmonella typhimurium LT2
aaagagcaggccaaaaaag

SEQ ID NO: 3782504 - RNA, 22 nt, Salmonella typhimurium LT2
aaagagcuccccacgaaagucu

SEQ ID NO: 3782505 - RNA, 18 nt, Salmonella typhimurium LT2
aaagagggugaaccaaag

SEQ ID NO: 3782506 - RNA, 18 nt, Salmonella typhimurium LT2
aaagagugccagaaacau

SEQ ID NO: 3782507 - RNA, 19 nt, Salmonella typhimurium LT2
aaaguuuaugccucaagug

SEQ ID NO: 3782508 - RNA, 19 nt, Salmonella typhimurium LT2
aaaguuugaccagcaauaa

SEQ ID NO: 3782509 - RNA, 15 nt, Salmonella typhimurium LT2
aaauaaaaaaggcag

SEQ ID NO: 3782510 - RNA, 15 nt, Salmonella typhimurium LT2
aaauaaaaaccauuu

SEQ ID NO: 3782511 - RNA, 22 nt, Salmonella typhimurium LT2
aaauaaaauacgcucaauauac

SEQ ID NO: 3782512 - RNA, 21 nt, Salmonella typhimurium LT2
aaauaaacgcuugacucugaa

SEQ ID NO: 3782513 - RNA, 16 nt, Salmonella typhimurium LT2
aaauaaauccaugaga

SEQ ID NO: 3782514 - RNA, 18 nt, Salmonella typhimurium LT2
aaauaaaugccgcaauaa

SEQ ID NO: 3782515 - RNA, 15 nt, Salmonella typhimurium LT2
aaauaacgccagauc

SEQ ID NO: 3782516 - RNA, 19 nt, Salmonella typhimurium LT2
aaauaacgcgauaaucccc

SEQ ID NO: 3782517 - RNA, 12 nt, Salmonella typhimurium LT2
aaauaagaaaau

SEQ ID NO: 3782518 - RNA, 12 nt, Salmonella typhimurium LT2
aaauaagaguca

SEQ ID NO: 3782519 - RNA, 14 nt, Salmonella typhimurium LT2
aaauaauaucgcgc

SEQ ID NO: 3782520 - RNA, 16 nt, Salmonella typhimurium LT2
aaauaaucaccacauu

SEQ ID NO: 3782521 - RNA, 22 nt, Salmonella typhimurium LT2
aaauaauccgcugcaacucccg

SEQ ID NO: 3782522 - RNA, 19 nt, Salmonella typhimurium LT2
aaauaaugccucauuaaaa

SEQ ID NO: 3782523 - RNA, 13 nt, Salmonella typhimurium LT2
aaauacagaugcu

SEQ ID NO: 3782524 - RNA, 14 nt, Salmonella typhimurium LT2
aaauaccaaauauu

SEQ ID NO: 3782525 - RNA, 13 nt, Salmonella typhimurium LT2
aaauaccacauca

SEQ ID NO: 3782526 - RNA, 9 nt, Salmonella typhimurium LT2
aaauaccag

SEQ ID NO: 3782527 - RNA, 12 nt, Salmonella typhimurium LT2
aaauaccagcac

SEQ ID NO: 3782528 - RNA, 15 nt, Salmonella typhimurium LT2
aaauacccucaguuc

SEQ ID NO: 3782529 - RNA, 20 nt, Salmonella typhimurium LT2
aaauacccuuaugauagccg

SEQ ID NO: 3782530 - RNA, 15 nt, Salmonella typhimurium LT2
aaauaccgcacauca

SEQ ID NO: 3782531 - RNA, 18 nt, Salmonella typhimurium LT2
aaauaccguaaugccgac

SEQ ID NO: 3782532 - RNA, 12 nt, Salmonella typhimurium LT2
aaauaccuaacu

SEQ ID NO: 3782533 - RNA, 15 nt, Salmonella typhimurium LT2
aaauacgccagauaa

SEQ ID NO: 3782534 - RNA, 19 nt, Salmonella typhimurium LT2
aaauacgccgccagcaaua

SEQ ID NO: 3782535 - RNA, 23 nt, Salmonella typhimurium LT2
aaauacgcgcgccgccugcuccg

SEQ ID NO: 3782536 - RNA, 16 nt, Salmonella typhimurium LT2
aaauacgcucaauaua

SEQ ID NO: 3782537 - RNA, 14 nt, Salmonella typhimurium LT2
aaauacgcugcggc

SEQ ID NO: 3782538 - RNA, 22 nt, Salmonella typhimurium LT2
aaauacggcuuccacugcggca

SEQ ID NO: 3782539 - RNA, 22 nt, Salmonella typhimurium LT2
aaauacugaacuauaggaaaau

SEQ ID NO: 3782540 - RNA, 14 nt, Salmonella typhimurium LT2
aaauacugauuaau

SEQ ID NO: 3782541 - RNA, 22 nt, Salmonella typhimurium LT2
aaauacugcgcgaaauacggac

SEQ ID NO: 3782542 - RNA, 20 nt, Salmonella typhimurium LT2
aaauacugcuuuuccggcag

SEQ ID NO: 3782543 - RNA, 19 nt, Salmonella typhimurium LT2
aaauagcgccagacagaua

SEQ ID NO: 3782544 - RNA, 22 nt, Salmonella typhimurium LT2
aaauagcgcgccauauuaacaa

SEQ ID NO: 3782545 - RNA, 16 nt, Salmonella typhimurium LT2
aaauaguccagcagcc

SEQ ID NO: 3782546 - RNA, 15 nt, Salmonella typhimurium LT2
aaauagugacgccgc

SEQ ID NO: 3782547 - RNA, 20 nt, Salmonella typhimurium LT2
aaauauagccauuuaaugau

SEQ ID NO: 3782548 - RNA, 16 nt, Salmonella typhimurium LT2
aaauauagcuuuucau

SEQ ID NO: 3782549 - RNA, 16 nt, Salmonella typhimurium LT2
aaauauauaauuuaua

SEQ ID NO: 3782550 - RNA, 16 nt, Salmonella typhimurium LT2
aaauaucaagaaaacu

SEQ ID NO: 3782551 - RNA, 19 nt, Salmonella typhimurium LT2
aaauaucgaugcuuauuau

SEQ ID NO: 3782552 - RNA, 17 nt, Salmonella typhimurium LT2
aaauaucgcguuaauuu

SEQ ID NO: 3782553 - RNA, 20 nt, Salmonella typhimurium LT2
aaauaucgcguuaauuuuua

SEQ ID NO: 3782554 - RNA, 21 nt, Salmonella typhimurium LT2
aaauaucgcguuaauuuuuag

SEQ ID NO: 3782555 - RNA, 19 nt, Salmonella typhimurium LT2
aaauaugaagaaggccugu

SEQ ID NO: 3782556 - RNA, 22 nt, Salmonella typhimurium LT2
aaauaugaugcuaucuuugcug

SEQ ID NO: 3782557 - RNA, 15 nt, Salmonella typhimurium LT2
aaauaugcaauuaau

SEQ ID NO: 3782558 - RNA, 11 nt, Salmonella typhimurium LT2
aaauauuaaga

SEQ ID NO: 3782559 - RNA, 12 nt, Salmonella typhimurium LT2
aaauauuaucgc

SEQ ID NO: 3782560 - RNA, 17 nt, Salmonella typhimurium LT2
aaauauugauuaaucgu

SEQ ID NO: 3782561 - RNA, 20 nt, Salmonella typhimurium LT2
aaauauugauuaaucgucau

SEQ ID NO: 3782562 - RNA, 14 nt, Salmonella typhimurium LT2
aaauauuucuuuau

SEQ ID NO: 3782563 - RNA, 15 nt, Salmonella typhimurium LT2
aaaucaaacagaaua

SEQ ID NO: 3782564 - RNA, 19 nt, Salmonella typhimurium LT2
aaaucaaacugauacugga

SEQ ID NO: 3782565 - RNA, 22 nt, Salmonella typhimurium LT2
aaaucaacgcucagaccgaucu

SEQ ID NO: 3782566 - RNA, 22 nt, Salmonella typhimurium LT2
aaaucaauuccgguugcccauu

SEQ ID NO: 3782567 - RNA, 20 nt, Salmonella typhimurium LT2
aaaucaauuuuaauuuaaua

SEQ ID NO: 3782568 - RNA, 21 nt, Salmonella typhimurium LT2
aaaucaauuuuaauuuaauaa

SEQ ID NO: 3782569 - RNA, 15 nt, Salmonella typhimurium LT2
aaaucacgcacacgu

SEQ ID NO: 3782570 - RNA, 20 nt, Salmonella typhimurium LT2
aaaucacuaagaccagcauc

SEQ ID NO: 3782571 - RNA, 22 nt, Salmonella typhimurium LT2
aaaucacuggagcgcauuuuac

SEQ ID NO: 3782572 - RNA, 20 nt, Salmonella typhimurium LT2
aaaucagcaaaaacauuacc

SEQ ID NO: 3782573 - RNA, 21 nt, Salmonella typhimurium LT2
aaaucagcaaucgcuggcgua

SEQ ID NO: 3782574 - RNA, 14 nt, Salmonella typhimurium LT2
aaaucagcauuacc

SEQ ID NO: 3782575 - RNA, 14 nt, Salmonella typhimurium LT2
aaaucaggaaaaag

SEQ ID NO: 3782576 - RNA, 15 nt, Salmonella typhimurium LT2
aaaucaggaaaaagg

SEQ ID NO: 3782577 - RNA, 20 nt, Salmonella typhimurium LT2
aaaucaggccaagcaacauu

SEQ ID NO: 3782578 - RNA, 14 nt, Salmonella typhimurium LT2
aaaucaguuguacu

SEQ ID NO: 3782579 - RNA, 22 nt, Salmonella typhimurium LT2
aaaucaguuguacuuguugcug

SEQ ID NO: 3782580 - RNA, 15 nt, Salmonella typhimurium LT2
aaaucauaccagcga

SEQ ID NO: 3782581 - RNA, 13 nt, Salmonella typhimurium LT2
aaaucaucaaugg

SEQ ID NO: 3782582 - RNA, 16 nt, Salmonella typhimurium LT2
aaaucaucaauggcga

SEQ ID NO: 3782583 - RNA, 21 nt, Salmonella typhimurium LT2
aaaucaugaaggagagcauuu

SEQ ID NO: 3782584 - RNA, 11 nt, Salmonella typhimurium LT2
aaaucaugccc

SEQ ID NO: 3782585 - RNA, 18 nt, Salmonella typhimurium LT2
aaaucauuuguacaaaaa

SEQ ID NO: 3782586 - RNA, 22 nt, Salmonella typhimurium LT2
aaaucauuuguacaaaaaaugu

SEQ ID NO: 3782587 - RNA, 15 nt, Salmonella typhimurium LT2
aaauccaacucaguu

SEQ ID NO: 3782588 - RNA, 20 nt, Salmonella typhimurium LT2
aaauccaaucugacacagag

SEQ ID NO: 3782589 - RNA, 16 nt, Salmonella typhimurium LT2
aaauccacauuccaga

SEQ ID NO: 3782590 - RNA, 16 nt, Salmonella typhimurium LT2
aaauccagcagaauaa

SEQ ID NO: 3782591 - RNA, 17 nt, Salmonella typhimurium LT2
aaauccagggaaaccau

SEQ ID NO: 3782592 - RNA, 22 nt, Salmonella typhimurium LT2
aaauccagggaaaccauguuga

SEQ ID NO: 3782593 - RNA, 16 nt, Salmonella typhimurium LT2
aaaucccacauccggc

SEQ ID NO: 3782594 - RNA, 13 nt, Salmonella typhimurium LT2
aaaucccauugcc

SEQ ID NO: 3782595 - RNA, 18 nt, Salmonella typhimurium LT2
aaauccgccggaaacugg

SEQ ID NO: 3782596 - RNA, 11 nt, Salmonella typhimurium LT2
aaauccggcag

SEQ ID NO: 3782597 - RNA, 21 nt, Salmonella typhimurium LT2
aaauccggcaggcagccggau

SEQ ID NO: 3782598 - RNA, 13 nt, Salmonella typhimurium LT2
aaauccuccggcg

SEQ ID NO: 3782599 - RNA, 13 nt, Salmonella typhimurium LT2
aaauccuggauga

SEQ ID NO: 3782600 - RNA, 13 nt, Salmonella typhimurium LT2
aaauccuguucca

SEQ ID NO: 3782601 - RNA, 20 nt, Salmonella typhimurium LT2
aaauccuuccagcgccauaa

SEQ ID NO: 3782602 - RNA, 18 nt, Salmonella typhimurium LT2
aaauccuucuuccauucc

SEQ ID NO: 3782603 - RNA, 23 nt, Salmonella typhimurium LT2
aaaucgccaaagaaacgcugauc

SEQ ID NO: 3782604 - RNA, 21 nt, Salmonella typhimurium LT2
aaaucgcuauauugcugcgca

SEQ ID NO: 3782605 - RNA, 21 nt, Salmonella typhimurium LT2
aaaucggggucuuccagcaga

SEQ ID NO: 3782606 - RNA, 22 nt, Salmonella typhimurium LT2
aaaucgguacgcgucugaauga

SEQ ID NO: 3782607 - RNA, 23 nt, Salmonella typhimurium LT2
aaaucggugcuuccggcacugcg

SEQ ID NO: 3782608 - RNA, 20 nt, Salmonella typhimurium LT2
aaaucgucagacggcuccag

SEQ ID NO: 3782609 - RNA, 21 nt, Salmonella typhimurium LT2
aaaucgucagccgccaguuca

SEQ ID NO: 3782610 - RNA, 16 nt, Salmonella typhimurium LT2
aaaucucgcuaaucau

SEQ ID NO: 3782611 - RNA, 14 nt, Salmonella typhimurium LT2
aacaccaguuuauc

SEQ ID NO: 3782612 - RNA, 18 nt, Salmonella typhimurium LT2
aacaccgacauccgccau

SEQ ID NO: 3782613 - RNA, 18 nt, Salmonella typhimurium LT2
aacacgaccagcgacagu

SEQ ID NO: 3782614 - RNA, 16 nt, Salmonella typhimurium LT2
aacacgacgcugccac

SEQ ID NO: 3782615 - RNA, 23 nt, Salmonella typhimurium LT2
aacacgaugaugucauaaucgcc

SEQ ID NO: 3782616 - RNA, 13 nt, Salmonella typhimurium LT2
aacacgauuuuug

SEQ ID NO: 3782617 - RNA, 20 nt, Salmonella typhimurium LT2
aacacgccgacucacgcagc

SEQ ID NO: 3782618 - RNA, 21 nt, Salmonella typhimurium LT2
aacacgccgccuaucgccagc

SEQ ID NO: 3782619 - RNA, 20 nt, Salmonella typhimurium LT2
aacacgccuggcgcuuuaaa

SEQ ID NO: 3782620 - RNA, 15 nt, Salmonella typhimurium LT2
aacacggcaugaagc

SEQ ID NO: 3782621 - RNA, 16 nt, Salmonella typhimurium LT2
aacacggcaugaagca

SEQ ID NO: 3782622 - RNA, 15 nt, Salmonella typhimurium LT2
aacacucuccaccaa

SEQ ID NO: 3782623 - RNA, 22 nt, Salmonella typhimurium LT2
aacagacaauuagcgacgcaua

SEQ ID NO: 3782624 - RNA, 12 nt, Salmonella typhimurium LT2
aacagagcaauu

SEQ ID NO: 3782625 - RNA, 13 nt, Salmonella typhimurium LT2
aacagaguaaccc

SEQ ID NO: 3782626 - RNA, 13 nt, Salmonella typhimurium LT2
aacagauaaaugu

SEQ ID NO: 3782627 - RNA, 20 nt, Salmonella typhimurium LT2
aacagaugacagugcgccau

SEQ ID NO: 3782628 - RNA, 21 nt, Salmonella typhimurium LT2
aacagauguuuacgcugcucc

SEQ ID NO: 3782629 - RNA, 20 nt, Salmonella typhimurium LT2
aacagcaaaucgggaaaaug

SEQ ID NO: 3782630 - RNA, 14 nt, Salmonella typhimurium LT2
aacagcaauguuuc

SEQ ID NO: 3782631 - RNA, 15 nt, Salmonella typhimurium LT2
aacagcaccagcagg

SEQ ID NO: 3782632 - RNA, 19 nt, Salmonella typhimurium LT2
aacagcaccagcagguggu

SEQ ID NO: 3782633 - RNA, 13 nt, Salmonella typhimurium LT2
aacagcaggaccc

SEQ ID NO: 3782634 - RNA, 19 nt, Salmonella typhimurium LT2
aacagcaggcaucgguucu

SEQ ID NO: 3782635 - RNA, 22 nt, Salmonella typhimurium LT2
aacagcauugaggcuacccaga

SEQ ID NO: 3782636 - RNA, 23 nt, Salmonella typhimurium LT2
aacagccaaucauaaacgccuga

SEQ ID NO: 3782637 - RNA, 14 nt, Salmonella typhimurium LT2
aacagccagaacgu

SEQ ID NO: 3782638 - RNA, 13 nt, Salmonella typhimurium LT2
aacagccagaagc

SEQ ID NO: 3782639 - RNA, 14 nt, Salmonella typhimurium LT2
aacagccagcgagc

SEQ ID NO: 3782640 - RNA, 12 nt, Salmonella typhimurium LT2
aacagccaggcu

SEQ ID NO: 3782641 - RNA, 13 nt, Salmonella typhimurium LT2
aacagccauaaug

SEQ ID NO: 3782642 - RNA, 23 nt, Salmonella typhimurium LT2
aacagccauaaugcugccagcau

SEQ ID NO: 3782643 - RNA, 16 nt, Salmonella typhimurium LT2
aacagccugucgccgu

SEQ ID NO: 3782644 - RNA, 15 nt, Salmonella typhimurium LT2
aacagcgaccacgcc

SEQ ID NO: 3782645 - RNA, 20 nt, Salmonella typhimurium LT2
aacagcgaucacgccgucca

SEQ ID NO: 3782646 - RNA, 22 nt, Salmonella typhimurium LT2
aacagcgcaauaugcagaucga

SEQ ID NO: 3782647 - RNA, 20 nt, Salmonella typhimurium LT2
aacagcgcguccagcggcaa

SEQ ID NO: 3782648 - RNA, 17 nt, Salmonella typhimurium LT2
aacagcgcuaucaggaa

SEQ ID NO: 3782649 - RNA, 19 nt, Salmonella typhimurium LT2
aacagcgcuaucaggaaga

SEQ ID NO: 3782650 - RNA, 21 nt, Salmonella typhimurium LT2
aacagcggcacuucgauaaac

SEQ ID NO: 3782651 - RNA, 18 nt, Salmonella typhimurium LT2
aacagcuggcgauauccg

SEQ ID NO: 3782652 - RNA, 17 nt, Salmonella typhimurium LT2
aacaggaggaucgccgc

SEQ ID NO: 3782653 - RNA, 19 nt, Salmonella typhimurium LT2
aacaggcuuuucaggcugu

SEQ ID NO: 3782654 - RNA, 16 nt, Salmonella typhimurium LT2
aacagggggcgcauca

SEQ ID NO: 3782655 - RNA, 18 nt, Salmonella typhimurium LT2
aacagggggcgcaucacu

SEQ ID NO: 3782656 - RNA, 18 nt, Salmonella typhimurium LT2
aacagggugacucauuuc

SEQ ID NO: 3782657 - RNA, 13 nt, Salmonella typhimurium LT2
aacaggucaacuc

SEQ ID NO: 3782658 - RNA, 17 nt, Salmonella typhimurium LT2
aacagguuuccggcaga

SEQ ID NO: 3782659 - RNA, 23 nt, Salmonella typhimurium LT2
aacagucccaccagcgcggcaca

SEQ ID NO: 3782660 - RNA, 17 nt, Salmonella typhimurium LT2
aacagucgcgccgugcc

SEQ ID NO: 3782661 - RNA, 19 nt, Salmonella typhimurium LT2
aacagugaguuaagacgcu

SEQ ID NO: 3782662 - RNA, 21 nt, Salmonella typhimurium LT2
aacaguguaaacgccagauaa

SEQ ID NO: 3782663 - RNA, 13 nt, Salmonella typhimurium LT2
aacaguucagaca

SEQ ID NO: 3782664 - RNA, 20 nt, Salmonella typhimurium LT2
aacauaagcaguaucccacc

SEQ ID NO: 3782665 - RNA, 13 nt, Salmonella typhimurium LT2
aacauaauaaagc

SEQ ID NO: 3782666 - RNA, 18 nt, Salmonella typhimurium LT2
aacauagcggcaaggaaa

SEQ ID NO: 3782667 - RNA, 19 nt, Salmonella typhimurium LT2
aacauagcggcaaggaaaa

SEQ ID NO: 3782668 - RNA, 18 nt, Salmonella typhimurium LT2
aacauagcuuacuuuuag

SEQ ID NO: 3782669 - RNA, 15 nt, Salmonella typhimurium LT2
aacauauaaaucagu

SEQ ID NO: 3782670 - RNA, 15 nt, Salmonella typhimurium LT2
aacauauagcagcag

SEQ ID NO: 3782671 - RNA, 12 nt, Salmonella typhimurium LT2
aacauauauauc

SEQ ID NO: 3782672 - RNA, 21 nt, Salmonella typhimurium LT2
aacauaucuccucugccauga

SEQ ID NO: 3782673 - RNA, 15 nt, Salmonella typhimurium LT2
aacauauggcccauu

SEQ ID NO: 3782674 - RNA, 17 nt, Salmonella typhimurium LT2
aacauaugggcaaaaac

SEQ ID NO: 3782675 - RNA, 12 nt, Salmonella typhimurium LT2
aacauauuuuua

SEQ ID NO: 3782676 - RNA, 13 nt, Salmonella typhimurium LT2
aacauauuuuuau

SEQ ID NO: 3782677 - RNA, 19 nt, Salmonella typhimurium LT2
aacauauuuuuaugcacgc

SEQ ID NO: 3782678 - RNA, 19 nt, Salmonella typhimurium LT2
aacauauuuuucacacaua

SEQ ID NO: 3782679 - RNA, 23 nt, Salmonella typhimurium LT2
aacauauuuuucacacauaagca

SEQ ID NO: 3782680 - RNA, 16 nt, Salmonella typhimurium LT2
aacaucaccuuucauu

SEQ ID NO: 3782681 - RNA, 15 nt, Salmonella typhimurium LT2
aacaucagccagcag

SEQ ID NO: 3782682 - RNA, 16 nt, Salmonella typhimurium LT2
aacaucagccagcagc

SEQ ID NO: 3782683 - RNA, 23 nt, Salmonella typhimurium LT2
aacaucagcccuaucgcugcgcu

SEQ ID NO: 3782684 - RNA, 11 nt, Salmonella typhimurium LT2
aacaucagccg

SEQ ID NO: 3782685 - RNA, 12 nt, Salmonella typhimurium LT2
aacaucagcgcg

SEQ ID NO: 3782686 - RNA, 20 nt, Salmonella typhimurium LT2
aacaucagcgcuaccagcgc

SEQ ID NO: 3782687 - RNA, 12 nt, Salmonella typhimurium LT2
aacaucauaaua

SEQ ID NO: 3782688 - RNA, 16 nt, Salmonella typhimurium LT2
aacaucgagcuuugac

SEQ ID NO: 3782689 - RNA, 14 nt, Salmonella typhimurium LT2
aacaucgguuaucg

SEQ ID NO: 3782690 - RNA, 15 nt, Salmonella typhimurium LT2
aacaucguaaaucaa

SEQ ID NO: 3782691 - RNA, 19 nt, Salmonella typhimurium LT2
aacaucguaaaucaaauga

SEQ ID NO: 3782692 - RNA, 20 nt, Salmonella typhimurium LT2
aacaucuaccgcauacugaa

SEQ ID NO: 3782693 - RNA, 11 nt, Salmonella typhimurium LT2
aacaucuguga

SEQ ID NO: 3782694 - RNA, 12 nt, Salmonella typhimurium LT2
aacaucugugaa

SEQ ID NO: 3782695 - RNA, 16 nt, Salmonella typhimurium LT2
aacaucugugaaaacg

SEQ ID NO: 3782696 - RNA, 18 nt, Salmonella typhimurium LT2
aacaucuuccaugccuuc

SEQ ID NO: 3782697 - RNA, 16 nt, Salmonella typhimurium LT2
aacaucuuugccgcgu

SEQ ID NO: 3782698 - RNA, 14 nt, Salmonella typhimurium LT2
aacaugaccagcgc

SEQ ID NO: 3782699 - RNA, 16 nt, Salmonella typhimurium LT2
aacaugaccagcgcaa

SEQ ID NO: 3782700 - RNA, 16 nt, Salmonella typhimurium LT2
aacaugaguaaacagg

SEQ ID NO: 3782701 - RNA, 21 nt, Salmonella typhimurium LT2
aacaugcccaccggaccuaau

SEQ ID NO: 3782702 - RNA, 23 nt, Salmonella typhimurium LT2
aacaugcccaccggaccuaauaa

SEQ ID NO: 3782703 - RNA, 14 nt, Salmonella typhimurium LT2
aacaugcccaguuu

SEQ ID NO: 3782704 - RNA, 20 nt, Salmonella typhimurium LT2
aacauuaaucgccauugcaa

SEQ ID NO: 3782705 - RNA, 19 nt, Salmonella typhimurium LT2
aacauuauggcgugaugcu

SEQ ID NO: 3782706 - RNA, 19 nt, Salmonella typhimurium LT2
aacauugguuaucaaaaac

SEQ ID NO: 3782707 - RNA, 14 nt, Salmonella typhimurium LT2
aacauuucagcgcc

SEQ ID NO: 3782708 - RNA, 16 nt, Salmonella typhimurium LT2
aaccaacgacccccac

SEQ ID NO: 3782709 - RNA, 23 nt, Salmonella typhimurium LT2
aaccaacgacccccaccauguca

SEQ ID NO: 3782710 - RNA, 16 nt, Salmonella typhimurium LT2
aaccaacgcccaacug

SEQ ID NO: 3782711 - RNA, 12 nt, Salmonella typhimurium LT2
aaccaacugagc

SEQ ID NO: 3782712 - RNA, 12 nt, Salmonella typhimurium LT2
aaccaaugcagc

SEQ ID NO: 3782713 - RNA, 17 nt, Salmonella typhimurium LT2
aaccacaaguuuauccg

SEQ ID NO: 3782714 - RNA, 20 nt, Salmonella typhimurium LT2
aaccacaaguuuauccggca

SEQ ID NO: 3782715 - RNA, 17 nt, Salmonella typhimurium LT2
aaccucggcuugcuuca

SEQ ID NO: 3782716 - RNA, 19 nt, Salmonella typhimurium LT2
aaccucggcuugcuucauc

SEQ ID NO: 3782717 - RNA, 17 nt, Salmonella typhimurium LT2
aaccucuauaguaaauu

SEQ ID NO: 3782718 - RNA, 14 nt, Salmonella typhimurium LT2
aaccugagaauauu

SEQ ID NO: 3782719 - RNA, 15 nt, Salmonella typhimurium LT2
aaccugagaauauua

SEQ ID NO: 3782720 - RNA, 21 nt, Salmonella typhimurium LT2
aaccugagcgcgaacgcucca

SEQ ID NO: 3782721 - RNA, 18 nt, Salmonella typhimurium LT2
aaccugauccaggaaacg

SEQ ID NO: 3782722 - RNA, 18 nt, Salmonella typhimurium LT2
aaccugaugcgucagaua

SEQ ID NO: 3782723 - RNA, 20 nt, Salmonella typhimurium LT2
aaccugcaaaaaaagaaaaa

SEQ ID NO: 3782724 - RNA, 21 nt, Salmonella typhimurium LT2
aaccugcccuuucuucaacgg

SEQ ID NO: 3782725 - RNA, 16 nt, Salmonella typhimurium LT2
aaccugccguuuucca

SEQ ID NO: 3782726 - RNA, 21 nt, Salmonella typhimurium LT2
aaccugcgccgcgauaaagaa

SEQ ID NO: 3782727 - RNA, 16 nt, Salmonella typhimurium LT2
aaccugcgcugacggc

SEQ ID NO: 3782728 - RNA, 16 nt, Salmonella typhimurium LT2
aaccuguuaucaggau

SEQ ID NO: 3782729 - RNA, 17 nt, Salmonella typhimurium LT2
aaccuuaagcgcgaaau

SEQ ID NO: 3782730 - RNA, 17 nt, Salmonella typhimurium LT2
aaccuucaagaaucaau

SEQ ID NO: 3782731 - RNA, 12 nt, Salmonella typhimurium LT2
aaccuucaaguu

SEQ ID NO: 3782732 - RNA, 15 nt, Salmonella typhimurium LT2
aaccuucauaaauac

SEQ ID NO: 3782733 - RNA, 17 nt, Salmonella typhimurium LT2
aaccuucauaaauacgu

SEQ ID NO: 3782734 - RNA, 17 nt, Salmonella typhimurium LT2
aaccuuugucgcguacu

SEQ ID NO: 3782735 - RNA, 19 nt, Salmonella typhimurium LT2
aacgaaacccaaauaacca

SEQ ID NO: 3782736 - RNA, 20 nt, Salmonella typhimurium LT2
aacgaaagcucaggcgggga

SEQ ID NO: 3782737 - RNA, 20 nt, Salmonella typhimurium LT2
aacgaacgcggaucagacgg

SEQ ID NO: 3782738 - RNA, 19 nt, Salmonella typhimurium LT2
aacgaaucaccucgcuucc

SEQ ID NO: 3782739 - RNA, 17 nt, Salmonella typhimurium LT2
aacgacacaggccugau

SEQ ID NO: 3782740 - RNA, 13 nt, Salmonella typhimurium LT2
aacgacagcgcca

SEQ ID NO: 3782741 - RNA, 14 nt, Salmonella typhimurium LT2
aacgaccagaauca

SEQ ID NO: 3782742 - RNA, 15 nt, Salmonella typhimurium LT2
aacgacccaucaaua

SEQ ID NO: 3782743 - RNA, 17 nt, Salmonella typhimurium LT2
aacgacgcauaaaaaau

SEQ ID NO: 3782744 - RNA, 17 nt, Salmonella typhimurium LT2
aacgacguuuuccaguu

SEQ ID NO: 3782745 - RNA, 12 nt, Salmonella typhimurium LT2
aacgagccgaua

SEQ ID NO: 3782746 - RNA, 16 nt, Salmonella typhimurium LT2
aacgagccgucgcuau

SEQ ID NO: 3782747 - RNA, 17 nt, Salmonella typhimurium LT2
aacgaggccaccaucac

SEQ ID NO: 3782748 - RNA, 21 nt, Salmonella typhimurium LT2
aacgagugaggaccguacuca

SEQ ID NO: 3782749 - RNA, 21 nt, Salmonella typhimurium LT2
aacgaguugcggcaacgugaa

SEQ ID NO: 3782750 - RNA, 20 nt, Salmonella typhimurium LT2
aacgauaagugaagcguuuc

SEQ ID NO: 3782751 - RNA, 19 nt, Salmonella typhimurium LT2
aacgauacagcacggcagu

SEQ ID NO: 3782752 - RNA, 16 nt, Salmonella typhimurium LT2
aacgaucccuaauaaa

SEQ ID NO: 3782753 - RNA, 18 nt, Salmonella typhimurium LT2
aacgauucguaaauugac

SEQ ID NO: 3782754 - RNA, 15 nt, Salmonella typhimurium LT2
aacgauuucaucagc

SEQ ID NO: 3782755 - RNA, 16 nt, Salmonella typhimurium LT2
aacgauuucaucagcg

SEQ ID NO: 3782756 - RNA, 15 nt, Salmonella typhimurium LT2
aacgcaacucaucgu

SEQ ID NO: 3782757 - RNA, 15 nt, Salmonella typhimurium LT2
aacgcaccaccugca

SEQ ID NO: 3782758 - RNA, 18 nt, Salmonella typhimurium LT2
aacgcacccgcgcaggcg

SEQ ID NO: 3782759 - RNA, 14 nt, Salmonella typhimurium LT2
aacgcacuaccaga

SEQ ID NO: 3782760 - RNA, 16 nt, Salmonella typhimurium LT2
aacgcagcaucgccau

SEQ ID NO: 3782761 - RNA, 18 nt, Salmonella typhimurium LT2
aacgcagcgcgcguagca

SEQ ID NO: 3782762 - RNA, 21 nt, Salmonella typhimurium LT2
aacgcaggcgauagccccagu

SEQ ID NO: 3782763 - RNA, 16 nt, Salmonella typhimurium LT2
aacgcauaagcgcgaa

SEQ ID NO: 3782764 - RNA, 18 nt, Salmonella typhimurium LT2
aacgcaucaaauaccuuu

SEQ ID NO: 3782765 - RNA, 13 nt, Salmonella typhimurium LT2
aacgcauccagcg

SEQ ID NO: 3782766 - RNA, 14 nt, Salmonella typhimurium LT2
aacgcauccagcgc

SEQ ID NO: 3782767 - RNA, 18 nt, Salmonella typhimurium LT2
aacgcauccaggcgaaau

SEQ ID NO: 3782768 - RNA, 18 nt, Salmonella typhimurium LT2
aacgcauguuccgcuacc

SEQ ID NO: 3782769 - RNA, 16 nt, Salmonella typhimurium LT2
aacgcauuggcaauga

SEQ ID NO: 3782770 - RNA, 14 nt, Salmonella typhimurium LT2
aacgccaagcgcgg

SEQ ID NO: 3782771 - RNA, 21 nt, Salmonella typhimurium LT2
aacgccaagcgcggcagcagc

SEQ ID NO: 3782772 - RNA, 21 nt, Salmonella typhimurium LT2
aacgccaccgcuaccugcccu

SEQ ID NO: 3782773 - RNA, 19 nt, Salmonella typhimurium LT2
aacgccagaucucacaaga

SEQ ID NO: 3782774 - RNA, 15 nt, Salmonella typhimurium LT2
aacgccaggcaaccu

SEQ ID NO: 3782775 - RNA, 20 nt, Salmonella typhimurium LT2
aacgccaucagccgcgcuau

SEQ ID NO: 3782776 - RNA, 16 nt, Salmonella typhimurium LT2
aacgccccuucaucag

SEQ ID NO: 3782777 - RNA, 22 nt, Salmonella typhimurium LT2
aacgccccuucaucagccagca

SEQ ID NO: 3782778 - RNA, 21 nt, Salmonella typhimurium LT2
aacgcccggcgcgacaccuuc

SEQ ID NO: 3782779 - RNA, 16 nt, Salmonella typhimurium LT2
aacgccgaacaggcca

SEQ ID NO: 3782780 - RNA, 20 nt, Salmonella typhimurium LT2
aacgccgaccacuucaacgc

SEQ ID NO: 3782781 - RNA, 22 nt, Salmonella typhimurium LT2
aacgccgcauccuguaccacca

SEQ ID NO: 3782782 - RNA, 13 nt, Salmonella typhimurium LT2
aacgccgccagcu

SEQ ID NO: 3782783 - RNA, 13 nt, Salmonella typhimurium LT2
aacgccgcgcaaa

SEQ ID NO: 3782784 - RNA, 16 nt, Salmonella typhimurium LT2
aacgccgcgcguaaau

SEQ ID NO: 3782785 - RNA, 17 nt, Salmonella typhimurium LT2
aacgccggauuccagaa

SEQ ID NO: 3782786 - RNA, 16 nt, Salmonella typhimurium LT2
aacgccgggaacuuuc

SEQ ID NO: 3782787 - RNA, 15 nt, Salmonella typhimurium LT2
aacgccgggccugcc

SEQ ID NO: 3782788 - RNA, 16 nt, Salmonella typhimurium LT2
aacgccgugcucaucc

SEQ ID NO: 3782789 - RNA, 23 nt, Salmonella typhimurium LT2
aacgccuccauuuuggggaaaau

SEQ ID NO: 3782790 - RNA, 23 nt, Salmonella typhimurium LT2
aacgccugcauaaacgcggccau

SEQ ID NO: 3782791 - RNA, 20 nt, Salmonella typhimurium LT2
aacgccugcuccguccacgc

SEQ ID NO: 3782792 - RNA, 13 nt, Salmonella typhimurium LT2
aacgccugggaua

SEQ ID NO: 3782793 - RNA, 17 nt, Salmonella typhimurium LT2
aacgccuuauccggccu

SEQ ID NO: 3782794 - RNA, 20 nt, Salmonella typhimurium LT2
aacgccuuauccugccuaca

SEQ ID NO: 3782795 - RNA, 19 nt, Salmonella typhimurium LT2
aacgccuuccugccagcac

SEQ ID NO: 3782796 - RNA, 13 nt, Salmonella typhimurium LT2
aacgcgaaaauac

SEQ ID NO: 3782797 - RNA, 19 nt, Salmonella typhimurium LT2
aacgcgaacugugaagcga

SEQ ID NO: 3782798 - RNA, 14 nt, Salmonella typhimurium LT2
aacgcgaccagcgc

SEQ ID NO: 3782799 - RNA, 15 nt, Salmonella typhimurium LT2
aacgcgaccagcgca

SEQ ID NO: 3782800 - RNA, 23 nt, Salmonella typhimurium LT2
aacgcgcaguccguuuucaacgc

SEQ ID NO: 3782801 - RNA, 13 nt, Salmonella typhimurium LT2
aacgcgccacgcg

SEQ ID NO: 3782802 - RNA, 12 nt, Salmonella typhimurium LT2
aacgcgccaggu

SEQ ID NO: 3782803 - RNA, 14 nt, Salmonella typhimurium LT2
aacgcgccaucuuu

SEQ ID NO: 3782804 - RNA, 23 nt, Salmonella typhimurium LT2
aacgcgcccaacggaugcgccau

SEQ ID NO: 3782805 - RNA, 12 nt, Salmonella typhimurium LT2
aacgcgccgagg

SEQ ID NO: 3782806 - RNA, 17 nt, Salmonella typhimurium LT2
aacgcgcgacuuaucuu

SEQ ID NO: 3782807 - RNA, 14 nt, Salmonella typhimurium LT2
aacgcgcgcgcugu

SEQ ID NO: 3782808 - RNA, 21 nt, Salmonella typhimurium LT2
aacgcgcgucgcuaaucagca

SEQ ID NO: 3782809 - RNA, 15 nt, Salmonella typhimurium LT2
aacgcgcucgccagc

SEQ ID NO: 3782810 - RNA, 17 nt, Salmonella typhimurium LT2
aacgcggcccugaaacc

SEQ ID NO: 3782811 - RNA, 22 nt, Salmonella typhimurium LT2
aacgcggcgccagcgacaacgc

SEQ ID NO: 3782812 - RNA, 21 nt, Salmonella typhimurium LT2
aacgcguagccaaaagcgcca

SEQ ID NO: 3782813 - RNA, 22 nt, Salmonella typhimurium LT2
aacgcgucuuaucuggccuaca

SEQ ID NO: 3782814 - RNA, 22 nt, Salmonella typhimurium LT2
aacgcguuaaucacuaccugca

SEQ ID NO: 3782815 - RNA, 23 nt, Salmonella typhimurium LT2
aacgcguuaucgggaugccagau

SEQ ID NO: 3782816 - RNA, 16 nt, Salmonella typhimurium LT2
aacgcguucauccagc

SEQ ID NO: 3782817 - RNA, 18 nt, Salmonella typhimurium LT2
aacgcguucauccagcgc

SEQ ID NO: 3782818 - RNA, 13 nt, Salmonella typhimurium LT2
aacgcuccagcag

SEQ ID NO: 3782819 - RNA, 22 nt, Salmonella typhimurium LT2
aacucuucaacggucucaggcu

SEQ ID NO: 3782820 - RNA, 23 nt, Salmonella typhimurium LT2
aacucuuucagaccauaguccau

SEQ ID NO: 3782821 - RNA, 16 nt, Salmonella typhimurium LT2
aacugaacccaucgcc

SEQ ID NO: 3782822 - RNA, 22 nt, Salmonella typhimurium LT2
aacugaauuucauccccggcgc

SEQ ID NO: 3782823 - RNA, 16 nt, Salmonella typhimurium LT2
aacugacagcagugac

SEQ ID NO: 3782824 - RNA, 14 nt, Salmonella typhimurium LT2
aacugacagcguuu

SEQ ID NO: 3782825 - RNA, 23 nt, Salmonella typhimurium LT2
aacugacguuagucauauucagc

SEQ ID NO: 3782826 - RNA, 15 nt, Salmonella typhimurium LT2
aacugagcgccaauu

SEQ ID NO: 3782827 - RNA, 20 nt, Salmonella typhimurium LT2
aacugauaguuuaaauccag

SEQ ID NO: 3782828 - RNA, 23 nt, Salmonella typhimurium LT2
aacugauggcgcuaagccagcca

SEQ ID NO: 3782829 - RNA, 18 nt, Salmonella typhimurium LT2
aacugcaaaucuucggca

SEQ ID NO: 3782830 - RNA, 23 nt, Salmonella typhimurium LT2
aacugcaccuuuuuuuccagcgu

SEQ ID NO: 3782831 - RNA, 18 nt, Salmonella typhimurium LT2
aacugcacuuucugcacu

SEQ ID NO: 3782832 - RNA, 14 nt, Salmonella typhimurium LT2
aacugccaaaccac

SEQ ID NO: 3782833 - RNA, 19 nt, Salmonella typhimurium LT2
aacugccccuugucguaau

SEQ ID NO: 3782834 - RNA, 20 nt, Salmonella typhimurium LT2
aacugcgaguucaccaguuu

SEQ ID NO: 3782835 - RNA, 15 nt, Salmonella typhimurium LT2
aacugcgccugaaga

SEQ ID NO: 3782836 - RNA, 21 nt, Salmonella typhimurium LT2
aacugcgccugaagauacgcc

SEQ ID NO: 3782837 - RNA, 16 nt, Salmonella typhimurium LT2
aacugcgccugcauau

SEQ ID NO: 3782838 - RNA, 20 nt, Salmonella typhimurium LT2
aacugcggaauuuuauccug

SEQ ID NO: 3782839 - RNA, 21 nt, Salmonella typhimurium LT2
aacugcggaauuuuauccugg

SEQ ID NO: 3782840 - RNA, 18 nt, Salmonella typhimurium LT2
aacugcggcuuuuucacg

SEQ ID NO: 3782841 - RNA, 15 nt, Salmonella typhimurium LT2
aacugcugccgcagc

SEQ ID NO: 3782842 - RNA, 23 nt, Salmonella typhimurium LT2
aacugcugcucgguuuugccgac

SEQ ID NO: 3782843 - RNA, 14 nt, Salmonella typhimurium LT2
aacugcuguagcac

SEQ ID NO: 3782844 - RNA, 21 nt, Salmonella typhimurium LT2
aacugcuuaaggcaaacaagg

SEQ ID NO: 3782845 - RNA, 12 nt, Salmonella typhimurium LT2
aacuggaaaaag

SEQ ID NO: 3782846 - RNA, 13 nt, Salmonella typhimurium LT2
aacuggaaaaaga

SEQ ID NO: 3782847 - RNA, 14 nt, Salmonella typhimurium LT2
aacuggacaacauu

SEQ ID NO: 3782848 - RNA, 15 nt, Salmonella typhimurium LT2
aacuggauuccuggc

SEQ ID NO: 3782849 - RNA, 16 nt, Salmonella typhimurium LT2
aacuggauuccuggcu

SEQ ID NO: 3782850 - RNA, 19 nt, Salmonella typhimurium LT2
aacuggcaagcgcuaagca

SEQ ID NO: 3782851 - RNA, 11 nt, Salmonella typhimurium LT2
aacuggcggcu

SEQ ID NO: 3782852 - RNA, 15 nt, Salmonella typhimurium LT2
aacuggcggcucagg

SEQ ID NO: 3782853 - RNA, 19 nt, Salmonella typhimurium LT2
aacugggugccaugaauau

SEQ ID NO: 3782854 - RNA, 17 nt, Salmonella typhimurium LT2
aacuggugaaacagguu

SEQ ID NO: 3782855 - RNA, 21 nt, Salmonella typhimurium LT2
aacuguagaaugcuauaugca

SEQ ID NO: 3782856 - RNA, 14 nt, Salmonella typhimurium LT2
aacugucgccgcua

SEQ ID NO: 3782857 - RNA, 18 nt, Salmonella typhimurium LT2
aacuguuaucauagacug

SEQ ID NO: 3782858 - RNA, 15 nt, Salmonella typhimurium LT2
aacuguucagccagc

SEQ ID NO: 3782859 - RNA, 11 nt, Salmonella typhimurium LT2
aacuguugcgc

SEQ ID NO: 3782860 - RNA, 14 nt, Salmonella typhimurium LT2
aacuguuuuucacu

SEQ ID NO: 3782861 - RNA, 14 nt, Salmonella typhimurium LT2
aacuuaaauaaaaa

SEQ ID NO: 3782862 - RNA, 16 nt, Salmonella typhimurium LT2
aacuuaaauaaaaaug

SEQ ID NO: 3782863 - RNA, 22 nt, Salmonella typhimurium LT2
aacuuagcguccacucgcccau

SEQ ID NO: 3782864 - RNA, 20 nt, Salmonella typhimurium LT2
aacuuaucauuuuuucuaag

SEQ ID NO: 3782865 - RNA, 22 nt, Salmonella typhimurium LT2
aacuuauccgacgcguuucaca

SEQ ID NO: 3782866 - RNA, 17 nt, Salmonella typhimurium LT2
aacuuauuuuauuuuua

SEQ ID NO: 3782867 - RNA, 11 nt, Salmonella typhimurium LT2
aacuucaccag

SEQ ID NO: 3782868 - RNA, 22 nt, Salmonella typhimurium LT2
aacuucacgccaucgacaaagg

SEQ ID NO: 3782869 - RNA, 14 nt, Salmonella typhimurium LT2
aacuucaucgccac

SEQ ID NO: 3782870 - RNA, 12 nt, Salmonella typhimurium LT2
aacuuccgccac

SEQ ID NO: 3782871 - RNA, 18 nt, Salmonella typhimurium LT2
aacuucgauaauaaaaua

SEQ ID NO: 3782872 - RNA, 19 nt, Salmonella typhimurium LT2
aacuucgauaauaaaauau

SEQ ID NO: 3782873 - RNA, 13 nt, Salmonella typhimurium LT2
aacuucuccucca

SEQ ID NO: 3782874 - RNA, 17 nt, Salmonella typhimurium LT2
aacuucuccuccaucag

SEQ ID NO: 3782875 - RNA, 17 nt, Salmonella typhimurium LT2
aacuucucgcaggccaa

SEQ ID NO: 3782876 - RNA, 23 nt, Salmonella typhimurium LT2
aacuugccguuuuucucaucaag

SEQ ID NO: 3782877 - RNA, 12 nt, Salmonella typhimurium LT2
aacuuucagaau

SEQ ID NO: 3782878 - RNA, 15 nt, Salmonella typhimurium LT2
aacuuucagaauaau

SEQ ID NO: 3782879 - RNA, 22 nt, Salmonella typhimurium LT2
aacuuucgggcaaacugaacug

SEQ ID NO: 3782880 - RNA, 22 nt, Salmonella typhimurium LT2
aagaaaaaggagccuuacggcu

SEQ ID NO: 3782881 - RNA, 17 nt, Salmonella typhimurium LT2
aagaaauugggcuucca

SEQ ID NO: 3782882 - RNA, 16 nt, Salmonella typhimurium LT2
aagaacgguuggaaua

SEQ ID NO: 3782883 - RNA, 16 nt, Salmonella typhimurium LT2
aagaagaaaccgcaga

SEQ ID NO: 3782884 - RNA, 18 nt, Salmonella typhimurium LT2
aagaagaggaugcuccgc

SEQ ID NO: 3782885 - RNA, 18 nt, Salmonella typhimurium LT2
aagaagcacgacacaaaa

SEQ ID NO: 3782886 - RNA, 19 nt, Salmonella typhimurium LT2
aagaagcgcacuuuccaua

SEQ ID NO: 3782887 - RNA, 22 nt, Salmonella typhimurium LT2
aagaagggagguauaaucagca

SEQ ID NO: 3782888 - RNA, 19 nt, Salmonella typhimurium LT2
aagaagucgaaggcgcagc

SEQ ID NO: 3782889 - RNA, 20 nt, Salmonella typhimurium LT2
aagaagucugugaggaaagc

SEQ ID NO: 3782890 - RNA, 21 nt, Salmonella typhimurium LT2
aagaagucugugaggaaagcg

SEQ ID NO: 3782891 - RNA, 19 nt, Salmonella typhimurium LT2
aagaaguucuucuggcgca

SEQ ID NO: 3782892 - RNA, 16 nt, Salmonella typhimurium LT2
aagaauagccugggca

SEQ ID NO: 3782893 - RNA, 13 nt, Salmonella typhimurium LT2
aagaauauauucu

SEQ ID NO: 3782894 - RNA, 14 nt, Salmonella typhimurium LT2
aagaaucacgccga

SEQ ID NO: 3782895 - RNA, 14 nt, Salmonella typhimurium LT2
aagaaucccccaua

SEQ ID NO: 3782896 - RNA, 15 nt, Salmonella typhimurium LT2
aagaaucgccaggcg

SEQ ID NO: 3782897 - RNA, 19 nt, Salmonella typhimurium LT2
aagaaucgccaggcgcagc

SEQ ID NO: 3782898 - RNA, 14 nt, Salmonella typhimurium LT2
aagaaugaaaaaaa

SEQ ID NO: 3782899 - RNA, 12 nt, Salmonella typhimurium LT2
aagaauuccacc

SEQ ID NO: 3782900 - RNA, 14 nt, Salmonella typhimurium LT2
aagaauucgcaaug

SEQ ID NO: 3782901 - RNA, 20 nt, Salmonella typhimurium LT2
aagaauuugaacucuuucag

SEQ ID NO: 3782902 - RNA, 16 nt, Salmonella typhimurium LT2
aagacaacguaaacgg

SEQ ID NO: 3782903 - RNA, 17 nt, Salmonella typhimurium LT2
aagacacagauuccaga

SEQ ID NO: 3782904 - RNA, 22 nt, Salmonella typhimurium LT2
aagacacagauuccagauguca

SEQ ID NO: 3782905 - RNA, 20 nt, Salmonella typhimurium LT2
aagacacagcgucgcgcgau

SEQ ID NO: 3782906 - RNA, 20 nt, Salmonella typhimurium LT2
aagacagcguaguuuauucu

SEQ ID NO: 3782907 - RNA, 15 nt, Salmonella typhimurium LT2
aagacagcuuauacu

SEQ ID NO: 3782908 - RNA, 24 nt, Salmonella typhimurium LT2
aagacauccgggccaacggcaucc

SEQ ID NO: 3782909 - RNA, 23 nt, Salmonella typhimurium LT2
aagacaucguugauauuauuaaa

SEQ ID NO: 3782910 - RNA, 16 nt, Salmonella typhimurium LT2
aagacauggaguucca

SEQ ID NO: 3782911 - RNA, 14 nt, Salmonella typhimurium LT2
aagacccgaaccug

SEQ ID NO: 3782912 - RNA, 21 nt, Salmonella typhimurium LT2
aagacccgacaguaaaaccca

SEQ ID NO: 3782913 - RNA, 17 nt, Salmonella typhimurium LT2
aagaccgauagagacug

SEQ ID NO: 3782914 - RNA, 15 nt, Salmonella typhimurium LT2
aagaccuccgcccgg

SEQ ID NO: 3782915 - RNA, 22 nt, Salmonella typhimurium LT2
aagacgaagccgaagcuaaucc

SEQ ID NO: 3782916 - RNA, 21 nt, Salmonella typhimurium LT2
aagacgcauuaacggcaauau

SEQ ID NO: 3782917 - RNA, 21 nt, Salmonella typhimurium LT2
aagacgcgcucggcagcagcg

SEQ ID NO: 3782918 - RNA, 19 nt, Salmonella typhimurium LT2
aagacgcucgacguccagc

SEQ ID NO: 3782919 - RNA, 22 nt, Salmonella typhimurium LT2
aagacggaaaccagauaccccg

SEQ ID NO: 3782920 - RNA, 22 nt, Salmonella typhimurium LT2
aagacggcagcgccauccggca

SEQ ID NO: 3782921 - RNA, 22 nt, Salmonella typhimurium LT2
aagacgucucuuucgacuggac

SEQ ID NO: 3782922 - RNA, 12 nt, Salmonella typhimurium LT2
aaggaugaccgg

SEQ ID NO: 3782923 - RNA, 20 nt, Salmonella typhimurium LT2
aaggauuauuggcaucauaa

SEQ ID NO: 3782924 - RNA, 17 nt, Salmonella typhimurium LT2
aaggcaccgguuuuuga

SEQ ID NO: 3782925 - RNA, 18 nt, Salmonella typhimurium LT2
aaggcagaagaaucugcc

SEQ ID NO: 3782926 - RNA, 15 nt, Salmonella typhimurium LT2
aaggcagagaacaac

SEQ ID NO: 3782927 - RNA, 13 nt, Salmonella typhimurium LT2
aaggcagccagga

SEQ ID NO: 3782928 - RNA, 16 nt, Salmonella typhimurium LT2
aaggcagccaggaacg

SEQ ID NO: 3782929 - RNA, 19 nt, Salmonella typhimurium LT2
aaggcauaaugccacgaga

SEQ ID NO: 3782930 - RNA, 11 nt, Salmonella typhimurium LT2
aaggccagacu

SEQ ID NO: 3782931 - RNA, 22 nt, Salmonella typhimurium LT2
aaggccagacucaucgccgcaa

SEQ ID NO: 3782932 - RNA, 20 nt, Salmonella typhimurium LT2
aaggccggcagccgcugaua

SEQ ID NO: 3782933 - RNA, 18 nt, Salmonella typhimurium LT2
aaggccgggaaaucuucu

SEQ ID NO: 3782934 - RNA, 23 nt, Salmonella typhimurium LT2
aaggccuggcugagaaaaauacg

SEQ ID NO: 3782935 - RNA, 19 nt, Salmonella typhimurium LT2
aaggcgaacuccagcgcga

SEQ ID NO: 3782936 - RNA, 12 nt, Salmonella typhimurium LT2
aaggcgcagccg

SEQ ID NO: 3782937 - RNA, 21 nt, Salmonella typhimurium LT2
aaggcgcgcacaugcagcgca

SEQ ID NO: 3782938 - RNA, 15 nt, Salmonella typhimurium LT2
aaggcgcuagccgca

SEQ ID NO: 3782939 - RNA, 11 nt, Salmonella typhimurium LT2
aaggcgcugaa

SEQ ID NO: 3782940 - RNA, 22 nt, Salmonella typhimurium LT2
aaggcgcuugugauaucugacu

SEQ ID NO: 3782941 - RNA, 17 nt, Salmonella typhimurium LT2
aaggcggaaaucagcac

SEQ ID NO: 3782942 - RNA, 15 nt, Salmonella typhimurium LT2
aaggcggcaaagaua

SEQ ID NO: 3782943 - RNA, 16 nt, Salmonella typhimurium LT2
aaggcguaaccgccau

SEQ ID NO: 3782944 - RNA, 20 nt, Salmonella typhimurium LT2
aaggcguugugcugcggcau

SEQ ID NO: 3782945 - RNA, 20 nt, Salmonella typhimurium LT2
aaggcguuucgccgccaucc

SEQ ID NO: 3782946 - RNA, 15 nt, Salmonella typhimurium LT2
aaggcguuugcgccg

SEQ ID NO: 3782947 - RNA, 19 nt, Salmonella typhimurium LT2
aaggcuaccggacaaacau

SEQ ID NO: 3782948 - RNA, 20 nt, Salmonella typhimurium LT2
aaggcuaccggacaaacauu

SEQ ID NO: 3782949 - RNA, 23 nt, Salmonella typhimurium LT2
aaggcuauugacgcaccgcccgg

SEQ ID NO: 3782950 - RNA, 14 nt, Salmonella typhimurium LT2
aaggcuccauauca

SEQ ID NO: 3782951 - RNA, 23 nt, Salmonella typhimurium LT2
aaggcugauuauauaacacgauu

SEQ ID NO: 3782952 - RNA, 17 nt, Salmonella typhimurium LT2
aaggcuggcacguucuc

SEQ ID NO: 3782953 - RNA, 20 nt, Salmonella typhimurium LT2
aaggcuugacucaaaaagag

SEQ ID NO: 3782954 - RNA, 14 nt, Salmonella typhimurium LT2
aagggaccgcgaag

SEQ ID NO: 3782955 - RNA, 18 nt, Salmonella typhimurium LT2
aagggaggugcucuccca

SEQ ID NO: 3782956 - RNA, 12 nt, Salmonella typhimurium LT2
aagggcagagcc

SEQ ID NO: 3782957 - RNA, 21 nt, Salmonella typhimurium LT2
aagggccagagaaagucgcuc

SEQ ID NO: 3782958 - RNA, 18 nt, Salmonella typhimurium LT2
aaggggauaacaaccagg

SEQ ID NO: 3782959 - RNA, 18 nt, Salmonella typhimurium LT2
aaggguauacaaaaaaga

SEQ ID NO: 3782960 - RNA, 17 nt, Salmonella typhimurium LT2
aaggguaugaauaaaaa

SEQ ID NO: 3782961 - RNA, 19 nt, Salmonella typhimurium LT2
aaggguuuucgccuggcgg

SEQ ID NO: 3782962 - RNA, 22 nt, Salmonella typhimurium LT2
aagguaaacgcgaccagcgcac

SEQ ID NO: 3782963 - RNA, 17 nt, Salmonella typhimurium LT2
aagguaacgcgaaaaaa

SEQ ID NO: 3782964 - RNA, 14 nt, Salmonella typhimurium LT2
aagguaauaauccu

SEQ ID NO: 3782965 - RNA, 14 nt, Salmonella typhimurium LT2
aagguauccgccau

SEQ ID NO: 3782966 - RNA, 19 nt, Salmonella typhimurium LT2
aaggucaucacaucccagc

SEQ ID NO: 3782967 - RNA, 13 nt, Salmonella typhimurium LT2
aagguccagggaa

SEQ ID NO: 3782968 - RNA, 13 nt, Salmonella typhimurium LT2
aaggugagaaaaa

SEQ ID NO: 3782969 - RNA, 14 nt, Salmonella typhimurium LT2
aaggugagcucuuu

SEQ ID NO: 3782970 - RNA, 14 nt, Salmonella typhimurium LT2
aagguuaagagggu

SEQ ID NO: 3782971 - RNA, 15 nt, Salmonella typhimurium LT2
aagguucauggcuuc

SEQ ID NO: 3782972 - RNA, 20 nt, Salmonella typhimurium LT2
aagguuguuugggcgcauag

SEQ ID NO: 3782973 - RNA, 13 nt, Salmonella typhimurium LT2
aagguuuuucccg

SEQ ID NO: 3782974 - RNA, 18 nt, Salmonella typhimurium LT2
aaguaaaacaagccgaua

SEQ ID NO: 3782975 - RNA, 12 nt, Salmonella typhimurium LT2
aaguaaaauaac

SEQ ID NO: 3782976 - RNA, 22 nt, Salmonella typhimurium LT2
aaguaaagauuuuuauuaaaau

SEQ ID NO: 3782977 - RNA, 23 nt, Salmonella typhimurium LT2
aaguaaagauuuuuauuaaaauu

SEQ ID NO: 3782978 - RNA, 15 nt, Salmonella typhimurium LT2
aaguaaauaagaaaa

SEQ ID NO: 3782979 - RNA, 17 nt, Salmonella typhimurium LT2
aaguaaauaagaaaaug

SEQ ID NO: 3782980 - RNA, 13 nt, Salmonella typhimurium LT2
aaguaagcgccag

SEQ ID NO: 3782981 - RNA, 18 nt, Salmonella typhimurium LT2
aaguaaggaggaaucgcu

SEQ ID NO: 3782982 - RNA, 23 nt, Salmonella typhimurium LT2
aaguaauagguugcgccaacguc

SEQ ID NO: 3782983 - RNA, 18 nt, Salmonella typhimurium LT2
aaguaccacuaacagugc

SEQ ID NO: 3782984 - RNA, 22 nt, Salmonella typhimurium LT2
aaguaccgugaagaaacggaaa

SEQ ID NO: 3782985 - RNA, 18 nt, Salmonella typhimurium LT2
aaguacgccuuucaccau

SEQ ID NO: 3782986 - RNA, 20 nt, Salmonella typhimurium LT2
aaguacggcaaaaauauuga

SEQ ID NO: 3782987 - RNA, 15 nt, Salmonella typhimurium LT2
aaguagcagagaaaa

SEQ ID NO: 3782988 - RNA, 23 nt, Salmonella typhimurium LT2
aaguaguuggugggugaugacgg

SEQ ID NO: 3782989 - RNA, 17 nt, Salmonella typhimurium LT2
aaguauaguggcgacaa

SEQ ID NO: 3782990 - RNA, 16 nt, Salmonella typhimurium LT2
aaguaucccuuccuca

SEQ ID NO: 3782991 - RNA, 13 nt, Salmonella typhimurium LT2
aaguauccuggaa

SEQ ID NO: 3782992 - RNA, 18 nt, Salmonella typhimurium LT2
aaguauucgaugguguua

SEQ ID NO: 3782993 - RNA, 14 nt, Salmonella typhimurium LT2
aagucaaaauaaaa

SEQ ID NO: 3782994 - RNA, 16 nt, Salmonella typhimurium LT2
aagucaaaauaaaauu

SEQ ID NO: 3782995 - RNA, 21 nt, Salmonella typhimurium LT2
aagucaacugcucuaccaacu

SEQ ID NO: 3782996 - RNA, 14 nt, Salmonella typhimurium LT2
aagucagcuuccug

SEQ ID NO: 3782997 - RNA, 17 nt, Salmonella typhimurium LT2
aagucauccagacuaac

SEQ ID NO: 3782998 - RNA, 14 nt, Salmonella typhimurium LT2
aagucaucugccag

SEQ ID NO: 3782999 - RNA, 18 nt, Salmonella typhimurium LT2
aagucaucugccaguuau

SEQ ID NO: 3783000 - RNA, 18 nt, Salmonella typhimurium LT2
aaguccaaguauguuaac

SEQ ID NO: 3783001 - RNA, 17 nt, Salmonella typhimurium LT2
aagucgaaggcgcagcc

SEQ ID NO: 3783002 - RNA, 18 nt, Salmonella typhimurium LT2
aagucgccacccggcuuu

SEQ ID NO: 3783003 - RNA, 13 nt, Salmonella typhimurium LT2
aagucgcgcauaa

SEQ ID NO: 3783004 - RNA, 20 nt, Salmonella typhimurium LT2
aagucucgaaacgaaucuca

SEQ ID NO: 3783005 - RNA, 18 nt, Salmonella typhimurium LT2
aagucugagcgcaaacau

SEQ ID NO: 3783006 - RNA, 15 nt, Salmonella typhimurium LT2
aagucugugaggaaa

SEQ ID NO: 3783007 - RNA, 17 nt, Salmonella typhimurium LT2
aagucugugaggaaagc

SEQ ID NO: 3783008 - RNA, 15 nt, Salmonella typhimurium LT2
aagugccagcacuaa

SEQ ID NO: 3783009 - RNA, 18 nt, Salmonella typhimurium LT2
aagugccagcacuaacga

SEQ ID NO: 3783010 - RNA, 17 nt, Salmonella typhimurium LT2
aagugccgcucacuggu

SEQ ID NO: 3783011 - RNA, 14 nt, Salmonella typhimurium LT2
aaguggugggugau

SEQ ID NO: 3783012 - RNA, 18 nt, Salmonella typhimurium LT2
aagugguuaacagcgcag

SEQ ID NO: 3783013 - RNA, 17 nt, Salmonella typhimurium LT2
aaguguaaguucauuua

SEQ ID NO: 3783014 - RNA, 16 nt, Salmonella typhimurium LT2
aagugucgauaaccug

SEQ ID NO: 3783015 - RNA, 15 nt, Salmonella typhimurium LT2
aagugugggaagggc

SEQ ID NO: 3783016 - RNA, 22 nt, Salmonella typhimurium LT2
aaguuaaucagcgcugucgcca

SEQ ID NO: 3783017 - RNA, 18 nt, Salmonella typhimurium LT2
aaguuaucccugcugagu

SEQ ID NO: 3783018 - RNA, 12 nt, Salmonella typhimurium LT2
aaguuaugcauc

SEQ ID NO: 3783019 - RNA, 15 nt, Salmonella typhimurium LT2
aaguucaaacucauu

SEQ ID NO: 3783020 - RNA, 15 nt, Salmonella typhimurium LT2
aaguucauauggcgu

SEQ ID NO: 3783021 - RNA, 14 nt, Salmonella typhimurium LT2
aaguugaccacacc

SEQ ID NO: 3783022 - RNA, 18 nt, Salmonella typhimurium LT2
aaguugacuuuuacgcca

SEQ ID NO: 3783023 - RNA, 15 nt, Salmonella typhimurium LT2
aaguugaucauccuu

SEQ ID NO: 3783024 - RNA, 13 nt, Salmonella typhimurium LT2
aaguuuaugguaa

SEQ ID NO: 3783025 - RNA, 20 nt, Salmonella typhimurium LT2
aaguuuaugguaaucacaca

SEQ ID NO: 3783026 - RNA, 12 nt, Salmonella typhimurium LT2
aauacugauaaa

SEQ ID NO: 3783027 - RNA, 17 nt, Salmonella typhimurium LT2
aauacugaucaguuugc

SEQ ID NO: 3783028 - RNA, 15 nt, Salmonella typhimurium LT2
aauacuguaagccuc

SEQ ID NO: 3783029 - RNA, 15 nt, Salmonella typhimurium LT2
aauacuuaucaacuu

SEQ ID NO: 3783030 - RNA, 21 nt, Salmonella typhimurium LT2
aauacuuaucaacuucuucau

SEQ ID NO: 3783031 - RNA, 21 nt, Salmonella typhimurium LT2
aauacuucaaaugauuuuuau

SEQ ID NO: 3783032 - RNA, 18 nt, Salmonella typhimurium LT2
aauacuucgcucucuuuu

SEQ ID NO: 3783033 - RNA, 13 nt, Salmonella typhimurium LT2
aauacuucguuau

SEQ ID NO: 3783034 - RNA, 15 nt, Salmonella typhimurium LT2
aauagagaaaucaac

SEQ ID NO: 3783035 - RNA, 17 nt, Salmonella typhimurium LT2
aauagagaaaucaacga

SEQ ID NO: 3783036 - RNA, 17 nt, Salmonella typhimurium LT2
aauagaggaaauaacau

SEQ ID NO: 3783037 - RNA, 16 nt, Salmonella typhimurium LT2
aauagaguaaugacaa

SEQ ID NO: 3783038 - RNA, 14 nt, Salmonella typhimurium LT2
aauagcaagggcaa

SEQ ID NO: 3783039 - RNA, 15 nt, Salmonella typhimurium LT2
aauagcaaugaagca

SEQ ID NO: 3783040 - RNA, 15 nt, Salmonella typhimurium LT2
aauagcagcguuuug

SEQ ID NO: 3783041 - RNA, 15 nt, Salmonella typhimurium LT2
aauagcaggcaaaaa

SEQ ID NO: 3783042 - RNA, 12 nt, Salmonella typhimurium LT2
aauagccagaca

SEQ ID NO: 3783043 - RNA, 13 nt, Salmonella typhimurium LT2
aauagccagcccc

SEQ ID NO: 3783044 - RNA, 12 nt, Salmonella typhimurium LT2
aauagccagcgu

SEQ ID NO: 3783045 - RNA, 12 nt, Salmonella typhimurium LT2
aauagcccggcu

SEQ ID NO: 3783046 - RNA, 23 nt, Salmonella typhimurium LT2
aauagccgggguaauauccauaa

SEQ ID NO: 3783047 - RNA, 14 nt, Salmonella typhimurium LT2
aauagccucauccc

SEQ ID NO: 3783048 - RNA, 13 nt, Salmonella typhimurium LT2
aauagccugggca

SEQ ID NO: 3783049 - RNA, 16 nt, Salmonella typhimurium LT2
aauagcgauacugacg

SEQ ID NO: 3783050 - RNA, 21 nt, Salmonella typhimurium LT2
aauagcgccacgcgaugcaac

SEQ ID NO: 3783051 - RNA, 19 nt, Salmonella typhimurium LT2
aauagcgccagaacugcgu

SEQ ID NO: 3783052 - RNA, 14 nt, Salmonella typhimurium LT2
aauagcgccagaca

SEQ ID NO: 3783053 - RNA, 15 nt, Salmonella typhimurium LT2
aauagcggcuaauca

SEQ ID NO: 3783054 - RNA, 18 nt, Salmonella typhimurium LT2
aauagcugccgcccggcg

SEQ ID NO: 3783055 - RNA, 22 nt, Salmonella typhimurium LT2
aauaggccggagaaaagaccag

SEQ ID NO: 3783056 - RNA, 17 nt, Salmonella typhimurium LT2
aauagguauguaacgug

SEQ ID NO: 3783057 - RNA, 22 nt, Salmonella typhimurium LT2
aauaguauggagcaggaaaaga

SEQ ID NO: 3783058 - RNA, 20 nt, Salmonella typhimurium LT2
aauaguccguuuaaagacau

SEQ ID NO: 3783059 - RNA, 15 nt, Salmonella typhimurium LT2
aauagugaauggcgc

SEQ ID NO: 3783060 - RNA, 17 nt, Salmonella typhimurium LT2
aauagugauaccagcca

SEQ ID NO: 3783061 - RNA, 17 nt, Salmonella typhimurium LT2
aauaguuagccugauag

SEQ ID NO: 3783062 - RNA, 23 nt, Salmonella typhimurium LT2
aauaguuuauugagauaauuuau

SEQ ID NO: 3783063 - RNA, 14 nt, Salmonella typhimurium LT2
aauauaaccaauuu

SEQ ID NO: 3783064 - RNA, 19 nt, Salmonella typhimurium LT2
aauauaauccuuguccaug

SEQ ID NO: 3783065 - RNA, 20 nt, Salmonella typhimurium LT2
aauauacaccugacggcagc

SEQ ID NO: 3783066 - RNA, 19 nt, Salmonella typhimurium LT2
aauauaccgucagcaccag

SEQ ID NO: 3783067 - RNA, 22 nt, Salmonella typhimurium LT2
aauauacgcaccugauaccuca

SEQ ID NO: 3783068 - RNA, 21 nt, Salmonella typhimurium LT2
aauauacucccgaauggcuuc

SEQ ID NO: 3783069 - RNA, 13 nt, Salmonella typhimurium LT2
aauauacuuauca

SEQ ID NO: 3783070 - RNA, 17 nt, Salmonella typhimurium LT2
aauauaucaggcugagc

SEQ ID NO: 3783071 - RNA, 15 nt, Salmonella typhimurium LT2
aauaucaaaccacgc

SEQ ID NO: 3783072 - RNA, 19 nt, Salmonella typhimurium LT2
aauaucaagaaaacugcca

SEQ ID NO: 3783073 - RNA, 23 nt, Salmonella typhimurium LT2
aauaucaauucaacacuuagaac

SEQ ID NO: 3783074 - RNA, 20 nt, Salmonella typhimurium LT2
aauaucagccauuaaccaga

SEQ ID NO: 3783075 - RNA, 21 nt, Salmonella typhimurium LT2
aauaucauccgguaucaugcu

SEQ ID NO: 3783076 - RNA, 22 nt, Salmonella typhimurium LT2
aauaucaucgucauuaaugccu

SEQ ID NO: 3783077 - RNA, 22 nt, Salmonella typhimurium LT2
aauaucauuagcgucauacuua

SEQ ID NO: 3783078 - RNA, 23 nt, Salmonella typhimurium LT2
aauauccccaucccagaccauuc

SEQ ID NO: 3783079 - RNA, 23 nt, Salmonella typhimurium LT2
aauaucccgcaagaaacaggcug

SEQ ID NO: 3783080 - RNA, 22 nt, Salmonella typhimurium LT2
aauaucccuucucauggacaca

SEQ ID NO: 3783081 - RNA, 15 nt, Salmonella typhimurium LT2
aauauccgcugcggu

SEQ ID NO: 3783082 - RNA, 12 nt, Salmonella typhimurium LT2
aauauccuucag

SEQ ID NO: 3783083 - RNA, 21 nt, Salmonella typhimurium LT2
aauaucgcggguuuuaucaau

SEQ ID NO: 3783084 - RNA, 15 nt, Salmonella typhimurium LT2
aauaucgcugccggu

SEQ ID NO: 3783085 - RNA, 14 nt, Salmonella typhimurium LT2
aauaucgucaguau

SEQ ID NO: 3783086 - RNA, 16 nt, Salmonella typhimurium LT2
aauaucuuccuggcgc

SEQ ID NO: 3783087 - RNA, 23 nt, Salmonella typhimurium LT2
aauaugauauguguaucuugcuu

SEQ ID NO: 3783088 - RNA, 16 nt, Salmonella typhimurium LT2
aauaugcaacaugucg

SEQ ID NO: 3783089 - RNA, 19 nt, Salmonella typhimurium LT2
aauaugcaauuaauauauu

SEQ ID NO: 3783090 - RNA, 14 nt, Salmonella typhimurium LT2
aauaugccaggcau

SEQ ID NO: 3783091 - RNA, 13 nt, Salmonella typhimurium LT2
aauaugcgucaga

SEQ ID NO: 3783092 - RNA, 17 nt, Salmonella typhimurium LT2
aauaugcgucagauaaa

SEQ ID NO: 3783093 - RNA, 15 nt, Salmonella typhimurium LT2
aauaugcgucagcgc

SEQ ID NO: 3783094 - RNA, 20 nt, Salmonella typhimurium LT2
aauaugcucaacuuccagaa

SEQ ID NO: 3783095 - RNA, 17 nt, Salmonella typhimurium LT2
aauaugcuggcuuaacu

SEQ ID NO: 3783096 - RNA, 13 nt, Salmonella typhimurium LT2
aauauggaauauc

SEQ ID NO: 3783097 - RNA, 15 nt, Salmonella typhimurium LT2
aauaugguuauccag

SEQ ID NO: 3783098 - RNA, 14 nt, Salmonella typhimurium LT2
aauauuaaaaccau

SEQ ID NO: 3783099 - RNA, 16 nt, Salmonella typhimurium LT2
aauauuaaaaccauug

SEQ ID NO: 3783100 - RNA, 15 nt, Salmonella typhimurium LT2
aauauuaaagaugcc

SEQ ID NO: 3783101 - RNA, 22 nt, Salmonella typhimurium LT2
aauauuaaggccgaauuugaaa

SEQ ID NO: 3783102 - RNA, 12 nt, Salmonella typhimurium LT2
aauauuaccuuc

SEQ ID NO: 3783103 - RNA, 20 nt, Salmonella typhimurium LT2
aauauuagcgguacucuuuu

SEQ ID NO: 3783104 - RNA, 17 nt, Salmonella typhimurium LT2
aauauucacacgaauuc

SEQ ID NO: 3783105 - RNA, 19 nt, Salmonella typhimurium LT2
aauauucagaauaugccag

SEQ ID NO: 3783106 - RNA, 15 nt, Salmonella typhimurium LT2
aauauugagaauaaa

SEQ ID NO: 3783107 - RNA, 14 nt, Salmonella typhimurium LT2
aauauuuaacuuaa

SEQ ID NO: 3783108 - RNA, 12 nt, Salmonella typhimurium LT2
aauauuuuguag

SEQ ID NO: 3783109 - RNA, 23 nt, Salmonella typhimurium LT2
aauauuuuguaggccuaaaaaua

SEQ ID NO: 3783110 - RNA, 21 nt, Salmonella typhimurium LT2
aaucaaaaggcaaugccuuuu

SEQ ID NO: 3783111 - RNA, 15 nt, Salmonella typhimurium LT2
aaucaaauccaacuc

SEQ ID NO: 3783112 - RNA, 22 nt, Salmonella typhimurium LT2
aaucaacacgucgauuuucccu

SEQ ID NO: 3783113 - RNA, 22 nt, Salmonella typhimurium LT2
aaucaacgccacaccgagacag

SEQ ID NO: 3783114 - RNA, 20 nt, Salmonella typhimurium LT2
aaucaacgccgccaggauaa

SEQ ID NO: 3783115 - RNA, 18 nt, Salmonella typhimurium LT2
aaucaacuccauaauuug

SEQ ID NO: 3783116 - RNA, 19 nt, Salmonella typhimurium LT2
aaucaacugcgccacauca

SEQ ID NO: 3783117 - RNA, 23 nt, Salmonella typhimurium LT2
aaucaacuuuuuuaccauugauu

SEQ ID NO: 3783118 - RNA, 17 nt, Salmonella typhimurium LT2
aaucaagcccagcucag

SEQ ID NO: 3783119 - RNA, 23 nt, Salmonella typhimurium LT2
aaucaagcuuugcguaaaaaaac

SEQ ID NO: 3783120 - RNA, 15 nt, Salmonella typhimurium LT2
aaucaauacugccau

SEQ ID NO: 3783121 - RNA, 22 nt, Salmonella typhimurium LT2
aaucaauuuuaauuuaauaaua

SEQ ID NO: 3783122 - RNA, 20 nt, Salmonella typhimurium LT2
aaucacaaugucaucaagau

SEQ ID NO: 3783123 - RNA, 23 nt, Salmonella typhimurium LT2
aaucacacaagucaccguuuuuc

SEQ ID NO: 3783124 - RNA, 16 nt, Salmonella typhimurium LT2
aaucacauacagcacu

SEQ ID NO: 3783125 - RNA, 12 nt, Salmonella typhimurium LT2
aaucacaucgcc

SEQ ID NO: 3783126 - RNA, 20 nt, Salmonella typhimurium LT2
aaucaccacguaacucggca

SEQ ID NO: 3783127 - RNA, 14 nt, Salmonella typhimurium LT2
aaucaccagcccga

SEQ ID NO: 3783128 - RNA, 18 nt, Salmonella typhimurium LT2
aaucacccacgucaguaa

SEQ ID NO: 3783129 - RNA, 20 nt, Salmonella typhimurium LT2
aaucacccacgucaguaaga

SEQ ID NO: 3783130 - RNA, 11 nt, Salmonella typhimurium LT2
aaucaccugau

SEQ ID NO: 3783131 - RNA, 14 nt, Salmonella typhimurium LT2
aaucacgcaucacu

SEQ ID NO: 3783132 - RNA, 15 nt, Salmonella typhimurium LT2
aaucacgccgaugac

SEQ ID NO: 3783133 - RNA, 21 nt, Salmonella typhimurium LT2
aaucacguuuugcagcgccau

SEQ ID NO: 3783134 - RNA, 14 nt, Salmonella typhimurium LT2
aaucagaauaccgc

SEQ ID NO: 3783135 - RNA, 21 nt, Salmonella typhimurium LT2
aaucagacuaucuucgauaaa

SEQ ID NO: 3783136 - RNA, 22 nt, Salmonella typhimurium LT2
aaucagauacggcuccagcaca

SEQ ID NO: 3783137 - RNA, 18 nt, Salmonella typhimurium LT2
aaucagauaguauuuccc

SEQ ID NO: 3783138 - RNA, 23 nt, Salmonella typhimurium LT2
aaucagaugcgcuucagcgacuu

SEQ ID NO: 3783139 - RNA, 17 nt, Salmonella typhimurium LT2
aaucagauugccacagg

SEQ ID NO: 3783140 - RNA, 16 nt, Salmonella typhimurium LT2
aaucagcaacuuuucc

SEQ ID NO: 3783141 - RNA, 11 nt, Salmonella typhimurium LT2
aaucagcaauc

SEQ ID NO: 3783142 - RNA, 18 nt, Salmonella typhimurium LT2
aaucagcaauuuuguuaa

SEQ ID NO: 3783143 - RNA, 13 nt, Salmonella typhimurium LT2
aaucagcgccccc

SEQ ID NO: 3783144 - RNA, 20 nt, Salmonella typhimurium LT2
aaucagcgcggcaaggauaa

SEQ ID NO: 3783145 - RNA, 16 nt, Salmonella typhimurium LT2
aaucagcucagcaaca

SEQ ID NO: 3783146 - RNA, 22 nt, Salmonella typhimurium LT2
aaucagcugcugcgcuuuccag

SEQ ID NO: 3783147 - RNA, 17 nt, Salmonella typhimurium LT2
aaucaggaaagagccgc

SEQ ID NO: 3783148 - RNA, 16 nt, Salmonella typhimurium LT2
aaucaggauauucgcc

SEQ ID NO: 3783149 - RNA, 13 nt, Salmonella typhimurium LT2
aaucagggugcca

SEQ ID NO: 3783150 - RNA, 17 nt, Salmonella typhimurium LT2
aaucaggugaauaccaa

SEQ ID NO: 3783151 - RNA, 18 nt, Salmonella typhimurium LT2
aaucaguggcggcaaaaa

SEQ ID NO: 3783152 - RNA, 22 nt, Salmonella typhimurium LT2
aaucaguggcggcaaaaaauau

SEQ ID NO: 3783153 - RNA, 11 nt, Salmonella typhimurium LT2
aaucaguucac

SEQ ID NO: 3783154 - RNA, 13 nt, Salmonella typhimurium LT2
aaucaguucagga

SEQ ID NO: 3783155 - RNA, 16 nt, Salmonella typhimurium LT2
aaucaguucaggaaca

SEQ ID NO: 3783156 - RNA, 23 nt, Salmonella typhimurium LT2
aaucaguucaggaacaucagcau

SEQ ID NO: 3783157 - RNA, 21 nt, Salmonella typhimurium LT2
aaucaguucucgguauccagc

SEQ ID NO: 3783158 - RNA, 14 nt, Salmonella typhimurium LT2
aaucaguuguacuu

SEQ ID NO: 3783159 - RNA, 13 nt, Salmonella typhimurium LT2
aaucauaaagcgc

SEQ ID NO: 3783160 - RNA, 22 nt, Salmonella typhimurium LT2
aaucauacauagcaggccauaa

SEQ ID NO: 3783161 - RNA, 17 nt, Salmonella typhimurium LT2
aaucauauaaaacagcc

SEQ ID NO: 3783162 - RNA, 12 nt, Salmonella typhimurium LT2
aaucaucaccac

SEQ ID NO: 3783163 - RNA, 21 nt, Salmonella typhimurium LT2
aaucaucagaccgauaaauac

SEQ ID NO: 3783164 - RNA, 22 nt, Salmonella typhimurium LT2
aaucaucagaccgauaaauacc

SEQ ID NO: 3783165 - RNA, 14 nt, Salmonella typhimurium LT2
aaucaucauauccc

SEQ ID NO: 3783166 - RNA, 12 nt, Salmonella typhimurium LT2
aaucaucaucgu

SEQ ID NO: 3783167 - RNA, 13 nt, Salmonella typhimurium LT2
aaucaucaugucg

SEQ ID NO: 3783168 - RNA, 23 nt, Salmonella typhimurium LT2
aaucaucgacaguaccagcagaa

SEQ ID NO: 3783169 - RNA, 14 nt, Salmonella typhimurium LT2
aaucaugagcgcaa

SEQ ID NO: 3783170 - RNA, 22 nt, Salmonella typhimurium LT2
aaucaugcucauaauggaccag

SEQ ID NO: 3783171 - RNA, 13 nt, Salmonella typhimurium LT2
aaucaugucaaau

SEQ ID NO: 3783172 - RNA, 15 nt, Salmonella typhimurium LT2
aaucauugcguucag

SEQ ID NO: 3783173 - RNA, 19 nt, Salmonella typhimurium LT2
aaucauuuguacaaaaaau

SEQ ID NO: 3783174 - RNA, 20 nt, Salmonella typhimurium LT2
aaucauuuguacaaaaaaug

SEQ ID NO: 3783175 - RNA, 13 nt, Salmonella typhimurium LT2
aauccaauguuua

SEQ ID NO: 3783176 - RNA, 16 nt, Salmonella typhimurium LT2
aauccacauuccagac

SEQ ID NO: 3783177 - RNA, 18 nt, Salmonella typhimurium LT2
aauccaccauaguuucga

SEQ ID NO: 3783178 - RNA, 17 nt, Salmonella typhimurium LT2
aauccacucggcgcugu

SEQ ID NO: 3783179 - RNA, 12 nt, Salmonella typhimurium LT2
aauccacugucc

SEQ ID NO: 3783180 - RNA, 15 nt, Salmonella typhimurium LT2
aauccagcagaauaa

SEQ ID NO: 3783181 - RNA, 12 nt, Salmonella typhimurium LT2
aauccagcgccg

SEQ ID NO: 3783182 - RNA, 14 nt, Salmonella typhimurium LT2
aauccaggaauuuu

SEQ ID NO: 3783183 - RNA, 16 nt, Salmonella typhimurium LT2
aauccaggaauuuucc

SEQ ID NO: 3783184 - RNA, 17 nt, Salmonella typhimurium LT2
aauccaggaauuuuccc

SEQ ID NO: 3783185 - RNA, 12 nt, Salmonella typhimurium LT2
aauccaggugga

SEQ ID NO: 3783186 - RNA, 13 nt, Salmonella typhimurium LT2
aauccagguggau

SEQ ID NO: 3783187 - RNA, 17 nt, Salmonella typhimurium LT2
aauccaugagaagaaaa

SEQ ID NO: 3783188 - RNA, 17 nt, Salmonella typhimurium LT2
aaucccaccaauugcca

SEQ ID NO: 3783189 - RNA, 19 nt, Salmonella typhimurium LT2
aauccccccuuuuuugcug

SEQ ID NO: 3783190 - RNA, 17 nt, Salmonella typhimurium LT2
aauccccuacggugugc

SEQ ID NO: 3783191 - RNA, 21 nt, Salmonella typhimurium LT2
aaucccgcaucacccgcauau

SEQ ID NO: 3783192 - RNA, 12 nt, Salmonella typhimurium LT2
aaucccguaccg

SEQ ID NO: 3783193 - RNA, 20 nt, Salmonella typhimurium LT2
aaucccguaccggaaauaaa

SEQ ID NO: 3783194 - RNA, 13 nt, Salmonella typhimurium LT2
aaucccuucuuuu

SEQ ID NO: 3783195 - RNA, 14 nt, Salmonella typhimurium LT2
aaucccuucuuuua

SEQ ID NO: 3783196 - RNA, 20 nt, Salmonella typhimurium LT2
aaucccuucuuuuacugccc

SEQ ID NO: 3783197 - RNA, 22 nt, Salmonella typhimurium LT2
aaucccuuucgacgucaccauc

SEQ ID NO: 3783198 - RNA, 17 nt, Salmonella typhimurium LT2
aauccgacgcuucaaau

SEQ ID NO: 3783199 - RNA, 21 nt, Salmonella typhimurium LT2
aauccgccagugaauccacca

SEQ ID NO: 3783200 - RNA, 12 nt, Salmonella typhimurium LT2
aauccgcggcaa

SEQ ID NO: 3783201 - RNA, 21 nt, Salmonella typhimurium LT2
aauccggcaacugccggggaa

SEQ ID NO: 3783202 - RNA, 18 nt, Salmonella typhimurium LT2
aauccggccugucaggau

SEQ ID NO: 3783203 - RNA, 18 nt, Salmonella typhimurium LT2
aauccgugcgcagaauau

SEQ ID NO: 3783204 - RNA, 15 nt, Salmonella typhimurium LT2
aauccgugguuuuac

SEQ ID NO: 3783205 - RNA, 15 nt, Salmonella typhimurium LT2
aauccucacugccga

SEQ ID NO: 3783206 - RNA, 16 nt, Salmonella typhimurium LT2
aauccuccagcggcau

SEQ ID NO: 3783207 - RNA, 19 nt, Salmonella typhimurium LT2
aauccucuaccggaaaaca

SEQ ID NO: 3783208 - RNA, 14 nt, Salmonella typhimurium LT2
aauccugcacuucc

SEQ ID NO: 3783209 - RNA, 18 nt, Salmonella typhimurium LT2
aauccugcacuuccagcc

SEQ ID NO: 3783210 - RNA, 11 nt, Salmonella typhimurium LT2
aauccugucgu

SEQ ID NO: 3783211 - RNA, 15 nt, Salmonella typhimurium LT2
aauccuuauuuaaua

SEQ ID NO: 3783212 - RNA, 16 nt, Salmonella typhimurium LT2
aauccuuccagcgcca

SEQ ID NO: 3783213 - RNA, 16 nt, Salmonella typhimurium LT2
aauccuucuuccauuc

SEQ ID NO: 3783214 - RNA, 18 nt, Salmonella typhimurium LT2
aauccuuguccauguaaa

SEQ ID NO: 3783215 - RNA, 17 nt, Salmonella typhimurium LT2
aaucgaauacagcgccu

SEQ ID NO: 3783216 - RNA, 21 nt, Salmonella typhimurium LT2
aaucgaaucguucgccaguga

SEQ ID NO: 3783217 - RNA, 14 nt, Salmonella typhimurium LT2
aaucgacaauccgc

SEQ ID NO: 3783218 - RNA, 12 nt, Salmonella typhimurium LT2
aaucgacucacg

SEQ ID NO: 3783219 - RNA, 14 nt, Salmonella typhimurium LT2
aaucgauaagccag

SEQ ID NO: 3783220 - RNA, 15 nt, Salmonella typhimurium LT2
aaucgauggugccga

SEQ ID NO: 3783221 - RNA, 17 nt, Salmonella typhimurium LT2
aaucgcaucauaaaugg

SEQ ID NO: 3783222 - RNA, 18 nt, Salmonella typhimurium LT2
aaucgccaccguaacuaa

SEQ ID NO: 3783223 - RNA, 21 nt, Salmonella typhimurium LT2
aaucgccaucagcgcgaaaau

SEQ ID NO: 3783224 - RNA, 15 nt, Salmonella typhimurium LT2
aaucgccgccgccag

SEQ ID NO: 3783225 - RNA, 17 nt, Salmonella typhimurium LT2
aaucgccgccgccaggu

SEQ ID NO: 3783226 - RNA, 23 nt, Salmonella typhimurium LT2
aaucgccgcgccggacuccagca

SEQ ID NO: 3783227 - RNA, 17 nt, Salmonella typhimurium LT2
aaucgccgugaucccaa

SEQ ID NO: 3783228 - RNA, 14 nt, Salmonella typhimurium LT2
aaucgccucaacca

SEQ ID NO: 3783229 - RNA, 15 nt, Salmonella typhimurium LT2
aaucgccucaaccaa

SEQ ID NO: 3783230 - RNA, 23 nt, Salmonella typhimurium LT2
aaucgccucaacgcucauaccug

SEQ ID NO: 3783231 - RNA, 19 nt, Salmonella typhimurium LT2
aaucgccuggcuugcuggc

SEQ ID NO: 3783232 - RNA, 21 nt, Salmonella typhimurium LT2
aaucgcgagaaaauagaggaa

SEQ ID NO: 3783233 - RNA, 18 nt, Salmonella typhimurium LT2
aaucgcgauccagcccca

SEQ ID NO: 3783234 - RNA, 14 nt, Salmonella typhimurium LT2
aaucgcgcgcgcca

SEQ ID NO: 3783235 - RNA, 15 nt, Salmonella typhimurium LT2
aaugcgacagcggca

SEQ ID NO: 3783236 - RNA, 16 nt, Salmonella typhimurium LT2
aaugcgacagcggcaa

SEQ ID NO: 3783237 - RNA, 13 nt, Salmonella typhimurium LT2
aaugcgagcaaaa

SEQ ID NO: 3783238 - RNA, 21 nt, Salmonella typhimurium LT2
aaugcgcaaaauucacaccaa

SEQ ID NO: 3783239 - RNA, 16 nt, Salmonella typhimurium LT2
aaugcgccagcggcca

SEQ ID NO: 3783240 - RNA, 19 nt, Salmonella typhimurium LT2
aaugcgcuaacgucgccau

SEQ ID NO: 3783241 - RNA, 17 nt, Salmonella typhimurium LT2
aaugcgcuuuuuuugcc

SEQ ID NO: 3783242 - RNA, 15 nt, Salmonella typhimurium LT2
aaugcggcauccggc

SEQ ID NO: 3783243 - RNA, 19 nt, Salmonella typhimurium LT2
aaugcguccagaggaucug

SEQ ID NO: 3783244 - RNA, 16 nt, Salmonella typhimurium LT2
aaugcgucggcaccau

SEQ ID NO: 3783245 - RNA, 16 nt, Salmonella typhimurium LT2
aaugcgucgucggcau

SEQ ID NO: 3783246 - RNA, 16 nt, Salmonella typhimurium LT2
aaugcgugagcagggg

SEQ ID NO: 3783247 - RNA, 20 nt, Salmonella typhimurium LT2
aaugcucauuauuuggauua

SEQ ID NO: 3783248 - RNA, 15 nt, Salmonella typhimurium LT2
aaugcuccaauaaau

SEQ ID NO: 3783249 - RNA, 21 nt, Salmonella typhimurium LT2
aaugcugcaucuuacugaccg

SEQ ID NO: 3783250 - RNA, 20 nt, Salmonella typhimurium LT2
aaugcugcuuugaugcggca

SEQ ID NO: 3783251 - RNA, 23 nt, Salmonella typhimurium LT2
aaugcuguuguagaaugaauuuc

SEQ ID NO: 3783252 - RNA, 10 nt, Salmonella typhimurium LT2
aaugcuuucc

SEQ ID NO: 3783253 - RNA, 17 nt, Salmonella typhimurium LT2
aaugcuuucgccagccg

SEQ ID NO: 3783254 - RNA, 14 nt, Salmonella typhimurium LT2
aauggaacugccug

SEQ ID NO: 3783255 - RNA, 14 nt, Salmonella typhimurium LT2
aauggacaaguaaa

SEQ ID NO: 3783256 - RNA, 16 nt, Salmonella typhimurium LT2
aauggauaacggcguu

SEQ ID NO: 3783257 - RNA, 17 nt, Salmonella typhimurium LT2
aauggauagagucgaua

SEQ ID NO: 3783258 - RNA, 20 nt, Salmonella typhimurium LT2
aauggauagagucgauaaau

SEQ ID NO: 3783259 - RNA, 23 nt, Salmonella typhimurium LT2
aauggauucaugguacucaacau

SEQ ID NO: 3783260 - RNA, 17 nt, Salmonella typhimurium LT2
aauggcagggacaacgc

SEQ ID NO: 3783261 - RNA, 17 nt, Salmonella typhimurium LT2
aauggccaccagcacaa

SEQ ID NO: 3783262 - RNA, 19 nt, Salmonella typhimurium LT2
aauggccccuggcugaaag

SEQ ID NO: 3783263 - RNA, 22 nt, Salmonella typhimurium LT2
aauggccgcagcgccauaaaaa

SEQ ID NO: 3783264 - RNA, 11 nt, Salmonella typhimurium LT2
aauggccuaca

SEQ ID NO: 3783265 - RNA, 12 nt, Salmonella typhimurium LT2
aauggcgaaaaa

SEQ ID NO: 3783266 - RNA, 20 nt, Salmonella typhimurium LT2
aauggcgacgaucagcgcca

SEQ ID NO: 3783267 - RNA, 23 nt, Salmonella typhimurium LT2
aauggcgauaauagaaccgaaca

SEQ ID NO: 3783268 - RNA, 15 nt, Salmonella typhimurium LT2
aauggcgccagguuu

SEQ ID NO: 3783269 - RNA, 14 nt, Salmonella typhimurium LT2
aauggcgcgaaaac

SEQ ID NO: 3783270 - RNA, 19 nt, Salmonella typhimurium LT2
aauggcgcgaaaacagcug

SEQ ID NO: 3783271 - RNA, 19 nt, Salmonella typhimurium LT2
aauggcggagaucuccaga

SEQ ID NO: 3783272 - RNA, 23 nt, Salmonella typhimurium LT2
aauggcggcuucgccauccggua

SEQ ID NO: 3783273 - RNA, 14 nt, Salmonella typhimurium LT2
aauggguaaaaaua

SEQ ID NO: 3783274 - RNA, 18 nt, Salmonella typhimurium LT2
aauggucccugauauaca

SEQ ID NO: 3783275 - RNA, 13 nt, Salmonella typhimurium LT2
aauggucgcgcca

SEQ ID NO: 3783276 - RNA, 15 nt, Salmonella typhimurium LT2
aauguauuauuauuu

SEQ ID NO: 3783277 - RNA, 23 nt, Salmonella typhimurium LT2
aauguauucucccgucagcaaca

SEQ ID NO: 3783278 - RNA, 13 nt, Salmonella typhimurium LT2
aauguauuucaga

SEQ ID NO: 3783279 - RNA, 15 nt, Salmonella typhimurium LT2
aaugucaugaagcuc

SEQ ID NO: 3783280 - RNA, 17 nt, Salmonella typhimurium LT2
aaugucaugaagcucaa

SEQ ID NO: 3783281 - RNA, 13 nt, Salmonella typhimurium LT2
aaugucgaaacaa

SEQ ID NO: 3783282 - RNA, 16 nt, Salmonella typhimurium LT2
aaugucgcaaucggcu

SEQ ID NO: 3783283 - RNA, 21 nt, Salmonella typhimurium LT2
aaugucguuacggcugaagcu

SEQ ID NO: 3783284 - RNA, 16 nt, Salmonella typhimurium LT2
aaugugauccgccccc

SEQ ID NO: 3783285 - RNA, 23 nt, Salmonella typhimurium LT2
aaugugcaaucacacuacacgaa

SEQ ID NO: 3783286 - RNA, 17 nt, Salmonella typhimurium LT2
aauguuaauaagcagaa

SEQ ID NO: 3783287 - RNA, 22 nt, Salmonella typhimurium LT2
aauguuagcauuauuuuuaacc

SEQ ID NO: 3783288 - RNA, 13 nt, Salmonella typhimurium LT2
aauguugauaagg

SEQ ID NO: 3783289 - RNA, 14 nt, Salmonella typhimurium LT2
aauguuguuccaga

SEQ ID NO: 3783290 - RNA, 15 nt, Salmonella typhimurium LT2
aauguuguuccagag

SEQ ID NO: 3783291 - RNA, 12 nt, Salmonella typhimurium LT2
aauguuugcuuu

SEQ ID NO: 3783292 - RNA, 18 nt, Salmonella typhimurium LT2
aauuaaaaagagaaaaaa

SEQ ID NO: 3783293 - RNA, 14 nt, Salmonella typhimurium LT2
aauuaaaggcagcg

SEQ ID NO: 3783294 - RNA, 18 nt, Salmonella typhimurium LT2
aauuaaauaacaaaugaa

SEQ ID NO: 3783295 - RNA, 14 nt, Salmonella typhimurium LT2
aauuaaauuauuua

SEQ ID NO: 3783296 - RNA, 14 nt, Salmonella typhimurium LT2
aauuaacaaauaaa

SEQ ID NO: 3783297 - RNA, 15 nt, Salmonella typhimurium LT2
aauuaacucaucaca

SEQ ID NO: 3783298 - RNA, 23 nt, Salmonella typhimurium LT2
aauuaagcgacccgauaaacacc

SEQ ID NO: 3783299 - RNA, 14 nt, Salmonella typhimurium LT2
aauuaaucacaaug

SEQ ID NO: 3783300 - RNA, 17 nt, Salmonella typhimurium LT2
aauuaaucccaacccga

SEQ ID NO: 3783301 - RNA, 18 nt, Salmonella typhimurium LT2
aauuaaucgccagcagcg

SEQ ID NO: 3783302 - RNA, 13 nt, Salmonella typhimurium LT2
aauuacagcucau

SEQ ID NO: 3783303 - RNA, 16 nt, Salmonella typhimurium LT2
aauuacagcucauaaa

SEQ ID NO: 3783304 - RNA, 22 nt, Salmonella typhimurium LT2
aauuacaucaaaugaacacaaa

SEQ ID NO: 3783305 - RNA, 18 nt, Salmonella typhimurium LT2
aauuaccacgcagccgag

SEQ ID NO: 3783306 - RNA, 23 nt, Salmonella typhimurium LT2
aauuaccgguuucgguauuaagc

SEQ ID NO: 3783307 - RNA, 18 nt, Salmonella typhimurium LT2
aauuaccuuuacaugaaa

SEQ ID NO: 3783308 - RNA, 17 nt, Salmonella typhimurium LT2
aauuacgcacacuugcu

SEQ ID NO: 3783309 - RNA, 22 nt, Salmonella typhimurium LT2
aauuacggacgauacaccuuca

SEQ ID NO: 3783310 - RNA, 22 nt, Salmonella typhimurium LT2
aauuacguuggggauaaccaga

SEQ ID NO: 3783311 - RNA, 16 nt, Salmonella typhimurium LT2
aauuacuuaugauaua

SEQ ID NO: 3783312 - RNA, 14 nt, Salmonella typhimurium LT2
aauuagagccaaua

SEQ ID NO: 3783313 - RNA, 14 nt, Salmonella typhimurium LT2
aauuagcgcgaaau

SEQ ID NO: 3783314 - RNA, 18 nt, Salmonella typhimurium LT2
aauuauaaacuacuggcu

SEQ ID NO: 3783315 - RNA, 21 nt, Salmonella typhimurium LT2
aauuauauucguccuuuauca

SEQ ID NO: 3783316 - RNA, 22 nt, Salmonella typhimurium LT2
aauuaucuguugauaaaacacu

SEQ ID NO: 3783317 - RNA, 23 nt, Salmonella typhimurium LT2
aauuaucuguugauaaaacacuc

SEQ ID NO: 3783318 - RNA, 16 nt, Salmonella typhimurium LT2
aauuaugaccaauguu

SEQ ID NO: 3783319 - RNA, 21 nt, Salmonella typhimurium LT2
aauuauuccauuuuaaccuua

SEQ ID NO: 3783320 - RNA, 21 nt, Salmonella typhimurium LT2
aauuauugcguugcuuuauaa

SEQ ID NO: 3783321 - RNA, 22 nt, Salmonella typhimurium LT2
aauuauuggcuuuguaaauacu

SEQ ID NO: 3783322 - RNA, 22 nt, Salmonella typhimurium LT2
aauuauugugagaaaagcagag

SEQ ID NO: 3783323 - RNA, 12 nt, Salmonella typhimurium LT2
aauuauuuaagc

SEQ ID NO: 3783324 - RNA, 19 nt, Salmonella typhimurium LT2
aauucaacguauuaacaua

SEQ ID NO: 3783325 - RNA, 19 nt, Salmonella typhimurium LT2
aauucaccaaauccucacu

SEQ ID NO: 3783326 - RNA, 12 nt, Salmonella typhimurium LT2
aauucagacuca

SEQ ID NO: 3783327 - RNA, 20 nt, Salmonella typhimurium LT2
aauucauagagcgcguccag

SEQ ID NO: 3783328 - RNA, 17 nt, Salmonella typhimurium LT2
aauucaugugaaaguga

SEQ ID NO: 3783329 - RNA, 14 nt, Salmonella typhimurium LT2
aauucauugagcau

SEQ ID NO: 3783330 - RNA, 14 nt, Salmonella typhimurium LT2
aauuccaggaugac

SEQ ID NO: 3783331 - RNA, 22 nt, Salmonella typhimurium LT2
aauuccaggcccggugucagac

SEQ ID NO: 3783332 - RNA, 14 nt, Salmonella typhimurium LT2
aauuccgcaucagg

SEQ ID NO: 3783333 - RNA, 16 nt, Salmonella typhimurium LT2
aauuccgcaucauuca

SEQ ID NO: 3783334 - RNA, 19 nt, Salmonella typhimurium LT2
aauuccggcacaaccuggc

SEQ ID NO: 3783335 - RNA, 19 nt, Salmonella typhimurium LT2
aauuccggcgaaaaaccag

SEQ ID NO: 3783336 - RNA, 16 nt, Salmonella typhimurium LT2
aauuccugacugcgcg

SEQ ID NO: 3783337 - RNA, 16 nt, Salmonella typhimurium LT2
aauuccugccagagac

SEQ ID NO: 3783338 - RNA, 15 nt, Salmonella typhimurium LT2
aauucgcagagcgca

SEQ ID NO: 3783339 - RNA, 18 nt, Salmonella typhimurium LT2
acaacaagaauauauucu

SEQ ID NO: 3783340 - RNA, 15 nt, Salmonella typhimurium LT2
acaacauaaaggggu

SEQ ID NO: 3783341 - RNA, 22 nt, Salmonella typhimurium LT2
acaacauuucgcacccugucaa

SEQ ID NO: 3783342 - RNA, 22 nt, Salmonella typhimurium LT2
acaaccagcagggcaauagcga

SEQ ID NO: 3783343 - RNA, 17 nt, Salmonella typhimurium LT2
acaaccgcccccaacug

SEQ ID NO: 3783344 - RNA, 18 nt, Salmonella typhimurium LT2
acaaccgcccccaacuga

SEQ ID NO: 3783345 - RNA, 19 nt, Salmonella typhimurium LT2
acaaccguuggggaaaaua

SEQ ID NO: 3783346 - RNA, 15 nt, Salmonella typhimurium LT2
acaaccuccacgccc

SEQ ID NO: 3783347 - RNA, 19 nt, Salmonella typhimurium LT2
acaaccuccacgcccagcg

SEQ ID NO: 3783348 - RNA, 20 nt, Salmonella typhimurium LT2
acaaccugcccuuucuucaa

SEQ ID NO: 3783349 - RNA, 22 nt, Salmonella typhimurium LT2
acaacgacuacguucaucaggc

SEQ ID NO: 3783350 - RNA, 13 nt, Salmonella typhimurium LT2
acaacgcauugcc

SEQ ID NO: 3783351 - RNA, 12 nt, Salmonella typhimurium LT2
acaacgccggac

SEQ ID NO: 3783352 - RNA, 21 nt, Salmonella typhimurium LT2
acaacgccgguacgcagcagg

SEQ ID NO: 3783353 - RNA, 19 nt, Salmonella typhimurium LT2
acaacgucaguggaaaaca

SEQ ID NO: 3783354 - RNA, 15 nt, Salmonella typhimurium LT2
acaacuagcaaaaca

SEQ ID NO: 3783355 - RNA, 16 nt, Salmonella typhimurium LT2
acaacuguuuuucacu

SEQ ID NO: 3783356 - RNA, 19 nt, Salmonella typhimurium LT2
acaacuucuaauuuuucca

SEQ ID NO: 3783357 - RNA, 21 nt, Salmonella typhimurium LT2
acaacuucuaauuuuuccagc

SEQ ID NO: 3783358 - RNA, 16 nt, Salmonella typhimurium LT2
acaagaauuuaucgca

SEQ ID NO: 3783359 - RNA, 17 nt, Salmonella typhimurium LT2
acaagaauuuaucgcaa

SEQ ID NO: 3783360 - RNA, 12 nt, Salmonella typhimurium LT2
acaagaucgcaa

SEQ ID NO: 3783361 - RNA, 15 nt, Salmonella typhimurium LT2
acaagauuaauuuaa

SEQ ID NO: 3783362 - RNA, 19 nt, Salmonella typhimurium LT2
acaagauucacucugaaaa

SEQ ID NO: 3783363 - RNA, 21 nt, Salmonella typhimurium LT2
acaagcaaaccuauuucagua

SEQ ID NO: 3783364 - RNA, 22 nt, Salmonella typhimurium LT2
acaagccccccgcacagcacau

SEQ ID NO: 3783365 - RNA, 22 nt, Salmonella typhimurium LT2
acaagcuaauccccagcgcucc

SEQ ID NO: 3783366 - RNA, 13 nt, Salmonella typhimurium LT2
acaagcucauuuc

SEQ ID NO: 3783367 - RNA, 20 nt, Salmonella typhimurium LT2
acaaggcgcuauccugguag

SEQ ID NO: 3783368 - RNA, 16 nt, Salmonella typhimurium LT2
acaaggcuuuuggcuu

SEQ ID NO: 3783369 - RNA, 17 nt, Salmonella typhimurium LT2
acaaggcuuuuggcuua

SEQ ID NO: 3783370 - RNA, 20 nt, Salmonella typhimurium LT2
acaaguaggccggauaaggu

SEQ ID NO: 3783371 - RNA, 15 nt, Salmonella typhimurium LT2
acaaguucagcaggc

SEQ ID NO: 3783372 - RNA, 16 nt, Salmonella typhimurium LT2
acaaguuuauccggca

SEQ ID NO: 3783373 - RNA, 13 nt, Salmonella typhimurium LT2
acaauaaaaaugc

SEQ ID NO: 3783374 - RNA, 12 nt, Salmonella typhimurium LT2
acaauaaaguua

SEQ ID NO: 3783375 - RNA, 13 nt, Salmonella typhimurium LT2
acaauaccaauaa

SEQ ID NO: 3783376 - RNA, 17 nt, Salmonella typhimurium LT2
acaauaccaauaagaac

SEQ ID NO: 3783377 - RNA, 19 nt, Salmonella typhimurium LT2
acaauaccguuuggaucug

SEQ ID NO: 3783378 - RNA, 14 nt, Salmonella typhimurium LT2
acaauacgccgagc

SEQ ID NO: 3783379 - RNA, 14 nt, Salmonella typhimurium LT2
acaauaucaucguc

SEQ ID NO: 3783380 - RNA, 23 nt, Salmonella typhimurium LT2
acaauaucucccgguugauaauc

SEQ ID NO: 3783381 - RNA, 20 nt, Salmonella typhimurium LT2
acaauaugguuauccagcag

SEQ ID NO: 3783382 - RNA, 16 nt, Salmonella typhimurium LT2
acaaucacagcgcaga

SEQ ID NO: 3783383 - RNA, 15 nt, Salmonella typhimurium LT2
acaaucagcacacua

SEQ ID NO: 3783384 - RNA, 16 nt, Salmonella typhimurium LT2
acaaucccggcaacug

SEQ ID NO: 3783385 - RNA, 16 nt, Salmonella typhimurium LT2
acaauccgccacgcuc

SEQ ID NO: 3783386 - RNA, 14 nt, Salmonella typhimurium LT2
acaauccgcggcaa

SEQ ID NO: 3783387 - RNA, 20 nt, Salmonella typhimurium LT2
acaauccguuccaaucucuu

SEQ ID NO: 3783388 - RNA, 21 nt, Salmonella typhimurium LT2
acaaucgccgugaucccaaug

SEQ ID NO: 3783389 - RNA, 17 nt, Salmonella typhimurium LT2
acaaucgcguuuuccag

SEQ ID NO: 3783390 - RNA, 18 nt, Salmonella typhimurium LT2
acaaucgucacuucaauu

SEQ ID NO: 3783391 - RNA, 17 nt, Salmonella typhimurium LT2
acaaucguuaauucaug

SEQ ID NO: 3783392 - RNA, 16 nt, Salmonella typhimurium LT2
acaaucugaauaucaa

SEQ ID NO: 3783393 - RNA, 21 nt, Salmonella typhimurium LT2
acaaucugugugggcacucga

SEQ ID NO: 3783394 - RNA, 13 nt, Salmonella typhimurium LT2
acaaugaagcaua

SEQ ID NO: 3783395 - RNA, 21 nt, Salmonella typhimurium LT2
acaaugaagcauaaaaagacu

SEQ ID NO: 3783396 - RNA, 13 nt, Salmonella typhimurium LT2
acaaugaauauua

SEQ ID NO: 3783397 - RNA, 15 nt, Salmonella typhimurium LT2
acaaugaauccucgg

SEQ ID NO: 3783398 - RNA, 16 nt, Salmonella typhimurium LT2
acaaugcaaagaaaaa

SEQ ID NO: 3783399 - RNA, 17 nt, Salmonella typhimurium LT2
acaaugccuucugcgcc

SEQ ID NO: 3783400 - RNA, 17 nt, Salmonella typhimurium LT2
acaauggucagcgccgc

SEQ ID NO: 3783401 - RNA, 16 nt, Salmonella typhimurium LT2
acaaugucaucaagau

SEQ ID NO: 3783402 - RNA, 16 nt, Salmonella typhimurium LT2
acaauguugauggcgc

SEQ ID NO: 3783403 - RNA, 15 nt, Salmonella typhimurium LT2
acaauuacgcaagag

SEQ ID NO: 3783404 - RNA, 11 nt, Salmonella typhimurium LT2
acaauuauaua

SEQ ID NO: 3783405 - RNA, 17 nt, Salmonella typhimurium LT2
acaauuccggcccaggc

SEQ ID NO: 3783406 - RNA, 15 nt, Salmonella typhimurium LT2
acaauugccagcagg

SEQ ID NO: 3783407 - RNA, 18 nt, Salmonella typhimurium LT2
acaauugcugcguaaccg

SEQ ID NO: 3783408 - RNA, 16 nt, Salmonella typhimurium LT2
acaauuugaauuaccc

SEQ ID NO: 3783409 - RNA, 18 nt, Salmonella typhimurium LT2
acaauuuugauaagagaa

SEQ ID NO: 3783410 - RNA, 21 nt, Salmonella typhimurium LT2
acaauuuugauaagagaaaau

SEQ ID NO: 3783411 - RNA, 22 nt, Salmonella typhimurium LT2
acacaaaaaacgguauaaaaaa

SEQ ID NO: 3783412 - RNA, 21 nt, Salmonella typhimurium LT2
acacaaacuccguuauauuuc

SEQ ID NO: 3783413 - RNA, 17 nt, Salmonella typhimurium LT2
acacaacacggcggcua

SEQ ID NO: 3783414 - RNA, 21 nt, Salmonella typhimurium LT2
acacaagucaccguuuuucau

SEQ ID NO: 3783415 - RNA, 15 nt, Salmonella typhimurium LT2
acacaauaucaauau

SEQ ID NO: 3783416 - RNA, 18 nt, Salmonella typhimurium LT2
acacaaucaucgacagua

SEQ ID NO: 3783417 - RNA, 15 nt, Salmonella typhimurium LT2
acacaauugccaugg

SEQ ID NO: 3783418 - RNA, 22 nt, Salmonella typhimurium LT2
acacacaguugccuucgauuaa

SEQ ID NO: 3783419 - RNA, 14 nt, Salmonella typhimurium LT2
acacaccagcagga

SEQ ID NO: 3783420 - RNA, 16 nt, Salmonella typhimurium LT2
acacacuuucugcuuu

SEQ ID NO: 3783421 - RNA, 12 nt, Salmonella typhimurium LT2
acacagaauuac

SEQ ID NO: 3783422 - RNA, 22 nt, Salmonella typhimurium LT2
acacagacuuugcacagucugc

SEQ ID NO: 3783423 - RNA, 17 nt, Salmonella typhimurium LT2
acacagaggaauauuau

SEQ ID NO: 3783424 - RNA, 19 nt, Salmonella typhimurium LT2
acacaggcgugguggauau

SEQ ID NO: 3783425 - RNA, 22 nt, Salmonella typhimurium LT2
acacaggcgugguggauaucca

SEQ ID NO: 3783426 - RNA, 16 nt, Salmonella typhimurium LT2
acacauaaccugaaua

SEQ ID NO: 3783427 - RNA, 17 nt, Salmonella typhimurium LT2
acacauaacgcccgaca

SEQ ID NO: 3783428 - RNA, 14 nt, Salmonella typhimurium LT2
acacauagauaaaa

SEQ ID NO: 3783429 - RNA, 14 nt, Salmonella typhimurium LT2
acacaucaccucca

SEQ ID NO: 3783430 - RNA, 15 nt, Salmonella typhimurium LT2
acacaucaccuccag

SEQ ID NO: 3783431 - RNA, 21 nt, Salmonella typhimurium LT2
acacauucaggcuggcaaagc

SEQ ID NO: 3783432 - RNA, 15 nt, Salmonella typhimurium LT2
acacauuucagcgca

SEQ ID NO: 3783433 - RNA, 13 nt, Salmonella typhimurium LT2
acacauuuccaac

SEQ ID NO: 3783434 - RNA, 16 nt, Salmonella typhimurium LT2
acacauuucuuuugau

SEQ ID NO: 3783435 - RNA, 15 nt, Salmonella typhimurium LT2
acacauuuuaaacca

SEQ ID NO: 3783436 - RNA, 18 nt, Salmonella typhimurium LT2
acaccaacggcgacgccc

SEQ ID NO: 3783437 - RNA, 17 nt, Salmonella typhimurium LT2
acaccaagacgacgggu

SEQ ID NO: 3783438 - RNA, 19 nt, Salmonella typhimurium LT2
acaccacgaaggaaacgcc

SEQ ID NO: 3783439 - RNA, 12 nt, Salmonella typhimurium LT2
acaccacgcagg

SEQ ID NO: 3783440 - RNA, 15 nt, Salmonella typhimurium LT2
acaccacgcaggcga

SEQ ID NO: 3783441 - RNA, 13 nt, Salmonella typhimurium LT2
acaccagaaugcu

SEQ ID NO: 3783442 - RNA, 13 nt, Salmonella typhimurium LT2
acaccagcacuga

SEQ ID NO: 3783443 - RNA, 15 nt, Salmonella typhimurium LT2
acagcgcaauaugca

SEQ ID NO: 3783444 - RNA, 14 nt, Salmonella typhimurium LT2
acagcgccaucagc

SEQ ID NO: 3783445 - RNA, 19 nt, Salmonella typhimurium LT2
acagcgccauccggcaguu

SEQ ID NO: 3783446 - RNA, 19 nt, Salmonella typhimurium LT2
acagcgcgaccaggaaacc

SEQ ID NO: 3783447 - RNA, 13 nt, Salmonella typhimurium LT2
acagcgcgcguca

SEQ ID NO: 3783448 - RNA, 17 nt, Salmonella typhimurium LT2
acagcgcggcaggccgg

SEQ ID NO: 3783449 - RNA, 12 nt, Salmonella typhimurium LT2
acagcggagaga

SEQ ID NO: 3783450 - RNA, 15 nt, Salmonella typhimurium LT2
acagcggcgcgccaa

SEQ ID NO: 3783451 - RNA, 20 nt, Salmonella typhimurium LT2
acagcggcucgaacuguucu

SEQ ID NO: 3783452 - RNA, 23 nt, Salmonella typhimurium LT2
acagcgggguaaagccuuuaugc

SEQ ID NO: 3783453 - RNA, 14 nt, Salmonella typhimurium LT2
acagcguaaauaag

SEQ ID NO: 3783454 - RNA, 15 nt, Salmonella typhimurium LT2
acagcguacaauggc

SEQ ID NO: 3783455 - RNA, 20 nt, Salmonella typhimurium LT2
acagcguacaauggcaggca

SEQ ID NO: 3783456 - RNA, 21 nt, Salmonella typhimurium LT2
acagcguaucggcuaucaccu

SEQ ID NO: 3783457 - RNA, 15 nt, Salmonella typhimurium LT2
acagcguauuaagcc

SEQ ID NO: 3783458 - RNA, 22 nt, Salmonella typhimurium LT2
acagcgugggaagcagcagacu

SEQ ID NO: 3783459 - RNA, 19 nt, Salmonella typhimurium LT2
acagcgugggcaaaucauc

SEQ ID NO: 3783460 - RNA, 19 nt, Salmonella typhimurium LT2
acagcuucgguccggcgcu

SEQ ID NO: 3783461 - RNA, 16 nt, Salmonella typhimurium LT2
acagcuugaucaucag

SEQ ID NO: 3783462 - RNA, 20 nt, Salmonella typhimurium LT2
acagcuugcgcccaugcuca

SEQ ID NO: 3783463 - RNA, 14 nt, Salmonella typhimurium LT2
acagcuuuuacaac

SEQ ID NO: 3783464 - RNA, 17 nt, Salmonella typhimurium LT2
acaggaagcagcuugcu

SEQ ID NO: 3783465 - RNA, 18 nt, Salmonella typhimurium LT2
acaggaagcggcuggguu

SEQ ID NO: 3783466 - RNA, 23 nt, Salmonella typhimurium LT2
acaggauguaagacagcgcgccc

SEQ ID NO: 3783467 - RNA, 15 nt, Salmonella typhimurium LT2
acaggcaacggcgcc

SEQ ID NO: 3783468 - RNA, 21 nt, Salmonella typhimurium LT2
acaggcaacguccuggugugu

SEQ ID NO: 3783469 - RNA, 15 nt, Salmonella typhimurium LT2
acaggcacaacaaua

SEQ ID NO: 3783470 - RNA, 23 nt, Salmonella typhimurium LT2
acaggcagcgucagcccaagcug

SEQ ID NO: 3783471 - RNA, 19 nt, Salmonella typhimurium LT2
acaggccaaacccugcgcc

SEQ ID NO: 3783472 - RNA, 19 nt, Salmonella typhimurium LT2
acaggccgauauauugucg

SEQ ID NO: 3783473 - RNA, 20 nt, Salmonella typhimurium LT2
acaggccgccauaagaaugu

SEQ ID NO: 3783474 - RNA, 15 nt, Salmonella typhimurium LT2
acaggccggacaggc

SEQ ID NO: 3783475 - RNA, 16 nt, Salmonella typhimurium LT2
acaggccuggccuuca

SEQ ID NO: 3783476 - RNA, 21 nt, Salmonella typhimurium LT2
acaggcgauucggacuaauac

SEQ ID NO: 3783477 - RNA, 23 nt, Salmonella typhimurium LT2
acaggcgcaggcauuaaaaaaac

SEQ ID NO: 3783478 - RNA, 12 nt, Salmonella typhimurium LT2
acaggcggauga

SEQ ID NO: 3783479 - RNA, 12 nt, Salmonella typhimurium LT2
acaggcggcaug

SEQ ID NO: 3783480 - RNA, 17 nt, Salmonella typhimurium LT2
acaggcuauaacgcacc

SEQ ID NO: 3783481 - RNA, 13 nt, Salmonella typhimurium LT2
acaggcugacaaa

SEQ ID NO: 3783482 - RNA, 23 nt, Salmonella typhimurium LT2
acaggcuucgguugccugcguca

SEQ ID NO: 3783483 - RNA, 11 nt, Salmonella typhimurium LT2
acagggcggca

SEQ ID NO: 3783484 - RNA, 15 nt, Salmonella typhimurium LT2
acagggcggccuccu

SEQ ID NO: 3783485 - RNA, 22 nt, Salmonella typhimurium LT2
acagggcggcgcgcugccgccc

SEQ ID NO: 3783486 - RNA, 21 nt, Salmonella typhimurium LT2
acaggggccuuuuuuucuccu

SEQ ID NO: 3783487 - RNA, 16 nt, Salmonella typhimurium LT2
acagggggaagcacau

SEQ ID NO: 3783488 - RNA, 23 nt, Salmonella typhimurium LT2
acaggguuugccagcaccagcag

SEQ ID NO: 3783489 - RNA, 14 nt, Salmonella typhimurium LT2
acagguacaggccg

SEQ ID NO: 3783490 - RNA, 18 nt, Salmonella typhimurium LT2
acaggucgacgugaacug

SEQ ID NO: 3783491 - RNA, 17 nt, Salmonella typhimurium LT2
acagguuaaccaugccc

SEQ ID NO: 3783492 - RNA, 18 nt, Salmonella typhimurium LT2
acagguugcguaacgcca

SEQ ID NO: 3783493 - RNA, 14 nt, Salmonella typhimurium LT2
acaguaaaacccaa

SEQ ID NO: 3783494 - RNA, 14 nt, Salmonella typhimurium LT2
acaguaccagcaga

SEQ ID NO: 3783495 - RNA, 12 nt, Salmonella typhimurium LT2
acaguacgcccg

SEQ ID NO: 3783496 - RNA, 21 nt, Salmonella typhimurium LT2
acaguauuuguucagacacau

SEQ ID NO: 3783497 - RNA, 22 nt, Salmonella typhimurium LT2
acagucaaacacgaccagcgac

SEQ ID NO: 3783498 - RNA, 16 nt, Salmonella typhimurium LT2
acagucaucgcgccaa

SEQ ID NO: 3783499 - RNA, 14 nt, Salmonella typhimurium LT2
acagucgcagagcc

SEQ ID NO: 3783500 - RNA, 21 nt, Salmonella typhimurium LT2
acagucgcgccgugcccagca

SEQ ID NO: 3783501 - RNA, 12 nt, Salmonella typhimurium LT2
acagugacagcg

SEQ ID NO: 3783502 - RNA, 14 nt, Salmonella typhimurium LT2
acagugaguacgca

SEQ ID NO: 3783503 - RNA, 17 nt, Salmonella typhimurium LT2
acagugaguacgcagga

SEQ ID NO: 3783504 - RNA, 21 nt, Salmonella typhimurium LT2
acagugauuacaaaaugugca

SEQ ID NO: 3783505 - RNA, 16 nt, Salmonella typhimurium LT2
acaguguaaacgccag

SEQ ID NO: 3783506 - RNA, 19 nt, Salmonella typhimurium LT2
acaguuaccgcacacgcaa

SEQ ID NO: 3783507 - RNA, 23 nt, Salmonella typhimurium LT2
acaguucagacaccacgccggaa

SEQ ID NO: 3783508 - RNA, 14 nt, Salmonella typhimurium LT2
acauaaagauaaau

SEQ ID NO: 3783509 - RNA, 18 nt, Salmonella typhimurium LT2
acauaaagcccagaauag

SEQ ID NO: 3783510 - RNA, 15 nt, Salmonella typhimurium LT2
acauaaauaaacagc

SEQ ID NO: 3783511 - RNA, 14 nt, Salmonella typhimurium LT2
acauaaauccggau

SEQ ID NO: 3783512 - RNA, 17 nt, Salmonella typhimurium LT2
acauaacagcagcagac

SEQ ID NO: 3783513 - RNA, 21 nt, Salmonella typhimurium LT2
acauaacgcgauagauaccau

SEQ ID NO: 3783514 - RNA, 18 nt, Salmonella typhimurium LT2
acauaaggguaagcaaua

SEQ ID NO: 3783515 - RNA, 13 nt, Salmonella typhimurium LT2
acauaauaaagcc

SEQ ID NO: 3783516 - RNA, 15 nt, Salmonella typhimurium LT2
acauaaucaccgcaa

SEQ ID NO: 3783517 - RNA, 17 nt, Salmonella typhimurium LT2
acauacaaagagaaaau

SEQ ID NO: 3783518 - RNA, 19 nt, Salmonella typhimurium LT2
acauaccgucaccacgcgc

SEQ ID NO: 3783519 - RNA, 12 nt, Salmonella typhimurium LT2
acauacgcgcuc

SEQ ID NO: 3783520 - RNA, 19 nt, Salmonella typhimurium LT2
acauacguuuaaagcgcuc

SEQ ID NO: 3783521 - RNA, 21 nt, Salmonella typhimurium LT2
acauacguuuaaagcgcucgu

SEQ ID NO: 3783522 - RNA, 22 nt, Salmonella typhimurium LT2
acauacugcaauuucuuuucca

SEQ ID NO: 3783523 - RNA, 20 nt, Salmonella typhimurium LT2
acauacugcuuuuucggcuc

SEQ ID NO: 3783524 - RNA, 20 nt, Salmonella typhimurium LT2
acauagcuaaauuaaaaaua

SEQ ID NO: 3783525 - RNA, 21 nt, Salmonella typhimurium LT2
acauagcuaaauuaaaaauaa

SEQ ID NO: 3783526 - RNA, 19 nt, Salmonella typhimurium LT2
acauagcuauauuuuuuau

SEQ ID NO: 3783527 - RNA, 15 nt, Salmonella typhimurium LT2
acauagcugaacaau

SEQ ID NO: 3783528 - RNA, 22 nt, Salmonella typhimurium LT2
acauaucgcaguugauacauuu

SEQ ID NO: 3783529 - RNA, 16 nt, Salmonella typhimurium LT2
acauauuccagaagcg

SEQ ID NO: 3783530 - RNA, 17 nt, Salmonella typhimurium LT2
acauauugagcugauaa

SEQ ID NO: 3783531 - RNA, 18 nt, Salmonella typhimurium LT2
acauauugagcugauaac

SEQ ID NO: 3783532 - RNA, 12 nt, Salmonella typhimurium LT2
acauauuuuuau

SEQ ID NO: 3783533 - RNA, 18 nt, Salmonella typhimurium LT2
acauauuuuuaugcacgc

SEQ ID NO: 3783534 - RNA, 22 nt, Salmonella typhimurium LT2
acauauuuuucacacauaagca

SEQ ID NO: 3783535 - RNA, 22 nt, Salmonella typhimurium LT2
acaucaaacucuucgcggcuca

SEQ ID NO: 3783536 - RNA, 16 nt, Salmonella typhimurium LT2
acaucaauaaagccgc

SEQ ID NO: 3783537 - RNA, 16 nt, Salmonella typhimurium LT2
acaucaauaaauccgc

SEQ ID NO: 3783538 - RNA, 16 nt, Salmonella typhimurium LT2
acaucaauagcaaggg

SEQ ID NO: 3783539 - RNA, 16 nt, Salmonella typhimurium LT2
acaucacguucgcgca

SEQ ID NO: 3783540 - RNA, 13 nt, Salmonella typhimurium LT2
acaucagauaaac

SEQ ID NO: 3783541 - RNA, 23 nt, Salmonella typhimurium LT2
acaucauccacggcaucaauaac

SEQ ID NO: 3783542 - RNA, 13 nt, Salmonella typhimurium LT2
acaucauuaucca

SEQ ID NO: 3783543 - RNA, 13 nt, Salmonella typhimurium LT2
acauccacauagg

SEQ ID NO: 3783544 - RNA, 14 nt, Salmonella typhimurium LT2
acauccagacagcc

SEQ ID NO: 3783545 - RNA, 20 nt, Salmonella typhimurium LT2
acauccagacagccgacggc

SEQ ID NO: 3783546 - RNA, 21 nt, Salmonella typhimurium LT2
acauccagacccagacggcga

SEQ ID NO: 3783547 - RNA, 14 nt, Salmonella typhimurium LT2
accaccguuauuuc

SEQ ID NO: 3783548 - RNA, 13 nt, Salmonella typhimurium LT2
accaccucuuucg

SEQ ID NO: 3783549 - RNA, 13 nt, Salmonella typhimurium LT2
accaccuggguca

SEQ ID NO: 3783550 - RNA, 13 nt, Salmonella typhimurium LT2
accacgaaucagg

SEQ ID NO: 3783551 - RNA, 17 nt, Salmonella typhimurium LT2
accacgacgaccgccag

SEQ ID NO: 3783552 - RNA, 16 nt, Salmonella typhimurium LT2
accacgauaaagacac

SEQ ID NO: 3783553 - RNA, 15 nt, Salmonella typhimurium LT2
accacgcacaugggc

SEQ ID NO: 3783554 - RNA, 13 nt, Salmonella typhimurium LT2
accacgccagcca

SEQ ID NO: 3783555 - RNA, 14 nt, Salmonella typhimurium LT2
accacgccagccag

SEQ ID NO: 3783556 - RNA, 22 nt, Salmonella typhimurium LT2
accacgccaucaacagcggaga

SEQ ID NO: 3783557 - RNA, 19 nt, Salmonella typhimurium LT2
accacgcccggaucaaaca

SEQ ID NO: 3783558 - RNA, 19 nt, Salmonella typhimurium LT2
accacgccggaaucgcgau

SEQ ID NO: 3783559 - RNA, 15 nt, Salmonella typhimurium LT2
accacggcuucagcg

SEQ ID NO: 3783560 - RNA, 20 nt, Salmonella typhimurium LT2
accacggcuucagcggcgca

SEQ ID NO: 3783561 - RNA, 19 nt, Salmonella typhimurium LT2
accacgguguaccccgccu

SEQ ID NO: 3783562 - RNA, 21 nt, Salmonella typhimurium LT2
accacgguguccggguucagc

SEQ ID NO: 3783563 - RNA, 20 nt, Salmonella typhimurium LT2
accacgucugcgcuuucagc

SEQ ID NO: 3783564 - RNA, 16 nt, Salmonella typhimurium LT2
accacguuaccgcgca

SEQ ID NO: 3783565 - RNA, 17 nt, Salmonella typhimurium LT2
accacguuaccgcgcag

SEQ ID NO: 3783566 - RNA, 23 nt, Salmonella typhimurium LT2
accacuccccaacguaauaacca

SEQ ID NO: 3783567 - RNA, 20 nt, Salmonella typhimurium LT2
accacuccggugcccauucc

SEQ ID NO: 3783568 - RNA, 23 nt, Salmonella typhimurium LT2
accacucuuuggacggcaucagg

SEQ ID NO: 3783569 - RNA, 17 nt, Salmonella typhimurium LT2
accacugauuccagagc

SEQ ID NO: 3783570 - RNA, 20 nt, Salmonella typhimurium LT2
accacugauuccagagcgaa

SEQ ID NO: 3783571 - RNA, 14 nt, Salmonella typhimurium LT2
accacuucacuauc

SEQ ID NO: 3783572 - RNA, 17 nt, Salmonella typhimurium LT2
accacuugauucugcag

SEQ ID NO: 3783573 - RNA, 21 nt, Salmonella typhimurium LT2
accacuuuaccgcucacaaug

SEQ ID NO: 3783574 - RNA, 14 nt, Salmonella typhimurium LT2
accacuuugcgguu

SEQ ID NO: 3783575 - RNA, 17 nt, Salmonella typhimurium LT2
accagaaucaccgacag

SEQ ID NO: 3783576 - RNA, 18 nt, Salmonella typhimurium LT2
accagaaugcccaggccc

SEQ ID NO: 3783577 - RNA, 11 nt, Salmonella typhimurium LT2
accagacccgc

SEQ ID NO: 3783578 - RNA, 16 nt, Salmonella typhimurium LT2
accagaccgacaagcc

SEQ ID NO: 3783579 - RNA, 14 nt, Salmonella typhimurium LT2
accagaccggcauc

SEQ ID NO: 3783580 - RNA, 16 nt, Salmonella typhimurium LT2
accagacgaauaaucu

SEQ ID NO: 3783581 - RNA, 14 nt, Salmonella typhimurium LT2
accagacgcgaacg

SEQ ID NO: 3783582 - RNA, 21 nt, Salmonella typhimurium LT2
accagacgcgaacguuugacc

SEQ ID NO: 3783583 - RNA, 19 nt, Salmonella typhimurium LT2
accagacguaaucguaauc

SEQ ID NO: 3783584 - RNA, 18 nt, Salmonella typhimurium LT2
accagacucaccccuucu

SEQ ID NO: 3783585 - RNA, 18 nt, Salmonella typhimurium LT2
accagaucaacauggugu

SEQ ID NO: 3783586 - RNA, 20 nt, Salmonella typhimurium LT2
accagaucggcaucuuuaac

SEQ ID NO: 3783587 - RNA, 14 nt, Salmonella typhimurium LT2
accagaugcagcaa

SEQ ID NO: 3783588 - RNA, 14 nt, Salmonella typhimurium LT2
accagcaacgccag

SEQ ID NO: 3783589 - RNA, 14 nt, Salmonella typhimurium LT2
accagcaauaacag

SEQ ID NO: 3783590 - RNA, 21 nt, Salmonella typhimurium LT2
accagcaauaacaggcacagu

SEQ ID NO: 3783591 - RNA, 16 nt, Salmonella typhimurium LT2
accagcaaugagacaa

SEQ ID NO: 3783592 - RNA, 21 nt, Salmonella typhimurium LT2
accagcaaugauaacggcgcc

SEQ ID NO: 3783593 - RNA, 14 nt, Salmonella typhimurium LT2
accagcacaaaaaa

SEQ ID NO: 3783594 - RNA, 14 nt, Salmonella typhimurium LT2
accagcacagccca

SEQ ID NO: 3783595 - RNA, 14 nt, Salmonella typhimurium LT2
accagcacaggcgu

SEQ ID NO: 3783596 - RNA, 14 nt, Salmonella typhimurium LT2
accagcaccgccag

SEQ ID NO: 3783597 - RNA, 19 nt, Salmonella typhimurium LT2
accagcaccgccagcgcau

SEQ ID NO: 3783598 - RNA, 14 nt, Salmonella typhimurium LT2
accagcacgcacag

SEQ ID NO: 3783599 - RNA, 16 nt, Salmonella typhimurium LT2
accagcagcacaaaaa

SEQ ID NO: 3783600 - RNA, 15 nt, Salmonella typhimurium LT2
accagcagcgggcug

SEQ ID NO: 3783601 - RNA, 12 nt, Salmonella typhimurium LT2
accagcaggugc

SEQ ID NO: 3783602 - RNA, 16 nt, Salmonella typhimurium LT2
accagcaggugguaca

SEQ ID NO: 3783603 - RNA, 21 nt, Salmonella typhimurium LT2
accagcaggugguacaucaaa

SEQ ID NO: 3783604 - RNA, 22 nt, Salmonella typhimurium LT2
accagcaguguaucguugucgc

SEQ ID NO: 3783605 - RNA, 22 nt, Salmonella typhimurium LT2
accagcauaaugagccccggac

SEQ ID NO: 3783606 - RNA, 22 nt, Salmonella typhimurium LT2
accagcaucaauagcagcuuca

SEQ ID NO: 3783607 - RNA, 18 nt, Salmonella typhimurium LT2
accagccaggaaccgccg

SEQ ID NO: 3783608 - RNA, 19 nt, Salmonella typhimurium LT2
accagccccacgguacgac

SEQ ID NO: 3783609 - RNA, 14 nt, Salmonella typhimurium LT2
accagccccagccc

SEQ ID NO: 3783610 - RNA, 20 nt, Salmonella typhimurium LT2
accagcccggcgcacacccu

SEQ ID NO: 3783611 - RNA, 20 nt, Salmonella typhimurium LT2
accagccgagugcuuaugua

SEQ ID NO: 3783612 - RNA, 18 nt, Salmonella typhimurium LT2
accagccgcaucuuauau

SEQ ID NO: 3783613 - RNA, 15 nt, Salmonella typhimurium LT2
accagccuaaaaaca

SEQ ID NO: 3783614 - RNA, 17 nt, Salmonella typhimurium LT2
accagccuaaaaacaga

SEQ ID NO: 3783615 - RNA, 14 nt, Salmonella typhimurium LT2
accagccugccguc

SEQ ID NO: 3783616 - RNA, 15 nt, Salmonella typhimurium LT2
accagcgaaaugaca

SEQ ID NO: 3783617 - RNA, 20 nt, Salmonella typhimurium LT2
accagcgaaaugacagccac

SEQ ID NO: 3783618 - RNA, 14 nt, Salmonella typhimurium LT2
accagcgacggcca

SEQ ID NO: 3783619 - RNA, 15 nt, Salmonella typhimurium LT2
accagcgacggccag

SEQ ID NO: 3783620 - RNA, 19 nt, Salmonella typhimurium LT2
accagcgagcuacaggugc

SEQ ID NO: 3783621 - RNA, 20 nt, Salmonella typhimurium LT2
accagcgauaaacgccagcc

SEQ ID NO: 3783622 - RNA, 21 nt, Salmonella typhimurium LT2
accagcgauaaacgccagccc

SEQ ID NO: 3783623 - RNA, 19 nt, Salmonella typhimurium LT2
accagcgcaguaaacuccu

SEQ ID NO: 3783624 - RNA, 21 nt, Salmonella typhimurium LT2
accagcgcaucaaugucgcgc

SEQ ID NO: 3783625 - RNA, 13 nt, Salmonella typhimurium LT2
accagcgccggag

SEQ ID NO: 3783626 - RNA, 15 nt, Salmonella typhimurium LT2
accagcgccugcgcu

SEQ ID NO: 3783627 - RNA, 16 nt, Salmonella typhimurium LT2
accagcgcgccagcgc

SEQ ID NO: 3783628 - RNA, 17 nt, Salmonella typhimurium LT2
accagcgcuauccaggc

SEQ ID NO: 3783629 - RNA, 22 nt, Salmonella typhimurium LT2
accagcgcuucuguuaaaaaau

SEQ ID NO: 3783630 - RNA, 22 nt, Salmonella typhimurium LT2
accagcggacggcuaauaugcc

SEQ ID NO: 3783631 - RNA, 21 nt, Salmonella typhimurium LT2
accagcgguuggaucucacca

SEQ ID NO: 3783632 - RNA, 18 nt, Salmonella typhimurium LT2
accagcgucagcgggcca

SEQ ID NO: 3783633 - RNA, 19 nt, Salmonella typhimurium LT2
accagcguggcuauccaua

SEQ ID NO: 3783634 - RNA, 19 nt, Salmonella typhimurium LT2
accagcguuggugccgcca

SEQ ID NO: 3783635 - RNA, 22 nt, Salmonella typhimurium LT2
accagcguuggugccgccagau

SEQ ID NO: 3783636 - RNA, 17 nt, Salmonella typhimurium LT2
accagcucucccgccuc

SEQ ID NO: 3783637 - RNA, 23 nt, Salmonella typhimurium LT2
accagcucucccgccucgucaug

SEQ ID NO: 3783638 - RNA, 19 nt, Salmonella typhimurium LT2
accagcugacgcagcagcu

SEQ ID NO: 3783639 - RNA, 18 nt, Salmonella typhimurium LT2
accagcuucucaguauga

SEQ ID NO: 3783640 - RNA, 17 nt, Salmonella typhimurium LT2
accaggaaauaaucgag

SEQ ID NO: 3783641 - RNA, 16 nt, Salmonella typhimurium LT2
accaggacaaaaggcg

SEQ ID NO: 3783642 - RNA, 14 nt, Salmonella typhimurium LT2
accaggacaugcca

SEQ ID NO: 3783643 - RNA, 18 nt, Salmonella typhimurium LT2
accaggacccgugacgca

SEQ ID NO: 3783644 - RNA, 18 nt, Salmonella typhimurium LT2
accaggauaaaggccggg

SEQ ID NO: 3783645 - RNA, 15 nt, Salmonella typhimurium LT2
accaggcaaaccagc

SEQ ID NO: 3783646 - RNA, 15 nt, Salmonella typhimurium LT2
accaggcaaugcccc

SEQ ID NO: 3783647 - RNA, 18 nt, Salmonella typhimurium LT2
accaggcaaugccccgcc

SEQ ID NO: 3783648 - RNA, 14 nt, Salmonella typhimurium LT2
accaggcacuugag

SEQ ID NO: 3783649 - RNA, 15 nt, Salmonella typhimurium LT2
accaggcaugcagcu

SEQ ID NO: 3783650 - RNA, 16 nt, Salmonella typhimurium LT2
accaggccgguaaagu

SEQ ID NO: 3783651 - RNA, 21 nt, Salmonella typhimurium LT2
accgcccgcggcgaucaccac

SEQ ID NO: 3783652 - RNA, 16 nt, Salmonella typhimurium LT2
accgccgacaaucguc

SEQ ID NO: 3783653 - RNA, 16 nt, Salmonella typhimurium LT2
accgccgccaaacugc

SEQ ID NO: 3783654 - RNA, 18 nt, Salmonella typhimurium LT2
accgccgccaccaaaaac

SEQ ID NO: 3783655 - RNA, 17 nt, Salmonella typhimurium LT2
accgccgccgcgcucgc

SEQ ID NO: 3783656 - RNA, 22 nt, Salmonella typhimurium LT2
accgccgcgauagaccacgcca

SEQ ID NO: 3783657 - RNA, 13 nt, Salmonella typhimurium LT2
accgccgcgcuau

SEQ ID NO: 3783658 - RNA, 21 nt, Salmonella typhimurium LT2
accgccgcugcaaaucaccac

SEQ ID NO: 3783659 - RNA, 22 nt, Salmonella typhimurium LT2
accgccggaaauuugcagcgcu

SEQ ID NO: 3783660 - RNA, 18 nt, Salmonella typhimurium LT2
accgccguuucguugcca

SEQ ID NO: 3783661 - RNA, 21 nt, Salmonella typhimurium LT2
accgccguuucguugccagag

SEQ ID NO: 3783662 - RNA, 17 nt, Salmonella typhimurium LT2
accgccguuuugauuug

SEQ ID NO: 3783663 - RNA, 21 nt, Salmonella typhimurium LT2
accgccucaucggcguugccc

SEQ ID NO: 3783664 - RNA, 14 nt, Salmonella typhimurium LT2
accgccuccaggcc

SEQ ID NO: 3783665 - RNA, 21 nt, Salmonella typhimurium LT2
accgccucgaccccuucgccu

SEQ ID NO: 3783666 - RNA, 19 nt, Salmonella typhimurium LT2
accgccucgccaaagcgcu

SEQ ID NO: 3783667 - RNA, 15 nt, Salmonella typhimurium LT2
accgccugcggcaua

SEQ ID NO: 3783668 - RNA, 17 nt, Salmonella typhimurium LT2
accgccugcucaagcug

SEQ ID NO: 3783669 - RNA, 23 nt, Salmonella typhimurium LT2
accgccuucgcauauuguaccug

SEQ ID NO: 3783670 - RNA, 17 nt, Salmonella typhimurium LT2
accgccuuguccggccu

SEQ ID NO: 3783671 - RNA, 20 nt, Salmonella typhimurium LT2
accgcgacaauaugauccuc

SEQ ID NO: 3783672 - RNA, 20 nt, Salmonella typhimurium LT2
accgcgaugaccaucaaaua

SEQ ID NO: 3783673 - RNA, 17 nt, Salmonella typhimurium LT2
accgcgaugugcugggg

SEQ ID NO: 3783674 - RNA, 16 nt, Salmonella typhimurium LT2
accgcgcaguucaaua

SEQ ID NO: 3783675 - RNA, 18 nt, Salmonella typhimurium LT2
accgcgcaguucaauauu

SEQ ID NO: 3783676 - RNA, 13 nt, Salmonella typhimurium LT2
accgcgccaggcg

SEQ ID NO: 3783677 - RNA, 15 nt, Salmonella typhimurium LT2
accgcgccaggcggc

SEQ ID NO: 3783678 - RNA, 14 nt, Salmonella typhimurium LT2
accgcgcggcguuc

SEQ ID NO: 3783679 - RNA, 19 nt, Salmonella typhimurium LT2
accgcgcggcguucugcgc

SEQ ID NO: 3783680 - RNA, 20 nt, Salmonella typhimurium LT2
accgcgcggcguucugcgcc

SEQ ID NO: 3783681 - RNA, 18 nt, Salmonella typhimurium LT2
accgcggcaaccagccca

SEQ ID NO: 3783682 - RNA, 15 nt, Salmonella typhimurium LT2
accgcguuccaucgc

SEQ ID NO: 3783683 - RNA, 12 nt, Salmonella typhimurium LT2
accgcguuucca

SEQ ID NO: 3783684 - RNA, 15 nt, Salmonella typhimurium LT2
accgcguuuccacgc

SEQ ID NO: 3783685 - RNA, 19 nt, Salmonella typhimurium LT2
accgcguuugcgcaacaga

SEQ ID NO: 3783686 - RNA, 16 nt, Salmonella typhimurium LT2
accgcuaaaaaacagg

SEQ ID NO: 3783687 - RNA, 14 nt, Salmonella typhimurium LT2
accgcuaaucccag

SEQ ID NO: 3783688 - RNA, 16 nt, Salmonella typhimurium LT2
accgcuaaugaggaaa

SEQ ID NO: 3783689 - RNA, 14 nt, Salmonella typhimurium LT2
accgcuacaaucca

SEQ ID NO: 3783690 - RNA, 14 nt, Salmonella typhimurium LT2
accgcuacgcaggc

SEQ ID NO: 3783691 - RNA, 20 nt, Salmonella typhimurium LT2
accgcuccgcgcauccugca

SEQ ID NO: 3783692 - RNA, 21 nt, Salmonella typhimurium LT2
accgcucgccgccucccccuc

SEQ ID NO: 3783693 - RNA, 22 nt, Salmonella typhimurium LT2
accgcugcgugcgcgccaccgg

SEQ ID NO: 3783694 - RNA, 18 nt, Salmonella typhimurium LT2
accgcuucccgcgucgcc

SEQ ID NO: 3783695 - RNA, 17 nt, Salmonella typhimurium LT2
accgcuucgccuucgcc

SEQ ID NO: 3783696 - RNA, 16 nt, Salmonella typhimurium LT2
accgcuucgcgcgcca

SEQ ID NO: 3783697 - RNA, 19 nt, Salmonella typhimurium LT2
accgcuucgcgcgccaguu

SEQ ID NO: 3783698 - RNA, 18 nt, Salmonella typhimurium LT2
accgcuugggccaccugc

SEQ ID NO: 3783699 - RNA, 17 nt, Salmonella typhimurium LT2
accgcuuucccggcaug

SEQ ID NO: 3783700 - RNA, 23 nt, Salmonella typhimurium LT2
accggaaauggucgcuccggaac

SEQ ID NO: 3783701 - RNA, 21 nt, Salmonella typhimurium LT2
accggaacaguccaggaaaga

SEQ ID NO: 3783702 - RNA, 18 nt, Salmonella typhimurium LT2
accggaggagugcgccag

SEQ ID NO: 3783703 - RNA, 15 nt, Salmonella typhimurium LT2
accggauauggcaaa

SEQ ID NO: 3783704 - RNA, 22 nt, Salmonella typhimurium LT2
accggauucacauaggcguagc

SEQ ID NO: 3783705 - RNA, 15 nt, Salmonella typhimurium LT2
accggcaaauaccgu

SEQ ID NO: 3783706 - RNA, 22 nt, Salmonella typhimurium LT2
accggcaaauaccgucauaauc

SEQ ID NO: 3783707 - RNA, 20 nt, Salmonella typhimurium LT2
accggcaaccaacgcccaac

SEQ ID NO: 3783708 - RNA, 22 nt, Salmonella typhimurium LT2
accggcaaucgccugcaacgcu

SEQ ID NO: 3783709 - RNA, 18 nt, Salmonella typhimurium LT2
accggcacauccagcugu

SEQ ID NO: 3783710 - RNA, 19 nt, Salmonella typhimurium LT2
accggcagcgucggcuuca

SEQ ID NO: 3783711 - RNA, 22 nt, Salmonella typhimurium LT2
accggcagcgucguccagcccg

SEQ ID NO: 3783712 - RNA, 20 nt, Salmonella typhimurium LT2
accggcaggugauggcggcu

SEQ ID NO: 3783713 - RNA, 21 nt, Salmonella typhimurium LT2
accggcaggugauggcggcuu

SEQ ID NO: 3783714 - RNA, 14 nt, Salmonella typhimurium LT2
accggcaucggcag

SEQ ID NO: 3783715 - RNA, 23 nt, Salmonella typhimurium LT2
accggcaugaagacguucuauca

SEQ ID NO: 3783716 - RNA, 20 nt, Salmonella typhimurium LT2
accggccacaauugccagca

SEQ ID NO: 3783717 - RNA, 18 nt, Salmonella typhimurium LT2
accggccauugccgcgcc

SEQ ID NO: 3783718 - RNA, 22 nt, Salmonella typhimurium LT2
accggcgaaaucgugcgcccca

SEQ ID NO: 3783719 - RNA, 12 nt, Salmonella typhimurium LT2
accggcgacgua

SEQ ID NO: 3783720 - RNA, 14 nt, Salmonella typhimurium LT2
accggcgcgcgcca

SEQ ID NO: 3783721 - RNA, 13 nt, Salmonella typhimurium LT2
accggcggcgucu

SEQ ID NO: 3783722 - RNA, 16 nt, Salmonella typhimurium LT2
accggcguaauugcgc

SEQ ID NO: 3783723 - RNA, 15 nt, Salmonella typhimurium LT2
accggcgucaucauu

SEQ ID NO: 3783724 - RNA, 18 nt, Salmonella typhimurium LT2
accggcgucucgcacucg

SEQ ID NO: 3783725 - RNA, 18 nt, Salmonella typhimurium LT2
accggcuaucagccgcca

SEQ ID NO: 3783726 - RNA, 19 nt, Salmonella typhimurium LT2
accggcuauccaugcgucg

SEQ ID NO: 3783727 - RNA, 21 nt, Salmonella typhimurium LT2
accgggagauuuccggcacca

SEQ ID NO: 3783728 - RNA, 18 nt, Salmonella typhimurium LT2
accgggcaggauacggcg

SEQ ID NO: 3783729 - RNA, 17 nt, Salmonella typhimurium LT2
accgggccugaugcgcg

SEQ ID NO: 3783730 - RNA, 23 nt, Salmonella typhimurium LT2
accgggccugaugcgcguuuagc

SEQ ID NO: 3783731 - RNA, 20 nt, Salmonella typhimurium LT2
accgggcgaaagcacuucuc

SEQ ID NO: 3783732 - RNA, 17 nt, Salmonella typhimurium LT2
accgggcgcaaucauca

SEQ ID NO: 3783733 - RNA, 22 nt, Salmonella typhimurium LT2
accgggcgcaaucaucaccacc

SEQ ID NO: 3783734 - RNA, 12 nt, Salmonella typhimurium LT2
accgggcuaaac

SEQ ID NO: 3783735 - RNA, 14 nt, Salmonella typhimurium LT2
accggggcguacca

SEQ ID NO: 3783736 - RNA, 14 nt, Salmonella typhimurium LT2
accggggcguucau

SEQ ID NO: 3783737 - RNA, 15 nt, Salmonella typhimurium LT2
accgggguucagacc

SEQ ID NO: 3783738 - RNA, 18 nt, Salmonella typhimurium LT2
accgggugcacgaacugc

SEQ ID NO: 3783739 - RNA, 22 nt, Salmonella typhimurium LT2
accgggugcacgaacugcugcc

SEQ ID NO: 3783740 - RNA, 18 nt, Salmonella typhimurium LT2
accgguaaaggcgaccgg

SEQ ID NO: 3783741 - RNA, 14 nt, Salmonella typhimurium LT2
accgguaugaaacg

SEQ ID NO: 3783742 - RNA, 15 nt, Salmonella typhimurium LT2
accggucaggcagca

SEQ ID NO: 3783743 - RNA, 20 nt, Salmonella typhimurium LT2
accggucucuuaauaccggc

SEQ ID NO: 3783744 - RNA, 15 nt, Salmonella typhimurium LT2
accggugcgccccag

SEQ ID NO: 3783745 - RNA, 22 nt, Salmonella typhimurium LT2
accgguucgcggcagauccugg

SEQ ID NO: 3783746 - RNA, 14 nt, Salmonella typhimurium LT2
accgguugcgcgcu

SEQ ID NO: 3783747 - RNA, 19 nt, Salmonella typhimurium LT2
accgguuugucauucgccu

SEQ ID NO: 3783748 - RNA, 23 nt, Salmonella typhimurium LT2
accgguuuguuauugaucacggu

SEQ ID NO: 3783749 - RNA, 14 nt, Salmonella typhimurium LT2
accgguuuuuuccu

SEQ ID NO: 3783750 - RNA, 17 nt, Salmonella typhimurium LT2
accgguuuuuuccugca

SEQ ID NO: 3783751 - RNA, 18 nt, Salmonella typhimurium LT2
accgguuuuuuccugcac

SEQ ID NO: 3783752 - RNA, 17 nt, Salmonella typhimurium LT2
accguaaacgccugcac

SEQ ID NO: 3783753 - RNA, 19 nt, Salmonella typhimurium LT2
accguaaacgccugcacca

SEQ ID NO: 3783754 - RNA, 18 nt, Salmonella typhimurium LT2
accugcauuuaucuuuaa

SEQ ID NO: 3783755 - RNA, 19 nt, Salmonella typhimurium LT2
accugccaguccgcccgcc

SEQ ID NO: 3783756 - RNA, 20 nt, Salmonella typhimurium LT2
accugccaguccgcccgccu

SEQ ID NO: 3783757 - RNA, 22 nt, Salmonella typhimurium LT2
accugcccauccuuucucuggu

SEQ ID NO: 3783758 - RNA, 18 nt, Salmonella typhimurium LT2
accugccgaccucacugg

SEQ ID NO: 3783759 - RNA, 13 nt, Salmonella typhimurium LT2
accugccgccaua

SEQ ID NO: 3783760 - RNA, 18 nt, Salmonella typhimurium LT2
accugccguuuuccagcc

SEQ ID NO: 3783761 - RNA, 19 nt, Salmonella typhimurium LT2
accugccguuuuccagccg

SEQ ID NO: 3783762 - RNA, 19 nt, Salmonella typhimurium LT2
accugcgacgcaugaaacg

SEQ ID NO: 3783763 - RNA, 17 nt, Salmonella typhimurium LT2
accugcgcaaucaugac

SEQ ID NO: 3783764 - RNA, 18 nt, Salmonella typhimurium LT2
accugcggcaauggcuca

SEQ ID NO: 3783765 - RNA, 15 nt, Salmonella typhimurium LT2
accugcggcgcgccc

SEQ ID NO: 3783766 - RNA, 20 nt, Salmonella typhimurium LT2
accugcuccagauuacuaug

SEQ ID NO: 3783767 - RNA, 23 nt, Salmonella typhimurium LT2
accugcuggcggcguaagcgggu

SEQ ID NO: 3783768 - RNA, 19 nt, Salmonella typhimurium LT2
accugcugguuauuaucca

SEQ ID NO: 3783769 - RNA, 19 nt, Salmonella typhimurium LT2
accugcuguaccucuugcu

SEQ ID NO: 3783770 - RNA, 18 nt, Salmonella typhimurium LT2
accuggaaguuuugcugg

SEQ ID NO: 3783771 - RNA, 19 nt, Salmonella typhimurium LT2
accuggaugcugccugccu

SEQ ID NO: 3783772 - RNA, 15 nt, Salmonella typhimurium LT2
accuggcggagcugc

SEQ ID NO: 3783773 - RNA, 11 nt, Salmonella typhimurium LT2
accuggcuggc

SEQ ID NO: 3783774 - RNA, 19 nt, Salmonella typhimurium LT2
accugggagacgucaaaga

SEQ ID NO: 3783775 - RNA, 17 nt, Salmonella typhimurium LT2
accugggagucgugcaa

SEQ ID NO: 3783776 - RNA, 20 nt, Salmonella typhimurium LT2
accuggguagcuucugucug

SEQ ID NO: 3783777 - RNA, 21 nt, Salmonella typhimurium LT2
accuggguagcuucugucugc

SEQ ID NO: 3783778 - RNA, 22 nt, Salmonella typhimurium LT2
accugguggcgaacaauaccgu

SEQ ID NO: 3783779 - RNA, 17 nt, Salmonella typhimurium LT2
accuguaaccuuaaaag

SEQ ID NO: 3783780 - RNA, 22 nt, Salmonella typhimurium LT2
accuguacccgguacuuucucc

SEQ ID NO: 3783781 - RNA, 16 nt, Salmonella typhimurium LT2
accuguguacacaauu

SEQ ID NO: 3783782 - RNA, 15 nt, Salmonella typhimurium LT2
accuguucagccguu

SEQ ID NO: 3783783 - RNA, 18 nt, Salmonella typhimurium LT2
accuguucaugccagauu

SEQ ID NO: 3783784 - RNA, 18 nt, Salmonella typhimurium LT2
accuguugcacgcauggc

SEQ ID NO: 3783785 - RNA, 16 nt, Salmonella typhimurium LT2
accuguugcggggcuu

SEQ ID NO: 3783786 - RNA, 17 nt, Salmonella typhimurium LT2
accuguuucgccaggcc

SEQ ID NO: 3783787 - RNA, 15 nt, Salmonella typhimurium LT2
accuuaauccagccg

SEQ ID NO: 3783788 - RNA, 19 nt, Salmonella typhimurium LT2
accuucaagaaucaauaua

SEQ ID NO: 3783789 - RNA, 17 nt, Salmonella typhimurium LT2
accuucacauuggcaaa

SEQ ID NO: 3783790 - RNA, 17 nt, Salmonella typhimurium LT2
accuucaccugaauauc

SEQ ID NO: 3783791 - RNA, 15 nt, Salmonella typhimurium LT2
accuucacgccgcca

SEQ ID NO: 3783792 - RNA, 18 nt, Salmonella typhimurium LT2
accuucacgccgccaaag

SEQ ID NO: 3783793 - RNA, 20 nt, Salmonella typhimurium LT2
accuucagccagaguuuuaa

SEQ ID NO: 3783794 - RNA, 22 nt, Salmonella typhimurium LT2
accuucauggcguucgccgcau

SEQ ID NO: 3783795 - RNA, 22 nt, Salmonella typhimurium LT2
accuucccgcgauaaaaacagc

SEQ ID NO: 3783796 - RNA, 22 nt, Salmonella typhimurium LT2
accuucgcguaaugcaaucaaa

SEQ ID NO: 3783797 - RNA, 11 nt, Salmonella typhimurium LT2
accuucgcguu

SEQ ID NO: 3783798 - RNA, 17 nt, Salmonella typhimurium LT2
accuucggucccaucgc

SEQ ID NO: 3783799 - RNA, 15 nt, Salmonella typhimurium LT2
accuucucuuuaugc

SEQ ID NO: 3783800 - RNA, 21 nt, Salmonella typhimurium LT2
accuucuucacuaaaaacagg

SEQ ID NO: 3783801 - RNA, 14 nt, Salmonella typhimurium LT2
accuucuucgccaa

SEQ ID NO: 3783802 - RNA, 12 nt, Salmonella typhimurium LT2
accuucuucgcu

SEQ ID NO: 3783803 - RNA, 18 nt, Salmonella typhimurium LT2
accuugauucccuuuugc

SEQ ID NO: 3783804 - RNA, 15 nt, Salmonella typhimurium LT2
accuuguucuuccau

SEQ ID NO: 3783805 - RNA, 22 nt, Salmonella typhimurium LT2
accuuuccaggauuaauuuucu

SEQ ID NO: 3783806 - RNA, 18 nt, Salmonella typhimurium LT2
accuuucgccgccagaua

SEQ ID NO: 3783807 - RNA, 13 nt, Salmonella typhimurium LT2
accuuucuucucu

SEQ ID NO: 3783808 - RNA, 19 nt, Salmonella typhimurium LT2
accuuucuucucuucuuca

SEQ ID NO: 3783809 - RNA, 22 nt, Salmonella typhimurium LT2
accuuugcccgagcgcuggcau

SEQ ID NO: 3783810 - RNA, 21 nt, Salmonella typhimurium LT2
accuuuggaggagagcgucau

SEQ ID NO: 3783811 - RNA, 21 nt, Salmonella typhimurium LT2
accuuugggaaaauaaaugcu

SEQ ID NO: 3783812 - RNA, 15 nt, Salmonella typhimurium LT2
accuuuuacuucacg

SEQ ID NO: 3783813 - RNA, 21 nt, Salmonella typhimurium LT2
accuuuucauuggucaguaag

SEQ ID NO: 3783814 - RNA, 17 nt, Salmonella typhimurium LT2
accuuuuucaucacgcu

SEQ ID NO: 3783815 - RNA, 21 nt, Salmonella typhimurium LT2
accuuuuugauccguuucaga

SEQ ID NO: 3783816 - RNA, 22 nt, Salmonella typhimurium LT2
accuuuuugauccguuucagaa

SEQ ID NO: 3783817 - RNA, 16 nt, Salmonella typhimurium LT2
acgaaaaucauccgcu

SEQ ID NO: 3783818 - RNA, 15 nt, Salmonella typhimurium LT2
acgaaaaugcgccuu

SEQ ID NO: 3783819 - RNA, 22 nt, Salmonella typhimurium LT2
acgaaacuuuucgcaagagcga

SEQ ID NO: 3783820 - RNA, 17 nt, Salmonella typhimurium LT2
acgaaagucuguucgua

SEQ ID NO: 3783821 - RNA, 21 nt, Salmonella typhimurium LT2
acgaaaucagagacaaauaca

SEQ ID NO: 3783822 - RNA, 21 nt, Salmonella typhimurium LT2
acgaaauggugugcauggugu

SEQ ID NO: 3783823 - RNA, 21 nt, Salmonella typhimurium LT2
acgaacaggauauuaccgcca

SEQ ID NO: 3783824 - RNA, 14 nt, Salmonella typhimurium LT2
acgaaccgagcggu

SEQ ID NO: 3783825 - RNA, 16 nt, Salmonella typhimurium LT2
acgaaccggcgccguu

SEQ ID NO: 3783826 - RNA, 20 nt, Salmonella typhimurium LT2
acgaacgcuggcacuuuccg

SEQ ID NO: 3783827 - RNA, 14 nt, Salmonella typhimurium LT2
acgaacugauggcg

SEQ ID NO: 3783828 - RNA, 13 nt, Salmonella typhimurium LT2
acgaacugcggcu

SEQ ID NO: 3783829 - RNA, 13 nt, Salmonella typhimurium LT2
acgaacugcugcc

SEQ ID NO: 3783830 - RNA, 17 nt, Salmonella typhimurium LT2
acgaacugcugcccugg

SEQ ID NO: 3783831 - RNA, 17 nt, Salmonella typhimurium LT2
acgaagagaccugugua

SEQ ID NO: 3783832 - RNA, 18 nt, Salmonella typhimurium LT2
acgaagauuaucgucuau

SEQ ID NO: 3783833 - RNA, 23 nt, Salmonella typhimurium LT2
acgaagcgggcaauuccggucau

SEQ ID NO: 3783834 - RNA, 15 nt, Salmonella typhimurium LT2
acgaagucuggcugc

SEQ ID NO: 3783835 - RNA, 15 nt, Salmonella typhimurium LT2
acgaauaacaaaaug

SEQ ID NO: 3783836 - RNA, 16 nt, Salmonella typhimurium LT2
acgaauaacaaaauga

SEQ ID NO: 3783837 - RNA, 12 nt, Salmonella typhimurium LT2
acgaaucaggau

SEQ ID NO: 3783838 - RNA, 18 nt, Salmonella typhimurium LT2
acgaaucucgcugccgga

SEQ ID NO: 3783839 - RNA, 22 nt, Salmonella typhimurium LT2
acgaaugccgauagucuccgcc

SEQ ID NO: 3783840 - RNA, 19 nt, Salmonella typhimurium LT2
acgaaugucgcgucagguu

SEQ ID NO: 3783841 - RNA, 23 nt, Salmonella typhimurium LT2
acgaauuccuuuuuccgccaccu

SEQ ID NO: 3783842 - RNA, 20 nt, Salmonella typhimurium LT2
acgaauuuggucguaagaau

SEQ ID NO: 3783843 - RNA, 15 nt, Salmonella typhimurium LT2
acgacaaaaauacca

SEQ ID NO: 3783844 - RNA, 18 nt, Salmonella typhimurium LT2
acgacaacuucuaauuuu

SEQ ID NO: 3783845 - RNA, 13 nt, Salmonella typhimurium LT2
acgacacggcgca

SEQ ID NO: 3783846 - RNA, 12 nt, Salmonella typhimurium LT2
acgacagaauau

SEQ ID NO: 3783847 - RNA, 19 nt, Salmonella typhimurium LT2
acgacagcgccaucagcau

SEQ ID NO: 3783848 - RNA, 22 nt, Salmonella typhimurium LT2
acgacagcgccaucagcaucau

SEQ ID NO: 3783849 - RNA, 13 nt, Salmonella typhimurium LT2
acgaccaaacaag

SEQ ID NO: 3783850 - RNA, 23 nt, Salmonella typhimurium LT2
acgaccacucuuuggacggcauc

SEQ ID NO: 3783851 - RNA, 19 nt, Salmonella typhimurium LT2
acgaccaggaucagaccga

SEQ ID NO: 3783852 - RNA, 22 nt, Salmonella typhimurium LT2
acgaccagguaauggacgcaaa

SEQ ID NO: 3783853 - RNA, 15 nt, Salmonella typhimurium LT2
acgaccauaaauagc

SEQ ID NO: 3783854 - RNA, 17 nt, Salmonella typhimurium LT2
acgaccaugguucccgc

SEQ ID NO: 3783855 - RNA, 21 nt, Salmonella typhimurium LT2
acgaccugguggcgaacaaua

SEQ ID NO: 3783856 - RNA, 20 nt, Salmonella typhimurium LT2
acgaccuuucgccgucaccu

SEQ ID NO: 3783857 - RNA, 18 nt, Salmonella typhimurium LT2
acgacgaauaagcugaau

SEQ ID NO: 3783858 - RNA, 15 nt, Salmonella typhimurium LT2
acgacgaauauccag

SEQ ID NO: 3783859 - RNA, 15 nt, Salmonella typhimurium LT2
acgacgcuccagaau

SEQ ID NO: 3783860 - RNA, 22 nt, Salmonella typhimurium LT2
acgacggcaggggcgugauaaa

SEQ ID NO: 3783861 - RNA, 22 nt, Salmonella typhimurium LT2
acgacguggaguccgaggcaug

SEQ ID NO: 3783862 - RNA, 20 nt, Salmonella typhimurium LT2
acgacuaaaaaaaugcccgc

SEQ ID NO: 3783863 - RNA, 16 nt, Salmonella typhimurium LT2
acgacuagucaauaaa

SEQ ID NO: 3783864 - RNA, 20 nt, Salmonella typhimurium LT2
acgacucaauacauucagua

SEQ ID NO: 3783865 - RNA, 13 nt, Salmonella typhimurium LT2
acgacugaguauu

SEQ ID NO: 3783866 - RNA, 14 nt, Salmonella typhimurium LT2
acgacugaguauug

SEQ ID NO: 3783867 - RNA, 19 nt, Salmonella typhimurium LT2
acgacuggauacaggcgca

SEQ ID NO: 3783868 - RNA, 18 nt, Salmonella typhimurium LT2
acgacuuacgcagcauua

SEQ ID NO: 3783869 - RNA, 17 nt, Salmonella typhimurium LT2
acgacuuauucaaucaa

SEQ ID NO: 3783870 - RNA, 16 nt, Salmonella typhimurium LT2
acgacuucguuaguga

SEQ ID NO: 3783871 - RNA, 13 nt, Salmonella typhimurium LT2
acgacuuuuccuu

SEQ ID NO: 3783872 - RNA, 18 nt, Salmonella typhimurium LT2
acgagaacccacuuugcu

SEQ ID NO: 3783873 - RNA, 19 nt, Salmonella typhimurium LT2
acgagaacucagaggcggc

SEQ ID NO: 3783874 - RNA, 22 nt, Salmonella typhimurium LT2
acgagaacucagaggcggcgua

SEQ ID NO: 3783875 - RNA, 16 nt, Salmonella typhimurium LT2
acgagagacugauaau

SEQ ID NO: 3783876 - RNA, 18 nt, Salmonella typhimurium LT2
acgagcauccagaucggc

SEQ ID NO: 3783877 - RNA, 22 nt, Salmonella typhimurium LT2
acgagcgggucaggaaacuggc

SEQ ID NO: 3783878 - RNA, 15 nt, Salmonella typhimurium LT2
acgaggcauggcgau

SEQ ID NO: 3783879 - RNA, 20 nt, Salmonella typhimurium LT2
acgaggcugccgaugauccc

SEQ ID NO: 3783880 - RNA, 17 nt, Salmonella typhimurium LT2
acgagugcguucuucca

SEQ ID NO: 3783881 - RNA, 22 nt, Salmonella typhimurium LT2
acgaguuaucgauucugaauaa

SEQ ID NO: 3783882 - RNA, 23 nt, Salmonella typhimurium LT2
acgaguugaauaacguguuaugc

SEQ ID NO: 3783883 - RNA, 17 nt, Salmonella typhimurium LT2
acgauaaagacacagau

SEQ ID NO: 3783884 - RNA, 14 nt, Salmonella typhimurium LT2
acgauaaagcuggg

SEQ ID NO: 3783885 - RNA, 20 nt, Salmonella typhimurium LT2
acgauaaagcugggucagga

SEQ ID NO: 3783886 - RNA, 13 nt, Salmonella typhimurium LT2
acgauacccacca

SEQ ID NO: 3783887 - RNA, 20 nt, Salmonella typhimurium LT2
acgauacggcccagacccca

SEQ ID NO: 3783888 - RNA, 18 nt, Salmonella typhimurium LT2
acgauacgucauaucauc

SEQ ID NO: 3783889 - RNA, 19 nt, Salmonella typhimurium LT2
acgauacgucauaucaucc

SEQ ID NO: 3783890 - RNA, 16 nt, Salmonella typhimurium LT2
acgauacucagcccca

SEQ ID NO: 3783891 - RNA, 11 nt, Salmonella typhimurium LT2
acgauaucgcc

SEQ ID NO: 3783892 - RNA, 15 nt, Salmonella typhimurium LT2
acgauaucgccuggu

SEQ ID NO: 3783893 - RNA, 11 nt, Salmonella typhimurium LT2
acgauauguuu

SEQ ID NO: 3783894 - RNA, 16 nt, Salmonella typhimurium LT2
acgaucaacagaccga

SEQ ID NO: 3783895 - RNA, 17 nt, Salmonella typhimurium LT2
acgaugagcguggcgua

SEQ ID NO: 3783896 - RNA, 20 nt, Salmonella typhimurium LT2
acgaugcauaugcacagcgc

SEQ ID NO: 3783897 - RNA, 23 nt, Salmonella typhimurium LT2
acgaugcuugccauauugccgca

SEQ ID NO: 3783898 - RNA, 17 nt, Salmonella typhimurium LT2
acgauggcaaauaauac

SEQ ID NO: 3783899 - RNA, 19 nt, Salmonella typhimurium LT2
acgauggucucaaucgcaa

SEQ ID NO: 3783900 - RNA, 19 nt, Salmonella typhimurium LT2
acgaugugacuggggugag

SEQ ID NO: 3783901 - RNA, 17 nt, Salmonella typhimurium LT2
acgauguucgucccugc

SEQ ID NO: 3783902 - RNA, 15 nt, Salmonella typhimurium LT2
acgauuaaccucacg

SEQ ID NO: 3783903 - RNA, 18 nt, Salmonella typhimurium LT2
acgauuaaccucacgcaa

SEQ ID NO: 3783904 - RNA, 15 nt, Salmonella typhimurium LT2
acgauugaucucauc

SEQ ID NO: 3783905 - RNA, 17 nt, Salmonella typhimurium LT2
acgcaacaacaggccag

SEQ ID NO: 3783906 - RNA, 20 nt, Salmonella typhimurium LT2
acgcaacgcuucugagaauu

SEQ ID NO: 3783907 - RNA, 19 nt, Salmonella typhimurium LT2
acgcaacucacgccauucc

SEQ ID NO: 3783908 - RNA, 19 nt, Salmonella typhimurium LT2
acgcaagguagccacgccc

SEQ ID NO: 3783909 - RNA, 17 nt, Salmonella typhimurium LT2
acgcaauagaguaauga

SEQ ID NO: 3783910 - RNA, 22 nt, Salmonella typhimurium LT2
acgcaauuagguuauagcgggg

SEQ ID NO: 3783911 - RNA, 22 nt, Salmonella typhimurium LT2
acgcacaguacgcccggcgggu

SEQ ID NO: 3783912 - RNA, 15 nt, Salmonella typhimurium LT2
acgcaccaccugcau

SEQ ID NO: 3783913 - RNA, 22 nt, Salmonella typhimurium LT2
acgcacgcguaaggaauccagc

SEQ ID NO: 3783914 - RNA, 17 nt, Salmonella typhimurium LT2
acgcacguacggaaggu

SEQ ID NO: 3783915 - RNA, 16 nt, Salmonella typhimurium LT2
acgcacguucagcuca

SEQ ID NO: 3783916 - RNA, 13 nt, Salmonella typhimurium LT2
acgcacuaccaga

SEQ ID NO: 3783917 - RNA, 16 nt, Salmonella typhimurium LT2
acgcacuguaacgcac

SEQ ID NO: 3783918 - RNA, 15 nt, Salmonella typhimurium LT2
acgcacuuuuaucgg

SEQ ID NO: 3783919 - RNA, 18 nt, Salmonella typhimurium LT2
acgcagaaccgccgcgau

SEQ ID NO: 3783920 - RNA, 20 nt, Salmonella typhimurium LT2
acgcagaaccgccgcgauag

SEQ ID NO: 3783921 - RNA, 19 nt, Salmonella typhimurium LT2
acgcagaagcgcguuggcg

SEQ ID NO: 3783922 - RNA, 15 nt, Salmonella typhimurium LT2
acgcagaccaaaauc

SEQ ID NO: 3783923 - RNA, 14 nt, Salmonella typhimurium LT2
acgcagcaagaaca

SEQ ID NO: 3783924 - RNA, 13 nt, Salmonella typhimurium LT2
acgcagcacuuuc

SEQ ID NO: 3783925 - RNA, 14 nt, Salmonella typhimurium LT2
acgcagcaucgcca

SEQ ID NO: 3783926 - RNA, 12 nt, Salmonella typhimurium LT2
acgcagccaugu

SEQ ID NO: 3783927 - RNA, 11 nt, Salmonella typhimurium LT2
acgcagcccca

SEQ ID NO: 3783928 - RNA, 17 nt, Salmonella typhimurium LT2
acgcagccgaggcuuaa

SEQ ID NO: 3783929 - RNA, 22 nt, Salmonella typhimurium LT2
acgcagccgaggcuuaauacag

SEQ ID NO: 3783930 - RNA, 12 nt, Salmonella typhimurium LT2
acgcagccgguc

SEQ ID NO: 3783931 - RNA, 13 nt, Salmonella typhimurium LT2
acgcagcggcauu

SEQ ID NO: 3783932 - RNA, 14 nt, Salmonella typhimurium LT2
acgcagcuccagcu

SEQ ID NO: 3783933 - RNA, 16 nt, Salmonella typhimurium LT2
acgcaggcauccgguu

SEQ ID NO: 3783934 - RNA, 22 nt, Salmonella typhimurium LT2
acgcaggcuaacgcgccccagg

SEQ ID NO: 3783935 - RNA, 17 nt, Salmonella typhimurium LT2
acgcaggcuuaaucccg

SEQ ID NO: 3783936 - RNA, 22 nt, Salmonella typhimurium LT2
acgcaggcuugcccauucgccg

SEQ ID NO: 3783937 - RNA, 20 nt, Salmonella typhimurium LT2
acgcagggccgcgagaacuu

SEQ ID NO: 3783938 - RNA, 19 nt, Salmonella typhimurium LT2
acgcaguaacgucgcauca

SEQ ID NO: 3783939 - RNA, 14 nt, Salmonella typhimurium LT2
acgcaguagcgcuu

SEQ ID NO: 3783940 - RNA, 19 nt, Salmonella typhimurium LT2
acgcagucaaaacgacaua

SEQ ID NO: 3783941 - RNA, 17 nt, Salmonella typhimurium LT2
acgcaguuuaucagaag

SEQ ID NO: 3783942 - RNA, 20 nt, Salmonella typhimurium LT2
acgcauaaugcgccccgcaa

SEQ ID NO: 3783943 - RNA, 15 nt, Salmonella typhimurium LT2
acgcauacgcagcac

SEQ ID NO: 3783944 - RNA, 17 nt, Salmonella typhimurium LT2
acgcauacgcagcacuu

SEQ ID NO: 3783945 - RNA, 20 nt, Salmonella typhimurium LT2
acgcauaucccacugcacgc

SEQ ID NO: 3783946 - RNA, 19 nt, Salmonella typhimurium LT2
acgcaucaaauaccuuuuc

SEQ ID NO: 3783947 - RNA, 14 nt, Salmonella typhimurium LT2
acgcauccugcacu

SEQ ID NO: 3783948 - RNA, 16 nt, Salmonella typhimurium LT2
acgcauccugcacuuu

SEQ ID NO: 3783949 - RNA, 15 nt, Salmonella typhimurium LT2
acgcaucuuuuuccc

SEQ ID NO: 3783950 - RNA, 16 nt, Salmonella typhimurium LT2
acgcaucuuuuucccg

SEQ ID NO: 3783951 - RNA, 18 nt, Salmonella typhimurium LT2
acgcauuaaaaugauggu

SEQ ID NO: 3783952 - RNA, 13 nt, Salmonella typhimurium LT2
acgccaaaaagug

SEQ ID NO: 3783953 - RNA, 15 nt, Salmonella typhimurium LT2
acgccaaaaagugaa

SEQ ID NO: 3783954 - RNA, 22 nt, Salmonella typhimurium LT2
acgccaaccaucggcacacuuu

SEQ ID NO: 3783955 - RNA, 15 nt, Salmonella typhimurium LT2
acgccaacucaacgc

SEQ ID NO: 3783956 - RNA, 16 nt, Salmonella typhimurium LT2
acgccaagcgcggcag

SEQ ID NO: 3783957 - RNA, 18 nt, Salmonella typhimurium LT2
acgccaagcgcggcagca

SEQ ID NO: 3783958 - RNA, 21 nt, Salmonella typhimurium LT2
acgccaagcgcggcagcagcu

SEQ ID NO: 3783959 - RNA, 14 nt, Salmonella typhimurium LT2
acgccaagcugcaa

SEQ ID NO: 3783960 - RNA, 15 nt, Salmonella typhimurium LT2
acgccaagcugcaau

SEQ ID NO: 3783961 - RNA, 15 nt, Salmonella typhimurium LT2
acgccuuucuucacg

SEQ ID NO: 3783962 - RNA, 17 nt, Salmonella typhimurium LT2
acgcgaaacgaaaccca

SEQ ID NO: 3783963 - RNA, 17 nt, Salmonella typhimurium LT2
acgcgaagauuaauccg

SEQ ID NO: 3783964 - RNA, 23 nt, Salmonella typhimurium LT2
acgcgaagauuaauccggucauc

SEQ ID NO: 3783965 - RNA, 16 nt, Salmonella typhimurium LT2
acgcgaaggccagcac

SEQ ID NO: 3783966 - RNA, 15 nt, Salmonella typhimurium LT2
acgcgaauccgccau

SEQ ID NO: 3783967 - RNA, 16 nt, Salmonella typhimurium LT2
acgcgacaacgccgga

SEQ ID NO: 3783968 - RNA, 21 nt, Salmonella typhimurium LT2
acgcgacuuuccgccaccaga

SEQ ID NO: 3783969 - RNA, 18 nt, Salmonella typhimurium LT2
acgcgagaagcccggcca

SEQ ID NO: 3783970 - RNA, 22 nt, Salmonella typhimurium LT2
acgcgagcugccaguucauucc

SEQ ID NO: 3783971 - RNA, 14 nt, Salmonella typhimurium LT2
acgcgauagauacc

SEQ ID NO: 3783972 - RNA, 17 nt, Salmonella typhimurium LT2
acgcgauauguuugcgc

SEQ ID NO: 3783973 - RNA, 19 nt, Salmonella typhimurium LT2
acgcgauauguuugcgcgu

SEQ ID NO: 3783974 - RNA, 13 nt, Salmonella typhimurium LT2
acgcgaucgccgu

SEQ ID NO: 3783975 - RNA, 13 nt, Salmonella typhimurium LT2
acgcgaucgcgau

SEQ ID NO: 3783976 - RNA, 20 nt, Salmonella typhimurium LT2
acgcgaugcaaccccugacg

SEQ ID NO: 3783977 - RNA, 15 nt, Salmonella typhimurium LT2
acgcgcaaucagcac

SEQ ID NO: 3783978 - RNA, 17 nt, Salmonella typhimurium LT2
acgcgcagacgcgugau

SEQ ID NO: 3783979 - RNA, 17 nt, Salmonella typhimurium LT2
acgcgcaguacggcgca

SEQ ID NO: 3783980 - RNA, 20 nt, Salmonella typhimurium LT2
acgcgcaucaacgccaggca

SEQ ID NO: 3783981 - RNA, 14 nt, Salmonella typhimurium LT2
acgcgccacgccau

SEQ ID NO: 3783982 - RNA, 20 nt, Salmonella typhimurium LT2
acgcgccacuuccagcgcgc

SEQ ID NO: 3783983 - RNA, 15 nt, Salmonella typhimurium LT2
acgcgccagcaaaau

SEQ ID NO: 3783984 - RNA, 13 nt, Salmonella typhimurium LT2
acgcgccagcagu

SEQ ID NO: 3783985 - RNA, 21 nt, Salmonella typhimurium LT2
acgcgccagcagugggaaaau

SEQ ID NO: 3783986 - RNA, 21 nt, Salmonella typhimurium LT2
acgcgccaucgucaccggauc

SEQ ID NO: 3783987 - RNA, 17 nt, Salmonella typhimurium LT2
acgcgccgagguuuuca

SEQ ID NO: 3783988 - RNA, 22 nt, Salmonella typhimurium LT2
acgcgccgccaacgauacagca

SEQ ID NO: 3783989 - RNA, 18 nt, Salmonella typhimurium LT2
acgcgccgccagcgacuu

SEQ ID NO: 3783990 - RNA, 14 nt, Salmonella typhimurium LT2
acgcgccgcugcgu

SEQ ID NO: 3783991 - RNA, 12 nt, Salmonella typhimurium LT2
acgcgccggaag

SEQ ID NO: 3783992 - RNA, 18 nt, Salmonella typhimurium LT2
acgcgccuggaucugcgc

SEQ ID NO: 3783993 - RNA, 18 nt, Salmonella typhimurium LT2
acgcgcgagaacugcugc

SEQ ID NO: 3783994 - RNA, 23 nt, Salmonella typhimurium LT2
acgcgcgccggugaucccaccag

SEQ ID NO: 3783995 - RNA, 14 nt, Salmonella typhimurium LT2
acgcgcgcgaaaag

SEQ ID NO: 3783996 - RNA, 15 nt, Salmonella typhimurium LT2
acgcgcgcgcgucaa

SEQ ID NO: 3783997 - RNA, 18 nt, Salmonella typhimurium LT2
acgcgcgucgcuaaucag

SEQ ID NO: 3783998 - RNA, 14 nt, Salmonella typhimurium LT2
acgcgcuaaaugca

SEQ ID NO: 3783999 - RNA, 15 nt, Salmonella typhimurium LT2
acgcgcuaaaugcau

SEQ ID NO: 3784000 - RNA, 14 nt, Salmonella typhimurium LT2
acgcgcuagcuuca

SEQ ID NO: 3784001 - RNA, 16 nt, Salmonella typhimurium LT2
acgcgcuagcuucagg

SEQ ID NO: 3784002 - RNA, 21 nt, Salmonella typhimurium LT2
acgcgcuaucguugcgcgcaa

SEQ ID NO: 3784003 - RNA, 19 nt, Salmonella typhimurium LT2
acgcgcucaccuccgccac

SEQ ID NO: 3784004 - RNA, 18 nt, Salmonella typhimurium LT2
acgcgcucgccagcgcag

SEQ ID NO: 3784005 - RNA, 22 nt, Salmonella typhimurium LT2
acgcgcuguaacuucacgccau

SEQ ID NO: 3784006 - RNA, 14 nt, Salmonella typhimurium LT2
acgcgcuuguucgu

SEQ ID NO: 3784007 - RNA, 17 nt, Salmonella typhimurium LT2
acgcgcuuguucgucug

SEQ ID NO: 3784008 - RNA, 19 nt, Salmonella typhimurium LT2
acgcggaacuggugaaaca

SEQ ID NO: 3784009 - RNA, 12 nt, Salmonella typhimurium LT2
acgcggaaguau

SEQ ID NO: 3784010 - RNA, 23 nt, Salmonella typhimurium LT2
acgcggauugccgcccguacaga

SEQ ID NO: 3784011 - RNA, 12 nt, Salmonella typhimurium LT2
acgcggcgcgcu

SEQ ID NO: 3784012 - RNA, 15 nt, Salmonella typhimurium LT2
acgcggcgcuacggc

SEQ ID NO: 3784013 - RNA, 17 nt, Salmonella typhimurium LT2
acgcggcgcuacggcgc

SEQ ID NO: 3784014 - RNA, 17 nt, Salmonella typhimurium LT2
acgcggcguacgcugca

SEQ ID NO: 3784015 - RNA, 15 nt, Salmonella typhimurium LT2
acgcggcuuauccgg

SEQ ID NO: 3784016 - RNA, 14 nt, Salmonella typhimurium LT2
acgcggcuugccaa

SEQ ID NO: 3784017 - RNA, 22 nt, Salmonella typhimurium LT2
acgcgggaucgucaaugguugu

SEQ ID NO: 3784018 - RNA, 16 nt, Salmonella typhimurium LT2
acgcggguacgggacg

SEQ ID NO: 3784019 - RNA, 15 nt, Salmonella typhimurium LT2
acgcggucaggguga

SEQ ID NO: 3784020 - RNA, 21 nt, Salmonella typhimurium LT2
acgcggucuuuuaaaagaccu

SEQ ID NO: 3784021 - RNA, 22 nt, Salmonella typhimurium LT2
acgcggucuuuuaaaagaccug

SEQ ID NO: 3784022 - RNA, 19 nt, Salmonella typhimurium LT2
acgcgucagggcgauaaua

SEQ ID NO: 3784023 - RNA, 23 nt, Salmonella typhimurium LT2
acgcguccucguacccgguacac

SEQ ID NO: 3784024 - RNA, 17 nt, Salmonella typhimurium LT2
acgcgucggcgcgggga

SEQ ID NO: 3784025 - RNA, 22 nt, Salmonella typhimurium LT2
acgcgucggcgcggggaacaca

SEQ ID NO: 3784026 - RNA, 23 nt, Salmonella typhimurium LT2
acgcgucggcgcggggaacacaa

SEQ ID NO: 3784027 - RNA, 23 nt, Salmonella typhimurium LT2
acgcgucugucgaaacuggcauu

SEQ ID NO: 3784028 - RNA, 13 nt, Salmonella typhimurium LT2
acgcgugcgaauu

SEQ ID NO: 3784029 - RNA, 14 nt, Salmonella typhimurium LT2
acgcguucauccag

SEQ ID NO: 3784030 - RNA, 16 nt, Salmonella typhimurium LT2
acgcguucauccagcg

SEQ ID NO: 3784031 - RNA, 23 nt, Salmonella typhimurium LT2
acgcguuguccaacugucgccau

SEQ ID NO: 3784032 - RNA, 16 nt, Salmonella typhimurium LT2
acgcuaaaccacauga

SEQ ID NO: 3784033 - RNA, 15 nt, Salmonella typhimurium LT2
acgcuaaagucagca

SEQ ID NO: 3784034 - RNA, 21 nt, Salmonella typhimurium LT2
acgcuaaccucuauaguaaau

SEQ ID NO: 3784035 - RNA, 16 nt, Salmonella typhimurium LT2
acgcuaacguccgccg

SEQ ID NO: 3784036 - RNA, 14 nt, Salmonella typhimurium LT2
acgcuaaucccgcu

SEQ ID NO: 3784037 - RNA, 18 nt, Salmonella typhimurium LT2
acgcuacaccaagacgac

SEQ ID NO: 3784038 - RNA, 20 nt, Salmonella typhimurium LT2
acgcuauguuugcugagaau

SEQ ID NO: 3784039 - RNA, 15 nt, Salmonella typhimurium LT2
acgcuauuuaaaaac

SEQ ID NO: 3784040 - RNA, 20 nt, Salmonella typhimurium LT2
acgcucaacgcguucaucca

SEQ ID NO: 3784041 - RNA, 23 nt, Salmonella typhimurium LT2
acgcucaacgcguucauccagcg

SEQ ID NO: 3784042 - RNA, 13 nt, Salmonella typhimurium LT2
acgcucacgcgca

SEQ ID NO: 3784043 - RNA, 12 nt, Salmonella typhimurium LT2
acgcucacuuuu

SEQ ID NO: 3784044 - RNA, 23 nt, Salmonella typhimurium LT2
acgcucauuaaaccgcgcggcau

SEQ ID NO: 3784045 - RNA, 18 nt, Salmonella typhimurium LT2
acgcuccagcuggcuggc

SEQ ID NO: 3784046 - RNA, 22 nt, Salmonella typhimurium LT2
acgcucccggaaccgaccgcga

SEQ ID NO: 3784047 - RNA, 15 nt, Salmonella typhimurium LT2
acgcuccggcaggca

SEQ ID NO: 3784048 - RNA, 15 nt, Salmonella typhimurium LT2
acgcuccugcuccug

SEQ ID NO: 3784049 - RNA, 11 nt, Salmonella typhimurium LT2
acgcuccugga

SEQ ID NO: 3784050 - RNA, 18 nt, Salmonella typhimurium LT2
acgcuccuugagcgccug

SEQ ID NO: 3784051 - RNA, 22 nt, Salmonella typhimurium LT2
acgcucgcggaagcgaccggcg

SEQ ID NO: 3784052 - RNA, 14 nt, Salmonella typhimurium LT2
acgcucgcugaugg

SEQ ID NO: 3784053 - RNA, 18 nt, Salmonella typhimurium LT2
acgcucuucgccaaucgc

SEQ ID NO: 3784054 - RNA, 23 nt, Salmonella typhimurium LT2
acgcugaauaucgucaguaugca

SEQ ID NO: 3784055 - RNA, 17 nt, Salmonella typhimurium LT2
acgcugaauaucuucac

SEQ ID NO: 3784056 - RNA, 15 nt, Salmonella typhimurium LT2
acgcugaccacgccg

SEQ ID NO: 3784057 - RNA, 16 nt, Salmonella typhimurium LT2
acgcugacgcgaucgc

SEQ ID NO: 3784058 - RNA, 20 nt, Salmonella typhimurium LT2
acgcugauacguaacaugac

SEQ ID NO: 3784059 - RNA, 18 nt, Salmonella typhimurium LT2
acgcugauagccacggcg

SEQ ID NO: 3784060 - RNA, 17 nt, Salmonella typhimurium LT2
acgcugaugaaaaguau

SEQ ID NO: 3784061 - RNA, 18 nt, Salmonella typhimurium LT2
acgcugcaaaaagccuug

SEQ ID NO: 3784062 - RNA, 12 nt, Salmonella typhimurium LT2
acgcugcgccug

SEQ ID NO: 3784063 - RNA, 22 nt, Salmonella typhimurium LT2
acgcugcgccuggucuuccgca

SEQ ID NO: 3784064 - RNA, 15 nt, Salmonella typhimurium LT2
acgcugcggccugcc

SEQ ID NO: 3784065 - RNA, 15 nt, Salmonella typhimurium LT2
acggcuccagcgcca

SEQ ID NO: 3784066 - RNA, 16 nt, Salmonella typhimurium LT2
acggcuccagcgccag

SEQ ID NO: 3784067 - RNA, 13 nt, Salmonella typhimurium LT2
acggcugaagcug

SEQ ID NO: 3784068 - RNA, 21 nt, Salmonella typhimurium LT2
acggcugacgcccaucagcau

SEQ ID NO: 3784069 - RNA, 22 nt, Salmonella typhimurium LT2
acggcugccuuuguacagcuug

SEQ ID NO: 3784070 - RNA, 18 nt, Salmonella typhimurium LT2
acggcugucggucaggaa

SEQ ID NO: 3784071 - RNA, 15 nt, Salmonella typhimurium LT2
acggcuuaacgccag

SEQ ID NO: 3784072 - RNA, 19 nt, Salmonella typhimurium LT2
acggcuuuccagcagccag

SEQ ID NO: 3784073 - RNA, 20 nt, Salmonella typhimurium LT2
acggcuuuccagcagccaga

SEQ ID NO: 3784074 - RNA, 14 nt, Salmonella typhimurium LT2
acgggaaaucuccc

SEQ ID NO: 3784075 - RNA, 13 nt, Salmonella typhimurium LT2
acgggaacagaau

SEQ ID NO: 3784076 - RNA, 19 nt, Salmonella typhimurium LT2
acgggaacuuucgggcaaa

SEQ ID NO: 3784077 - RNA, 20 nt, Salmonella typhimurium LT2
acgggagagcguauccagca

SEQ ID NO: 3784078 - RNA, 22 nt, Salmonella typhimurium LT2
acgggcaagguuaugcagcaug

SEQ ID NO: 3784079 - RNA, 19 nt, Salmonella typhimurium LT2
acgggcacggucugcugac

SEQ ID NO: 3784080 - RNA, 20 nt, Salmonella typhimurium LT2
acgggcagcgggugcuccag

SEQ ID NO: 3784081 - RNA, 22 nt, Salmonella typhimurium LT2
acgggcauuguuaauccagagc

SEQ ID NO: 3784082 - RNA, 12 nt, Salmonella typhimurium LT2
acgggccaggcg

SEQ ID NO: 3784083 - RNA, 21 nt, Salmonella typhimurium LT2
acgggccuacgcgcauguucu

SEQ ID NO: 3784084 - RNA, 19 nt, Salmonella typhimurium LT2
acgggcgaugguguuggcg

SEQ ID NO: 3784085 - RNA, 17 nt, Salmonella typhimurium LT2
acgggcggaggggagga

SEQ ID NO: 3784086 - RNA, 16 nt, Salmonella typhimurium LT2
acgggcuaucaauaug

SEQ ID NO: 3784087 - RNA, 15 nt, Salmonella typhimurium LT2
acgggcuuccaguac

SEQ ID NO: 3784088 - RNA, 20 nt, Salmonella typhimurium LT2
acgggggcgaucagcagguc

SEQ ID NO: 3784089 - RNA, 22 nt, Salmonella typhimurium LT2
acgggucgcuucggcgacccgu

SEQ ID NO: 3784090 - RNA, 19 nt, Salmonella typhimurium LT2
acgggucuacaucggaagc

SEQ ID NO: 3784091 - RNA, 16 nt, Salmonella typhimurium LT2
acgggugaucuuuaua

SEQ ID NO: 3784092 - RNA, 19 nt, Salmonella typhimurium LT2
acggguuuuacuggcgcgc

SEQ ID NO: 3784093 - RNA, 16 nt, Salmonella typhimurium LT2
acgguaaaccgcacgg

SEQ ID NO: 3784094 - RNA, 22 nt, Salmonella typhimurium LT2
acgguaacagcuugaucaucag

SEQ ID NO: 3784095 - RNA, 20 nt, Salmonella typhimurium LT2
acgguaaccauuuccggauc

SEQ ID NO: 3784096 - RNA, 21 nt, Salmonella typhimurium LT2
acgguaaguugaaaggaaagg

SEQ ID NO: 3784097 - RNA, 16 nt, Salmonella typhimurium LT2
acgguaauauugagca

SEQ ID NO: 3784098 - RNA, 20 nt, Salmonella typhimurium LT2
acgguaauugccgggaaaac

SEQ ID NO: 3784099 - RNA, 14 nt, Salmonella typhimurium LT2
acgguaccugaagc

SEQ ID NO: 3784100 - RNA, 22 nt, Salmonella typhimurium LT2
acgguaucagcgcguuuuccau

SEQ ID NO: 3784101 - RNA, 13 nt, Salmonella typhimurium LT2
acgguaugaaaca

SEQ ID NO: 3784102 - RNA, 19 nt, Salmonella typhimurium LT2
acgguaugaaacauauaua

SEQ ID NO: 3784103 - RNA, 12 nt, Salmonella typhimurium LT2
acgguauuucca

SEQ ID NO: 3784104 - RNA, 21 nt, Salmonella typhimurium LT2
acggucaaacagauccagcgc

SEQ ID NO: 3784105 - RNA, 23 nt, Salmonella typhimurium LT2
acggucaaacagauccagcgccg

SEQ ID NO: 3784106 - RNA, 14 nt, Salmonella typhimurium LT2
acggucaaucauca

SEQ ID NO: 3784107 - RNA, 15 nt, Salmonella typhimurium LT2
acggucaaucaucag

SEQ ID NO: 3784108 - RNA, 20 nt, Salmonella typhimurium LT2
acggucauaucgucaucggu

SEQ ID NO: 3784109 - RNA, 19 nt, Salmonella typhimurium LT2
acgguccguuuucgccccc

SEQ ID NO: 3784110 - RNA, 17 nt, Salmonella typhimurium LT2
acggucgacaccagcga

SEQ ID NO: 3784111 - RNA, 15 nt, Salmonella typhimurium LT2
acgguguggcccagc

SEQ ID NO: 3784112 - RNA, 23 nt, Salmonella typhimurium LT2
acgguuaaugaaaucgucgccaa

SEQ ID NO: 3784113 - RNA, 21 nt, Salmonella typhimurium LT2
acgguuggcuauacgcggcgu

SEQ ID NO: 3784114 - RNA, 23 nt, Salmonella typhimurium LT2
acgguuguguauccauagucagc

SEQ ID NO: 3784115 - RNA, 16 nt, Salmonella typhimurium LT2
acgguuucagcagcgg

SEQ ID NO: 3784116 - RNA, 19 nt, Salmonella typhimurium LT2
acgguuucagugauaaagc

SEQ ID NO: 3784117 - RNA, 22 nt, Salmonella typhimurium LT2
acgguuucuacuuccaccaccu

SEQ ID NO: 3784118 - RNA, 17 nt, Salmonella typhimurium LT2
acgguuuuaacaacccg

SEQ ID NO: 3784119 - RNA, 17 nt, Salmonella typhimurium LT2
acgguuuucacuggcau

SEQ ID NO: 3784120 - RNA, 22 nt, Salmonella typhimurium LT2
acguaaagcuggccuucagguu

SEQ ID NO: 3784121 - RNA, 13 nt, Salmonella typhimurium LT2
acguaaauaccca

SEQ ID NO: 3784122 - RNA, 13 nt, Salmonella typhimurium LT2
acguaaaucugaa

SEQ ID NO: 3784123 - RNA, 23 nt, Salmonella typhimurium LT2
acguaaaucugaaauaaaagcaa

SEQ ID NO: 3784124 - RNA, 21 nt, Salmonella typhimurium LT2
acguaaauuacuuaugauaua

SEQ ID NO: 3784125 - RNA, 14 nt, Salmonella typhimurium LT2
acguaacagacgca

SEQ ID NO: 3784126 - RNA, 16 nt, Salmonella typhimurium LT2
acguaacaugaccugc

SEQ ID NO: 3784127 - RNA, 20 nt, Salmonella typhimurium LT2
acguaacgguguuucaucuu

SEQ ID NO: 3784128 - RNA, 22 nt, Salmonella typhimurium LT2
acguaacucggcagcgcgacau

SEQ ID NO: 3784129 - RNA, 21 nt, Salmonella typhimurium LT2
acguaacugcgguaaauaaug

SEQ ID NO: 3784130 - RNA, 15 nt, Salmonella typhimurium LT2
acguaacuuauccac

SEQ ID NO: 3784131 - RNA, 13 nt, Salmonella typhimurium LT2
acguaauaccuga

SEQ ID NO: 3784132 - RNA, 13 nt, Salmonella typhimurium LT2
acguaaugcgaaa

SEQ ID NO: 3784133 - RNA, 16 nt, Salmonella typhimurium LT2
acguaaugcgaaaaac

SEQ ID NO: 3784134 - RNA, 22 nt, Salmonella typhimurium LT2
acguacagguugugcaucuccu

SEQ ID NO: 3784135 - RNA, 13 nt, Salmonella typhimurium LT2
acguaccggcaac

SEQ ID NO: 3784136 - RNA, 12 nt, Salmonella typhimurium LT2
acguacugcacc

SEQ ID NO: 3784137 - RNA, 23 nt, Salmonella typhimurium LT2
acguagcccauugucaucaguau

SEQ ID NO: 3784138 - RNA, 19 nt, Salmonella typhimurium LT2
acguagcucgcccagcacu

SEQ ID NO: 3784139 - RNA, 18 nt, Salmonella typhimurium LT2
acguagucguuguaggcc

SEQ ID NO: 3784140 - RNA, 23 nt, Salmonella typhimurium LT2
acguagucguuguaggccugaua

SEQ ID NO: 3784141 - RNA, 17 nt, Salmonella typhimurium LT2
acguauaauaauauccu

SEQ ID NO: 3784142 - RNA, 13 nt, Salmonella typhimurium LT2
acguauuaucccg

SEQ ID NO: 3784143 - RNA, 20 nt, Salmonella typhimurium LT2
acguauuucgcagcgaucag

SEQ ID NO: 3784144 - RNA, 11 nt, Salmonella typhimurium LT2
acgucaccauc

SEQ ID NO: 3784145 - RNA, 12 nt, Salmonella typhimurium LT2
acgucaccauca

SEQ ID NO: 3784146 - RNA, 18 nt, Salmonella typhimurium LT2
acgucaccaucaacauca

SEQ ID NO: 3784147 - RNA, 15 nt, Salmonella typhimurium LT2
acgucacgugacgca

SEQ ID NO: 3784148 - RNA, 19 nt, Salmonella typhimurium LT2
acgucacgugacgcagacg

SEQ ID NO: 3784149 - RNA, 12 nt, Salmonella typhimurium LT2
acgucacuguca

SEQ ID NO: 3784150 - RNA, 16 nt, Salmonella typhimurium LT2
acgucacugucagcau

SEQ ID NO: 3784151 - RNA, 18 nt, Salmonella typhimurium LT2
acgucacugucagcauca

SEQ ID NO: 3784152 - RNA, 12 nt, Salmonella typhimurium LT2
acgucagcaaua

SEQ ID NO: 3784153 - RNA, 20 nt, Salmonella typhimurium LT2
acgucagcccaaaacgcgcc

SEQ ID NO: 3784154 - RNA, 20 nt, Salmonella typhimurium LT2
acgucagccgggauaaucag

SEQ ID NO: 3784155 - RNA, 22 nt, Salmonella typhimurium LT2
acgucagccgggauaaucaggu

SEQ ID NO: 3784156 - RNA, 12 nt, Salmonella typhimurium LT2
acgucagcugga

SEQ ID NO: 3784157 - RNA, 15 nt, Salmonella typhimurium LT2
acgucauaacgcgca

SEQ ID NO: 3784158 - RNA, 22 nt, Salmonella typhimurium LT2
acgucauaucauccagccccgg

SEQ ID NO: 3784159 - RNA, 22 nt, Salmonella typhimurium LT2
acgucaucaccaguugaccaaa

SEQ ID NO: 3784160 - RNA, 14 nt, Salmonella typhimurium LT2
acgucaucaugaaa

SEQ ID NO: 3784161 - RNA, 19 nt, Salmonella typhimurium LT2
acgucaucaugcugcugau

SEQ ID NO: 3784162 - RNA, 19 nt, Salmonella typhimurium LT2
acgucaugaccgguuuuuc

SEQ ID NO: 3784163 - RNA, 10 nt, Salmonella typhimurium LT2
acgucaugcc

SEQ ID NO: 3784164 - RNA, 11 nt, Salmonella typhimurium LT2
acgucaugccg

SEQ ID NO: 3784165 - RNA, 18 nt, Salmonella typhimurium LT2
acgucauuuuuucaauuu

SEQ ID NO: 3784166 - RNA, 15 nt, Salmonella typhimurium LT2
acguccauccgggua

SEQ ID NO: 3784167 - RNA, 16 nt, Salmonella typhimurium LT2
acgucgaaaaucacug

SEQ ID NO: 3784168 - RNA, 14 nt, Salmonella typhimurium LT2
acgucgaugaaacg

SEQ ID NO: 3784169 - RNA, 18 nt, Salmonella typhimurium LT2
acugacacgccaguucau

SEQ ID NO: 3784170 - RNA, 13 nt, Salmonella typhimurium LT2
acugaccagaccg

SEQ ID NO: 3784171 - RNA, 17 nt, Salmonella typhimurium LT2
acugacccgccagugcu

SEQ ID NO: 3784172 - RNA, 20 nt, Salmonella typhimurium LT2
acugacgacucucccaucaa

SEQ ID NO: 3784173 - RNA, 16 nt, Salmonella typhimurium LT2
acugacgcgccagcuc

SEQ ID NO: 3784174 - RNA, 15 nt, Salmonella typhimurium LT2
acugacggcgcucuu

SEQ ID NO: 3784175 - RNA, 21 nt, Salmonella typhimurium LT2
acugacggcgcucuuuacaua

SEQ ID NO: 3784176 - RNA, 16 nt, Salmonella typhimurium LT2
acugacuauccacagc

SEQ ID NO: 3784177 - RNA, 16 nt, Salmonella typhimurium LT2
acugagcgccaauuga

SEQ ID NO: 3784178 - RNA, 16 nt, Salmonella typhimurium LT2
acugagcuaacgaccc

SEQ ID NO: 3784179 - RNA, 21 nt, Salmonella typhimurium LT2
acugaguauuggcaagaauca

SEQ ID NO: 3784180 - RNA, 18 nt, Salmonella typhimurium LT2
acugaguuucaccgccag

SEQ ID NO: 3784181 - RNA, 20 nt, Salmonella typhimurium LT2
acugauaccccagcgauccc

SEQ ID NO: 3784182 - RNA, 23 nt, Salmonella typhimurium LT2
acugauaguccaucaccucuucg

SEQ ID NO: 3784183 - RNA, 15 nt, Salmonella typhimurium LT2
acugauaguuuaaau

SEQ ID NO: 3784184 - RNA, 17 nt, Salmonella typhimurium LT2
acugauaucuaugguaa

SEQ ID NO: 3784185 - RNA, 14 nt, Salmonella typhimurium LT2
acugaugaucauug

SEQ ID NO: 3784186 - RNA, 24 nt, Salmonella typhimurium LT2
acugauggcguggcgcaguaaagg

SEQ ID NO: 3784187 - RNA, 13 nt, Salmonella typhimurium LT2
acugauggcuggc

SEQ ID NO: 3784188 - RNA, 15 nt, Salmonella typhimurium LT2
acugauuaauugcga

SEQ ID NO: 3784189 - RNA, 18 nt, Salmonella typhimurium LT2
acugauuaauugcgacaa

SEQ ID NO: 3784190 - RNA, 17 nt, Salmonella typhimurium LT2
acugauucaaaagguga

SEQ ID NO: 3784191 - RNA, 18 nt, Salmonella typhimurium LT2
acugauuccugccagacc

SEQ ID NO: 3784192 - RNA, 20 nt, Salmonella typhimurium LT2
acugauuuugccgauacugc

SEQ ID NO: 3784193 - RNA, 13 nt, Salmonella typhimurium LT2
acugcaaauacca

SEQ ID NO: 3784194 - RNA, 16 nt, Salmonella typhimurium LT2
acugcaaauaccacau

SEQ ID NO: 3784195 - RNA, 19 nt, Salmonella typhimurium LT2
acugcaaaucuucggcaaa

SEQ ID NO: 3784196 - RNA, 22 nt, Salmonella typhimurium LT2
acugcaaccgacgaacaaaaua

SEQ ID NO: 3784197 - RNA, 13 nt, Salmonella typhimurium LT2
acugcaacgccag

SEQ ID NO: 3784198 - RNA, 16 nt, Salmonella typhimurium LT2
acugcaacgccagaug

SEQ ID NO: 3784199 - RNA, 15 nt, Salmonella typhimurium LT2
acugcaccaaauccu

SEQ ID NO: 3784200 - RNA, 22 nt, Salmonella typhimurium LT2
acugcaccaaauccuccagcgg

SEQ ID NO: 3784201 - RNA, 15 nt, Salmonella typhimurium LT2
acugcacgccagggu

SEQ ID NO: 3784202 - RNA, 22 nt, Salmonella typhimurium LT2
acugcacgccaggguaauacug

SEQ ID NO: 3784203 - RNA, 24 nt, Salmonella typhimurium LT2
acugcagugucaaauuguacuuuu

SEQ ID NO: 3784204 - RNA, 15 nt, Salmonella typhimurium LT2
acugccagaccggcg

SEQ ID NO: 3784205 - RNA, 20 nt, Salmonella typhimurium LT2
acugcccagagaauauuggc

SEQ ID NO: 3784206 - RNA, 16 nt, Salmonella typhimurium LT2
acugccccgccacagc

SEQ ID NO: 3784207 - RNA, 13 nt, Salmonella typhimurium LT2
acugcccggcaua

SEQ ID NO: 3784208 - RNA, 21 nt, Salmonella typhimurium LT2
acugccgcccaucgccacagc

SEQ ID NO: 3784209 - RNA, 23 nt, Salmonella typhimurium LT2
acugccgcccaucgccacagcgg

SEQ ID NO: 3784210 - RNA, 15 nt, Salmonella typhimurium LT2
acugccguagcgcau

SEQ ID NO: 3784211 - RNA, 16 nt, Salmonella typhimurium LT2
acugccguauccaggg

SEQ ID NO: 3784212 - RNA, 13 nt, Salmonella typhimurium LT2
acugcgaauuucc

SEQ ID NO: 3784213 - RNA, 22 nt, Salmonella typhimurium LT2
acugcgaauuuccugccagacc

SEQ ID NO: 3784214 - RNA, 15 nt, Salmonella typhimurium LT2
acugcgccacaucau

SEQ ID NO: 3784215 - RNA, 12 nt, Salmonella typhimurium LT2
acugcgcccgca

SEQ ID NO: 3784216 - RNA, 18 nt, Salmonella typhimurium LT2
acugcgcgaaauacggac

SEQ ID NO: 3784217 - RNA, 22 nt, Salmonella typhimurium LT2
acugcgcgccgaagcugaccag

SEQ ID NO: 3784218 - RNA, 17 nt, Salmonella typhimurium LT2
acugcgcucuaucaccg

SEQ ID NO: 3784219 - RNA, 20 nt, Salmonella typhimurium LT2
acugcgcucuaucaccgccc

SEQ ID NO: 3784220 - RNA, 13 nt, Salmonella typhimurium LT2
acugcguaagcau

SEQ ID NO: 3784221 - RNA, 16 nt, Salmonella typhimurium LT2
acugcguaaucuuuuc

SEQ ID NO: 3784222 - RNA, 22 nt, Salmonella typhimurium LT2
acugcguuugaaauaccaggcg

SEQ ID NO: 3784223 - RNA, 13 nt, Salmonella typhimurium LT2
acugcuaguggau

SEQ ID NO: 3784224 - RNA, 20 nt, Salmonella typhimurium LT2
acugcucauaacccuccugc

SEQ ID NO: 3784225 - RNA, 19 nt, Salmonella typhimurium LT2
acugcugacaaucagcaca

SEQ ID NO: 3784226 - RNA, 20 nt, Salmonella typhimurium LT2
acugcugcguaaagaucugc

SEQ ID NO: 3784227 - RNA, 14 nt, Salmonella typhimurium LT2
acugcuggcgagca

SEQ ID NO: 3784228 - RNA, 21 nt, Salmonella typhimurium LT2
acugcuggcgagcagaaaaag

SEQ ID NO: 3784229 - RNA, 17 nt, Salmonella typhimurium LT2
acugcuguacgcuacug

SEQ ID NO: 3784230 - RNA, 23 nt, Salmonella typhimurium LT2
acugcuuaaauuuuuugccgcuc

SEQ ID NO: 3784231 - RNA, 20 nt, Salmonella typhimurium LT2
acugcuuagcucaucagccu

SEQ ID NO: 3784232 - RNA, 21 nt, Salmonella typhimurium LT2
acugcuuguuuaauggcagaa

SEQ ID NO: 3784233 - RNA, 14 nt, Salmonella typhimurium LT2
acugcuuugaucac

SEQ ID NO: 3784234 - RNA, 20 nt, Salmonella typhimurium LT2
acugcuuuuccggcagcgca

SEQ ID NO: 3784235 - RNA, 14 nt, Salmonella typhimurium LT2
acuggaaaaagacc

SEQ ID NO: 3784236 - RNA, 16 nt, Salmonella typhimurium LT2
acuggaaaaagaccaa

SEQ ID NO: 3784237 - RNA, 19 nt, Salmonella typhimurium LT2
acuggaaaaagaccaauac

SEQ ID NO: 3784238 - RNA, 20 nt, Salmonella typhimurium LT2
acuggaauaguuacggacau

SEQ ID NO: 3784239 - RNA, 22 nt, Salmonella typhimurium LT2
acuggacaacauuucgcacccu

SEQ ID NO: 3784240 - RNA, 18 nt, Salmonella typhimurium LT2
acuggcaguaaaaagaaa

SEQ ID NO: 3784241 - RNA, 12 nt, Salmonella typhimurium LT2
acuggccuccca

SEQ ID NO: 3784242 - RNA, 16 nt, Salmonella typhimurium LT2
acuggccucccaguuc

SEQ ID NO: 3784243 - RNA, 18 nt, Salmonella typhimurium LT2
acuggccuuuuuuuuacc

SEQ ID NO: 3784244 - RNA, 16 nt, Salmonella typhimurium LT2
acuggcgaccggcagc

SEQ ID NO: 3784245 - RNA, 21 nt, Salmonella typhimurium LT2
acuggcggcaaaaacgccggu

SEQ ID NO: 3784246 - RNA, 13 nt, Salmonella typhimurium LT2
acuggcggcgcac

SEQ ID NO: 3784247 - RNA, 23 nt, Salmonella typhimurium LT2
acuggcggcucagggcaaagucu

SEQ ID NO: 3784248 - RNA, 15 nt, Salmonella typhimurium LT2
acuggcuuucaucca

SEQ ID NO: 3784249 - RNA, 17 nt, Salmonella typhimurium LT2
acuggcuuuccugauca

SEQ ID NO: 3784250 - RNA, 20 nt, Salmonella typhimurium LT2
acugggcgagggaggcaauc

SEQ ID NO: 3784251 - RNA, 14 nt, Salmonella typhimurium LT2
acugggugccauga

SEQ ID NO: 3784252 - RNA, 18 nt, Salmonella typhimurium LT2
acuggucaaacaaaucau

SEQ ID NO: 3784253 - RNA, 15 nt, Salmonella typhimurium LT2
acuggucgcagccca

SEQ ID NO: 3784254 - RNA, 19 nt, Salmonella typhimurium LT2
acuggugcccgcaaaaccu

SEQ ID NO: 3784255 - RNA, 21 nt, Salmonella typhimurium LT2
acugguucaacaucagcgcua

SEQ ID NO: 3784256 - RNA, 17 nt, Salmonella typhimurium LT2
acugguuuguugcgucu

SEQ ID NO: 3784257 - RNA, 14 nt, Salmonella typhimurium LT2
acuguaaaucugcc

SEQ ID NO: 3784258 - RNA, 12 nt, Salmonella typhimurium LT2
acuguaaauugc

SEQ ID NO: 3784259 - RNA, 17 nt, Salmonella typhimurium LT2
acuguacgccacggcuu

SEQ ID NO: 3784260 - RNA, 21 nt, Salmonella typhimurium LT2
acuguacgccacggcuuaaau

SEQ ID NO: 3784261 - RNA, 22 nt, Salmonella typhimurium LT2
acuguagcgccgcuuccaggcg

SEQ ID NO: 3784262 - RNA, 19 nt, Salmonella typhimurium LT2
acuguagcugagcggcaau

SEQ ID NO: 3784263 - RNA, 19 nt, Salmonella typhimurium LT2
acuguccacgacagaaccc

SEQ ID NO: 3784264 - RNA, 15 nt, Salmonella typhimurium LT2
acuguccagaucuuc

SEQ ID NO: 3784265 - RNA, 15 nt, Salmonella typhimurium LT2
acugucccgaauauu

SEQ ID NO: 3784266 - RNA, 16 nt, Salmonella typhimurium LT2
acugucgccaggccau

SEQ ID NO: 3784267 - RNA, 23 nt, Salmonella typhimurium LT2
acugucggcuauguagcgcugaa

SEQ ID NO: 3784268 - RNA, 13 nt, Salmonella typhimurium LT2
acugucgggcaaa

SEQ ID NO: 3784269 - RNA, 18 nt, Salmonella typhimurium LT2
acugugacgacaguuuug

SEQ ID NO: 3784270 - RNA, 21 nt, Salmonella typhimurium LT2
acugugaggcgucuuccagca

SEQ ID NO: 3784271 - RNA, 16 nt, Salmonella typhimurium LT2
acugugcgaagguggc

SEQ ID NO: 3784272 - RNA, 22 nt, Salmonella typhimurium LT2
acugugcugauuuuggcuucac

SEQ ID NO: 3784273 - RNA, 18 nt, Salmonella typhimurium LT2
agaaacggaaaucacgca

SEQ ID NO: 3784274 - RNA, 17 nt, Salmonella typhimurium LT2
agaaacugcuguagcac

SEQ ID NO: 3784275 - RNA, 23 nt, Salmonella typhimurium LT2
agaaacuucugcacuuugccaga

SEQ ID NO: 3784276 - RNA, 22 nt, Salmonella typhimurium LT2
agaaaggcgcgcacaugcagcg

SEQ ID NO: 3784277 - RNA, 18 nt, Salmonella typhimurium LT2
agaaaggggagggcaaca

SEQ ID NO: 3784278 - RNA, 12 nt, Salmonella typhimurium LT2
agaaauaaaaua

SEQ ID NO: 3784279 - RNA, 14 nt, Salmonella typhimurium LT2
agaaauaaaauacg

SEQ ID NO: 3784280 - RNA, 14 nt, Salmonella typhimurium LT2
agaaauaacucccu

SEQ ID NO: 3784281 - RNA, 14 nt, Salmonella typhimurium LT2
agaaaucaacgaaa

SEQ ID NO: 3784282 - RNA, 18 nt, Salmonella typhimurium LT2
agaaaucaacgaaaucag

SEQ ID NO: 3784283 - RNA, 12 nt, Salmonella typhimurium LT2
agaaaucgccgg

SEQ ID NO: 3784284 - RNA, 13 nt, Salmonella typhimurium LT2
agaaaugcagggg

SEQ ID NO: 3784285 - RNA, 14 nt, Salmonella typhimurium LT2
agaaauuaaaucau

SEQ ID NO: 3784286 - RNA, 17 nt, Salmonella typhimurium LT2
agaaauuaaaucaucuu

SEQ ID NO: 3784287 - RNA, 16 nt, Salmonella typhimurium LT2
agaaauuauuuuaaau

SEQ ID NO: 3784288 - RNA, 21 nt, Salmonella typhimurium LT2
agaaauuauuuuaaauuuccu

SEQ ID NO: 3784289 - RNA, 13 nt, Salmonella typhimurium LT2
agaaauucugcag

SEQ ID NO: 3784290 - RNA, 21 nt, Salmonella typhimurium LT2
agaaauucugcaggccaaaua

SEQ ID NO: 3784291 - RNA, 21 nt, Salmonella typhimurium LT2
agaacacccagaucgcgaucc

SEQ ID NO: 3784292 - RNA, 13 nt, Salmonella typhimurium LT2
agaacaucaucuu

SEQ ID NO: 3784293 - RNA, 19 nt, Salmonella typhimurium LT2
agaacaugaaauggcauga

SEQ ID NO: 3784294 - RNA, 17 nt, Salmonella typhimurium LT2
agaaccaacgucaucau

SEQ ID NO: 3784295 - RNA, 22 nt, Salmonella typhimurium LT2
agaaccgacugucgaaaccagc

SEQ ID NO: 3784296 - RNA, 23 nt, Salmonella typhimurium LT2
agaaccguugcgcccaucaucau

SEQ ID NO: 3784297 - RNA, 22 nt, Salmonella typhimurium LT2
agaaccucacggagaaaagcga

SEQ ID NO: 3784298 - RNA, 23 nt, Salmonella typhimurium LT2
agaaccucacggagaaaagcgaa

SEQ ID NO: 3784299 - RNA, 20 nt, Salmonella typhimurium LT2
agaacgacgaauaagcugaa

SEQ ID NO: 3784300 - RNA, 14 nt, Salmonella typhimurium LT2
agaacgagaggagg

SEQ ID NO: 3784301 - RNA, 19 nt, Salmonella typhimurium LT2
agaacgccgggccugccag

SEQ ID NO: 3784302 - RNA, 21 nt, Salmonella typhimurium LT2
agaacggaaguugcauauaag

SEQ ID NO: 3784303 - RNA, 13 nt, Salmonella typhimurium LT2
agaacuaucugaa

SEQ ID NO: 3784304 - RNA, 23 nt, Salmonella typhimurium LT2
agaacucacauauucaauaauau

SEQ ID NO: 3784305 - RNA, 14 nt, Salmonella typhimurium LT2
agaacucaggcaaa

SEQ ID NO: 3784306 - RNA, 18 nt, Salmonella typhimurium LT2
agaacucguugccagaaa

SEQ ID NO: 3784307 - RNA, 18 nt, Salmonella typhimurium LT2
agaacugcaaauaccaca

SEQ ID NO: 3784308 - RNA, 22 nt, Salmonella typhimurium LT2
agaacugcguaagcauccccac

SEQ ID NO: 3784309 - RNA, 22 nt, Salmonella typhimurium LT2
agaacugcugcauccgcgcuuu

SEQ ID NO: 3784310 - RNA, 16 nt, Salmonella typhimurium LT2
agaacuggcgcgauga

SEQ ID NO: 3784311 - RNA, 18 nt, Salmonella typhimurium LT2
agaacuggcgcgaugacu

SEQ ID NO: 3784312 - RNA, 15 nt, Salmonella typhimurium LT2
agaacuuggcuuccu

SEQ ID NO: 3784313 - RNA, 13 nt, Salmonella typhimurium LT2
agaagaaaaaauu

SEQ ID NO: 3784314 - RNA, 16 nt, Salmonella typhimurium LT2
agaagaauaagccgga

SEQ ID NO: 3784315 - RNA, 15 nt, Salmonella typhimurium LT2
agaagagaauggcca

SEQ ID NO: 3784316 - RNA, 20 nt, Salmonella typhimurium LT2
agaagcacgacacaaaagca

SEQ ID NO: 3784317 - RNA, 21 nt, Salmonella typhimurium LT2
agaagccuuuuuucaccaguu

SEQ ID NO: 3784318 - RNA, 15 nt, Salmonella typhimurium LT2
agaagcgcacuuucc

SEQ ID NO: 3784319 - RNA, 17 nt, Salmonella typhimurium LT2
agaagcgccugucuauu

SEQ ID NO: 3784320 - RNA, 21 nt, Salmonella typhimurium LT2
agaagcgcugguaaauccggc

SEQ ID NO: 3784321 - RNA, 23 nt, Salmonella typhimurium LT2
agaagcgucauaaguguuuuaag

SEQ ID NO: 3784322 - RNA, 15 nt, Salmonella typhimurium LT2
agaagcuuaccaccu

SEQ ID NO: 3784323 - RNA, 22 nt, Salmonella typhimurium LT2
agaagggagguauaaucagcau

SEQ ID NO: 3784324 - RNA, 23 nt, Salmonella typhimurium LT2
agaaggucagguuaugcgcgcca

SEQ ID NO: 3784325 - RNA, 17 nt, Salmonella typhimurium LT2
agaaguaaacagaauca

SEQ ID NO: 3784326 - RNA, 17 nt, Salmonella typhimurium LT2
agaaguagcagagaaaa

SEQ ID NO: 3784327 - RNA, 19 nt, Salmonella typhimurium LT2
agaagucgaaggcgcagcc

SEQ ID NO: 3784328 - RNA, 18 nt, Salmonella typhimurium LT2
agaagucugugaggaaag

SEQ ID NO: 3784329 - RNA, 19 nt, Salmonella typhimurium LT2
agaagucugugaggaaagc

SEQ ID NO: 3784330 - RNA, 16 nt, Salmonella typhimurium LT2
agaagugccaguaacu

SEQ ID NO: 3784331 - RNA, 15 nt, Salmonella typhimurium LT2
agaaguguacaaaca

SEQ ID NO: 3784332 - RNA, 18 nt, Salmonella typhimurium LT2
agaaguguacaaacacgu

SEQ ID NO: 3784333 - RNA, 21 nt, Salmonella typhimurium LT2
agaauaaaaagugcgcacuca

SEQ ID NO: 3784334 - RNA, 13 nt, Salmonella typhimurium LT2
agaauaacaaucu

SEQ ID NO: 3784335 - RNA, 15 nt, Salmonella typhimurium LT2
agaauaacaaucugc

SEQ ID NO: 3784336 - RNA, 21 nt, Salmonella typhimurium LT2
agaauaacguuuaacgcgugc

SEQ ID NO: 3784337 - RNA, 15 nt, Salmonella typhimurium LT2
agaauaagccagguu

SEQ ID NO: 3784338 - RNA, 21 nt, Salmonella typhimurium LT2
agaauaaugcuggcggagcca

SEQ ID NO: 3784339 - RNA, 22 nt, Salmonella typhimurium LT2
agaauacacuucucaacauuga

SEQ ID NO: 3784340 - RNA, 14 nt, Salmonella typhimurium LT2
agaauacgaauauu

SEQ ID NO: 3784341 - RNA, 15 nt, Salmonella typhimurium LT2
agaauaucggcgucg

SEQ ID NO: 3784342 - RNA, 13 nt, Salmonella typhimurium LT2
agaaucaccucuu

SEQ ID NO: 3784343 - RNA, 12 nt, Salmonella typhimurium LT2
agaaucacguaa

SEQ ID NO: 3784344 - RNA, 19 nt, Salmonella typhimurium LT2
agaaucagccgacggcgau

SEQ ID NO: 3784345 - RNA, 11 nt, Salmonella typhimurium LT2
agaaucagcgu

SEQ ID NO: 3784346 - RNA, 23 nt, Salmonella typhimurium LT2
agaauccacucggcgcugucguu

SEQ ID NO: 3784347 - RNA, 21 nt, Salmonella typhimurium LT2
agaauccggcgcucaucagac

SEQ ID NO: 3784348 - RNA, 17 nt, Salmonella typhimurium LT2
agaaucgaucagcuuaa

SEQ ID NO: 3784349 - RNA, 20 nt, Salmonella typhimurium LT2
agaaucgccaggaucgccgc

SEQ ID NO: 3784350 - RNA, 13 nt, Salmonella typhimurium LT2
agaaucgccaggc

SEQ ID NO: 3784351 - RNA, 22 nt, Salmonella typhimurium LT2
agaaucgccaggcgcagcaaac

SEQ ID NO: 3784352 - RNA, 11 nt, Salmonella typhimurium LT2
agaaucgccgu

SEQ ID NO: 3784353 - RNA, 20 nt, Salmonella typhimurium LT2
agaaucguggcgccaaaaag

SEQ ID NO: 3784354 - RNA, 21 nt, Salmonella typhimurium LT2
agaaucguggcgccaaaaagu

SEQ ID NO: 3784355 - RNA, 18 nt, Salmonella typhimurium LT2
agaaucucgaaacaauag

SEQ ID NO: 3784356 - RNA, 17 nt, Salmonella typhimurium LT2
agaaugaaaaaaaauua

SEQ ID NO: 3784357 - RNA, 14 nt, Salmonella typhimurium LT2
agaaugauaaugcc

SEQ ID NO: 3784358 - RNA, 17 nt, Salmonella typhimurium LT2
agaaugauaaugccgcu

SEQ ID NO: 3784359 - RNA, 13 nt, Salmonella typhimurium LT2
agaaugcccagca

SEQ ID NO: 3784360 - RNA, 14 nt, Salmonella typhimurium LT2
agaaugcccagcaa

SEQ ID NO: 3784361 - RNA, 13 nt, Salmonella typhimurium LT2
agaaugcccugcu

SEQ ID NO: 3784362 - RNA, 18 nt, Salmonella typhimurium LT2
agaaugcgagcaaaaccc

SEQ ID NO: 3784363 - RNA, 15 nt, Salmonella typhimurium LT2
agaaugcuccauugc

SEQ ID NO: 3784364 - RNA, 16 nt, Salmonella typhimurium LT2
agaauggaacaauaga

SEQ ID NO: 3784365 - RNA, 15 nt, Salmonella typhimurium LT2
agaauggccagcaca

SEQ ID NO: 3784366 - RNA, 16 nt, Salmonella typhimurium LT2
agaauggccagcacaa

SEQ ID NO: 3784367 - RNA, 24 nt, Salmonella typhimurium LT2
agaauggucgguauuaucaauggu

SEQ ID NO: 3784368 - RNA, 15 nt, Salmonella typhimurium LT2
agaaugucgccaugu

SEQ ID NO: 3784369 - RNA, 20 nt, Salmonella typhimurium LT2
agaauuacaucaauaaacau

SEQ ID NO: 3784370 - RNA, 20 nt, Salmonella typhimurium LT2
agaauuaccgguuucgguau

SEQ ID NO: 3784371 - RNA, 16 nt, Salmonella typhimurium LT2
agaauuauuaccaaug

SEQ ID NO: 3784372 - RNA, 13 nt, Salmonella typhimurium LT2
agaauucgcaaug

SEQ ID NO: 3784373 - RNA, 14 nt, Salmonella typhimurium LT2
agaauucguccaga

SEQ ID NO: 3784374 - RNA, 15 nt, Salmonella typhimurium LT2
agaauucugcgcguc

SEQ ID NO: 3784375 - RNA, 18 nt, Salmonella typhimurium LT2
agaauugcgccaccuuaa

SEQ ID NO: 3784376 - RNA, 13 nt, Salmonella typhimurium LT2
agaauuuccccag

SEQ ID NO: 3784377 - RNA, 19 nt, Salmonella typhimurium LT2
agagacuggcgacagccgc

SEQ ID NO: 3784378 - RNA, 16 nt, Salmonella typhimurium LT2
agagagaugucgcaau

SEQ ID NO: 3784379 - RNA, 19 nt, Salmonella typhimurium LT2
agagagcgggccguggcca

SEQ ID NO: 3784380 - RNA, 12 nt, Salmonella typhimurium LT2
agagaguuccuc

SEQ ID NO: 3784381 - RNA, 18 nt, Salmonella typhimurium LT2
agagaguuccuccuggcu

SEQ ID NO: 3784382 - RNA, 21 nt, Salmonella typhimurium LT2
agagauaauuuucccaguuca

SEQ ID NO: 3784383 - RNA, 12 nt, Salmonella typhimurium LT2
agagauagaacg

SEQ ID NO: 3784384 - RNA, 15 nt, Salmonella typhimurium LT2
agagauaucccaucg

SEQ ID NO: 3784385 - RNA, 23 nt, Salmonella typhimurium LT2
agagauaucccaucgacuuaaaa

SEQ ID NO: 3784386 - RNA, 13 nt, Salmonella typhimurium LT2
agagauccagaac

SEQ ID NO: 3784387 - RNA, 18 nt, Salmonella typhimurium LT2
agagcaacauaccgcaga

SEQ ID NO: 3784388 - RNA, 19 nt, Salmonella typhimurium LT2
agagcagcgccagcgacag

SEQ ID NO: 3784389 - RNA, 13 nt, Salmonella typhimurium LT2
agagcaggccaaa

SEQ ID NO: 3784390 - RNA, 16 nt, Salmonella typhimurium LT2
agagcaggccaaaaaa

SEQ ID NO: 3784391 - RNA, 19 nt, Salmonella typhimurium LT2
agagcaguacgccaaaaaa

SEQ ID NO: 3784392 - RNA, 14 nt, Salmonella typhimurium LT2
agagcaucaucugc

SEQ ID NO: 3784393 - RNA, 23 nt, Salmonella typhimurium LT2
agagccgcgcagcgcaacgccuu

SEQ ID NO: 3784394 - RNA, 21 nt, Salmonella typhimurium LT2
agagcgauaaacucagcgcca

SEQ ID NO: 3784395 - RNA, 17 nt, Salmonella typhimurium LT2
agagcgccugcaggcga

SEQ ID NO: 3784396 - RNA, 15 nt, Salmonella typhimurium LT2
agagcgcgcucugcc

SEQ ID NO: 3784397 - RNA, 20 nt, Salmonella typhimurium LT2
agagcgcuucuaacaaaaca

SEQ ID NO: 3784398 - RNA, 20 nt, Salmonella typhimurium LT2
agagcggcaacacauccggc

SEQ ID NO: 3784399 - RNA, 22 nt, Salmonella typhimurium LT2
agagcggcuacgccugauaagc

SEQ ID NO: 3784400 - RNA, 20 nt, Salmonella typhimurium LT2
agagcgggccguggccagga

SEQ ID NO: 3784401 - RNA, 21 nt, Salmonella typhimurium LT2
agagcggugacgauauuccgc

SEQ ID NO: 3784402 - RNA, 17 nt, Salmonella typhimurium LT2
agagcgucucauccggc

SEQ ID NO: 3784403 - RNA, 19 nt, Salmonella typhimurium LT2
agagcguuuguaaugccgu

SEQ ID NO: 3784404 - RNA, 19 nt, Salmonella typhimurium LT2
agaggaggagaugucccac

SEQ ID NO: 3784405 - RNA, 23 nt, Salmonella typhimurium LT2
agaggaucuggacgccaauuccu

SEQ ID NO: 3784406 - RNA, 11 nt, Salmonella typhimurium LT2
agaggcagcaa

SEQ ID NO: 3784407 - RNA, 18 nt, Salmonella typhimurium LT2
agaggcguugccgggcau

SEQ ID NO: 3784408 - RNA, 19 nt, Salmonella typhimurium LT2
agagguauccugaaccagc

SEQ ID NO: 3784409 - RNA, 15 nt, Salmonella typhimurium LT2
agagguguuaccggu

SEQ ID NO: 3784410 - RNA, 23 nt, Salmonella typhimurium LT2
agagguguuaccgguucaacugg

SEQ ID NO: 3784411 - RNA, 17 nt, Salmonella typhimurium LT2
agagguuaccgggcuaa

SEQ ID NO: 3784412 - RNA, 18 nt, Salmonella typhimurium LT2
agagguuagcgcaggggg

SEQ ID NO: 3784413 - RNA, 16 nt, Salmonella typhimurium LT2
agaguaaagaucgcac

SEQ ID NO: 3784414 - RNA, 11 nt, Salmonella typhimurium LT2
agaguaaccac

SEQ ID NO: 3784415 - RNA, 18 nt, Salmonella typhimurium LT2
agaguaacccuucagcuu

SEQ ID NO: 3784416 - RNA, 13 nt, Salmonella typhimurium LT2
agaguauugagac

SEQ ID NO: 3784417 - RNA, 18 nt, Salmonella typhimurium LT2
agaguccacagcccggcg

SEQ ID NO: 3784418 - RNA, 15 nt, Salmonella typhimurium LT2
agagucuaccgccgu

SEQ ID NO: 3784419 - RNA, 21 nt, Salmonella typhimurium LT2
agagucuuccgguaucccaaa

SEQ ID NO: 3784420 - RNA, 20 nt, Salmonella typhimurium LT2
agagugagcaacguuuuccu

SEQ ID NO: 3784421 - RNA, 22 nt, Salmonella typhimurium LT2
agagugauaguggcgucgccau

SEQ ID NO: 3784422 - RNA, 23 nt, Salmonella typhimurium LT2
agagugauaguggcgucgccaua

SEQ ID NO: 3784423 - RNA, 20 nt, Salmonella typhimurium LT2
agagugauccaccaccagca

SEQ ID NO: 3784424 - RNA, 23 nt, Salmonella typhimurium LT2
agagugcuucuucaaacuuagcg

SEQ ID NO: 3784425 - RNA, 24 nt, Salmonella typhimurium LT2
agaguucauagcgcacaacgucag

SEQ ID NO: 3784426 - RNA, 19 nt, Salmonella typhimurium LT2
agaguuguugaccaacaau

SEQ ID NO: 3784427 - RNA, 19 nt, Salmonella typhimurium LT2
agauaaaaagacagauaaa

SEQ ID NO: 3784428 - RNA, 19 nt, Salmonella typhimurium LT2
agauaaacagguaaaacaa

SEQ ID NO: 3784429 - RNA, 20 nt, Salmonella typhimurium LT2
agauaaacagguaaaacaaa

SEQ ID NO: 3784430 - RNA, 14 nt, Salmonella typhimurium LT2
agauaaauaaaaaa

SEQ ID NO: 3784431 - RNA, 15 nt, Salmonella typhimurium LT2
agauaaauaaaaaau

SEQ ID NO: 3784432 - RNA, 16 nt, Salmonella typhimurium LT2
agauaaauaaaaaauu

SEQ ID NO: 3784433 - RNA, 13 nt, Salmonella typhimurium LT2
agauaaaucagcc

SEQ ID NO: 3784434 - RNA, 19 nt, Salmonella typhimurium LT2
agauaacuaugugcccggg

SEQ ID NO: 3784435 - RNA, 12 nt, Salmonella typhimurium LT2
agauaagcgcca

SEQ ID NO: 3784436 - RNA, 17 nt, Salmonella typhimurium LT2
agauaagcgucugcaau

SEQ ID NO: 3784437 - RNA, 20 nt, Salmonella typhimurium LT2
agauaauccagccacagauu

SEQ ID NO: 3784438 - RNA, 15 nt, Salmonella typhimurium LT2
agauaaucgggaaua

SEQ ID NO: 3784439 - RNA, 20 nt, Salmonella typhimurium LT2
agauaaugcucauuauuugg

SEQ ID NO: 3784440 - RNA, 14 nt, Salmonella typhimurium LT2
agauaauucucuuu

SEQ ID NO: 3784441 - RNA, 15 nt, Salmonella typhimurium LT2
agauaauucucuuug

SEQ ID NO: 3784442 - RNA, 14 nt, Salmonella typhimurium LT2
agauacauggcuau

SEQ ID NO: 3784443 - RNA, 20 nt, Salmonella typhimurium LT2
agauaccuacuuuauuuuuc

SEQ ID NO: 3784444 - RNA, 17 nt, Salmonella typhimurium LT2
agauacggauucuuaac

SEQ ID NO: 3784445 - RNA, 16 nt, Salmonella typhimurium LT2
agauacggcuccagca

SEQ ID NO: 3784446 - RNA, 18 nt, Salmonella typhimurium LT2
agauacggcuccagcaca

SEQ ID NO: 3784447 - RNA, 19 nt, Salmonella typhimurium LT2
agauacggcuccagcacau

SEQ ID NO: 3784448 - RNA, 18 nt, Salmonella typhimurium LT2
agauacugcgaucgccgg

SEQ ID NO: 3784449 - RNA, 14 nt, Salmonella typhimurium LT2
agauagagaaggcu

SEQ ID NO: 3784450 - RNA, 17 nt, Salmonella typhimurium LT2
agauagcguauuauaaa

SEQ ID NO: 3784451 - RNA, 18 nt, Salmonella typhimurium LT2
agauagcuuccaugccga

SEQ ID NO: 3784452 - RNA, 14 nt, Salmonella typhimurium LT2
agauagggccaggc

SEQ ID NO: 3784453 - RNA, 17 nt, Salmonella typhimurium LT2
agauagucaucaccauu

SEQ ID NO: 3784454 - RNA, 15 nt, Salmonella typhimurium LT2
agauaguugagcagc

SEQ ID NO: 3784455 - RNA, 11 nt, Salmonella typhimurium LT2
agauaguuuuu

SEQ ID NO: 3784456 - RNA, 14 nt, Salmonella typhimurium LT2
agauauacaucuga

SEQ ID NO: 3784457 - RNA, 17 nt, Salmonella typhimurium LT2
agauaucaccaucuuuu

SEQ ID NO: 3784458 - RNA, 21 nt, Salmonella typhimurium LT2
agauaucccaucgacuuaaaa

SEQ ID NO: 3784459 - RNA, 14 nt, Salmonella typhimurium LT2
agauauggcacuuu

SEQ ID NO: 3784460 - RNA, 15 nt, Salmonella typhimurium LT2
agauauuauaaaaua

SEQ ID NO: 3784461 - RNA, 16 nt, Salmonella typhimurium LT2
agauauuauaaaauaa

SEQ ID NO: 3784462 - RNA, 13 nt, Salmonella typhimurium LT2
agauauuuuguca

SEQ ID NO: 3784463 - RNA, 22 nt, Salmonella typhimurium LT2
agauauuuuguuuuaaauucaa

SEQ ID NO: 3784464 - RNA, 17 nt, Salmonella typhimurium LT2
agaucaaacaggcgaaa

SEQ ID NO: 3784465 - RNA, 14 nt, Salmonella typhimurium LT2
agaucagcauggua

SEQ ID NO: 3784466 - RNA, 17 nt, Salmonella typhimurium LT2
agaucaggaguaaauaa

SEQ ID NO: 3784467 - RNA, 24 nt, Salmonella typhimurium LT2
agaucaggaguaaauaacaaaagc

SEQ ID NO: 3784468 - RNA, 12 nt, Salmonella typhimurium LT2
agaucaggcgca

SEQ ID NO: 3784469 - RNA, 14 nt, Salmonella typhimurium LT2
agauccaacacggc

SEQ ID NO: 3784470 - RNA, 21 nt, Salmonella typhimurium LT2
agauccacugagcgcgccaug

SEQ ID NO: 3784471 - RNA, 15 nt, Salmonella typhimurium LT2
agauccggcgucagc

SEQ ID NO: 3784472 - RNA, 23 nt, Salmonella typhimurium LT2
agauccugagaaaucaacgugac

SEQ ID NO: 3784473 - RNA, 18 nt, Salmonella typhimurium LT2
agauccuggcgaaagcga

SEQ ID NO: 3784474 - RNA, 14 nt, Salmonella typhimurium LT2
agauccuucauuca

SEQ ID NO: 3784475 - RNA, 23 nt, Salmonella typhimurium LT2
agauccuucauucagaucaaaaa

SEQ ID NO: 3784476 - RNA, 20 nt, Salmonella typhimurium LT2
agaucgaacaauuaccgaug

SEQ ID NO: 3784477 - RNA, 16 nt, Salmonella typhimurium LT2
agaucgaccagcgcau

SEQ ID NO: 3784478 - RNA, 17 nt, Salmonella typhimurium LT2
agaucgagacgcgucag

SEQ ID NO: 3784479 - RNA, 19 nt, Salmonella typhimurium LT2
agaucgccgucgauuuaau

SEQ ID NO: 3784480 - RNA, 17 nt, Salmonella typhimurium LT2
agaucgcgggcaaucaa

SEQ ID NO: 3784481 - RNA, 13 nt, Salmonella typhimurium LT2
agcaaucaguuca

SEQ ID NO: 3784482 - RNA, 14 nt, Salmonella typhimurium LT2
agcaaucaguucac

SEQ ID NO: 3784483 - RNA, 22 nt, Salmonella typhimurium LT2
agcaaucucuauaccauaaaug

SEQ ID NO: 3784484 - RNA, 13 nt, Salmonella typhimurium LT2
agcaaugauuuua

SEQ ID NO: 3784485 - RNA, 13 nt, Salmonella typhimurium LT2
agcaaugccgccg

SEQ ID NO: 3784486 - RNA, 20 nt, Salmonella typhimurium LT2
agcaaugcgaauaacaucau

SEQ ID NO: 3784487 - RNA, 13 nt, Salmonella typhimurium LT2
agcaaugggaagg

SEQ ID NO: 3784488 - RNA, 15 nt, Salmonella typhimurium LT2
agcaaugggaaggaa

SEQ ID NO: 3784489 - RNA, 17 nt, Salmonella typhimurium LT2
agcaauguaagaauaac

SEQ ID NO: 3784490 - RNA, 19 nt, Salmonella typhimurium LT2
agcaauguaagaauaacaa

SEQ ID NO: 3784491 - RNA, 20 nt, Salmonella typhimurium LT2
agcaauuaacaaauaaagcg

SEQ ID NO: 3784492 - RNA, 21 nt, Salmonella typhimurium LT2
agcaauuacggacagaaaaaa

SEQ ID NO: 3784493 - RNA, 22 nt, Salmonella typhimurium LT2
agcaauuacggacagaaaaaau

SEQ ID NO: 3784494 - RNA, 11 nt, Salmonella typhimurium LT2
agcaauuacua

SEQ ID NO: 3784495 - RNA, 19 nt, Salmonella typhimurium LT2
agcaauugccugaccggca

SEQ ID NO: 3784496 - RNA, 19 nt, Salmonella typhimurium LT2
agcaauuucucgcccgcca

SEQ ID NO: 3784497 - RNA, 12 nt, Salmonella typhimurium LT2
agcacaaaaagu

SEQ ID NO: 3784498 - RNA, 21 nt, Salmonella typhimurium LT2
agcacaaacaauuuacgcagc

SEQ ID NO: 3784499 - RNA, 22 nt, Salmonella typhimurium LT2
agcacaacgcauuggcaaugaa

SEQ ID NO: 3784500 - RNA, 20 nt, Salmonella typhimurium LT2
agcacaauaacgaccccaau

SEQ ID NO: 3784501 - RNA, 16 nt, Salmonella typhimurium LT2
agcacaauggucagcg

SEQ ID NO: 3784502 - RNA, 17 nt, Salmonella typhimurium LT2
agcacaauggucagcgc

SEQ ID NO: 3784503 - RNA, 18 nt, Salmonella typhimurium LT2
agcacaauggucagcgcc

SEQ ID NO: 3784504 - RNA, 15 nt, Salmonella typhimurium LT2
agcacaccauuucac

SEQ ID NO: 3784505 - RNA, 21 nt, Salmonella typhimurium LT2
agcacaccauuucacaaauua

SEQ ID NO: 3784506 - RNA, 16 nt, Salmonella typhimurium LT2
agcacagcccaguaau

SEQ ID NO: 3784507 - RNA, 18 nt, Salmonella typhimurium LT2
agcacagcgguagcaucu

SEQ ID NO: 3784508 - RNA, 20 nt, Salmonella typhimurium LT2
agcacagcgguagcaucuca

SEQ ID NO: 3784509 - RNA, 14 nt, Salmonella typhimurium LT2
agcacauccucaau

SEQ ID NO: 3784510 - RNA, 21 nt, Salmonella typhimurium LT2
agcacaucgauuuugaccuga

SEQ ID NO: 3784511 - RNA, 15 nt, Salmonella typhimurium LT2
agcacaugcagauau

SEQ ID NO: 3784512 - RNA, 21 nt, Salmonella typhimurium LT2
agcaccagauagcguauuaua

SEQ ID NO: 3784513 - RNA, 15 nt, Salmonella typhimurium LT2
agcaccagcaggugg

SEQ ID NO: 3784514 - RNA, 22 nt, Salmonella typhimurium LT2
agcaccaggauacguucaucuu

SEQ ID NO: 3784515 - RNA, 14 nt, Salmonella typhimurium LT2
agcaccaggccaac

SEQ ID NO: 3784516 - RNA, 21 nt, Salmonella typhimurium LT2
agcaccauggcuauccacgcc

SEQ ID NO: 3784517 - RNA, 13 nt, Salmonella typhimurium LT2
agcacccaggcac

SEQ ID NO: 3784518 - RNA, 11 nt, Salmonella typhimurium LT2
agcacccauga

SEQ ID NO: 3784519 - RNA, 16 nt, Salmonella typhimurium LT2
agcaccgccagcgcau

SEQ ID NO: 3784520 - RNA, 21 nt, Salmonella typhimurium LT2
agcaccgccgggaagaaauua

SEQ ID NO: 3784521 - RNA, 20 nt, Salmonella typhimurium LT2
agcaccggauacaagguauc

SEQ ID NO: 3784522 - RNA, 22 nt, Salmonella typhimurium LT2
agcaccgguuaacauaugggca

SEQ ID NO: 3784523 - RNA, 18 nt, Salmonella typhimurium LT2
agcaccucaauaugaaau

SEQ ID NO: 3784524 - RNA, 20 nt, Salmonella typhimurium LT2
agcaccucaucgcuaccuuc

SEQ ID NO: 3784525 - RNA, 15 nt, Salmonella typhimurium LT2
agcaccugcucaggc

SEQ ID NO: 3784526 - RNA, 18 nt, Salmonella typhimurium LT2
agcaccugcucaggcuga

SEQ ID NO: 3784527 - RNA, 22 nt, Salmonella typhimurium LT2
agcaccuuuuuugcgccuggca

SEQ ID NO: 3784528 - RNA, 17 nt, Salmonella typhimurium LT2
agcacgauauccagcac

SEQ ID NO: 3784529 - RNA, 16 nt, Salmonella typhimurium LT2
agcacgccaccgggcu

SEQ ID NO: 3784530 - RNA, 21 nt, Salmonella typhimurium LT2
agcacgccaccgggcuuuaau

SEQ ID NO: 3784531 - RNA, 16 nt, Salmonella typhimurium LT2
agcacgcgcugcgccg

SEQ ID NO: 3784532 - RNA, 19 nt, Salmonella typhimurium LT2
agcacgcuucggugaucuc

SEQ ID NO: 3784533 - RNA, 21 nt, Salmonella typhimurium LT2
agcacgcuuuggcaggccucu

SEQ ID NO: 3784534 - RNA, 14 nt, Salmonella typhimurium LT2
agcacuaacagcag

SEQ ID NO: 3784535 - RNA, 21 nt, Salmonella typhimurium LT2
agcacuacggauggcccugcc

SEQ ID NO: 3784536 - RNA, 15 nt, Salmonella typhimurium LT2
agcacugcccaggac

SEQ ID NO: 3784537 - RNA, 19 nt, Salmonella typhimurium LT2
agcacugcuuaaauuuuuu

SEQ ID NO: 3784538 - RNA, 14 nt, Salmonella typhimurium LT2
agcacuucccacug

SEQ ID NO: 3784539 - RNA, 15 nt, Salmonella typhimurium LT2
agcacuucccacugu

SEQ ID NO: 3784540 - RNA, 18 nt, Salmonella typhimurium LT2
agcacuucuccacgcgau

SEQ ID NO: 3784541 - RNA, 20 nt, Salmonella typhimurium LT2
agcagaagacggaaaccaga

SEQ ID NO: 3784542 - RNA, 23 nt, Salmonella typhimurium LT2
agcagacagacaaccagcagggc

SEQ ID NO: 3784543 - RNA, 13 nt, Salmonella typhimurium LT2
agcagacagguga

SEQ ID NO: 3784544 - RNA, 13 nt, Salmonella typhimurium LT2
agcagacguuggu

SEQ ID NO: 3784545 - RNA, 14 nt, Salmonella typhimurium LT2
agcagagaucuuuc

SEQ ID NO: 3784546 - RNA, 15 nt, Salmonella typhimurium LT2
agcagauacugcgcg

SEQ ID NO: 3784547 - RNA, 15 nt, Salmonella typhimurium LT2
agcagauagccugcc

SEQ ID NO: 3784548 - RNA, 20 nt, Salmonella typhimurium LT2
agcagauagccugccagcac

SEQ ID NO: 3784549 - RNA, 15 nt, Salmonella typhimurium LT2
agcagcaacccugcc

SEQ ID NO: 3784550 - RNA, 17 nt, Salmonella typhimurium LT2
agcagcaacccugccgu

SEQ ID NO: 3784551 - RNA, 13 nt, Salmonella typhimurium LT2
agcagcagucucu

SEQ ID NO: 3784552 - RNA, 18 nt, Salmonella typhimurium LT2
agcagcauaaaaccgccg

SEQ ID NO: 3784553 - RNA, 19 nt, Salmonella typhimurium LT2
agcagcauacgacaucgcc

SEQ ID NO: 3784554 - RNA, 15 nt, Salmonella typhimurium LT2
agcagccacagaaug

SEQ ID NO: 3784555 - RNA, 17 nt, Salmonella typhimurium LT2
agcagccacagaaugcc

SEQ ID NO: 3784556 - RNA, 18 nt, Salmonella typhimurium LT2
agcagccagaaaaaggga

SEQ ID NO: 3784557 - RNA, 16 nt, Salmonella typhimurium LT2
agcagccagacccgcg

SEQ ID NO: 3784558 - RNA, 17 nt, Salmonella typhimurium LT2
agcagccagcccagcgc

SEQ ID NO: 3784559 - RNA, 21 nt, Salmonella typhimurium LT2
agcagccaguuauuaaucaag

SEQ ID NO: 3784560 - RNA, 22 nt, Salmonella typhimurium LT2
agcagccgaccaguaagagaac

SEQ ID NO: 3784561 - RNA, 15 nt, Salmonella typhimurium LT2
agcagccuggcggcu

SEQ ID NO: 3784562 - RNA, 17 nt, Salmonella typhimurium LT2
agcagcgaugacagcag

SEQ ID NO: 3784563 - RNA, 19 nt, Salmonella typhimurium LT2
agcagcgaugacagcagga

SEQ ID NO: 3784564 - RNA, 23 nt, Salmonella typhimurium LT2
agcagcggcgguuauccgccagc

SEQ ID NO: 3784565 - RNA, 16 nt, Salmonella typhimurium LT2
agcagcucaacggcag

SEQ ID NO: 3784566 - RNA, 20 nt, Salmonella typhimurium LT2
agcagcugcuuaacuucugc

SEQ ID NO: 3784567 - RNA, 16 nt, Salmonella typhimurium LT2
agcagcuuauccggcc

SEQ ID NO: 3784568 - RNA, 17 nt, Salmonella typhimurium LT2
agcagcuucgccagaug

SEQ ID NO: 3784569 - RNA, 14 nt, Salmonella typhimurium LT2
agcaggaacggcag

SEQ ID NO: 3784570 - RNA, 13 nt, Salmonella typhimurium LT2
agcaggcaaaaaa

SEQ ID NO: 3784571 - RNA, 17 nt, Salmonella typhimurium LT2
agcaggccauaaugcag

SEQ ID NO: 3784572 - RNA, 13 nt, Salmonella typhimurium LT2
agcaggcggcuuc

SEQ ID NO: 3784573 - RNA, 19 nt, Salmonella typhimurium LT2
agcaggcggcuucgcaucc

SEQ ID NO: 3784574 - RNA, 24 nt, Salmonella typhimurium LT2
agcaggcgggacgccauagcguuu

SEQ ID NO: 3784575 - RNA, 20 nt, Salmonella typhimurium LT2
agcaggcuacgguacugccc

SEQ ID NO: 3784576 - RNA, 16 nt, Salmonella typhimurium LT2
agcaggcuuacgauau

SEQ ID NO: 3784577 - RNA, 20 nt, Salmonella typhimurium LT2
agcagggcaugauuacagau

SEQ ID NO: 3784578 - RNA, 16 nt, Salmonella typhimurium LT2
agcagggucaggaacu

SEQ ID NO: 3784579 - RNA, 22 nt, Salmonella typhimurium LT2
agcagggucaggaacugcggcc

SEQ ID NO: 3784580 - RNA, 14 nt, Salmonella typhimurium LT2
agcaggugguacau

SEQ ID NO: 3784581 - RNA, 21 nt, Salmonella typhimurium LT2
agcaguaugcccccuccagcc

SEQ ID NO: 3784582 - RNA, 24 nt, Salmonella typhimurium LT2
agcaguaugcccccuccagccagc

SEQ ID NO: 3784583 - RNA, 18 nt, Salmonella typhimurium LT2
agcagugcaaugcgcuuu

SEQ ID NO: 3784584 - RNA, 14 nt, Salmonella typhimurium LT2
agcagugggaaaau

SEQ ID NO: 3784585 - RNA, 15 nt, Salmonella typhimurium LT2
agccagccggagagc

SEQ ID NO: 3784586 - RNA, 19 nt, Salmonella typhimurium LT2
agccagcgagcgcagucca

SEQ ID NO: 3784587 - RNA, 18 nt, Salmonella typhimurium LT2
agccagcgaugagcgcca

SEQ ID NO: 3784588 - RNA, 22 nt, Salmonella typhimurium LT2
agccagcgaugagcgccagcaa

SEQ ID NO: 3784589 - RNA, 15 nt, Salmonella typhimurium LT2
agccagcgccccugc

SEQ ID NO: 3784590 - RNA, 20 nt, Salmonella typhimurium LT2
agccagcguaaauagcccgg

SEQ ID NO: 3784591 - RNA, 20 nt, Salmonella typhimurium LT2
agccagcgugaaccuguuau

SEQ ID NO: 3784592 - RNA, 18 nt, Salmonella typhimurium LT2
agccagcguuucuggaag

SEQ ID NO: 3784593 - RNA, 14 nt, Salmonella typhimurium LT2
agccaggcgaugaa

SEQ ID NO: 3784594 - RNA, 19 nt, Salmonella typhimurium LT2
agccaggcggcaauauccu

SEQ ID NO: 3784595 - RNA, 14 nt, Salmonella typhimurium LT2
agccagguaauccg

SEQ ID NO: 3784596 - RNA, 22 nt, Salmonella typhimurium LT2
agccagguauuuagccacgccg

SEQ ID NO: 3784597 - RNA, 20 nt, Salmonella typhimurium LT2
agccagguccagauaccgga

SEQ ID NO: 3784598 - RNA, 16 nt, Salmonella typhimurium LT2
agccaguagcugguga

SEQ ID NO: 3784599 - RNA, 19 nt, Salmonella typhimurium LT2
agccaguagcuggugacuu

SEQ ID NO: 3784600 - RNA, 14 nt, Salmonella typhimurium LT2
agccagucgccagg

SEQ ID NO: 3784601 - RNA, 18 nt, Salmonella typhimurium LT2
agccagucgccaggcaag

SEQ ID NO: 3784602 - RNA, 13 nt, Salmonella typhimurium LT2
agccagugggcgu

SEQ ID NO: 3784603 - RNA, 16 nt, Salmonella typhimurium LT2
agccaguguucccugc

SEQ ID NO: 3784604 - RNA, 19 nt, Salmonella typhimurium LT2
agccaguuagcuucagcaa

SEQ ID NO: 3784605 - RNA, 22 nt, Salmonella typhimurium LT2
agccaguucgccuucuucaucu

SEQ ID NO: 3784606 - RNA, 22 nt, Salmonella typhimurium LT2
agccaguuguucgauaaccugu

SEQ ID NO: 3784607 - RNA, 22 nt, Salmonella typhimurium LT2
agccaguuuucuucuuugcgcg

SEQ ID NO: 3784608 - RNA, 15 nt, Salmonella typhimurium LT2
agccauacgccacgg

SEQ ID NO: 3784609 - RNA, 15 nt, Salmonella typhimurium LT2
agccauauaugaaau

SEQ ID NO: 3784610 - RNA, 14 nt, Salmonella typhimurium LT2
agccaucaauccau

SEQ ID NO: 3784611 - RNA, 13 nt, Salmonella typhimurium LT2
agccaucaccguu

SEQ ID NO: 3784612 - RNA, 18 nt, Salmonella typhimurium LT2
agccauccucacgcaacc

SEQ ID NO: 3784613 - RNA, 12 nt, Salmonella typhimurium LT2
agccauccugca

SEQ ID NO: 3784614 - RNA, 13 nt, Salmonella typhimurium LT2
agccaucggcaaa

SEQ ID NO: 3784615 - RNA, 19 nt, Salmonella typhimurium LT2
agccaugcauaaugcagcc

SEQ ID NO: 3784616 - RNA, 15 nt, Salmonella typhimurium LT2
agccaugccagcagu

SEQ ID NO: 3784617 - RNA, 17 nt, Salmonella typhimurium LT2
agccaugccagcaguuu

SEQ ID NO: 3784618 - RNA, 14 nt, Salmonella typhimurium LT2
agccaugcccggcg

SEQ ID NO: 3784619 - RNA, 15 nt, Salmonella typhimurium LT2
agccaugcccggcgg

SEQ ID NO: 3784620 - RNA, 22 nt, Salmonella typhimurium LT2
agccaugcuauucagcaguuca

SEQ ID NO: 3784621 - RNA, 17 nt, Salmonella typhimurium LT2
agccauuaaugcaggca

SEQ ID NO: 3784622 - RNA, 17 nt, Salmonella typhimurium LT2
agccauucgaauucuga

SEQ ID NO: 3784623 - RNA, 16 nt, Salmonella typhimurium LT2
agccauucgccacugg

SEQ ID NO: 3784624 - RNA, 14 nt, Salmonella typhimurium LT2
agccauucggcugc

SEQ ID NO: 3784625 - RNA, 19 nt, Salmonella typhimurium LT2
agccauugccgauuucacg

SEQ ID NO: 3784626 - RNA, 13 nt, Salmonella typhimurium LT2
agccauugccgcg

SEQ ID NO: 3784627 - RNA, 23 nt, Salmonella typhimurium LT2
agccauugcugcuauauaacaua

SEQ ID NO: 3784628 - RNA, 19 nt, Salmonella typhimurium LT2
agccauuggucaucaucag

SEQ ID NO: 3784629 - RNA, 14 nt, Salmonella typhimurium LT2
agcccaaaacgcgc

SEQ ID NO: 3784630 - RNA, 13 nt, Salmonella typhimurium LT2
agcccaaccgcgu

SEQ ID NO: 3784631 - RNA, 15 nt, Salmonella typhimurium LT2
agcccaauacgccag

SEQ ID NO: 3784632 - RNA, 17 nt, Salmonella typhimurium LT2
agcccaccguguugcga

SEQ ID NO: 3784633 - RNA, 12 nt, Salmonella typhimurium LT2
agcccagcgccg

SEQ ID NO: 3784634 - RNA, 20 nt, Salmonella typhimurium LT2
agcccagcgugccugccgca

SEQ ID NO: 3784635 - RNA, 12 nt, Salmonella typhimurium LT2
agcccagcucag

SEQ ID NO: 3784636 - RNA, 17 nt, Salmonella typhimurium LT2
agcccagcucauaggau

SEQ ID NO: 3784637 - RNA, 20 nt, Salmonella typhimurium LT2
agcccaguaauauccccauc

SEQ ID NO: 3784638 - RNA, 16 nt, Salmonella typhimurium LT2
agcccaucaccgccag

SEQ ID NO: 3784639 - RNA, 20 nt, Salmonella typhimurium LT2
agcccaucagcgccagcccu

SEQ ID NO: 3784640 - RNA, 17 nt, Salmonella typhimurium LT2
agcccaugauggugaac

SEQ ID NO: 3784641 - RNA, 20 nt, Salmonella typhimurium LT2
agcccaugauggugaacaga

SEQ ID NO: 3784642 - RNA, 23 nt, Salmonella typhimurium LT2
agcccaugauggugaacagaauc

SEQ ID NO: 3784643 - RNA, 17 nt, Salmonella typhimurium LT2
agcccauggcaggcagc

SEQ ID NO: 3784644 - RNA, 12 nt, Salmonella typhimurium LT2
agccccacgccc

SEQ ID NO: 3784645 - RNA, 23 nt, Salmonella typhimurium LT2
agccccacggcaaauuuaagcca

SEQ ID NO: 3784646 - RNA, 14 nt, Salmonella typhimurium LT2
agccccagcgcaaa

SEQ ID NO: 3784647 - RNA, 21 nt, Salmonella typhimurium LT2
agccccauaaccgaugcacau

SEQ ID NO: 3784648 - RNA, 23 nt, Salmonella typhimurium LT2
agccccccgcacagcacauagaa

SEQ ID NO: 3784649 - RNA, 18 nt, Salmonella typhimurium LT2
agccccccuaaagcucau

SEQ ID NO: 3784650 - RNA, 18 nt, Salmonella typhimurium LT2
agcccccguaauguugcc

SEQ ID NO: 3784651 - RNA, 21 nt, Salmonella typhimurium LT2
agccccuaccgaggcaggggc

SEQ ID NO: 3784652 - RNA, 13 nt, Salmonella typhimurium LT2
agcccgaagaagc

SEQ ID NO: 3784653 - RNA, 14 nt, Salmonella typhimurium LT2
agcccgaauccacu

SEQ ID NO: 3784654 - RNA, 20 nt, Salmonella typhimurium LT2
agcccgauaagcaagcgcca

SEQ ID NO: 3784655 - RNA, 21 nt, Salmonella typhimurium LT2
agcccgauaagcaagcgccau

SEQ ID NO: 3784656 - RNA, 16 nt, Salmonella typhimurium LT2
agcccgcccacaggcu

SEQ ID NO: 3784657 - RNA, 22 nt, Salmonella typhimurium LT2
agcccgcgaacgccaggccaaa

SEQ ID NO: 3784658 - RNA, 21 nt, Salmonella typhimurium LT2
agcccggaaauaaacgccagu

SEQ ID NO: 3784659 - RNA, 17 nt, Salmonella typhimurium LT2
agcccggccacagcgcc

SEQ ID NO: 3784660 - RNA, 22 nt, Salmonella typhimurium LT2
agcccggcggauaaaucaucau

SEQ ID NO: 3784661 - RNA, 15 nt, Salmonella typhimurium LT2
agcccggcuucccau

SEQ ID NO: 3784662 - RNA, 14 nt, Salmonella typhimurium LT2
agcccgucccuucc

SEQ ID NO: 3784663 - RNA, 19 nt, Salmonella typhimurium LT2
agcccuauaacagcgccag

SEQ ID NO: 3784664 - RNA, 18 nt, Salmonella typhimurium LT2
agcccuaucaccauaauc

SEQ ID NO: 3784665 - RNA, 22 nt, Salmonella typhimurium LT2
agcccuaucaccauaaucgcga

SEQ ID NO: 3784666 - RNA, 18 nt, Salmonella typhimurium LT2
agcccuccuccagcgcgu

SEQ ID NO: 3784667 - RNA, 16 nt, Salmonella typhimurium LT2
agcccucucacuggag

SEQ ID NO: 3784668 - RNA, 14 nt, Salmonella typhimurium LT2
agcccucuuccggc

SEQ ID NO: 3784669 - RNA, 13 nt, Salmonella typhimurium LT2
agcccugccacca

SEQ ID NO: 3784670 - RNA, 16 nt, Salmonella typhimurium LT2
agcccuggaaucgaaa

SEQ ID NO: 3784671 - RNA, 17 nt, Salmonella typhimurium LT2
agcccugugccgcuggu

SEQ ID NO: 3784672 - RNA, 19 nt, Salmonella typhimurium LT2
agcccuuaucgccccagcc

SEQ ID NO: 3784673 - RNA, 14 nt, Salmonella typhimurium LT2
agcccuuccaccag

SEQ ID NO: 3784674 - RNA, 13 nt, Salmonella typhimurium LT2
agcccuuugcccu

SEQ ID NO: 3784675 - RNA, 14 nt, Salmonella typhimurium LT2
agcccuuugcccuc

SEQ ID NO: 3784676 - RNA, 19 nt, Salmonella typhimurium LT2
agccgaaguucgcgccgcg

SEQ ID NO: 3784677 - RNA, 15 nt, Salmonella typhimurium LT2
agccgaccaguaaga

SEQ ID NO: 3784678 - RNA, 19 nt, Salmonella typhimurium LT2
agccgaccaucgcgccgcu

SEQ ID NO: 3784679 - RNA, 21 nt, Salmonella typhimurium LT2
agccgaccaucgcgccgcugg

SEQ ID NO: 3784680 - RNA, 14 nt, Salmonella typhimurium LT2
agccgaccuggcgg

SEQ ID NO: 3784681 - RNA, 13 nt, Salmonella typhimurium LT2
agccgacgcucuu

SEQ ID NO: 3784682 - RNA, 15 nt, Salmonella typhimurium LT2
agccgacggccauaa

SEQ ID NO: 3784683 - RNA, 19 nt, Salmonella typhimurium LT2
agccgauaaacgccacgau

SEQ ID NO: 3784684 - RNA, 14 nt, Salmonella typhimurium LT2
agccgauaguccgg

SEQ ID NO: 3784685 - RNA, 13 nt, Salmonella typhimurium LT2
agccgaucagcgc

SEQ ID NO: 3784686 - RNA, 23 nt, Salmonella typhimurium LT2
agccgaucaucacgaaauaacgc

SEQ ID NO: 3784687 - RNA, 17 nt, Salmonella typhimurium LT2
agccgcaaucagcguuu

SEQ ID NO: 3784688 - RNA, 14 nt, Salmonella typhimurium LT2
agccgcaguugcca

SEQ ID NO: 3784689 - RNA, 19 nt, Salmonella typhimurium LT2
agcgagcgccugaugccgc

SEQ ID NO: 3784690 - RNA, 17 nt, Salmonella typhimurium LT2
agcgagcugguuucaau

SEQ ID NO: 3784691 - RNA, 19 nt, Salmonella typhimurium LT2
agcgagguucccgccgcca

SEQ ID NO: 3784692 - RNA, 16 nt, Salmonella typhimurium LT2
agcgagguucugguuu

SEQ ID NO: 3784693 - RNA, 22 nt, Salmonella typhimurium LT2
agcgagguucugguuuucaaau

SEQ ID NO: 3784694 - RNA, 19 nt, Salmonella typhimurium LT2
agcgagucccuaauagcgc

SEQ ID NO: 3784695 - RNA, 18 nt, Salmonella typhimurium LT2
agcgauaaagaacgccgc

SEQ ID NO: 3784696 - RNA, 15 nt, Salmonella typhimurium LT2
agcgauaaccgccgc

SEQ ID NO: 3784697 - RNA, 19 nt, Salmonella typhimurium LT2
agcgauaagucuccuguuu

SEQ ID NO: 3784698 - RNA, 21 nt, Salmonella typhimurium LT2
agcgauacaaggcaaucugau

SEQ ID NO: 3784699 - RNA, 15 nt, Salmonella typhimurium LT2
agcgauauuucuccg

SEQ ID NO: 3784700 - RNA, 14 nt, Salmonella typhimurium LT2
agcgaucaccucuu

SEQ ID NO: 3784701 - RNA, 14 nt, Salmonella typhimurium LT2
agcgaucagcgcca

SEQ ID NO: 3784702 - RNA, 14 nt, Salmonella typhimurium LT2
agcgauccagaccg

SEQ ID NO: 3784703 - RNA, 17 nt, Salmonella typhimurium LT2
agcgaucgagauaagau

SEQ ID NO: 3784704 - RNA, 16 nt, Salmonella typhimurium LT2
agcgaugacagcagga

SEQ ID NO: 3784705 - RNA, 23 nt, Salmonella typhimurium LT2
agcgaugacgccugccagauagu

SEQ ID NO: 3784706 - RNA, 21 nt, Salmonella typhimurium LT2
agcgaugagcgccagcaacag

SEQ ID NO: 3784707 - RNA, 22 nt, Salmonella typhimurium LT2
agcgaugagcgccagcaacagc

SEQ ID NO: 3784708 - RNA, 21 nt, Salmonella typhimurium LT2
agcgauguauuuauccacgcc

SEQ ID NO: 3784709 - RNA, 17 nt, Salmonella typhimurium LT2
agcgauugcgccagacc

SEQ ID NO: 3784710 - RNA, 14 nt, Salmonella typhimurium LT2
agcgauuuauccac

SEQ ID NO: 3784711 - RNA, 19 nt, Salmonella typhimurium LT2
agcgauuuuugaucucuuu

SEQ ID NO: 3784712 - RNA, 17 nt, Salmonella typhimurium LT2
agcgcaaaagcgcgccc

SEQ ID NO: 3784713 - RNA, 13 nt, Salmonella typhimurium LT2
agcgcaaacgcgc

SEQ ID NO: 3784714 - RNA, 19 nt, Salmonella typhimurium LT2
agcgcaaauauccuaccac

SEQ ID NO: 3784715 - RNA, 20 nt, Salmonella typhimurium LT2
agcgcaaccugcgcccgcgu

SEQ ID NO: 3784716 - RNA, 22 nt, Salmonella typhimurium LT2
agcgcaacgcgcaucaacgcca

SEQ ID NO: 3784717 - RNA, 20 nt, Salmonella typhimurium LT2
agcgcaaucaagcucaccac

SEQ ID NO: 3784718 - RNA, 16 nt, Salmonella typhimurium LT2
agcgcaccagccggug

SEQ ID NO: 3784719 - RNA, 19 nt, Salmonella typhimurium LT2
agcgcaccagccggugcuc

SEQ ID NO: 3784720 - RNA, 19 nt, Salmonella typhimurium LT2
agcgcagacccgucagggu

SEQ ID NO: 3784721 - RNA, 13 nt, Salmonella typhimurium LT2
agcgcagcaaaac

SEQ ID NO: 3784722 - RNA, 17 nt, Salmonella typhimurium LT2
agcgcagcauuggguca

SEQ ID NO: 3784723 - RNA, 19 nt, Salmonella typhimurium LT2
agcgcagcgcaucaggcaa

SEQ ID NO: 3784724 - RNA, 11 nt, Salmonella typhimurium LT2
agcgcagcgcc

SEQ ID NO: 3784725 - RNA, 20 nt, Salmonella typhimurium LT2
agcgcagcgccaccgggcaa

SEQ ID NO: 3784726 - RNA, 18 nt, Salmonella typhimurium LT2
agcgcagcgccaucaggc

SEQ ID NO: 3784727 - RNA, 15 nt, Salmonella typhimurium LT2
agcgcaguccagaug

SEQ ID NO: 3784728 - RNA, 13 nt, Salmonella typhimurium LT2
agcgcauagcugc

SEQ ID NO: 3784729 - RNA, 20 nt, Salmonella typhimurium LT2
agcgcauaggcuuugcugag

SEQ ID NO: 3784730 - RNA, 22 nt, Salmonella typhimurium LT2
agcgcaucauccccaccacuga

SEQ ID NO: 3784731 - RNA, 16 nt, Salmonella typhimurium LT2
agcgcauccagcucuu

SEQ ID NO: 3784732 - RNA, 13 nt, Salmonella typhimurium LT2
agcgcauccggca

SEQ ID NO: 3784733 - RNA, 17 nt, Salmonella typhimurium LT2
agcgcauccggccagcg

SEQ ID NO: 3784734 - RNA, 14 nt, Salmonella typhimurium LT2
agcgcaucgcgcaa

SEQ ID NO: 3784735 - RNA, 16 nt, Salmonella typhimurium LT2
agcgcaugagcaaaau

SEQ ID NO: 3784736 - RNA, 19 nt, Salmonella typhimurium LT2
agcgcauguuucuggugga

SEQ ID NO: 3784737 - RNA, 16 nt, Salmonella typhimurium LT2
agcgcauuaccgccgc

SEQ ID NO: 3784738 - RNA, 18 nt, Salmonella typhimurium LT2
agcgcauuauguaauaac

SEQ ID NO: 3784739 - RNA, 16 nt, Salmonella typhimurium LT2
agcgcauugcguccca

SEQ ID NO: 3784740 - RNA, 23 nt, Salmonella typhimurium LT2
agcgcauuuuuaucagaccugcc

SEQ ID NO: 3784741 - RNA, 14 nt, Salmonella typhimurium LT2
agcgccaacgccac

SEQ ID NO: 3784742 - RNA, 16 nt, Salmonella typhimurium LT2
agcgccaacgccacug

SEQ ID NO: 3784743 - RNA, 17 nt, Salmonella typhimurium LT2
agcgccaauaccaauau

SEQ ID NO: 3784744 - RNA, 14 nt, Salmonella typhimurium LT2
agcgccaccacaaa

SEQ ID NO: 3784745 - RNA, 17 nt, Salmonella typhimurium LT2
agcgccacccauuuucc

SEQ ID NO: 3784746 - RNA, 14 nt, Salmonella typhimurium LT2
agcgccacgcccaa

SEQ ID NO: 3784747 - RNA, 17 nt, Salmonella typhimurium LT2
agcgccacgcgaugcaa

SEQ ID NO: 3784748 - RNA, 15 nt, Salmonella typhimurium LT2
agcgccacgcgucag

SEQ ID NO: 3784749 - RNA, 16 nt, Salmonella typhimurium LT2
agcgccagaauagcgc

SEQ ID NO: 3784750 - RNA, 17 nt, Salmonella typhimurium LT2
agcgccagacagauaac

SEQ ID NO: 3784751 - RNA, 22 nt, Salmonella typhimurium LT2
agcgccagacagauaacaccag

SEQ ID NO: 3784752 - RNA, 12 nt, Salmonella typhimurium LT2
agcgccagcagc

SEQ ID NO: 3784753 - RNA, 13 nt, Salmonella typhimurium LT2
agcgccagcaugg

SEQ ID NO: 3784754 - RNA, 18 nt, Salmonella typhimurium LT2
agcgccagcgacugcuuc

SEQ ID NO: 3784755 - RNA, 23 nt, Salmonella typhimurium LT2
agcgccagcgguguuugccagac

SEQ ID NO: 3784756 - RNA, 13 nt, Salmonella typhimurium LT2
agcgccagcucca

SEQ ID NO: 3784757 - RNA, 14 nt, Salmonella typhimurium LT2
agcgccagcuccau

SEQ ID NO: 3784758 - RNA, 14 nt, Salmonella typhimurium LT2
agcgccaguuuuuc

SEQ ID NO: 3784759 - RNA, 20 nt, Salmonella typhimurium LT2
agcgccaguuuuuccuguuc

SEQ ID NO: 3784760 - RNA, 22 nt, Salmonella typhimurium LT2
agcgccauaaaaaacaccuguc

SEQ ID NO: 3784761 - RNA, 16 nt, Salmonella typhimurium LT2
agcgccauauccgcag

SEQ ID NO: 3784762 - RNA, 20 nt, Salmonella typhimurium LT2
agcgccauaucggcacugcu

SEQ ID NO: 3784763 - RNA, 14 nt, Salmonella typhimurium LT2
agcgccauauugcu

SEQ ID NO: 3784764 - RNA, 13 nt, Salmonella typhimurium LT2
agcgccaucagca

SEQ ID NO: 3784765 - RNA, 17 nt, Salmonella typhimurium LT2
agcgccaucagcaucau

SEQ ID NO: 3784766 - RNA, 17 nt, Salmonella typhimurium LT2
agcgccaucaggcaaug

SEQ ID NO: 3784767 - RNA, 17 nt, Salmonella typhimurium LT2
agcgccaucaggcauaa

SEQ ID NO: 3784768 - RNA, 18 nt, Salmonella typhimurium LT2
agcgccaucaggccuacg

SEQ ID NO: 3784769 - RNA, 15 nt, Salmonella typhimurium LT2
agcgccauccggcaa

SEQ ID NO: 3784770 - RNA, 18 nt, Salmonella typhimurium LT2
agcgccaucgggcauuua

SEQ ID NO: 3784771 - RNA, 12 nt, Salmonella typhimurium LT2
agcgccauugcg

SEQ ID NO: 3784772 - RNA, 13 nt, Salmonella typhimurium LT2
agcgcccagcagc

SEQ ID NO: 3784773 - RNA, 19 nt, Salmonella typhimurium LT2
agcgccccagccaaagccu

SEQ ID NO: 3784774 - RNA, 17 nt, Salmonella typhimurium LT2
agcgcccccaguuccug

SEQ ID NO: 3784775 - RNA, 23 nt, Salmonella typhimurium LT2
agcgccgacaaauccuccggcgc

SEQ ID NO: 3784776 - RNA, 23 nt, Salmonella typhimurium LT2
agcgccgauaaucggcgcggcga

SEQ ID NO: 3784777 - RNA, 16 nt, Salmonella typhimurium LT2
agcgccgcgccuacca

SEQ ID NO: 3784778 - RNA, 16 nt, Salmonella typhimurium LT2
agcgccgcuuccaggc

SEQ ID NO: 3784779 - RNA, 17 nt, Salmonella typhimurium LT2
agcgccgcuuccaggcg

SEQ ID NO: 3784780 - RNA, 17 nt, Salmonella typhimurium LT2
agcgccggauaauccag

SEQ ID NO: 3784781 - RNA, 16 nt, Salmonella typhimurium LT2
agcgccggcaacagcu

SEQ ID NO: 3784782 - RNA, 19 nt, Salmonella typhimurium LT2
agcgccggcaacagcucuu

SEQ ID NO: 3784783 - RNA, 11 nt, Salmonella typhimurium LT2
agcgccgggaa

SEQ ID NO: 3784784 - RNA, 18 nt, Salmonella typhimurium LT2
agcgccguuaaacugcgc

SEQ ID NO: 3784785 - RNA, 14 nt, Salmonella typhimurium LT2
agcgccuacgggca

SEQ ID NO: 3784786 - RNA, 15 nt, Salmonella typhimurium LT2
agcgccuacgggcau

SEQ ID NO: 3784787 - RNA, 14 nt, Salmonella typhimurium LT2
agcgccucgcaaaa

SEQ ID NO: 3784788 - RNA, 22 nt, Salmonella typhimurium LT2
agcgccucgcugacgccagcca

SEQ ID NO: 3784789 - RNA, 21 nt, Salmonella typhimurium LT2
agcgccucggcgcccagcgug

SEQ ID NO: 3784790 - RNA, 22 nt, Salmonella typhimurium LT2
agcgccugaugcacauuguccg

SEQ ID NO: 3784791 - RNA, 19 nt, Salmonella typhimurium LT2
agcgccugaugccgccguu

SEQ ID NO: 3784792 - RNA, 22 nt, Salmonella typhimurium LT2
agcgccugcgccaguucaucca

SEQ ID NO: 3784793 - RNA, 13 nt, Salmonella typhimurium LT2
agcggcuggaaga

SEQ ID NO: 3784794 - RNA, 13 nt, Salmonella typhimurium LT2
agcgggccgguaa

SEQ ID NO: 3784795 - RNA, 17 nt, Salmonella typhimurium LT2
agcgggcuggcauucau

SEQ ID NO: 3784796 - RNA, 22 nt, Salmonella typhimurium LT2
agcgggucaacgccaagcgcgg

SEQ ID NO: 3784797 - RNA, 13 nt, Salmonella typhimurium LT2
agcgggucaggaa

SEQ ID NO: 3784798 - RNA, 19 nt, Salmonella typhimurium LT2
agcgguaagucaaccagcc

SEQ ID NO: 3784799 - RNA, 11 nt, Salmonella typhimurium LT2
agcgguaccac

SEQ ID NO: 3784800 - RNA, 15 nt, Salmonella typhimurium LT2
agcgguacccggucc

SEQ ID NO: 3784801 - RNA, 19 nt, Salmonella typhimurium LT2
agcgguccggcauccaacc

SEQ ID NO: 3784802 - RNA, 15 nt, Salmonella typhimurium LT2
agcggucuuucaaca

SEQ ID NO: 3784803 - RNA, 18 nt, Salmonella typhimurium LT2
agcgguuaagauacauau

SEQ ID NO: 3784804 - RNA, 23 nt, Salmonella typhimurium LT2
agcgguugcaugaaauccuggua

SEQ ID NO: 3784805 - RNA, 19 nt, Salmonella typhimurium LT2
agcgguuggaucucaccac

SEQ ID NO: 3784806 - RNA, 16 nt, Salmonella typhimurium LT2
agcgguuucauauggg

SEQ ID NO: 3784807 - RNA, 22 nt, Salmonella typhimurium LT2
agcguaaccgguugucgcgcca

SEQ ID NO: 3784808 - RNA, 15 nt, Salmonella typhimurium LT2
agcguaauacaggcg

SEQ ID NO: 3784809 - RNA, 15 nt, Salmonella typhimurium LT2
agcguaauuucuggu

SEQ ID NO: 3784810 - RNA, 13 nt, Salmonella typhimurium LT2
agcguacaggcgg

SEQ ID NO: 3784811 - RNA, 12 nt, Salmonella typhimurium LT2
agcguaccagcg

SEQ ID NO: 3784812 - RNA, 15 nt, Salmonella typhimurium LT2
agcguaccagcguca

SEQ ID NO: 3784813 - RNA, 14 nt, Salmonella typhimurium LT2
agcguacugcagcg

SEQ ID NO: 3784814 - RNA, 18 nt, Salmonella typhimurium LT2
agcguagcgcauccggcg

SEQ ID NO: 3784815 - RNA, 13 nt, Salmonella typhimurium LT2
agcguagcgccau

SEQ ID NO: 3784816 - RNA, 17 nt, Salmonella typhimurium LT2
agcguagcgccaucagg

SEQ ID NO: 3784817 - RNA, 20 nt, Salmonella typhimurium LT2
agcguauaauuaagcugcga

SEQ ID NO: 3784818 - RNA, 13 nt, Salmonella typhimurium LT2
agcguauccagca

SEQ ID NO: 3784819 - RNA, 14 nt, Salmonella typhimurium LT2
agcguauccagcac

SEQ ID NO: 3784820 - RNA, 20 nt, Salmonella typhimurium LT2
agcguauccauucucaucag

SEQ ID NO: 3784821 - RNA, 13 nt, Salmonella typhimurium LT2
agcgucacaggcu

SEQ ID NO: 3784822 - RNA, 13 nt, Salmonella typhimurium LT2
agcgucagcacca

SEQ ID NO: 3784823 - RNA, 16 nt, Salmonella typhimurium LT2
agcgucagcgccaucc

SEQ ID NO: 3784824 - RNA, 12 nt, Salmonella typhimurium LT2
agcgucauacuu

SEQ ID NO: 3784825 - RNA, 15 nt, Salmonella typhimurium LT2
agcgucaucacaggu

SEQ ID NO: 3784826 - RNA, 20 nt, Salmonella typhimurium LT2
agcguccaguccugccccug

SEQ ID NO: 3784827 - RNA, 17 nt, Salmonella typhimurium LT2
agcgucccuggcguagu

SEQ ID NO: 3784828 - RNA, 19 nt, Salmonella typhimurium LT2
agcguccguucugauacuc

SEQ ID NO: 3784829 - RNA, 12 nt, Salmonella typhimurium LT2
agcgucgccagu

SEQ ID NO: 3784830 - RNA, 19 nt, Salmonella typhimurium LT2
agcgucgccaguaacacca

SEQ ID NO: 3784831 - RNA, 22 nt, Salmonella typhimurium LT2
agcgucgcgucagcaaaauggc

SEQ ID NO: 3784832 - RNA, 19 nt, Salmonella typhimurium LT2
agcgucguccagcccggcg

SEQ ID NO: 3784833 - RNA, 15 nt, Salmonella typhimurium LT2
agcgucuaaauuucg

SEQ ID NO: 3784834 - RNA, 15 nt, Salmonella typhimurium LT2
agcgucugcacgcca

SEQ ID NO: 3784835 - RNA, 15 nt, Salmonella typhimurium LT2
agcgucugcggcugg

SEQ ID NO: 3784836 - RNA, 18 nt, Salmonella typhimurium LT2
agcgucuuuuauccccac

SEQ ID NO: 3784837 - RNA, 15 nt, Salmonella typhimurium LT2
agcgugacccagaca

SEQ ID NO: 3784838 - RNA, 20 nt, Salmonella typhimurium LT2
agcgugacgaccggcacggu

SEQ ID NO: 3784839 - RNA, 12 nt, Salmonella typhimurium LT2
agcgugauaauu

SEQ ID NO: 3784840 - RNA, 22 nt, Salmonella typhimurium LT2
agcgugaucgucuccuguaaca

SEQ ID NO: 3784841 - RNA, 18 nt, Salmonella typhimurium LT2
agcgugaugcgauccagc

SEQ ID NO: 3784842 - RNA, 17 nt, Salmonella typhimurium LT2
agcgugcaacgucauga

SEQ ID NO: 3784843 - RNA, 23 nt, Salmonella typhimurium LT2
agcgugcguucauggcgcgacau

SEQ ID NO: 3784844 - RNA, 23 nt, Salmonella typhimurium LT2
agcgugcuguugcuaaauccaua

SEQ ID NO: 3784845 - RNA, 22 nt, Salmonella typhimurium LT2
agcguggaaaacagcgccggca

SEQ ID NO: 3784846 - RNA, 22 nt, Salmonella typhimurium LT2
agcguggcgcaaccgauagcua

SEQ ID NO: 3784847 - RNA, 16 nt, Salmonella typhimurium LT2
agcguguaaucgccgu

SEQ ID NO: 3784848 - RNA, 16 nt, Salmonella typhimurium LT2
agcguguagcaggaga

SEQ ID NO: 3784849 - RNA, 17 nt, Salmonella typhimurium LT2
agcgugucgcagauacg

SEQ ID NO: 3784850 - RNA, 22 nt, Salmonella typhimurium LT2
agcguguuucucuuaugccgcu

SEQ ID NO: 3784851 - RNA, 14 nt, Salmonella typhimurium LT2
agcguuaaacuggc

SEQ ID NO: 3784852 - RNA, 18 nt, Salmonella typhimurium LT2
agcguuaaaucaacggca

SEQ ID NO: 3784853 - RNA, 19 nt, Salmonella typhimurium LT2
agcguuaaaucaacggcau

SEQ ID NO: 3784854 - RNA, 17 nt, Salmonella typhimurium LT2
agcguuagcaacacaga

SEQ ID NO: 3784855 - RNA, 21 nt, Salmonella typhimurium LT2
agcguuagcgccaccgggcau

SEQ ID NO: 3784856 - RNA, 16 nt, Salmonella typhimurium LT2
agcguucaaaaucaaa

SEQ ID NO: 3784857 - RNA, 21 nt, Salmonella typhimurium LT2
agcguucauucccgccaauaa

SEQ ID NO: 3784858 - RNA, 18 nt, Salmonella typhimurium LT2
agcguucggccugcugca

SEQ ID NO: 3784859 - RNA, 20 nt, Salmonella typhimurium LT2
agcguucucacggucuccug

SEQ ID NO: 3784860 - RNA, 14 nt, Salmonella typhimurium LT2
agcguugaccagcc

SEQ ID NO: 3784861 - RNA, 19 nt, Salmonella typhimurium LT2
agcguugcagccacguugc

SEQ ID NO: 3784862 - RNA, 16 nt, Salmonella typhimurium LT2
agcguuggcgucaucg

SEQ ID NO: 3784863 - RNA, 19 nt, Salmonella typhimurium LT2
agcguuuaaaaagcugcau

SEQ ID NO: 3784864 - RNA, 23 nt, Salmonella typhimurium LT2
agcguuuaacugaacaucgccgu

SEQ ID NO: 3784865 - RNA, 13 nt, Salmonella typhimurium LT2
agcguuuccagcc

SEQ ID NO: 3784866 - RNA, 22 nt, Salmonella typhimurium LT2
agcguuucgauacauccggcag

SEQ ID NO: 3784867 - RNA, 22 nt, Salmonella typhimurium LT2
agcguuuguuugucgauuuccg

SEQ ID NO: 3784868 - RNA, 20 nt, Salmonella typhimurium LT2
agcguuuugauguccagaug

SEQ ID NO: 3784869 - RNA, 15 nt, Salmonella typhimurium LT2
agcguuuugcgcgua

SEQ ID NO: 3784870 - RNA, 15 nt, Salmonella typhimurium LT2
agcuaaaaaccgcaa

SEQ ID NO: 3784871 - RNA, 14 nt, Salmonella typhimurium LT2
agcuaacguacagg

SEQ ID NO: 3784872 - RNA, 16 nt, Salmonella typhimurium LT2
agcuaauccccagcgc

SEQ ID NO: 3784873 - RNA, 18 nt, Salmonella typhimurium LT2
agcuaauccccagcgcuc

SEQ ID NO: 3784874 - RNA, 22 nt, Salmonella typhimurium LT2
agcuaaugauuaucuuuuuuag

SEQ ID NO: 3784875 - RNA, 14 nt, Salmonella typhimurium LT2
agcuaaugcaauaa

SEQ ID NO: 3784876 - RNA, 20 nt, Salmonella typhimurium LT2
agcuacagggaauaugcuga

SEQ ID NO: 3784877 - RNA, 21 nt, Salmonella typhimurium LT2
agcuacguuugaacagcagcu

SEQ ID NO: 3784878 - RNA, 23 nt, Salmonella typhimurium LT2
agcuacguuugaacagcagcucg

SEQ ID NO: 3784879 - RNA, 17 nt, Salmonella typhimurium LT2
agcuauccggcaacaug

SEQ ID NO: 3784880 - RNA, 21 nt, Salmonella typhimurium LT2
agcuaucuggccugacgacgg

SEQ ID NO: 3784881 - RNA, 13 nt, Salmonella typhimurium LT2
agcuauuucugua

SEQ ID NO: 3784882 - RNA, 17 nt, Salmonella typhimurium LT2
agcucaaacguaaagca

SEQ ID NO: 3784883 - RNA, 17 nt, Salmonella typhimurium LT2
agcucaaauaugauaug

SEQ ID NO: 3784884 - RNA, 22 nt, Salmonella typhimurium LT2
agcucaacgcaggcuggagagc

SEQ ID NO: 3784885 - RNA, 18 nt, Salmonella typhimurium LT2
agcucaacgccuuuacaa

SEQ ID NO: 3784886 - RNA, 18 nt, Salmonella typhimurium LT2
agcucaagcccgcgucgu

SEQ ID NO: 3784887 - RNA, 19 nt, Salmonella typhimurium LT2
agcucaagcccgcgucguu

SEQ ID NO: 3784888 - RNA, 17 nt, Salmonella typhimurium LT2
agcucaccgagacugcc

SEQ ID NO: 3784889 - RNA, 14 nt, Salmonella typhimurium LT2
agcucaccugcucg

SEQ ID NO: 3784890 - RNA, 19 nt, Salmonella typhimurium LT2
agcucaccugcucgcccug

SEQ ID NO: 3784891 - RNA, 22 nt, Salmonella typhimurium LT2
agcucagcuggauagagcauca

SEQ ID NO: 3784892 - RNA, 19 nt, Salmonella typhimurium LT2
agcucagcuggauagagua

SEQ ID NO: 3784893 - RNA, 19 nt, Salmonella typhimurium LT2
agcucaguccagccgccgc

SEQ ID NO: 3784894 - RNA, 23 nt, Salmonella typhimurium LT2
agcucauaacggcuuaacgccag

SEQ ID NO: 3784895 - RNA, 17 nt, Salmonella typhimurium LT2
agcucauacccuuccag

SEQ ID NO: 3784896 - RNA, 22 nt, Salmonella typhimurium LT2
agcucauguagucauauugcgc

SEQ ID NO: 3784897 - RNA, 14 nt, Salmonella typhimurium LT2
aggacauacgccgc

SEQ ID NO: 3784898 - RNA, 12 nt, Salmonella typhimurium LT2
aggacaucaaag

SEQ ID NO: 3784899 - RNA, 15 nt, Salmonella typhimurium LT2
aggacgauauccacg

SEQ ID NO: 3784900 - RNA, 17 nt, Salmonella typhimurium LT2
aggacugauacagccaa

SEQ ID NO: 3784901 - RNA, 15 nt, Salmonella typhimurium LT2
aggacuuaaaaacaa

SEQ ID NO: 3784902 - RNA, 19 nt, Salmonella typhimurium LT2
aggacuuaucaggccuacg

SEQ ID NO: 3784903 - RNA, 18 nt, Salmonella typhimurium LT2
aggacuuuuuccccgcgc

SEQ ID NO: 3784904 - RNA, 15 nt, Salmonella typhimurium LT2
aggagauaucaaaag

SEQ ID NO: 3784905 - RNA, 21 nt, Salmonella typhimurium LT2
aggagaucuuuccauuucagc

SEQ ID NO: 3784906 - RNA, 17 nt, Salmonella typhimurium LT2
aggagaugaccugccca

SEQ ID NO: 3784907 - RNA, 14 nt, Salmonella typhimurium LT2
aggagaugucccac

SEQ ID NO: 3784908 - RNA, 20 nt, Salmonella typhimurium LT2
aggagcauagauaacgaugu

SEQ ID NO: 3784909 - RNA, 17 nt, Salmonella typhimurium LT2
aggaggcaaaaugccag

SEQ ID NO: 3784910 - RNA, 15 nt, Salmonella typhimurium LT2
aggauaaaaucgcca

SEQ ID NO: 3784911 - RNA, 16 nt, Salmonella typhimurium LT2
aggauacagccgacua

SEQ ID NO: 3784912 - RNA, 21 nt, Salmonella typhimurium LT2
aggauacggucgacaccagcg

SEQ ID NO: 3784913 - RNA, 16 nt, Salmonella typhimurium LT2
aggauacguucaucuu

SEQ ID NO: 3784914 - RNA, 15 nt, Salmonella typhimurium LT2
aggauauaagcgcca

SEQ ID NO: 3784915 - RNA, 15 nt, Salmonella typhimurium LT2
aggauauagugaaga

SEQ ID NO: 3784916 - RNA, 14 nt, Salmonella typhimurium LT2
aggaucaccgccac

SEQ ID NO: 3784917 - RNA, 16 nt, Salmonella typhimurium LT2
aggaucaucuccgacg

SEQ ID NO: 3784918 - RNA, 18 nt, Salmonella typhimurium LT2
aggaucugaaaggcguca

SEQ ID NO: 3784919 - RNA, 15 nt, Salmonella typhimurium LT2
aggaugaaugacugu

SEQ ID NO: 3784920 - RNA, 19 nt, Salmonella typhimurium LT2
aggaugaaugacuguccac

SEQ ID NO: 3784921 - RNA, 17 nt, Salmonella typhimurium LT2
aggaugcuccgccagag

SEQ ID NO: 3784922 - RNA, 19 nt, Salmonella typhimurium LT2
aggaugggaggcuauucaa

SEQ ID NO: 3784923 - RNA, 16 nt, Salmonella typhimurium LT2
aggauguccaggcgac

SEQ ID NO: 3784924 - RNA, 20 nt, Salmonella typhimurium LT2
aggauguuuugcggcuucag

SEQ ID NO: 3784925 - RNA, 21 nt, Salmonella typhimurium LT2
aggauguuuugcggcuucagc

SEQ ID NO: 3784926 - RNA, 22 nt, Salmonella typhimurium LT2
aggauucgacggccagcgcgcg

SEQ ID NO: 3784927 - RNA, 15 nt, Salmonella typhimurium LT2
aggauucgccauucc

SEQ ID NO: 3784928 - RNA, 20 nt, Salmonella typhimurium LT2
aggauugugguaagcaauca

SEQ ID NO: 3784929 - RNA, 18 nt, Salmonella typhimurium LT2
aggauuugucucaucuga

SEQ ID NO: 3784930 - RNA, 12 nt, Salmonella typhimurium LT2
aggcaaaaaaaa

SEQ ID NO: 3784931 - RNA, 13 nt, Salmonella typhimurium LT2
aggcaaaaauaac

SEQ ID NO: 3784932 - RNA, 15 nt, Salmonella typhimurium LT2
aggcaaaaugccagc

SEQ ID NO: 3784933 - RNA, 17 nt, Salmonella typhimurium LT2
aggcaaaaugccagccc

SEQ ID NO: 3784934 - RNA, 19 nt, Salmonella typhimurium LT2
aggcaacaugaccagcgca

SEQ ID NO: 3784935 - RNA, 21 nt, Salmonella typhimurium LT2
aggcaacgccgugagauguuc

SEQ ID NO: 3784936 - RNA, 19 nt, Salmonella typhimurium LT2
aggcaauaaaaaaggcaga

SEQ ID NO: 3784937 - RNA, 16 nt, Salmonella typhimurium LT2
aggcaauaaacaucag

SEQ ID NO: 3784938 - RNA, 22 nt, Salmonella typhimurium LT2
aggcaauacguccauuugauga

SEQ ID NO: 3784939 - RNA, 19 nt, Salmonella typhimurium LT2
aggcaauagaccagcggcc

SEQ ID NO: 3784940 - RNA, 20 nt, Salmonella typhimurium LT2
aggcaauauaccgucagcac

SEQ ID NO: 3784941 - RNA, 23 nt, Salmonella typhimurium LT2
aggcaauauaccgucagcaccag

SEQ ID NO: 3784942 - RNA, 18 nt, Salmonella typhimurium LT2
aggcaauaugucuuaaac

SEQ ID NO: 3784943 - RNA, 23 nt, Salmonella typhimurium LT2
aggcaauccuggcgcacauugcu

SEQ ID NO: 3784944 - RNA, 13 nt, Salmonella typhimurium LT2
aggcaaucggcca

SEQ ID NO: 3784945 - RNA, 13 nt, Salmonella typhimurium LT2
aggcacaacaaua

SEQ ID NO: 3784946 - RNA, 18 nt, Salmonella typhimurium LT2
aggcacaacaauauucca

SEQ ID NO: 3784947 - RNA, 18 nt, Salmonella typhimurium LT2
aggcacuacggugugccu

SEQ ID NO: 3784948 - RNA, 14 nt, Salmonella typhimurium LT2
aggcacuugagaaa

SEQ ID NO: 3784949 - RNA, 22 nt, Salmonella typhimurium LT2
aggcacuuucauugccguuaac

SEQ ID NO: 3784950 - RNA, 21 nt, Salmonella typhimurium LT2
aggcagauccaaauggcguac

SEQ ID NO: 3784951 - RNA, 15 nt, Salmonella typhimurium LT2
aggcagauucuucug

SEQ ID NO: 3784952 - RNA, 14 nt, Salmonella typhimurium LT2
aggcagcacaauca

SEQ ID NO: 3784953 - RNA, 19 nt, Salmonella typhimurium LT2
aggcagcaccucaauauga

SEQ ID NO: 3784954 - RNA, 18 nt, Salmonella typhimurium LT2
aggcagccggauuuuaaa

SEQ ID NO: 3784955 - RNA, 20 nt, Salmonella typhimurium LT2
aggcagcguaauacaggcga

SEQ ID NO: 3784956 - RNA, 16 nt, Salmonella typhimurium LT2
aggcagcguggcgagc

SEQ ID NO: 3784957 - RNA, 15 nt, Salmonella typhimurium LT2
aggcaggaaauccag

SEQ ID NO: 3784958 - RNA, 17 nt, Salmonella typhimurium LT2
aggcaggaaauccagca

SEQ ID NO: 3784959 - RNA, 15 nt, Salmonella typhimurium LT2
aggcaggcauuggca

SEQ ID NO: 3784960 - RNA, 16 nt, Salmonella typhimurium LT2
aggcaggucugauaaa

SEQ ID NO: 3784961 - RNA, 17 nt, Salmonella typhimurium LT2
aggcaguaacucuauau

SEQ ID NO: 3784962 - RNA, 13 nt, Salmonella typhimurium LT2
aggcauaaaaaaa

SEQ ID NO: 3784963 - RNA, 16 nt, Salmonella typhimurium LT2
aggcauaaugccacga

SEQ ID NO: 3784964 - RNA, 19 nt, Salmonella typhimurium LT2
aggcauaauggaacugccu

SEQ ID NO: 3784965 - RNA, 14 nt, Salmonella typhimurium LT2
aggcauagaaaaag

SEQ ID NO: 3784966 - RNA, 22 nt, Salmonella typhimurium LT2
aggcauagcaacgacgcaagca

SEQ ID NO: 3784967 - RNA, 17 nt, Salmonella typhimurium LT2
aggcaucaacucgauac

SEQ ID NO: 3784968 - RNA, 19 nt, Salmonella typhimurium LT2
aggcauccgugaccugcug

SEQ ID NO: 3784969 - RNA, 21 nt, Salmonella typhimurium LT2
aggcauccgugaccugcugac

SEQ ID NO: 3784970 - RNA, 22 nt, Salmonella typhimurium LT2
aggcaucgacgccagcggguga

SEQ ID NO: 3784971 - RNA, 15 nt, Salmonella typhimurium LT2
aggcaucgcgccgcc

SEQ ID NO: 3784972 - RNA, 18 nt, Salmonella typhimurium LT2
aggcaucguacgggcaaa

SEQ ID NO: 3784973 - RNA, 22 nt, Salmonella typhimurium LT2
aggcaucuaucagaggggaugg

SEQ ID NO: 3784974 - RNA, 18 nt, Salmonella typhimurium LT2
aggcaugguuaacaauau

SEQ ID NO: 3784975 - RNA, 21 nt, Salmonella typhimurium LT2
aggcauguugcgcaaucacgc

SEQ ID NO: 3784976 - RNA, 15 nt, Salmonella typhimurium LT2
aggcauuaaaaaaac

SEQ ID NO: 3784977 - RNA, 16 nt, Salmonella typhimurium LT2
aggcauuaaaaaaacg

SEQ ID NO: 3784978 - RNA, 22 nt, Salmonella typhimurium LT2
aggcauuaguaauaaagcguag

SEQ ID NO: 3784979 - RNA, 13 nt, Salmonella typhimurium LT2
aggcauuggcauu

SEQ ID NO: 3784980 - RNA, 17 nt, Salmonella typhimurium LT2
aggcauuggcauucuuu

SEQ ID NO: 3784981 - RNA, 20 nt, Salmonella typhimurium LT2
aggccaaacccugcgccaca

SEQ ID NO: 3784982 - RNA, 22 nt, Salmonella typhimurium LT2
aggccaaauagggguucauaag

SEQ ID NO: 3784983 - RNA, 22 nt, Salmonella typhimurium LT2
aggccaacauagcggcaaggaa

SEQ ID NO: 3784984 - RNA, 20 nt, Salmonella typhimurium LT2
aggccagaaggcgaacauaa

SEQ ID NO: 3784985 - RNA, 12 nt, Salmonella typhimurium LT2
aggccagacuga

SEQ ID NO: 3784986 - RNA, 16 nt, Salmonella typhimurium LT2
aggccagauucaccac

SEQ ID NO: 3784987 - RNA, 13 nt, Salmonella typhimurium LT2
aggccagccugau

SEQ ID NO: 3784988 - RNA, 23 nt, Salmonella typhimurium LT2
aggccaggcguuguccaguaagg

SEQ ID NO: 3784989 - RNA, 15 nt, Salmonella typhimurium LT2
aggccaucacuggca

SEQ ID NO: 3784990 - RNA, 20 nt, Salmonella typhimurium LT2
aggccaucugaucgcugagc

SEQ ID NO: 3784991 - RNA, 20 nt, Salmonella typhimurium LT2
aggccauuaagcuucgugag

SEQ ID NO: 3784992 - RNA, 20 nt, Salmonella typhimurium LT2
aggccauuaauauuuuauca

SEQ ID NO: 3784993 - RNA, 18 nt, Salmonella typhimurium LT2
aggccgccaccgccucgc

SEQ ID NO: 3784994 - RNA, 10 nt, Salmonella typhimurium LT2
aggccgccgc

SEQ ID NO: 3784995 - RNA, 18 nt, Salmonella typhimurium LT2
aggccgccgcacaggcga

SEQ ID NO: 3784996 - RNA, 17 nt, Salmonella typhimurium LT2
aggccgccgggucagaa

SEQ ID NO: 3784997 - RNA, 19 nt, Salmonella typhimurium LT2
aggccgccgggucagaaaa

SEQ ID NO: 3784998 - RNA, 20 nt, Salmonella typhimurium LT2
aggccggaacgacguucaga

SEQ ID NO: 3784999 - RNA, 16 nt, Salmonella typhimurium LT2
aggccggacaaggcgg

SEQ ID NO: 3785000 - RNA, 14 nt, Salmonella typhimurium LT2
aggccggacaggcg

SEQ ID NO: 3785001 - RNA, 16 nt, Salmonella typhimurium LT2
aggcugggucaguggu

SEQ ID NO: 3785002 - RNA, 22 nt, Salmonella typhimurium LT2
aggcuggguugauaccggagga

SEQ ID NO: 3785003 - RNA, 17 nt, Salmonella typhimurium LT2
aggcugugacugucguu

SEQ ID NO: 3785004 - RNA, 15 nt, Salmonella typhimurium LT2
aggcuuaccaaacag

SEQ ID NO: 3785005 - RNA, 21 nt, Salmonella typhimurium LT2
aggcuucacgccacaguuggu

SEQ ID NO: 3785006 - RNA, 13 nt, Salmonella typhimurium LT2
aggcuucacgcuc

SEQ ID NO: 3785007 - RNA, 15 nt, Salmonella typhimurium LT2
aggcuuccacgcacg

SEQ ID NO: 3785008 - RNA, 14 nt, Salmonella typhimurium LT2
aggcuuccagauac

SEQ ID NO: 3785009 - RNA, 22 nt, Salmonella typhimurium LT2
aggcuucgcgcagccagcgccc

SEQ ID NO: 3785010 - RNA, 19 nt, Salmonella typhimurium LT2
aggcuugccgcgccagacg

SEQ ID NO: 3785011 - RNA, 17 nt, Salmonella typhimurium LT2
aggcuuuaugcugacaa

SEQ ID NO: 3785012 - RNA, 16 nt, Salmonella typhimurium LT2
aggcuuuugguucaaa

SEQ ID NO: 3785013 - RNA, 14 nt, Salmonella typhimurium LT2
agggaaaagccauu

SEQ ID NO: 3785014 - RNA, 17 nt, Salmonella typhimurium LT2
agggaaaagccauugcc

SEQ ID NO: 3785015 - RNA, 23 nt, Salmonella typhimurium LT2
agggaaaccauguugaucguaaa

SEQ ID NO: 3785016 - RNA, 13 nt, Salmonella typhimurium LT2
agggaacacggca

SEQ ID NO: 3785017 - RNA, 22 nt, Salmonella typhimurium LT2
agggaacacggcaugaagcagc

SEQ ID NO: 3785018 - RNA, 14 nt, Salmonella typhimurium LT2
agggaacuccagca

SEQ ID NO: 3785019 - RNA, 18 nt, Salmonella typhimurium LT2
agggaauaagcacccaug

SEQ ID NO: 3785020 - RNA, 21 nt, Salmonella typhimurium LT2
agggaaugcgccgucaggcuu

SEQ ID NO: 3785021 - RNA, 20 nt, Salmonella typhimurium LT2
agggacacauuucuuuugau

SEQ ID NO: 3785022 - RNA, 14 nt, Salmonella typhimurium LT2
agggagcagacugu

SEQ ID NO: 3785023 - RNA, 18 nt, Salmonella typhimurium LT2
agggagcagacuguaaau

SEQ ID NO: 3785024 - RNA, 19 nt, Salmonella typhimurium LT2
agggaggugcucucccagc

SEQ ID NO: 3785025 - RNA, 21 nt, Salmonella typhimurium LT2
agggaggugcucucccagcug

SEQ ID NO: 3785026 - RNA, 23 nt, Salmonella typhimurium LT2
agggaggugcucucccagcugag

SEQ ID NO: 3785027 - RNA, 23 nt, Salmonella typhimurium LT2
agggaguaugcggucaaaagcug

SEQ ID NO: 3785028 - RNA, 22 nt, Salmonella typhimurium LT2
agggaucaagcaauaccagaaa

SEQ ID NO: 3785029 - RNA, 16 nt, Salmonella typhimurium LT2
agggaucaauguaaaa

SEQ ID NO: 3785030 - RNA, 16 nt, Salmonella typhimurium LT2
agggaucaucuucacu

SEQ ID NO: 3785031 - RNA, 14 nt, Salmonella typhimurium LT2
agggauuaugcaga

SEQ ID NO: 3785032 - RNA, 13 nt, Salmonella typhimurium LT2
agggauuuugcuu

SEQ ID NO: 3785033 - RNA, 16 nt, Salmonella typhimurium LT2
agggcaacaaacauaa

SEQ ID NO: 3785034 - RNA, 12 nt, Salmonella typhimurium LT2
agggcaagggca

SEQ ID NO: 3785035 - RNA, 23 nt, Salmonella typhimurium LT2
agggcaggggccagcauaguaaa

SEQ ID NO: 3785036 - RNA, 12 nt, Salmonella typhimurium LT2
agggcauuaaau

SEQ ID NO: 3785037 - RNA, 15 nt, Salmonella typhimurium LT2
agggccagagaaagu

SEQ ID NO: 3785038 - RNA, 23 nt, Salmonella typhimurium LT2
agggcgaacauuccgcccaggaa

SEQ ID NO: 3785039 - RNA, 18 nt, Salmonella typhimurium LT2
agggcgauucccgaucuu

SEQ ID NO: 3785040 - RNA, 21 nt, Salmonella typhimurium LT2
agggcggcgcgcugccgcccu

SEQ ID NO: 3785041 - RNA, 13 nt, Salmonella typhimurium LT2
agggcggcuggau

SEQ ID NO: 3785042 - RNA, 17 nt, Salmonella typhimurium LT2
agggcgggcgauagaga

SEQ ID NO: 3785043 - RNA, 23 nt, Salmonella typhimurium LT2
agggcgugacgcgccagcaaaau

SEQ ID NO: 3785044 - RNA, 14 nt, Salmonella typhimurium LT2
agggcuuccgcuuu

SEQ ID NO: 3785045 - RNA, 20 nt, Salmonella typhimurium LT2
aggggaucgugcaguaaugc

SEQ ID NO: 3785046 - RNA, 17 nt, Salmonella typhimurium LT2
aggggauggcguauucc

SEQ ID NO: 3785047 - RNA, 15 nt, Salmonella typhimurium LT2
aggggcauuuuccgg

SEQ ID NO: 3785048 - RNA, 23 nt, Salmonella typhimurium LT2
aggggccugcacaauaccaauaa

SEQ ID NO: 3785049 - RNA, 21 nt, Salmonella typhimurium LT2
aggggcuggcauuacgcuggc

SEQ ID NO: 3785050 - RNA, 14 nt, Salmonella typhimurium LT2
agggguuccggcaa

SEQ ID NO: 3785051 - RNA, 20 nt, Salmonella typhimurium LT2
aggguaccugggcaauaacg

SEQ ID NO: 3785052 - RNA, 14 nt, Salmonella typhimurium LT2
aggguauacaaaaa

SEQ ID NO: 3785053 - RNA, 13 nt, Salmonella typhimurium LT2
aggguaucaucaa

SEQ ID NO: 3785054 - RNA, 20 nt, Salmonella typhimurium LT2
agggucgccgcgcccagcag

SEQ ID NO: 3785055 - RNA, 22 nt, Salmonella typhimurium LT2
agggucgccgcgcccagcagca

SEQ ID NO: 3785056 - RNA, 19 nt, Salmonella typhimurium LT2
agggugaaccaaagcaaaa

SEQ ID NO: 3785057 - RNA, 16 nt, Salmonella typhimurium LT2
agggugaauaccagcg

SEQ ID NO: 3785058 - RNA, 22 nt, Salmonella typhimurium LT2
agggugacucauuucaacauau

SEQ ID NO: 3785059 - RNA, 23 nt, Salmonella typhimurium LT2
agggugauuucgcccgcauucgc

SEQ ID NO: 3785060 - RNA, 13 nt, Salmonella typhimurium LT2
agggugccaggca

SEQ ID NO: 3785061 - RNA, 11 nt, Salmonella typhimurium LT2
aggguggcgcc

SEQ ID NO: 3785062 - RNA, 15 nt, Salmonella typhimurium LT2
aggguguucaccauu

SEQ ID NO: 3785063 - RNA, 17 nt, Salmonella typhimurium LT2
aggguuagcgcguugag

SEQ ID NO: 3785064 - RNA, 17 nt, Salmonella typhimurium LT2
aggguuuucaggaagga

SEQ ID NO: 3785065 - RNA, 17 nt, Salmonella typhimurium LT2
aggguuuugccgucaca

SEQ ID NO: 3785066 - RNA, 20 nt, Salmonella typhimurium LT2
agguaaacgcgaccagcgca

SEQ ID NO: 3785067 - RNA, 22 nt, Salmonella typhimurium LT2
agguaaaggcggaaaucagcac

SEQ ID NO: 3785068 - RNA, 17 nt, Salmonella typhimurium LT2
agguaaauuagcgcgaa

SEQ ID NO: 3785069 - RNA, 20 nt, Salmonella typhimurium LT2
agguaacgcgaaaaaaagau

SEQ ID NO: 3785070 - RNA, 13 nt, Salmonella typhimurium LT2
agguaagcccuua

SEQ ID NO: 3785071 - RNA, 23 nt, Salmonella typhimurium LT2
agguaagcccuuacaaaaaucau

SEQ ID NO: 3785072 - RNA, 13 nt, Salmonella typhimurium LT2
agguaagggugaa

SEQ ID NO: 3785073 - RNA, 18 nt, Salmonella typhimurium LT2
agguaaguguaaguucau

SEQ ID NO: 3785074 - RNA, 16 nt, Salmonella typhimurium LT2
agguaauuuggcgaga

SEQ ID NO: 3785075 - RNA, 14 nt, Salmonella typhimurium LT2
agguacgcguuuca

SEQ ID NO: 3785076 - RNA, 20 nt, Salmonella typhimurium LT2
agguacgcguuucacaaccu

SEQ ID NO: 3785077 - RNA, 11 nt, Salmonella typhimurium LT2
agguacugcau

SEQ ID NO: 3785078 - RNA, 22 nt, Salmonella typhimurium LT2
agguagcugcacaagccccacg

SEQ ID NO: 3785079 - RNA, 17 nt, Salmonella typhimurium LT2
agguauaaucagcauca

SEQ ID NO: 3785080 - RNA, 18 nt, Salmonella typhimurium LT2
agguauacauccacuggu

SEQ ID NO: 3785081 - RNA, 18 nt, Salmonella typhimurium LT2
agguaucauaugugccga

SEQ ID NO: 3785082 - RNA, 13 nt, Salmonella typhimurium LT2
agguauccagcag

SEQ ID NO: 3785083 - RNA, 14 nt, Salmonella typhimurium LT2
agguauccagcaga

SEQ ID NO: 3785084 - RNA, 14 nt, Salmonella typhimurium LT2
agguauccgccaua

SEQ ID NO: 3785085 - RNA, 14 nt, Salmonella typhimurium LT2
agguauuaaauaca

SEQ ID NO: 3785086 - RNA, 19 nt, Salmonella typhimurium LT2
agguauuaaauacagaguc

SEQ ID NO: 3785087 - RNA, 16 nt, Salmonella typhimurium LT2
aggucagcaguuuuuc

SEQ ID NO: 3785088 - RNA, 21 nt, Salmonella typhimurium LT2
aggucagguaagcgcuagcgc

SEQ ID NO: 3785089 - RNA, 16 nt, Salmonella typhimurium LT2
aggucaucacauccca

SEQ ID NO: 3785090 - RNA, 19 nt, Salmonella typhimurium LT2
aggucaugaucgauccgca

SEQ ID NO: 3785091 - RNA, 17 nt, Salmonella typhimurium LT2
aggucauuauucaggcc

SEQ ID NO: 3785092 - RNA, 20 nt, Salmonella typhimurium LT2
aggucgcuauccagcaguaa

SEQ ID NO: 3785093 - RNA, 22 nt, Salmonella typhimurium LT2
aggucgcuauccagcaguaaau

SEQ ID NO: 3785094 - RNA, 23 nt, Salmonella typhimurium LT2
aggucgcuauccagcaguaaaua

SEQ ID NO: 3785095 - RNA, 14 nt, Salmonella typhimurium LT2
aggucguuuccccc

SEQ ID NO: 3785096 - RNA, 13 nt, Salmonella typhimurium LT2
aggucuccagcuc

SEQ ID NO: 3785097 - RNA, 15 nt, Salmonella typhimurium LT2
aggucugacaacuau

SEQ ID NO: 3785098 - RNA, 13 nt, Salmonella typhimurium LT2
aggucuggcaggg

SEQ ID NO: 3785099 - RNA, 18 nt, Salmonella typhimurium LT2
aggucuugauagcgauca

SEQ ID NO: 3785100 - RNA, 18 nt, Salmonella typhimurium LT2
aggucuugccaacaaagg

SEQ ID NO: 3785101 - RNA, 20 nt, Salmonella typhimurium LT2
aggucuugccaacaaagguu

SEQ ID NO: 3785102 - RNA, 22 nt, Salmonella typhimurium LT2
aggucuuuaucuaucaccgccu

SEQ ID NO: 3785103 - RNA, 16 nt, Salmonella typhimurium LT2
aggugaauaccaaagc

SEQ ID NO: 3785104 - RNA, 13 nt, Salmonella typhimurium LT2
aggugagcucuuu

SEQ ID NO: 3785105 - RNA, 20 nt, Salmonella typhimurium LT2
aguacgggucugaauagcgc

SEQ ID NO: 3785106 - RNA, 23 nt, Salmonella typhimurium LT2
aguacgguuugcggauuggauaa

SEQ ID NO: 3785107 - RNA, 15 nt, Salmonella typhimurium LT2
aguacuccaguacug

SEQ ID NO: 3785108 - RNA, 16 nt, Salmonella typhimurium LT2
aguacuggaauaucua

SEQ ID NO: 3785109 - RNA, 18 nt, Salmonella typhimurium LT2
aguagacagagaagcugc

SEQ ID NO: 3785110 - RNA, 22 nt, Salmonella typhimurium LT2
aguagcaagguauguauuuuau

SEQ ID NO: 3785111 - RNA, 11 nt, Salmonella typhimurium LT2
aguagcagcga

SEQ ID NO: 3785112 - RNA, 22 nt, Salmonella typhimurium LT2
aguagccaugcauaaugcagcc

SEQ ID NO: 3785113 - RNA, 19 nt, Salmonella typhimurium LT2
aguagcccugacgaacaga

SEQ ID NO: 3785114 - RNA, 15 nt, Salmonella typhimurium LT2
aguagcgcgcccaug

SEQ ID NO: 3785115 - RNA, 20 nt, Salmonella typhimurium LT2
aguagcguucucuccaguuc

SEQ ID NO: 3785116 - RNA, 23 nt, Salmonella typhimurium LT2
aguagcugagaguaaauuauuua

SEQ ID NO: 3785117 - RNA, 16 nt, Salmonella typhimurium LT2
aguagguauccagcag

SEQ ID NO: 3785118 - RNA, 13 nt, Salmonella typhimurium LT2
aguaguuaaaaaa

SEQ ID NO: 3785119 - RNA, 16 nt, Salmonella typhimurium LT2
aguaguugguggguga

SEQ ID NO: 3785120 - RNA, 15 nt, Salmonella typhimurium LT2
aguauaagcgccgcu

SEQ ID NO: 3785121 - RNA, 11 nt, Salmonella typhimurium LT2
aguauauauga

SEQ ID NO: 3785122 - RNA, 13 nt, Salmonella typhimurium LT2
aguauaugucuga

SEQ ID NO: 3785123 - RNA, 19 nt, Salmonella typhimurium LT2
aguaugcgacgguaaaaau

SEQ ID NO: 3785124 - RNA, 23 nt, Salmonella typhimurium LT2
aguaugucuaugauuuuaaagca

SEQ ID NO: 3785125 - RNA, 15 nt, Salmonella typhimurium LT2
aguauucaccuggaa

SEQ ID NO: 3785126 - RNA, 21 nt, Salmonella typhimurium LT2
aguauuuccuuccgaaucaau

SEQ ID NO: 3785127 - RNA, 22 nt, Salmonella typhimurium LT2
agucaaaagauugauuuauuca

SEQ ID NO: 3785128 - RNA, 13 nt, Salmonella typhimurium LT2
agucaaaauaaaa

SEQ ID NO: 3785129 - RNA, 12 nt, Salmonella typhimurium LT2
agucaaauucca

SEQ ID NO: 3785130 - RNA, 14 nt, Salmonella typhimurium LT2
agucaccagcagca

SEQ ID NO: 3785131 - RNA, 15 nt, Salmonella typhimurium LT2
agucaccagcagcac

SEQ ID NO: 3785132 - RNA, 16 nt, Salmonella typhimurium LT2
agucaccagcagcaca

SEQ ID NO: 3785133 - RNA, 19 nt, Salmonella typhimurium LT2
agucagacaaguagccugc

SEQ ID NO: 3785134 - RNA, 15 nt, Salmonella typhimurium LT2
agucagacaccagcc

SEQ ID NO: 3785135 - RNA, 14 nt, Salmonella typhimurium LT2
agucagcaauuaac

SEQ ID NO: 3785136 - RNA, 13 nt, Salmonella typhimurium LT2
agucagcguuacu

SEQ ID NO: 3785137 - RNA, 19 nt, Salmonella typhimurium LT2
agucaggcacaaaaaacaa

SEQ ID NO: 3785138 - RNA, 15 nt, Salmonella typhimurium LT2
agucaguuuaugacu

SEQ ID NO: 3785139 - RNA, 13 nt, Salmonella typhimurium LT2
agucaguuuucaa

SEQ ID NO: 3785140 - RNA, 21 nt, Salmonella typhimurium LT2
agucaucgucugcgucuucuu

SEQ ID NO: 3785141 - RNA, 18 nt, Salmonella typhimurium LT2
agucaucugccaguuauc

SEQ ID NO: 3785142 - RNA, 18 nt, Salmonella typhimurium LT2
agucaugaagucuaucug

SEQ ID NO: 3785143 - RNA, 18 nt, Salmonella typhimurium LT2
agucaugagcuauuucag

SEQ ID NO: 3785144 - RNA, 14 nt, Salmonella typhimurium LT2
agucauggcuuuua

SEQ ID NO: 3785145 - RNA, 19 nt, Salmonella typhimurium LT2
agucauucuguagauacug

SEQ ID NO: 3785146 - RNA, 15 nt, Salmonella typhimurium LT2
agucauugacagcaa

SEQ ID NO: 3785147 - RNA, 20 nt, Salmonella typhimurium LT2
aguccaacaaggauauccgc

SEQ ID NO: 3785148 - RNA, 22 nt, Salmonella typhimurium LT2
aguccaacaaggauauccgcca

SEQ ID NO: 3785149 - RNA, 18 nt, Salmonella typhimurium LT2
aguccacaucuaccaggu

SEQ ID NO: 3785150 - RNA, 19 nt, Salmonella typhimurium LT2
aguccacguuuuacuuccu

SEQ ID NO: 3785151 - RNA, 14 nt, Salmonella typhimurium LT2
aguccagcagccau

SEQ ID NO: 3785152 - RNA, 17 nt, Salmonella typhimurium LT2
aguccauaccguuucaa

SEQ ID NO: 3785153 - RNA, 13 nt, Salmonella typhimurium LT2
aguccauauccgu

SEQ ID NO: 3785154 - RNA, 21 nt, Salmonella typhimurium LT2
aguccauauccguacauaaca

SEQ ID NO: 3785155 - RNA, 14 nt, Salmonella typhimurium LT2
aguccauuuuccua

SEQ ID NO: 3785156 - RNA, 19 nt, Salmonella typhimurium LT2
aguccccccccucgcacca

SEQ ID NO: 3785157 - RNA, 18 nt, Salmonella typhimurium LT2
aguccccuuuucacccaa

SEQ ID NO: 3785158 - RNA, 20 nt, Salmonella typhimurium LT2
agucccgcacuuuccagccc

SEQ ID NO: 3785159 - RNA, 19 nt, Salmonella typhimurium LT2
agucccguccguuccgcca

SEQ ID NO: 3785160 - RNA, 17 nt, Salmonella typhimurium LT2
agucccuccgcuuccac

SEQ ID NO: 3785161 - RNA, 17 nt, Salmonella typhimurium LT2
aguccgaggcaugguua

SEQ ID NO: 3785162 - RNA, 20 nt, Salmonella typhimurium LT2
aguccgaugguuaaauugaa

SEQ ID NO: 3785163 - RNA, 21 nt, Salmonella typhimurium LT2
aguccgcccgccucaaaccag

SEQ ID NO: 3785164 - RNA, 19 nt, Salmonella typhimurium LT2
aguccgccgucgucaccgc

SEQ ID NO: 3785165 - RNA, 15 nt, Salmonella typhimurium LT2
aguccgccguugaga

SEQ ID NO: 3785166 - RNA, 14 nt, Salmonella typhimurium LT2
aguccggcgaaaaa

SEQ ID NO: 3785167 - RNA, 17 nt, Salmonella typhimurium LT2
aguccgguggcgaaaac

SEQ ID NO: 3785168 - RNA, 20 nt, Salmonella typhimurium LT2
aguccgucagaauaucuuuu

SEQ ID NO: 3785169 - RNA, 18 nt, Salmonella typhimurium LT2
aguccgucgagcgcggag

SEQ ID NO: 3785170 - RNA, 21 nt, Salmonella typhimurium LT2
aguccgucguuaaucagcgcg

SEQ ID NO: 3785171 - RNA, 16 nt, Salmonella typhimurium LT2
aguccguuuaaagaca

SEQ ID NO: 3785172 - RNA, 15 nt, Salmonella typhimurium LT2
aguccuccggcugaa

SEQ ID NO: 3785173 - RNA, 16 nt, Salmonella typhimurium LT2
aguccucgcccacuuc

SEQ ID NO: 3785174 - RNA, 14 nt, Salmonella typhimurium LT2
aguccucuauuuuu

SEQ ID NO: 3785175 - RNA, 21 nt, Salmonella typhimurium LT2
aguccucuauuuuuucaauca

SEQ ID NO: 3785176 - RNA, 22 nt, Salmonella typhimurium LT2
aguccugccauucgacaagcgg

SEQ ID NO: 3785177 - RNA, 22 nt, Salmonella typhimurium LT2
aguccugccggacugauaccgc

SEQ ID NO: 3785178 - RNA, 21 nt, Salmonella typhimurium LT2
aguccugcgcuuugacauugu

SEQ ID NO: 3785179 - RNA, 20 nt, Salmonella typhimurium LT2
aguccugcgucgcuucgcca

SEQ ID NO: 3785180 - RNA, 19 nt, Salmonella typhimurium LT2
aguccuuaucccugcggcu

SEQ ID NO: 3785181 - RNA, 18 nt, Salmonella typhimurium LT2
aguccuucuccuucgcca

SEQ ID NO: 3785182 - RNA, 21 nt, Salmonella typhimurium LT2
agucgaacuuugcgaaaaagu

SEQ ID NO: 3785183 - RNA, 17 nt, Salmonella typhimurium LT2
agucgacagcccgccag

SEQ ID NO: 3785184 - RNA, 20 nt, Salmonella typhimurium LT2
agucgacagcccgccagcau

SEQ ID NO: 3785185 - RNA, 21 nt, Salmonella typhimurium LT2
agucgacagcccgccagcaua

SEQ ID NO: 3785186 - RNA, 16 nt, Salmonella typhimurium LT2
agucgacucaucuuuu

SEQ ID NO: 3785187 - RNA, 16 nt, Salmonella typhimurium LT2
agucgauaaaugcccg

SEQ ID NO: 3785188 - RNA, 15 nt, Salmonella typhimurium LT2
agucgcagcggcugc

SEQ ID NO: 3785189 - RNA, 16 nt, Salmonella typhimurium LT2
agucgcaucauggcga

SEQ ID NO: 3785190 - RNA, 21 nt, Salmonella typhimurium LT2
agucgccaugaguucaauaug

SEQ ID NO: 3785191 - RNA, 14 nt, Salmonella typhimurium LT2
agucgccgcggcgc

SEQ ID NO: 3785192 - RNA, 17 nt, Salmonella typhimurium LT2
agucgcgggcgcuaaac

SEQ ID NO: 3785193 - RNA, 24 nt, Salmonella typhimurium LT2
agucgcucagguuguccagcagca

SEQ ID NO: 3785194 - RNA, 18 nt, Salmonella typhimurium LT2
agucgcugcgcucaucag

SEQ ID NO: 3785195 - RNA, 20 nt, Salmonella typhimurium LT2
agucgcuuaucugcugcugg

SEQ ID NO: 3785196 - RNA, 17 nt, Salmonella typhimurium LT2
agucgcuuuucauacug

SEQ ID NO: 3785197 - RNA, 16 nt, Salmonella typhimurium LT2
agucgggaucgccaga

SEQ ID NO: 3785198 - RNA, 16 nt, Salmonella typhimurium LT2
agucggguagaaauuc

SEQ ID NO: 3785199 - RNA, 20 nt, Salmonella typhimurium LT2
agucgucgcuaucagacuga

SEQ ID NO: 3785200 - RNA, 22 nt, Salmonella typhimurium LT2
agucgugucauagucggcgcca

SEQ ID NO: 3785201 - RNA, 15 nt, Salmonella typhimurium LT2
agucuaaaaauaauu

SEQ ID NO: 3785202 - RNA, 20 nt, Salmonella typhimurium LT2
agucuaaccgaugcccggca

SEQ ID NO: 3785203 - RNA, 23 nt, Salmonella typhimurium LT2
agucuaaccgaugcccggcaauc

SEQ ID NO: 3785204 - RNA, 16 nt, Salmonella typhimurium LT2
agucuaauaacacaau

SEQ ID NO: 3785205 - RNA, 20 nt, Salmonella typhimurium LT2
agucuccgccaccugaauaa

SEQ ID NO: 3785206 - RNA, 14 nt, Salmonella typhimurium LT2
agucuggcugcggc

SEQ ID NO: 3785207 - RNA, 21 nt, Salmonella typhimurium LT2
agucuggcugcggccuccgca

SEQ ID NO: 3785208 - RNA, 11 nt, Salmonella typhimurium LT2
aguuccuccug

SEQ ID NO: 3785209 - RNA, 24 nt, Salmonella typhimurium LT2
aguuccugugcggcauagccuauc

SEQ ID NO: 3785210 - RNA, 16 nt, Salmonella typhimurium LT2
aguucgaauagccggu

SEQ ID NO: 3785211 - RNA, 15 nt, Salmonella typhimurium LT2
aguucgccuucuuca

SEQ ID NO: 3785212 - RNA, 18 nt, Salmonella typhimurium LT2
aguucgguuacaugcuga

SEQ ID NO: 3785213 - RNA, 19 nt, Salmonella typhimurium LT2
aguucgguuacaugcugaa

SEQ ID NO: 3785214 - RNA, 16 nt, Salmonella typhimurium LT2
aguucguacuccugca

SEQ ID NO: 3785215 - RNA, 16 nt, Salmonella typhimurium LT2
aguucguagagcucca

SEQ ID NO: 3785216 - RNA, 14 nt, Salmonella typhimurium LT2
aguucguccaccuc

SEQ ID NO: 3785217 - RNA, 18 nt, Salmonella typhimurium LT2
aguucucgguauccagcu

SEQ ID NO: 3785218 - RNA, 18 nt, Salmonella typhimurium LT2
aguucuucccugcaauau

SEQ ID NO: 3785219 - RNA, 16 nt, Salmonella typhimurium LT2
aguucuuucgccagaa

SEQ ID NO: 3785220 - RNA, 17 nt, Salmonella typhimurium LT2
aguucuuucgccagaac

SEQ ID NO: 3785221 - RNA, 23 nt, Salmonella typhimurium LT2
aguucuuucgccagaaccgcgcu

SEQ ID NO: 3785222 - RNA, 22 nt, Salmonella typhimurium LT2
aguugauacauuuuuuggugau

SEQ ID NO: 3785223 - RNA, 20 nt, Salmonella typhimurium LT2
aguugauauuuaaacggggu

SEQ ID NO: 3785224 - RNA, 19 nt, Salmonella typhimurium LT2
aguugcacccgaacaacaa

SEQ ID NO: 3785225 - RNA, 23 nt, Salmonella typhimurium LT2
aguugccccuuguugaaacauca

SEQ ID NO: 3785226 - RNA, 19 nt, Salmonella typhimurium LT2
aguugcgacuguucaucaa

SEQ ID NO: 3785227 - RNA, 18 nt, Salmonella typhimurium LT2
aguugcgauccuuccggc

SEQ ID NO: 3785228 - RNA, 13 nt, Salmonella typhimurium LT2
aguugcgcagggu

SEQ ID NO: 3785229 - RNA, 16 nt, Salmonella typhimurium LT2
aguugcgcaggguauc

SEQ ID NO: 3785230 - RNA, 14 nt, Salmonella typhimurium LT2
aguugcgccacugc

SEQ ID NO: 3785231 - RNA, 22 nt, Salmonella typhimurium LT2
aguugcgcuacuuuauaaauca

SEQ ID NO: 3785232 - RNA, 19 nt, Salmonella typhimurium LT2
aguugcguucccaguuccg

SEQ ID NO: 3785233 - RNA, 13 nt, Salmonella typhimurium LT2
aguugcugauuaa

SEQ ID NO: 3785234 - RNA, 21 nt, Salmonella typhimurium LT2
aguugcugauuaaaaucauua

SEQ ID NO: 3785235 - RNA, 23 nt, Salmonella typhimurium LT2
aguugcugucgcucacgauaacg

SEQ ID NO: 3785236 - RNA, 18 nt, Salmonella typhimurium LT2
aguuggcuugccagcaga

SEQ ID NO: 3785237 - RNA, 22 nt, Salmonella typhimurium LT2
aguuguacuuguugcuggcagg

SEQ ID NO: 3785238 - RNA, 16 nt, Salmonella typhimurium LT2
aguuguccauuuuccu

SEQ ID NO: 3785239 - RNA, 14 nt, Salmonella typhimurium LT2
aguuguuccagcag

SEQ ID NO: 3785240 - RNA, 21 nt, Salmonella typhimurium LT2
aguuguugucgagguuauaaa

SEQ ID NO: 3785241 - RNA, 22 nt, Salmonella typhimurium LT2
aguuguuuauuccauucaucga

SEQ ID NO: 3785242 - RNA, 13 nt, Salmonella typhimurium LT2
aguuguuucaaca

SEQ ID NO: 3785243 - RNA, 18 nt, Salmonella typhimurium LT2
aguuuaaacacucuccac

SEQ ID NO: 3785244 - RNA, 15 nt, Salmonella typhimurium LT2
aguuuaaagccaauc

SEQ ID NO: 3785245 - RNA, 15 nt, Salmonella typhimurium LT2
aguuuaauucuuuga

SEQ ID NO: 3785246 - RNA, 22 nt, Salmonella typhimurium LT2
aguuuacgagugcguucuucca

SEQ ID NO: 3785247 - RNA, 16 nt, Salmonella typhimurium LT2
aguuuagccagcagcg

SEQ ID NO: 3785248 - RNA, 14 nt, Salmonella typhimurium LT2
aguuuauccgccag

SEQ ID NO: 3785249 - RNA, 22 nt, Salmonella typhimurium LT2
aguuuauguaccaguuggcugu

SEQ ID NO: 3785250 - RNA, 13 nt, Salmonella typhimurium LT2
aguuuauucuucu

SEQ ID NO: 3785251 - RNA, 14 nt, Salmonella typhimurium LT2
aguuuauucuucuc

SEQ ID NO: 3785252 - RNA, 17 nt, Salmonella typhimurium LT2
aguuucaucaucgccga

SEQ ID NO: 3785253 - RNA, 15 nt, Salmonella typhimurium LT2
aguuucguuaccccg

SEQ ID NO: 3785254 - RNA, 14 nt, Salmonella typhimurium LT2
aguuucucaaagcu

SEQ ID NO: 3785255 - RNA, 16 nt, Salmonella typhimurium LT2
aguuugaccagcaaua

SEQ ID NO: 3785256 - RNA, 16 nt, Salmonella typhimurium LT2
aguuugauagcgcuau

SEQ ID NO: 3785257 - RNA, 23 nt, Salmonella typhimurium LT2
aguuugccccauuguucuuucau

SEQ ID NO: 3785258 - RNA, 16 nt, Salmonella typhimurium LT2
aguuugccuuuauuca

SEQ ID NO: 3785259 - RNA, 22 nt, Salmonella typhimurium LT2
aguuugccuuuauucauuucaa

SEQ ID NO: 3785260 - RNA, 19 nt, Salmonella typhimurium LT2
aguuugcgauaagcgcguu

SEQ ID NO: 3785261 - RNA, 16 nt, Salmonella typhimurium LT2
aguuugcgcgauuuau

SEQ ID NO: 3785262 - RNA, 16 nt, Salmonella typhimurium LT2
aguuuggugaugcgau

SEQ ID NO: 3785263 - RNA, 22 nt, Salmonella typhimurium LT2
aguuugucaacgugugccagga

SEQ ID NO: 3785264 - RNA, 13 nt, Salmonella typhimurium LT2
aguuugucaucca

SEQ ID NO: 3785265 - RNA, 21 nt, Salmonella typhimurium LT2
aguuugucaugcgugcgccgc

SEQ ID NO: 3785266 - RNA, 13 nt, Salmonella typhimurium LT2
aguuuuccagccc

SEQ ID NO: 3785267 - RNA, 13 nt, Salmonella typhimurium LT2
aguuuuccgccau

SEQ ID NO: 3785268 - RNA, 22 nt, Salmonella typhimurium LT2
aguuuucgggcagcguuccuga

SEQ ID NO: 3785269 - RNA, 12 nt, Salmonella typhimurium LT2
aguuuucuucuu

SEQ ID NO: 3785270 - RNA, 16 nt, Salmonella typhimurium LT2
aguuuugcuucaugca

SEQ ID NO: 3785271 - RNA, 19 nt, Salmonella typhimurium LT2
aguuuugcuucaugcacaa

SEQ ID NO: 3785272 - RNA, 20 nt, Salmonella typhimurium LT2
aguuuugcuucaugcacaaa

SEQ ID NO: 3785273 - RNA, 15 nt, Salmonella typhimurium LT2
aguuuuucaagaauu

SEQ ID NO: 3785274 - RNA, 13 nt, Salmonella typhimurium LT2
aguuuuuuuaaaa

SEQ ID NO: 3785275 - RNA, 20 nt, Salmonella typhimurium LT2
auaaaaaagccgaccuggcg

SEQ ID NO: 3785276 - RNA, 13 nt, Salmonella typhimurium LT2
auaaaaaauuauc

SEQ ID NO: 3785277 - RNA, 21 nt, Salmonella typhimurium LT2
auaaaaagugcgcacucagaa

SEQ ID NO: 3785278 - RNA, 17 nt, Salmonella typhimurium LT2
auaaaaauagcuggcug

SEQ ID NO: 3785279 - RNA, 18 nt, Salmonella typhimurium LT2
auaaaaauagcuggcugu

SEQ ID NO: 3785280 - RNA, 14 nt, Salmonella typhimurium LT2
auaaaaccggcaua

SEQ ID NO: 3785281 - RNA, 14 nt, Salmonella typhimurium LT2
auaaaacgcgauau

SEQ ID NO: 3785282 - RNA, 18 nt, Salmonella typhimurium LT2
auaaaacugccaucaauu

SEQ ID NO: 3785283 - RNA, 18 nt, Salmonella typhimurium LT2
auaaaagcccuuaucgcc

SEQ ID NO: 3785284 - RNA, 23 nt, Salmonella typhimurium LT2
auaaaagcucuggaaaaauuguu

SEQ ID NO: 3785285 - RNA, 12 nt, Salmonella typhimurium LT2
auaaaauaacua

SEQ ID NO: 3785286 - RNA, 12 nt, Salmonella typhimurium LT2
auaaaauaagca

SEQ ID NO: 3785287 - RNA, 13 nt, Salmonella typhimurium LT2
auaaaauaagcaa

SEQ ID NO: 3785288 - RNA, 21 nt, Salmonella typhimurium LT2
auaaaauauccuccaccucgc

SEQ ID NO: 3785289 - RNA, 15 nt, Salmonella typhimurium LT2
auaaaauauuauuuu

SEQ ID NO: 3785290 - RNA, 14 nt, Salmonella typhimurium LT2
auaaaauccucuac

SEQ ID NO: 3785291 - RNA, 20 nt, Salmonella typhimurium LT2
auaaaauguuccauauccag

SEQ ID NO: 3785292 - RNA, 14 nt, Salmonella typhimurium LT2
auaaaauuauuggc

SEQ ID NO: 3785293 - RNA, 18 nt, Salmonella typhimurium LT2
auaaaauuguuauuuaau

SEQ ID NO: 3785294 - RNA, 21 nt, Salmonella typhimurium LT2
auaaaauuuaauauugcugaa

SEQ ID NO: 3785295 - RNA, 20 nt, Salmonella typhimurium LT2
auaaacagauaugaaaugag

SEQ ID NO: 3785296 - RNA, 17 nt, Salmonella typhimurium LT2
auaaacagcguuuucau

SEQ ID NO: 3785297 - RNA, 22 nt, Salmonella typhimurium LT2
auaaacauuuuuuuugcaugau

SEQ ID NO: 3785298 - RNA, 21 nt, Salmonella typhimurium LT2
auaaaccgccguuuugauuug

SEQ ID NO: 3785299 - RNA, 22 nt, Salmonella typhimurium LT2
auaaacgacagcgccaucagca

SEQ ID NO: 3785300 - RNA, 19 nt, Salmonella typhimurium LT2
auaaacgccagcccuucca

SEQ ID NO: 3785301 - RNA, 18 nt, Salmonella typhimurium LT2
auaaacgcggccaucacg

SEQ ID NO: 3785302 - RNA, 20 nt, Salmonella typhimurium LT2
auaaacgguuucagcagcgg

SEQ ID NO: 3785303 - RNA, 21 nt, Salmonella typhimurium LT2
auaaacgucccgacgaauaac

SEQ ID NO: 3785304 - RNA, 16 nt, Salmonella typhimurium LT2
auaaacuacuggcugg

SEQ ID NO: 3785305 - RNA, 14 nt, Salmonella typhimurium LT2
auaaacucagcaau

SEQ ID NO: 3785306 - RNA, 21 nt, Salmonella typhimurium LT2
auaaagaaaguagaucaccag

SEQ ID NO: 3785307 - RNA, 17 nt, Salmonella typhimurium LT2
auaaagcagcgacaaua

SEQ ID NO: 3785308 - RNA, 22 nt, Salmonella typhimurium LT2
auaaagcccgcuuuuagcgcgg

SEQ ID NO: 3785309 - RNA, 19 nt, Salmonella typhimurium LT2
auaaagccgcauuuuucca

SEQ ID NO: 3785310 - RNA, 20 nt, Salmonella typhimurium LT2
auaaagcgcucaugccacgc

SEQ ID NO: 3785311 - RNA, 16 nt, Salmonella typhimurium LT2
auaaagcgguuuucaa

SEQ ID NO: 3785312 - RNA, 22 nt, Salmonella typhimurium LT2
auaagguacggcccguacugaa

SEQ ID NO: 3785313 - RNA, 20 nt, Salmonella typhimurium LT2
auaaggucgcuauccagcag

SEQ ID NO: 3785314 - RNA, 18 nt, Salmonella typhimurium LT2
auaagguugccugccaga

SEQ ID NO: 3785315 - RNA, 17 nt, Salmonella typhimurium LT2
auaaguaccauugccca

SEQ ID NO: 3785316 - RNA, 19 nt, Salmonella typhimurium LT2
auaaguaccauugcccauu

SEQ ID NO: 3785317 - RNA, 14 nt, Salmonella typhimurium LT2
auaagucaugagcu

SEQ ID NO: 3785318 - RNA, 17 nt, Salmonella typhimurium LT2
auaauaaaacggcucau

SEQ ID NO: 3785319 - RNA, 14 nt, Salmonella typhimurium LT2
auaauaaaauauua

SEQ ID NO: 3785320 - RNA, 15 nt, Salmonella typhimurium LT2
auaauaaaauauuau

SEQ ID NO: 3785321 - RNA, 23 nt, Salmonella typhimurium LT2
auaauaaaugccgucgcuuucau

SEQ ID NO: 3785322 - RNA, 13 nt, Salmonella typhimurium LT2
auaauaauauccu

SEQ ID NO: 3785323 - RNA, 20 nt, Salmonella typhimurium LT2
auaauaauuaccacgcagcc

SEQ ID NO: 3785324 - RNA, 10 nt, Salmonella typhimurium LT2
auaauacacg

SEQ ID NO: 3785325 - RNA, 20 nt, Salmonella typhimurium LT2
auaauacgccggcaucauca

SEQ ID NO: 3785326 - RNA, 19 nt, Salmonella typhimurium LT2
auaauaguuagccugauag

SEQ ID NO: 3785327 - RNA, 14 nt, Salmonella typhimurium LT2
auaauauccagcac

SEQ ID NO: 3785328 - RNA, 18 nt, Salmonella typhimurium LT2
auaauaucgucaccagga

SEQ ID NO: 3785329 - RNA, 21 nt, Salmonella typhimurium LT2
auaauaucuuucucgcggcag

SEQ ID NO: 3785330 - RNA, 20 nt, Salmonella typhimurium LT2
auaauauguuccacaaucaa

SEQ ID NO: 3785331 - RNA, 18 nt, Salmonella typhimurium LT2
auaauauuaucagcaaua

SEQ ID NO: 3785332 - RNA, 19 nt, Salmonella typhimurium LT2
auaaucaacggucuugcca

SEQ ID NO: 3785333 - RNA, 13 nt, Salmonella typhimurium LT2
auaaucagcagcg

SEQ ID NO: 3785334 - RNA, 12 nt, Salmonella typhimurium LT2
auaaucaucaua

SEQ ID NO: 3785335 - RNA, 12 nt, Salmonella typhimurium LT2
auaauccagcuu

SEQ ID NO: 3785336 - RNA, 16 nt, Salmonella typhimurium LT2
auaaucccgcagaaaa

SEQ ID NO: 3785337 - RNA, 20 nt, Salmonella typhimurium LT2
auaauccgccuuuuccccca

SEQ ID NO: 3785338 - RNA, 18 nt, Salmonella typhimurium LT2
auaauccgcuaacgaugu

SEQ ID NO: 3785339 - RNA, 20 nt, Salmonella typhimurium LT2
auaauccggaauaagaauau

SEQ ID NO: 3785340 - RNA, 21 nt, Salmonella typhimurium LT2
auaauccuuccuccaccacca

SEQ ID NO: 3785341 - RNA, 16 nt, Salmonella typhimurium LT2
auaaucgaccguaucc

SEQ ID NO: 3785342 - RNA, 13 nt, Salmonella typhimurium LT2
auaaucgccggac

SEQ ID NO: 3785343 - RNA, 21 nt, Salmonella typhimurium LT2
auaaucgcgauacugccgccc

SEQ ID NO: 3785344 - RNA, 17 nt, Salmonella typhimurium LT2
auaaucgguagcacuuu

SEQ ID NO: 3785345 - RNA, 20 nt, Salmonella typhimurium LT2
auaaucgguagcacuuuaaa

SEQ ID NO: 3785346 - RNA, 22 nt, Salmonella typhimurium LT2
auaaucucugcgacaaucagau

SEQ ID NO: 3785347 - RNA, 17 nt, Salmonella typhimurium LT2
auaaucuugauccggcu

SEQ ID NO: 3785348 - RNA, 15 nt, Salmonella typhimurium LT2
auaaugacauccaga

SEQ ID NO: 3785349 - RNA, 20 nt, Salmonella typhimurium LT2
auaaugacgcuauucaugcc

SEQ ID NO: 3785350 - RNA, 15 nt, Salmonella typhimurium LT2
auaaugccaaaaugg

SEQ ID NO: 3785351 - RNA, 15 nt, Salmonella typhimurium LT2
auaaugccucauccg

SEQ ID NO: 3785352 - RNA, 23 nt, Salmonella typhimurium LT2
auaaugcgccccgcaacgccgau

SEQ ID NO: 3785353 - RNA, 20 nt, Salmonella typhimurium LT2
auaaugcuuaauucauaacg

SEQ ID NO: 3785354 - RNA, 19 nt, Salmonella typhimurium LT2
auaaugcuuucgccagccg

SEQ ID NO: 3785355 - RNA, 12 nt, Salmonella typhimurium LT2
auaauggcauau

SEQ ID NO: 3785356 - RNA, 14 nt, Salmonella typhimurium LT2
auaauggcccagcg

SEQ ID NO: 3785357 - RNA, 21 nt, Salmonella typhimurium LT2
auaauuaaaucaauacugcca

SEQ ID NO: 3785358 - RNA, 19 nt, Salmonella typhimurium LT2
auaauuaacagacaaugaa

SEQ ID NO: 3785359 - RNA, 24 nt, Salmonella typhimurium LT2
auaauuaacagacaaugaauauua

SEQ ID NO: 3785360 - RNA, 19 nt, Salmonella typhimurium LT2
auaauucauaacaccaaua

SEQ ID NO: 3785361 - RNA, 15 nt, Salmonella typhimurium LT2
auaauugauaauaac

SEQ ID NO: 3785362 - RNA, 23 nt, Salmonella typhimurium LT2
auaauuuccguggcgauaaugac

SEQ ID NO: 3785363 - RNA, 18 nt, Salmonella typhimurium LT2
auacaaaaaagacagcau

SEQ ID NO: 3785364 - RNA, 13 nt, Salmonella typhimurium LT2
auacaaauauccc

SEQ ID NO: 3785365 - RNA, 18 nt, Salmonella typhimurium LT2
auacaagguauccgccau

SEQ ID NO: 3785366 - RNA, 15 nt, Salmonella typhimurium LT2
auacaccuuugcccg

SEQ ID NO: 3785367 - RNA, 22 nt, Salmonella typhimurium LT2
auacacgauuaaccucacgcaa

SEQ ID NO: 3785368 - RNA, 18 nt, Salmonella typhimurium LT2
auacacgcccucucgcca

SEQ ID NO: 3785369 - RNA, 21 nt, Salmonella typhimurium LT2
auacacugcauaaauaucugc

SEQ ID NO: 3785370 - RNA, 17 nt, Salmonella typhimurium LT2
auacagaaaacgccugc

SEQ ID NO: 3785371 - RNA, 19 nt, Salmonella typhimurium LT2
auacagacagcagaugaaa

SEQ ID NO: 3785372 - RNA, 19 nt, Salmonella typhimurium LT2
auacagaugcugucuuagu

SEQ ID NO: 3785373 - RNA, 16 nt, Salmonella typhimurium LT2
auacagcaauaugacu

SEQ ID NO: 3785374 - RNA, 13 nt, Salmonella typhimurium LT2
auacagcccgcgc

SEQ ID NO: 3785375 - RNA, 21 nt, Salmonella typhimurium LT2
auacagcgccgcgcaggcgau

SEQ ID NO: 3785376 - RNA, 22 nt, Salmonella typhimurium LT2
auacaggacugacugcugucau

SEQ ID NO: 3785377 - RNA, 18 nt, Salmonella typhimurium LT2
auacaggcgauaucgcga

SEQ ID NO: 3785378 - RNA, 21 nt, Salmonella typhimurium LT2
auacaggcgcaguugaaaaca

SEQ ID NO: 3785379 - RNA, 11 nt, Salmonella typhimurium LT2
auacauaaaau

SEQ ID NO: 3785380 - RNA, 15 nt, Salmonella typhimurium LT2
auacauaaaauguuc

SEQ ID NO: 3785381 - RNA, 21 nt, Salmonella typhimurium LT2
auacauaccacgcagcggcau

SEQ ID NO: 3785382 - RNA, 14 nt, Salmonella typhimurium LT2
auacauagcaggcc

SEQ ID NO: 3785383 - RNA, 14 nt, Salmonella typhimurium LT2
auacauagucuaug

SEQ ID NO: 3785384 - RNA, 23 nt, Salmonella typhimurium LT2
auacauccggcaggcauuuuaca

SEQ ID NO: 3785385 - RNA, 19 nt, Salmonella typhimurium LT2
auacaucucgaguaaucac

SEQ ID NO: 3785386 - RNA, 18 nt, Salmonella typhimurium LT2
auacaugccugcgccaug

SEQ ID NO: 3785387 - RNA, 21 nt, Salmonella typhimurium LT2
auacaugccugcgccauguuc

SEQ ID NO: 3785388 - RNA, 18 nt, Salmonella typhimurium LT2
auacauucaguacaauac

SEQ ID NO: 3785389 - RNA, 14 nt, Salmonella typhimurium LT2
auacauucucugcc

SEQ ID NO: 3785390 - RNA, 23 nt, Salmonella typhimurium LT2
auacauuuuguauucgcagggcu

SEQ ID NO: 3785391 - RNA, 21 nt, Salmonella typhimurium LT2
auaccaaaucucaagagugaa

SEQ ID NO: 3785392 - RNA, 19 nt, Salmonella typhimurium LT2
auaccaaauuacgcacacu

SEQ ID NO: 3785393 - RNA, 17 nt, Salmonella typhimurium LT2
auaccaaguuuggcaau

SEQ ID NO: 3785394 - RNA, 14 nt, Salmonella typhimurium LT2
auaccacaaauuuu

SEQ ID NO: 3785395 - RNA, 19 nt, Salmonella typhimurium LT2
auaccaccacuucacuauc

SEQ ID NO: 3785396 - RNA, 15 nt, Salmonella typhimurium LT2
auaccaccugccaaa

SEQ ID NO: 3785397 - RNA, 20 nt, Salmonella typhimurium LT2
auaccacugcccgccgccac

SEQ ID NO: 3785398 - RNA, 21 nt, Salmonella typhimurium LT2
auaccagaaaucgcucaugcg

SEQ ID NO: 3785399 - RNA, 19 nt, Salmonella typhimurium LT2
auaccagcaccugaauaau

SEQ ID NO: 3785400 - RNA, 15 nt, Salmonella typhimurium LT2
auaccagccaacagu

SEQ ID NO: 3785401 - RNA, 20 nt, Salmonella typhimurium LT2
auaccagccaacaguauaga

SEQ ID NO: 3785402 - RNA, 21 nt, Salmonella typhimurium LT2
auaccagcggcaaacagcgac

SEQ ID NO: 3785403 - RNA, 12 nt, Salmonella typhimurium LT2
auaccaggcacu

SEQ ID NO: 3785404 - RNA, 15 nt, Salmonella typhimurium LT2
auacccaaaauaauu

SEQ ID NO: 3785405 - RNA, 14 nt, Salmonella typhimurium LT2
auacccaacagcag

SEQ ID NO: 3785406 - RNA, 18 nt, Salmonella typhimurium LT2
auacccaacagcagacag

SEQ ID NO: 3785407 - RNA, 21 nt, Salmonella typhimurium LT2
auacccgaccccgccaucaga

SEQ ID NO: 3785408 - RNA, 17 nt, Salmonella typhimurium LT2
auacccgcguuuucuca

SEQ ID NO: 3785409 - RNA, 14 nt, Salmonella typhimurium LT2
auacccuguuugau

SEQ ID NO: 3785410 - RNA, 21 nt, Salmonella typhimurium LT2
auaccgauagcgcggaauauc

SEQ ID NO: 3785411 - RNA, 23 nt, Salmonella typhimurium LT2
auaccgauucccagucauccggu

SEQ ID NO: 3785412 - RNA, 23 nt, Salmonella typhimurium LT2
auaccgccgcccagcacaaugac

SEQ ID NO: 3785413 - RNA, 22 nt, Salmonella typhimurium LT2
auaccgccgguaaggccaauca

SEQ ID NO: 3785414 - RNA, 20 nt, Salmonella typhimurium LT2
auaccgcuuuguaaaacauu

SEQ ID NO: 3785415 - RNA, 16 nt, Salmonella typhimurium LT2
auagcaaugaagcaag

SEQ ID NO: 3785416 - RNA, 14 nt, Salmonella typhimurium LT2
auagcaccaggcca

SEQ ID NO: 3785417 - RNA, 17 nt, Salmonella typhimurium LT2
auagcagcgcccuuuca

SEQ ID NO: 3785418 - RNA, 16 nt, Salmonella typhimurium LT2
auagcaggagauauag

SEQ ID NO: 3785419 - RNA, 12 nt, Salmonella typhimurium LT2
auagcaggcauc

SEQ ID NO: 3785420 - RNA, 13 nt, Salmonella typhimurium LT2
auagcaggcauca

SEQ ID NO: 3785421 - RNA, 20 nt, Salmonella typhimurium LT2
auagcaucggucaacugaau

SEQ ID NO: 3785422 - RNA, 22 nt, Salmonella typhimurium LT2
auagcauggcguguaguaaugc

SEQ ID NO: 3785423 - RNA, 18 nt, Salmonella typhimurium LT2
auagccagcccccugcca

SEQ ID NO: 3785424 - RNA, 11 nt, Salmonella typhimurium LT2
auagccaggca

SEQ ID NO: 3785425 - RNA, 19 nt, Salmonella typhimurium LT2
auagccaucggcauaaccc

SEQ ID NO: 3785426 - RNA, 23 nt, Salmonella typhimurium LT2
auagccauugcugcuauauaaca

SEQ ID NO: 3785427 - RNA, 13 nt, Salmonella typhimurium LT2
auagccauuuaau

SEQ ID NO: 3785428 - RNA, 12 nt, Salmonella typhimurium LT2
auagcccggcuu

SEQ ID NO: 3785429 - RNA, 21 nt, Salmonella typhimurium LT2
auagccguaaauaaucaccac

SEQ ID NO: 3785430 - RNA, 21 nt, Salmonella typhimurium LT2
auagccguccauguucggcau

SEQ ID NO: 3785431 - RNA, 13 nt, Salmonella typhimurium LT2
auagccuaaucuc

SEQ ID NO: 3785432 - RNA, 14 nt, Salmonella typhimurium LT2
auagccugcugggu

SEQ ID NO: 3785433 - RNA, 15 nt, Salmonella typhimurium LT2
auagccugcugggua

SEQ ID NO: 3785434 - RNA, 12 nt, Salmonella typhimurium LT2
auagccugggca

SEQ ID NO: 3785435 - RNA, 14 nt, Salmonella typhimurium LT2
auagccuuccaccg

SEQ ID NO: 3785436 - RNA, 16 nt, Salmonella typhimurium LT2
auagcgaccugcggac

SEQ ID NO: 3785437 - RNA, 13 nt, Salmonella typhimurium LT2
auagcgagaggca

SEQ ID NO: 3785438 - RNA, 18 nt, Salmonella typhimurium LT2
auagcgaggcagcaggau

SEQ ID NO: 3785439 - RNA, 17 nt, Salmonella typhimurium LT2
auagcgcacaacgucag

SEQ ID NO: 3785440 - RNA, 16 nt, Salmonella typhimurium LT2
auagcgcaguaauuuc

SEQ ID NO: 3785441 - RNA, 18 nt, Salmonella typhimurium LT2
auagcgccaucagacauu

SEQ ID NO: 3785442 - RNA, 18 nt, Salmonella typhimurium LT2
auagcgccccaguaacgc

SEQ ID NO: 3785443 - RNA, 23 nt, Salmonella typhimurium LT2
auagcgcgccauauuaacaaugc

SEQ ID NO: 3785444 - RNA, 23 nt, Salmonella typhimurium LT2
auagcgcuaugcgcuccaggaug

SEQ ID NO: 3785445 - RNA, 13 nt, Salmonella typhimurium LT2
auagcgcugcgca

SEQ ID NO: 3785446 - RNA, 22 nt, Salmonella typhimurium LT2
auagcgcugucgcuaauccggc

SEQ ID NO: 3785447 - RNA, 23 nt, Salmonella typhimurium LT2
auagcggcguuuauauaaaaaua

SEQ ID NO: 3785448 - RNA, 22 nt, Salmonella typhimurium LT2
auagcggggacuguggaagaga

SEQ ID NO: 3785449 - RNA, 16 nt, Salmonella typhimurium LT2
auagcuaaccagcgag

SEQ ID NO: 3785450 - RNA, 21 nt, Salmonella typhimurium LT2
auagcuaaugcgguagcgaug

SEQ ID NO: 3785451 - RNA, 14 nt, Salmonella typhimurium LT2
auagcugaacauac

SEQ ID NO: 3785452 - RNA, 19 nt, Salmonella typhimurium LT2
auagcuggcugucuuccgu

SEQ ID NO: 3785453 - RNA, 16 nt, Salmonella typhimurium LT2
auagcugguaaauaac

SEQ ID NO: 3785454 - RNA, 15 nt, Salmonella typhimurium LT2
auagcuuuucaugac

SEQ ID NO: 3785455 - RNA, 18 nt, Salmonella typhimurium LT2
auaggaucugaaaggcgu

SEQ ID NO: 3785456 - RNA, 12 nt, Salmonella typhimurium LT2
auaggccagcgu

SEQ ID NO: 3785457 - RNA, 12 nt, Salmonella typhimurium LT2
auaggccaggcu

SEQ ID NO: 3785458 - RNA, 23 nt, Salmonella typhimurium LT2
auaggccucgaccaguuuuuccg

SEQ ID NO: 3785459 - RNA, 12 nt, Salmonella typhimurium LT2
auaggcgccgcc

SEQ ID NO: 3785460 - RNA, 16 nt, Salmonella typhimurium LT2
auaggcggcaaauaaa

SEQ ID NO: 3785461 - RNA, 12 nt, Salmonella typhimurium LT2
auagggccaggc

SEQ ID NO: 3785462 - RNA, 15 nt, Salmonella typhimurium LT2
auaggucguuccuca

SEQ ID NO: 3785463 - RNA, 18 nt, Salmonella typhimurium LT2
auaggugacuuuccuggc

SEQ ID NO: 3785464 - RNA, 23 nt, Salmonella typhimurium LT2
auaggugccgccgcacagaaucg

SEQ ID NO: 3785465 - RNA, 22 nt, Salmonella typhimurium LT2
auagguugaauaaccauacuga

SEQ ID NO: 3785466 - RNA, 13 nt, Salmonella typhimurium LT2
auagguuuuaugc

SEQ ID NO: 3785467 - RNA, 17 nt, Salmonella typhimurium LT2
auaguaacguaugcugg

SEQ ID NO: 3785468 - RNA, 18 nt, Salmonella typhimurium LT2
auaguagcugagaguaaa

SEQ ID NO: 3785469 - RNA, 14 nt, Salmonella typhimurium LT2
auaguauuucccuu

SEQ ID NO: 3785470 - RNA, 16 nt, Salmonella typhimurium LT2
auaguauuucccuucc

SEQ ID NO: 3785471 - RNA, 20 nt, Salmonella typhimurium LT2
auaguauuucccuucccagc

SEQ ID NO: 3785472 - RNA, 21 nt, Salmonella typhimurium LT2
auagucaaugcccccgccaaa

SEQ ID NO: 3785473 - RNA, 13 nt, Salmonella typhimurium LT2
auagucagcgcaa

SEQ ID NO: 3785474 - RNA, 19 nt, Salmonella typhimurium LT2
auagucaguaauauaacca

SEQ ID NO: 3785475 - RNA, 19 nt, Salmonella typhimurium LT2
auagucauugacagcaagu

SEQ ID NO: 3785476 - RNA, 14 nt, Salmonella typhimurium LT2
auaguccagcagcc

SEQ ID NO: 3785477 - RNA, 16 nt, Salmonella typhimurium LT2
auaguccagcagccau

SEQ ID NO: 3785478 - RNA, 19 nt, Salmonella typhimurium LT2
auagucgcuuuucauacug

SEQ ID NO: 3785479 - RNA, 14 nt, Salmonella typhimurium LT2
auagucuccaugac

SEQ ID NO: 3785480 - RNA, 17 nt, Salmonella typhimurium LT2
auagucuccgccaccug

SEQ ID NO: 3785481 - RNA, 14 nt, Salmonella typhimurium LT2
auagucuucaagcc

SEQ ID NO: 3785482 - RNA, 24 nt, Salmonella typhimurium LT2
auagugaagaugguaauauuaaaa

SEQ ID NO: 3785483 - RNA, 17 nt, Salmonella typhimurium LT2
auagugacgccgccauc

SEQ ID NO: 3785484 - RNA, 18 nt, Salmonella typhimurium LT2
auagugagcgacuucaaa

SEQ ID NO: 3785485 - RNA, 21 nt, Salmonella typhimurium LT2
auagugcgugacaaucuccuc

SEQ ID NO: 3785486 - RNA, 23 nt, Salmonella typhimurium LT2
auaguggcgcgacgcgucaguga

SEQ ID NO: 3785487 - RNA, 21 nt, Salmonella typhimurium LT2
auaguggcuggcguccgccug

SEQ ID NO: 3785488 - RNA, 19 nt, Salmonella typhimurium LT2
auaguguaaacgcgccauc

SEQ ID NO: 3785489 - RNA, 20 nt, Salmonella typhimurium LT2
auagugucgccauaaaucag

SEQ ID NO: 3785490 - RNA, 15 nt, Salmonella typhimurium LT2
auagugucuaauuua

SEQ ID NO: 3785491 - RNA, 15 nt, Salmonella typhimurium LT2
auaguuaauaauggu

SEQ ID NO: 3785492 - RNA, 21 nt, Salmonella typhimurium LT2
auaguuauacauuuuuuucuu

SEQ ID NO: 3785493 - RNA, 17 nt, Salmonella typhimurium LT2
auaguuauuaacaucag

SEQ ID NO: 3785494 - RNA, 23 nt, Salmonella typhimurium LT2
auaguucuggcuuugcgccggca

SEQ ID NO: 3785495 - RNA, 16 nt, Salmonella typhimurium LT2
auaguugagcagcgcg

SEQ ID NO: 3785496 - RNA, 16 nt, Salmonella typhimurium LT2
auaguuuuuaauucca

SEQ ID NO: 3785497 - RNA, 16 nt, Salmonella typhimurium LT2
auaguuuuucaagaau

SEQ ID NO: 3785498 - RNA, 19 nt, Salmonella typhimurium LT2
auaguuuuucaagaauuac

SEQ ID NO: 3785499 - RNA, 12 nt, Salmonella typhimurium LT2
auauaaaaauag

SEQ ID NO: 3785500 - RNA, 15 nt, Salmonella typhimurium LT2
auauaacagaauaag

SEQ ID NO: 3785501 - RNA, 17 nt, Salmonella typhimurium LT2
auauaacgugccgacca

SEQ ID NO: 3785502 - RNA, 15 nt, Salmonella typhimurium LT2
auauaagcuuuucca

SEQ ID NO: 3785503 - RNA, 18 nt, Salmonella typhimurium LT2
auauaaggaucggaagac

SEQ ID NO: 3785504 - RNA, 16 nt, Salmonella typhimurium LT2
auauaauaucaacccu

SEQ ID NO: 3785505 - RNA, 17 nt, Salmonella typhimurium LT2
auauaauccggcgaggc

SEQ ID NO: 3785506 - RNA, 13 nt, Salmonella typhimurium LT2
auauaaucugaaa

SEQ ID NO: 3785507 - RNA, 16 nt, Salmonella typhimurium LT2
auauaauuuauagcca

SEQ ID NO: 3785508 - RNA, 17 nt, Salmonella typhimurium LT2
auauacccccugcaauu

SEQ ID NO: 3785509 - RNA, 19 nt, Salmonella typhimurium LT2
auauaccgucagcaccagc

SEQ ID NO: 3785510 - RNA, 18 nt, Salmonella typhimurium LT2
auauacgacggcuaaguu

SEQ ID NO: 3785511 - RNA, 14 nt, Salmonella typhimurium LT2
auauagccguggcu

SEQ ID NO: 3785512 - RNA, 13 nt, Salmonella typhimurium LT2
auauagccuucaa

SEQ ID NO: 3785513 - RNA, 18 nt, Salmonella typhimurium LT2
auauauuacgacugcacc

SEQ ID NO: 3785514 - RNA, 21 nt, Salmonella typhimurium LT2
auauauuucacuucaucauca

SEQ ID NO: 3785515 - RNA, 17 nt, Salmonella typhimurium LT2
auaucaaaccacgcuga

SEQ ID NO: 3785516 - RNA, 13 nt, Salmonella typhimurium LT2
auaucaaucaccu

SEQ ID NO: 3785517 - RNA, 18 nt, Salmonella typhimurium LT2
auaucaccaucuuuuugc

SEQ ID NO: 3785518 - RNA, 22 nt, Salmonella typhimurium LT2
auaucaccaucuuuuugcucaa

SEQ ID NO: 3785519 - RNA, 21 nt, Salmonella typhimurium LT2
aucaaauacgcuauuuaaaaa

SEQ ID NO: 3785520 - RNA, 22 nt, Salmonella typhimurium LT2
aucaaaucagacgcuucauugg

SEQ ID NO: 3785521 - RNA, 19 nt, Salmonella typhimurium LT2
aucaacaaccggcuggcua

SEQ ID NO: 3785522 - RNA, 23 nt, Salmonella typhimurium LT2
aucaacagcggagagacauuggu

SEQ ID NO: 3785523 - RNA, 22 nt, Salmonella typhimurium LT2
aucaacaggcuauaacgcacca

SEQ ID NO: 3785524 - RNA, 16 nt, Salmonella typhimurium LT2
aucaaccaccuucacc

SEQ ID NO: 3785525 - RNA, 16 nt, Salmonella typhimurium LT2
aucaacccucccugca

SEQ ID NO: 3785526 - RNA, 15 nt, Salmonella typhimurium LT2
aucaaccugcugacu

SEQ ID NO: 3785527 - RNA, 15 nt, Salmonella typhimurium LT2
aucaacgaaaucaga

SEQ ID NO: 3785528 - RNA, 22 nt, Salmonella typhimurium LT2
aucaacgaccaugguucccgcc

SEQ ID NO: 3785529 - RNA, 23 nt, Salmonella typhimurium LT2
aucaacgaccaugguucccgcca

SEQ ID NO: 3785530 - RNA, 14 nt, Salmonella typhimurium LT2
aucaacgccgccag

SEQ ID NO: 3785531 - RNA, 20 nt, Salmonella typhimurium LT2
aucaacgccgcgccaucagg

SEQ ID NO: 3785532 - RNA, 13 nt, Salmonella typhimurium LT2
aucaacggguuaa

SEQ ID NO: 3785533 - RNA, 17 nt, Salmonella typhimurium LT2
aucaacgugaccauucc

SEQ ID NO: 3785534 - RNA, 15 nt, Salmonella typhimurium LT2
aucaacucgauacgg

SEQ ID NO: 3785535 - RNA, 13 nt, Salmonella typhimurium LT2
aucaacugcgcca

SEQ ID NO: 3785536 - RNA, 22 nt, Salmonella typhimurium LT2
aucaacugggugugaucgccgc

SEQ ID NO: 3785537 - RNA, 24 nt, Salmonella typhimurium LT2
aucaacugggugugaucgccgcga

SEQ ID NO: 3785538 - RNA, 18 nt, Salmonella typhimurium LT2
aucaagauugaguccaua

SEQ ID NO: 3785539 - RNA, 15 nt, Salmonella typhimurium LT2
aucaagguugcucag

SEQ ID NO: 3785540 - RNA, 22 nt, Salmonella typhimurium LT2
aucaauaaaaucaccgcggcaa

SEQ ID NO: 3785541 - RNA, 17 nt, Salmonella typhimurium LT2
aucaauaaccgccagca

SEQ ID NO: 3785542 - RNA, 19 nt, Salmonella typhimurium LT2
aucaauaaccgccagcagc

SEQ ID NO: 3785543 - RNA, 20 nt, Salmonella typhimurium LT2
aucaauaacgauaauuuuac

SEQ ID NO: 3785544 - RNA, 18 nt, Salmonella typhimurium LT2
aucaauaagcgaauugcc

SEQ ID NO: 3785545 - RNA, 19 nt, Salmonella typhimurium LT2
aucaauacagagauauuaa

SEQ ID NO: 3785546 - RNA, 14 nt, Salmonella typhimurium LT2
aucaauaccagccc

SEQ ID NO: 3785547 - RNA, 18 nt, Salmonella typhimurium LT2
aucaauaccguccagcgc

SEQ ID NO: 3785548 - RNA, 12 nt, Salmonella typhimurium LT2
aucaauagcaag

SEQ ID NO: 3785549 - RNA, 21 nt, Salmonella typhimurium LT2
aucaauagcagcuucacgcgc

SEQ ID NO: 3785550 - RNA, 17 nt, Salmonella typhimurium LT2
aucaauauaucaggcug

SEQ ID NO: 3785551 - RNA, 20 nt, Salmonella typhimurium LT2
aucaauauguuccggcgucg

SEQ ID NO: 3785552 - RNA, 12 nt, Salmonella typhimurium LT2
aucaaucaccac

SEQ ID NO: 3785553 - RNA, 18 nt, Salmonella typhimurium LT2
aucaaucaccucuucccc

SEQ ID NO: 3785554 - RNA, 12 nt, Salmonella typhimurium LT2
aucaaugcccag

SEQ ID NO: 3785555 - RNA, 21 nt, Salmonella typhimurium LT2
aucaaugcccagcgcaaucac

SEQ ID NO: 3785556 - RNA, 22 nt, Salmonella typhimurium LT2
aucaaugcccagcgcaaucacg

SEQ ID NO: 3785557 - RNA, 20 nt, Salmonella typhimurium LT2
aucaaugcgcguaauuugcg

SEQ ID NO: 3785558 - RNA, 21 nt, Salmonella typhimurium LT2
aucaaugggauagugccugcc

SEQ ID NO: 3785559 - RNA, 19 nt, Salmonella typhimurium LT2
aucaauggugaauuugcug

SEQ ID NO: 3785560 - RNA, 18 nt, Salmonella typhimurium LT2
aucaauucuuuaauuugu

SEQ ID NO: 3785561 - RNA, 23 nt, Salmonella typhimurium LT2
aucaauuucucuuuuauuauuuu

SEQ ID NO: 3785562 - RNA, 22 nt, Salmonella typhimurium LT2
aucaauuuuaauuuaauaauaa

SEQ ID NO: 3785563 - RNA, 20 nt, Salmonella typhimurium LT2
aucacaacguaaugaucaug

SEQ ID NO: 3785564 - RNA, 14 nt, Salmonella typhimurium LT2
aucacaaucagcca

SEQ ID NO: 3785565 - RNA, 23 nt, Salmonella typhimurium LT2
aucacaauuacgcaagagagcaa

SEQ ID NO: 3785566 - RNA, 15 nt, Salmonella typhimurium LT2
aucacacccagcgcg

SEQ ID NO: 3785567 - RNA, 12 nt, Salmonella typhimurium LT2
aucacagacaga

SEQ ID NO: 3785568 - RNA, 13 nt, Salmonella typhimurium LT2
aucacaucccagc

SEQ ID NO: 3785569 - RNA, 16 nt, Salmonella typhimurium LT2
aucacaucccagcaga

SEQ ID NO: 3785570 - RNA, 17 nt, Salmonella typhimurium LT2
aucacauccgccagcgc

SEQ ID NO: 3785571 - RNA, 17 nt, Salmonella typhimurium LT2
aucacaucgccguucca

SEQ ID NO: 3785572 - RNA, 22 nt, Salmonella typhimurium LT2
aucacaucguaaaucagcguga

SEQ ID NO: 3785573 - RNA, 21 nt, Salmonella typhimurium LT2
aucacaugcggaagcaaaaua

SEQ ID NO: 3785574 - RNA, 13 nt, Salmonella typhimurium LT2
aucaccaccucaa

SEQ ID NO: 3785575 - RNA, 12 nt, Salmonella typhimurium LT2
aucaccagcacc

SEQ ID NO: 3785576 - RNA, 14 nt, Salmonella typhimurium LT2
aucaccagcagcag

SEQ ID NO: 3785577 - RNA, 14 nt, Salmonella typhimurium LT2
aucaccaggcaaug

SEQ ID NO: 3785578 - RNA, 21 nt, Salmonella typhimurium LT2
aucaccaucguugccagcggc

SEQ ID NO: 3785579 - RNA, 18 nt, Salmonella typhimurium LT2
aucaccauucccagcgcc

SEQ ID NO: 3785580 - RNA, 19 nt, Salmonella typhimurium LT2
aucaccauucccagcgccc

SEQ ID NO: 3785581 - RNA, 15 nt, Salmonella typhimurium LT2
aucacccugaauuuc

SEQ ID NO: 3785582 - RNA, 19 nt, Salmonella typhimurium LT2
aucacccugaauuucaaua

SEQ ID NO: 3785583 - RNA, 13 nt, Salmonella typhimurium LT2
aucaccgacaggu

SEQ ID NO: 3785584 - RNA, 18 nt, Salmonella typhimurium LT2
aucaccgccagucccagc

SEQ ID NO: 3785585 - RNA, 23 nt, Salmonella typhimurium LT2
aucaccgcgaugaccaucaaaua

SEQ ID NO: 3785586 - RNA, 21 nt, Salmonella typhimurium LT2
aucaccgcggcaaccagccca

SEQ ID NO: 3785587 - RNA, 13 nt, Salmonella typhimurium LT2
aucaccggcauuu

SEQ ID NO: 3785588 - RNA, 15 nt, Salmonella typhimurium LT2
aucaccggcauuuca

SEQ ID NO: 3785589 - RNA, 19 nt, Salmonella typhimurium LT2
aucaccucgcuucccugac

SEQ ID NO: 3785590 - RNA, 22 nt, Salmonella typhimurium LT2
aucaccugauugauacgcgccc

SEQ ID NO: 3785591 - RNA, 16 nt, Salmonella typhimurium LT2
aucaccuuacgcucgc

SEQ ID NO: 3785592 - RNA, 21 nt, Salmonella typhimurium LT2
aucacgauauguuugccguca

SEQ ID NO: 3785593 - RNA, 18 nt, Salmonella typhimurium LT2
aucacgccacaguauuca

SEQ ID NO: 3785594 - RNA, 18 nt, Salmonella typhimurium LT2
aucacgccguccagcacc

SEQ ID NO: 3785595 - RNA, 12 nt, Salmonella typhimurium LT2
aucacgcgcugg

SEQ ID NO: 3785596 - RNA, 18 nt, Salmonella typhimurium LT2
aucacgcgugcgcggcac

SEQ ID NO: 3785597 - RNA, 13 nt, Salmonella typhimurium LT2
aucacggcaacgc

SEQ ID NO: 3785598 - RNA, 15 nt, Salmonella typhimurium LT2
aucacgguacgcauc

SEQ ID NO: 3785599 - RNA, 15 nt, Salmonella typhimurium LT2
aucacguagccagag

SEQ ID NO: 3785600 - RNA, 19 nt, Salmonella typhimurium LT2
aucacguuuugcagcgcca

SEQ ID NO: 3785601 - RNA, 15 nt, Salmonella typhimurium LT2
aucacuaagaccagc

SEQ ID NO: 3785602 - RNA, 13 nt, Salmonella typhimurium LT2
aucacuaauuugc

SEQ ID NO: 3785603 - RNA, 18 nt, Salmonella typhimurium LT2
aucacuaccgccgcggau

SEQ ID NO: 3785604 - RNA, 21 nt, Salmonella typhimurium LT2
aucacuaucaguuuuggcaau

SEQ ID NO: 3785605 - RNA, 13 nt, Salmonella typhimurium LT2
aucacugauauaa

SEQ ID NO: 3785606 - RNA, 17 nt, Salmonella typhimurium LT2
aucacugauauaacccu

SEQ ID NO: 3785607 - RNA, 20 nt, Salmonella typhimurium LT2
aucacuggagcgcauuuuac

SEQ ID NO: 3785608 - RNA, 17 nt, Salmonella typhimurium LT2
aucacugucagaaauua

SEQ ID NO: 3785609 - RNA, 19 nt, Salmonella typhimurium LT2
aucacugucagaaauuaaa

SEQ ID NO: 3785610 - RNA, 12 nt, Salmonella typhimurium LT2
aucacuuaucaa

SEQ ID NO: 3785611 - RNA, 14 nt, Salmonella typhimurium LT2
aucacuuccgccac

SEQ ID NO: 3785612 - RNA, 14 nt, Salmonella typhimurium LT2
aucacuucgcgcau

SEQ ID NO: 3785613 - RNA, 17 nt, Salmonella typhimurium LT2
aucacuucgcgcauugc

SEQ ID NO: 3785614 - RNA, 19 nt, Salmonella typhimurium LT2
aucagaaaaaagccaagca

SEQ ID NO: 3785615 - RNA, 20 nt, Salmonella typhimurium LT2
aucagaaaaaauuacagccg

SEQ ID NO: 3785616 - RNA, 15 nt, Salmonella typhimurium LT2
aucagaaaacagcau

SEQ ID NO: 3785617 - RNA, 21 nt, Salmonella typhimurium LT2
aucagaacucacauauucaau

SEQ ID NO: 3785618 - RNA, 15 nt, Salmonella typhimurium LT2
aucagaacugguagg

SEQ ID NO: 3785619 - RNA, 19 nt, Salmonella typhimurium LT2
aucagaagcuaagggaugc

SEQ ID NO: 3785620 - RNA, 12 nt, Salmonella typhimurium LT2
aucagacaggca

SEQ ID NO: 3785621 - RNA, 21 nt, Salmonella typhimurium LT2
aucagacaggcaugguuaaca

SEQ ID NO: 3785622 - RNA, 13 nt, Salmonella typhimurium LT2
aucagaccgacaa

SEQ ID NO: 3785623 - RNA, 12 nt, Salmonella typhimurium LT2
aucauccagccc

SEQ ID NO: 3785624 - RNA, 20 nt, Salmonella typhimurium LT2
aucauccagucagcaauuaa

SEQ ID NO: 3785625 - RNA, 12 nt, Salmonella typhimurium LT2
aucaucgaacgc

SEQ ID NO: 3785626 - RNA, 23 nt, Salmonella typhimurium LT2
aucaucgauauaccaugccgcca

SEQ ID NO: 3785627 - RNA, 22 nt, Salmonella typhimurium LT2
aucaucgcaggcggucagcaca

SEQ ID NO: 3785628 - RNA, 17 nt, Salmonella typhimurium LT2
aucaucgccagcuuauc

SEQ ID NO: 3785629 - RNA, 20 nt, Salmonella typhimurium LT2
aucaucgcuugcccagcaua

SEQ ID NO: 3785630 - RNA, 21 nt, Salmonella typhimurium LT2
aucaucgguuacuccuuauuu

SEQ ID NO: 3785631 - RNA, 19 nt, Salmonella typhimurium LT2
aucaucucccaggccgcca

SEQ ID NO: 3785632 - RNA, 14 nt, Salmonella typhimurium LT2
aucaucuucacuuc

SEQ ID NO: 3785633 - RNA, 21 nt, Salmonella typhimurium LT2
aucaucuucacuucacaaaca

SEQ ID NO: 3785634 - RNA, 18 nt, Salmonella typhimurium LT2
aucaucuuuuaccgccug

SEQ ID NO: 3785635 - RNA, 17 nt, Salmonella typhimurium LT2
aucaugacagauuuaau

SEQ ID NO: 3785636 - RNA, 21 nt, Salmonella typhimurium LT2
aucaugcccaaaccugagcau

SEQ ID NO: 3785637 - RNA, 11 nt, Salmonella typhimurium LT2
aucaugcccac

SEQ ID NO: 3785638 - RNA, 13 nt, Salmonella typhimurium LT2
aucaugcccggca

SEQ ID NO: 3785639 - RNA, 15 nt, Salmonella typhimurium LT2
aucaugguugaaaaa

SEQ ID NO: 3785640 - RNA, 20 nt, Salmonella typhimurium LT2
aucaugguugaaaaaagccg

SEQ ID NO: 3785641 - RNA, 19 nt, Salmonella typhimurium LT2
aucaugucaaauucaagcc

SEQ ID NO: 3785642 - RNA, 18 nt, Salmonella typhimurium LT2
aucauuaauaaccccagc

SEQ ID NO: 3785643 - RNA, 15 nt, Salmonella typhimurium LT2
aucauuagcgucaua

SEQ ID NO: 3785644 - RNA, 19 nt, Salmonella typhimurium LT2
aucauuaugucauagcaau

SEQ ID NO: 3785645 - RNA, 20 nt, Salmonella typhimurium LT2
aucauucaacgcaucaaaua

SEQ ID NO: 3785646 - RNA, 15 nt, Salmonella typhimurium LT2
aucauucaucucgau

SEQ ID NO: 3785647 - RNA, 22 nt, Salmonella typhimurium LT2
aucauucccgaauaccacaaau

SEQ ID NO: 3785648 - RNA, 13 nt, Salmonella typhimurium LT2
aucauucccgccc

SEQ ID NO: 3785649 - RNA, 19 nt, Salmonella typhimurium LT2
aucauucucuacgcccagu

SEQ ID NO: 3785650 - RNA, 15 nt, Salmonella typhimurium LT2
aucauugauacugua

SEQ ID NO: 3785651 - RNA, 20 nt, Salmonella typhimurium LT2
aucauugcgaugguccccgg

SEQ ID NO: 3785652 - RNA, 14 nt, Salmonella typhimurium LT2
aucauugcugcugu

SEQ ID NO: 3785653 - RNA, 13 nt, Salmonella typhimurium LT2
aucauuggccaga

SEQ ID NO: 3785654 - RNA, 16 nt, Salmonella typhimurium LT2
aucauugguauuacug

SEQ ID NO: 3785655 - RNA, 19 nt, Salmonella typhimurium LT2
aucauuguucuguccggaa

SEQ ID NO: 3785656 - RNA, 18 nt, Salmonella typhimurium LT2
aucauuuguacaaaaaau

SEQ ID NO: 3785657 - RNA, 13 nt, Salmonella typhimurium LT2
aucauuuucccac

SEQ ID NO: 3785658 - RNA, 17 nt, Salmonella typhimurium LT2
aucauuuucuuucauca

SEQ ID NO: 3785659 - RNA, 19 nt, Salmonella typhimurium LT2
aucauuuucuuucaucaaa

SEQ ID NO: 3785660 - RNA, 21 nt, Salmonella typhimurium LT2
aucauuuucuuucaucaaacg

SEQ ID NO: 3785661 - RNA, 18 nt, Salmonella typhimurium LT2
aucauuuuuuaauaucaa

SEQ ID NO: 3785662 - RNA, 16 nt, Salmonella typhimurium LT2
auccaaaagaaagcgg

SEQ ID NO: 3785663 - RNA, 15 nt, Salmonella typhimurium LT2
auccaacgaaacgca

SEQ ID NO: 3785664 - RNA, 21 nt, Salmonella typhimurium LT2
auccaacgcuuugaucagcac

SEQ ID NO: 3785665 - RNA, 13 nt, Salmonella typhimurium LT2
auccaagccccuc

SEQ ID NO: 3785666 - RNA, 15 nt, Salmonella typhimurium LT2
auccaauaauaagaa

SEQ ID NO: 3785667 - RNA, 14 nt, Salmonella typhimurium LT2
auccacaaucgucg

SEQ ID NO: 3785668 - RNA, 16 nt, Salmonella typhimurium LT2
auccacagcgaauucc

SEQ ID NO: 3785669 - RNA, 13 nt, Salmonella typhimurium LT2
auccacagcgcca

SEQ ID NO: 3785670 - RNA, 16 nt, Salmonella typhimurium LT2
auccacagcgccagaa

SEQ ID NO: 3785671 - RNA, 15 nt, Salmonella typhimurium LT2
auccacauacugcaa

SEQ ID NO: 3785672 - RNA, 16 nt, Salmonella typhimurium LT2
auccacauccaaccgc

SEQ ID NO: 3785673 - RNA, 21 nt, Salmonella typhimurium LT2
auccacauuauucacgcuaug

SEQ ID NO: 3785674 - RNA, 17 nt, Salmonella typhimurium LT2
auccaccaccagcauca

SEQ ID NO: 3785675 - RNA, 14 nt, Salmonella typhimurium LT2
auccaccaccuggu

SEQ ID NO: 3785676 - RNA, 20 nt, Salmonella typhimurium LT2
auccaccacuugauucugca

SEQ ID NO: 3785677 - RNA, 16 nt, Salmonella typhimurium LT2
auccaccaggcaugca

SEQ ID NO: 3785678 - RNA, 22 nt, Salmonella typhimurium LT2
auccaccauaguuucgaacgcc

SEQ ID NO: 3785679 - RNA, 16 nt, Salmonella typhimurium LT2
auccaccgccagcaua

SEQ ID NO: 3785680 - RNA, 18 nt, Salmonella typhimurium LT2
auccaccgguacgcucca

SEQ ID NO: 3785681 - RNA, 18 nt, Salmonella typhimurium LT2
auccaccugaucgugcca

SEQ ID NO: 3785682 - RNA, 15 nt, Salmonella typhimurium LT2
auccacgcagacgcc

SEQ ID NO: 3785683 - RNA, 19 nt, Salmonella typhimurium LT2
auccacgcccugcuuuuuc

SEQ ID NO: 3785684 - RNA, 22 nt, Salmonella typhimurium LT2
auccacgucauaacgcgcauuc

SEQ ID NO: 3785685 - RNA, 18 nt, Salmonella typhimurium LT2
auccacguuccgcaaucg

SEQ ID NO: 3785686 - RNA, 20 nt, Salmonella typhimurium LT2
auccacuggucgucugaaag

SEQ ID NO: 3785687 - RNA, 24 nt, Salmonella typhimurium LT2
auccagaacugcgaaaucaccgac

SEQ ID NO: 3785688 - RNA, 18 nt, Salmonella typhimurium LT2
auccagaaugcguaaaaa

SEQ ID NO: 3785689 - RNA, 20 nt, Salmonella typhimurium LT2
auccagacaaacaccgccug

SEQ ID NO: 3785690 - RNA, 15 nt, Salmonella typhimurium LT2
auccagacagccgac

SEQ ID NO: 3785691 - RNA, 19 nt, Salmonella typhimurium LT2
auccagaccuauugccuug

SEQ ID NO: 3785692 - RNA, 14 nt, Salmonella typhimurium LT2
auccagacgcugac

SEQ ID NO: 3785693 - RNA, 14 nt, Salmonella typhimurium LT2
auccagauccgguu

SEQ ID NO: 3785694 - RNA, 20 nt, Salmonella typhimurium LT2
auccagaucuucagaggccu

SEQ ID NO: 3785695 - RNA, 12 nt, Salmonella typhimurium LT2
auccagcaaaau

SEQ ID NO: 3785696 - RNA, 18 nt, Salmonella typhimurium LT2
auccagcacgagugccag

SEQ ID NO: 3785697 - RNA, 17 nt, Salmonella typhimurium LT2
auccagcgagccuucca

SEQ ID NO: 3785698 - RNA, 22 nt, Salmonella typhimurium LT2
auccagcgauugacgguuuguc

SEQ ID NO: 3785699 - RNA, 16 nt, Salmonella typhimurium LT2
auccagcgcaaaggga

SEQ ID NO: 3785700 - RNA, 16 nt, Salmonella typhimurium LT2
auccagcgcgcugagc

SEQ ID NO: 3785701 - RNA, 19 nt, Salmonella typhimurium LT2
auccagcgcguaaauaccu

SEQ ID NO: 3785702 - RNA, 22 nt, Salmonella typhimurium LT2
auccagcggaacucaucaucaa

SEQ ID NO: 3785703 - RNA, 18 nt, Salmonella typhimurium LT2
auccagcgggccgacgau

SEQ ID NO: 3785704 - RNA, 18 nt, Salmonella typhimurium LT2
auccagcgguagcggcac

SEQ ID NO: 3785705 - RNA, 18 nt, Salmonella typhimurium LT2
auccagcgguuacuuuug

SEQ ID NO: 3785706 - RNA, 16 nt, Salmonella typhimurium LT2
auccaggaaguaaauu

SEQ ID NO: 3785707 - RNA, 16 nt, Salmonella typhimurium LT2
auccaggaauuuuccc

SEQ ID NO: 3785708 - RNA, 12 nt, Salmonella typhimurium LT2
auccaggaggca

SEQ ID NO: 3785709 - RNA, 13 nt, Salmonella typhimurium LT2
auccaggcgggca

SEQ ID NO: 3785710 - RNA, 16 nt, Salmonella typhimurium LT2
auccagggcacuguca

SEQ ID NO: 3785711 - RNA, 11 nt, Salmonella typhimurium LT2
auccaggugga

SEQ ID NO: 3785712 - RNA, 9 nt, Salmonella typhimurium LT2
auccaguaa

SEQ ID NO: 3785713 - RNA, 17 nt, Salmonella typhimurium LT2
auccaguaauuuuuccg

SEQ ID NO: 3785714 - RNA, 15 nt, Salmonella typhimurium LT2
auccaguugaugaug

SEQ ID NO: 3785715 - RNA, 22 nt, Salmonella typhimurium LT2
auccaguuuuuuacuuucaaaa

SEQ ID NO: 3785716 - RNA, 23 nt, Salmonella typhimurium LT2
auccauaccgcuuuguaaaacau

SEQ ID NO: 3785717 - RNA, 18 nt, Salmonella typhimurium LT2
auccaucagaucgaucuu

SEQ ID NO: 3785718 - RNA, 13 nt, Salmonella typhimurium LT2
auccaucagccag

SEQ ID NO: 3785719 - RNA, 17 nt, Salmonella typhimurium LT2
auccaucagccaggguu

SEQ ID NO: 3785720 - RNA, 13 nt, Salmonella typhimurium LT2
auccaucagcgcg

SEQ ID NO: 3785721 - RNA, 18 nt, Salmonella typhimurium LT2
auccaugaccguugccau

SEQ ID NO: 3785722 - RNA, 20 nt, Salmonella typhimurium LT2
auccaugauaaucagcacgc

SEQ ID NO: 3785723 - RNA, 16 nt, Salmonella typhimurium LT2
auccauguugccauga

SEQ ID NO: 3785724 - RNA, 18 nt, Salmonella typhimurium LT2
auccauucucaucagacc

SEQ ID NO: 3785725 - RNA, 22 nt, Salmonella typhimurium LT2
auccauuuaacuaaggggacaa

SEQ ID NO: 3785726 - RNA, 18 nt, Salmonella typhimurium LT2
auccauuuccguuuucag

SEQ ID NO: 3785727 - RNA, 16 nt, Salmonella typhimurium LT2
auccuggaugaguaug

SEQ ID NO: 3785728 - RNA, 23 nt, Salmonella typhimurium LT2
auccuguaacggcgcgauuuuuu

SEQ ID NO: 3785729 - RNA, 24 nt, Salmonella typhimurium LT2
auccuguaccaccacgccuuucac

SEQ ID NO: 3785730 - RNA, 19 nt, Salmonella typhimurium LT2
auccuguagugaagugcag

SEQ ID NO: 3785731 - RNA, 21 nt, Salmonella typhimurium LT2
auccuguagugaagugcagga

SEQ ID NO: 3785732 - RNA, 19 nt, Salmonella typhimurium LT2
auccuguccugggccgcca

SEQ ID NO: 3785733 - RNA, 21 nt, Salmonella typhimurium LT2
auccuguggguucaucgccac

SEQ ID NO: 3785734 - RNA, 13 nt, Salmonella typhimurium LT2
auccuguucaaac

SEQ ID NO: 3785735 - RNA, 18 nt, Salmonella typhimurium LT2
auccuguucaaacaucag

SEQ ID NO: 3785736 - RNA, 19 nt, Salmonella typhimurium LT2
auccuguucauccacagaa

SEQ ID NO: 3785737 - RNA, 11 nt, Salmonella typhimurium LT2
auccuguucca

SEQ ID NO: 3785738 - RNA, 22 nt, Salmonella typhimurium LT2
auccuucauucagaucaaaaau

SEQ ID NO: 3785739 - RNA, 13 nt, Salmonella typhimurium LT2
auccuuccagccc

SEQ ID NO: 3785740 - RNA, 14 nt, Salmonella typhimurium LT2
auccuuccagcccg

SEQ ID NO: 3785741 - RNA, 22 nt, Salmonella typhimurium LT2
auccuuccagcgccauaagacu

SEQ ID NO: 3785742 - RNA, 21 nt, Salmonella typhimurium LT2
auccuucuaccuucaccccca

SEQ ID NO: 3785743 - RNA, 12 nt, Salmonella typhimurium LT2
auccuucuucca

SEQ ID NO: 3785744 - RNA, 15 nt, Salmonella typhimurium LT2
auccuucuuccauuc

SEQ ID NO: 3785745 - RNA, 13 nt, Salmonella typhimurium LT2
aucgaaaaccggu

SEQ ID NO: 3785746 - RNA, 16 nt, Salmonella typhimurium LT2
aucgaacaauuaccga

SEQ ID NO: 3785747 - RNA, 20 nt, Salmonella typhimurium LT2
aucgaacgccgccugcgcca

SEQ ID NO: 3785748 - RNA, 14 nt, Salmonella typhimurium LT2
aucgaacgcuaaau

SEQ ID NO: 3785749 - RNA, 21 nt, Salmonella typhimurium LT2
aucgaacgcuuccgggcucau

SEQ ID NO: 3785750 - RNA, 20 nt, Salmonella typhimurium LT2
aucgaacuguacgcgggaaa

SEQ ID NO: 3785751 - RNA, 23 nt, Salmonella typhimurium LT2
aucgaacuguuuacccacuucuu

SEQ ID NO: 3785752 - RNA, 22 nt, Salmonella typhimurium LT2
aucgaaggcaucuucagacagu

SEQ ID NO: 3785753 - RNA, 22 nt, Salmonella typhimurium LT2
aucgaaucguucgccagugaca

SEQ ID NO: 3785754 - RNA, 15 nt, Salmonella typhimurium LT2
aucgacaaaccacug

SEQ ID NO: 3785755 - RNA, 15 nt, Salmonella typhimurium LT2
aucgacacuauuuuu

SEQ ID NO: 3785756 - RNA, 15 nt, Salmonella typhimurium LT2
aucgacagcagcgcu

SEQ ID NO: 3785757 - RNA, 15 nt, Salmonella typhimurium LT2
aucgacauuaugauc

SEQ ID NO: 3785758 - RNA, 23 nt, Salmonella typhimurium LT2
aucgaccauacuaaugcugccca

SEQ ID NO: 3785759 - RNA, 19 nt, Salmonella typhimurium LT2
aucgacccccaccauguca

SEQ ID NO: 3785760 - RNA, 21 nt, Salmonella typhimurium LT2
aucgacgauaugcaggggcag

SEQ ID NO: 3785761 - RNA, 20 nt, Salmonella typhimurium LT2
aucgacggcgucccugcuuc

SEQ ID NO: 3785762 - RNA, 15 nt, Salmonella typhimurium LT2
aucgacuucgaaggu

SEQ ID NO: 3785763 - RNA, 11 nt, Salmonella typhimurium LT2
aucgagauaag

SEQ ID NO: 3785764 - RNA, 15 nt, Salmonella typhimurium LT2
aucgagaucagacuu

SEQ ID NO: 3785765 - RNA, 20 nt, Salmonella typhimurium LT2
aucgagccuuucacccaaaa

SEQ ID NO: 3785766 - RNA, 15 nt, Salmonella typhimurium LT2
aucgaggccaccaaa

SEQ ID NO: 3785767 - RNA, 15 nt, Salmonella typhimurium LT2
aucgaggcuggucgc

SEQ ID NO: 3785768 - RNA, 14 nt, Salmonella typhimurium LT2
aucgauaagccagc

SEQ ID NO: 3785769 - RNA, 21 nt, Salmonella typhimurium LT2
aucgauagcauuuuuacucag

SEQ ID NO: 3785770 - RNA, 18 nt, Salmonella typhimurium LT2
aucgauagcgauuuuuga

SEQ ID NO: 3785771 - RNA, 15 nt, Salmonella typhimurium LT2
aucgauauaaugccu

SEQ ID NO: 3785772 - RNA, 16 nt, Salmonella typhimurium LT2
aucgaugaccauacgg

SEQ ID NO: 3785773 - RNA, 19 nt, Salmonella typhimurium LT2
aucgaugaccauacggcca

SEQ ID NO: 3785774 - RNA, 16 nt, Salmonella typhimurium LT2
aucgaugcccugugca

SEQ ID NO: 3785775 - RNA, 22 nt, Salmonella typhimurium LT2
aucgaugcuggugaagacgcug

SEQ ID NO: 3785776 - RNA, 18 nt, Salmonella typhimurium LT2
aucgauguuaaaggucag

SEQ ID NO: 3785777 - RNA, 16 nt, Salmonella typhimurium LT2
aucgauucucuucuuc

SEQ ID NO: 3785778 - RNA, 15 nt, Salmonella typhimurium LT2
aucgauucugaauaa

SEQ ID NO: 3785779 - RNA, 20 nt, Salmonella typhimurium LT2
aucgauuuacggaucgccgc

SEQ ID NO: 3785780 - RNA, 15 nt, Salmonella typhimurium LT2
aucgcaaauucugua

SEQ ID NO: 3785781 - RNA, 23 nt, Salmonella typhimurium LT2
aucgcaaauugcgcgcccgcuuc

SEQ ID NO: 3785782 - RNA, 14 nt, Salmonella typhimurium LT2
aucgcaacgugcag

SEQ ID NO: 3785783 - RNA, 14 nt, Salmonella typhimurium LT2
aucgcagauagcaa

SEQ ID NO: 3785784 - RNA, 14 nt, Salmonella typhimurium LT2
aucgcaucagauaa

SEQ ID NO: 3785785 - RNA, 19 nt, Salmonella typhimurium LT2
aucgcauccucgccgacug

SEQ ID NO: 3785786 - RNA, 20 nt, Salmonella typhimurium LT2
aucgcaugacuacgaaucgc

SEQ ID NO: 3785787 - RNA, 17 nt, Salmonella typhimurium LT2
aucgcauuuaaucgccu

SEQ ID NO: 3785788 - RNA, 12 nt, Salmonella typhimurium LT2
aucgccaaacca

SEQ ID NO: 3785789 - RNA, 13 nt, Salmonella typhimurium LT2
aucgccaaaccag

SEQ ID NO: 3785790 - RNA, 12 nt, Salmonella typhimurium LT2
aucgccaaagcg

SEQ ID NO: 3785791 - RNA, 22 nt, Salmonella typhimurium LT2
aucgccaaagucauugcugcca

SEQ ID NO: 3785792 - RNA, 17 nt, Salmonella typhimurium LT2
aucgccaaauccggcuu

SEQ ID NO: 3785793 - RNA, 22 nt, Salmonella typhimurium LT2
aucgccaaauuuagugcucagc

SEQ ID NO: 3785794 - RNA, 19 nt, Salmonella typhimurium LT2
aucgccacaugcggcaggc

SEQ ID NO: 3785795 - RNA, 22 nt, Salmonella typhimurium LT2
aucgccacaugcggcaggcuuu

SEQ ID NO: 3785796 - RNA, 21 nt, Salmonella typhimurium LT2
aucgccaccguaacuaaaaua

SEQ ID NO: 3785797 - RNA, 20 nt, Salmonella typhimurium LT2
aucgccacggugagccacug

SEQ ID NO: 3785798 - RNA, 21 nt, Salmonella typhimurium LT2
aucgccacggugagccacugc

SEQ ID NO: 3785799 - RNA, 22 nt, Salmonella typhimurium LT2
aucgccacggugagccacugca

SEQ ID NO: 3785800 - RNA, 14 nt, Salmonella typhimurium LT2
aucgccagcgccug

SEQ ID NO: 3785801 - RNA, 19 nt, Salmonella typhimurium LT2
aucgccagcguuagcacau

SEQ ID NO: 3785802 - RNA, 19 nt, Salmonella typhimurium LT2
aucgccagggcuuccgcuu

SEQ ID NO: 3785803 - RNA, 23 nt, Salmonella typhimurium LT2
aucgccaguuugucaugcgugcg

SEQ ID NO: 3785804 - RNA, 15 nt, Salmonella typhimurium LT2
aucgccaucaacgcc

SEQ ID NO: 3785805 - RNA, 23 nt, Salmonella typhimurium LT2
aucgccaucaacgccauaaucca

SEQ ID NO: 3785806 - RNA, 15 nt, Salmonella typhimurium LT2
aucgccaucagcgcg

SEQ ID NO: 3785807 - RNA, 14 nt, Salmonella typhimurium LT2
aucgccauccugca

SEQ ID NO: 3785808 - RNA, 23 nt, Salmonella typhimurium LT2
aucgccaucgcgaauuucaaucg

SEQ ID NO: 3785809 - RNA, 18 nt, Salmonella typhimurium LT2
aucgccaugaccacaaag

SEQ ID NO: 3785810 - RNA, 17 nt, Salmonella typhimurium LT2
aucgccauucacggcga

SEQ ID NO: 3785811 - RNA, 22 nt, Salmonella typhimurium LT2
aucgccauucggauaauccaga

SEQ ID NO: 3785812 - RNA, 23 nt, Salmonella typhimurium LT2
aucgcccacuuguaccaacugcu

SEQ ID NO: 3785813 - RNA, 22 nt, Salmonella typhimurium LT2
aucgcccaggucugaugagcgc

SEQ ID NO: 3785814 - RNA, 15 nt, Salmonella typhimurium LT2
aucgcccaucacaug

SEQ ID NO: 3785815 - RNA, 14 nt, Salmonella typhimurium LT2
aucgccccaggcga

SEQ ID NO: 3785816 - RNA, 22 nt, Salmonella typhimurium LT2
aucgcccccaucgugauaaagg

SEQ ID NO: 3785817 - RNA, 14 nt, Salmonella typhimurium LT2
aucgcccggaucgc

SEQ ID NO: 3785818 - RNA, 20 nt, Salmonella typhimurium LT2
aucgcccggaucgcggccuu

SEQ ID NO: 3785819 - RNA, 18 nt, Salmonella typhimurium LT2
aucgcccguaucacugau

SEQ ID NO: 3785820 - RNA, 16 nt, Salmonella typhimurium LT2
aucgccgaagcggcag

SEQ ID NO: 3785821 - RNA, 17 nt, Salmonella typhimurium LT2
aucgccgaagcggcagu

SEQ ID NO: 3785822 - RNA, 16 nt, Salmonella typhimurium LT2
aucgccgacccggcga

SEQ ID NO: 3785823 - RNA, 17 nt, Salmonella typhimurium LT2
aucgccgacgaccggcg

SEQ ID NO: 3785824 - RNA, 13 nt, Salmonella typhimurium LT2
aucgccgaucaca

SEQ ID NO: 3785825 - RNA, 20 nt, Salmonella typhimurium LT2
aucgccgauuccugcugggc

SEQ ID NO: 3785826 - RNA, 23 nt, Salmonella typhimurium LT2
aucgccgcaagcggcaaucgccu

SEQ ID NO: 3785827 - RNA, 20 nt, Salmonella typhimurium LT2
aucgccgcaaugaccacaaa

SEQ ID NO: 3785828 - RNA, 14 nt, Salmonella typhimurium LT2
aucgccgcaucaua

SEQ ID NO: 3785829 - RNA, 22 nt, Salmonella typhimurium LT2
aucgccgccaucaacagcaggc

SEQ ID NO: 3785830 - RNA, 19 nt, Salmonella typhimurium LT2
aucgucggacaacguaccg

SEQ ID NO: 3785831 - RNA, 16 nt, Salmonella typhimurium LT2
aucgucggucagauua

SEQ ID NO: 3785832 - RNA, 14 nt, Salmonella typhimurium LT2
aucgucguauuauc

SEQ ID NO: 3785833 - RNA, 15 nt, Salmonella typhimurium LT2
aucgucgucauaucg

SEQ ID NO: 3785834 - RNA, 19 nt, Salmonella typhimurium LT2
aucgucuaucacaugugcg

SEQ ID NO: 3785835 - RNA, 21 nt, Salmonella typhimurium LT2
aucgugauaacgcgauggcca

SEQ ID NO: 3785836 - RNA, 16 nt, Salmonella typhimurium LT2
aucgugccaugaccau

SEQ ID NO: 3785837 - RNA, 23 nt, Salmonella typhimurium LT2
aucgugccguccggcaucacaaa

SEQ ID NO: 3785838 - RNA, 16 nt, Salmonella typhimurium LT2
aucgugguuggcauau

SEQ ID NO: 3785839 - RNA, 23 nt, Salmonella typhimurium LT2
aucguuacccuauuuugcgccug

SEQ ID NO: 3785840 - RNA, 21 nt, Salmonella typhimurium LT2
aucguuaguguaguuagcgcc

SEQ ID NO: 3785841 - RNA, 14 nt, Salmonella typhimurium LT2
aucguuauccagca

SEQ ID NO: 3785842 - RNA, 18 nt, Salmonella typhimurium LT2
aucguuauccagcagcca

SEQ ID NO: 3785843 - RNA, 21 nt, Salmonella typhimurium LT2
aucguucaaaagugccagcac

SEQ ID NO: 3785844 - RNA, 18 nt, Salmonella typhimurium LT2
aucguugcggcgcagggc

SEQ ID NO: 3785845 - RNA, 18 nt, Salmonella typhimurium LT2
aucguuggaaagcugcug

SEQ ID NO: 3785846 - RNA, 22 nt, Salmonella typhimurium LT2
aucguuugcccauucuucgucg

SEQ ID NO: 3785847 - RNA, 20 nt, Salmonella typhimurium LT2
aucuaaauuucaguauuacu

SEQ ID NO: 3785848 - RNA, 19 nt, Salmonella typhimurium LT2
aucuaauacgagcggguca

SEQ ID NO: 3785849 - RNA, 15 nt, Salmonella typhimurium LT2
aucuaauuaaaaaga

SEQ ID NO: 3785850 - RNA, 22 nt, Salmonella typhimurium LT2
aucuaauuaaaaagagaaaaaa

SEQ ID NO: 3785851 - RNA, 20 nt, Salmonella typhimurium LT2
aucuaccagccgauuuuucg

SEQ ID NO: 3785852 - RNA, 17 nt, Salmonella typhimurium LT2
aucuacgacaaaggcaa

SEQ ID NO: 3785853 - RNA, 14 nt, Salmonella typhimurium LT2
aucuacuaucaucu

SEQ ID NO: 3785854 - RNA, 16 nt, Salmonella typhimurium LT2
aucuauagccugcugg

SEQ ID NO: 3785855 - RNA, 16 nt, Salmonella typhimurium LT2
aucuauauauucuucu

SEQ ID NO: 3785856 - RNA, 16 nt, Salmonella typhimurium LT2
aucuauccaauaauaa

SEQ ID NO: 3785857 - RNA, 19 nt, Salmonella typhimurium LT2
aucuauccaauaauaagaa

SEQ ID NO: 3785858 - RNA, 14 nt, Salmonella typhimurium LT2
aucuauuauuuuuc

SEQ ID NO: 3785859 - RNA, 15 nt, Salmonella typhimurium LT2
aucucaagagugaac

SEQ ID NO: 3785860 - RNA, 15 nt, Salmonella typhimurium LT2
aucucaagcgccgcc

SEQ ID NO: 3785861 - RNA, 20 nt, Salmonella typhimurium LT2
aucucaagcgccgccgcauu

SEQ ID NO: 3785862 - RNA, 22 nt, Salmonella typhimurium LT2
aucucaagcgccgccgcauuuu

SEQ ID NO: 3785863 - RNA, 14 nt, Salmonella typhimurium LT2
aucucaaugaugcc

SEQ ID NO: 3785864 - RNA, 15 nt, Salmonella typhimurium LT2
aucucaaugccacgc

SEQ ID NO: 3785865 - RNA, 17 nt, Salmonella typhimurium LT2
aucucaaugccacgccg

SEQ ID NO: 3785866 - RNA, 21 nt, Salmonella typhimurium LT2
aucucacgcucauagccgcuu

SEQ ID NO: 3785867 - RNA, 18 nt, Salmonella typhimurium LT2
aucucaggguguuuuuau

SEQ ID NO: 3785868 - RNA, 19 nt, Salmonella typhimurium LT2
aucucauagacugccgccg

SEQ ID NO: 3785869 - RNA, 14 nt, Salmonella typhimurium LT2
aucucauggagcug

SEQ ID NO: 3785870 - RNA, 18 nt, Salmonella typhimurium LT2
aucucauggagcugcccg

SEQ ID NO: 3785871 - RNA, 14 nt, Salmonella typhimurium LT2
aucuccagcgcauu

SEQ ID NO: 3785872 - RNA, 22 nt, Salmonella typhimurium LT2
aucuccagcgcauugcccuucg

SEQ ID NO: 3785873 - RNA, 16 nt, Salmonella typhimurium LT2
aucuccaguuguucac

SEQ ID NO: 3785874 - RNA, 13 nt, Salmonella typhimurium LT2
aucuccaucucca

SEQ ID NO: 3785875 - RNA, 16 nt, Salmonella typhimurium LT2
aucucccccggcacca

SEQ ID NO: 3785876 - RNA, 19 nt, Salmonella typhimurium LT2
aucuccgcgcaaucgccga

SEQ ID NO: 3785877 - RNA, 16 nt, Salmonella typhimurium LT2
aucuccggcgaccaau

SEQ ID NO: 3785878 - RNA, 13 nt, Salmonella typhimurium LT2
aucuccuccggcu

SEQ ID NO: 3785879 - RNA, 17 nt, Salmonella typhimurium LT2
aucuccuccggcuucag

SEQ ID NO: 3785880 - RNA, 20 nt, Salmonella typhimurium LT2
aucuccucgccguaaaauuc

SEQ ID NO: 3785881 - RNA, 23 nt, Salmonella typhimurium LT2
aucuccucgccguaaaauucacu

SEQ ID NO: 3785882 - RNA, 12 nt, Salmonella typhimurium LT2
aucuccugacau

SEQ ID NO: 3785883 - RNA, 13 nt, Salmonella typhimurium LT2
aucuccugacugc

SEQ ID NO: 3785884 - RNA, 16 nt, Salmonella typhimurium LT2
aucuccuuuaaugaag

SEQ ID NO: 3785885 - RNA, 12 nt, Salmonella typhimurium LT2
aucucgccuggc

SEQ ID NO: 3785886 - RNA, 13 nt, Salmonella typhimurium LT2
aucucgcuaauca

SEQ ID NO: 3785887 - RNA, 23 nt, Salmonella typhimurium LT2
aucucgguacgccaaaucuguuc

SEQ ID NO: 3785888 - RNA, 17 nt, Salmonella typhimurium LT2
aucucgugaucgccaaa

SEQ ID NO: 3785889 - RNA, 18 nt, Salmonella typhimurium LT2
aucucuaucggcaaacca

SEQ ID NO: 3785890 - RNA, 18 nt, Salmonella typhimurium LT2
aucucucgcgggcauacu

SEQ ID NO: 3785891 - RNA, 19 nt, Salmonella typhimurium LT2
aucucucuggcgcauucca

SEQ ID NO: 3785892 - RNA, 16 nt, Salmonella typhimurium LT2
aucucugucgaccauc

SEQ ID NO: 3785893 - RNA, 19 nt, Salmonella typhimurium LT2
aucucuuccaggauacaca

SEQ ID NO: 3785894 - RNA, 21 nt, Salmonella typhimurium LT2
aucucuuccaggauacacaug

SEQ ID NO: 3785895 - RNA, 13 nt, Salmonella typhimurium LT2
aucugaaaaaccu

SEQ ID NO: 3785896 - RNA, 19 nt, Salmonella typhimurium LT2
aucugaaauaaaagcaaug

SEQ ID NO: 3785897 - RNA, 13 nt, Salmonella typhimurium LT2
aucugaauaccuu

SEQ ID NO: 3785898 - RNA, 15 nt, Salmonella typhimurium LT2
aucugacagauaucu

SEQ ID NO: 3785899 - RNA, 13 nt, Salmonella typhimurium LT2
aucugaguauuua

SEQ ID NO: 3785900 - RNA, 12 nt, Salmonella typhimurium LT2
aucugauagccc

SEQ ID NO: 3785901 - RNA, 23 nt, Salmonella typhimurium LT2
aucugauuaccgguuguuguguc

SEQ ID NO: 3785902 - RNA, 15 nt, Salmonella typhimurium LT2
aucugcauaggcuuu

SEQ ID NO: 3785903 - RNA, 13 nt, Salmonella typhimurium LT2
aucugccauuucu

SEQ ID NO: 3785904 - RNA, 16 nt, Salmonella typhimurium LT2
aucugccauuucugcu

SEQ ID NO: 3785905 - RNA, 13 nt, Salmonella typhimurium LT2
aucugcccuuucu

SEQ ID NO: 3785906 - RNA, 14 nt, Salmonella typhimurium LT2
aucugcccuuucuu

SEQ ID NO: 3785907 - RNA, 23 nt, Salmonella typhimurium LT2
aucugcgcccauuuccucggcca

SEQ ID NO: 3785908 - RNA, 17 nt, Salmonella typhimurium LT2
aucugcggucuccugaa

SEQ ID NO: 3785909 - RNA, 13 nt, Salmonella typhimurium LT2
aucugcuccggcg

SEQ ID NO: 3785910 - RNA, 20 nt, Salmonella typhimurium LT2
aucugcucgacgcgcugcgg

SEQ ID NO: 3785911 - RNA, 14 nt, Salmonella typhimurium LT2
aucugcuucuggcu

SEQ ID NO: 3785912 - RNA, 14 nt, Salmonella typhimurium LT2
aucuggacgccaau

SEQ ID NO: 3785913 - RNA, 17 nt, Salmonella typhimurium LT2
aucuggccaauuuuuca

SEQ ID NO: 3785914 - RNA, 15 nt, Salmonella typhimurium LT2
aucuggcgacaucug

SEQ ID NO: 3785915 - RNA, 20 nt, Salmonella typhimurium LT2
aucuggucggugauauauuc

SEQ ID NO: 3785916 - RNA, 14 nt, Salmonella typhimurium LT2
aucuggugauaaag

SEQ ID NO: 3785917 - RNA, 17 nt, Salmonella typhimurium LT2
aucugguggaaaagaaa

SEQ ID NO: 3785918 - RNA, 19 nt, Salmonella typhimurium LT2
aucugguggaaaagaaaac

SEQ ID NO: 3785919 - RNA, 21 nt, Salmonella typhimurium LT2
aucugguucgcuuucauacga

SEQ ID NO: 3785920 - RNA, 22 nt, Salmonella typhimurium LT2
aucuguauaaauaaaauuguua

SEQ ID NO: 3785921 - RNA, 12 nt, Salmonella typhimurium LT2
aucugucaacgu

SEQ ID NO: 3785922 - RNA, 18 nt, Salmonella typhimurium LT2
aucugucacuuaaguaaa

SEQ ID NO: 3785923 - RNA, 13 nt, Salmonella typhimurium LT2
aucugugaaaacg

SEQ ID NO: 3785924 - RNA, 22 nt, Salmonella typhimurium LT2
aucugugugggcacucgaagau

SEQ ID NO: 3785925 - RNA, 15 nt, Salmonella typhimurium LT2
aucuguucuguccau

SEQ ID NO: 3785926 - RNA, 14 nt, Salmonella typhimurium LT2
aucuguuugagaaa

SEQ ID NO: 3785927 - RNA, 15 nt, Salmonella typhimurium LT2
aucuguuuuagcaug

SEQ ID NO: 3785928 - RNA, 22 nt, Salmonella typhimurium LT2
aucuucaccgaugcccagcuug

SEQ ID NO: 3785929 - RNA, 17 nt, Salmonella typhimurium LT2
aucuucacgcagcguga

SEQ ID NO: 3785930 - RNA, 18 nt, Salmonella typhimurium LT2
aucuucacuucacaaaca

SEQ ID NO: 3785931 - RNA, 20 nt, Salmonella typhimurium LT2
aucuucauguucuaacagau

SEQ ID NO: 3785932 - RNA, 20 nt, Salmonella typhimurium LT2
aucuuccacacuacguugga

SEQ ID NO: 3785933 - RNA, 17 nt, Salmonella typhimurium LT2
aucuuccacgguaaaac

SEQ ID NO: 3785934 - RNA, 13 nt, Salmonella typhimurium LT2
augauaaugccgc

SEQ ID NO: 3785935 - RNA, 19 nt, Salmonella typhimurium LT2
augauaccguuguuauuau

SEQ ID NO: 3785936 - RNA, 16 nt, Salmonella typhimurium LT2
augauauauucaugau

SEQ ID NO: 3785937 - RNA, 22 nt, Salmonella typhimurium LT2
augauaucgcgccaggcuuugg

SEQ ID NO: 3785938 - RNA, 21 nt, Salmonella typhimurium LT2
augauaucggccggaugccag

SEQ ID NO: 3785939 - RNA, 20 nt, Salmonella typhimurium LT2
augaucacuuccgccaccac

SEQ ID NO: 3785940 - RNA, 17 nt, Salmonella typhimurium LT2
augaucagcauagcgcc

SEQ ID NO: 3785941 - RNA, 23 nt, Salmonella typhimurium LT2
augauccagcggaacucaucauc

SEQ ID NO: 3785942 - RNA, 13 nt, Salmonella typhimurium LT2
augaucgacaaug

SEQ ID NO: 3785943 - RNA, 21 nt, Salmonella typhimurium LT2
augaucguaugcagccaggcc

SEQ ID NO: 3785944 - RNA, 13 nt, Salmonella typhimurium LT2
augaucgucaacg

SEQ ID NO: 3785945 - RNA, 17 nt, Salmonella typhimurium LT2
augaucguuuccagcau

SEQ ID NO: 3785946 - RNA, 17 nt, Salmonella typhimurium LT2
augaugaccgaagcagg

SEQ ID NO: 3785947 - RNA, 15 nt, Salmonella typhimurium LT2
augaugagcgccaua

SEQ ID NO: 3785948 - RNA, 17 nt, Salmonella typhimurium LT2
augaugaucuucagccc

SEQ ID NO: 3785949 - RNA, 17 nt, Salmonella typhimurium LT2
augaugcgcuguaaaug

SEQ ID NO: 3785950 - RNA, 23 nt, Salmonella typhimurium LT2
augauguccgccuugaggcguuu

SEQ ID NO: 3785951 - RNA, 22 nt, Salmonella typhimurium LT2
augauuaauacguacugaaaua

SEQ ID NO: 3785952 - RNA, 17 nt, Salmonella typhimurium LT2
augauucaaucggcgau

SEQ ID NO: 3785953 - RNA, 16 nt, Salmonella typhimurium LT2
augauuuaaaaguaca

SEQ ID NO: 3785954 - RNA, 18 nt, Salmonella typhimurium LT2
augauuucacccagaguu

SEQ ID NO: 3785955 - RNA, 16 nt, Salmonella typhimurium LT2
augauuuuaacaucac

SEQ ID NO: 3785956 - RNA, 16 nt, Salmonella typhimurium LT2
augauuuucaaaccaa

SEQ ID NO: 3785957 - RNA, 16 nt, Salmonella typhimurium LT2
augauuuuuauaaaau

SEQ ID NO: 3785958 - RNA, 13 nt, Salmonella typhimurium LT2
augcaaacgacac

SEQ ID NO: 3785959 - RNA, 14 nt, Salmonella typhimurium LT2
augcaaagaaaaac

SEQ ID NO: 3785960 - RNA, 14 nt, Salmonella typhimurium LT2
augcaacuggcaag

SEQ ID NO: 3785961 - RNA, 15 nt, Salmonella typhimurium LT2
augcaagucgaacgg

SEQ ID NO: 3785962 - RNA, 15 nt, Salmonella typhimurium LT2
augcacaacacgcuu

SEQ ID NO: 3785963 - RNA, 14 nt, Salmonella typhimurium LT2
augcacaaccagcg

SEQ ID NO: 3785964 - RNA, 18 nt, Salmonella typhimurium LT2
augcacaaccagcggcac

SEQ ID NO: 3785965 - RNA, 12 nt, Salmonella typhimurium LT2
augcaccgccuu

SEQ ID NO: 3785966 - RNA, 15 nt, Salmonella typhimurium LT2
augcaccucgccaaa

SEQ ID NO: 3785967 - RNA, 18 nt, Salmonella typhimurium LT2
augcacguuaaagccgac

SEQ ID NO: 3785968 - RNA, 14 nt, Salmonella typhimurium LT2
augcacugcugaua

SEQ ID NO: 3785969 - RNA, 14 nt, Salmonella typhimurium LT2
augcagaccucugc

SEQ ID NO: 3785970 - RNA, 20 nt, Salmonella typhimurium LT2
augcagcaagaagagaaugu

SEQ ID NO: 3785971 - RNA, 21 nt, Salmonella typhimurium LT2
augcagcaggucgaccaccug

SEQ ID NO: 3785972 - RNA, 13 nt, Salmonella typhimurium LT2
augcagccaggcc

SEQ ID NO: 3785973 - RNA, 20 nt, Salmonella typhimurium LT2
augcagcgcgaugacgucac

SEQ ID NO: 3785974 - RNA, 21 nt, Salmonella typhimurium LT2
augcagcggaauuaacugcac

SEQ ID NO: 3785975 - RNA, 14 nt, Salmonella typhimurium LT2
augcaggccaagca

SEQ ID NO: 3785976 - RNA, 18 nt, Salmonella typhimurium LT2
augcaggccaagcagcgc

SEQ ID NO: 3785977 - RNA, 19 nt, Salmonella typhimurium LT2
augcaggccaagcagcgcc

SEQ ID NO: 3785978 - RNA, 22 nt, Salmonella typhimurium LT2
augcaggcggucgaaacacgaa

SEQ ID NO: 3785979 - RNA, 15 nt, Salmonella typhimurium LT2
augcagguucccgcc

SEQ ID NO: 3785980 - RNA, 22 nt, Salmonella typhimurium LT2
augcaguagugugguauucagc

SEQ ID NO: 3785981 - RNA, 17 nt, Salmonella typhimurium LT2
augcaguucaucauccu

SEQ ID NO: 3785982 - RNA, 13 nt, Salmonella typhimurium LT2
augcauaaaaaaa

SEQ ID NO: 3785983 - RNA, 19 nt, Salmonella typhimurium LT2
augcauaugcacagcgcua

SEQ ID NO: 3785984 - RNA, 12 nt, Salmonella typhimurium LT2
augcaucagaac

SEQ ID NO: 3785985 - RNA, 13 nt, Salmonella typhimurium LT2
augcauccgccag

SEQ ID NO: 3785986 - RNA, 23 nt, Salmonella typhimurium LT2
augcaucucguaaaucaauuuua

SEQ ID NO: 3785987 - RNA, 16 nt, Salmonella typhimurium LT2
augcaucuugaaugau

SEQ ID NO: 3785988 - RNA, 13 nt, Salmonella typhimurium LT2
augcaugaagcgu

SEQ ID NO: 3785989 - RNA, 18 nt, Salmonella typhimurium LT2
augcaugacgcaggcgca

SEQ ID NO: 3785990 - RNA, 19 nt, Salmonella typhimurium LT2
augcaugguguugguacac

SEQ ID NO: 3785991 - RNA, 18 nt, Salmonella typhimurium LT2
augcauguggagaugagc

SEQ ID NO: 3785992 - RNA, 14 nt, Salmonella typhimurium LT2
augccaaccaccgc

SEQ ID NO: 3785993 - RNA, 14 nt, Salmonella typhimurium LT2
augccaccagcgcc

SEQ ID NO: 3785994 - RNA, 21 nt, Salmonella typhimurium LT2
augccacgccccuaaggcagc

SEQ ID NO: 3785995 - RNA, 15 nt, Salmonella typhimurium LT2
augccacucgauucc

SEQ ID NO: 3785996 - RNA, 23 nt, Salmonella typhimurium LT2
augccacugcccucaaguuaugu

SEQ ID NO: 3785997 - RNA, 14 nt, Salmonella typhimurium LT2
augccagcaggcca

SEQ ID NO: 3785998 - RNA, 21 nt, Salmonella typhimurium LT2
augccagcaggccaaagauua

SEQ ID NO: 3785999 - RNA, 17 nt, Salmonella typhimurium LT2
augccagcucaaaucgc

SEQ ID NO: 3786000 - RNA, 15 nt, Salmonella typhimurium LT2
augccauccagcacc

SEQ ID NO: 3786001 - RNA, 16 nt, Salmonella typhimurium LT2
augccaucggccagca

SEQ ID NO: 3786002 - RNA, 18 nt, Salmonella typhimurium LT2
augccauguuucuuuuaa

SEQ ID NO: 3786003 - RNA, 21 nt, Salmonella typhimurium LT2
augccauuugcaaaagacggc

SEQ ID NO: 3786004 - RNA, 15 nt, Salmonella typhimurium LT2
augcccaauugacgg

SEQ ID NO: 3786005 - RNA, 18 nt, Salmonella typhimurium LT2
augcccacgcuucccagc

SEQ ID NO: 3786006 - RNA, 20 nt, Salmonella typhimurium LT2
augccccagaaaaugcucag

SEQ ID NO: 3786007 - RNA, 22 nt, Salmonella typhimurium LT2
augcccggcuggcgauuauucc

SEQ ID NO: 3786008 - RNA, 17 nt, Salmonella typhimurium LT2
augcccgucccauuucu

SEQ ID NO: 3786009 - RNA, 14 nt, Salmonella typhimurium LT2
augcccugcuguuc

SEQ ID NO: 3786010 - RNA, 17 nt, Salmonella typhimurium LT2
augccgaagacuccccu

SEQ ID NO: 3786011 - RNA, 12 nt, Salmonella typhimurium LT2
augccgaccaau

SEQ ID NO: 3786012 - RNA, 16 nt, Salmonella typhimurium LT2
augccgaucaccagcg

SEQ ID NO: 3786013 - RNA, 21 nt, Salmonella typhimurium LT2
augccgcacuccccagaauga

SEQ ID NO: 3786014 - RNA, 12 nt, Salmonella typhimurium LT2
augccgccacuu

SEQ ID NO: 3786015 - RNA, 16 nt, Salmonella typhimurium LT2
augccgccauccggca

SEQ ID NO: 3786016 - RNA, 17 nt, Salmonella typhimurium LT2
augccgccauccggcaa

SEQ ID NO: 3786017 - RNA, 19 nt, Salmonella typhimurium LT2
augccgccgacaaccagcg

SEQ ID NO: 3786018 - RNA, 15 nt, Salmonella typhimurium LT2
augccgccgcaacac

SEQ ID NO: 3786019 - RNA, 16 nt, Salmonella typhimurium LT2
augccgccguuuuauu

SEQ ID NO: 3786020 - RNA, 18 nt, Salmonella typhimurium LT2
augccgccuuuaucgaca

SEQ ID NO: 3786021 - RNA, 21 nt, Salmonella typhimurium LT2
augccgcuggccgaugucaau

SEQ ID NO: 3786022 - RNA, 23 nt, Salmonella typhimurium LT2
augccggccgcaguuuuccagcg

SEQ ID NO: 3786023 - RNA, 23 nt, Salmonella typhimurium LT2
augccggugcgagaaaaagcaau

SEQ ID NO: 3786024 - RNA, 17 nt, Salmonella typhimurium LT2
augccguagccaaguau

SEQ ID NO: 3786025 - RNA, 13 nt, Salmonella typhimurium LT2
augccguagcggc

SEQ ID NO: 3786026 - RNA, 15 nt, Salmonella typhimurium LT2
augccgucaucagca

SEQ ID NO: 3786027 - RNA, 18 nt, Salmonella typhimurium LT2
augccgucgacgccgaua

SEQ ID NO: 3786028 - RNA, 22 nt, Salmonella typhimurium LT2
augccguuaccguucaggcaaa

SEQ ID NO: 3786029 - RNA, 21 nt, Salmonella typhimurium LT2
augccguucuuuaaucagauu

SEQ ID NO: 3786030 - RNA, 18 nt, Salmonella typhimurium LT2
augccguuuuaacgucau

SEQ ID NO: 3786031 - RNA, 18 nt, Salmonella typhimurium LT2
augccguuuucauccauu

SEQ ID NO: 3786032 - RNA, 24 nt, Salmonella typhimurium LT2
augccuaaaccgacaauauucgcc

SEQ ID NO: 3786033 - RNA, 16 nt, Salmonella typhimurium LT2
augccucauuaaaaaa

SEQ ID NO: 3786034 - RNA, 19 nt, Salmonella typhimurium LT2
augccucauuaaaaaaaca

SEQ ID NO: 3786035 - RNA, 19 nt, Salmonella typhimurium LT2
augccucgaaaauauauuc

SEQ ID NO: 3786036 - RNA, 22 nt, Salmonella typhimurium LT2
augccucguuucccucauauuu

SEQ ID NO: 3786037 - RNA, 19 nt, Salmonella typhimurium LT2
augccugaaaauagcgcca

SEQ ID NO: 3786038 - RNA, 22 nt, Salmonella typhimurium LT2
auggacagggucgauucccaga

SEQ ID NO: 3786039 - RNA, 23 nt, Salmonella typhimurium LT2
auggacgggauacggcgagacca

SEQ ID NO: 3786040 - RNA, 14 nt, Salmonella typhimurium LT2
auggagauaagcug

SEQ ID NO: 3786041 - RNA, 23 nt, Salmonella typhimurium LT2
auggaugagucuugcgcguccgc

SEQ ID NO: 3786042 - RNA, 15 nt, Salmonella typhimurium LT2
auggaugugaaugaa

SEQ ID NO: 3786043 - RNA, 15 nt, Salmonella typhimurium LT2
auggauucaugguac

SEQ ID NO: 3786044 - RNA, 18 nt, Salmonella typhimurium LT2
auggcaaacggauauuuu

SEQ ID NO: 3786045 - RNA, 12 nt, Salmonella typhimurium LT2
auggcaaagucg

SEQ ID NO: 3786046 - RNA, 18 nt, Salmonella typhimurium LT2
auggcaacaaagccugcu

SEQ ID NO: 3786047 - RNA, 19 nt, Salmonella typhimurium LT2
auggcaacaaagccugcug

SEQ ID NO: 3786048 - RNA, 17 nt, Salmonella typhimurium LT2
auggcaaguaaaauaac

SEQ ID NO: 3786049 - RNA, 17 nt, Salmonella typhimurium LT2
auggcacaucaggcaaa

SEQ ID NO: 3786050 - RNA, 14 nt, Salmonella typhimurium LT2
auggcagaacagcg

SEQ ID NO: 3786051 - RNA, 19 nt, Salmonella typhimurium LT2
auggcaggcagcacaauca

SEQ ID NO: 3786052 - RNA, 14 nt, Salmonella typhimurium LT2
auggcccgccagca

SEQ ID NO: 3786053 - RNA, 12 nt, Salmonella typhimurium LT2
auggccgcagcc

SEQ ID NO: 3786054 - RNA, 17 nt, Salmonella typhimurium LT2
auggccgcagcgccaua

SEQ ID NO: 3786055 - RNA, 20 nt, Salmonella typhimurium LT2
auggccguuuucaugcacga

SEQ ID NO: 3786056 - RNA, 13 nt, Salmonella typhimurium LT2
auggccuggagcg

SEQ ID NO: 3786057 - RNA, 15 nt, Salmonella typhimurium LT2
auggcgacgaucagc

SEQ ID NO: 3786058 - RNA, 17 nt, Salmonella typhimurium LT2
auggcgacgaucagcgc

SEQ ID NO: 3786059 - RNA, 18 nt, Salmonella typhimurium LT2
auggcgacgaucagcgcc

SEQ ID NO: 3786060 - RNA, 19 nt, Salmonella typhimurium LT2
auggcgacgaucagcgcca

SEQ ID NO: 3786061 - RNA, 20 nt, Salmonella typhimurium LT2
auggcgacgccuucagucaa

SEQ ID NO: 3786062 - RNA, 12 nt, Salmonella typhimurium LT2
auggcgccaagu

SEQ ID NO: 3786063 - RNA, 19 nt, Salmonella typhimurium LT2
auggcgccaauauagccga

SEQ ID NO: 3786064 - RNA, 18 nt, Salmonella typhimurium LT2
auggcgcgaaaacagcug

SEQ ID NO: 3786065 - RNA, 22 nt, Salmonella typhimurium LT2
auggcgcgacgcuuaucagccc

SEQ ID NO: 3786066 - RNA, 18 nt, Salmonella typhimurium LT2
auggcgcgccacuucuuu

SEQ ID NO: 3786067 - RNA, 20 nt, Salmonella typhimurium LT2
auggcgcgccacuucuuuga

SEQ ID NO: 3786068 - RNA, 15 nt, Salmonella typhimurium LT2
auggcgcgccagcca

SEQ ID NO: 3786069 - RNA, 16 nt, Salmonella typhimurium LT2
auggcgcgcgccgccu

SEQ ID NO: 3786070 - RNA, 17 nt, Salmonella typhimurium LT2
auggcgcuaagccagcc

SEQ ID NO: 3786071 - RNA, 21 nt, Salmonella typhimurium LT2
auggcgcuacgccugaacgaa

SEQ ID NO: 3786072 - RNA, 22 nt, Salmonella typhimurium LT2
auggcgcuacgcuuaucaggcc

SEQ ID NO: 3786073 - RNA, 20 nt, Salmonella typhimurium LT2
auggcgcuacgcuuauccgg

SEQ ID NO: 3786074 - RNA, 12 nt, Salmonella typhimurium LT2
auggcgcugcgc

SEQ ID NO: 3786075 - RNA, 15 nt, Salmonella typhimurium LT2
auggcgcugcgcgca

SEQ ID NO: 3786076 - RNA, 22 nt, Salmonella typhimurium LT2
auggcgcuucgcuuaucaggcc

SEQ ID NO: 3786077 - RNA, 24 nt, Salmonella typhimurium LT2
auggcgcuucgcuuaucgggccua

SEQ ID NO: 3786078 - RNA, 18 nt, Salmonella typhimurium LT2
auggcggaguaccgccuu

SEQ ID NO: 3786079 - RNA, 22 nt, Salmonella typhimurium LT2
auggcggauuccaguagcgcgc

SEQ ID NO: 3786080 - RNA, 23 nt, Salmonella typhimurium LT2
auggcggcgaaacgccuuauccg

SEQ ID NO: 3786081 - RNA, 24 nt, Salmonella typhimurium LT2
auggcggcgaaacgccuuauccgg

SEQ ID NO: 3786082 - RNA, 21 nt, Salmonella typhimurium LT2
auggcggcgagaaaaucccau

SEQ ID NO: 3786083 - RNA, 21 nt, Salmonella typhimurium LT2
auggcggcuuggcuguagaua

SEQ ID NO: 3786084 - RNA, 18 nt, Salmonella typhimurium LT2
auggcgggccugugccug

SEQ ID NO: 3786085 - RNA, 16 nt, Salmonella typhimurium LT2
auggcgggcguccugc

SEQ ID NO: 3786086 - RNA, 20 nt, Salmonella typhimurium LT2
auggcgguauaacugccuua

SEQ ID NO: 3786087 - RNA, 15 nt, Salmonella typhimurium LT2
auggcggucagcuuu

SEQ ID NO: 3786088 - RNA, 20 nt, Salmonella typhimurium LT2
auggcggugcuuaaccggga

SEQ ID NO: 3786089 - RNA, 21 nt, Salmonella typhimurium LT2
auggcggugcuuaaccgggau

SEQ ID NO: 3786090 - RNA, 12 nt, Salmonella typhimurium LT2
auggcguaagcu

SEQ ID NO: 3786091 - RNA, 23 nt, Salmonella typhimurium LT2
auggcguggauagccaucggcau

SEQ ID NO: 3786092 - RNA, 18 nt, Salmonella typhimurium LT2
auggcguuccgguugccg

SEQ ID NO: 3786093 - RNA, 17 nt, Salmonella typhimurium LT2
auggcuaauauccagcc

SEQ ID NO: 3786094 - RNA, 21 nt, Salmonella typhimurium LT2
auggcuauuuugaucccacug

SEQ ID NO: 3786095 - RNA, 18 nt, Salmonella typhimurium LT2
auggcugauggcgaaaau

SEQ ID NO: 3786096 - RNA, 18 nt, Salmonella typhimurium LT2
auggcuggaaagcucuuc

SEQ ID NO: 3786097 - RNA, 20 nt, Salmonella typhimurium LT2
augggauagugccugccguc

SEQ ID NO: 3786098 - RNA, 18 nt, Salmonella typhimurium LT2
augggaucgauccuucaa

SEQ ID NO: 3786099 - RNA, 22 nt, Salmonella typhimurium LT2
augggcaggagaugaccugccc

SEQ ID NO: 3786100 - RNA, 18 nt, Salmonella typhimurium LT2
augggccuacgccuggau

SEQ ID NO: 3786101 - RNA, 17 nt, Salmonella typhimurium LT2
augggcgcacagcgcca

SEQ ID NO: 3786102 - RNA, 13 nt, Salmonella typhimurium LT2
augggcgcggcga

SEQ ID NO: 3786103 - RNA, 16 nt, Salmonella typhimurium LT2
augggcggccugcgcc

SEQ ID NO: 3786104 - RNA, 16 nt, Salmonella typhimurium LT2
augggcgggauccugc

SEQ ID NO: 3786105 - RNA, 15 nt, Salmonella typhimurium LT2
augggcuucuucacu

SEQ ID NO: 3786106 - RNA, 22 nt, Salmonella typhimurium LT2
augggguuuguccugcagcgcc

SEQ ID NO: 3786107 - RNA, 23 nt, Salmonella typhimurium LT2
auggguaaaaauauggcgggccu

SEQ ID NO: 3786108 - RNA, 20 nt, Salmonella typhimurium LT2
auggguaggccggauaagcg

SEQ ID NO: 3786109 - RNA, 20 nt, Salmonella typhimurium LT2
augggucacauccagacagc

SEQ ID NO: 3786110 - RNA, 15 nt, Salmonella typhimurium LT2
auggguggcagggca

SEQ ID NO: 3786111 - RNA, 20 nt, Salmonella typhimurium LT2
auggguuauggauguuuuca

SEQ ID NO: 3786112 - RNA, 17 nt, Salmonella typhimurium LT2
auggguuccaguugcac

SEQ ID NO: 3786113 - RNA, 21 nt, Salmonella typhimurium LT2
auggguuuccuccaucagcgc

SEQ ID NO: 3786114 - RNA, 14 nt, Salmonella typhimurium LT2
augguaauauuaaa

SEQ ID NO: 3786115 - RNA, 16 nt, Salmonella typhimurium LT2
augguacucaacauca

SEQ ID NO: 3786116 - RNA, 22 nt, Salmonella typhimurium LT2
augguauaaaucccggugggga

SEQ ID NO: 3786117 - RNA, 16 nt, Salmonella typhimurium LT2
augguauaugggcaau

SEQ ID NO: 3786118 - RNA, 16 nt, Salmonella typhimurium LT2
auggucauuccagcua

SEQ ID NO: 3786119 - RNA, 18 nt, Salmonella typhimurium LT2
auggucgcgccaaaagag

SEQ ID NO: 3786120 - RNA, 15 nt, Salmonella typhimurium LT2
auggucgguauuauc

SEQ ID NO: 3786121 - RNA, 14 nt, Salmonella typhimurium LT2
auggucuccagcaa

SEQ ID NO: 3786122 - RNA, 22 nt, Salmonella typhimurium LT2
auggugcccauaaaaaucccaa

SEQ ID NO: 3786123 - RNA, 13 nt, Salmonella typhimurium LT2
auggugccgccga

SEQ ID NO: 3786124 - RNA, 18 nt, Salmonella typhimurium LT2
augguggagucuaaaaau

SEQ ID NO: 3786125 - RNA, 22 nt, Salmonella typhimurium LT2
augguggucggcuacgacaggu

SEQ ID NO: 3786126 - RNA, 16 nt, Salmonella typhimurium LT2
augguguauaaauaac

SEQ ID NO: 3786127 - RNA, 22 nt, Salmonella typhimurium LT2
augguuaaauuaaauaacaaau

SEQ ID NO: 3786128 - RNA, 18 nt, Salmonella typhimurium LT2
augguuacgcgacgugcu

SEQ ID NO: 3786129 - RNA, 22 nt, Salmonella typhimurium LT2
augguuacgcgacgugcugugg

SEQ ID NO: 3786130 - RNA, 21 nt, Salmonella typhimurium LT2
augguuacuccucuuucccuu

SEQ ID NO: 3786131 - RNA, 15 nt, Salmonella typhimurium LT2
augguucccgccacu

SEQ ID NO: 3786132 - RNA, 22 nt, Salmonella typhimurium LT2
augguuuugcccauuuccugca

SEQ ID NO: 3786133 - RNA, 16 nt, Salmonella typhimurium LT2
auguaaaaaaauaaaa

SEQ ID NO: 3786134 - RNA, 19 nt, Salmonella typhimurium LT2
auguaaaaaaauaaaaaag

SEQ ID NO: 3786135 - RNA, 19 nt, Salmonella typhimurium LT2
auguaaaacgguaugaaac

SEQ ID NO: 3786136 - RNA, 18 nt, Salmonella typhimurium LT2
auguaaacuccauuaaau

SEQ ID NO: 3786137 - RNA, 19 nt, Salmonella typhimurium LT2
auguaaacuccauuaaauu

SEQ ID NO: 3786138 - RNA, 17 nt, Salmonella typhimurium LT2
auguaaauuaauucaug

SEQ ID NO: 3786139 - RNA, 22 nt, Salmonella typhimurium LT2
auguaagacagcgcgcccagca

SEQ ID NO: 3786140 - RNA, 24 nt, Salmonella typhimurium LT2
auguaagcgucuauuacacgauca

SEQ ID NO: 3786141 - RNA, 18 nt, Salmonella typhimurium LT2
auuaaguuuuuuuaaaaa

SEQ ID NO: 3786142 - RNA, 16 nt, Salmonella typhimurium LT2
auuaauacguacugaa

SEQ ID NO: 3786143 - RNA, 14 nt, Salmonella typhimurium LT2
auuaauaugcgcaa

SEQ ID NO: 3786144 - RNA, 19 nt, Salmonella typhimurium LT2
auuaauaugcgcaaucacc

SEQ ID NO: 3786145 - RNA, 15 nt, Salmonella typhimurium LT2
auuaauauuuuauca

SEQ ID NO: 3786146 - RNA, 20 nt, Salmonella typhimurium LT2
auuaaucaagcccagcucag

SEQ ID NO: 3786147 - RNA, 21 nt, Salmonella typhimurium LT2
auuaaucagcagauagccugc

SEQ ID NO: 3786148 - RNA, 21 nt, Salmonella typhimurium LT2
auuaauccccggcgaaagaaa

SEQ ID NO: 3786149 - RNA, 17 nt, Salmonella typhimurium LT2
auuaaugcgaaaauaaa

SEQ ID NO: 3786150 - RNA, 17 nt, Salmonella typhimurium LT2
auuaaugcuccaauaaa

SEQ ID NO: 3786151 - RNA, 19 nt, Salmonella typhimurium LT2
auuaaugcuccaauaaaua

SEQ ID NO: 3786152 - RNA, 21 nt, Salmonella typhimurium LT2
auuaaugucaugaagcucaac

SEQ ID NO: 3786153 - RNA, 21 nt, Salmonella typhimurium LT2
auuaauugcgacaagcucauu

SEQ ID NO: 3786154 - RNA, 15 nt, Salmonella typhimurium LT2
auuaauugcuuugca

SEQ ID NO: 3786155 - RNA, 15 nt, Salmonella typhimurium LT2
auuaauuuucacgcu

SEQ ID NO: 3786156 - RNA, 14 nt, Salmonella typhimurium LT2
auuacaaaaauaga

SEQ ID NO: 3786157 - RNA, 16 nt, Salmonella typhimurium LT2
auuacagauauccacc

SEQ ID NO: 3786158 - RNA, 16 nt, Salmonella typhimurium LT2
auuacaggaguaugcg

SEQ ID NO: 3786159 - RNA, 18 nt, Salmonella typhimurium LT2
auuacaucaauaaacauu

SEQ ID NO: 3786160 - RNA, 14 nt, Salmonella typhimurium LT2
auuaccagcaauaa

SEQ ID NO: 3786161 - RNA, 20 nt, Salmonella typhimurium LT2
auuaccagcaauaacaggca

SEQ ID NO: 3786162 - RNA, 18 nt, Salmonella typhimurium LT2
auuaccccgugguggggu

SEQ ID NO: 3786163 - RNA, 22 nt, Salmonella typhimurium LT2
auuaccccguggugggguuccc

SEQ ID NO: 3786164 - RNA, 21 nt, Salmonella typhimurium LT2
auuaccccuggugggguuccc

SEQ ID NO: 3786165 - RNA, 15 nt, Salmonella typhimurium LT2
auuacccuucaugca

SEQ ID NO: 3786166 - RNA, 13 nt, Salmonella typhimurium LT2
auuaccgccaaca

SEQ ID NO: 3786167 - RNA, 13 nt, Salmonella typhimurium LT2
auuaccgccacuu

SEQ ID NO: 3786168 - RNA, 23 nt, Salmonella typhimurium LT2
auuaccgggauuuccauauuaac

SEQ ID NO: 3786169 - RNA, 18 nt, Salmonella typhimurium LT2
auuacgaaaaggucuuuc

SEQ ID NO: 3786170 - RNA, 14 nt, Salmonella typhimurium LT2
auuacgcaccacgc

SEQ ID NO: 3786171 - RNA, 16 nt, Salmonella typhimurium LT2
auuacgccaucagcau

SEQ ID NO: 3786172 - RNA, 20 nt, Salmonella typhimurium LT2
auuacggacgauacaccuuc

SEQ ID NO: 3786173 - RNA, 22 nt, Salmonella typhimurium LT2
auuacggacgauacaccuucac

SEQ ID NO: 3786174 - RNA, 17 nt, Salmonella typhimurium LT2
auuacguucaacgggaa

SEQ ID NO: 3786175 - RNA, 22 nt, Salmonella typhimurium LT2
auuacguucaacgggaaaaaau

SEQ ID NO: 3786176 - RNA, 22 nt, Salmonella typhimurium LT2
auuacguuggggauaaccagaa

SEQ ID NO: 3786177 - RNA, 22 nt, Salmonella typhimurium LT2
auuacucgccugcgcuuugugc

SEQ ID NO: 3786178 - RNA, 15 nt, Salmonella typhimurium LT2
auuacugaauaccuu

SEQ ID NO: 3786179 - RNA, 12 nt, Salmonella typhimurium LT2
auuagccgccag

SEQ ID NO: 3786180 - RNA, 19 nt, Salmonella typhimurium LT2
auuagccggauagcaacgc

SEQ ID NO: 3786181 - RNA, 22 nt, Salmonella typhimurium LT2
auuagcgacgcauacucuugga

SEQ ID NO: 3786182 - RNA, 16 nt, Salmonella typhimurium LT2
auuagcgucauacuua

SEQ ID NO: 3786183 - RNA, 22 nt, Salmonella typhimurium LT2
auuaggcuuuucauucagcgcg

SEQ ID NO: 3786184 - RNA, 20 nt, Salmonella typhimurium LT2
auuagguuacguugucacaa

SEQ ID NO: 3786185 - RNA, 18 nt, Salmonella typhimurium LT2
auuauaacgugacuguca

SEQ ID NO: 3786186 - RNA, 13 nt, Salmonella typhimurium LT2
auuauauaauauc

SEQ ID NO: 3786187 - RNA, 21 nt, Salmonella typhimurium LT2
auuauauagucaaugcccccg

SEQ ID NO: 3786188 - RNA, 16 nt, Salmonella typhimurium LT2
auuaucaauccugcca

SEQ ID NO: 3786189 - RNA, 12 nt, Salmonella typhimurium LT2
auuaucaccauu

SEQ ID NO: 3786190 - RNA, 14 nt, Salmonella typhimurium LT2
auuaucagcaauaa

SEQ ID NO: 3786191 - RNA, 24 nt, Salmonella typhimurium LT2
auuaucagcaauaauuuuaccauu

SEQ ID NO: 3786192 - RNA, 22 nt, Salmonella typhimurium LT2
auuauccacaaacuccagacga

SEQ ID NO: 3786193 - RNA, 23 nt, Salmonella typhimurium LT2
auuauccagccgaaguucauaaa

SEQ ID NO: 3786194 - RNA, 15 nt, Salmonella typhimurium LT2
auuauccggcaucaa

SEQ ID NO: 3786195 - RNA, 16 nt, Salmonella typhimurium LT2
auuaucgaaauagcgg

SEQ ID NO: 3786196 - RNA, 15 nt, Salmonella typhimurium LT2
auuaucuccaucuug

SEQ ID NO: 3786197 - RNA, 17 nt, Salmonella typhimurium LT2
auuaugaucgguuuuuu

SEQ ID NO: 3786198 - RNA, 13 nt, Salmonella typhimurium LT2
auuaugccgacca

SEQ ID NO: 3786199 - RNA, 19 nt, Salmonella typhimurium LT2
auuaugccgcacuccccag

SEQ ID NO: 3786200 - RNA, 20 nt, Salmonella typhimurium LT2
auuaugccgcacuccccaga

SEQ ID NO: 3786201 - RNA, 18 nt, Salmonella typhimurium LT2
auuaugccugucaucauc

SEQ ID NO: 3786202 - RNA, 16 nt, Salmonella typhimurium LT2
auuauggcgugaugcu

SEQ ID NO: 3786203 - RNA, 14 nt, Salmonella typhimurium LT2
auuaugguagcugc

SEQ ID NO: 3786204 - RNA, 14 nt, Salmonella typhimurium LT2
auuauguugagagc

SEQ ID NO: 3786205 - RNA, 22 nt, Salmonella typhimurium LT2
auuauucacgcuauguuugcug

SEQ ID NO: 3786206 - RNA, 21 nt, Salmonella typhimurium LT2
auuauuccuugaucaggaaau

SEQ ID NO: 3786207 - RNA, 20 nt, Salmonella typhimurium LT2
auuauucggcgacuggaaca

SEQ ID NO: 3786208 - RNA, 23 nt, Salmonella typhimurium LT2
auuauugccaucggacauauuuu

SEQ ID NO: 3786209 - RNA, 21 nt, Salmonella typhimurium LT2
auuauuggcuuuguaaauacu

SEQ ID NO: 3786210 - RNA, 17 nt, Salmonella typhimurium LT2
auuauuuuagugaaaaa

SEQ ID NO: 3786211 - RNA, 21 nt, Salmonella typhimurium LT2
auuauuuuucuauuccgcuca

SEQ ID NO: 3786212 - RNA, 16 nt, Salmonella typhimurium LT2
auuauuuuugucauaa

SEQ ID NO: 3786213 - RNA, 17 nt, Salmonella typhimurium LT2
auuauuuuuucuuuaau

SEQ ID NO: 3786214 - RNA, 23 nt, Salmonella typhimurium LT2
auuauuuuuucuuuaauuaaauu

SEQ ID NO: 3786215 - RNA, 15 nt, Salmonella typhimurium LT2
auucaaaauccgcca

SEQ ID NO: 3786216 - RNA, 15 nt, Salmonella typhimurium LT2
auucaacgcaucaaa

SEQ ID NO: 3786217 - RNA, 23 nt, Salmonella typhimurium LT2
auucaagcaacuguagaaugcua

SEQ ID NO: 3786218 - RNA, 18 nt, Salmonella typhimurium LT2
auucaauaauauugucau

SEQ ID NO: 3786219 - RNA, 11 nt, Salmonella typhimurium LT2
auucaauauug

SEQ ID NO: 3786220 - RNA, 17 nt, Salmonella typhimurium LT2
auucaaucuggugacga

SEQ ID NO: 3786221 - RNA, 21 nt, Salmonella typhimurium LT2
auucaauuagcgccuccccua

SEQ ID NO: 3786222 - RNA, 15 nt, Salmonella typhimurium LT2
auucacaccuuuaua

SEQ ID NO: 3786223 - RNA, 14 nt, Salmonella typhimurium LT2
auucaccaaauccu

SEQ ID NO: 3786224 - RNA, 19 nt, Salmonella typhimurium LT2
auucaccgugccaccggug

SEQ ID NO: 3786225 - RNA, 23 nt, Salmonella typhimurium LT2
auucaccuggaaaggcuuuuuaa

SEQ ID NO: 3786226 - RNA, 20 nt, Salmonella typhimurium LT2
auucacgacaugagauaaug

SEQ ID NO: 3786227 - RNA, 22 nt, Salmonella typhimurium LT2
auucacgcgauugucauccccc

SEQ ID NO: 3786228 - RNA, 18 nt, Salmonella typhimurium LT2
auucacucgccggguuuu

SEQ ID NO: 3786229 - RNA, 18 nt, Salmonella typhimurium LT2
auucacucugaaaaauuu

SEQ ID NO: 3786230 - RNA, 18 nt, Salmonella typhimurium LT2
auucacuuuccgaaucag

SEQ ID NO: 3786231 - RNA, 19 nt, Salmonella typhimurium LT2
auucacuuuccgaaucagg

SEQ ID NO: 3786232 - RNA, 15 nt, Salmonella typhimurium LT2
auucacuuucuugcc

SEQ ID NO: 3786233 - RNA, 21 nt, Salmonella typhimurium LT2
auucacuuucuugccacuggc

SEQ ID NO: 3786234 - RNA, 17 nt, Salmonella typhimurium LT2
auucagaauaugccagg

SEQ ID NO: 3786235 - RNA, 22 nt, Salmonella typhimurium LT2
auucagaauuuuuaaccgucac

SEQ ID NO: 3786236 - RNA, 23 nt, Salmonella typhimurium LT2
auucagaccccugugauuuaugu

SEQ ID NO: 3786237 - RNA, 20 nt, Salmonella typhimurium LT2
auucagacugcgcauuaaca

SEQ ID NO: 3786238 - RNA, 17 nt, Salmonella typhimurium LT2
auucagagcgucuacgc

SEQ ID NO: 3786239 - RNA, 16 nt, Salmonella typhimurium LT2
auucagcaacucaucu

SEQ ID NO: 3786240 - RNA, 16 nt, Salmonella typhimurium LT2
auucagcaggaggcuu

SEQ ID NO: 3786241 - RNA, 15 nt, Salmonella typhimurium LT2
auucagcaguucauu

SEQ ID NO: 3786242 - RNA, 12 nt, Salmonella typhimurium LT2
auucagccgcag

SEQ ID NO: 3786243 - RNA, 20 nt, Salmonella typhimurium LT2
auucagcgcagugaccagca

SEQ ID NO: 3786244 - RNA, 23 nt, Salmonella typhimurium LT2
auucugaagagguguaguuggcg

SEQ ID NO: 3786245 - RNA, 16 nt, Salmonella typhimurium LT2
auucugaauagccggu

SEQ ID NO: 3786246 - RNA, 21 nt, Salmonella typhimurium LT2
auucugcaacuguugcgccag

SEQ ID NO: 3786247 - RNA, 19 nt, Salmonella typhimurium LT2
auucugcauggcgcuaaac

SEQ ID NO: 3786248 - RNA, 15 nt, Salmonella typhimurium LT2
auucugccaguucac

SEQ ID NO: 3786249 - RNA, 16 nt, Salmonella typhimurium LT2
auucugcgaaagccuc

SEQ ID NO: 3786250 - RNA, 13 nt, Salmonella typhimurium LT2
auucugcgguaau

SEQ ID NO: 3786251 - RNA, 18 nt, Salmonella typhimurium LT2
auucugcuuaccagaccg

SEQ ID NO: 3786252 - RNA, 17 nt, Salmonella typhimurium LT2
auucuggccguuuucaa

SEQ ID NO: 3786253 - RNA, 22 nt, Salmonella typhimurium LT2
auucuguaucgcuuauuuucgu

SEQ ID NO: 3786254 - RNA, 14 nt, Salmonella typhimurium LT2
auucuuaucauuua

SEQ ID NO: 3786255 - RNA, 13 nt, Salmonella typhimurium LT2
auucuuaucugug

SEQ ID NO: 3786256 - RNA, 18 nt, Salmonella typhimurium LT2
auucuucgaaugucucaa

SEQ ID NO: 3786257 - RNA, 19 nt, Salmonella typhimurium LT2
auucuugcgccgcaaacuc

SEQ ID NO: 3786258 - RNA, 19 nt, Salmonella typhimurium LT2
auucuuuaauuugugccag

SEQ ID NO: 3786259 - RNA, 17 nt, Salmonella typhimurium LT2
auucuuuacgcagcaag

SEQ ID NO: 3786260 - RNA, 17 nt, Salmonella typhimurium LT2
auucuuucgucacuaac

SEQ ID NO: 3786261 - RNA, 23 nt, Salmonella typhimurium LT2
auucuuuguuuaaaaauuuuuau

SEQ ID NO: 3786262 - RNA, 16 nt, Salmonella typhimurium LT2
auugaaaaccauaaua

SEQ ID NO: 3786263 - RNA, 15 nt, Salmonella typhimurium LT2
auugaaacgcaucac

SEQ ID NO: 3786264 - RNA, 15 nt, Salmonella typhimurium LT2
auugaacccgaccgu

SEQ ID NO: 3786265 - RNA, 17 nt, Salmonella typhimurium LT2
auugaacggcucaaaau

SEQ ID NO: 3786266 - RNA, 23 nt, Salmonella typhimurium LT2
auugaagcgauauucgguaagcu

SEQ ID NO: 3786267 - RNA, 18 nt, Salmonella typhimurium LT2
auugaagguauccagcca

SEQ ID NO: 3786268 - RNA, 17 nt, Salmonella typhimurium LT2
auugacagaauaaugcc

SEQ ID NO: 3786269 - RNA, 16 nt, Salmonella typhimurium LT2
auugacccucccugcg

SEQ ID NO: 3786270 - RNA, 13 nt, Salmonella typhimurium LT2
auugaccuucaug

SEQ ID NO: 3786271 - RNA, 14 nt, Salmonella typhimurium LT2
auugacgauaucau

SEQ ID NO: 3786272 - RNA, 14 nt, Salmonella typhimurium LT2
auugacuucaacgc

SEQ ID NO: 3786273 - RNA, 12 nt, Salmonella typhimurium LT2
auugagcagcgg

SEQ ID NO: 3786274 - RNA, 15 nt, Salmonella typhimurium LT2
auugagcagcggcug

SEQ ID NO: 3786275 - RNA, 13 nt, Salmonella typhimurium LT2
auugagcagggac

SEQ ID NO: 3786276 - RNA, 20 nt, Salmonella typhimurium LT2
auugagcgcaaaacgcugcu

SEQ ID NO: 3786277 - RNA, 17 nt, Salmonella typhimurium LT2
auugauaaucagcaaga

SEQ ID NO: 3786278 - RNA, 16 nt, Salmonella typhimurium LT2
auugauacaggcgcug

SEQ ID NO: 3786279 - RNA, 22 nt, Salmonella typhimurium LT2
auugauaccuaaacgcgucaga

SEQ ID NO: 3786280 - RNA, 12 nt, Salmonella typhimurium LT2
auugauccacgg

SEQ ID NO: 3786281 - RNA, 21 nt, Salmonella typhimurium LT2
auugaugacgcuuacgaagau

SEQ ID NO: 3786282 - RNA, 13 nt, Salmonella typhimurium LT2
auugcaagaauau

SEQ ID NO: 3786283 - RNA, 20 nt, Salmonella typhimurium LT2
auugcagacgcuccuccaau

SEQ ID NO: 3786284 - RNA, 20 nt, Salmonella typhimurium LT2
auugcagauaauuuugcaua

SEQ ID NO: 3786285 - RNA, 21 nt, Salmonella typhimurium LT2
auugcagcauuacacuauguu

SEQ ID NO: 3786286 - RNA, 17 nt, Salmonella typhimurium LT2
auugcagcgcagcggca

SEQ ID NO: 3786287 - RNA, 18 nt, Salmonella typhimurium LT2
auugcagcgcguggguga

SEQ ID NO: 3786288 - RNA, 14 nt, Salmonella typhimurium LT2
auugcauaggggca

SEQ ID NO: 3786289 - RNA, 15 nt, Salmonella typhimurium LT2
auugcauaggggcaa

SEQ ID NO: 3786290 - RNA, 19 nt, Salmonella typhimurium LT2
auugcauaggggcaauaaa

SEQ ID NO: 3786291 - RNA, 19 nt, Salmonella typhimurium LT2
auugccaugaugagcgcca

SEQ ID NO: 3786292 - RNA, 20 nt, Salmonella typhimurium LT2
auugccaugaugagcgccau

SEQ ID NO: 3786293 - RNA, 18 nt, Salmonella typhimurium LT2
auugccauguuaauacca

SEQ ID NO: 3786294 - RNA, 19 nt, Salmonella typhimurium LT2
auugccauguuaauaccag

SEQ ID NO: 3786295 - RNA, 19 nt, Salmonella typhimurium LT2
auugccgaccauuacccac

SEQ ID NO: 3786296 - RNA, 11 nt, Salmonella typhimurium LT2
auugccgccag

SEQ ID NO: 3786297 - RNA, 19 nt, Salmonella typhimurium LT2
auugccgcuuaaguugccg

SEQ ID NO: 3786298 - RNA, 13 nt, Salmonella typhimurium LT2
auugccgucucaa

SEQ ID NO: 3786299 - RNA, 15 nt, Salmonella typhimurium LT2
auugccugauggcgc

SEQ ID NO: 3786300 - RNA, 19 nt, Salmonella typhimurium LT2
auugccuggcagcuugccu

SEQ ID NO: 3786301 - RNA, 12 nt, Salmonella typhimurium LT2
auugccuuucaa

SEQ ID NO: 3786302 - RNA, 17 nt, Salmonella typhimurium LT2
auugcgaaacggcagcg

SEQ ID NO: 3786303 - RNA, 17 nt, Salmonella typhimurium LT2
auugcgaauaaaacugc

SEQ ID NO: 3786304 - RNA, 18 nt, Salmonella typhimurium LT2
auugcgaauaaaacugcc

SEQ ID NO: 3786305 - RNA, 13 nt, Salmonella typhimurium LT2
auugcgagaaaaa

SEQ ID NO: 3786306 - RNA, 14 nt, Salmonella typhimurium LT2
auugcgaguuaucu

SEQ ID NO: 3786307 - RNA, 13 nt, Salmonella typhimurium LT2
auugcgccaccuu

SEQ ID NO: 3786308 - RNA, 21 nt, Salmonella typhimurium LT2
auugcgccugggauaagcaga

SEQ ID NO: 3786309 - RNA, 21 nt, Salmonella typhimurium LT2
auugcgcgcuauguucaugcu

SEQ ID NO: 3786310 - RNA, 17 nt, Salmonella typhimurium LT2
auugcgucccagcacaa

SEQ ID NO: 3786311 - RNA, 18 nt, Salmonella typhimurium LT2
auugcuccaucaucgcca

SEQ ID NO: 3786312 - RNA, 15 nt, Salmonella typhimurium LT2
auugcugaagauaaa

SEQ ID NO: 3786313 - RNA, 16 nt, Salmonella typhimurium LT2
auugcugaagauaaaa

SEQ ID NO: 3786314 - RNA, 13 nt, Salmonella typhimurium LT2
auugcugacacaa

SEQ ID NO: 3786315 - RNA, 21 nt, Salmonella typhimurium LT2
auugcugcuguauuucacgcc

SEQ ID NO: 3786316 - RNA, 16 nt, Salmonella typhimurium LT2
auugcuguaaaccggu

SEQ ID NO: 3786317 - RNA, 23 nt, Salmonella typhimurium LT2
auugcuguaggcacuuuccagac

SEQ ID NO: 3786318 - RNA, 15 nt, Salmonella typhimurium LT2
auugcuguauuuuau

SEQ ID NO: 3786319 - RNA, 14 nt, Salmonella typhimurium LT2
auugcuguccaggu

SEQ ID NO: 3786320 - RNA, 22 nt, Salmonella typhimurium LT2
auugcuguccgggcguuucagc

SEQ ID NO: 3786321 - RNA, 23 nt, Salmonella typhimurium LT2
auugcuguguuuucagccaggcg

SEQ ID NO: 3786322 - RNA, 15 nt, Salmonella typhimurium LT2
auugcuguuaauuuc

SEQ ID NO: 3786323 - RNA, 14 nt, Salmonella typhimurium LT2
auugcuuuuuucca

SEQ ID NO: 3786324 - RNA, 19 nt, Salmonella typhimurium LT2
auuggaauauccgcugcgg

SEQ ID NO: 3786325 - RNA, 15 nt, Salmonella typhimurium LT2
auuggcaaacugccg

SEQ ID NO: 3786326 - RNA, 17 nt, Salmonella typhimurium LT2
auuggcaagaaucacgc

SEQ ID NO: 3786327 - RNA, 14 nt, Salmonella typhimurium LT2
auuggcauccagca

SEQ ID NO: 3786328 - RNA, 14 nt, Salmonella typhimurium LT2
auuggccagcgugg

SEQ ID NO: 3786329 - RNA, 16 nt, Salmonella typhimurium LT2
auuggcccuucagacg

SEQ ID NO: 3786330 - RNA, 19 nt, Salmonella typhimurium LT2
auuggcgaggaacaucagc

SEQ ID NO: 3786331 - RNA, 18 nt, Salmonella typhimurium LT2
auuggcgcagccuuuuuc

SEQ ID NO: 3786332 - RNA, 20 nt, Salmonella typhimurium LT2
auuggcuuuguaaauacuga

SEQ ID NO: 3786333 - RNA, 15 nt, Salmonella typhimurium LT2
auuggguaauuuuuu

SEQ ID NO: 3786334 - RNA, 19 nt, Salmonella typhimurium LT2
auuggguaguaauauuaaa

SEQ ID NO: 3786335 - RNA, 13 nt, Salmonella typhimurium LT2
auugguaaauccg

SEQ ID NO: 3786336 - RNA, 16 nt, Salmonella typhimurium LT2
auugguagacgcgcua

SEQ ID NO: 3786337 - RNA, 19 nt, Salmonella typhimurium LT2
auugguagacgcgcuagcu

SEQ ID NO: 3786338 - RNA, 18 nt, Salmonella typhimurium LT2
auuggucaauaagugaua

SEQ ID NO: 3786339 - RNA, 14 nt, Salmonella typhimurium LT2
auuggucagcagcc

SEQ ID NO: 3786340 - RNA, 12 nt, Salmonella typhimurium LT2
auuguaaaaccg

SEQ ID NO: 3786341 - RNA, 15 nt, Salmonella typhimurium LT2
auuguaaaaccgacu

SEQ ID NO: 3786342 - RNA, 16 nt, Salmonella typhimurium LT2
auuguaauaauuuaaa

SEQ ID NO: 3786343 - RNA, 17 nt, Salmonella typhimurium LT2
auuguaauaauuuaaaa

SEQ ID NO: 3786344 - RNA, 15 nt, Salmonella typhimurium LT2
auuguacugcgccag

SEQ ID NO: 3786345 - RNA, 19 nt, Salmonella typhimurium LT2
auuguaucauuuuuguuaa

SEQ ID NO: 3786346 - RNA, 17 nt, Salmonella typhimurium LT2
auugucacuauucuuau

SEQ ID NO: 3786347 - RNA, 22 nt, Salmonella typhimurium LT2
auugucauaaugucccugccac

SEQ ID NO: 3786348 - RNA, 12 nt, Salmonella typhimurium LT2
auuguccacccu

SEQ ID NO: 3786349 - RNA, 16 nt, Salmonella typhimurium LT2
auuucuugaucaaucu

SEQ ID NO: 3786350 - RNA, 16 nt, Salmonella typhimurium LT2
auuucuugcaauagcg

SEQ ID NO: 3786351 - RNA, 12 nt, Salmonella typhimurium LT2
auuucuugcauc

SEQ ID NO: 3786352 - RNA, 16 nt, Salmonella typhimurium LT2
auuucuuugucaccaa

SEQ ID NO: 3786353 - RNA, 19 nt, Salmonella typhimurium LT2
auuugaacaaggcuacgaa

SEQ ID NO: 3786354 - RNA, 21 nt, Salmonella typhimurium LT2
auuugaacucuuccagauacg

SEQ ID NO: 3786355 - RNA, 17 nt, Salmonella typhimurium LT2
auuugaaucugcaguuu

SEQ ID NO: 3786356 - RNA, 23 nt, Salmonella typhimurium LT2
auuugauggcuaauauccagcca

SEQ ID NO: 3786357 - RNA, 21 nt, Salmonella typhimurium LT2
auuugcccuguaaauagugcg

SEQ ID NO: 3786358 - RNA, 22 nt, Salmonella typhimurium LT2
auuugcgacaucagccagccgc

SEQ ID NO: 3786359 - RNA, 14 nt, Salmonella typhimurium LT2
auuugcgccgccgu

SEQ ID NO: 3786360 - RNA, 23 nt, Salmonella typhimurium LT2
auuugcggcaauggccgcagcgc

SEQ ID NO: 3786361 - RNA, 17 nt, Salmonella typhimurium LT2
auuugcggcgucgccug

SEQ ID NO: 3786362 - RNA, 22 nt, Salmonella typhimurium LT2
auuugcgggaacauaugcacau

SEQ ID NO: 3786363 - RNA, 13 nt, Salmonella typhimurium LT2
auuugcugcaacg

SEQ ID NO: 3786364 - RNA, 22 nt, Salmonella typhimurium LT2
auuugcugcauuucuuguugac

SEQ ID NO: 3786365 - RNA, 16 nt, Salmonella typhimurium LT2
auuuggcuuaaauaau

SEQ ID NO: 3786366 - RNA, 14 nt, Salmonella typhimurium LT2
auuuguaugacaaa

SEQ ID NO: 3786367 - RNA, 20 nt, Salmonella typhimurium LT2
auuuguaugacaaauaaaau

SEQ ID NO: 3786368 - RNA, 16 nt, Salmonella typhimurium LT2
auuugucccuguucca

SEQ ID NO: 3786369 - RNA, 14 nt, Salmonella typhimurium LT2
auuugucgcgcauu

SEQ ID NO: 3786370 - RNA, 24 nt, Salmonella typhimurium LT2
auuugugagacaaaaaagcugcga

SEQ ID NO: 3786371 - RNA, 17 nt, Salmonella typhimurium LT2
auuugugagcuauacgg

SEQ ID NO: 3786372 - RNA, 22 nt, Salmonella typhimurium LT2
auuugugagcuauacgguaaau

SEQ ID NO: 3786373 - RNA, 13 nt, Salmonella typhimurium LT2
auuuguuaucuac

SEQ ID NO: 3786374 - RNA, 15 nt, Salmonella typhimurium LT2
auuuguuaucuacag

SEQ ID NO: 3786375 - RNA, 15 nt, Salmonella typhimurium LT2
auuuguugguuuaaa

SEQ ID NO: 3786376 - RNA, 14 nt, Salmonella typhimurium LT2
auuuuaaaccaauc

SEQ ID NO: 3786377 - RNA, 20 nt, Salmonella typhimurium LT2
auuuuaaauugguuauauua

SEQ ID NO: 3786378 - RNA, 19 nt, Salmonella typhimurium LT2
auuuuaaccuuauauaugu

SEQ ID NO: 3786379 - RNA, 17 nt, Salmonella typhimurium LT2
auuuuaagcauccagga

SEQ ID NO: 3786380 - RNA, 23 nt, Salmonella typhimurium LT2
auuuuaccuucgcguuuaucacc

SEQ ID NO: 3786381 - RNA, 14 nt, Salmonella typhimurium LT2
auuuuacgagaacc

SEQ ID NO: 3786382 - RNA, 22 nt, Salmonella typhimurium LT2
auuuuacugcguaaucuuuuca

SEQ ID NO: 3786383 - RNA, 15 nt, Salmonella typhimurium LT2
auuuuagcgcaucgc

SEQ ID NO: 3786384 - RNA, 17 nt, Salmonella typhimurium LT2
auuuuagcuucuucaua

SEQ ID NO: 3786385 - RNA, 21 nt, Salmonella typhimurium LT2
auuuuagcuucuucauauugu

SEQ ID NO: 3786386 - RNA, 13 nt, Salmonella typhimurium LT2
auuuuauccagga

SEQ ID NO: 3786387 - RNA, 16 nt, Salmonella typhimurium LT2
auuuuauccggcguca

SEQ ID NO: 3786388 - RNA, 11 nt, Salmonella typhimurium LT2
auuuuauucau

SEQ ID NO: 3786389 - RNA, 18 nt, Salmonella typhimurium LT2
auuuuauuuccaauguaa

SEQ ID NO: 3786390 - RNA, 12 nt, Salmonella typhimurium LT2
auuuuauuuuua

SEQ ID NO: 3786391 - RNA, 20 nt, Salmonella typhimurium LT2
auuuucaaccggguuaagcu

SEQ ID NO: 3786392 - RNA, 19 nt, Salmonella typhimurium LT2
auuuucaacggcaucaaua

SEQ ID NO: 3786393 - RNA, 22 nt, Salmonella typhimurium LT2
auuuucaacggcaucaauaauu

SEQ ID NO: 3786394 - RNA, 12 nt, Salmonella typhimurium LT2
auuuucaccucc

SEQ ID NO: 3786395 - RNA, 21 nt, Salmonella typhimurium LT2
auuuucaccuggaugcugccu

SEQ ID NO: 3786396 - RNA, 20 nt, Salmonella typhimurium LT2
auuuucagcuucagucauaa

SEQ ID NO: 3786397 - RNA, 14 nt, Salmonella typhimurium LT2
auuuucaucauauc

SEQ ID NO: 3786398 - RNA, 21 nt, Salmonella typhimurium LT2
auuuucaucauaucugauaaa

SEQ ID NO: 3786399 - RNA, 19 nt, Salmonella typhimurium LT2
auuuucaugauauucuguc

SEQ ID NO: 3786400 - RNA, 15 nt, Salmonella typhimurium LT2
auuuucauuauaaaa

SEQ ID NO: 3786401 - RNA, 19 nt, Salmonella typhimurium LT2
auuuucccaacuguauuuu

SEQ ID NO: 3786402 - RNA, 16 nt, Salmonella typhimurium LT2
auuuuccccgaugcca

SEQ ID NO: 3786403 - RNA, 19 nt, Salmonella typhimurium LT2
auuuuccccgaugccauuu

SEQ ID NO: 3786404 - RNA, 22 nt, Salmonella typhimurium LT2
auuuuccccgaugccauuugca

SEQ ID NO: 3786405 - RNA, 17 nt, Salmonella typhimurium LT2
auuuucgaugcacgcca

SEQ ID NO: 3786406 - RNA, 18 nt, Salmonella typhimurium LT2
auuuucgucguuucuaca

SEQ ID NO: 3786407 - RNA, 20 nt, Salmonella typhimurium LT2
auuuucucgcgcagccagua

SEQ ID NO: 3786408 - RNA, 15 nt, Salmonella typhimurium LT2
auuuucuuucaucaa

SEQ ID NO: 3786409 - RNA, 17 nt, Salmonella typhimurium LT2
auuuucuuucaucaaac

SEQ ID NO: 3786410 - RNA, 20 nt, Salmonella typhimurium LT2
auuuucuuucaucaaacgga

SEQ ID NO: 3786411 - RNA, 15 nt, Salmonella typhimurium LT2
auuuugaaacugaau

SEQ ID NO: 3786412 - RNA, 23 nt, Salmonella typhimurium LT2
auuuugaaacugaaucaauagcu

SEQ ID NO: 3786413 - RNA, 16 nt, Salmonella typhimurium LT2
auuuugauaaaaacac

SEQ ID NO: 3786414 - RNA, 15 nt, Salmonella typhimurium LT2
auuuugauaaaucag

SEQ ID NO: 3786415 - RNA, 13 nt, Salmonella typhimurium LT2
auuuugccuucaa

SEQ ID NO: 3786416 - RNA, 17 nt, Salmonella typhimurium LT2
auuuugcucccuggugc

SEQ ID NO: 3786417 - RNA, 19 nt, Salmonella typhimurium LT2
auuuuggacggcgucacca

SEQ ID NO: 3786418 - RNA, 20 nt, Salmonella typhimurium LT2
auuuugguuacuauuuuuca

SEQ ID NO: 3786419 - RNA, 21 nt, Salmonella typhimurium LT2
auuuuguaggccuaaaaauag

SEQ ID NO: 3786420 - RNA, 19 nt, Salmonella typhimurium LT2
auuuugucaggccgcgugg

SEQ ID NO: 3786421 - RNA, 23 nt, Salmonella typhimurium LT2
auuuuguggugggccucaauaua

SEQ ID NO: 3786422 - RNA, 17 nt, Salmonella typhimurium LT2
auuuuguugaaauuucu

SEQ ID NO: 3786423 - RNA, 18 nt, Salmonella typhimurium LT2
auuuuguugcuccagcau

SEQ ID NO: 3786424 - RNA, 19 nt, Salmonella typhimurium LT2
auuuuguugcuccagcauc

SEQ ID NO: 3786425 - RNA, 22 nt, Salmonella typhimurium LT2
auuuuguugcuccagcaucaca

SEQ ID NO: 3786426 - RNA, 24 nt, Salmonella typhimurium LT2
auuuuguugcuccagcaucacauc

SEQ ID NO: 3786427 - RNA, 12 nt, Salmonella typhimurium LT2
auuuuuaagcug

SEQ ID NO: 3786428 - RNA, 15 nt, Salmonella typhimurium LT2
auuuuuauaaaauuu

SEQ ID NO: 3786429 - RNA, 17 nt, Salmonella typhimurium LT2
auuuuuauucccgccgc

SEQ ID NO: 3786430 - RNA, 13 nt, Salmonella typhimurium LT2
auuuuuccagcau

SEQ ID NO: 3786431 - RNA, 15 nt, Salmonella typhimurium LT2
auuuuucgaucuucu

SEQ ID NO: 3786432 - RNA, 16 nt, Salmonella typhimurium LT2
auuuuucgaucuucuc

SEQ ID NO: 3786433 - RNA, 17 nt, Salmonella typhimurium LT2
auuuuucgaucuucucc

SEQ ID NO: 3786434 - RNA, 18 nt, Salmonella typhimurium LT2
auuuuucgcccgguucau

SEQ ID NO: 3786435 - RNA, 16 nt, Salmonella typhimurium LT2
auuuuucgguuuucca

SEQ ID NO: 3786436 - RNA, 22 nt, Salmonella typhimurium LT2
auuuuucuauuccgcucagaua

SEQ ID NO: 3786437 - RNA, 14 nt, Salmonella typhimurium LT2
auuuuucugcgcca

SEQ ID NO: 3786438 - RNA, 20 nt, Salmonella typhimurium LT2
auuuuucuggcuucuuaaaa

SEQ ID NO: 3786439 - RNA, 16 nt, Salmonella typhimurium LT2
auuuuugugaacuugu

SEQ ID NO: 3786440 - RNA, 23 nt, Salmonella typhimurium LT2
auuuuuguuaauucuauucuugu

SEQ ID NO: 3786441 - RNA, 13 nt, Salmonella typhimurium LT2
auuuuuuccauuc

SEQ ID NO: 3786442 - RNA, 17 nt, Salmonella typhimurium LT2
auuuuuuguauccacca

SEQ ID NO: 3786443 - RNA, 22 nt, Salmonella typhimurium LT2
auuuuuuuagcauaacguuucc

SEQ ID NO: 3786444 - RNA, 23 nt, Salmonella typhimurium LT2
auuuuuuucucgauaucuucccc

SEQ ID NO: 3786445 - RNA, 12 nt, Salmonella typhimurium LT2
caaaaaaaaccg

SEQ ID NO: 3786446 - RNA, 12 nt, Salmonella typhimurium LT2
caaaaaaagcca

SEQ ID NO: 3786447 - RNA, 19 nt, Salmonella typhimurium LT2
caaaaaaaucccaaccuug

SEQ ID NO: 3786448 - RNA, 18 nt, Salmonella typhimurium LT2
caaaaaacgguauaaaaa

SEQ ID NO: 3786449 - RNA, 16 nt, Salmonella typhimurium LT2
caaaaaagcugcgauc

SEQ ID NO: 3786450 - RNA, 22 nt, Salmonella typhimurium LT2
caaaaaauauagccauuuaaug

SEQ ID NO: 3786451 - RNA, 16 nt, Salmonella typhimurium LT2
caaaaaaugugagcca

SEQ ID NO: 3786452 - RNA, 15 nt, Salmonella typhimurium LT2
caaacucacgggcgu

SEQ ID NO: 3786453 - RNA, 19 nt, Salmonella typhimurium LT2
caaacucaggagcuaaaua

SEQ ID NO: 3786454 - RNA, 19 nt, Salmonella typhimurium LT2
caaacucuuuuucaauaaa

SEQ ID NO: 3786455 - RNA, 17 nt, Salmonella typhimurium LT2
caaacugauaagggccu

SEQ ID NO: 3786456 - RNA, 16 nt, Salmonella typhimurium LT2
caaacugcgcgccgcc

SEQ ID NO: 3786457 - RNA, 20 nt, Salmonella typhimurium LT2
caaacugguucaacaucagc

SEQ ID NO: 3786458 - RNA, 23 nt, Salmonella typhimurium LT2
caaacuguguacgccaagcugca

SEQ ID NO: 3786459 - RNA, 14 nt, Salmonella typhimurium LT2
caaacuucaucgcc

SEQ ID NO: 3786460 - RNA, 14 nt, Salmonella typhimurium LT2
caaacuuuccguug

SEQ ID NO: 3786461 - RNA, 13 nt, Salmonella typhimurium LT2
caaacuuuuaaau

SEQ ID NO: 3786462 - RNA, 12 nt, Salmonella typhimurium LT2
caaagaaaacca

SEQ ID NO: 3786463 - RNA, 23 nt, Salmonella typhimurium LT2
caaagacgguuucagugauaaag

SEQ ID NO: 3786464 - RNA, 18 nt, Salmonella typhimurium LT2
caaagagugccagaaaca

SEQ ID NO: 3786465 - RNA, 13 nt, Salmonella typhimurium LT2
caaagaguuccug

SEQ ID NO: 3786466 - RNA, 14 nt, Salmonella typhimurium LT2
caaagauaaacgac

SEQ ID NO: 3786467 - RNA, 12 nt, Salmonella typhimurium LT2
caaagaugauuu

SEQ ID NO: 3786468 - RNA, 16 nt, Salmonella typhimurium LT2
caaagcagauagagca

SEQ ID NO: 3786469 - RNA, 23 nt, Salmonella typhimurium LT2
caaagcagauagagcauaauaaa

SEQ ID NO: 3786470 - RNA, 17 nt, Salmonella typhimurium LT2
caaagcaucugccggca

SEQ ID NO: 3786471 - RNA, 18 nt, Salmonella typhimurium LT2
caaagcauugugcagcca

SEQ ID NO: 3786472 - RNA, 19 nt, Salmonella typhimurium LT2
caaagcauugugcagccau

SEQ ID NO: 3786473 - RNA, 20 nt, Salmonella typhimurium LT2
caaagcccugacgauacaua

SEQ ID NO: 3786474 - RNA, 19 nt, Salmonella typhimurium LT2
caaagccgccauccggccu

SEQ ID NO: 3786475 - RNA, 13 nt, Salmonella typhimurium LT2
caaagccugcugg

SEQ ID NO: 3786476 - RNA, 21 nt, Salmonella typhimurium LT2
caaagcgccaucgggcauuca

SEQ ID NO: 3786477 - RNA, 16 nt, Salmonella typhimurium LT2
caaagcgguaaaucgc

SEQ ID NO: 3786478 - RNA, 18 nt, Salmonella typhimurium LT2
caaagcgucgcgucagca

SEQ ID NO: 3786479 - RNA, 22 nt, Salmonella typhimurium LT2
caaagcguuauuugcauuuucg

SEQ ID NO: 3786480 - RNA, 21 nt, Salmonella typhimurium LT2
caaagcguucggccugcugca

SEQ ID NO: 3786481 - RNA, 22 nt, Salmonella typhimurium LT2
caaagcguucugaacuguaacc

SEQ ID NO: 3786482 - RNA, 15 nt, Salmonella typhimurium LT2
caaagcucaacgcag

SEQ ID NO: 3786483 - RNA, 16 nt, Salmonella typhimurium LT2
caaaggaucgcaacca

SEQ ID NO: 3786484 - RNA, 19 nt, Salmonella typhimurium LT2
caaaggaucgcaaccacga

SEQ ID NO: 3786485 - RNA, 19 nt, Salmonella typhimurium LT2
caaaggcaaaauggguucu

SEQ ID NO: 3786486 - RNA, 20 nt, Salmonella typhimurium LT2
caaaggcguaaaaaggcgca

SEQ ID NO: 3786487 - RNA, 10 nt, Salmonella typhimurium LT2
caaagggagc

SEQ ID NO: 3786488 - RNA, 14 nt, Salmonella typhimurium LT2
caaagggagcagac

SEQ ID NO: 3786489 - RNA, 18 nt, Salmonella typhimurium LT2
caaagggauaagaaagau

SEQ ID NO: 3786490 - RNA, 18 nt, Salmonella typhimurium LT2
caaaggggccacaggcgg

SEQ ID NO: 3786491 - RNA, 20 nt, Salmonella typhimurium LT2
caaaggggccacaggcggca

SEQ ID NO: 3786492 - RNA, 23 nt, Salmonella typhimurium LT2
caaagggugggggaguguuggau

SEQ ID NO: 3786493 - RNA, 17 nt, Salmonella typhimurium LT2
caaagucaccuuagcga

SEQ ID NO: 3786494 - RNA, 14 nt, Salmonella typhimurium LT2
caaagucgucaaua

SEQ ID NO: 3786495 - RNA, 16 nt, Salmonella typhimurium LT2
caaagucuucaugguc

SEQ ID NO: 3786496 - RNA, 15 nt, Salmonella typhimurium LT2
caaagugauuauaaa

SEQ ID NO: 3786497 - RNA, 20 nt, Salmonella typhimurium LT2
caaagugauuauaaaucaau

SEQ ID NO: 3786498 - RNA, 20 nt, Salmonella typhimurium LT2
caaagugcgcugucagcaca

SEQ ID NO: 3786499 - RNA, 14 nt, Salmonella typhimurium LT2
caaaguuaaucagc

SEQ ID NO: 3786500 - RNA, 18 nt, Salmonella typhimurium LT2
caaaguuaucccugcuga

SEQ ID NO: 3786501 - RNA, 15 nt, Salmonella typhimurium LT2
caaaguugcaucaag

SEQ ID NO: 3786502 - RNA, 16 nt, Salmonella typhimurium LT2
caaaguugcaucaaga

SEQ ID NO: 3786503 - RNA, 18 nt, Salmonella typhimurium LT2
caaauaaaagccgccaug

SEQ ID NO: 3786504 - RNA, 17 nt, Salmonella typhimurium LT2
caaauaaagccagaugc

SEQ ID NO: 3786505 - RNA, 18 nt, Salmonella typhimurium LT2
caaauaaagccagaugcg

SEQ ID NO: 3786506 - RNA, 15 nt, Salmonella typhimurium LT2
caaauacugcuuuuc

SEQ ID NO: 3786507 - RNA, 16 nt, Salmonella typhimurium LT2
caaauaguccagcagc

SEQ ID NO: 3786508 - RNA, 14 nt, Salmonella typhimurium LT2
caaauauuucuuug

SEQ ID NO: 3786509 - RNA, 16 nt, Salmonella typhimurium LT2
caaaucaccacauggc

SEQ ID NO: 3786510 - RNA, 17 nt, Salmonella typhimurium LT2
caaaucaccacauggcc

SEQ ID NO: 3786511 - RNA, 11 nt, Salmonella typhimurium LT2
caaaucacugg

SEQ ID NO: 3786512 - RNA, 15 nt, Salmonella typhimurium LT2
caaaucagacgcuuc

SEQ ID NO: 3786513 - RNA, 12 nt, Salmonella typhimurium LT2
caaaucaucgcc

SEQ ID NO: 3786514 - RNA, 20 nt, Salmonella typhimurium LT2
caaaucaugagcgcaaucaa

SEQ ID NO: 3786515 - RNA, 19 nt, Salmonella typhimurium LT2
caaauccaacucaguuucc

SEQ ID NO: 3786516 - RNA, 17 nt, Salmonella typhimurium LT2
caaaucccgguaaaggu

SEQ ID NO: 3786517 - RNA, 23 nt, Salmonella typhimurium LT2
caaauccuccagcggcauauggc

SEQ ID NO: 3786518 - RNA, 17 nt, Salmonella typhimurium LT2
caaaucgcaggcauuca

SEQ ID NO: 3786519 - RNA, 15 nt, Salmonella typhimurium LT2
caaaucgccaucagc

SEQ ID NO: 3786520 - RNA, 16 nt, Salmonella typhimurium LT2
caaaucgcccaucaca

SEQ ID NO: 3786521 - RNA, 18 nt, Salmonella typhimurium LT2
caaaucgcccaucacaug

SEQ ID NO: 3786522 - RNA, 17 nt, Salmonella typhimurium LT2
caaaucgggaaaaugau

SEQ ID NO: 3786523 - RNA, 16 nt, Salmonella typhimurium LT2
caaaugaugcuuucga

SEQ ID NO: 3786524 - RNA, 14 nt, Salmonella typhimurium LT2
caaaugauuuuuau

SEQ ID NO: 3786525 - RNA, 16 nt, Salmonella typhimurium LT2
caaaugauuuuuauaa

SEQ ID NO: 3786526 - RNA, 14 nt, Salmonella typhimurium LT2
caaaugccauccca

SEQ ID NO: 3786527 - RNA, 19 nt, Salmonella typhimurium LT2
caaauggcagggacaacgc

SEQ ID NO: 3786528 - RNA, 20 nt, Salmonella typhimurium LT2
caaauguuguuugaaaagug

SEQ ID NO: 3786529 - RNA, 17 nt, Salmonella typhimurium LT2
caaauuacgcacacuug

SEQ ID NO: 3786530 - RNA, 19 nt, Salmonella typhimurium LT2
caaauuacgcacacuugcu

SEQ ID NO: 3786531 - RNA, 21 nt, Salmonella typhimurium LT2
caaauuauaaacuacuggcug

SEQ ID NO: 3786532 - RNA, 24 nt, Salmonella typhimurium LT2
caaauuaucuguugauaaaacacu

SEQ ID NO: 3786533 - RNA, 14 nt, Salmonella typhimurium LT2
caaauuauuuuaug

SEQ ID NO: 3786534 - RNA, 17 nt, Salmonella typhimurium LT2
caaauucagaccccugu

SEQ ID NO: 3786535 - RNA, 13 nt, Salmonella typhimurium LT2
caaauugcugaug

SEQ ID NO: 3786536 - RNA, 22 nt, Salmonella typhimurium LT2
caaauuguuggucacgauccgc

SEQ ID NO: 3786537 - RNA, 13 nt, Salmonella typhimurium LT2
caaauuuggcuca

SEQ ID NO: 3786538 - RNA, 15 nt, Salmonella typhimurium LT2
caaauuuucaaccac

SEQ ID NO: 3786539 - RNA, 17 nt, Salmonella typhimurium LT2
caaauuuugauaaaaac

SEQ ID NO: 3786540 - RNA, 12 nt, Salmonella typhimurium LT2
caacaaacauaa

SEQ ID NO: 3786541 - RNA, 14 nt, Salmonella typhimurium LT2
caacaaacauaagc

SEQ ID NO: 3786542 - RNA, 22 nt, Salmonella typhimurium LT2
caacaaauguugauaaggugaa

SEQ ID NO: 3786543 - RNA, 13 nt, Salmonella typhimurium LT2
caacaacaggcca

SEQ ID NO: 3786544 - RNA, 20 nt, Salmonella typhimurium LT2
caacaacaggccagaauaac

SEQ ID NO: 3786545 - RNA, 14 nt, Salmonella typhimurium LT2
caacaacaguugca

SEQ ID NO: 3786546 - RNA, 16 nt, Salmonella typhimurium LT2
caacaauauuccauau

SEQ ID NO: 3786547 - RNA, 17 nt, Salmonella typhimurium LT2
caacaaucgggaacagc

SEQ ID NO: 3786548 - RNA, 15 nt, Salmonella typhimurium LT2
caacaaugccacgcc

SEQ ID NO: 3786549 - RNA, 18 nt, Salmonella typhimurium LT2
caacaaugccacgccccu

SEQ ID NO: 3786550 - RNA, 21 nt, Salmonella typhimurium LT2
caacaaugccacgccccuaag

SEQ ID NO: 3786551 - RNA, 15 nt, Salmonella typhimurium LT2
caacaaugcuuucac

SEQ ID NO: 3786552 - RNA, 21 nt, Salmonella typhimurium LT2
caacaaugcuuucaccaguga

SEQ ID NO: 3786553 - RNA, 17 nt, Salmonella typhimurium LT2
caacacaaucaggcgca

SEQ ID NO: 3786554 - RNA, 23 nt, Salmonella typhimurium LT2
caacacaucagcaacuugaagua

SEQ ID NO: 3786555 - RNA, 14 nt, Salmonella typhimurium LT2
caacacauccagcg

SEQ ID NO: 3786556 - RNA, 14 nt, Salmonella typhimurium LT2
caacgcgccgccaa

SEQ ID NO: 3786557 - RNA, 18 nt, Salmonella typhimurium LT2
caacgcgugauccacagc

SEQ ID NO: 3786558 - RNA, 19 nt, Salmonella typhimurium LT2
caacgcguucauccagcgc

SEQ ID NO: 3786559 - RNA, 15 nt, Salmonella typhimurium LT2
caacgcucagaccga

SEQ ID NO: 3786560 - RNA, 23 nt, Salmonella typhimurium LT2
caacgcugagucagaaacggcca

SEQ ID NO: 3786561 - RNA, 19 nt, Salmonella typhimurium LT2
caacgcuuuagugccgcca

SEQ ID NO: 3786562 - RNA, 20 nt, Salmonella typhimurium LT2
caacgcuuuagugccgccau

SEQ ID NO: 3786563 - RNA, 13 nt, Salmonella typhimurium LT2
caacggcggauga

SEQ ID NO: 3786564 - RNA, 15 nt, Salmonella typhimurium LT2
caacggcuugugagc

SEQ ID NO: 3786565 - RNA, 17 nt, Salmonella typhimurium LT2
caacgggacggcggcca

SEQ ID NO: 3786566 - RNA, 16 nt, Salmonella typhimurium LT2
caacgggcaaugccac

SEQ ID NO: 3786567 - RNA, 17 nt, Salmonella typhimurium LT2
caacgggcaguccggcg

SEQ ID NO: 3786568 - RNA, 20 nt, Salmonella typhimurium LT2
caacgggcaguccggcggca

SEQ ID NO: 3786569 - RNA, 23 nt, Salmonella typhimurium LT2
caacgguacgacgccguuuccgg

SEQ ID NO: 3786570 - RNA, 18 nt, Salmonella typhimurium LT2
caacggucggucuuuuug

SEQ ID NO: 3786571 - RNA, 14 nt, Salmonella typhimurium LT2
caacguaaugauca

SEQ ID NO: 3786572 - RNA, 19 nt, Salmonella typhimurium LT2
caacguauaaaauggcaaa

SEQ ID NO: 3786573 - RNA, 23 nt, Salmonella typhimurium LT2
caacgucaguucgccacggucgg

SEQ ID NO: 3786574 - RNA, 12 nt, Salmonella typhimurium LT2
caacgucauccc

SEQ ID NO: 3786575 - RNA, 17 nt, Salmonella typhimurium LT2
caacguccaccagcggu

SEQ ID NO: 3786576 - RNA, 15 nt, Salmonella typhimurium LT2
caacguccgcagccg

SEQ ID NO: 3786577 - RNA, 20 nt, Salmonella typhimurium LT2
caacgucgugccagugaugc

SEQ ID NO: 3786578 - RNA, 16 nt, Salmonella typhimurium LT2
caacgugccagaaaca

SEQ ID NO: 3786579 - RNA, 16 nt, Salmonella typhimurium LT2
caacguuacgccagcg

SEQ ID NO: 3786580 - RNA, 19 nt, Salmonella typhimurium LT2
caacguuucuuucaucaga

SEQ ID NO: 3786581 - RNA, 17 nt, Salmonella typhimurium LT2
caacguuuguaacagca

SEQ ID NO: 3786582 - RNA, 21 nt, Salmonella typhimurium LT2
caacguuuguaacagcaggac

SEQ ID NO: 3786583 - RNA, 19 nt, Salmonella typhimurium LT2
caacucacacuaacgugaa

SEQ ID NO: 3786584 - RNA, 15 nt, Salmonella typhimurium LT2
caacucaguuuccag

SEQ ID NO: 3786585 - RNA, 11 nt, Salmonella typhimurium LT2
caacuccagca

SEQ ID NO: 3786586 - RNA, 21 nt, Salmonella typhimurium LT2
caacuccccgccccagcagca

SEQ ID NO: 3786587 - RNA, 23 nt, Salmonella typhimurium LT2
caacuccgccggcgcggaaggga

SEQ ID NO: 3786588 - RNA, 21 nt, Salmonella typhimurium LT2
caacucuccuuucggccaugg

SEQ ID NO: 3786589 - RNA, 15 nt, Salmonella typhimurium LT2
caacucuucaacggu

SEQ ID NO: 3786590 - RNA, 18 nt, Salmonella typhimurium LT2
caacugauuaaucugccg

SEQ ID NO: 3786591 - RNA, 17 nt, Salmonella typhimurium LT2
caacugauucaaaaggu

SEQ ID NO: 3786592 - RNA, 16 nt, Salmonella typhimurium LT2
caacugcgccugaaga

SEQ ID NO: 3786593 - RNA, 18 nt, Salmonella typhimurium LT2
caacugcgggaaguagca

SEQ ID NO: 3786594 - RNA, 14 nt, Salmonella typhimurium LT2
caacugcucuacca

SEQ ID NO: 3786595 - RNA, 15 nt, Salmonella typhimurium LT2
caacugggcuugcau

SEQ ID NO: 3786596 - RNA, 18 nt, Salmonella typhimurium LT2
caacugggugugaucgcc

SEQ ID NO: 3786597 - RNA, 17 nt, Salmonella typhimurium LT2
caacuguacgccacggc

SEQ ID NO: 3786598 - RNA, 22 nt, Salmonella typhimurium LT2
caacuguucuucgcuuucgaca

SEQ ID NO: 3786599 - RNA, 16 nt, Salmonella typhimurium LT2
caacuucguucaguuc

SEQ ID NO: 3786600 - RNA, 21 nt, Salmonella typhimurium LT2
caacuucuaauuuuuccagca

SEQ ID NO: 3786601 - RNA, 16 nt, Salmonella typhimurium LT2
caacuuuuucuuaagc

SEQ ID NO: 3786602 - RNA, 20 nt, Salmonella typhimurium LT2
caacuuuuucuuaagcugag

SEQ ID NO: 3786603 - RNA, 18 nt, Salmonella typhimurium LT2
caagaacagagcaauuac

SEQ ID NO: 3786604 - RNA, 23 nt, Salmonella typhimurium LT2
caagaaccgcuuuuccugcugcc

SEQ ID NO: 3786605 - RNA, 19 nt, Salmonella typhimurium LT2
caagaagauuucuuaauuc

SEQ ID NO: 3786606 - RNA, 16 nt, Salmonella typhimurium LT2
caagaauaugagauug

SEQ ID NO: 3786607 - RNA, 15 nt, Salmonella typhimurium LT2
caagaaucacgccga

SEQ ID NO: 3786608 - RNA, 16 nt, Salmonella typhimurium LT2
caagaauuuaucgcaa

SEQ ID NO: 3786609 - RNA, 22 nt, Salmonella typhimurium LT2
caagacacgcuuccagaugaag

SEQ ID NO: 3786610 - RNA, 16 nt, Salmonella typhimurium LT2
caagacagguguuaau

SEQ ID NO: 3786611 - RNA, 15 nt, Salmonella typhimurium LT2
caagacccgacagua

SEQ ID NO: 3786612 - RNA, 21 nt, Salmonella typhimurium LT2
caagaccgauagagacugccg

SEQ ID NO: 3786613 - RNA, 22 nt, Salmonella typhimurium LT2
caagaccgauagagacugccgc

SEQ ID NO: 3786614 - RNA, 19 nt, Salmonella typhimurium LT2
caagagcagcaacccugcc

SEQ ID NO: 3786615 - RNA, 17 nt, Salmonella typhimurium LT2
caagagcguccaguccu

SEQ ID NO: 3786616 - RNA, 20 nt, Salmonella typhimurium LT2
caagaucacauacaaagaga

SEQ ID NO: 3786617 - RNA, 23 nt, Salmonella typhimurium LT2
caagaucauccggguuaaaccag

SEQ ID NO: 3786618 - RNA, 17 nt, Salmonella typhimurium LT2
caagauccaacacggcg

SEQ ID NO: 3786619 - RNA, 16 nt, Salmonella typhimurium LT2
caagauccguccaugu

SEQ ID NO: 3786620 - RNA, 17 nt, Salmonella typhimurium LT2
caagaucgguugaacca

SEQ ID NO: 3786621 - RNA, 20 nt, Salmonella typhimurium LT2
caagaucgguugaaccaucu

SEQ ID NO: 3786622 - RNA, 24 nt, Salmonella typhimurium LT2
caagauuacucccuugccagcgca

SEQ ID NO: 3786623 - RNA, 14 nt, Salmonella typhimurium LT2
caagauuugcaaua

SEQ ID NO: 3786624 - RNA, 15 nt, Salmonella typhimurium LT2
caagauuugcaauau

SEQ ID NO: 3786625 - RNA, 13 nt, Salmonella typhimurium LT2
caagcaauaccag

SEQ ID NO: 3786626 - RNA, 22 nt, Salmonella typhimurium LT2
caagcacaaaaaguaguuccag

SEQ ID NO: 3786627 - RNA, 15 nt, Salmonella typhimurium LT2
caagcacauagcuga

SEQ ID NO: 3786628 - RNA, 14 nt, Salmonella typhimurium LT2
caagcaguaugccc

SEQ ID NO: 3786629 - RNA, 22 nt, Salmonella typhimurium LT2
caagcaguaugcccccuccagc

SEQ ID NO: 3786630 - RNA, 18 nt, Salmonella typhimurium LT2
caagccagguugcgcccg

SEQ ID NO: 3786631 - RNA, 11 nt, Salmonella typhimurium LT2
caagcccagcu

SEQ ID NO: 3786632 - RNA, 14 nt, Salmonella typhimurium LT2
caagcccagcucag

SEQ ID NO: 3786633 - RNA, 21 nt, Salmonella typhimurium LT2
caagccccccgcacagcacau

SEQ ID NO: 3786634 - RNA, 17 nt, Salmonella typhimurium LT2
caagccgcaacgccucu

SEQ ID NO: 3786635 - RNA, 12 nt, Salmonella typhimurium LT2
caagccugcaug

SEQ ID NO: 3786636 - RNA, 14 nt, Salmonella typhimurium LT2
caagcgaagcgccc

SEQ ID NO: 3786637 - RNA, 18 nt, Salmonella typhimurium LT2
caagcgccucgcugacgc

SEQ ID NO: 3786638 - RNA, 21 nt, Salmonella typhimurium LT2
caagcgccucgcugacgccag

SEQ ID NO: 3786639 - RNA, 18 nt, Salmonella typhimurium LT2
caagcgccuguucaacau

SEQ ID NO: 3786640 - RNA, 16 nt, Salmonella typhimurium LT2
caagcgcgccauaaca

SEQ ID NO: 3786641 - RNA, 20 nt, Salmonella typhimurium LT2
caagcgcgccauaacaucac

SEQ ID NO: 3786642 - RNA, 17 nt, Salmonella typhimurium LT2
caagcgcggcagcagcu

SEQ ID NO: 3786643 - RNA, 16 nt, Salmonella typhimurium LT2
caagcgcuaagcaaca

SEQ ID NO: 3786644 - RNA, 15 nt, Salmonella typhimurium LT2
caagcgcuucguuga

SEQ ID NO: 3786645 - RNA, 18 nt, Salmonella typhimurium LT2
caagcggcaucucgccaa

SEQ ID NO: 3786646 - RNA, 13 nt, Salmonella typhimurium LT2
caagcggcggcca

SEQ ID NO: 3786647 - RNA, 19 nt, Salmonella typhimurium LT2
caagcgggaauauccugcc

SEQ ID NO: 3786648 - RNA, 20 nt, Salmonella typhimurium LT2
caagcgguuugaaaauggcg

SEQ ID NO: 3786649 - RNA, 14 nt, Salmonella typhimurium LT2
caagcguugaauuc

SEQ ID NO: 3786650 - RNA, 22 nt, Salmonella typhimurium LT2
caagcuaauccccagcgcucca

SEQ ID NO: 3786651 - RNA, 13 nt, Salmonella typhimurium LT2
caagcucauuucc

SEQ ID NO: 3786652 - RNA, 15 nt, Salmonella typhimurium LT2
caagcugauuuuucg

SEQ ID NO: 3786653 - RNA, 18 nt, Salmonella typhimurium LT2
caagcugcaucccgguca

SEQ ID NO: 3786654 - RNA, 14 nt, Salmonella typhimurium LT2
caagcugcuuuuug

SEQ ID NO: 3786655 - RNA, 18 nt, Salmonella typhimurium LT2
caagcugguuaaugaccu

SEQ ID NO: 3786656 - RNA, 16 nt, Salmonella typhimurium LT2
caaggaaaaccaguaa

SEQ ID NO: 3786657 - RNA, 15 nt, Salmonella typhimurium LT2
caaggagacgcccgu

SEQ ID NO: 3786658 - RNA, 22 nt, Salmonella typhimurium LT2
caaggcauuggacgggaucucg

SEQ ID NO: 3786659 - RNA, 15 nt, Salmonella typhimurium LT2
caaggcgcagaacca

SEQ ID NO: 3786660 - RNA, 23 nt, Salmonella typhimurium LT2
caaucaacaccagcagcgcggcg

SEQ ID NO: 3786661 - RNA, 16 nt, Salmonella typhimurium LT2
caaucacacccagcgc

SEQ ID NO: 3786662 - RNA, 14 nt, Salmonella typhimurium LT2
caaucaccccaggu

SEQ ID NO: 3786663 - RNA, 18 nt, Salmonella typhimurium LT2
caaucacuuauguacaac

SEQ ID NO: 3786664 - RNA, 12 nt, Salmonella typhimurium LT2
caaucagcagcc

SEQ ID NO: 3786665 - RNA, 19 nt, Salmonella typhimurium LT2
caaucagccccagcaccag

SEQ ID NO: 3786666 - RNA, 20 nt, Salmonella typhimurium LT2
caaucagccccagcaccaga

SEQ ID NO: 3786667 - RNA, 22 nt, Salmonella typhimurium LT2
caaucaggaaagagccgcgcag

SEQ ID NO: 3786668 - RNA, 20 nt, Salmonella typhimurium LT2
caaucaguacgcgcgcggcg

SEQ ID NO: 3786669 - RNA, 13 nt, Salmonella typhimurium LT2
caaucaguucacg

SEQ ID NO: 3786670 - RNA, 18 nt, Salmonella typhimurium LT2
caaucauaaacgccugac

SEQ ID NO: 3786671 - RNA, 21 nt, Salmonella typhimurium LT2
caaucauaaacgccugacgau

SEQ ID NO: 3786672 - RNA, 12 nt, Salmonella typhimurium LT2
caaucaucacca

SEQ ID NO: 3786673 - RNA, 14 nt, Salmonella typhimurium LT2
caaucaucagaaga

SEQ ID NO: 3786674 - RNA, 16 nt, Salmonella typhimurium LT2
caaucauucuuauucg

SEQ ID NO: 3786675 - RNA, 13 nt, Salmonella typhimurium LT2
caauccaggugga

SEQ ID NO: 3786676 - RNA, 15 nt, Salmonella typhimurium LT2
caauccauuaaugcc

SEQ ID NO: 3786677 - RNA, 14 nt, Salmonella typhimurium LT2
caaucccgcgcugc

SEQ ID NO: 3786678 - RNA, 23 nt, Salmonella typhimurium LT2
caauccgccacgcucgcuggugc

SEQ ID NO: 3786679 - RNA, 15 nt, Salmonella typhimurium LT2
caauccguuccaauc

SEQ ID NO: 3786680 - RNA, 23 nt, Salmonella typhimurium LT2
caauccugucgucaccagcaggu

SEQ ID NO: 3786681 - RNA, 14 nt, Salmonella typhimurium LT2
caaucgagaagcca

SEQ ID NO: 3786682 - RNA, 17 nt, Salmonella typhimurium LT2
caaucgcaaauugcugu

SEQ ID NO: 3786683 - RNA, 20 nt, Salmonella typhimurium LT2
caaucgcauaaccggcgcca

SEQ ID NO: 3786684 - RNA, 19 nt, Salmonella typhimurium LT2
caaucgccaaauccggcuu

SEQ ID NO: 3786685 - RNA, 14 nt, Salmonella typhimurium LT2
caaucgccagcccc

SEQ ID NO: 3786686 - RNA, 19 nt, Salmonella typhimurium LT2
caaucgcgugcaacaguug

SEQ ID NO: 3786687 - RNA, 18 nt, Salmonella typhimurium LT2
caaucgcuaucugacagc

SEQ ID NO: 3786688 - RNA, 19 nt, Salmonella typhimurium LT2
caaucgcuaucugacagcc

SEQ ID NO: 3786689 - RNA, 17 nt, Salmonella typhimurium LT2
caaucgcugccuugagu

SEQ ID NO: 3786690 - RNA, 19 nt, Salmonella typhimurium LT2
caaucgcuuccagcgccgg

SEQ ID NO: 3786691 - RNA, 17 nt, Salmonella typhimurium LT2
caaucgcuuuuaucugg

SEQ ID NO: 3786692 - RNA, 23 nt, Salmonella typhimurium LT2
caaucggcgauaaaccaacagcc

SEQ ID NO: 3786693 - RNA, 17 nt, Salmonella typhimurium LT2
caaucgggccugcuccg

SEQ ID NO: 3786694 - RNA, 21 nt, Salmonella typhimurium LT2
caaucgucacuucaauuugcc

SEQ ID NO: 3786695 - RNA, 19 nt, Salmonella typhimurium LT2
caaucguuaauucauggcc

SEQ ID NO: 3786696 - RNA, 14 nt, Salmonella typhimurium LT2
caaucucaccggcu

SEQ ID NO: 3786697 - RNA, 15 nt, Salmonella typhimurium LT2
caaucucacugccca

SEQ ID NO: 3786698 - RNA, 12 nt, Salmonella typhimurium LT2
caaucuccuccg

SEQ ID NO: 3786699 - RNA, 22 nt, Salmonella typhimurium LT2
caaucuccuccggcuucagcaa

SEQ ID NO: 3786700 - RNA, 22 nt, Salmonella typhimurium LT2
caaucucgcaagauuccagaua

SEQ ID NO: 3786701 - RNA, 13 nt, Salmonella typhimurium LT2
caaucucgccaau

SEQ ID NO: 3786702 - RNA, 13 nt, Salmonella typhimurium LT2
caaucucuauacc

SEQ ID NO: 3786703 - RNA, 15 nt, Salmonella typhimurium LT2
caaucucuuccgccc

SEQ ID NO: 3786704 - RNA, 22 nt, Salmonella typhimurium LT2
caaucuggccguuugcugcucu

SEQ ID NO: 3786705 - RNA, 22 nt, Salmonella typhimurium LT2
caaucugguggcguuccuuauc

SEQ ID NO: 3786706 - RNA, 21 nt, Salmonella typhimurium LT2
caaucuuuagcaccuuacgaa

SEQ ID NO: 3786707 - RNA, 18 nt, Salmonella typhimurium LT2
caaugaaaccgccggaug

SEQ ID NO: 3786708 - RNA, 13 nt, Salmonella typhimurium LT2
caaugaacaguuu

SEQ ID NO: 3786709 - RNA, 18 nt, Salmonella typhimurium LT2
caaugaagcauaaaaaga

SEQ ID NO: 3786710 - RNA, 17 nt, Salmonella typhimurium LT2
caaugaccgcaauuaaa

SEQ ID NO: 3786711 - RNA, 19 nt, Salmonella typhimurium LT2
caaugaccgcaauuaaaug

SEQ ID NO: 3786712 - RNA, 20 nt, Salmonella typhimurium LT2
caaugagauccacugagcgc

SEQ ID NO: 3786713 - RNA, 17 nt, Salmonella typhimurium LT2
caaugauaacggcgcca

SEQ ID NO: 3786714 - RNA, 21 nt, Salmonella typhimurium LT2
caaugauaucggccggaugcc

SEQ ID NO: 3786715 - RNA, 13 nt, Salmonella typhimurium LT2
caaugaucagacg

SEQ ID NO: 3786716 - RNA, 17 nt, Salmonella typhimurium LT2
caaugaugccuugcgaa

SEQ ID NO: 3786717 - RNA, 15 nt, Salmonella typhimurium LT2
caaugauuuuuagcc

SEQ ID NO: 3786718 - RNA, 13 nt, Salmonella typhimurium LT2
caaugcaaagaaa

SEQ ID NO: 3786719 - RNA, 20 nt, Salmonella typhimurium LT2
caaugcacugcgaaaagagg

SEQ ID NO: 3786720 - RNA, 23 nt, Salmonella typhimurium LT2
caaugccacgccccuaaggcagc

SEQ ID NO: 3786721 - RNA, 15 nt, Salmonella typhimurium LT2
caaugccauuuuugc

SEQ ID NO: 3786722 - RNA, 22 nt, Salmonella typhimurium LT2
caaugcccgguuuuuuaaugag

SEQ ID NO: 3786723 - RNA, 21 nt, Salmonella typhimurium LT2
caaugccgcgagaaauaccaa

SEQ ID NO: 3786724 - RNA, 16 nt, Salmonella typhimurium LT2
caaugccuaacccuuu

SEQ ID NO: 3786725 - RNA, 19 nt, Salmonella typhimurium LT2
caaugccuaacccuuuucc

SEQ ID NO: 3786726 - RNA, 17 nt, Salmonella typhimurium LT2
caaugccugacgccacc

SEQ ID NO: 3786727 - RNA, 15 nt, Salmonella typhimurium LT2
caaugcgaauaacau

SEQ ID NO: 3786728 - RNA, 20 nt, Salmonella typhimurium LT2
caaugcgcccggagcgguga

SEQ ID NO: 3786729 - RNA, 14 nt, Salmonella typhimurium LT2
caaugcgcuuuuuu

SEQ ID NO: 3786730 - RNA, 21 nt, Salmonella typhimurium LT2
caaugcgcuuuuuuugcccuu

SEQ ID NO: 3786731 - RNA, 14 nt, Salmonella typhimurium LT2
caaugcuggcaggc

SEQ ID NO: 3786732 - RNA, 20 nt, Salmonella typhimurium LT2
caaugcuggcaggcgcgacc

SEQ ID NO: 3786733 - RNA, 15 nt, Salmonella typhimurium LT2
caaugcuuucaccag

SEQ ID NO: 3786734 - RNA, 21 nt, Salmonella typhimurium LT2
caauggccccuggcugaaagc

SEQ ID NO: 3786735 - RNA, 19 nt, Salmonella typhimurium LT2
caauggcgacgaucagcgc

SEQ ID NO: 3786736 - RNA, 22 nt, Salmonella typhimurium LT2
caauggcgucgugcagcgccgc

SEQ ID NO: 3786737 - RNA, 21 nt, Salmonella typhimurium LT2
caauggcuuaguaggcuggcg

SEQ ID NO: 3786738 - RNA, 11 nt, Salmonella typhimurium LT2
caaugggaagg

SEQ ID NO: 3786739 - RNA, 17 nt, Salmonella typhimurium LT2
caaugguugccuggugu

SEQ ID NO: 3786740 - RNA, 14 nt, Salmonella typhimurium LT2
caauguaaauuaau

SEQ ID NO: 3786741 - RNA, 17 nt, Salmonella typhimurium LT2
caauguacguaaaacca

SEQ ID NO: 3786742 - RNA, 18 nt, Salmonella typhimurium LT2
caauguacguaaaaccag

SEQ ID NO: 3786743 - RNA, 21 nt, Salmonella typhimurium LT2
caaugucauacuuaccuggcg

SEQ ID NO: 3786744 - RNA, 14 nt, Salmonella typhimurium LT2
caaugucauauuug

SEQ ID NO: 3786745 - RNA, 16 nt, Salmonella typhimurium LT2
caaugucaucaagauu

SEQ ID NO: 3786746 - RNA, 16 nt, Salmonella typhimurium LT2
caaugucguuaucgcc

SEQ ID NO: 3786747 - RNA, 17 nt, Salmonella typhimurium LT2
caaugucuuuauccgcc

SEQ ID NO: 3786748 - RNA, 20 nt, Salmonella typhimurium LT2
caaugucuuuauccgccagc

SEQ ID NO: 3786749 - RNA, 18 nt, Salmonella typhimurium LT2
caauguucauacaccgca

SEQ ID NO: 3786750 - RNA, 14 nt, Salmonella typhimurium LT2
caauguucaugcgc

SEQ ID NO: 3786751 - RNA, 21 nt, Salmonella typhimurium LT2
caauguugaaucccacgccgc

SEQ ID NO: 3786752 - RNA, 23 nt, Salmonella typhimurium LT2
caauguugaaucccacgccgcug

SEQ ID NO: 3786753 - RNA, 21 nt, Salmonella typhimurium LT2
caauguuuuaccggcagcucu

SEQ ID NO: 3786754 - RNA, 17 nt, Salmonella typhimurium LT2
caauuaaaugaaugagu

SEQ ID NO: 3786755 - RNA, 17 nt, Salmonella typhimurium LT2
caauuacccucgcgcuc

SEQ ID NO: 3786756 - RNA, 17 nt, Salmonella typhimurium LT2
caauuacggacagaaaa

SEQ ID NO: 3786757 - RNA, 18 nt, Salmonella typhimurium LT2
caauuacggacagaaaaa

SEQ ID NO: 3786758 - RNA, 22 nt, Salmonella typhimurium LT2
caauuacguuggggauaaccag

SEQ ID NO: 3786759 - RNA, 19 nt, Salmonella typhimurium LT2
caauuauauucguccuuua

SEQ ID NO: 3786760 - RNA, 23 nt, Salmonella typhimurium LT2
caauuauguauuucucgccgccg

SEQ ID NO: 3786761 - RNA, 15 nt, Salmonella typhimurium LT2
caauuccacaggcgc

SEQ ID NO: 3786762 - RNA, 19 nt, Salmonella typhimurium LT2
caauuccggcccaggccau

SEQ ID NO: 3786763 - RNA, 22 nt, Salmonella typhimurium LT2
cacagcuugccguagcgcgcuu

SEQ ID NO: 3786764 - RNA, 13 nt, Salmonella typhimurium LT2
cacaggaaccggu

SEQ ID NO: 3786765 - RNA, 16 nt, Salmonella typhimurium LT2
cacaggcugcggcacg

SEQ ID NO: 3786766 - RNA, 22 nt, Salmonella typhimurium LT2
cacaggcuucgacaaacagcug

SEQ ID NO: 3786767 - RNA, 20 nt, Salmonella typhimurium LT2
cacagguaaaauugccgcca

SEQ ID NO: 3786768 - RNA, 13 nt, Salmonella typhimurium LT2
cacagguaagccu

SEQ ID NO: 3786769 - RNA, 19 nt, Salmonella typhimurium LT2
cacagguaagccuggcaua

SEQ ID NO: 3786770 - RNA, 14 nt, Salmonella typhimurium LT2
cacagguacaggcc

SEQ ID NO: 3786771 - RNA, 18 nt, Salmonella typhimurium LT2
cacagguuuuaguccggu

SEQ ID NO: 3786772 - RNA, 12 nt, Salmonella typhimurium LT2
cacaguacgccc

SEQ ID NO: 3786773 - RNA, 20 nt, Salmonella typhimurium LT2
cacaguagcucauagcccag

SEQ ID NO: 3786774 - RNA, 17 nt, Salmonella typhimurium LT2
cacaguauucaccugga

SEQ ID NO: 3786775 - RNA, 18 nt, Salmonella typhimurium LT2
cacaguauucaccuggaa

SEQ ID NO: 3786776 - RNA, 17 nt, Salmonella typhimurium LT2
cacauacagcacuuccc

SEQ ID NO: 3786777 - RNA, 20 nt, Salmonella typhimurium LT2
cacauaccgcauucacucgc

SEQ ID NO: 3786778 - RNA, 21 nt, Salmonella typhimurium LT2
cacauauaacaaacgccgcuc

SEQ ID NO: 3786779 - RNA, 23 nt, Salmonella typhimurium LT2
cacauaucgcaguugauacauuu

SEQ ID NO: 3786780 - RNA, 14 nt, Salmonella typhimurium LT2
cacauauugcgcuu

SEQ ID NO: 3786781 - RNA, 12 nt, Salmonella typhimurium LT2
cacaucaauaaa

SEQ ID NO: 3786782 - RNA, 15 nt, Salmonella typhimurium LT2
cacaucaccuccagc

SEQ ID NO: 3786783 - RNA, 13 nt, Salmonella typhimurium LT2
cacaucagaccgc

SEQ ID NO: 3786784 - RNA, 18 nt, Salmonella typhimurium LT2
cacaucagcaacuugaag

SEQ ID NO: 3786785 - RNA, 20 nt, Salmonella typhimurium LT2
cacaucagccaacuuuuucu

SEQ ID NO: 3786786 - RNA, 12 nt, Salmonella typhimurium LT2
cacaucaugaug

SEQ ID NO: 3786787 - RNA, 23 nt, Salmonella typhimurium LT2
cacaucaugaugaucuucagccc

SEQ ID NO: 3786788 - RNA, 13 nt, Salmonella typhimurium LT2
cacauccaaccgc

SEQ ID NO: 3786789 - RNA, 14 nt, Salmonella typhimurium LT2
cacauccagcguca

SEQ ID NO: 3786790 - RNA, 13 nt, Salmonella typhimurium LT2
cacauccauguac

SEQ ID NO: 3786791 - RNA, 17 nt, Salmonella typhimurium LT2
cacauccgccagcgccu

SEQ ID NO: 3786792 - RNA, 22 nt, Salmonella typhimurium LT2
cacauccggcguguaaaccgcc

SEQ ID NO: 3786793 - RNA, 18 nt, Salmonella typhimurium LT2
cacauccggcugaaaaau

SEQ ID NO: 3786794 - RNA, 20 nt, Salmonella typhimurium LT2
cacaucgccauuaaaagcca

SEQ ID NO: 3786795 - RNA, 17 nt, Salmonella typhimurium LT2
cacaucgcccugauggc

SEQ ID NO: 3786796 - RNA, 22 nt, Salmonella typhimurium LT2
cacaucgcgacgggaugcgaug

SEQ ID NO: 3786797 - RNA, 15 nt, Salmonella typhimurium LT2
cacaucgcgcagcag

SEQ ID NO: 3786798 - RNA, 13 nt, Salmonella typhimurium LT2
cacaucggcagga

SEQ ID NO: 3786799 - RNA, 20 nt, Salmonella typhimurium LT2
cacaucuguuugagaaaaac

SEQ ID NO: 3786800 - RNA, 15 nt, Salmonella typhimurium LT2
cacaugaccagcgcc

SEQ ID NO: 3786801 - RNA, 19 nt, Salmonella typhimurium LT2
cacaugcaagucgaacggu

SEQ ID NO: 3786802 - RNA, 22 nt, Salmonella typhimurium LT2
cacauucagagcgucuacgcca

SEQ ID NO: 3786803 - RNA, 18 nt, Salmonella typhimurium LT2
cacauucaggcgguaaua

SEQ ID NO: 3786804 - RNA, 22 nt, Salmonella typhimurium LT2
cacauucaggcuggcaaagcag

SEQ ID NO: 3786805 - RNA, 16 nt, Salmonella typhimurium LT2
cacauucauaaaagau

SEQ ID NO: 3786806 - RNA, 19 nt, Salmonella typhimurium LT2
cacauucauugccgccagu

SEQ ID NO: 3786807 - RNA, 17 nt, Salmonella typhimurium LT2
cacauucucuucuuuaa

SEQ ID NO: 3786808 - RNA, 17 nt, Salmonella typhimurium LT2
cacauucugaccgcguu

SEQ ID NO: 3786809 - RNA, 22 nt, Salmonella typhimurium LT2
cacauucugaccgcguuuccac

SEQ ID NO: 3786810 - RNA, 18 nt, Salmonella typhimurium LT2
cacauugcaaugcaguuc

SEQ ID NO: 3786811 - RNA, 16 nt, Salmonella typhimurium LT2
cacauugcgguucauu

SEQ ID NO: 3786812 - RNA, 19 nt, Salmonella typhimurium LT2
cacauugcugccuuauccg

SEQ ID NO: 3786813 - RNA, 19 nt, Salmonella typhimurium LT2
cacauuggguaauuuuuug

SEQ ID NO: 3786814 - RNA, 14 nt, Salmonella typhimurium LT2
cacauuuuauccgg

SEQ ID NO: 3786815 - RNA, 10 nt, Salmonella typhimurium LT2
caccaaaaac

SEQ ID NO: 3786816 - RNA, 18 nt, Salmonella typhimurium LT2
caccaaaaacgcccccag

SEQ ID NO: 3786817 - RNA, 23 nt, Salmonella typhimurium LT2
caccaaaaauucuuuuacgaucg

SEQ ID NO: 3786818 - RNA, 17 nt, Salmonella typhimurium LT2
caccaaaguuaaucagc

SEQ ID NO: 3786819 - RNA, 20 nt, Salmonella typhimurium LT2
caccaaaguuaaucagcgcu

SEQ ID NO: 3786820 - RNA, 12 nt, Salmonella typhimurium LT2
caccaaaucauc

SEQ ID NO: 3786821 - RNA, 15 nt, Salmonella typhimurium LT2
caccaaauccuccag

SEQ ID NO: 3786822 - RNA, 18 nt, Salmonella typhimurium LT2
caccaaauccuccagcgg

SEQ ID NO: 3786823 - RNA, 16 nt, Salmonella typhimurium LT2
caccaacggcgacgcc

SEQ ID NO: 3786824 - RNA, 16 nt, Salmonella typhimurium LT2
caccaaguagacagag

SEQ ID NO: 3786825 - RNA, 22 nt, Salmonella typhimurium LT2
caccaauacgugagcgaaguuc

SEQ ID NO: 3786826 - RNA, 22 nt, Salmonella typhimurium LT2
caccaaugucauauuugugagc

SEQ ID NO: 3786827 - RNA, 12 nt, Salmonella typhimurium LT2
caccaauugcca

SEQ ID NO: 3786828 - RNA, 22 nt, Salmonella typhimurium LT2
caccacaaacgccgucacaaag

SEQ ID NO: 3786829 - RNA, 19 nt, Salmonella typhimurium LT2
caccacaaaggcgcguagu

SEQ ID NO: 3786830 - RNA, 18 nt, Salmonella typhimurium LT2
caccacaaagucgccuuc

SEQ ID NO: 3786831 - RNA, 13 nt, Salmonella typhimurium LT2
caccaccagcccg

SEQ ID NO: 3786832 - RNA, 19 nt, Salmonella typhimurium LT2
caccaccagcccggcgcac

SEQ ID NO: 3786833 - RNA, 18 nt, Salmonella typhimurium LT2
caccaccaguacauggca

SEQ ID NO: 3786834 - RNA, 13 nt, Salmonella typhimurium LT2
caccaccgcaggc

SEQ ID NO: 3786835 - RNA, 14 nt, Salmonella typhimurium LT2
caccaccucaaacg

SEQ ID NO: 3786836 - RNA, 17 nt, Salmonella typhimurium LT2
caccaccugcaugggga

SEQ ID NO: 3786837 - RNA, 19 nt, Salmonella typhimurium LT2
caccacgaaggaaacgcca

SEQ ID NO: 3786838 - RNA, 22 nt, Salmonella typhimurium LT2
caccacgaaggaaacgccaggc

SEQ ID NO: 3786839 - RNA, 23 nt, Salmonella typhimurium LT2
caccacgaaggaaacgccaggca

SEQ ID NO: 3786840 - RNA, 15 nt, Salmonella typhimurium LT2
caccacgcaaaccgc

SEQ ID NO: 3786841 - RNA, 12 nt, Salmonella typhimurium LT2
caccacgcaggc

SEQ ID NO: 3786842 - RNA, 15 nt, Salmonella typhimurium LT2
caccacgccgagaaa

SEQ ID NO: 3786843 - RNA, 22 nt, Salmonella typhimurium LT2
caccacgccuaaugaagcgcgu

SEQ ID NO: 3786844 - RNA, 19 nt, Salmonella typhimurium LT2
caccacgccuuucacgccg

SEQ ID NO: 3786845 - RNA, 17 nt, Salmonella typhimurium LT2
caccacggcgcagguaa

SEQ ID NO: 3786846 - RNA, 18 nt, Salmonella typhimurium LT2
caccacgguguaccccgc

SEQ ID NO: 3786847 - RNA, 20 nt, Salmonella typhimurium LT2
caccacgguguaccccgccu

SEQ ID NO: 3786848 - RNA, 22 nt, Salmonella typhimurium LT2
caccacgguguaccccgccuga

SEQ ID NO: 3786849 - RNA, 18 nt, Salmonella typhimurium LT2
caccacguaaugcgcccc

SEQ ID NO: 3786850 - RNA, 19 nt, Salmonella typhimurium LT2
caccacguaaugcgccccg

SEQ ID NO: 3786851 - RNA, 21 nt, Salmonella typhimurium LT2
caccacguaaugcgccccggc

SEQ ID NO: 3786852 - RNA, 13 nt, Salmonella typhimurium LT2
caccacguuaccg

SEQ ID NO: 3786853 - RNA, 23 nt, Salmonella typhimurium LT2
caccacguuaccgcgcaguucaa

SEQ ID NO: 3786854 - RNA, 23 nt, Salmonella typhimurium LT2
caccacugaaaaauaauuacuau

SEQ ID NO: 3786855 - RNA, 19 nt, Salmonella typhimurium LT2
caccacuggcagcgccuga

SEQ ID NO: 3786856 - RNA, 23 nt, Salmonella typhimurium LT2
caccacuggcagcgccugacggc

SEQ ID NO: 3786857 - RNA, 16 nt, Salmonella typhimurium LT2
caccagaauccacucg

SEQ ID NO: 3786858 - RNA, 21 nt, Salmonella typhimurium LT2
caccagaccgacaagcccccc

SEQ ID NO: 3786859 - RNA, 23 nt, Salmonella typhimurium LT2
caccagaucggcaucuuuaaccg

SEQ ID NO: 3786860 - RNA, 23 nt, Salmonella typhimurium LT2
caccagcaaugauaacggcgcca

SEQ ID NO: 3786861 - RNA, 13 nt, Salmonella typhimurium LT2
caccagcacaaug

SEQ ID NO: 3786862 - RNA, 21 nt, Salmonella typhimurium LT2
caccagcacaauggucagcgc

SEQ ID NO: 3786863 - RNA, 16 nt, Salmonella typhimurium LT2
caccagcaccgccagc

SEQ ID NO: 3786864 - RNA, 18 nt, Salmonella typhimurium LT2
caccagcaccgccagcgc

SEQ ID NO: 3786865 - RNA, 15 nt, Salmonella typhimurium LT2
caccagcacgcaggc

SEQ ID NO: 3786866 - RNA, 10 nt, Salmonella typhimurium LT2
caccagcagc

SEQ ID NO: 3786867 - RNA, 17 nt, Salmonella typhimurium LT2
caccagcagcgcggcgu

SEQ ID NO: 3786868 - RNA, 23 nt, Salmonella typhimurium LT2
caccagcaggaaucccauuaagc

SEQ ID NO: 3786869 - RNA, 19 nt, Salmonella typhimurium LT2
caccagcagggcaugauua

SEQ ID NO: 3786870 - RNA, 13 nt, Salmonella typhimurium LT2
caccagccaggcc

SEQ ID NO: 3786871 - RNA, 12 nt, Salmonella typhimurium LT2
caccagcccauc

SEQ ID NO: 3786872 - RNA, 21 nt, Salmonella typhimurium LT2
caccagcccaucuuucgccag

SEQ ID NO: 3786873 - RNA, 24 nt, Salmonella typhimurium LT2
caccagccccaaaauucacgcuuc

SEQ ID NO: 3786874 - RNA, 17 nt, Salmonella typhimurium LT2
caccagcccggcgcaca

SEQ ID NO: 3786875 - RNA, 13 nt, Salmonella typhimurium LT2
caccagccguuca

SEQ ID NO: 3786876 - RNA, 17 nt, Salmonella typhimurium LT2
caccagccguucaccag

SEQ ID NO: 3786877 - RNA, 16 nt, Salmonella typhimurium LT2
caccagccuaaaaaca

SEQ ID NO: 3786878 - RNA, 18 nt, Salmonella typhimurium LT2
caccagcgauaaacgcca

SEQ ID NO: 3786879 - RNA, 19 nt, Salmonella typhimurium LT2
caccagcgauaaacgccag

SEQ ID NO: 3786880 - RNA, 18 nt, Salmonella typhimurium LT2
caccagcgauaucaacgu

SEQ ID NO: 3786881 - RNA, 12 nt, Salmonella typhimurium LT2
caccagcgaucc

SEQ ID NO: 3786882 - RNA, 17 nt, Salmonella typhimurium LT2
caccagcgauccagacc

SEQ ID NO: 3786883 - RNA, 13 nt, Salmonella typhimurium LT2
caccagcgcagua

SEQ ID NO: 3786884 - RNA, 16 nt, Salmonella typhimurium LT2
caccagcgcaucgccc

SEQ ID NO: 3786885 - RNA, 21 nt, Salmonella typhimurium LT2
caccagcgcaucgcccugcca

SEQ ID NO: 3786886 - RNA, 13 nt, Salmonella typhimurium LT2
caccagcgccaga

SEQ ID NO: 3786887 - RNA, 23 nt, Salmonella typhimurium LT2
caccagcgccagaauagcgcagu

SEQ ID NO: 3786888 - RNA, 17 nt, Salmonella typhimurium LT2
caccagcgccagcgacu

SEQ ID NO: 3786889 - RNA, 16 nt, Salmonella typhimurium LT2
caccagcgccugcgcu

SEQ ID NO: 3786890 - RNA, 18 nt, Salmonella typhimurium LT2
caccagcgcgaccgguuu

SEQ ID NO: 3786891 - RNA, 13 nt, Salmonella typhimurium LT2
caccagcgcgccg

SEQ ID NO: 3786892 - RNA, 18 nt, Salmonella typhimurium LT2
caccagcggaauccccgc

SEQ ID NO: 3786893 - RNA, 12 nt, Salmonella typhimurium LT2
caccagcguacc

SEQ ID NO: 3786894 - RNA, 19 nt, Salmonella typhimurium LT2
caccagcugacgcagcagc

SEQ ID NO: 3786895 - RNA, 23 nt, Salmonella typhimurium LT2
caccagcugacgcagcagcuccc

SEQ ID NO: 3786896 - RNA, 14 nt, Salmonella typhimurium LT2
caccagcuuaucag

SEQ ID NO: 3786897 - RNA, 15 nt, Salmonella typhimurium LT2
caccagcuuaucuga

SEQ ID NO: 3786898 - RNA, 15 nt, Salmonella typhimurium LT2
caccagcuuguuauc

SEQ ID NO: 3786899 - RNA, 24 nt, Salmonella typhimurium LT2
caccaggcguuauuggcgcagcca

SEQ ID NO: 3786900 - RNA, 17 nt, Salmonella typhimurium LT2
caccagggauuuugcuu

SEQ ID NO: 3786901 - RNA, 23 nt, Salmonella typhimurium LT2
caccaggucaaaauuaaucgcca

SEQ ID NO: 3786902 - RNA, 21 nt, Salmonella typhimurium LT2
caccagguccgacuucaugcg

SEQ ID NO: 3786903 - RNA, 17 nt, Salmonella typhimurium LT2
caccagguucagcaacg

SEQ ID NO: 3786904 - RNA, 19 nt, Salmonella typhimurium LT2
caccaguagcgcgacgcca

SEQ ID NO: 3786905 - RNA, 21 nt, Salmonella typhimurium LT2
caccaguucacuccuaagaga

SEQ ID NO: 3786906 - RNA, 17 nt, Salmonella typhimurium LT2
caccaguuuauccgccg

SEQ ID NO: 3786907 - RNA, 15 nt, Salmonella typhimurium LT2
caccauaaaaccauu

SEQ ID NO: 3786908 - RNA, 20 nt, Salmonella typhimurium LT2
caccauaaagcgaauaauua

SEQ ID NO: 3786909 - RNA, 17 nt, Salmonella typhimurium LT2
caccauaauuaccggca

SEQ ID NO: 3786910 - RNA, 17 nt, Salmonella typhimurium LT2
caccauaucgcagacca

SEQ ID NO: 3786911 - RNA, 17 nt, Salmonella typhimurium LT2
caccauauucgccaccg

SEQ ID NO: 3786912 - RNA, 20 nt, Salmonella typhimurium LT2
caccaucagcgucagcacca

SEQ ID NO: 3786913 - RNA, 13 nt, Salmonella typhimurium LT2
caccaucccgcuc

SEQ ID NO: 3786914 - RNA, 13 nt, Salmonella typhimurium LT2
caccauccggcaa

SEQ ID NO: 3786915 - RNA, 22 nt, Salmonella typhimurium LT2
caccaucgcaaauucaucgccg

SEQ ID NO: 3786916 - RNA, 15 nt, Salmonella typhimurium LT2
caccaucgccggaga

SEQ ID NO: 3786917 - RNA, 19 nt, Salmonella typhimurium LT2
caccaucgccggagaccug

SEQ ID NO: 3786918 - RNA, 24 nt, Salmonella typhimurium LT2
caccaucgcgaucaucagcacgcc

SEQ ID NO: 3786919 - RNA, 20 nt, Salmonella typhimurium LT2
caccaucgucgccagaccca

SEQ ID NO: 3786920 - RNA, 16 nt, Salmonella typhimurium LT2
caccaucguugccagc

SEQ ID NO: 3786921 - RNA, 19 nt, Salmonella typhimurium LT2
caccaucguugccagcggc

SEQ ID NO: 3786922 - RNA, 20 nt, Salmonella typhimurium LT2
caccaucguugccagcggcc

SEQ ID NO: 3786923 - RNA, 19 nt, Salmonella typhimurium LT2
caccaucuuuuccggcagg

SEQ ID NO: 3786924 - RNA, 13 nt, Salmonella typhimurium LT2
caccaucuuuuug

SEQ ID NO: 3786925 - RNA, 17 nt, Salmonella typhimurium LT2
caccaugacgcagugca

SEQ ID NO: 3786926 - RNA, 16 nt, Salmonella typhimurium LT2
caccaugcaaaaugcu

SEQ ID NO: 3786927 - RNA, 16 nt, Salmonella typhimurium LT2
caccauggcgccaagu

SEQ ID NO: 3786928 - RNA, 13 nt, Salmonella typhimurium LT2
caccauuaucgcg

SEQ ID NO: 3786929 - RNA, 21 nt, Salmonella typhimurium LT2
caccauuaugaccaauaauaa

SEQ ID NO: 3786930 - RNA, 13 nt, Salmonella typhimurium LT2
caccauucccagc

SEQ ID NO: 3786931 - RNA, 16 nt, Salmonella typhimurium LT2
caccauucccagcgcc

SEQ ID NO: 3786932 - RNA, 12 nt, Salmonella typhimurium LT2
caccauucuuca

SEQ ID NO: 3786933 - RNA, 14 nt, Salmonella typhimurium LT2
caccauuucacaaa

SEQ ID NO: 3786934 - RNA, 19 nt, Salmonella typhimurium LT2
caccauuucacaaauuaaa

SEQ ID NO: 3786935 - RNA, 12 nt, Salmonella typhimurium LT2
caccauuuccgc

SEQ ID NO: 3786936 - RNA, 13 nt, Salmonella typhimurium LT2
cacccacgccgga

SEQ ID NO: 3786937 - RNA, 17 nt, Salmonella typhimurium LT2
cacccagaucgcgaucc

SEQ ID NO: 3786938 - RNA, 14 nt, Salmonella typhimurium LT2
cacccagccccccu

SEQ ID NO: 3786939 - RNA, 12 nt, Salmonella typhimurium LT2
cacccagcgcgg

SEQ ID NO: 3786940 - RNA, 16 nt, Salmonella typhimurium LT2
cacccagugccaccag

SEQ ID NO: 3786941 - RNA, 20 nt, Salmonella typhimurium LT2
cacccaguuuuuuucugcca

SEQ ID NO: 3786942 - RNA, 18 nt, Salmonella typhimurium LT2
cacccauagauaccuucu

SEQ ID NO: 3786943 - RNA, 22 nt, Salmonella typhimurium LT2
cacccauugaacccgaccgucu

SEQ ID NO: 3786944 - RNA, 12 nt, Salmonella typhimurium LT2
caccccacagca

SEQ ID NO: 3786945 - RNA, 22 nt, Salmonella typhimurium LT2
caccccagguaaauccgccagu

SEQ ID NO: 3786946 - RNA, 14 nt, Salmonella typhimurium LT2
cacccccaucgccc

SEQ ID NO: 3786947 - RNA, 21 nt, Salmonella typhimurium LT2
caccccgcgccgcugagaaaa

SEQ ID NO: 3786948 - RNA, 14 nt, Salmonella typhimurium LT2
caccccggccacgu

SEQ ID NO: 3786949 - RNA, 18 nt, Salmonella typhimurium LT2
cacccgaaagucaaaaua

SEQ ID NO: 3786950 - RNA, 15 nt, Salmonella typhimurium LT2
cacccgcgccagcag

SEQ ID NO: 3786951 - RNA, 21 nt, Salmonella typhimurium LT2
cacccgcgugaacacacccuu

SEQ ID NO: 3786952 - RNA, 16 nt, Salmonella typhimurium LT2
cacccgcuuccagcgc

SEQ ID NO: 3786953 - RNA, 14 nt, Salmonella typhimurium LT2
cacccggagagaaa

SEQ ID NO: 3786954 - RNA, 15 nt, Salmonella typhimurium LT2
cacccggagagaaac

SEQ ID NO: 3786955 - RNA, 17 nt, Salmonella typhimurium LT2
cacccguucgcugcauu

SEQ ID NO: 3786956 - RNA, 15 nt, Salmonella typhimurium LT2
cacccuauccgccag

SEQ ID NO: 3786957 - RNA, 16 nt, Salmonella typhimurium LT2
cacccugccccgguga

SEQ ID NO: 3786958 - RNA, 15 nt, Salmonella typhimurium LT2
cacccugcgaggccu

SEQ ID NO: 3786959 - RNA, 19 nt, Salmonella typhimurium LT2
cacccuguaaugacgcugu

SEQ ID NO: 3786960 - RNA, 18 nt, Salmonella typhimurium LT2
caccgaagaauuuaucaa

SEQ ID NO: 3786961 - RNA, 14 nt, Salmonella typhimurium LT2
caccgacagcaccg

SEQ ID NO: 3786962 - RNA, 18 nt, Salmonella typhimurium LT2
caccgagacugcccggca

SEQ ID NO: 3786963 - RNA, 13 nt, Salmonella typhimurium LT2
caccgagccagaa

SEQ ID NO: 3786964 - RNA, 22 nt, Salmonella typhimurium LT2
caccgauacaggacugacugcu

SEQ ID NO: 3786965 - RNA, 15 nt, Salmonella typhimurium LT2
caccgaucaucccac

SEQ ID NO: 3786966 - RNA, 14 nt, Salmonella typhimurium LT2
caccgauccgaaga

SEQ ID NO: 3786967 - RNA, 23 nt, Salmonella typhimurium LT2
caccgauuucaucgcugaauuug

SEQ ID NO: 3786968 - RNA, 21 nt, Salmonella typhimurium LT2
caccgcaucaaacucgcccag

SEQ ID NO: 3786969 - RNA, 15 nt, Salmonella typhimurium LT2
caccgcauccgcauc

SEQ ID NO: 3786970 - RNA, 14 nt, Salmonella typhimurium LT2
cacgcaacaggccg

SEQ ID NO: 3786971 - RNA, 22 nt, Salmonella typhimurium LT2
cacgcaaugccugaccaacguc

SEQ ID NO: 3786972 - RNA, 22 nt, Salmonella typhimurium LT2
cacgcacaaaaggcuggaacag

SEQ ID NO: 3786973 - RNA, 20 nt, Salmonella typhimurium LT2
cacgcacagcggauggcuga

SEQ ID NO: 3786974 - RNA, 12 nt, Salmonella typhimurium LT2
cacgcagacgcc

SEQ ID NO: 3786975 - RNA, 24 nt, Salmonella typhimurium LT2
cacgcagacgccgcgguugacggc

SEQ ID NO: 3786976 - RNA, 20 nt, Salmonella typhimurium LT2
cacgcagauaucuuccagcg

SEQ ID NO: 3786977 - RNA, 13 nt, Salmonella typhimurium LT2
cacgcagccaugu

SEQ ID NO: 3786978 - RNA, 17 nt, Salmonella typhimurium LT2
cacgcagccauguaaaa

SEQ ID NO: 3786979 - RNA, 17 nt, Salmonella typhimurium LT2
cacgcauggcacuggcg

SEQ ID NO: 3786980 - RNA, 17 nt, Salmonella typhimurium LT2
cacgccaaaaagugaau

SEQ ID NO: 3786981 - RNA, 18 nt, Salmonella typhimurium LT2
cacgccaaccaucggcac

SEQ ID NO: 3786982 - RNA, 11 nt, Salmonella typhimurium LT2
cacgccaauag

SEQ ID NO: 3786983 - RNA, 15 nt, Salmonella typhimurium LT2
cacgccaccgggcuu

SEQ ID NO: 3786984 - RNA, 19 nt, Salmonella typhimurium LT2
cacgccaccgggcuuuaau

SEQ ID NO: 3786985 - RNA, 15 nt, Salmonella typhimurium LT2
cacgccagauaaauc

SEQ ID NO: 3786986 - RNA, 17 nt, Salmonella typhimurium LT2
cacgccagcgguugcgg

SEQ ID NO: 3786987 - RNA, 17 nt, Salmonella typhimurium LT2
cacgccagucaccagca

SEQ ID NO: 3786988 - RNA, 20 nt, Salmonella typhimurium LT2
cacgccagucaccagcagca

SEQ ID NO: 3786989 - RNA, 21 nt, Salmonella typhimurium LT2
cacgccauaauggcccagcgu

SEQ ID NO: 3786990 - RNA, 14 nt, Salmonella typhimurium LT2
cacgccaucaacag

SEQ ID NO: 3786991 - RNA, 20 nt, Salmonella typhimurium LT2
cacgccaucgacaaaggcaa

SEQ ID NO: 3786992 - RNA, 14 nt, Salmonella typhimurium LT2
cacgccaucggcua

SEQ ID NO: 3786993 - RNA, 17 nt, Salmonella typhimurium LT2
cacgccauggccgcagc

SEQ ID NO: 3786994 - RNA, 11 nt, Salmonella typhimurium LT2
cacgcccagcg

SEQ ID NO: 3786995 - RNA, 20 nt, Salmonella typhimurium LT2
cacgcccauacacaccagca

SEQ ID NO: 3786996 - RNA, 17 nt, Salmonella typhimurium LT2
cacgccccuaaggcagc

SEQ ID NO: 3786997 - RNA, 17 nt, Salmonella typhimurium LT2
cacgcccgcggcaugau

SEQ ID NO: 3786998 - RNA, 16 nt, Salmonella typhimurium LT2
cacgcccuccuguuga

SEQ ID NO: 3786999 - RNA, 17 nt, Salmonella typhimurium LT2
cacgccgacgacaggca

SEQ ID NO: 3787000 - RNA, 22 nt, Salmonella typhimurium LT2
cacgccgacucacgcagcgcuc

SEQ ID NO: 3787001 - RNA, 16 nt, Salmonella typhimurium LT2
cacgccgcacacagcg

SEQ ID NO: 3787002 - RNA, 18 nt, Salmonella typhimurium LT2
cacgccgccauccggcac

SEQ ID NO: 3787003 - RNA, 16 nt, Salmonella typhimurium LT2
cacgccgccgccgacc

SEQ ID NO: 3787004 - RNA, 13 nt, Salmonella typhimurium LT2
cacgccgccgcgu

SEQ ID NO: 3787005 - RNA, 16 nt, Salmonella typhimurium LT2
cacgccgcuacugccg

SEQ ID NO: 3787006 - RNA, 18 nt, Salmonella typhimurium LT2
cacgccggaaagaauaau

SEQ ID NO: 3787007 - RNA, 14 nt, Salmonella typhimurium LT2
cacgccguagcugc

SEQ ID NO: 3787008 - RNA, 21 nt, Salmonella typhimurium LT2
cacgccguagcugcgcgccgc

SEQ ID NO: 3787009 - RNA, 15 nt, Salmonella typhimurium LT2
cacgccguccagcac

SEQ ID NO: 3787010 - RNA, 22 nt, Salmonella typhimurium LT2
cacgccucuggcguacgcagau

SEQ ID NO: 3787011 - RNA, 16 nt, Salmonella typhimurium LT2
cacgccuguucaucag

SEQ ID NO: 3787012 - RNA, 14 nt, Salmonella typhimurium LT2
cacgccuuuaagcu

SEQ ID NO: 3787013 - RNA, 22 nt, Salmonella typhimurium LT2
cacgcgaauagccagacagccc

SEQ ID NO: 3787014 - RNA, 13 nt, Salmonella typhimurium LT2
cacgcgacgccag

SEQ ID NO: 3787015 - RNA, 14 nt, Salmonella typhimurium LT2
cacgcgacgccagc

SEQ ID NO: 3787016 - RNA, 19 nt, Salmonella typhimurium LT2
cacgcgcaguacggcgcac

SEQ ID NO: 3787017 - RNA, 14 nt, Salmonella typhimurium LT2
cacgcgccagccgu

SEQ ID NO: 3787018 - RNA, 12 nt, Salmonella typhimurium LT2
cacgcgccgccu

SEQ ID NO: 3787019 - RNA, 13 nt, Salmonella typhimurium LT2
cacgcgccgccug

SEQ ID NO: 3787020 - RNA, 15 nt, Salmonella typhimurium LT2
cacgcgcgcgcguca

SEQ ID NO: 3787021 - RNA, 19 nt, Salmonella typhimurium LT2
cacgcgcgcugcgccugga

SEQ ID NO: 3787022 - RNA, 20 nt, Salmonella typhimurium LT2
cacgcgcgcugcgccuggaa

SEQ ID NO: 3787023 - RNA, 22 nt, Salmonella typhimurium LT2
cacgcgcgcuuuucgccagcgc

SEQ ID NO: 3787024 - RNA, 17 nt, Salmonella typhimurium LT2
cacgcggccuccggcgc

SEQ ID NO: 3787025 - RNA, 21 nt, Salmonella typhimurium LT2
cacgcgggcgguauuauccgc

SEQ ID NO: 3787026 - RNA, 15 nt, Salmonella typhimurium LT2
cacgcguucacaacg

SEQ ID NO: 3787027 - RNA, 18 nt, Salmonella typhimurium LT2
cacgcuaaaaaaggcaga

SEQ ID NO: 3787028 - RNA, 16 nt, Salmonella typhimurium LT2
cacgcuaaagcccagc

SEQ ID NO: 3787029 - RNA, 17 nt, Salmonella typhimurium LT2
cacgcuaaagucagcau

SEQ ID NO: 3787030 - RNA, 13 nt, Salmonella typhimurium LT2
cacgcuccagcgg

SEQ ID NO: 3787031 - RNA, 14 nt, Salmonella typhimurium LT2
cacgcucgcggaag

SEQ ID NO: 3787032 - RNA, 15 nt, Salmonella typhimurium LT2
cacgcucgcuggugc

SEQ ID NO: 3787033 - RNA, 19 nt, Salmonella typhimurium LT2
cacgcugaccacgccgccg

SEQ ID NO: 3787034 - RNA, 17 nt, Salmonella typhimurium LT2
cacgcugaggcgccguc

SEQ ID NO: 3787035 - RNA, 16 nt, Salmonella typhimurium LT2
cacgcugauacguaac

SEQ ID NO: 3787036 - RNA, 19 nt, Salmonella typhimurium LT2
cacgcugccacccggcaac

SEQ ID NO: 3787037 - RNA, 21 nt, Salmonella typhimurium LT2
cacgcugggcgaauacccagc

SEQ ID NO: 3787038 - RNA, 14 nt, Salmonella typhimurium LT2
cacgcuucccagcg

SEQ ID NO: 3787039 - RNA, 15 nt, Salmonella typhimurium LT2
cacgcuucccagcgu

SEQ ID NO: 3787040 - RNA, 20 nt, Salmonella typhimurium LT2
cacgcuucggugaucuccuc

SEQ ID NO: 3787041 - RNA, 20 nt, Salmonella typhimurium LT2
cacgcuugcccggaucgcca

SEQ ID NO: 3787042 - RNA, 23 nt, Salmonella typhimurium LT2
cacgcuuguuagcuuucugccag

SEQ ID NO: 3787043 - RNA, 18 nt, Salmonella typhimurium LT2
cacgcuuuuacaucgcug

SEQ ID NO: 3787044 - RNA, 15 nt, Salmonella typhimurium LT2
cacgcuuuucagcgc

SEQ ID NO: 3787045 - RNA, 20 nt, Salmonella typhimurium LT2
cacgcuuuuuaccggcgacc

SEQ ID NO: 3787046 - RNA, 22 nt, Salmonella typhimurium LT2
cacggaacaacgcaacacaggc

SEQ ID NO: 3787047 - RNA, 19 nt, Salmonella typhimurium LT2
cacggaacaacggcacaca

SEQ ID NO: 3787048 - RNA, 22 nt, Salmonella typhimurium LT2
cacggaacaacggcacacaggc

SEQ ID NO: 3787049 - RNA, 15 nt, Salmonella typhimurium LT2
cacggaauacgacgc

SEQ ID NO: 3787050 - RNA, 16 nt, Salmonella typhimurium LT2
cacggacaucggcuuc

SEQ ID NO: 3787051 - RNA, 20 nt, Salmonella typhimurium LT2
cacggagagacaguucagau

SEQ ID NO: 3787052 - RNA, 19 nt, Salmonella typhimurium LT2
cacggagagucgcaccgcg

SEQ ID NO: 3787053 - RNA, 19 nt, Salmonella typhimurium LT2
cacggaucaucuacccgua

SEQ ID NO: 3787054 - RNA, 19 nt, Salmonella typhimurium LT2
cacggauuuaauccaccac

SEQ ID NO: 3787055 - RNA, 12 nt, Salmonella typhimurium LT2
cacggcaacgcc

SEQ ID NO: 3787056 - RNA, 22 nt, Salmonella typhimurium LT2
cacggcaacgccuuccugccag

SEQ ID NO: 3787057 - RNA, 23 nt, Salmonella typhimurium LT2
cacggcaacgccuuccugccagc

SEQ ID NO: 3787058 - RNA, 16 nt, Salmonella typhimurium LT2
cacggcaguacacgca

SEQ ID NO: 3787059 - RNA, 15 nt, Salmonella typhimurium LT2
cacggcaugaagcag

SEQ ID NO: 3787060 - RNA, 15 nt, Salmonella typhimurium LT2
cacggcauguucugc

SEQ ID NO: 3787061 - RNA, 17 nt, Salmonella typhimurium LT2
cacggcauucacgucgc

SEQ ID NO: 3787062 - RNA, 23 nt, Salmonella typhimurium LT2
cacggcauucacgucgcgcgccg

SEQ ID NO: 3787063 - RNA, 13 nt, Salmonella typhimurium LT2
cacggcauucagu

SEQ ID NO: 3787064 - RNA, 18 nt, Salmonella typhimurium LT2
cacggccaacuuauccga

SEQ ID NO: 3787065 - RNA, 19 nt, Salmonella typhimurium LT2
cacggcgauguaacgccuu

SEQ ID NO: 3787066 - RNA, 20 nt, Salmonella typhimurium LT2
cacggcgccaugauccagcg

SEQ ID NO: 3787067 - RNA, 21 nt, Salmonella typhimurium LT2
cacggcgccaugauccagcgg

SEQ ID NO: 3787068 - RNA, 12 nt, Salmonella typhimurium LT2
cacggcgucaaa

SEQ ID NO: 3787069 - RNA, 17 nt, Salmonella typhimurium LT2
cacggcgugaccaccgc

SEQ ID NO: 3787070 - RNA, 13 nt, Salmonella typhimurium LT2
cacggcucgccuu

SEQ ID NO: 3787071 - RNA, 21 nt, Salmonella typhimurium LT2
cacggcucgccuuugcgcccg

SEQ ID NO: 3787072 - RNA, 16 nt, Salmonella typhimurium LT2
cacgguaaaacacgcc

SEQ ID NO: 3787073 - RNA, 14 nt, Salmonella typhimurium LT2
cacgguaaaccucu

SEQ ID NO: 3787074 - RNA, 14 nt, Salmonella typhimurium LT2
cacuguugcaucuu

SEQ ID NO: 3787075 - RNA, 22 nt, Salmonella typhimurium LT2
cacuguuugcugacaaucugcu

SEQ ID NO: 3787076 - RNA, 21 nt, Salmonella typhimurium LT2
cacuuaaguaaagauuuuuau

SEQ ID NO: 3787077 - RNA, 17 nt, Salmonella typhimurium LT2
cacuuaccaaucgcggc

SEQ ID NO: 3787078 - RNA, 16 nt, Salmonella typhimurium LT2
cacuucacuggcggca

SEQ ID NO: 3787079 - RNA, 16 nt, Salmonella typhimurium LT2
cacuucagccagcugc

SEQ ID NO: 3787080 - RNA, 14 nt, Salmonella typhimurium LT2
cacuucaucaucau

SEQ ID NO: 3787081 - RNA, 20 nt, Salmonella typhimurium LT2
cacuucauccggauaaagcc

SEQ ID NO: 3787082 - RNA, 21 nt, Salmonella typhimurium LT2
cacuucaugccgaacagguua

SEQ ID NO: 3787083 - RNA, 16 nt, Salmonella typhimurium LT2
cacuuccagccacggc

SEQ ID NO: 3787084 - RNA, 14 nt, Salmonella typhimurium LT2
cacuucgauaacau

SEQ ID NO: 3787085 - RNA, 16 nt, Salmonella typhimurium LT2
cacuucgauaacauca

SEQ ID NO: 3787086 - RNA, 17 nt, Salmonella typhimurium LT2
cacuucgcgcauugcga

SEQ ID NO: 3787087 - RNA, 17 nt, Salmonella typhimurium LT2
cacuucgcguuagccgg

SEQ ID NO: 3787088 - RNA, 21 nt, Salmonella typhimurium LT2
cacuucgcugauaccgcccuc

SEQ ID NO: 3787089 - RNA, 17 nt, Salmonella typhimurium LT2
cacuucuccacgcgaug

SEQ ID NO: 3787090 - RNA, 13 nt, Salmonella typhimurium LT2
cacuucugacaga

SEQ ID NO: 3787091 - RNA, 22 nt, Salmonella typhimurium LT2
cacuucugaguucggcaugggg

SEQ ID NO: 3787092 - RNA, 21 nt, Salmonella typhimurium LT2
cacuucuucauaaaacccgcu

SEQ ID NO: 3787093 - RNA, 23 nt, Salmonella typhimurium LT2
cacuucuuucacugucauggcua

SEQ ID NO: 3787094 - RNA, 21 nt, Salmonella typhimurium LT2
cacuucuuugaaguucaucac

SEQ ID NO: 3787095 - RNA, 14 nt, Salmonella typhimurium LT2
cacuucuuugacca

SEQ ID NO: 3787096 - RNA, 14 nt, Salmonella typhimurium LT2
cacuugagaaauua

SEQ ID NO: 3787097 - RNA, 21 nt, Salmonella typhimurium LT2
cacuugagaaauuauuuuaaa

SEQ ID NO: 3787098 - RNA, 22 nt, Salmonella typhimurium LT2
cacuugagaaauuauuuuaaau

SEQ ID NO: 3787099 - RNA, 20 nt, Salmonella typhimurium LT2
cacuuggcgaucaccagcac

SEQ ID NO: 3787100 - RNA, 21 nt, Salmonella typhimurium LT2
cacuuggcgaucaccagcacc

SEQ ID NO: 3787101 - RNA, 16 nt, Salmonella typhimurium LT2
cacuuguaccaacugc

SEQ ID NO: 3787102 - RNA, 19 nt, Salmonella typhimurium LT2
cacuuuacugaauaacagc

SEQ ID NO: 3787103 - RNA, 20 nt, Salmonella typhimurium LT2
cacuuuacugaauaacagca

SEQ ID NO: 3787104 - RNA, 13 nt, Salmonella typhimurium LT2
cacuuuccagccc

SEQ ID NO: 3787105 - RNA, 17 nt, Salmonella typhimurium LT2
cacuuucgcccggcgcc

SEQ ID NO: 3787106 - RNA, 12 nt, Salmonella typhimurium LT2
cacuuucucggc

SEQ ID NO: 3787107 - RNA, 17 nt, Salmonella typhimurium LT2
cacuuucucggcuuucc

SEQ ID NO: 3787108 - RNA, 12 nt, Salmonella typhimurium LT2
cacuuucuugcc

SEQ ID NO: 3787109 - RNA, 17 nt, Salmonella typhimurium LT2
cacuuucuugccacugg

SEQ ID NO: 3787110 - RNA, 18 nt, Salmonella typhimurium LT2
cacuuucuugccacuggc

SEQ ID NO: 3787111 - RNA, 16 nt, Salmonella typhimurium LT2
cacuuugcagaccuuu

SEQ ID NO: 3787112 - RNA, 20 nt, Salmonella typhimurium LT2
cacuuuucccgccagcugcg

SEQ ID NO: 3787113 - RNA, 21 nt, Salmonella typhimurium LT2
cacuuuucuuuccugcaaauu

SEQ ID NO: 3787114 - RNA, 14 nt, Salmonella typhimurium LT2
cacuuuugccguca

SEQ ID NO: 3787115 - RNA, 22 nt, Salmonella typhimurium LT2
cagaaaaaagccaagcacaaaa

SEQ ID NO: 3787116 - RNA, 22 nt, Salmonella typhimurium LT2
cagaaaaaauaguaaaguuuau

SEQ ID NO: 3787117 - RNA, 19 nt, Salmonella typhimurium LT2
cagaaaaaaugcaccgccu

SEQ ID NO: 3787118 - RNA, 17 nt, Salmonella typhimurium LT2
cagaaaaaauuacagcc

SEQ ID NO: 3787119 - RNA, 13 nt, Salmonella typhimurium LT2
cagaaaaccggca

SEQ ID NO: 3787120 - RNA, 15 nt, Salmonella typhimurium LT2
cagaaaaccggcaaa

SEQ ID NO: 3787121 - RNA, 20 nt, Salmonella typhimurium LT2
cagaaaaugcucaguauggc

SEQ ID NO: 3787122 - RNA, 19 nt, Salmonella typhimurium LT2
cagaaacaucgguaauagc

SEQ ID NO: 3787123 - RNA, 18 nt, Salmonella typhimurium LT2
cagaaacgguccuggucc

SEQ ID NO: 3787124 - RNA, 12 nt, Salmonella typhimurium LT2
cagaaacuguga

SEQ ID NO: 3787125 - RNA, 15 nt, Salmonella typhimurium LT2
cagaaaggcgugcag

SEQ ID NO: 3787126 - RNA, 20 nt, Salmonella typhimurium LT2
cagaaagugggucacaucgc

SEQ ID NO: 3787127 - RNA, 14 nt, Salmonella typhimurium LT2
cagaaauaaaauac

SEQ ID NO: 3787128 - RNA, 23 nt, Salmonella typhimurium LT2
cagaaauaaaauacgcucaauau

SEQ ID NO: 3787129 - RNA, 15 nt, Salmonella typhimurium LT2
cagaaauaaaauacu

SEQ ID NO: 3787130 - RNA, 22 nt, Salmonella typhimurium LT2
cagaaauccgcgaauaccuucc

SEQ ID NO: 3787131 - RNA, 16 nt, Salmonella typhimurium LT2
cagaaaucgccgggcu

SEQ ID NO: 3787132 - RNA, 21 nt, Salmonella typhimurium LT2
cagaaaugcagggguccugua

SEQ ID NO: 3787133 - RNA, 12 nt, Salmonella typhimurium LT2
cagaaauuaaau

SEQ ID NO: 3787134 - RNA, 16 nt, Salmonella typhimurium LT2
cagaaauuaaaucauc

SEQ ID NO: 3787135 - RNA, 13 nt, Salmonella typhimurium LT2
cagaacaaaggcu

SEQ ID NO: 3787136 - RNA, 15 nt, Salmonella typhimurium LT2
cagaacaucaucuuc

SEQ ID NO: 3787137 - RNA, 17 nt, Salmonella typhimurium LT2
cagaacccggcuuaucg

SEQ ID NO: 3787138 - RNA, 23 nt, Salmonella typhimurium LT2
cagaaccguugcgcccaucauca

SEQ ID NO: 3787139 - RNA, 23 nt, Salmonella typhimurium LT2
cagaaccugcucggcuaucgcca

SEQ ID NO: 3787140 - RNA, 19 nt, Salmonella typhimurium LT2
cagaacgcuuuugcgcacu

SEQ ID NO: 3787141 - RNA, 14 nt, Salmonella typhimurium LT2
cagaacucaucuuc

SEQ ID NO: 3787142 - RNA, 17 nt, Salmonella typhimurium LT2
cagaacugcgaaaucac

SEQ ID NO: 3787143 - RNA, 22 nt, Salmonella typhimurium LT2
cagaagacggaaaccagauacc

SEQ ID NO: 3787144 - RNA, 23 nt, Salmonella typhimurium LT2
cagaagaguuaacuucuccucca

SEQ ID NO: 3787145 - RNA, 16 nt, Salmonella typhimurium LT2
cagaagcacuucucca

SEQ ID NO: 3787146 - RNA, 17 nt, Salmonella typhimurium LT2
cagaagcgccugucuau

SEQ ID NO: 3787147 - RNA, 14 nt, Salmonella typhimurium LT2
cagaagcgucauaa

SEQ ID NO: 3787148 - RNA, 22 nt, Salmonella typhimurium LT2
cagaagcuguaaccuacgccaa

SEQ ID NO: 3787149 - RNA, 15 nt, Salmonella typhimurium LT2
cagaaggcaugggga

SEQ ID NO: 3787150 - RNA, 23 nt, Salmonella typhimurium LT2
cagaaggcuugauacugaggauu

SEQ ID NO: 3787151 - RNA, 12 nt, Salmonella typhimurium LT2
cagaauaaaaca

SEQ ID NO: 3787152 - RNA, 18 nt, Salmonella typhimurium LT2
cagaauaaugcuggcgga

SEQ ID NO: 3787153 - RNA, 16 nt, Salmonella typhimurium LT2
cagaauacacuucuca

SEQ ID NO: 3787154 - RNA, 17 nt, Salmonella typhimurium LT2
cagaauacgaauauuca

SEQ ID NO: 3787155 - RNA, 21 nt, Salmonella typhimurium LT2
cagaauacgccgccgcccaga

SEQ ID NO: 3787156 - RNA, 16 nt, Salmonella typhimurium LT2
cagaauagacgccaug

SEQ ID NO: 3787157 - RNA, 13 nt, Salmonella typhimurium LT2
cagaaucaauaaa

SEQ ID NO: 3787158 - RNA, 23 nt, Salmonella typhimurium LT2
cagaaucacgucguucgggccga

SEQ ID NO: 3787159 - RNA, 19 nt, Salmonella typhimurium LT2
cagaaucagauccgcguca

SEQ ID NO: 3787160 - RNA, 14 nt, Salmonella typhimurium LT2
cagaaucagccgac

SEQ ID NO: 3787161 - RNA, 13 nt, Salmonella typhimurium LT2
cagaaucaggcca

SEQ ID NO: 3787162 - RNA, 24 nt, Salmonella typhimurium LT2
cagaaugauaaugccgcugauaau

SEQ ID NO: 3787163 - RNA, 14 nt, Salmonella typhimurium LT2
cagaaugcguaaaa

SEQ ID NO: 3787164 - RNA, 22 nt, Salmonella typhimurium LT2
cagaaugcguaaaaagcacgcu

SEQ ID NO: 3787165 - RNA, 19 nt, Salmonella typhimurium LT2
cagaauggcgaucaccgca

SEQ ID NO: 3787166 - RNA, 19 nt, Salmonella typhimurium LT2
cagaauuaacucaucacag

SEQ ID NO: 3787167 - RNA, 16 nt, Salmonella typhimurium LT2
cagaauugcgccaccu

SEQ ID NO: 3787168 - RNA, 21 nt, Salmonella typhimurium LT2
cagaauuucgcccuguauaca

SEQ ID NO: 3787169 - RNA, 21 nt, Salmonella typhimurium LT2
cagaauuucuacacagcgcga

SEQ ID NO: 3787170 - RNA, 15 nt, Salmonella typhimurium LT2
cagaauuuuuaaccg

SEQ ID NO: 3787171 - RNA, 21 nt, Salmonella typhimurium LT2
cagacaaaaucuuuccagcuc

SEQ ID NO: 3787172 - RNA, 19 nt, Salmonella typhimurium LT2
cagacaaccauauuuaugc

SEQ ID NO: 3787173 - RNA, 23 nt, Salmonella typhimurium LT2
cagacaaccauauuuaugcagcg

SEQ ID NO: 3787174 - RNA, 13 nt, Salmonella typhimurium LT2
cagacaacgccgc

SEQ ID NO: 3787175 - RNA, 16 nt, Salmonella typhimurium LT2
cagacaacgccgccug

SEQ ID NO: 3787176 - RNA, 21 nt, Salmonella typhimurium LT2
cagacaagcacauagcugaga

SEQ ID NO: 3787177 - RNA, 14 nt, Salmonella typhimurium LT2
cagauaaaggauug

SEQ ID NO: 3787178 - RNA, 18 nt, Salmonella typhimurium LT2
cagauaaaucagcccgau

SEQ ID NO: 3787179 - RNA, 15 nt, Salmonella typhimurium LT2
cagauaacaccagcg

SEQ ID NO: 3787180 - RNA, 16 nt, Salmonella typhimurium LT2
cagauaacaggcaauu

SEQ ID NO: 3787181 - RNA, 21 nt, Salmonella typhimurium LT2
cagauaagcucuccuggaugc

SEQ ID NO: 3787182 - RNA, 22 nt, Salmonella typhimurium LT2
cagauaauccacauugcaaugc

SEQ ID NO: 3787183 - RNA, 22 nt, Salmonella typhimurium LT2
cagauaauucucuuugacgacc

SEQ ID NO: 3787184 - RNA, 15 nt, Salmonella typhimurium LT2
cagauacauggcuau

SEQ ID NO: 3787185 - RNA, 21 nt, Salmonella typhimurium LT2
cagauaccgaccgugagaauc

SEQ ID NO: 3787186 - RNA, 22 nt, Salmonella typhimurium LT2
cagauaccggcgcagcaucugc

SEQ ID NO: 3787187 - RNA, 15 nt, Salmonella typhimurium LT2
cagauacgcgggcuc

SEQ ID NO: 3787188 - RNA, 17 nt, Salmonella typhimurium LT2
cagauagagcauaauaa

SEQ ID NO: 3787189 - RNA, 15 nt, Salmonella typhimurium LT2
cagauagccugccag

SEQ ID NO: 3787190 - RNA, 12 nt, Salmonella typhimurium LT2
cagauagcgcau

SEQ ID NO: 3787191 - RNA, 13 nt, Salmonella typhimurium LT2
cagauagcgcugc

SEQ ID NO: 3787192 - RNA, 17 nt, Salmonella typhimurium LT2
cagauagcgcugcgcca

SEQ ID NO: 3787193 - RNA, 19 nt, Salmonella typhimurium LT2
cagauagcgcugcgccaga

SEQ ID NO: 3787194 - RNA, 15 nt, Salmonella typhimurium LT2
cagauagcguaaccg

SEQ ID NO: 3787195 - RNA, 15 nt, Salmonella typhimurium LT2
cagauagcuuccaug

SEQ ID NO: 3787196 - RNA, 18 nt, Salmonella typhimurium LT2
cagauaggcgaggaagac

SEQ ID NO: 3787197 - RNA, 19 nt, Salmonella typhimurium LT2
cagauaggcggcaaauaaa

SEQ ID NO: 3787198 - RNA, 20 nt, Salmonella typhimurium LT2
cagauaggcggcaaauaaag

SEQ ID NO: 3787199 - RNA, 24 nt, Salmonella typhimurium LT2
cagauaggcggcaaauaaagccag

SEQ ID NO: 3787200 - RNA, 16 nt, Salmonella typhimurium LT2
cagauagggccaggcg

SEQ ID NO: 3787201 - RNA, 21 nt, Salmonella typhimurium LT2
cagauagucguuaaaacggua

SEQ ID NO: 3787202 - RNA, 19 nt, Salmonella typhimurium LT2
cagauagugaucgggcuga

SEQ ID NO: 3787203 - RNA, 17 nt, Salmonella typhimurium LT2
cagauaguuaauaaugg

SEQ ID NO: 3787204 - RNA, 21 nt, Salmonella typhimurium LT2
cagauaguuagcuaucgcgcc

SEQ ID NO: 3787205 - RNA, 13 nt, Salmonella typhimurium LT2
cagauaucgcgua

SEQ ID NO: 3787206 - RNA, 21 nt, Salmonella typhimurium LT2
cagauauugcggaucagcaaa

SEQ ID NO: 3787207 - RNA, 16 nt, Salmonella typhimurium LT2
cagaucaagcgggugu

SEQ ID NO: 3787208 - RNA, 18 nt, Salmonella typhimurium LT2
cagaucagcacgcgccgu

SEQ ID NO: 3787209 - RNA, 22 nt, Salmonella typhimurium LT2
cagaucaugguauucggcgacc

SEQ ID NO: 3787210 - RNA, 14 nt, Salmonella typhimurium LT2
cagauccagcgccg

SEQ ID NO: 3787211 - RNA, 19 nt, Salmonella typhimurium LT2
cagauccagcgccguugcg

SEQ ID NO: 3787212 - RNA, 20 nt, Salmonella typhimurium LT2
cagaucgccaaagucauugc

SEQ ID NO: 3787213 - RNA, 18 nt, Salmonella typhimurium LT2
cagaucgcggcaauggcu

SEQ ID NO: 3787214 - RNA, 19 nt, Salmonella typhimurium LT2
cagaucggcagacaguuuc

SEQ ID NO: 3787215 - RNA, 22 nt, Salmonella typhimurium LT2
cagaucguccauuggcgggcga

SEQ ID NO: 3787216 - RNA, 22 nt, Salmonella typhimurium LT2
cagaucuuauaugagcgggccg

SEQ ID NO: 3787217 - RNA, 16 nt, Salmonella typhimurium LT2
cagaucuucacgcguc

SEQ ID NO: 3787218 - RNA, 15 nt, Salmonella typhimurium LT2
cagaucuucagaggc

SEQ ID NO: 3787219 - RNA, 23 nt, Salmonella typhimurium LT2
cagaugaccaccgauuucaucgc

SEQ ID NO: 3787220 - RNA, 21 nt, Salmonella typhimurium LT2
cagaugcagguucccgcccug

SEQ ID NO: 3787221 - RNA, 24 nt, Salmonella typhimurium LT2
cagaugcccgcagaucugucgcca

SEQ ID NO: 3787222 - RNA, 23 nt, Salmonella typhimurium LT2
cagaugcccguaaagcucgacaa

SEQ ID NO: 3787223 - RNA, 18 nt, Salmonella typhimurium LT2
cagaugcugacucgcgca

SEQ ID NO: 3787224 - RNA, 20 nt, Salmonella typhimurium LT2
cagaugcuuaaugcucugcu

SEQ ID NO: 3787225 - RNA, 18 nt, Salmonella typhimurium LT2
cagauggauaaccugccg

SEQ ID NO: 3787226 - RNA, 18 nt, Salmonella typhimurium LT2
cagauggcaaacgguaaa

SEQ ID NO: 3787227 - RNA, 19 nt, Salmonella typhimurium LT2
cagauggugauagcgcgcc

SEQ ID NO: 3787228 - RNA, 15 nt, Salmonella typhimurium LT2
cagaugucaguaaca

SEQ ID NO: 3787229 - RNA, 17 nt, Salmonella typhimurium LT2
cagaugugguauuuucu

SEQ ID NO: 3787230 - RNA, 20 nt, Salmonella typhimurium LT2
cagauguugagcaaugggaa

SEQ ID NO: 3787231 - RNA, 23 nt, Salmonella typhimurium LT2
cagauguugagcaaugggaagga

SEQ ID NO: 3787232 - RNA, 14 nt, Salmonella typhimurium LT2
cagauguugauaca

SEQ ID NO: 3787233 - RNA, 15 nt, Salmonella typhimurium LT2
cagauguugauacag

SEQ ID NO: 3787234 - RNA, 22 nt, Salmonella typhimurium LT2
cagauuaccggcaauagucucc

SEQ ID NO: 3787235 - RNA, 14 nt, Salmonella typhimurium LT2
cagauuaucggcca

SEQ ID NO: 3787236 - RNA, 17 nt, Salmonella typhimurium LT2
cagauugccacaggacc

SEQ ID NO: 3787237 - RNA, 14 nt, Salmonella typhimurium LT2
cagauugccgauau

SEQ ID NO: 3787238 - RNA, 21 nt, Salmonella typhimurium LT2
cagauugcgaaagaauuacug

SEQ ID NO: 3787239 - RNA, 22 nt, Salmonella typhimurium LT2
cagauuuucauuuagcgccugu

SEQ ID NO: 3787240 - RNA, 15 nt, Salmonella typhimurium LT2
cagauuuuuaauguc

SEQ ID NO: 3787241 - RNA, 22 nt, Salmonella typhimurium LT2
cagauuuuuaauguccagcagu

SEQ ID NO: 3787242 - RNA, 23 nt, Salmonella typhimurium LT2
cagauuuuuaauguccagcagug

SEQ ID NO: 3787243 - RNA, 20 nt, Salmonella typhimurium LT2
cagcaaaaaaugcggcgcau

SEQ ID NO: 3787244 - RNA, 24 nt, Salmonella typhimurium LT2
cagcaaaaagaaucgccaggcgca

SEQ ID NO: 3787245 - RNA, 22 nt, Salmonella typhimurium LT2
cagcaaaaucacgcacacgucu

SEQ ID NO: 3787246 - RNA, 15 nt, Salmonella typhimurium LT2
cagcaaaauggcaau

SEQ ID NO: 3787247 - RNA, 23 nt, Salmonella typhimurium LT2
cagcaaaauuuugcgcagaccgc

SEQ ID NO: 3787248 - RNA, 23 nt, Salmonella typhimurium LT2
cagcaaaccaucggaguccagca

SEQ ID NO: 3787249 - RNA, 13 nt, Salmonella typhimurium LT2
cagcaaacggcau

SEQ ID NO: 3787250 - RNA, 20 nt, Salmonella typhimurium LT2
cagcaaaucgggaaaaugau

SEQ ID NO: 3787251 - RNA, 16 nt, Salmonella typhimurium LT2
cagcaacaaaccgaua

SEQ ID NO: 3787252 - RNA, 18 nt, Salmonella typhimurium LT2
cagcaacacaaucaggcg

SEQ ID NO: 3787253 - RNA, 19 nt, Salmonella typhimurium LT2
cagcaacacuuugcgcugc

SEQ ID NO: 3787254 - RNA, 16 nt, Salmonella typhimurium LT2
cagcaacagaaguuca

SEQ ID NO: 3787255 - RNA, 19 nt, Salmonella typhimurium LT2
cagcaacaucuaucacuuc

SEQ ID NO: 3787256 - RNA, 13 nt, Salmonella typhimurium LT2
cagcaacgcccag

SEQ ID NO: 3787257 - RNA, 17 nt, Salmonella typhimurium LT2
cagcaacgccuccagcg

SEQ ID NO: 3787258 - RNA, 14 nt, Salmonella typhimurium LT2
cagcaacggcugau

SEQ ID NO: 3787259 - RNA, 24 nt, Salmonella typhimurium LT2
cagcaacgugaacugcgccugcau

SEQ ID NO: 3787260 - RNA, 21 nt, Salmonella typhimurium LT2
cagcaacguuuguaacagcag

SEQ ID NO: 3787261 - RNA, 21 nt, Salmonella typhimurium LT2
cagcaacugaccaucuucguu

SEQ ID NO: 3787262 - RNA, 18 nt, Salmonella typhimurium LT2
cagcaacugcgcgcgggu

SEQ ID NO: 3787263 - RNA, 14 nt, Salmonella typhimurium LT2
cagcaagaagagaa

SEQ ID NO: 3787264 - RNA, 16 nt, Salmonella typhimurium LT2
cagcaagacucgcgcc

SEQ ID NO: 3787265 - RNA, 19 nt, Salmonella typhimurium LT2
cagcaaggcggcggugaua

SEQ ID NO: 3787266 - RNA, 17 nt, Salmonella typhimurium LT2
cagcaaggcugccgcca

SEQ ID NO: 3787267 - RNA, 23 nt, Salmonella typhimurium LT2
cagcaagucgcgggcgcuaaacc

SEQ ID NO: 3787268 - RNA, 15 nt, Salmonella typhimurium LT2
cagcaauaaaaggaa

SEQ ID NO: 3787269 - RNA, 22 nt, Salmonella typhimurium LT2
cagcaauaacacaggcggcgcu

SEQ ID NO: 3787270 - RNA, 18 nt, Salmonella typhimurium LT2
cagcaauaacaggcacag

SEQ ID NO: 3787271 - RNA, 19 nt, Salmonella typhimurium LT2
cagcaauaacaggcacagu

SEQ ID NO: 3787272 - RNA, 13 nt, Salmonella typhimurium LT2
cagcaauacccag

SEQ ID NO: 3787273 - RNA, 13 nt, Salmonella typhimurium LT2
cagcaauacgccc

SEQ ID NO: 3787274 - RNA, 18 nt, Salmonella typhimurium LT2
cagcaaugagacaacggc

SEQ ID NO: 3787275 - RNA, 20 nt, Salmonella typhimurium LT2
cagcaaugauaacggcgcca

SEQ ID NO: 3787276 - RNA, 17 nt, Salmonella typhimurium LT2
cagcaaugccgccgcca

SEQ ID NO: 3787277 - RNA, 20 nt, Salmonella typhimurium LT2
cagcaaugccgccgccaggu

SEQ ID NO: 3787278 - RNA, 23 nt, Salmonella typhimurium LT2
cagcaauggacaaguaaaccggu

SEQ ID NO: 3787279 - RNA, 14 nt, Salmonella typhimurium LT2
cagcaauuccgcca

SEQ ID NO: 3787280 - RNA, 14 nt, Salmonella typhimurium LT2
cagcauccagcuca

SEQ ID NO: 3787281 - RNA, 15 nt, Salmonella typhimurium LT2
cagcauccugcguuc

SEQ ID NO: 3787282 - RNA, 19 nt, Salmonella typhimurium LT2
cagcaucgccaucaacucc

SEQ ID NO: 3787283 - RNA, 14 nt, Salmonella typhimurium LT2
cagcaucgcccggg

SEQ ID NO: 3787284 - RNA, 16 nt, Salmonella typhimurium LT2
cagcaucgccgguagc

SEQ ID NO: 3787285 - RNA, 15 nt, Salmonella typhimurium LT2
cagcaucuaauuaaa

SEQ ID NO: 3787286 - RNA, 17 nt, Salmonella typhimurium LT2
cagcaucuuaugcgcaa

SEQ ID NO: 3787287 - RNA, 17 nt, Salmonella typhimurium LT2
cagcaucuuuggcuuua

SEQ ID NO: 3787288 - RNA, 21 nt, Salmonella typhimurium LT2
cagcaugaauaaccucccgcc

SEQ ID NO: 3787289 - RNA, 16 nt, Salmonella typhimurium LT2
cagcaugagccagccc

SEQ ID NO: 3787290 - RNA, 19 nt, Salmonella typhimurium LT2
cagcaugguguguucccgc

SEQ ID NO: 3787291 - RNA, 17 nt, Salmonella typhimurium LT2
cagcauuaacccggccc

SEQ ID NO: 3787292 - RNA, 13 nt, Salmonella typhimurium LT2
cagcauuaagauc

SEQ ID NO: 3787293 - RNA, 22 nt, Salmonella typhimurium LT2
cagcauuaccagcaauaacagg

SEQ ID NO: 3787294 - RNA, 14 nt, Salmonella typhimurium LT2
cagcauuacccccg

SEQ ID NO: 3787295 - RNA, 17 nt, Salmonella typhimurium LT2
cagcauuacccccgcca

SEQ ID NO: 3787296 - RNA, 20 nt, Salmonella typhimurium LT2
cagcauugagcaacccuaaa

SEQ ID NO: 3787297 - RNA, 14 nt, Salmonella typhimurium LT2
cagcauugaggcua

SEQ ID NO: 3787298 - RNA, 19 nt, Salmonella typhimurium LT2
cagcauugaggcuacccag

SEQ ID NO: 3787299 - RNA, 21 nt, Salmonella typhimurium LT2
cagcauugaggcuacccagac

SEQ ID NO: 3787300 - RNA, 17 nt, Salmonella typhimurium LT2
cagcauugggccgauaa

SEQ ID NO: 3787301 - RNA, 19 nt, Salmonella typhimurium LT2
cagcauugggucaugcgga

SEQ ID NO: 3787302 - RNA, 20 nt, Salmonella typhimurium LT2
cagcauuuccgccgccuucu

SEQ ID NO: 3787303 - RNA, 23 nt, Salmonella typhimurium LT2
cagcauuucggcguguaacugca

SEQ ID NO: 3787304 - RNA, 13 nt, Salmonella typhimurium LT2
cagcauuucuuca

SEQ ID NO: 3787305 - RNA, 21 nt, Salmonella typhimurium LT2
cagccaaaaauaacgcccugc

SEQ ID NO: 3787306 - RNA, 22 nt, Salmonella typhimurium LT2
cagccaaaaauaacgcccugcg

SEQ ID NO: 3787307 - RNA, 15 nt, Salmonella typhimurium LT2
cagccaaaacgucgu

SEQ ID NO: 3787308 - RNA, 17 nt, Salmonella typhimurium LT2
cagccaaaauaugcugg

SEQ ID NO: 3787309 - RNA, 12 nt, Salmonella typhimurium LT2
cagccaaacagu

SEQ ID NO: 3787310 - RNA, 13 nt, Salmonella typhimurium LT2
cagccaaacugcu

SEQ ID NO: 3787311 - RNA, 16 nt, Salmonella typhimurium LT2
cagccaacaaagaggc

SEQ ID NO: 3787312 - RNA, 21 nt, Salmonella typhimurium LT2
cagccaacaaagaggcugcgc

SEQ ID NO: 3787313 - RNA, 21 nt, Salmonella typhimurium LT2
cagccaaucauaaacgccuga

SEQ ID NO: 3787314 - RNA, 19 nt, Salmonella typhimurium LT2
cagccacaagagcagcaac

SEQ ID NO: 3787315 - RNA, 15 nt, Salmonella typhimurium LT2
cagccacacacuguu

SEQ ID NO: 3787316 - RNA, 18 nt, Salmonella typhimurium LT2
cagccacacugcuguguc

SEQ ID NO: 3787317 - RNA, 15 nt, Salmonella typhimurium LT2
cagccaccaugcaaa

SEQ ID NO: 3787318 - RNA, 18 nt, Salmonella typhimurium LT2
cagccacggaauaucuuu

SEQ ID NO: 3787319 - RNA, 16 nt, Salmonella typhimurium LT2
cagccacggcgcacac

SEQ ID NO: 3787320 - RNA, 19 nt, Salmonella typhimurium LT2
cagccacguaaagacgacg

SEQ ID NO: 3787321 - RNA, 14 nt, Salmonella typhimurium LT2
cagccacucccgau

SEQ ID NO: 3787322 - RNA, 20 nt, Salmonella typhimurium LT2
cagccacuggcuggucagcg

SEQ ID NO: 3787323 - RNA, 15 nt, Salmonella typhimurium LT2
cagccacuucuucca

SEQ ID NO: 3787324 - RNA, 20 nt, Salmonella typhimurium LT2
cagccacuucuuccagcggc

SEQ ID NO: 3787325 - RNA, 13 nt, Salmonella typhimurium LT2
cagccagaaaaag

SEQ ID NO: 3787326 - RNA, 20 nt, Salmonella typhimurium LT2
cagccagaaacgguccuggu

SEQ ID NO: 3787327 - RNA, 20 nt, Salmonella typhimurium LT2
cagccagaacguaauggcau

SEQ ID NO: 3787328 - RNA, 16 nt, Salmonella typhimurium LT2
cagccagaacucaucu

SEQ ID NO: 3787329 - RNA, 16 nt, Salmonella typhimurium LT2
cagccagaagcccggg

SEQ ID NO: 3787330 - RNA, 17 nt, Salmonella typhimurium LT2
cagccagacggcgccca

SEQ ID NO: 3787331 - RNA, 22 nt, Salmonella typhimurium LT2
cagccagagauccacauuggcu

SEQ ID NO: 3787332 - RNA, 12 nt, Salmonella typhimurium LT2
cagccagcagcu

SEQ ID NO: 3787333 - RNA, 20 nt, Salmonella typhimurium LT2
cagccagcagcucaacggca

SEQ ID NO: 3787334 - RNA, 14 nt, Salmonella typhimurium LT2
cagccagcccagcg

SEQ ID NO: 3787335 - RNA, 14 nt, Salmonella typhimurium LT2
cagccagccggaga

SEQ ID NO: 3787336 - RNA, 12 nt, Salmonella typhimurium LT2
cagccagcgcca

SEQ ID NO: 3787337 - RNA, 19 nt, Salmonella typhimurium LT2
cagccagcgccccugcggg

SEQ ID NO: 3787338 - RNA, 20 nt, Salmonella typhimurium LT2
cagccagcguuucuggaagu

SEQ ID NO: 3787339 - RNA, 17 nt, Salmonella typhimurium LT2
cagccagcucaccagcc

SEQ ID NO: 3787340 - RNA, 14 nt, Salmonella typhimurium LT2
cagccagcugcugg

SEQ ID NO: 3787341 - RNA, 17 nt, Salmonella typhimurium LT2
cagccaggaauauacca

SEQ ID NO: 3787342 - RNA, 17 nt, Salmonella typhimurium LT2
cagccaggcggcaaagu

SEQ ID NO: 3787343 - RNA, 19 nt, Salmonella typhimurium LT2
cagccagggaacuccagca

SEQ ID NO: 3787344 - RNA, 21 nt, Salmonella typhimurium LT2
cagccagguauuuagccacgc

SEQ ID NO: 3787345 - RNA, 19 nt, Salmonella typhimurium LT2
cagccaguccuccggcuga

SEQ ID NO: 3787346 - RNA, 23 nt, Salmonella typhimurium LT2
cagccaguccuccggcugaagcc

SEQ ID NO: 3787347 - RNA, 16 nt, Salmonella typhimurium LT2
cagccagucgccaggc

SEQ ID NO: 3787348 - RNA, 23 nt, Salmonella typhimurium LT2
cagccagucgccaggcaagguua

SEQ ID NO: 3787349 - RNA, 16 nt, Salmonella typhimurium LT2
cagccauaaaugcuga

SEQ ID NO: 3787350 - RNA, 22 nt, Salmonella typhimurium LT2
cagccauaaucaguacugcgcc

SEQ ID NO: 3787351 - RNA, 23 nt, Salmonella typhimurium LT2
cagccauaaucaguacugcgccc

SEQ ID NO: 3787352 - RNA, 15 nt, Salmonella typhimurium LT2
cagccauaccggcgc

SEQ ID NO: 3787353 - RNA, 21 nt, Salmonella typhimurium LT2
cagccauaccggcgcgcgcca

SEQ ID NO: 3787354 - RNA, 13 nt, Salmonella typhimurium LT2
cagccauccugca

SEQ ID NO: 3787355 - RNA, 13 nt, Salmonella typhimurium LT2
cagccaugccagc

SEQ ID NO: 3787356 - RNA, 22 nt, Salmonella typhimurium LT2
cagccauggcccaaaagguagc

SEQ ID NO: 3787357 - RNA, 15 nt, Salmonella typhimurium LT2
cagccauucgccacu

SEQ ID NO: 3787358 - RNA, 23 nt, Salmonella typhimurium LT2
cagccauucggguaauucaaucu

SEQ ID NO: 3787359 - RNA, 20 nt, Salmonella typhimurium LT2
cagcccaaaacgcgccaggu

SEQ ID NO: 3787360 - RNA, 17 nt, Salmonella typhimurium LT2
cagcccaucuuucgcca

SEQ ID NO: 3787361 - RNA, 12 nt, Salmonella typhimurium LT2
cagcccaugaau

SEQ ID NO: 3787362 - RNA, 16 nt, Salmonella typhimurium LT2
cagccccacauuggaa

SEQ ID NO: 3787363 - RNA, 17 nt, Salmonella typhimurium LT2
cagccccagcaccagag

SEQ ID NO: 3787364 - RNA, 17 nt, Salmonella typhimurium LT2
cagccccagcgccagcc

SEQ ID NO: 3787365 - RNA, 18 nt, Salmonella typhimurium LT2
cagccccagcgccagccg

SEQ ID NO: 3787366 - RNA, 17 nt, Salmonella typhimurium LT2
cagccccagcgccagcu

SEQ ID NO: 3787367 - RNA, 17 nt, Salmonella typhimurium LT2
cagcccgauacccgccc

SEQ ID NO: 3787368 - RNA, 16 nt, Salmonella typhimurium LT2
cagcccgaucaucucc

SEQ ID NO: 3787369 - RNA, 19 nt, Salmonella typhimurium LT2
cagcccgaucaucuccugu

SEQ ID NO: 3787370 - RNA, 22 nt, Salmonella typhimurium LT2
cagcccgaucggcuggcauuuu

SEQ ID NO: 3787371 - RNA, 17 nt, Salmonella typhimurium LT2
cagcccgccagcaccag

SEQ ID NO: 3787372 - RNA, 20 nt, Salmonella typhimurium LT2
cagcccgccagcaccaggcu

SEQ ID NO: 3787373 - RNA, 12 nt, Salmonella typhimurium LT2
cagcccgcgaac

SEQ ID NO: 3787374 - RNA, 19 nt, Salmonella typhimurium LT2
cagcccgcgaacgccaggc

SEQ ID NO: 3787375 - RNA, 17 nt, Salmonella typhimurium LT2
cagcccgcucguuucaa

SEQ ID NO: 3787376 - RNA, 21 nt, Salmonella typhimurium LT2
cagcccggcgcacacccugca

SEQ ID NO: 3787377 - RNA, 22 nt, Salmonella typhimurium LT2
cagcccgugaucggagaaauag

SEQ ID NO: 3787378 - RNA, 19 nt, Salmonella typhimurium LT2
cagcccguucucgccgcgu

SEQ ID NO: 3787379 - RNA, 21 nt, Salmonella typhimurium LT2
cagcccguucugugcgccgcu

SEQ ID NO: 3787380 - RNA, 23 nt, Salmonella typhimurium LT2
cagcccuaaauggagcgagcugg

SEQ ID NO: 3787381 - RNA, 12 nt, Salmonella typhimurium LT2
cagcccuggcug

SEQ ID NO: 3787382 - RNA, 15 nt, Salmonella typhimurium LT2
cagcccugugccgcu

SEQ ID NO: 3787383 - RNA, 20 nt, Salmonella typhimurium LT2
cagcccugugccgcuggugc

SEQ ID NO: 3787384 - RNA, 12 nt, Salmonella typhimurium LT2
cagcgccaauac

SEQ ID NO: 3787385 - RNA, 13 nt, Salmonella typhimurium LT2
cagcgccaccaca

SEQ ID NO: 3787386 - RNA, 16 nt, Salmonella typhimurium LT2
cagcgccaccacaaac

SEQ ID NO: 3787387 - RNA, 21 nt, Salmonella typhimurium LT2
cagcgccaccacaaacgccgu

SEQ ID NO: 3787388 - RNA, 11 nt, Salmonella typhimurium LT2
cagcgccaccg

SEQ ID NO: 3787389 - RNA, 21 nt, Salmonella typhimurium LT2
cagcgccacggagcauaauuu

SEQ ID NO: 3787390 - RNA, 16 nt, Salmonella typhimurium LT2
cagcgccagaaacugu

SEQ ID NO: 3787391 - RNA, 17 nt, Salmonella typhimurium LT2
cagcgccagauagucac

SEQ ID NO: 3787392 - RNA, 18 nt, Salmonella typhimurium LT2
cagcgccagcagcagugc

SEQ ID NO: 3787393 - RNA, 13 nt, Salmonella typhimurium LT2
cagcgccagcccu

SEQ ID NO: 3787394 - RNA, 14 nt, Salmonella typhimurium LT2
cagcgccagcccug

SEQ ID NO: 3787395 - RNA, 15 nt, Salmonella typhimurium LT2
cagcgccagcccugc

SEQ ID NO: 3787396 - RNA, 16 nt, Salmonella typhimurium LT2
cagcgccagcccugcg

SEQ ID NO: 3787397 - RNA, 13 nt, Salmonella typhimurium LT2
cagcgccagccgc

SEQ ID NO: 3787398 - RNA, 15 nt, Salmonella typhimurium LT2
cagcgccagccgcgc

SEQ ID NO: 3787399 - RNA, 14 nt, Salmonella typhimurium LT2
cagcgccagcgacu

SEQ ID NO: 3787400 - RNA, 15 nt, Salmonella typhimurium LT2
cagcgccagcgacug

SEQ ID NO: 3787401 - RNA, 23 nt, Salmonella typhimurium LT2
cagcgccagcugcgucaugucgu

SEQ ID NO: 3787402 - RNA, 22 nt, Salmonella typhimurium LT2
cagcgccauauaaauuucaucc

SEQ ID NO: 3787403 - RNA, 22 nt, Salmonella typhimurium LT2
cagcgccauccacggccccggg

SEQ ID NO: 3787404 - RNA, 23 nt, Salmonella typhimurium LT2
cagcgccauccacggccccgggc

SEQ ID NO: 3787405 - RNA, 17 nt, Salmonella typhimurium LT2
cagcgccauccggcaaa

SEQ ID NO: 3787406 - RNA, 16 nt, Salmonella typhimurium LT2
cagcgccauccggcac

SEQ ID NO: 3787407 - RNA, 15 nt, Salmonella typhimurium LT2
cagcgcccagcagcu

SEQ ID NO: 3787408 - RNA, 22 nt, Salmonella typhimurium LT2
cagcgcccccagcaaaccggca

SEQ ID NO: 3787409 - RNA, 17 nt, Salmonella typhimurium LT2
cagcgcccccaguuccu

SEQ ID NO: 3787410 - RNA, 11 nt, Salmonella typhimurium LT2
cagcgccgccu

SEQ ID NO: 3787411 - RNA, 23 nt, Salmonella typhimurium LT2
cagcgccgcgacaagcaguaugc

SEQ ID NO: 3787412 - RNA, 14 nt, Salmonella typhimurium LT2
cagcgccgcgcagg

SEQ ID NO: 3787413 - RNA, 14 nt, Salmonella typhimurium LT2
cagcgccgcgccgu

SEQ ID NO: 3787414 - RNA, 16 nt, Salmonella typhimurium LT2
cagcgccgcgggcugg

SEQ ID NO: 3787415 - RNA, 20 nt, Salmonella typhimurium LT2
cagcgccggaaaaccgguca

SEQ ID NO: 3787416 - RNA, 12 nt, Salmonella typhimurium LT2
cagcgccggaau

SEQ ID NO: 3787417 - RNA, 11 nt, Salmonella typhimurium LT2
cagcgccggac

SEQ ID NO: 3787418 - RNA, 21 nt, Salmonella typhimurium LT2
cagcgccggaucgggcuucca

SEQ ID NO: 3787419 - RNA, 13 nt, Salmonella typhimurium LT2
cagcgccggcaac

SEQ ID NO: 3787420 - RNA, 22 nt, Salmonella typhimurium LT2
cagcgccuccgcguagcccagc

SEQ ID NO: 3787421 - RNA, 19 nt, Salmonella typhimurium LT2
cagcgccucggcgcccagc

SEQ ID NO: 3787422 - RNA, 20 nt, Salmonella typhimurium LT2
cagcgcgaauuugccccaga

SEQ ID NO: 3787423 - RNA, 14 nt, Salmonella typhimurium LT2
cagcgcgacauaga

SEQ ID NO: 3787424 - RNA, 21 nt, Salmonella typhimurium LT2
cagcgcgacauggcccauuuc

SEQ ID NO: 3787425 - RNA, 17 nt, Salmonella typhimurium LT2
cagcgcgaccagcguga

SEQ ID NO: 3787426 - RNA, 14 nt, Salmonella typhimurium LT2
cagcgcgaccugca

SEQ ID NO: 3787427 - RNA, 21 nt, Salmonella typhimurium LT2
cagcgcgccaauggccgcccc

SEQ ID NO: 3787428 - RNA, 16 nt, Salmonella typhimurium LT2
cagcgcgccagcgcca

SEQ ID NO: 3787429 - RNA, 19 nt, Salmonella typhimurium LT2
cagcgcgccagcgccaaua

SEQ ID NO: 3787430 - RNA, 19 nt, Salmonella typhimurium LT2
cagcgcgcccgccaccagc

SEQ ID NO: 3787431 - RNA, 13 nt, Salmonella typhimurium LT2
cagcgcgccgcag

SEQ ID NO: 3787432 - RNA, 14 nt, Salmonella typhimurium LT2
cagcgcgccgccaa

SEQ ID NO: 3787433 - RNA, 18 nt, Salmonella typhimurium LT2
cagcgcgccgccaacgcc

SEQ ID NO: 3787434 - RNA, 18 nt, Salmonella typhimurium LT2
cagcgcgcgacccagcgc

SEQ ID NO: 3787435 - RNA, 19 nt, Salmonella typhimurium LT2
cagcgcgcgacccagcgca

SEQ ID NO: 3787436 - RNA, 13 nt, Salmonella typhimurium LT2
cagcgcgcgcagg

SEQ ID NO: 3787437 - RNA, 14 nt, Salmonella typhimurium LT2
cagcgcgcgcaggg

SEQ ID NO: 3787438 - RNA, 12 nt, Salmonella typhimurium LT2
cagcgcgcggcu

SEQ ID NO: 3787439 - RNA, 13 nt, Salmonella typhimurium LT2
cagcgcgcguaac

SEQ ID NO: 3787440 - RNA, 13 nt, Salmonella typhimurium LT2
cagcgcgcguggg

SEQ ID NO: 3787441 - RNA, 15 nt, Salmonella typhimurium LT2
cagcgcgcugucuuu

SEQ ID NO: 3787442 - RNA, 20 nt, Salmonella typhimurium LT2
cagcgcggaaggaccgucgc

SEQ ID NO: 3787443 - RNA, 14 nt, Salmonella typhimurium LT2
cagcgcggcaagga

SEQ ID NO: 3787444 - RNA, 15 nt, Salmonella typhimurium LT2
cagcgcggcacacag

SEQ ID NO: 3787445 - RNA, 13 nt, Salmonella typhimurium LT2
cagcgcggcagcc

SEQ ID NO: 3787446 - RNA, 15 nt, Salmonella typhimurium LT2
cagcgcgguacggcc

SEQ ID NO: 3787447 - RNA, 20 nt, Salmonella typhimurium LT2
cagcgcguccaauagccccu

SEQ ID NO: 3787448 - RNA, 21 nt, Salmonella typhimurium LT2
cagcgcguccuccagcgugca

SEQ ID NO: 3787449 - RNA, 16 nt, Salmonella typhimurium LT2
cagcgcgucgaccaua

SEQ ID NO: 3787450 - RNA, 15 nt, Salmonella typhimurium LT2
cagcgcgucggccgg

SEQ ID NO: 3787451 - RNA, 18 nt, Salmonella typhimurium LT2
cagcgcgucggccggcac

SEQ ID NO: 3787452 - RNA, 19 nt, Salmonella typhimurium LT2
cagcgcgucggccggcacc

SEQ ID NO: 3787453 - RNA, 17 nt, Salmonella typhimurium LT2
cagcgcuaucaggaaga

SEQ ID NO: 3787454 - RNA, 15 nt, Salmonella typhimurium LT2
cagcgcuauccggcc

SEQ ID NO: 3787455 - RNA, 18 nt, Salmonella typhimurium LT2
cagcgcuccaccaaccag

SEQ ID NO: 3787456 - RNA, 23 nt, Salmonella typhimurium LT2
cagcgcuccaccaaccaggcaaa

SEQ ID NO: 3787457 - RNA, 22 nt, Salmonella typhimurium LT2
cagcgcugcuguaacagacgca

SEQ ID NO: 3787458 - RNA, 15 nt, Salmonella typhimurium LT2
cagcgcuggcuguuc

SEQ ID NO: 3787459 - RNA, 21 nt, Salmonella typhimurium LT2
cagcgcugucgccaucaccag

SEQ ID NO: 3787460 - RNA, 14 nt, Salmonella typhimurium LT2
cagcgcuuagcggc

SEQ ID NO: 3787461 - RNA, 15 nt, Salmonella typhimurium LT2
cagcgcuuagcggca

SEQ ID NO: 3787462 - RNA, 23 nt, Salmonella typhimurium LT2
cagcgcuucucuuuccaguuggc

SEQ ID NO: 3787463 - RNA, 20 nt, Salmonella typhimurium LT2
cagcgcuuucaccgcgucgu

SEQ ID NO: 3787464 - RNA, 15 nt, Salmonella typhimurium LT2
cagcgcuuugccgcu

SEQ ID NO: 3787465 - RNA, 20 nt, Salmonella typhimurium LT2
cagcgcuuuugccgcgccca

SEQ ID NO: 3787466 - RNA, 20 nt, Salmonella typhimurium LT2
cagcggaaucgcuuccuggg

SEQ ID NO: 3787467 - RNA, 20 nt, Salmonella typhimurium LT2
cagcggacacccgcagccgg

SEQ ID NO: 3787468 - RNA, 18 nt, Salmonella typhimurium LT2
cagcggagagacauuggu

SEQ ID NO: 3787469 - RNA, 22 nt, Salmonella typhimurium LT2
cagcggagaguugaaaccgcgc

SEQ ID NO: 3787470 - RNA, 20 nt, Salmonella typhimurium LT2
cagcggagaucgcuuuccag

SEQ ID NO: 3787471 - RNA, 22 nt, Salmonella typhimurium LT2
cagcggaugguauuucaggcca

SEQ ID NO: 3787472 - RNA, 17 nt, Salmonella typhimurium LT2
cagcggcagcucgugca

SEQ ID NO: 3787473 - RNA, 24 nt, Salmonella typhimurium LT2
cagcggcauuggcguuaccggcag

SEQ ID NO: 3787474 - RNA, 16 nt, Salmonella typhimurium LT2
cagcggccacagccag

SEQ ID NO: 3787475 - RNA, 17 nt, Salmonella typhimurium LT2
cagcggccauugaaguc

SEQ ID NO: 3787476 - RNA, 13 nt, Salmonella typhimurium LT2
cagcggcgcaggg

SEQ ID NO: 3787477 - RNA, 18 nt, Salmonella typhimurium LT2
cagcggcgccaucaccau

SEQ ID NO: 3787478 - RNA, 14 nt, Salmonella typhimurium LT2
cagcggcggcagua

SEQ ID NO: 3787479 - RNA, 19 nt, Salmonella typhimurium LT2
cagcggcgguuauccgcca

SEQ ID NO: 3787480 - RNA, 16 nt, Salmonella typhimurium LT2
cagcggcgucccggca

SEQ ID NO: 3787481 - RNA, 22 nt, Salmonella typhimurium LT2
cagcggcugcaaagcaucugcc

SEQ ID NO: 3787482 - RNA, 12 nt, Salmonella typhimurium LT2
cagcgggaacau

SEQ ID NO: 3787483 - RNA, 14 nt, Salmonella typhimurium LT2
cagcgggccaaaaa

SEQ ID NO: 3787484 - RNA, 14 nt, Salmonella typhimurium LT2
cagcgggguucgga

SEQ ID NO: 3787485 - RNA, 16 nt, Salmonella typhimurium LT2
cagcgguagccagcgc

SEQ ID NO: 3787486 - RNA, 18 nt, Salmonella typhimurium LT2
cagcgguccaaagauaaa

SEQ ID NO: 3787487 - RNA, 14 nt, Salmonella typhimurium LT2
cagcggugcgcggu

SEQ ID NO: 3787488 - RNA, 18 nt, Salmonella typhimurium LT2
caggaacaugacggcagu

SEQ ID NO: 3787489 - RNA, 22 nt, Salmonella typhimurium LT2
caggaacaugacggcagucgcu

SEQ ID NO: 3787490 - RNA, 19 nt, Salmonella typhimurium LT2
caggaaccguccggguucu

SEQ ID NO: 3787491 - RNA, 17 nt, Salmonella typhimurium LT2
caggaacgcggcgccga

SEQ ID NO: 3787492 - RNA, 14 nt, Salmonella typhimurium LT2
caggaacugcucca

SEQ ID NO: 3787493 - RNA, 16 nt, Salmonella typhimurium LT2
caggaagaaagacgcg

SEQ ID NO: 3787494 - RNA, 20 nt, Salmonella typhimurium LT2
caggaagaacacgccgccua

SEQ ID NO: 3787495 - RNA, 15 nt, Salmonella typhimurium LT2
caggaagaguaucuc

SEQ ID NO: 3787496 - RNA, 13 nt, Salmonella typhimurium LT2
caggaagcggcug

SEQ ID NO: 3787497 - RNA, 18 nt, Salmonella typhimurium LT2
caggaagcggcuggguuc

SEQ ID NO: 3787498 - RNA, 18 nt, Salmonella typhimurium LT2
caggaaggggaaaagggu

SEQ ID NO: 3787499 - RNA, 15 nt, Salmonella typhimurium LT2
caggaauaaagguca

SEQ ID NO: 3787500 - RNA, 20 nt, Salmonella typhimurium LT2
caggaauaacaucguaaauc

SEQ ID NO: 3787501 - RNA, 22 nt, Salmonella typhimurium LT2
caggaaucgaaccugcaacuag

SEQ ID NO: 3787502 - RNA, 12 nt, Salmonella typhimurium LT2
caggacagcgac

SEQ ID NO: 3787503 - RNA, 21 nt, Salmonella typhimurium LT2
caggacguugccgcccaccug

SEQ ID NO: 3787504 - RNA, 13 nt, Salmonella typhimurium LT2
caggacugacugc

SEQ ID NO: 3787505 - RNA, 18 nt, Salmonella typhimurium LT2
caggagcaaaccgaccca

SEQ ID NO: 3787506 - RNA, 22 nt, Salmonella typhimurium LT2
caggagcgccguggaaaagagc

SEQ ID NO: 3787507 - RNA, 15 nt, Salmonella typhimurium LT2
caggaguaaauaaca

SEQ ID NO: 3787508 - RNA, 20 nt, Salmonella typhimurium LT2
caggaguugccuugccucac

SEQ ID NO: 3787509 - RNA, 12 nt, Salmonella typhimurium LT2
caggauaaagac

SEQ ID NO: 3787510 - RNA, 19 nt, Salmonella typhimurium LT2
caggauaaagaccggcaca

SEQ ID NO: 3787511 - RNA, 16 nt, Salmonella typhimurium LT2
caggauacagccgaag

SEQ ID NO: 3787512 - RNA, 19 nt, Salmonella typhimurium LT2
caggauacguucaucuucc

SEQ ID NO: 3787513 - RNA, 18 nt, Salmonella typhimurium LT2
caggauauacuucaucag

SEQ ID NO: 3787514 - RNA, 14 nt, Salmonella typhimurium LT2
caggaucaccggca

SEQ ID NO: 3787515 - RNA, 15 nt, Salmonella typhimurium LT2
caggaucggaagcga

SEQ ID NO: 3787516 - RNA, 21 nt, Salmonella typhimurium LT2
caggaucgggaucagcgcgcu

SEQ ID NO: 3787517 - RNA, 22 nt, Salmonella typhimurium LT2
caggaucgguaaacgccccuuc

SEQ ID NO: 3787518 - RNA, 23 nt, Salmonella typhimurium LT2
caggaucgguaaacgccccuucg

SEQ ID NO: 3787519 - RNA, 14 nt, Salmonella typhimurium LT2
caggaucuucaucc

SEQ ID NO: 3787520 - RNA, 16 nt, Salmonella typhimurium LT2
caggaugaaugacugu

SEQ ID NO: 3787521 - RNA, 18 nt, Salmonella typhimurium LT2
caggaugaaugacugucc

SEQ ID NO: 3787522 - RNA, 14 nt, Salmonella typhimurium LT2
caggaugccaacca

SEQ ID NO: 3787523 - RNA, 22 nt, Salmonella typhimurium LT2
caggauguaagacagcgcgccc

SEQ ID NO: 3787524 - RNA, 20 nt, Salmonella typhimurium LT2
caggauguccgguugcauug

SEQ ID NO: 3787525 - RNA, 18 nt, Salmonella typhimurium LT2
caggauuauuacagacag

SEQ ID NO: 3787526 - RNA, 17 nt, Salmonella typhimurium LT2
caggauucgaaccugcg

SEQ ID NO: 3787527 - RNA, 19 nt, Salmonella typhimurium LT2
caggcaaaaaaaaccggca

SEQ ID NO: 3787528 - RNA, 18 nt, Salmonella typhimurium LT2
caggcaaaaggccuuuuu

SEQ ID NO: 3787529 - RNA, 15 nt, Salmonella typhimurium LT2
caggcaaaccagcac

SEQ ID NO: 3787530 - RNA, 16 nt, Salmonella typhimurium LT2
caggcaaaggaaugcu

SEQ ID NO: 3787531 - RNA, 21 nt, Salmonella typhimurium LT2
caggcaaaggaaugcuuuaca

SEQ ID NO: 3787532 - RNA, 17 nt, Salmonella typhimurium LT2
caggcaaaucuggugau

SEQ ID NO: 3787533 - RNA, 20 nt, Salmonella typhimurium LT2
caggcaaccugucaguaccu

SEQ ID NO: 3787534 - RNA, 22 nt, Salmonella typhimurium LT2
caggcaagacacagcgucgcgc

SEQ ID NO: 3787535 - RNA, 17 nt, Salmonella typhimurium LT2
caggcaagacgcaugac

SEQ ID NO: 3787536 - RNA, 16 nt, Salmonella typhimurium LT2
caggcaaggcaucagg

SEQ ID NO: 3787537 - RNA, 20 nt, Salmonella typhimurium LT2
caggcaauaaacaucagcca

SEQ ID NO: 3787538 - RNA, 14 nt, Salmonella typhimurium LT2
caggcaauacuucg

SEQ ID NO: 3787539 - RNA, 19 nt, Salmonella typhimurium LT2
caggcaaucagcagccggg

SEQ ID NO: 3787540 - RNA, 14 nt, Salmonella typhimurium LT2
caggcaaucggcca

SEQ ID NO: 3787541 - RNA, 15 nt, Salmonella typhimurium LT2
caggcaauuuaucgu

SEQ ID NO: 3787542 - RNA, 18 nt, Salmonella typhimurium LT2
caggcacagaagcgccug

SEQ ID NO: 3787543 - RNA, 19 nt, Salmonella typhimurium LT2
caggcacagaagcgccugu

SEQ ID NO: 3787544 - RNA, 13 nt, Salmonella typhimurium LT2
caggcacgccugu

SEQ ID NO: 3787545 - RNA, 16 nt, Salmonella typhimurium LT2
caggcacgccugugcu

SEQ ID NO: 3787546 - RNA, 20 nt, Salmonella typhimurium LT2
caggcacgggugccuguucu

SEQ ID NO: 3787547 - RNA, 15 nt, Salmonella typhimurium LT2
caggcacgugcauaa

SEQ ID NO: 3787548 - RNA, 15 nt, Salmonella typhimurium LT2
caggcacucaaccug

SEQ ID NO: 3787549 - RNA, 14 nt, Salmonella typhimurium LT2
caggcacuugagaa

SEQ ID NO: 3787550 - RNA, 13 nt, Salmonella typhimurium LT2
caggcagaacgcu

SEQ ID NO: 3787551 - RNA, 13 nt, Salmonella typhimurium LT2
caggcagccacaa

SEQ ID NO: 3787552 - RNA, 20 nt, Salmonella typhimurium LT2
caggcagccggauuuuaaau

SEQ ID NO: 3787553 - RNA, 14 nt, Salmonella typhimurium LT2
caggcagcguaaua

SEQ ID NO: 3787554 - RNA, 22 nt, Salmonella typhimurium LT2
caggcagcguaauacaggcgau

SEQ ID NO: 3787555 - RNA, 18 nt, Salmonella typhimurium LT2
caggcauaaaaaagagga

SEQ ID NO: 3787556 - RNA, 16 nt, Salmonella typhimurium LT2
caggcauaauggaacu

SEQ ID NO: 3787557 - RNA, 21 nt, Salmonella typhimurium LT2
caggcauaauggaacugccug

SEQ ID NO: 3787558 - RNA, 17 nt, Salmonella typhimurium LT2
caggcauccgugaccug

SEQ ID NO: 3787559 - RNA, 19 nt, Salmonella typhimurium LT2
caggcauccgugaccugcu

SEQ ID NO: 3787560 - RNA, 16 nt, Salmonella typhimurium LT2
caggcaucgacgccag

SEQ ID NO: 3787561 - RNA, 22 nt, Salmonella typhimurium LT2
caggcaugaccugccggauggc

SEQ ID NO: 3787562 - RNA, 23 nt, Salmonella typhimurium LT2
caggcaugcagcucaagcgccgc

SEQ ID NO: 3787563 - RNA, 17 nt, Salmonella typhimurium LT2
caggcauggcagcaggg

SEQ ID NO: 3787564 - RNA, 15 nt, Salmonella typhimurium LT2
caggcauuaaaaaaa

SEQ ID NO: 3787565 - RNA, 20 nt, Salmonella typhimurium LT2
caggcauugauaaagcgcuc

SEQ ID NO: 3787566 - RNA, 12 nt, Salmonella typhimurium LT2
caggcauuuucu

SEQ ID NO: 3787567 - RNA, 18 nt, Salmonella typhimurium LT2
caggccaauggcucaacu

SEQ ID NO: 3787568 - RNA, 18 nt, Salmonella typhimurium LT2
caggccaauuccgccaua

SEQ ID NO: 3787569 - RNA, 20 nt, Salmonella typhimurium LT2
caggccacggcuguaauuga

SEQ ID NO: 3787570 - RNA, 19 nt, Salmonella typhimurium LT2
caggccagauagcuuuacg

SEQ ID NO: 3787571 - RNA, 23 nt, Salmonella typhimurium LT2
caggccagauauugccgaccauu

SEQ ID NO: 3787572 - RNA, 14 nt, Salmonella typhimurium LT2
caggccaggcguug

SEQ ID NO: 3787573 - RNA, 18 nt, Salmonella typhimurium LT2
caggccaggguugcguuc

SEQ ID NO: 3787574 - RNA, 22 nt, Salmonella typhimurium LT2
caggccaggguugcguucgcca

SEQ ID NO: 3787575 - RNA, 14 nt, Salmonella typhimurium LT2
caggccaucgacga

SEQ ID NO: 3787576 - RNA, 16 nt, Salmonella typhimurium LT2
caggccaugcgcaagc

SEQ ID NO: 3787577 - RNA, 22 nt, Salmonella typhimurium LT2
caggccauuaauauuuuaucac

SEQ ID NO: 3787578 - RNA, 20 nt, Salmonella typhimurium LT2
caggccauuuuuucgaugau

SEQ ID NO: 3787579 - RNA, 22 nt, Salmonella typhimurium LT2
caggcccccuucaucguuuauu

SEQ ID NO: 3787580 - RNA, 19 nt, Salmonella typhimurium LT2
caggcccgauaagcgccgc

SEQ ID NO: 3787581 - RNA, 19 nt, Salmonella typhimurium LT2
caggcccgguggcgccgcg

SEQ ID NO: 3787582 - RNA, 16 nt, Salmonella typhimurium LT2
caggccgaaacgcagc

SEQ ID NO: 3787583 - RNA, 21 nt, Salmonella typhimurium LT2
caggccgauauauugucggcc

SEQ ID NO: 3787584 - RNA, 13 nt, Salmonella typhimurium LT2
caggccgccaccg

SEQ ID NO: 3787585 - RNA, 14 nt, Salmonella typhimurium LT2
caggccgccaccgc

SEQ ID NO: 3787586 - RNA, 17 nt, Salmonella typhimurium LT2
caggccgccaccgccuc

SEQ ID NO: 3787587 - RNA, 19 nt, Salmonella typhimurium LT2
caggccgccgcacaggcga

SEQ ID NO: 3787588 - RNA, 13 nt, Salmonella typhimurium LT2
caggccgccgccu

SEQ ID NO: 3787589 - RNA, 20 nt, Salmonella typhimurium LT2
caggccgccgggucagaaaa

SEQ ID NO: 3787590 - RNA, 18 nt, Salmonella typhimurium LT2
caggccggacaggcgacg

SEQ ID NO: 3787591 - RNA, 22 nt, Salmonella typhimurium LT2
caggccggauggcggcuuugaa

SEQ ID NO: 3787592 - RNA, 22 nt, Salmonella typhimurium LT2
caggguuagcgauccuguccug

SEQ ID NO: 3787593 - RNA, 22 nt, Salmonella typhimurium LT2
caggguuccguucccaaugcuu

SEQ ID NO: 3787594 - RNA, 14 nt, Salmonella typhimurium LT2
caggguuuaaucac

SEQ ID NO: 3787595 - RNA, 16 nt, Salmonella typhimurium LT2
caggguuuacugccag

SEQ ID NO: 3787596 - RNA, 13 nt, Salmonella typhimurium LT2
caggguuugccag

SEQ ID NO: 3787597 - RNA, 17 nt, Salmonella typhimurium LT2
caggguuugccagcacc

SEQ ID NO: 3787598 - RNA, 18 nt, Salmonella typhimurium LT2
caggguuugccagcacca

SEQ ID NO: 3787599 - RNA, 18 nt, Salmonella typhimurium LT2
caggguuuucaggaagga

SEQ ID NO: 3787600 - RNA, 20 nt, Salmonella typhimurium LT2
cagguaagcccuuacaaaaa

SEQ ID NO: 3787601 - RNA, 16 nt, Salmonella typhimurium LT2
cagguacaggccgccg

SEQ ID NO: 3787602 - RNA, 23 nt, Salmonella typhimurium LT2
cagguacuuacgcagccggucag

SEQ ID NO: 3787603 - RNA, 17 nt, Salmonella typhimurium LT2
cagguagaaucccacca

SEQ ID NO: 3787604 - RNA, 19 nt, Salmonella typhimurium LT2
cagguagcgccuuuacugg

SEQ ID NO: 3787605 - RNA, 22 nt, Salmonella typhimurium LT2
cagguaucguauccggucaaua

SEQ ID NO: 3787606 - RNA, 16 nt, Salmonella typhimurium LT2
cagguauuaauccugc

SEQ ID NO: 3787607 - RNA, 21 nt, Salmonella typhimurium LT2
cagguauucguuaaagccgau

SEQ ID NO: 3787608 - RNA, 23 nt, Salmonella typhimurium LT2
caggucaucaccuccagcacgcg

SEQ ID NO: 3787609 - RNA, 14 nt, Salmonella typhimurium LT2
caggucaugcagga

SEQ ID NO: 3787610 - RNA, 15 nt, Salmonella typhimurium LT2
caggucgaugauuuu

SEQ ID NO: 3787611 - RNA, 20 nt, Salmonella typhimurium LT2
caggucgccagaagccgucg

SEQ ID NO: 3787612 - RNA, 18 nt, Salmonella typhimurium LT2
caggucgcccagccauaa

SEQ ID NO: 3787613 - RNA, 14 nt, Salmonella typhimurium LT2
caggucgccgaugu

SEQ ID NO: 3787614 - RNA, 21 nt, Salmonella typhimurium LT2
caggucguccguugccaccca

SEQ ID NO: 3787615 - RNA, 15 nt, Salmonella typhimurium LT2
caggucuccgcccag

SEQ ID NO: 3787616 - RNA, 18 nt, Salmonella typhimurium LT2
caggucuuuaucuaucac

SEQ ID NO: 3787617 - RNA, 14 nt, Salmonella typhimurium LT2
caggugaacauuac

SEQ ID NO: 3787618 - RNA, 20 nt, Salmonella typhimurium LT2
caggugaauaccaaagcccg

SEQ ID NO: 3787619 - RNA, 21 nt, Salmonella typhimurium LT2
caggugcggauaguccugcgc

SEQ ID NO: 3787620 - RNA, 18 nt, Salmonella typhimurium LT2
caggugucguuaaugcuc

SEQ ID NO: 3787621 - RNA, 16 nt, Salmonella typhimurium LT2
cagguguuaguguccu

SEQ ID NO: 3787622 - RNA, 20 nt, Salmonella typhimurium LT2
cagguuacucuuccaccauu

SEQ ID NO: 3787623 - RNA, 13 nt, Salmonella typhimurium LT2
cagguuagcagcc

SEQ ID NO: 3787624 - RNA, 15 nt, Salmonella typhimurium LT2
cagguuauacuguga

SEQ ID NO: 3787625 - RNA, 12 nt, Salmonella typhimurium LT2
cagguucagcaa

SEQ ID NO: 3787626 - RNA, 21 nt, Salmonella typhimurium LT2
cagguucgggccaccuuccag

SEQ ID NO: 3787627 - RNA, 18 nt, Salmonella typhimurium LT2
cagguucugagaacccca

SEQ ID NO: 3787628 - RNA, 23 nt, Salmonella typhimurium LT2
cagguuguaucauguuccggcag

SEQ ID NO: 3787629 - RNA, 16 nt, Salmonella typhimurium LT2
cagguuguccagcagc

SEQ ID NO: 3787630 - RNA, 14 nt, Salmonella typhimurium LT2
cagguugugcaucu

SEQ ID NO: 3787631 - RNA, 19 nt, Salmonella typhimurium LT2
cagguuuaaacgaacgaga

SEQ ID NO: 3787632 - RNA, 17 nt, Salmonella typhimurium LT2
cagguuuacguagcagc

SEQ ID NO: 3787633 - RNA, 22 nt, Salmonella typhimurium LT2
cagguuuacguagcagcgcgcg

SEQ ID NO: 3787634 - RNA, 14 nt, Salmonella typhimurium LT2
cagguuuucaggcc

SEQ ID NO: 3787635 - RNA, 17 nt, Salmonella typhimurium LT2
cagguuuuuaagcugcc

SEQ ID NO: 3787636 - RNA, 18 nt, Salmonella typhimurium LT2
caguaaaacccaauaacu

SEQ ID NO: 3787637 - RNA, 13 nt, Salmonella typhimurium LT2
caguaaaggggag

SEQ ID NO: 3787638 - RNA, 16 nt, Salmonella typhimurium LT2
caguaaauuaaacagc

SEQ ID NO: 3787639 - RNA, 17 nt, Salmonella typhimurium LT2
caguaaccgccacagca

SEQ ID NO: 3787640 - RNA, 20 nt, Salmonella typhimurium LT2
caguaaccuauuuuaaaaaa

SEQ ID NO: 3787641 - RNA, 14 nt, Salmonella typhimurium LT2
caguaacguucuuc

SEQ ID NO: 3787642 - RNA, 14 nt, Salmonella typhimurium LT2
caguaacucaucgc

SEQ ID NO: 3787643 - RNA, 15 nt, Salmonella typhimurium LT2
caguaacuucagcau

SEQ ID NO: 3787644 - RNA, 21 nt, Salmonella typhimurium LT2
caguaagaacgagaacucaga

SEQ ID NO: 3787645 - RNA, 22 nt, Salmonella typhimurium LT2
caguaagaacgagaacucagag

SEQ ID NO: 3787646 - RNA, 13 nt, Salmonella typhimurium LT2
caguaagacaaaa

SEQ ID NO: 3787647 - RNA, 17 nt, Salmonella typhimurium LT2
caguaagacaaaaaugg

SEQ ID NO: 3787648 - RNA, 19 nt, Salmonella typhimurium LT2
caguaagauuugcgccgcc

SEQ ID NO: 3787649 - RNA, 20 nt, Salmonella typhimurium LT2
caguaagauuugcgccgccg

SEQ ID NO: 3787650 - RNA, 22 nt, Salmonella typhimurium LT2
caguaauauaaccaauuuaaaa

SEQ ID NO: 3787651 - RNA, 17 nt, Salmonella typhimurium LT2
caguaauaugaauugau

SEQ ID NO: 3787652 - RNA, 15 nt, Salmonella typhimurium LT2
caguaauccggcaac

SEQ ID NO: 3787653 - RNA, 16 nt, Salmonella typhimurium LT2
caguaaucgcacggcu

SEQ ID NO: 3787654 - RNA, 16 nt, Salmonella typhimurium LT2
caguaaugcuguugua

SEQ ID NO: 3787655 - RNA, 18 nt, Salmonella typhimurium LT2
caguaauuucagcgacca

SEQ ID NO: 3787656 - RNA, 18 nt, Salmonella typhimurium LT2
caguaauuucuugcgcca

SEQ ID NO: 3787657 - RNA, 22 nt, Salmonella typhimurium LT2
caguaauuuuucucccagcaga

SEQ ID NO: 3787658 - RNA, 23 nt, Salmonella typhimurium LT2
caguaauuuuucucccagcagac

SEQ ID NO: 3787659 - RNA, 16 nt, Salmonella typhimurium LT2
caguacaaacaaauaa

SEQ ID NO: 3787660 - RNA, 17 nt, Salmonella typhimurium LT2
caguacaaacaaauaaa

SEQ ID NO: 3787661 - RNA, 18 nt, Salmonella typhimurium LT2
caguacaauuucuggccc

SEQ ID NO: 3787662 - RNA, 16 nt, Salmonella typhimurium LT2
caguacagccaaaaau

SEQ ID NO: 3787663 - RNA, 19 nt, Salmonella typhimurium LT2
caguacagccaaaaauaac

SEQ ID NO: 3787664 - RNA, 17 nt, Salmonella typhimurium LT2
caguacccgcacgcuuu

SEQ ID NO: 3787665 - RNA, 17 nt, Salmonella typhimurium LT2
caguaccgccuucagcg

SEQ ID NO: 3787666 - RNA, 22 nt, Salmonella typhimurium LT2
caguaccugacuuuuccauacu

SEQ ID NO: 3787667 - RNA, 17 nt, Salmonella typhimurium LT2
caguacgaucaugaauc

SEQ ID NO: 3787668 - RNA, 15 nt, Salmonella typhimurium LT2
caguacgccaaaaaa

SEQ ID NO: 3787669 - RNA, 21 nt, Salmonella typhimurium LT2
caguacgcccgugacgccagg

SEQ ID NO: 3787670 - RNA, 22 nt, Salmonella typhimurium LT2
caguacgcgccaugucgaggau

SEQ ID NO: 3787671 - RNA, 22 nt, Salmonella typhimurium LT2
caguacgucaacaaugcuuuca

SEQ ID NO: 3787672 - RNA, 15 nt, Salmonella typhimurium LT2
caguacuuucaccug

SEQ ID NO: 3787673 - RNA, 17 nt, Salmonella typhimurium LT2
caguacuuucaccugca

SEQ ID NO: 3787674 - RNA, 18 nt, Salmonella typhimurium LT2
caguagauggcgcuaaaa

SEQ ID NO: 3787675 - RNA, 18 nt, Salmonella typhimurium LT2
caguagcacccuucgcua

SEQ ID NO: 3787676 - RNA, 12 nt, Salmonella typhimurium LT2
caguagccaugc

SEQ ID NO: 3787677 - RNA, 16 nt, Salmonella typhimurium LT2
caguagcgcgacgcca

SEQ ID NO: 3787678 - RNA, 22 nt, Salmonella typhimurium LT2
caguaguuaccguaaucaucgc

SEQ ID NO: 3787679 - RNA, 17 nt, Salmonella typhimurium LT2
caguaguuccuggagaa

SEQ ID NO: 3787680 - RNA, 18 nt, Salmonella typhimurium LT2
caguaucggcaggacuua

SEQ ID NO: 3787681 - RNA, 12 nt, Salmonella typhimurium LT2
caguaucuuuua

SEQ ID NO: 3787682 - RNA, 15 nt, Salmonella typhimurium LT2
caguaugagcgaacg

SEQ ID NO: 3787683 - RNA, 13 nt, Salmonella typhimurium LT2
caguaugcccccu

SEQ ID NO: 3787684 - RNA, 19 nt, Salmonella typhimurium LT2
caguauuaagcauuacccc

SEQ ID NO: 3787685 - RNA, 21 nt, Salmonella typhimurium LT2
caguauucaccuggaaaggcu

SEQ ID NO: 3787686 - RNA, 23 nt, Salmonella typhimurium LT2
cagucaacgaggugaauaaaucc

SEQ ID NO: 3787687 - RNA, 17 nt, Salmonella typhimurium LT2
cagucacauacuucugu

SEQ ID NO: 3787688 - RNA, 12 nt, Salmonella typhimurium LT2
cagucaccagca

SEQ ID NO: 3787689 - RNA, 17 nt, Salmonella typhimurium LT2
cagucaggcucaauaug

SEQ ID NO: 3787690 - RNA, 22 nt, Salmonella typhimurium LT2
cagucaggcucaauaugggcau

SEQ ID NO: 3787691 - RNA, 13 nt, Salmonella typhimurium LT2
cagucaucgcgcc

SEQ ID NO: 3787692 - RNA, 17 nt, Salmonella typhimurium LT2
cagucaucgcgccaaac

SEQ ID NO: 3787693 - RNA, 18 nt, Salmonella typhimurium LT2
caguccacaucuaccagg

SEQ ID NO: 3787694 - RNA, 18 nt, Salmonella typhimurium LT2
caguccagaugcgccaga

SEQ ID NO: 3787695 - RNA, 22 nt, Salmonella typhimurium LT2
caguccagccgccgcgcggcag

SEQ ID NO: 3787696 - RNA, 23 nt, Salmonella typhimurium LT2
caguuuagagguuccccagccgc

SEQ ID NO: 3787697 - RNA, 17 nt, Salmonella typhimurium LT2
caguuuagggaucaucu

SEQ ID NO: 3787698 - RNA, 12 nt, Salmonella typhimurium LT2
caguuuaucugc

SEQ ID NO: 3787699 - RNA, 15 nt, Salmonella typhimurium LT2
caguuucgccagcgc

SEQ ID NO: 3787700 - RNA, 22 nt, Salmonella typhimurium LT2
caguuugcaaccgcuuugucag

SEQ ID NO: 3787701 - RNA, 14 nt, Salmonella typhimurium LT2
caguuugcgaaaag

SEQ ID NO: 3787702 - RNA, 15 nt, Salmonella typhimurium LT2
caguuugcgaaaagc

SEQ ID NO: 3787703 - RNA, 20 nt, Salmonella typhimurium LT2
caguuugcguucacagcacc

SEQ ID NO: 3787704 - RNA, 13 nt, Salmonella typhimurium LT2
caguuugucauca

SEQ ID NO: 3787705 - RNA, 18 nt, Salmonella typhimurium LT2
caguuuguccauuucuug

SEQ ID NO: 3787706 - RNA, 14 nt, Salmonella typhimurium LT2
caguuuucaauauu

SEQ ID NO: 3787707 - RNA, 18 nt, Salmonella typhimurium LT2
caguuuucaauauucugu

SEQ ID NO: 3787708 - RNA, 19 nt, Salmonella typhimurium LT2
caguuuuccagcgccucgu

SEQ ID NO: 3787709 - RNA, 16 nt, Salmonella typhimurium LT2
caguuuugcauucugc

SEQ ID NO: 3787710 - RNA, 21 nt, Salmonella typhimurium LT2
caguuuuggcaaucacaagcu

SEQ ID NO: 3787711 - RNA, 19 nt, Salmonella typhimurium LT2
caguuuuucauuuguuccu

SEQ ID NO: 3787712 - RNA, 15 nt, Salmonella typhimurium LT2
caguuuuugaacaua

SEQ ID NO: 3787713 - RNA, 14 nt, Salmonella typhimurium LT2
caguuuuugcgcca

SEQ ID NO: 3787714 - RNA, 22 nt, Salmonella typhimurium LT2
caguuuuuucaguagccgccgc

SEQ ID NO: 3787715 - RNA, 13 nt, Salmonella typhimurium LT2
caguuuuuugucu

SEQ ID NO: 3787716 - RNA, 20 nt, Salmonella typhimurium LT2
cauaaaaaaagcgccggauu

SEQ ID NO: 3787717 - RNA, 18 nt, Salmonella typhimurium LT2
cauaaaaaacaucaugcc

SEQ ID NO: 3787718 - RNA, 14 nt, Salmonella typhimurium LT2
cauaaaaaagaaua

SEQ ID NO: 3787719 - RNA, 12 nt, Salmonella typhimurium LT2
cauaaaaaagag

SEQ ID NO: 3787720 - RNA, 15 nt, Salmonella typhimurium LT2
cauaaaaaagaggaa

SEQ ID NO: 3787721 - RNA, 24 nt, Salmonella typhimurium LT2
cauaaaaacgcgcucgccagcgca

SEQ ID NO: 3787722 - RNA, 14 nt, Salmonella typhimurium LT2
cauaaaaaucauuc

SEQ ID NO: 3787723 - RNA, 19 nt, Salmonella typhimurium LT2
cauaaaccccgauaaacca

SEQ ID NO: 3787724 - RNA, 14 nt, Salmonella typhimurium LT2
cauaaacgcggcca

SEQ ID NO: 3787725 - RNA, 19 nt, Salmonella typhimurium LT2
cauaaacgguuucagcagc

SEQ ID NO: 3787726 - RNA, 20 nt, Salmonella typhimurium LT2
cauaaacgguuucagcagcg

SEQ ID NO: 3787727 - RNA, 19 nt, Salmonella typhimurium LT2
cauaaagaagcgugcgccg

SEQ ID NO: 3787728 - RNA, 21 nt, Salmonella typhimurium LT2
cauaaagauaaauaaaaaauu

SEQ ID NO: 3787729 - RNA, 12 nt, Salmonella typhimurium LT2
cauaaagcgaau

SEQ ID NO: 3787730 - RNA, 16 nt, Salmonella typhimurium LT2
cauaaagcgaauaauu

SEQ ID NO: 3787731 - RNA, 12 nt, Salmonella typhimurium LT2
cauaaaucagau

SEQ ID NO: 3787732 - RNA, 18 nt, Salmonella typhimurium LT2
cauaaauccggugcguuu

SEQ ID NO: 3787733 - RNA, 15 nt, Salmonella typhimurium LT2
cauaaaugcugauga

SEQ ID NO: 3787734 - RNA, 17 nt, Salmonella typhimurium LT2
cauaaauucgcagcguu

SEQ ID NO: 3787735 - RNA, 14 nt, Salmonella typhimurium LT2
cauaaauuggcuca

SEQ ID NO: 3787736 - RNA, 14 nt, Salmonella typhimurium LT2
cauaacaacuauuu

SEQ ID NO: 3787737 - RNA, 15 nt, Salmonella typhimurium LT2
cauaacaccaauacg

SEQ ID NO: 3787738 - RNA, 22 nt, Salmonella typhimurium LT2
cauaacauugguuaucaaaaac

SEQ ID NO: 3787739 - RNA, 23 nt, Salmonella typhimurium LT2
cauaacauugguuaucaaaaacc

SEQ ID NO: 3787740 - RNA, 19 nt, Salmonella typhimurium LT2
cauaaccggcaaccaacgc

SEQ ID NO: 3787741 - RNA, 20 nt, Salmonella typhimurium LT2
cauaaccggcaaccaacgcc

SEQ ID NO: 3787742 - RNA, 22 nt, Salmonella typhimurium LT2
cauaaccggugccgaaaucauc

SEQ ID NO: 3787743 - RNA, 23 nt, Salmonella typhimurium LT2
cauaaccggugccgaaaucauca

SEQ ID NO: 3787744 - RNA, 17 nt, Salmonella typhimurium LT2
cauaacgaccaaacaag

SEQ ID NO: 3787745 - RNA, 18 nt, Salmonella typhimurium LT2
cauaacgaccuuuacuga

SEQ ID NO: 3787746 - RNA, 19 nt, Salmonella typhimurium LT2
cauaacgcccgacaaucgc

SEQ ID NO: 3787747 - RNA, 14 nt, Salmonella typhimurium LT2
cauaacgccgaugc

SEQ ID NO: 3787748 - RNA, 14 nt, Salmonella typhimurium LT2
cauaacgggaagcc

SEQ ID NO: 3787749 - RNA, 18 nt, Salmonella typhimurium LT2
cauaacguuuccuuauau

SEQ ID NO: 3787750 - RNA, 14 nt, Salmonella typhimurium LT2
cauaagaguccauu

SEQ ID NO: 3787751 - RNA, 21 nt, Salmonella typhimurium LT2
cauaagcacaccauuucacaa

SEQ ID NO: 3787752 - RNA, 14 nt, Salmonella typhimurium LT2
cauaagcacagaua

SEQ ID NO: 3787753 - RNA, 16 nt, Salmonella typhimurium LT2
cauaagcacagauaaa

SEQ ID NO: 3787754 - RNA, 15 nt, Salmonella typhimurium LT2
cauaagccagcccug

SEQ ID NO: 3787755 - RNA, 20 nt, Salmonella typhimurium LT2
cauaagccgcguucugucga

SEQ ID NO: 3787756 - RNA, 19 nt, Salmonella typhimurium LT2
cauaaggguaagcaauaug

SEQ ID NO: 3787757 - RNA, 16 nt, Salmonella typhimurium LT2
cauaagguacggcccg

SEQ ID NO: 3787758 - RNA, 13 nt, Salmonella typhimurium LT2
cauaaguguuuua

SEQ ID NO: 3787759 - RNA, 15 nt, Salmonella typhimurium LT2
cauaaguguuuuaag

SEQ ID NO: 3787760 - RNA, 20 nt, Salmonella typhimurium LT2
cauaauaaacugcauccccu

SEQ ID NO: 3787761 - RNA, 15 nt, Salmonella typhimurium LT2
cauaauaaagccggg

SEQ ID NO: 3787762 - RNA, 17 nt, Salmonella typhimurium LT2
cauaauaaccccaagca

SEQ ID NO: 3787763 - RNA, 19 nt, Salmonella typhimurium LT2
cauaauaagcgcucaggca

SEQ ID NO: 3787764 - RNA, 23 nt, Salmonella typhimurium LT2
cauaauaagcgcucaggcagcca

SEQ ID NO: 3787765 - RNA, 18 nt, Salmonella typhimurium LT2
cauaauacgcuugcgcca

SEQ ID NO: 3787766 - RNA, 17 nt, Salmonella typhimurium LT2
cauaaucgcguuuuccu

SEQ ID NO: 3787767 - RNA, 12 nt, Salmonella typhimurium LT2
cauaaugaaucc

SEQ ID NO: 3787768 - RNA, 19 nt, Salmonella typhimurium LT2
cauaaugacguccaggccg

SEQ ID NO: 3787769 - RNA, 23 nt, Salmonella typhimurium LT2
cauaaugcugccagcaugauaau

SEQ ID NO: 3787770 - RNA, 23 nt, Salmonella typhimurium LT2
cauaauggcgacgccuucaguca

SEQ ID NO: 3787771 - RNA, 17 nt, Salmonella typhimurium LT2
cauaaugguggaaugcc

SEQ ID NO: 3787772 - RNA, 18 nt, Salmonella typhimurium LT2
cauaaugucccugccacg

SEQ ID NO: 3787773 - RNA, 23 nt, Salmonella typhimurium LT2
cauaaugucucccgauuguauaa

SEQ ID NO: 3787774 - RNA, 14 nt, Salmonella typhimurium LT2
cauaauuuuccugu

SEQ ID NO: 3787775 - RNA, 16 nt, Salmonella typhimurium LT2
cauacaaagagaaaau

SEQ ID NO: 3787776 - RNA, 14 nt, Salmonella typhimurium LT2
cauacacaccagca

SEQ ID NO: 3787777 - RNA, 15 nt, Salmonella typhimurium LT2
cauacaccgccagcg

SEQ ID NO: 3787778 - RNA, 16 nt, Salmonella typhimurium LT2
cauacaccuuugcccg

SEQ ID NO: 3787779 - RNA, 14 nt, Salmonella typhimurium LT2
cauacacugcauaa

SEQ ID NO: 3787780 - RNA, 14 nt, Salmonella typhimurium LT2
cauacagcacuucc

SEQ ID NO: 3787781 - RNA, 19 nt, Salmonella typhimurium LT2
cauacagcgauaaccgccg

SEQ ID NO: 3787782 - RNA, 23 nt, Salmonella typhimurium LT2
cauacaggccgccgggucagaaa

SEQ ID NO: 3787783 - RNA, 17 nt, Salmonella typhimurium LT2
cauacauauauuccggg

SEQ ID NO: 3787784 - RNA, 19 nt, Salmonella typhimurium LT2
cauacauccaucacuccuu

SEQ ID NO: 3787785 - RNA, 20 nt, Salmonella typhimurium LT2
cauacauuuuuguaauaaaa

SEQ ID NO: 3787786 - RNA, 20 nt, Salmonella typhimurium LT2
cauaccacaacagaaucgcg

SEQ ID NO: 3787787 - RNA, 17 nt, Salmonella typhimurium LT2
cauaccacgcagcggca

SEQ ID NO: 3787788 - RNA, 18 nt, Salmonella typhimurium LT2
cauaccacgcagcggcau

SEQ ID NO: 3787789 - RNA, 11 nt, Salmonella typhimurium LT2
cauaccagcga

SEQ ID NO: 3787790 - RNA, 16 nt, Salmonella typhimurium LT2
cauaccagguuagcgu

SEQ ID NO: 3787791 - RNA, 22 nt, Salmonella typhimurium LT2
cauaccagguuagcgugaaucu

SEQ ID NO: 3787792 - RNA, 17 nt, Salmonella typhimurium LT2
cauacccaacagcagac

SEQ ID NO: 3787793 - RNA, 18 nt, Salmonella typhimurium LT2
cauacccaacagcagaca

SEQ ID NO: 3787794 - RNA, 14 nt, Salmonella typhimurium LT2
cauacccagguuug

SEQ ID NO: 3787795 - RNA, 12 nt, Salmonella typhimurium LT2
cauacccgcuua

SEQ ID NO: 3787796 - RNA, 19 nt, Salmonella typhimurium LT2
cauacccuauuuacagagc

SEQ ID NO: 3787797 - RNA, 23 nt, Salmonella typhimurium LT2
cauacccuguucagcacccagag

SEQ ID NO: 3787798 - RNA, 13 nt, Salmonella typhimurium LT2
cauacccuuccag

SEQ ID NO: 3787799 - RNA, 20 nt, Salmonella typhimurium LT2
cauacccuuccaguugcguc

SEQ ID NO: 3787800 - RNA, 18 nt, Salmonella typhimurium LT2
caucaacagcggagagac

SEQ ID NO: 3787801 - RNA, 19 nt, Salmonella typhimurium LT2
caucaaguaccgugaagaa

SEQ ID NO: 3787802 - RNA, 17 nt, Salmonella typhimurium LT2
caucaauaaaaucaccg

SEQ ID NO: 3787803 - RNA, 17 nt, Salmonella typhimurium LT2
caucaauaaagccgcau

SEQ ID NO: 3787804 - RNA, 17 nt, Salmonella typhimurium LT2
caucaauaauccggcaa

SEQ ID NO: 3787805 - RNA, 15 nt, Salmonella typhimurium LT2
caucaauaccagccc

SEQ ID NO: 3787806 - RNA, 17 nt, Salmonella typhimurium LT2
caucaauaccagcccca

SEQ ID NO: 3787807 - RNA, 20 nt, Salmonella typhimurium LT2
caucaauacguuaugcaguc

SEQ ID NO: 3787808 - RNA, 11 nt, Salmonella typhimurium LT2
caucaauagca

SEQ ID NO: 3787809 - RNA, 17 nt, Salmonella typhimurium LT2
caucaauagcaagggca

SEQ ID NO: 3787810 - RNA, 19 nt, Salmonella typhimurium LT2
caucaauauuggugucgua

SEQ ID NO: 3787811 - RNA, 20 nt, Salmonella typhimurium LT2
caucaaucgcuaucugacag

SEQ ID NO: 3787812 - RNA, 13 nt, Salmonella typhimurium LT2
caucaaugcccag

SEQ ID NO: 3787813 - RNA, 15 nt, Salmonella typhimurium LT2
caucaaugcccagcg

SEQ ID NO: 3787814 - RNA, 22 nt, Salmonella typhimurium LT2
caucaaugcccagcgcaaucac

SEQ ID NO: 3787815 - RNA, 20 nt, Salmonella typhimurium LT2
caucaauucuuuaauuugug

SEQ ID NO: 3787816 - RNA, 16 nt, Salmonella typhimurium LT2
caucaauuucucuuuu

SEQ ID NO: 3787817 - RNA, 20 nt, Salmonella typhimurium LT2
caucacaaaaucauugcguu

SEQ ID NO: 3787818 - RNA, 15 nt, Salmonella typhimurium LT2
caucacagccacacu

SEQ ID NO: 3787819 - RNA, 20 nt, Salmonella typhimurium LT2
caucacagccacacugcugu

SEQ ID NO: 3787820 - RNA, 17 nt, Salmonella typhimurium LT2
caucacaucaaagcccc

SEQ ID NO: 3787821 - RNA, 14 nt, Salmonella typhimurium LT2
caucacaucccagc

SEQ ID NO: 3787822 - RNA, 18 nt, Salmonella typhimurium LT2
caucacaucccagcagag

SEQ ID NO: 3787823 - RNA, 20 nt, Salmonella typhimurium LT2
caucacaucguaaaucagcg

SEQ ID NO: 3787824 - RNA, 23 nt, Salmonella typhimurium LT2
caucaccagaucggcaucuuuaa

SEQ ID NO: 3787825 - RNA, 18 nt, Salmonella typhimurium LT2
caucaccaguugaccaaa

SEQ ID NO: 3787826 - RNA, 22 nt, Salmonella typhimurium LT2
caucaccaguugcgaagccacu

SEQ ID NO: 3787827 - RNA, 18 nt, Salmonella typhimurium LT2
caucaccaucgccggaga

SEQ ID NO: 3787828 - RNA, 23 nt, Salmonella typhimurium LT2
caucaccaucguugccagcggcc

SEQ ID NO: 3787829 - RNA, 14 nt, Salmonella typhimurium LT2
caucaccuccagca

SEQ ID NO: 3787830 - RNA, 16 nt, Salmonella typhimurium LT2
caucaccuccagcacg

SEQ ID NO: 3787831 - RNA, 17 nt, Salmonella typhimurium LT2
caucacgcaacggugag

SEQ ID NO: 3787832 - RNA, 20 nt, Salmonella typhimurium LT2
caucacggagcgguaguuca

SEQ ID NO: 3787833 - RNA, 19 nt, Salmonella typhimurium LT2
caucacggcagcaccgcug

SEQ ID NO: 3787834 - RNA, 19 nt, Salmonella typhimurium LT2
caucacuaccauuuccggc

SEQ ID NO: 3787835 - RNA, 13 nt, Salmonella typhimurium LT2
caucacuggcauu

SEQ ID NO: 3787836 - RNA, 20 nt, Salmonella typhimurium LT2
caucacuuuuggcgacagga

SEQ ID NO: 3787837 - RNA, 21 nt, Salmonella typhimurium LT2
caucacuuuuggcgacaggaa

SEQ ID NO: 3787838 - RNA, 16 nt, Salmonella typhimurium LT2
caucagaagugccagu

SEQ ID NO: 3787839 - RNA, 19 nt, Salmonella typhimurium LT2
caucagacccgcguacagg

SEQ ID NO: 3787840 - RNA, 18 nt, Salmonella typhimurium LT2
caucagaccgauaaauac

SEQ ID NO: 3787841 - RNA, 12 nt, Salmonella typhimurium LT2
caucagccagca

SEQ ID NO: 3787842 - RNA, 15 nt, Salmonella typhimurium LT2
caucagccagcagcu

SEQ ID NO: 3787843 - RNA, 17 nt, Salmonella typhimurium LT2
caucagccagccgccaa

SEQ ID NO: 3787844 - RNA, 23 nt, Salmonella typhimurium LT2
caucagccagccgccaaaaauau

SEQ ID NO: 3787845 - RNA, 22 nt, Salmonella typhimurium LT2
caucagccaggcggcaaagucu

SEQ ID NO: 3787846 - RNA, 23 nt, Salmonella typhimurium LT2
caucagcccuaucgcugcgcugc

SEQ ID NO: 3787847 - RNA, 21 nt, Salmonella typhimurium LT2
caucagccugcaguuuugcau

SEQ ID NO: 3787848 - RNA, 16 nt, Salmonella typhimurium LT2
caucagcgccagcccu

SEQ ID NO: 3787849 - RNA, 18 nt, Salmonella typhimurium LT2
caucagcgccagcccugc

SEQ ID NO: 3787850 - RNA, 14 nt, Salmonella typhimurium LT2
caucagcgcgugcc

SEQ ID NO: 3787851 - RNA, 10 nt, Salmonella typhimurium LT2
caucagcgcu

SEQ ID NO: 3787852 - RNA, 21 nt, Salmonella typhimurium LT2
caucagcgcuaccagcgcggc

SEQ ID NO: 3787853 - RNA, 20 nt, Salmonella typhimurium LT2
caucagcgggcuaugcugaa

SEQ ID NO: 3787854 - RNA, 15 nt, Salmonella typhimurium LT2
caucaggaaaugaac

SEQ ID NO: 3787855 - RNA, 17 nt, Salmonella typhimurium LT2
caucaggaucuucaucc

SEQ ID NO: 3787856 - RNA, 20 nt, Salmonella typhimurium LT2
caucaggaucuucaucccau

SEQ ID NO: 3787857 - RNA, 14 nt, Salmonella typhimurium LT2
caucaggcacaaug

SEQ ID NO: 3787858 - RNA, 15 nt, Salmonella typhimurium LT2
caucaggcauagcaa

SEQ ID NO: 3787859 - RNA, 19 nt, Salmonella typhimurium LT2
caucaggcauggcagcagg

SEQ ID NO: 3787860 - RNA, 15 nt, Salmonella typhimurium LT2
caucaggccugcaaa

SEQ ID NO: 3787861 - RNA, 17 nt, Salmonella typhimurium LT2
caucaggcuuugcgcca

SEQ ID NO: 3787862 - RNA, 19 nt, Salmonella typhimurium LT2
caucagggcguaagcgcgu

SEQ ID NO: 3787863 - RNA, 20 nt, Salmonella typhimurium LT2
caucagguaguacaggguuu

SEQ ID NO: 3787864 - RNA, 15 nt, Salmonella typhimurium LT2
caucaguacaaacgc

SEQ ID NO: 3787865 - RNA, 21 nt, Salmonella typhimurium LT2
caucaguacaaacgcaccgcc

SEQ ID NO: 3787866 - RNA, 17 nt, Salmonella typhimurium LT2
caucaguagugucuuca

SEQ ID NO: 3787867 - RNA, 13 nt, Salmonella typhimurium LT2
caucauaaaaggc

SEQ ID NO: 3787868 - RNA, 22 nt, Salmonella typhimurium LT2
caucauaaaaggcaucgcucuu

SEQ ID NO: 3787869 - RNA, 14 nt, Salmonella typhimurium LT2
caucauaauaauug

SEQ ID NO: 3787870 - RNA, 22 nt, Salmonella typhimurium LT2
caucauaucaauauguuccggc

SEQ ID NO: 3787871 - RNA, 19 nt, Salmonella typhimurium LT2
caucauaucccggcugaca

SEQ ID NO: 3787872 - RNA, 21 nt, Salmonella typhimurium LT2
caucauaucuucccgauaacu

SEQ ID NO: 3787873 - RNA, 14 nt, Salmonella typhimurium LT2
caucaucagcagca

SEQ ID NO: 3787874 - RNA, 18 nt, Salmonella typhimurium LT2
caucaucaggacucaauc

SEQ ID NO: 3787875 - RNA, 22 nt, Salmonella typhimurium LT2
caucauccccaccacugauggc

SEQ ID NO: 3787876 - RNA, 17 nt, Salmonella typhimurium LT2
caucauccugcagggua

SEQ ID NO: 3787877 - RNA, 22 nt, Salmonella typhimurium LT2
caucaucgaacgccgccugcgc

SEQ ID NO: 3787878 - RNA, 17 nt, Salmonella typhimurium LT2
caucaucggcacagcca

SEQ ID NO: 3787879 - RNA, 18 nt, Salmonella typhimurium LT2
caucaucggcacagccag

SEQ ID NO: 3787880 - RNA, 14 nt, Salmonella typhimurium LT2
caucaucucauaaa

SEQ ID NO: 3787881 - RNA, 14 nt, Salmonella typhimurium LT2
caucaucugccauu

SEQ ID NO: 3787882 - RNA, 13 nt, Salmonella typhimurium LT2
caucaucuugucc

SEQ ID NO: 3787883 - RNA, 20 nt, Salmonella typhimurium LT2
caucaugaaaaacaguaccg

SEQ ID NO: 3787884 - RNA, 16 nt, Salmonella typhimurium LT2
caucaugacacuuuau

SEQ ID NO: 3787885 - RNA, 20 nt, Salmonella typhimurium LT2
caucaugacacuuuauucuc

SEQ ID NO: 3787886 - RNA, 13 nt, Salmonella typhimurium LT2
caucaugaugauc

SEQ ID NO: 3787887 - RNA, 20 nt, Salmonella typhimurium LT2
caucaugcgcagaaacugau

SEQ ID NO: 3787888 - RNA, 15 nt, Salmonella typhimurium LT2
caucauuacaggcga

SEQ ID NO: 3787889 - RNA, 21 nt, Salmonella typhimurium LT2
caucauuacaggcgaauagcg

SEQ ID NO: 3787890 - RNA, 15 nt, Salmonella typhimurium LT2
caucauucugcaggc

SEQ ID NO: 3787891 - RNA, 15 nt, Salmonella typhimurium LT2
caucauugauacugu

SEQ ID NO: 3787892 - RNA, 13 nt, Salmonella typhimurium LT2
caucauugcgcca

SEQ ID NO: 3787893 - RNA, 17 nt, Salmonella typhimurium LT2
caucauuggcugucuua

SEQ ID NO: 3787894 - RNA, 17 nt, Salmonella typhimurium LT2
caucauuuucccacuga

SEQ ID NO: 3787895 - RNA, 19 nt, Salmonella typhimurium LT2
caucauuuucuuucaucaa

SEQ ID NO: 3787896 - RNA, 14 nt, Salmonella typhimurium LT2
cauccaacugcgcc

SEQ ID NO: 3787897 - RNA, 14 nt, Salmonella typhimurium LT2
cauccacagcgcca

SEQ ID NO: 3787898 - RNA, 13 nt, Salmonella typhimurium LT2
cauccacccuggc

SEQ ID NO: 3787899 - RNA, 15 nt, Salmonella typhimurium LT2
cauccacgccacaau

SEQ ID NO: 3787900 - RNA, 14 nt, Salmonella typhimurium LT2
cauccacggccccg

SEQ ID NO: 3787901 - RNA, 16 nt, Salmonella typhimurium LT2
cauccagacaugcaca

SEQ ID NO: 3787902 - RNA, 21 nt, Salmonella typhimurium LT2
cauccagcuugccgucgcagg

SEQ ID NO: 3787903 - RNA, 16 nt, Salmonella typhimurium LT2
cauccagucagcaauu

SEQ ID NO: 3787904 - RNA, 17 nt, Salmonella typhimurium LT2
caucggucaguuugccc

SEQ ID NO: 3787905 - RNA, 15 nt, Salmonella typhimurium LT2
caucggucgcgcgca

SEQ ID NO: 3787906 - RNA, 13 nt, Salmonella typhimurium LT2
caucgguuaucgg

SEQ ID NO: 3787907 - RNA, 14 nt, Salmonella typhimurium LT2
caucgguucucugc

SEQ ID NO: 3787908 - RNA, 23 nt, Salmonella typhimurium LT2
caucguaccaauacccagcgcca

SEQ ID NO: 3787909 - RNA, 21 nt, Salmonella typhimurium LT2
caucguauaaauuuuuaccca

SEQ ID NO: 3787910 - RNA, 23 nt, Salmonella typhimurium LT2
caucguauauacccaaaauaauu

SEQ ID NO: 3787911 - RNA, 22 nt, Salmonella typhimurium LT2
caucgucgccagacccagcgcu

SEQ ID NO: 3787912 - RNA, 18 nt, Salmonella typhimurium LT2
caucgucuguacggaaua

SEQ ID NO: 3787913 - RNA, 16 nt, Salmonella typhimurium LT2
caucgugagcgcguca

SEQ ID NO: 3787914 - RNA, 14 nt, Salmonella typhimurium LT2
caucgugauaaacg

SEQ ID NO: 3787915 - RNA, 21 nt, Salmonella typhimurium LT2
caucgugccagacucuugcuc

SEQ ID NO: 3787916 - RNA, 15 nt, Salmonella typhimurium LT2
caucuaacacaaauu

SEQ ID NO: 3787917 - RNA, 14 nt, Salmonella typhimurium LT2
caucuaauuaaaaa

SEQ ID NO: 3787918 - RNA, 16 nt, Salmonella typhimurium LT2
caucuaauuaaaaaga

SEQ ID NO: 3787919 - RNA, 13 nt, Salmonella typhimurium LT2
caucuacgccgga

SEQ ID NO: 3787920 - RNA, 19 nt, Salmonella typhimurium LT2
caucuaucugcuucuggcu

SEQ ID NO: 3787921 - RNA, 12 nt, Salmonella typhimurium LT2
caucucaucuug

SEQ ID NO: 3787922 - RNA, 18 nt, Salmonella typhimurium LT2
caucucccaggccgccac

SEQ ID NO: 3787923 - RNA, 20 nt, Salmonella typhimurium LT2
caucucccaggccgccaccg

SEQ ID NO: 3787924 - RNA, 21 nt, Salmonella typhimurium LT2
caucucccaggccgccaccgc

SEQ ID NO: 3787925 - RNA, 22 nt, Salmonella typhimurium LT2
caucuccuccucauucagcggc

SEQ ID NO: 3787926 - RNA, 16 nt, Salmonella typhimurium LT2
caucuccuuaacacaa

SEQ ID NO: 3787927 - RNA, 23 nt, Salmonella typhimurium LT2
caucucgauaccgguaaucaaac

SEQ ID NO: 3787928 - RNA, 19 nt, Salmonella typhimurium LT2
caucucguaaaucaauuuu

SEQ ID NO: 3787929 - RNA, 22 nt, Salmonella typhimurium LT2
caucucgucaaacucuuccggg

SEQ ID NO: 3787930 - RNA, 14 nt, Salmonella typhimurium LT2
caucucuuugcccg

SEQ ID NO: 3787931 - RNA, 19 nt, Salmonella typhimurium LT2
caucucuuugcccgucgcc

SEQ ID NO: 3787932 - RNA, 22 nt, Salmonella typhimurium LT2
caucugauagcccauccagcac

SEQ ID NO: 3787933 - RNA, 17 nt, Salmonella typhimurium LT2
caucugcggcuuucauc

SEQ ID NO: 3787934 - RNA, 23 nt, Salmonella typhimurium LT2
caucugcuccggcguacgggcaa

SEQ ID NO: 3787935 - RNA, 16 nt, Salmonella typhimurium LT2
caucugcuucaacagc

SEQ ID NO: 3787936 - RNA, 14 nt, Salmonella typhimurium LT2
caucuguagcggcg

SEQ ID NO: 3787937 - RNA, 23 nt, Salmonella typhimurium LT2
caucugugaaaacgccuuacggu

SEQ ID NO: 3787938 - RNA, 22 nt, Salmonella typhimurium LT2
caucuuacugaccggcccguug

SEQ ID NO: 3787939 - RNA, 16 nt, Salmonella typhimurium LT2
caucuuauauuuuggu

SEQ ID NO: 3787940 - RNA, 22 nt, Salmonella typhimurium LT2
caucuuauauuuuggugugaca

SEQ ID NO: 3787941 - RNA, 14 nt, Salmonella typhimurium LT2
caucuuaucaggcc

SEQ ID NO: 3787942 - RNA, 16 nt, Salmonella typhimurium LT2
caucuucaccuuucca

SEQ ID NO: 3787943 - RNA, 17 nt, Salmonella typhimurium LT2
caucuucaccuuuccag

SEQ ID NO: 3787944 - RNA, 13 nt, Salmonella typhimurium LT2
caucuucacuuca

SEQ ID NO: 3787945 - RNA, 14 nt, Salmonella typhimurium LT2
caucuuccaugccu

SEQ ID NO: 3787946 - RNA, 15 nt, Salmonella typhimurium LT2
caucuucuaccugaa

SEQ ID NO: 3787947 - RNA, 18 nt, Salmonella typhimurium LT2
caucuugaaugauuuugu

SEQ ID NO: 3787948 - RNA, 12 nt, Salmonella typhimurium LT2
caucuuuaaccg

SEQ ID NO: 3787949 - RNA, 17 nt, Salmonella typhimurium LT2
caucuuuaaccgccugc

SEQ ID NO: 3787950 - RNA, 21 nt, Salmonella typhimurium LT2
caucuuuaccaaugugcaaag

SEQ ID NO: 3787951 - RNA, 14 nt, Salmonella typhimurium LT2
caucuuugcaccgc

SEQ ID NO: 3787952 - RNA, 16 nt, Salmonella typhimurium LT2
caucuuugcaccgcua

SEQ ID NO: 3787953 - RNA, 13 nt, Salmonella typhimurium LT2
caucuuuuccuga

SEQ ID NO: 3787954 - RNA, 13 nt, Salmonella typhimurium LT2
caugaaaaaaacg

SEQ ID NO: 3787955 - RNA, 18 nt, Salmonella typhimurium LT2
caugaaaaauagacacaa

SEQ ID NO: 3787956 - RNA, 19 nt, Salmonella typhimurium LT2
caugaaaaauagacacaaa

SEQ ID NO: 3787957 - RNA, 22 nt, Salmonella typhimurium LT2
caugaaaaauagacacaaaugc

SEQ ID NO: 3787958 - RNA, 21 nt, Salmonella typhimurium LT2
caugaaaaauguucagcgacc

SEQ ID NO: 3787959 - RNA, 11 nt, Salmonella typhimurium LT2
caugaaaauau

SEQ ID NO: 3787960 - RNA, 17 nt, Salmonella typhimurium LT2
caugaaaauaugaugcu

SEQ ID NO: 3787961 - RNA, 14 nt, Salmonella typhimurium LT2
caugaagaaaauac

SEQ ID NO: 3787962 - RNA, 18 nt, Salmonella typhimurium LT2
caugaaucgcgcgcgcca

SEQ ID NO: 3787963 - RNA, 18 nt, Salmonella typhimurium LT2
caugaaugccccagcgcu

SEQ ID NO: 3787964 - RNA, 20 nt, Salmonella typhimurium LT2
caugaauuacagcucauaaa

SEQ ID NO: 3787965 - RNA, 15 nt, Salmonella typhimurium LT2
caugaauucaacgcc

SEQ ID NO: 3787966 - RNA, 22 nt, Salmonella typhimurium LT2
caugacaucgcuuaaugucaca

SEQ ID NO: 3787967 - RNA, 18 nt, Salmonella typhimurium LT2
caugaccauccacgggcu

SEQ ID NO: 3787968 - RNA, 21 nt, Salmonella typhimurium LT2
caugaccauucgcacuccagg

SEQ ID NO: 3787969 - RNA, 17 nt, Salmonella typhimurium LT2
caugaccugggcgccag

SEQ ID NO: 3787970 - RNA, 20 nt, Salmonella typhimurium LT2
caugacgccgcagccugaug

SEQ ID NO: 3787971 - RNA, 15 nt, Salmonella typhimurium LT2
caugacgcuggaagu

SEQ ID NO: 3787972 - RNA, 16 nt, Salmonella typhimurium LT2
caugacgggggcgauc

SEQ ID NO: 3787973 - RNA, 22 nt, Salmonella typhimurium LT2
caugacgggggcgaucagcagg

SEQ ID NO: 3787974 - RNA, 13 nt, Salmonella typhimurium LT2
caugagaagaaaa

SEQ ID NO: 3787975 - RNA, 21 nt, Salmonella typhimurium LT2
caugagcaguuaauuucccac

SEQ ID NO: 3787976 - RNA, 16 nt, Salmonella typhimurium LT2
caugagccagcccuca

SEQ ID NO: 3787977 - RNA, 19 nt, Salmonella typhimurium LT2
caugauaaucagcacgcca

SEQ ID NO: 3787978 - RNA, 18 nt, Salmonella typhimurium LT2
caugauaauggcauauaa

SEQ ID NO: 3787979 - RNA, 17 nt, Salmonella typhimurium LT2
caugauacccagcgucc

SEQ ID NO: 3787980 - RNA, 18 nt, Salmonella typhimurium LT2
caugauacccagcguccc

SEQ ID NO: 3787981 - RNA, 23 nt, Salmonella typhimurium LT2
caugauaguaucgcugcuaaacg

SEQ ID NO: 3787982 - RNA, 12 nt, Salmonella typhimurium LT2
caugauccagcg

SEQ ID NO: 3787983 - RNA, 18 nt, Salmonella typhimurium LT2
caugaucgauccgcauca

SEQ ID NO: 3787984 - RNA, 14 nt, Salmonella typhimurium LT2
caugaucgccgcca

SEQ ID NO: 3787985 - RNA, 14 nt, Salmonella typhimurium LT2
caugaucggccaga

SEQ ID NO: 3787986 - RNA, 21 nt, Salmonella typhimurium LT2
caugaucggcuggguuuccgg

SEQ ID NO: 3787987 - RNA, 13 nt, Salmonella typhimurium LT2
caugaucuuuccu

SEQ ID NO: 3787988 - RNA, 23 nt, Salmonella typhimurium LT2
caugaucuuuccuuuuucaggca

SEQ ID NO: 3787989 - RNA, 15 nt, Salmonella typhimurium LT2
caugaugagcgccau

SEQ ID NO: 3787990 - RNA, 23 nt, Salmonella typhimurium LT2
caugauggacguuuccugcgcca

SEQ ID NO: 3787991 - RNA, 18 nt, Salmonella typhimurium LT2
caugauggcgaacagccc

SEQ ID NO: 3787992 - RNA, 16 nt, Salmonella typhimurium LT2
caugauggcguaaucc

SEQ ID NO: 3787993 - RNA, 20 nt, Salmonella typhimurium LT2
caugaugggcgcacagcgcc

SEQ ID NO: 3787994 - RNA, 15 nt, Salmonella typhimurium LT2
caugauggugaacag

SEQ ID NO: 3787995 - RNA, 17 nt, Salmonella typhimurium LT2
caugauggugaacagaa

SEQ ID NO: 3787996 - RNA, 16 nt, Salmonella typhimurium LT2
caugcaacuucaccuc

SEQ ID NO: 3787997 - RNA, 15 nt, Salmonella typhimurium LT2
caugcaauuugaggu

SEQ ID NO: 3787998 - RNA, 14 nt, Salmonella typhimurium LT2
caugcaccagcccc

SEQ ID NO: 3787999 - RNA, 22 nt, Salmonella typhimurium LT2
caugcagagcaacgagaaccca

SEQ ID NO: 3788000 - RNA, 22 nt, Salmonella typhimurium LT2
caugcagcgcaaacucagagag

SEQ ID NO: 3788001 - RNA, 11 nt, Salmonella typhimurium LT2
caugcagcgcg

SEQ ID NO: 3788002 - RNA, 15 nt, Salmonella typhimurium LT2
caugcagcucaagcg

SEQ ID NO: 3788003 - RNA, 17 nt, Salmonella typhimurium LT2
caugcagcucaagcgcc

SEQ ID NO: 3788004 - RNA, 18 nt, Salmonella typhimurium LT2
caugcauaaugcagccau

SEQ ID NO: 3788005 - RNA, 14 nt, Salmonella typhimurium LT2
caugcaucaauggc

SEQ ID NO: 3788006 - RNA, 13 nt, Salmonella typhimurium LT2
caugccacugggu

SEQ ID NO: 3788007 - RNA, 12 nt, Salmonella typhimurium LT2
caugccaucggc

SEQ ID NO: 3788008 - RNA, 16 nt, Salmonella typhimurium LT2
cauuaccagcaauaac

SEQ ID NO: 3788009 - RNA, 13 nt, Salmonella typhimurium LT2
cauuacccccgcc

SEQ ID NO: 3788010 - RNA, 21 nt, Salmonella typhimurium LT2
cauuaccgcccuguccuccau

SEQ ID NO: 3788011 - RNA, 14 nt, Salmonella typhimurium LT2
cauuacgauaaaug

SEQ ID NO: 3788012 - RNA, 16 nt, Salmonella typhimurium LT2
cauuacgcuuccugcc

SEQ ID NO: 3788013 - RNA, 21 nt, Salmonella typhimurium LT2
cauuacuccgcuauaaaaauu

SEQ ID NO: 3788014 - RNA, 14 nt, Salmonella typhimurium LT2
cauuacucguccuu

SEQ ID NO: 3788015 - RNA, 23 nt, Salmonella typhimurium LT2
cauuagacaguuuuuucguucca

SEQ ID NO: 3788016 - RNA, 22 nt, Salmonella typhimurium LT2
cauuagcaugggcuaaagcauc

SEQ ID NO: 3788017 - RNA, 11 nt, Salmonella typhimurium LT2
cauuagcgccu

SEQ ID NO: 3788018 - RNA, 22 nt, Salmonella typhimurium LT2
cauuaguaauaaagcguagccg

SEQ ID NO: 3788019 - RNA, 17 nt, Salmonella typhimurium LT2
cauuauacgccuauuuu

SEQ ID NO: 3788020 - RNA, 19 nt, Salmonella typhimurium LT2
cauuaucgaugcguauuuc

SEQ ID NO: 3788021 - RNA, 21 nt, Salmonella typhimurium LT2
cauuauugcgaaauagcgcgg

SEQ ID NO: 3788022 - RNA, 14 nt, Salmonella typhimurium LT2
cauucaacgcauca

SEQ ID NO: 3788023 - RNA, 15 nt, Salmonella typhimurium LT2
cauucacgccgccau

SEQ ID NO: 3788024 - RNA, 20 nt, Salmonella typhimurium LT2
cauucagcggcugcgccugc

SEQ ID NO: 3788025 - RNA, 18 nt, Salmonella typhimurium LT2
cauucaggcuggcaaagc

SEQ ID NO: 3788026 - RNA, 14 nt, Salmonella typhimurium LT2
cauucaggcuuucc

SEQ ID NO: 3788027 - RNA, 19 nt, Salmonella typhimurium LT2
cauucagugaauuaugacc

SEQ ID NO: 3788028 - RNA, 14 nt, Salmonella typhimurium LT2
cauucauaaaagau

SEQ ID NO: 3788029 - RNA, 16 nt, Salmonella typhimurium LT2
cauucauugccgccag

SEQ ID NO: 3788030 - RNA, 12 nt, Salmonella typhimurium LT2
cauuccagaccc

SEQ ID NO: 3788031 - RNA, 12 nt, Salmonella typhimurium LT2
cauuccagaccu

SEQ ID NO: 3788032 - RNA, 14 nt, Salmonella typhimurium LT2
cauucccagcgccc

SEQ ID NO: 3788033 - RNA, 19 nt, Salmonella typhimurium LT2
cauucccgaauaccacaaa

SEQ ID NO: 3788034 - RNA, 18 nt, Salmonella typhimurium LT2
cauucccgccaauaacca

SEQ ID NO: 3788035 - RNA, 15 nt, Salmonella typhimurium LT2
cauucccgccgagaa

SEQ ID NO: 3788036 - RNA, 17 nt, Salmonella typhimurium LT2
cauucccguaaaagaag

SEQ ID NO: 3788037 - RNA, 17 nt, Salmonella typhimurium LT2
cauucccgucccugcau

SEQ ID NO: 3788038 - RNA, 14 nt, Salmonella typhimurium LT2
cauuccgcccagga

SEQ ID NO: 3788039 - RNA, 16 nt, Salmonella typhimurium LT2
cauuccugccgccgca

SEQ ID NO: 3788040 - RNA, 21 nt, Salmonella typhimurium LT2
cauuccuuuaaauauccgcag

SEQ ID NO: 3788041 - RNA, 17 nt, Salmonella typhimurium LT2
cauuccuuuagcuucca

SEQ ID NO: 3788042 - RNA, 16 nt, Salmonella typhimurium LT2
cauucgaauccuccug

SEQ ID NO: 3788043 - RNA, 24 nt, Salmonella typhimurium LT2
cauucgaccacaacccacuggccu

SEQ ID NO: 3788044 - RNA, 16 nt, Salmonella typhimurium LT2
cauucgcacuccaggc

SEQ ID NO: 3788045 - RNA, 13 nt, Salmonella typhimurium LT2
cauucgccccagc

SEQ ID NO: 3788046 - RNA, 21 nt, Salmonella typhimurium LT2
cauucgcgagccuuuuaucaa

SEQ ID NO: 3788047 - RNA, 20 nt, Salmonella typhimurium LT2
cauucgcgcauacucuuccg

SEQ ID NO: 3788048 - RNA, 14 nt, Salmonella typhimurium LT2
cauucgcuccucag

SEQ ID NO: 3788049 - RNA, 19 nt, Salmonella typhimurium LT2
cauucgcuguuguugacac

SEQ ID NO: 3788050 - RNA, 23 nt, Salmonella typhimurium LT2
cauucgggacaaacccccagcca

SEQ ID NO: 3788051 - RNA, 16 nt, Salmonella typhimurium LT2
cauucgguacggcgcu

SEQ ID NO: 3788052 - RNA, 15 nt, Salmonella typhimurium LT2
cauucgguaguucca

SEQ ID NO: 3788053 - RNA, 20 nt, Salmonella typhimurium LT2
cauucguuuugcugauauga

SEQ ID NO: 3788054 - RNA, 20 nt, Salmonella typhimurium LT2
cauucuacaaguucagcagg

SEQ ID NO: 3788055 - RNA, 20 nt, Salmonella typhimurium LT2
cauucucgccgugacuguuc

SEQ ID NO: 3788056 - RNA, 20 nt, Salmonella typhimurium LT2
cauucugucagcaauugccu

SEQ ID NO: 3788057 - RNA, 15 nt, Salmonella typhimurium LT2
cauucuugcgccgca

SEQ ID NO: 3788058 - RNA, 23 nt, Salmonella typhimurium LT2
cauucuuugcuuuguaaagcgcc

SEQ ID NO: 3788059 - RNA, 22 nt, Salmonella typhimurium LT2
cauugaccaccauauucgccac

SEQ ID NO: 3788060 - RNA, 14 nt, Salmonella typhimurium LT2
cauugacucaugaa

SEQ ID NO: 3788061 - RNA, 23 nt, Salmonella typhimurium LT2
cauugagcaucaaacuuuuaaau

SEQ ID NO: 3788062 - RNA, 18 nt, Salmonella typhimurium LT2
cauugagcauucuacagu

SEQ ID NO: 3788063 - RNA, 18 nt, Salmonella typhimurium LT2
cauugaggcuacccagac

SEQ ID NO: 3788064 - RNA, 19 nt, Salmonella typhimurium LT2
cauugaggcuacccagaca

SEQ ID NO: 3788065 - RNA, 21 nt, Salmonella typhimurium LT2
cauugauauagaguccagcca

SEQ ID NO: 3788066 - RNA, 22 nt, Salmonella typhimurium LT2
cauugauauagaguccagccau

SEQ ID NO: 3788067 - RNA, 11 nt, Salmonella typhimurium LT2
cauugcagcau

SEQ ID NO: 3788068 - RNA, 12 nt, Salmonella typhimurium LT2
cauugcagcgcg

SEQ ID NO: 3788069 - RNA, 20 nt, Salmonella typhimurium LT2
cauugccauguuaauaccag

SEQ ID NO: 3788070 - RNA, 16 nt, Salmonella typhimurium LT2
cauugccgauuucacg

SEQ ID NO: 3788071 - RNA, 13 nt, Salmonella typhimurium LT2
cauugccgccagu

SEQ ID NO: 3788072 - RNA, 14 nt, Salmonella typhimurium LT2
cauugccguaaauu

SEQ ID NO: 3788073 - RNA, 19 nt, Salmonella typhimurium LT2
cauugccguuaacugcugc

SEQ ID NO: 3788074 - RNA, 20 nt, Salmonella typhimurium LT2
cauugccguuaacugcugcu

SEQ ID NO: 3788075 - RNA, 18 nt, Salmonella typhimurium LT2
cauugccuuucaauacuu

SEQ ID NO: 3788076 - RNA, 23 nt, Salmonella typhimurium LT2
cauugccuuucaauacuucgaca

SEQ ID NO: 3788077 - RNA, 14 nt, Salmonella typhimurium LT2
cauugcgagaaaaa

SEQ ID NO: 3788078 - RNA, 13 nt, Salmonella typhimurium LT2
cauugcgccaaga

SEQ ID NO: 3788079 - RNA, 22 nt, Salmonella typhimurium LT2
cauugcguaaugagcgucgcca

SEQ ID NO: 3788080 - RNA, 13 nt, Salmonella typhimurium LT2
cauugcguauuuc

SEQ ID NO: 3788081 - RNA, 16 nt, Salmonella typhimurium LT2
cauugcgucccagcac

SEQ ID NO: 3788082 - RNA, 18 nt, Salmonella typhimurium LT2
cauugcucauaccgccgc

SEQ ID NO: 3788083 - RNA, 20 nt, Salmonella typhimurium LT2
cauugcucauaccgccgccc

SEQ ID NO: 3788084 - RNA, 22 nt, Salmonella typhimurium LT2
cauugcucauaccgccgcccag

SEQ ID NO: 3788085 - RNA, 16 nt, Salmonella typhimurium LT2
cauugcugucgacaau

SEQ ID NO: 3788086 - RNA, 14 nt, Salmonella typhimurium LT2
cauugcuuucuuga

SEQ ID NO: 3788087 - RNA, 17 nt, Salmonella typhimurium LT2
cauugcuuucuugaauc

SEQ ID NO: 3788088 - RNA, 19 nt, Salmonella typhimurium LT2
cauuggaaaaccccauccc

SEQ ID NO: 3788089 - RNA, 20 nt, Salmonella typhimurium LT2
cauuggaaaaccccaucccg

SEQ ID NO: 3788090 - RNA, 18 nt, Salmonella typhimurium LT2
cauuggcaaugaaaccgc

SEQ ID NO: 3788091 - RNA, 13 nt, Salmonella typhimurium LT2
cauuggcuaauga

SEQ ID NO: 3788092 - RNA, 14 nt, Salmonella typhimurium LT2
cauuggcuaaugaa

SEQ ID NO: 3788093 - RNA, 20 nt, Salmonella typhimurium LT2
cauugggauggauaaauagg

SEQ ID NO: 3788094 - RNA, 21 nt, Salmonella typhimurium LT2
cauuggggacgcgcaaacgcu

SEQ ID NO: 3788095 - RNA, 14 nt, Salmonella typhimurium LT2
cauuguaaaaccga

SEQ ID NO: 3788096 - RNA, 19 nt, Salmonella typhimurium LT2
cauugucauuaacgucgca

SEQ ID NO: 3788097 - RNA, 19 nt, Salmonella typhimurium LT2
cauuguccuuuaucugccc

SEQ ID NO: 3788098 - RNA, 14 nt, Salmonella typhimurium LT2
cauugucuuuuucu

SEQ ID NO: 3788099 - RNA, 19 nt, Salmonella typhimurium LT2
cauuguuccugcuggcaaa

SEQ ID NO: 3788100 - RNA, 23 nt, Salmonella typhimurium LT2
cauuguucuguccggaagacagc

SEQ ID NO: 3788101 - RNA, 17 nt, Salmonella typhimurium LT2
cauuuaaugaugcguuc

SEQ ID NO: 3788102 - RNA, 17 nt, Salmonella typhimurium LT2
cauuuauugcagguauu

SEQ ID NO: 3788103 - RNA, 18 nt, Salmonella typhimurium LT2
cauuucaaagcguucuga

SEQ ID NO: 3788104 - RNA, 22 nt, Salmonella typhimurium LT2
cauuucaaagcguucugaacug

SEQ ID NO: 3788105 - RNA, 21 nt, Salmonella typhimurium LT2
cauuucaagcagacgaucggc

SEQ ID NO: 3788106 - RNA, 15 nt, Salmonella typhimurium LT2
cauuucaaucgccac

SEQ ID NO: 3788107 - RNA, 15 nt, Salmonella typhimurium LT2
cauuucaaugcguaa

SEQ ID NO: 3788108 - RNA, 16 nt, Salmonella typhimurium LT2
cauuucacaaauuaaa

SEQ ID NO: 3788109 - RNA, 21 nt, Salmonella typhimurium LT2
cauuucagcgaguuccaccau

SEQ ID NO: 3788110 - RNA, 12 nt, Salmonella typhimurium LT2
cauuucagcgcc

SEQ ID NO: 3788111 - RNA, 16 nt, Salmonella typhimurium LT2
cauuucaggcaaaaaa

SEQ ID NO: 3788112 - RNA, 21 nt, Salmonella typhimurium LT2
ccaagaaacgcaguugccccu

SEQ ID NO: 3788113 - RNA, 18 nt, Salmonella typhimurium LT2
ccaagaccgccuaacagc

SEQ ID NO: 3788114 - RNA, 21 nt, Salmonella typhimurium LT2
ccaagauaagaaguaaacaga

SEQ ID NO: 3788115 - RNA, 14 nt, Salmonella typhimurium LT2
ccaagauccagcgg

SEQ ID NO: 3788116 - RNA, 21 nt, Salmonella typhimurium LT2
ccaagaucggagauauaaacc

SEQ ID NO: 3788117 - RNA, 13 nt, Salmonella typhimurium LT2
ccaagcagcgcca

SEQ ID NO: 3788118 - RNA, 18 nt, Salmonella typhimurium LT2
ccaagcaggaaccccuga

SEQ ID NO: 3788119 - RNA, 16 nt, Salmonella typhimurium LT2
ccaagcgccucgcuga

SEQ ID NO: 3788120 - RNA, 22 nt, Salmonella typhimurium LT2
ccaagcgcgguaaauuucuuga

SEQ ID NO: 3788121 - RNA, 19 nt, Salmonella typhimurium LT2
ccaagcggcaucucgccaa

SEQ ID NO: 3788122 - RNA, 15 nt, Salmonella typhimurium LT2
ccaagcguaguacgu

SEQ ID NO: 3788123 - RNA, 17 nt, Salmonella typhimurium LT2
ccaagcgucagcauggu

SEQ ID NO: 3788124 - RNA, 16 nt, Salmonella typhimurium LT2
ccaaguaacacggcga

SEQ ID NO: 3788125 - RNA, 16 nt, Salmonella typhimurium LT2
ccaauaauaaucccaa

SEQ ID NO: 3788126 - RNA, 12 nt, Salmonella typhimurium LT2
ccaauacccagc

SEQ ID NO: 3788127 - RNA, 16 nt, Salmonella typhimurium LT2
ccaauacccagcgcca

SEQ ID NO: 3788128 - RNA, 23 nt, Salmonella typhimurium LT2
ccaauaccggcguaauugcgccu

SEQ ID NO: 3788129 - RNA, 23 nt, Salmonella typhimurium LT2
ccaauauccggauauucugcacg

SEQ ID NO: 3788130 - RNA, 22 nt, Salmonella typhimurium LT2
ccaauauuaaagaugccugaaa

SEQ ID NO: 3788131 - RNA, 21 nt, Salmonella typhimurium LT2
ccaauauuaauguauuauuau

SEQ ID NO: 3788132 - RNA, 22 nt, Salmonella typhimurium LT2
ccaaucaugucaaauucaagcc

SEQ ID NO: 3788133 - RNA, 14 nt, Salmonella typhimurium LT2
ccaaucccaccacu

SEQ ID NO: 3788134 - RNA, 19 nt, Salmonella typhimurium LT2
ccaaucgagaagccaucaa

SEQ ID NO: 3788135 - RNA, 12 nt, Salmonella typhimurium LT2
ccaaucgccagu

SEQ ID NO: 3788136 - RNA, 20 nt, Salmonella typhimurium LT2
ccaaucgccgccgccagguu

SEQ ID NO: 3788137 - RNA, 18 nt, Salmonella typhimurium LT2
ccaaucgcggcgacaucg

SEQ ID NO: 3788138 - RNA, 15 nt, Salmonella typhimurium LT2
ccaaucuccagcauc

SEQ ID NO: 3788139 - RNA, 14 nt, Salmonella typhimurium LT2
ccaaugcgaaaaua

SEQ ID NO: 3788140 - RNA, 12 nt, Salmonella typhimurium LT2
ccaaugcggaaa

SEQ ID NO: 3788141 - RNA, 14 nt, Salmonella typhimurium LT2
ccaauguaaauuaa

SEQ ID NO: 3788142 - RNA, 17 nt, Salmonella typhimurium LT2
ccaauguacacgaaaua

SEQ ID NO: 3788143 - RNA, 15 nt, Salmonella typhimurium LT2
ccaauguuaauaagc

SEQ ID NO: 3788144 - RNA, 22 nt, Salmonella typhimurium LT2
ccaauguuaauaagcagaacgu

SEQ ID NO: 3788145 - RNA, 16 nt, Salmonella typhimurium LT2
ccaauucccagacccg

SEQ ID NO: 3788146 - RNA, 15 nt, Salmonella typhimurium LT2
ccaauugcugcaucg

SEQ ID NO: 3788147 - RNA, 15 nt, Salmonella typhimurium LT2
ccacaaacgccggau

SEQ ID NO: 3788148 - RNA, 15 nt, Salmonella typhimurium LT2
ccacaaacgccguca

SEQ ID NO: 3788149 - RNA, 13 nt, Salmonella typhimurium LT2
ccacaaaggcgcg

SEQ ID NO: 3788150 - RNA, 21 nt, Salmonella typhimurium LT2
ccacaaauuuugauaaaaaca

SEQ ID NO: 3788151 - RNA, 22 nt, Salmonella typhimurium LT2
ccacaaauuuugauaaaaacac

SEQ ID NO: 3788152 - RNA, 23 nt, Salmonella typhimurium LT2
ccacaaccgcccccaacugagcg

SEQ ID NO: 3788153 - RNA, 22 nt, Salmonella typhimurium LT2
ccacaacgugauaaccaacagg

SEQ ID NO: 3788154 - RNA, 18 nt, Salmonella typhimurium LT2
ccacaaucacagcgcaga

SEQ ID NO: 3788155 - RNA, 19 nt, Salmonella typhimurium LT2
ccacaauggcaggcagcag

SEQ ID NO: 3788156 - RNA, 22 nt, Salmonella typhimurium LT2
ccacaauguugauggcgcugcc

SEQ ID NO: 3788157 - RNA, 18 nt, Salmonella typhimurium LT2
ccacaauugccagcaggu

SEQ ID NO: 3788158 - RNA, 20 nt, Salmonella typhimurium LT2
ccacaccgguucgcggcaga

SEQ ID NO: 3788159 - RNA, 21 nt, Salmonella typhimurium LT2
ccacaccugaugguuauuuuc

SEQ ID NO: 3788160 - RNA, 15 nt, Salmonella typhimurium LT2
ccacacucuccuccc

SEQ ID NO: 3788161 - RNA, 16 nt, Salmonella typhimurium LT2
ccacacugacgcgcca

SEQ ID NO: 3788162 - RNA, 16 nt, Salmonella typhimurium LT2
ccacagauaaaacaaa

SEQ ID NO: 3788163 - RNA, 18 nt, Salmonella typhimurium LT2
ccacagccaccgccagca

SEQ ID NO: 3788164 - RNA, 20 nt, Salmonella typhimurium LT2
ccacagcgaauuccggccau

SEQ ID NO: 3788165 - RNA, 11 nt, Salmonella typhimurium LT2
ccacagcgcca

SEQ ID NO: 3788166 - RNA, 17 nt, Salmonella typhimurium LT2
ccacagcgccagacacu

SEQ ID NO: 3788167 - RNA, 23 nt, Salmonella typhimurium LT2
ccacagcggaugguauuucaggc

SEQ ID NO: 3788168 - RNA, 23 nt, Salmonella typhimurium LT2
ccacaggaaccgguagccaggcg

SEQ ID NO: 3788169 - RNA, 18 nt, Salmonella typhimurium LT2
ccacaggaucaccgccac

SEQ ID NO: 3788170 - RNA, 15 nt, Salmonella typhimurium LT2
ccacaggccaacaua

SEQ ID NO: 3788171 - RNA, 21 nt, Salmonella typhimurium LT2
ccacaggccguucauucgccc

SEQ ID NO: 3788172 - RNA, 21 nt, Salmonella typhimurium LT2
ccacagguaaaauugccgcca

SEQ ID NO: 3788173 - RNA, 21 nt, Salmonella typhimurium LT2
ccacagucauggcuuuuaccc

SEQ ID NO: 3788174 - RNA, 16 nt, Salmonella typhimurium LT2
ccacauauaaguaacu

SEQ ID NO: 3788175 - RNA, 22 nt, Salmonella typhimurium LT2
ccacauauugagcugauaacgu

SEQ ID NO: 3788176 - RNA, 23 nt, Salmonella typhimurium LT2
ccacaucgcgauuuagcguaaau

SEQ ID NO: 3788177 - RNA, 17 nt, Salmonella typhimurium LT2
ccacaucguuacccauc

SEQ ID NO: 3788178 - RNA, 18 nt, Salmonella typhimurium LT2
ccacaucguuggccgcca

SEQ ID NO: 3788179 - RNA, 13 nt, Salmonella typhimurium LT2
ccacaugaccagc

SEQ ID NO: 3788180 - RNA, 14 nt, Salmonella typhimurium LT2
ccacaugaccagcg

SEQ ID NO: 3788181 - RNA, 17 nt, Salmonella typhimurium LT2
ccacaugaccagcgccg

SEQ ID NO: 3788182 - RNA, 15 nt, Salmonella typhimurium LT2
ccacauuaaagagcg

SEQ ID NO: 3788183 - RNA, 15 nt, Salmonella typhimurium LT2
ccacauucaggcggu

SEQ ID NO: 3788184 - RNA, 16 nt, Salmonella typhimurium LT2
ccacauuccagaccug

SEQ ID NO: 3788185 - RNA, 18 nt, Salmonella typhimurium LT2
ccacauuuccuuuucgca

SEQ ID NO: 3788186 - RNA, 11 nt, Salmonella typhimurium LT2
ccaccacaaac

SEQ ID NO: 3788187 - RNA, 12 nt, Salmonella typhimurium LT2
ccaccacaaagc

SEQ ID NO: 3788188 - RNA, 21 nt, Salmonella typhimurium LT2
ccaccacccagugccaccagc

SEQ ID NO: 3788189 - RNA, 14 nt, Salmonella typhimurium LT2
ccaccaccuccugc

SEQ ID NO: 3788190 - RNA, 18 nt, Salmonella typhimurium LT2
ccaccacguaaugcgccc

SEQ ID NO: 3788191 - RNA, 21 nt, Salmonella typhimurium LT2
ccaccacugauuccagagcga

SEQ ID NO: 3788192 - RNA, 12 nt, Salmonella typhimurium LT2
ccaccagcacag

SEQ ID NO: 3788193 - RNA, 13 nt, Salmonella typhimurium LT2
ccaccagcacagg

SEQ ID NO: 3788194 - RNA, 13 nt, Salmonella typhimurium LT2
ccaccagccgcau

SEQ ID NO: 3788195 - RNA, 18 nt, Salmonella typhimurium LT2
ccaccagccggagccggu

SEQ ID NO: 3788196 - RNA, 12 nt, Salmonella typhimurium LT2
ccaccagcgcca

SEQ ID NO: 3788197 - RNA, 13 nt, Salmonella typhimurium LT2
ccaccagcgccag

SEQ ID NO: 3788198 - RNA, 23 nt, Salmonella typhimurium LT2
ccaccagcgccauaauccagaau

SEQ ID NO: 3788199 - RNA, 15 nt, Salmonella typhimurium LT2
ccaccagcggacggc

SEQ ID NO: 3788200 - RNA, 16 nt, Salmonella typhimurium LT2
ccaccagcuuaucuga

SEQ ID NO: 3788201 - RNA, 15 nt, Salmonella typhimurium LT2
ccaccagguucagca

SEQ ID NO: 3788202 - RNA, 20 nt, Salmonella typhimurium LT2
ccaccaguaaccgccacagc

SEQ ID NO: 3788203 - RNA, 21 nt, Salmonella typhimurium LT2
ccaccauacccaacagcagac

SEQ ID NO: 3788204 - RNA, 16 nt, Salmonella typhimurium LT2
ccaccauaggccagcg

SEQ ID NO: 3788205 - RNA, 14 nt, Salmonella typhimurium LT2
ccaccauaguuucg

SEQ ID NO: 3788206 - RNA, 19 nt, Salmonella typhimurium LT2
ccaccauaguuucgaacgc

SEQ ID NO: 3788207 - RNA, 21 nt, Salmonella typhimurium LT2
ccaccauaguuucgaacgcca

SEQ ID NO: 3788208 - RNA, 22 nt, Salmonella typhimurium LT2
ccaccauaucgcagaccaucca

SEQ ID NO: 3788209 - RNA, 19 nt, Salmonella typhimurium LT2
ccaccauauucgccaccgc

SEQ ID NO: 3788210 - RNA, 21 nt, Salmonella typhimurium LT2
ccaccauauucgccaccgcgc

SEQ ID NO: 3788211 - RNA, 17 nt, Salmonella typhimurium LT2
ccaccaucagacccgau

SEQ ID NO: 3788212 - RNA, 19 nt, Salmonella typhimurium LT2
ccaccaucuccugacugcc

SEQ ID NO: 3788213 - RNA, 21 nt, Salmonella typhimurium LT2
ccaccaucuccugacugccgc

SEQ ID NO: 3788214 - RNA, 16 nt, Salmonella typhimurium LT2
ccaccaugcugguugg

SEQ ID NO: 3788215 - RNA, 16 nt, Salmonella typhimurium LT2
ccacccauuuuccgcu

SEQ ID NO: 3788216 - RNA, 15 nt, Salmonella typhimurium LT2
ccacugcaucucuuc

SEQ ID NO: 3788217 - RNA, 12 nt, Salmonella typhimurium LT2
ccacugcccaga

SEQ ID NO: 3788218 - RNA, 12 nt, Salmonella typhimurium LT2
ccacugcccgcc

SEQ ID NO: 3788219 - RNA, 21 nt, Salmonella typhimurium LT2
ccacuggcagcgccugacggc

SEQ ID NO: 3788220 - RNA, 14 nt, Salmonella typhimurium LT2
ccacuggccuccca

SEQ ID NO: 3788221 - RNA, 19 nt, Salmonella typhimurium LT2
ccacuggcuuuccugauca

SEQ ID NO: 3788222 - RNA, 15 nt, Salmonella typhimurium LT2
ccacuggguuuccca

SEQ ID NO: 3788223 - RNA, 23 nt, Salmonella typhimurium LT2
ccacugguaggcauccagaugua

SEQ ID NO: 3788224 - RNA, 19 nt, Salmonella typhimurium LT2
ccacuuauuuguauugacg

SEQ ID NO: 3788225 - RNA, 22 nt, Salmonella typhimurium LT2
ccacuucaucagcguguacggc

SEQ ID NO: 3788226 - RNA, 20 nt, Salmonella typhimurium LT2
ccacuucuuccagcggcagg

SEQ ID NO: 3788227 - RNA, 16 nt, Salmonella typhimurium LT2
ccacuucuuccagcgu

SEQ ID NO: 3788228 - RNA, 19 nt, Salmonella typhimurium LT2
ccacuuucuguaauuugaa

SEQ ID NO: 3788229 - RNA, 12 nt, Salmonella typhimurium LT2
ccacuuugcgcu

SEQ ID NO: 3788230 - RNA, 16 nt, Salmonella typhimurium LT2
ccacuuuuccggcacc

SEQ ID NO: 3788231 - RNA, 16 nt, Salmonella typhimurium LT2
ccagaaaaaaaagcgc

SEQ ID NO: 3788232 - RNA, 20 nt, Salmonella typhimurium LT2
ccagaaacaucgguaauagc

SEQ ID NO: 3788233 - RNA, 13 nt, Salmonella typhimurium LT2
ccagaaaccgccc

SEQ ID NO: 3788234 - RNA, 11 nt, Salmonella typhimurium LT2
ccagaaacugu

SEQ ID NO: 3788235 - RNA, 15 nt, Salmonella typhimurium LT2
ccagaaacugugaug

SEQ ID NO: 3788236 - RNA, 12 nt, Salmonella typhimurium LT2
ccagaaaggcgc

SEQ ID NO: 3788237 - RNA, 15 nt, Salmonella typhimurium LT2
ccagaacaucuaccg

SEQ ID NO: 3788238 - RNA, 17 nt, Salmonella typhimurium LT2
ccagaaccguugcgccc

SEQ ID NO: 3788239 - RNA, 19 nt, Salmonella typhimurium LT2
ccagaaccucacggagaaa

SEQ ID NO: 3788240 - RNA, 23 nt, Salmonella typhimurium LT2
ccagaacgaauuuacucgccaau

SEQ ID NO: 3788241 - RNA, 18 nt, Salmonella typhimurium LT2
ccagaacgagaggaggag

SEQ ID NO: 3788242 - RNA, 14 nt, Salmonella typhimurium LT2
ccagaacucaucuu

SEQ ID NO: 3788243 - RNA, 19 nt, Salmonella typhimurium LT2
ccagaacugcgaaaucacc

SEQ ID NO: 3788244 - RNA, 15 nt, Salmonella typhimurium LT2
ccagaagagaagcuu

SEQ ID NO: 3788245 - RNA, 17 nt, Salmonella typhimurium LT2
ccagaagcacuucucca

SEQ ID NO: 3788246 - RNA, 18 nt, Salmonella typhimurium LT2
ccagaaggcgaacauaag

SEQ ID NO: 3788247 - RNA, 19 nt, Salmonella typhimurium LT2
ccagaauacgccgccgccc

SEQ ID NO: 3788248 - RNA, 20 nt, Salmonella typhimurium LT2
ccagaauacgccgccgccca

SEQ ID NO: 3788249 - RNA, 18 nt, Salmonella typhimurium LT2
ccagaaucaccgacagca

SEQ ID NO: 3788250 - RNA, 19 nt, Salmonella typhimurium LT2
ccagaaucaccgacagcac

SEQ ID NO: 3788251 - RNA, 21 nt, Salmonella typhimurium LT2
ccagaaugauaaugccgcuga

SEQ ID NO: 3788252 - RNA, 16 nt, Salmonella typhimurium LT2
ccagaaugcccagcaa

SEQ ID NO: 3788253 - RNA, 17 nt, Salmonella typhimurium LT2
ccagaaugcccaggccc

SEQ ID NO: 3788254 - RNA, 21 nt, Salmonella typhimurium LT2
ccagaaugcccugcuguucca

SEQ ID NO: 3788255 - RNA, 20 nt, Salmonella typhimurium LT2
ccagaauguggguggcgaua

SEQ ID NO: 3788256 - RNA, 14 nt, Salmonella typhimurium LT2
ccagacaagcacau

SEQ ID NO: 3788257 - RNA, 11 nt, Salmonella typhimurium LT2
ccagacacagu

SEQ ID NO: 3788258 - RNA, 13 nt, Salmonella typhimurium LT2
ccagacacuggaa

SEQ ID NO: 3788259 - RNA, 22 nt, Salmonella typhimurium LT2
ccagacacuggaaacagccaau

SEQ ID NO: 3788260 - RNA, 18 nt, Salmonella typhimurium LT2
ccagacagauaacaccag

SEQ ID NO: 3788261 - RNA, 20 nt, Salmonella typhimurium LT2
ccagacagauaacaccagcg

SEQ ID NO: 3788262 - RNA, 22 nt, Salmonella typhimurium LT2
ccagacaucacguucgcgcaua

SEQ ID NO: 3788263 - RNA, 15 nt, Salmonella typhimurium LT2
ccagacaugcacaug

SEQ ID NO: 3788264 - RNA, 18 nt, Salmonella typhimurium LT2
ccagaccauuaacgccgc

SEQ ID NO: 3788265 - RNA, 19 nt, Salmonella typhimurium LT2
ccagacccgauaguguaaa

SEQ ID NO: 3788266 - RNA, 12 nt, Salmonella typhimurium LT2
ccagacccgcug

SEQ ID NO: 3788267 - RNA, 13 nt, Salmonella typhimurium LT2
ccagaccgacagc

SEQ ID NO: 3788268 - RNA, 19 nt, Salmonella typhimurium LT2
ccagaccggcaucucaucu

SEQ ID NO: 3788269 - RNA, 20 nt, Salmonella typhimurium LT2
ccagaccguagauaagcgcc

SEQ ID NO: 3788270 - RNA, 23 nt, Salmonella typhimurium LT2
ccagaccugaauauucggcucca

SEQ ID NO: 3788271 - RNA, 18 nt, Salmonella typhimurium LT2
ccagacgaccguaauagc

SEQ ID NO: 3788272 - RNA, 23 nt, Salmonella typhimurium LT2
ccagacgccgcgccgcggcgucu

SEQ ID NO: 3788273 - RNA, 15 nt, Salmonella typhimurium LT2
ccagacgcgccugca

SEQ ID NO: 3788274 - RNA, 17 nt, Salmonella typhimurium LT2
ccagacgcguaaccccu

SEQ ID NO: 3788275 - RNA, 19 nt, Salmonella typhimurium LT2
ccagacgcguaaccccugc

SEQ ID NO: 3788276 - RNA, 20 nt, Salmonella typhimurium LT2
ccagacgcugauagccacgg

SEQ ID NO: 3788277 - RNA, 19 nt, Salmonella typhimurium LT2
ccagacggcgcccagccug

SEQ ID NO: 3788278 - RNA, 22 nt, Salmonella typhimurium LT2
ccagacggcgcccagccugccc

SEQ ID NO: 3788279 - RNA, 17 nt, Salmonella typhimurium LT2
ccagacgggccaggcga

SEQ ID NO: 3788280 - RNA, 16 nt, Salmonella typhimurium LT2
ccagacgguuuauccc

SEQ ID NO: 3788281 - RNA, 20 nt, Salmonella typhimurium LT2
ccagacgguuuauccccgcu

SEQ ID NO: 3788282 - RNA, 16 nt, Salmonella typhimurium LT2
ccagacucagccaggu

SEQ ID NO: 3788283 - RNA, 21 nt, Salmonella typhimurium LT2
ccagagagcguuucuacgcca

SEQ ID NO: 3788284 - RNA, 21 nt, Salmonella typhimurium LT2
ccagagcaagcucuguucaaa

SEQ ID NO: 3788285 - RNA, 18 nt, Salmonella typhimurium LT2
ccagagcgcggccuuugc

SEQ ID NO: 3788286 - RNA, 20 nt, Salmonella typhimurium LT2
ccagaggaaauccuuccagc

SEQ ID NO: 3788287 - RNA, 20 nt, Salmonella typhimurium LT2
ccagaggaucuggacgccaa

SEQ ID NO: 3788288 - RNA, 18 nt, Salmonella typhimurium LT2
ccagaggcuaaucaggaa

SEQ ID NO: 3788289 - RNA, 15 nt, Salmonella typhimurium LT2
ccagagucaccagca

SEQ ID NO: 3788290 - RNA, 16 nt, Salmonella typhimurium LT2
ccagagucaccagcac

SEQ ID NO: 3788291 - RNA, 14 nt, Salmonella typhimurium LT2
ccagauaaaucagc

SEQ ID NO: 3788292 - RNA, 21 nt, Salmonella typhimurium LT2
ccagauaagccugcgcgccug

SEQ ID NO: 3788293 - RNA, 23 nt, Salmonella typhimurium LT2
ccagauaagccugcgcgccugcu

SEQ ID NO: 3788294 - RNA, 21 nt, Salmonella typhimurium LT2
ccagauaagcucuccuggaug

SEQ ID NO: 3788295 - RNA, 18 nt, Salmonella typhimurium LT2
ccagauaauauucagauc

SEQ ID NO: 3788296 - RNA, 20 nt, Salmonella typhimurium LT2
ccagauaaucaaacgcgccg

SEQ ID NO: 3788297 - RNA, 22 nt, Salmonella typhimurium LT2
ccagauaaucgccgccagcuca

SEQ ID NO: 3788298 - RNA, 13 nt, Salmonella typhimurium LT2
ccagauacauggc

SEQ ID NO: 3788299 - RNA, 13 nt, Salmonella typhimurium LT2
ccagauacgcacg

SEQ ID NO: 3788300 - RNA, 19 nt, Salmonella typhimurium LT2
ccagauagaaccacgcaaa

SEQ ID NO: 3788301 - RNA, 14 nt, Salmonella typhimurium LT2
ccagauagcgcugc

SEQ ID NO: 3788302 - RNA, 18 nt, Salmonella typhimurium LT2
ccagauagcgcugcgcca

SEQ ID NO: 3788303 - RNA, 16 nt, Salmonella typhimurium LT2
ccagauagggccaggc

SEQ ID NO: 3788304 - RNA, 16 nt, Salmonella typhimurium LT2
ccagauaguggcugag

SEQ ID NO: 3788305 - RNA, 17 nt, Salmonella typhimurium LT2
ccagauauccgcgcuca

SEQ ID NO: 3788306 - RNA, 22 nt, Salmonella typhimurium LT2
ccagauaucgcguacaggaugu

SEQ ID NO: 3788307 - RNA, 17 nt, Salmonella typhimurium LT2
ccagauauugccgacca

SEQ ID NO: 3788308 - RNA, 12 nt, Salmonella typhimurium LT2
ccagauccgguu

SEQ ID NO: 3788309 - RNA, 13 nt, Salmonella typhimurium LT2
ccagaucgugcca

SEQ ID NO: 3788310 - RNA, 12 nt, Salmonella typhimurium LT2
ccagaucucaca

SEQ ID NO: 3788311 - RNA, 15 nt, Salmonella typhimurium LT2
ccagaucucacaaga

SEQ ID NO: 3788312 - RNA, 17 nt, Salmonella typhimurium LT2
ccagaucucacaagauu

SEQ ID NO: 3788313 - RNA, 16 nt, Salmonella typhimurium LT2
ccagaucuucccaguu

SEQ ID NO: 3788314 - RNA, 15 nt, Salmonella typhimurium LT2
ccagaugaagcgcau

SEQ ID NO: 3788315 - RNA, 23 nt, Salmonella typhimurium LT2
ccagaugacacuaucuccuuccg

SEQ ID NO: 3788316 - RNA, 17 nt, Salmonella typhimurium LT2
ccagauggcaagauuaa

SEQ ID NO: 3788317 - RNA, 22 nt, Salmonella typhimurium LT2
ccagauggcaagauuaaccagc

SEQ ID NO: 3788318 - RNA, 18 nt, Salmonella typhimurium LT2
ccagauggcugcacccgg

SEQ ID NO: 3788319 - RNA, 21 nt, Salmonella typhimurium LT2
ccagauggcugcacccggaga

SEQ ID NO: 3788320 - RNA, 19 nt, Salmonella typhimurium LT2
ccagccgggcaggaaaagc

SEQ ID NO: 3788321 - RNA, 22 nt, Salmonella typhimurium LT2
ccagccgugaauggucacauuc

SEQ ID NO: 3788322 - RNA, 18 nt, Salmonella typhimurium LT2
ccagccuaccugccgcca

SEQ ID NO: 3788323 - RNA, 20 nt, Salmonella typhimurium LT2
ccagccuaccugccgccaua

SEQ ID NO: 3788324 - RNA, 16 nt, Salmonella typhimurium LT2
ccagcgaaaugcgaau

SEQ ID NO: 3788325 - RNA, 21 nt, Salmonella typhimurium LT2
ccagcgaaaugcgaauccggc

SEQ ID NO: 3788326 - RNA, 20 nt, Salmonella typhimurium LT2
ccagcgaaccgcagcguuga

SEQ ID NO: 3788327 - RNA, 13 nt, Salmonella typhimurium LT2
ccagcgaauaaug

SEQ ID NO: 3788328 - RNA, 23 nt, Salmonella typhimurium LT2
ccagcgacauggcggucgccaua

SEQ ID NO: 3788329 - RNA, 19 nt, Salmonella typhimurium LT2
ccagcgaccaccgucccag

SEQ ID NO: 3788330 - RNA, 14 nt, Salmonella typhimurium LT2
ccagcgacggccag

SEQ ID NO: 3788331 - RNA, 17 nt, Salmonella typhimurium LT2
ccagcgaggccucuccu

SEQ ID NO: 3788332 - RNA, 16 nt, Salmonella typhimurium LT2
ccagcgauaaacgcca

SEQ ID NO: 3788333 - RNA, 18 nt, Salmonella typhimurium LT2
ccagcgaucaggcgucag

SEQ ID NO: 3788334 - RNA, 16 nt, Salmonella typhimurium LT2
ccagcgauccagaccg

SEQ ID NO: 3788335 - RNA, 16 nt, Salmonella typhimurium LT2
ccagcgaugagcgcca

SEQ ID NO: 3788336 - RNA, 19 nt, Salmonella typhimurium LT2
ccagcgaugagcgccagca

SEQ ID NO: 3788337 - RNA, 23 nt, Salmonella typhimurium LT2
ccagcgauuuuuacgccauucau

SEQ ID NO: 3788338 - RNA, 22 nt, Salmonella typhimurium LT2
ccagcgcaaagggacacucaag

SEQ ID NO: 3788339 - RNA, 16 nt, Salmonella typhimurium LT2
ccagcgcaaucacguu

SEQ ID NO: 3788340 - RNA, 19 nt, Salmonella typhimurium LT2
ccagcgcagucagugaaaa

SEQ ID NO: 3788341 - RNA, 18 nt, Salmonella typhimurium LT2
ccagcgcaucgcccugcc

SEQ ID NO: 3788342 - RNA, 17 nt, Salmonella typhimurium LT2
ccagcgcauuccccacc

SEQ ID NO: 3788343 - RNA, 22 nt, Salmonella typhimurium LT2
ccagcgccaacgccacugccau

SEQ ID NO: 3788344 - RNA, 13 nt, Salmonella typhimurium LT2
ccagcgccagccg

SEQ ID NO: 3788345 - RNA, 14 nt, Salmonella typhimurium LT2
ccagcgccagcucc

SEQ ID NO: 3788346 - RNA, 19 nt, Salmonella typhimurium LT2
ccagcgccauaauccagaa

SEQ ID NO: 3788347 - RNA, 13 nt, Salmonella typhimurium LT2
ccagcgccccugc

SEQ ID NO: 3788348 - RNA, 12 nt, Salmonella typhimurium LT2
ccagcgccgcga

SEQ ID NO: 3788349 - RNA, 18 nt, Salmonella typhimurium LT2
ccagcgccgcgacaagca

SEQ ID NO: 3788350 - RNA, 12 nt, Salmonella typhimurium LT2
ccagcgccggau

SEQ ID NO: 3788351 - RNA, 22 nt, Salmonella typhimurium LT2
ccagcgccggauaauccagaca

SEQ ID NO: 3788352 - RNA, 21 nt, Salmonella typhimurium LT2
ccagcgccggcgaaucaccga

SEQ ID NO: 3788353 - RNA, 20 nt, Salmonella typhimurium LT2
ccagcgccugcgcugcaaua

SEQ ID NO: 3788354 - RNA, 16 nt, Salmonella typhimurium LT2
ccagcgccuucuucac

SEQ ID NO: 3788355 - RNA, 16 nt, Salmonella typhimurium LT2
ccagcgcgaauuugcc

SEQ ID NO: 3788356 - RNA, 20 nt, Salmonella typhimurium LT2
ccagcgcgaccugcaucccu

SEQ ID NO: 3788357 - RNA, 15 nt, Salmonella typhimurium LT2
ccagcgcgccagcgc

SEQ ID NO: 3788358 - RNA, 19 nt, Salmonella typhimurium LT2
ccagcgcgccagcgccaau

SEQ ID NO: 3788359 - RNA, 18 nt, Salmonella typhimurium LT2
ccagcgcgccgcagcgcc

SEQ ID NO: 3788360 - RNA, 19 nt, Salmonella typhimurium LT2
ccagcgcgccgcagcgccg

SEQ ID NO: 3788361 - RNA, 14 nt, Salmonella typhimurium LT2
ccagcgcgccgcca

SEQ ID NO: 3788362 - RNA, 21 nt, Salmonella typhimurium LT2
ccagcgcgccgccaacgccaa

SEQ ID NO: 3788363 - RNA, 13 nt, Salmonella typhimurium LT2
ccagcgcgccguc

SEQ ID NO: 3788364 - RNA, 13 nt, Salmonella typhimurium LT2
ccagcgcggcaca

SEQ ID NO: 3788365 - RNA, 15 nt, Salmonella typhimurium LT2
ccagcgcggcacagg

SEQ ID NO: 3788366 - RNA, 15 nt, Salmonella typhimurium LT2
ccagcgcggcgccag

SEQ ID NO: 3788367 - RNA, 19 nt, Salmonella typhimurium LT2
ccagcgcgggcgaggccuc

SEQ ID NO: 3788368 - RNA, 18 nt, Salmonella typhimurium LT2
ccagcgcguaaauaccuu

SEQ ID NO: 3788369 - RNA, 18 nt, Salmonella typhimurium LT2
ccagcggaacucaucauc

SEQ ID NO: 3788370 - RNA, 19 nt, Salmonella typhimurium LT2
ccagcggaacucaucauca

SEQ ID NO: 3788371 - RNA, 20 nt, Salmonella typhimurium LT2
ccagcggaacucaucaucaa

SEQ ID NO: 3788372 - RNA, 22 nt, Salmonella typhimurium LT2
ccagcggcagaucguuuacgac

SEQ ID NO: 3788373 - RNA, 13 nt, Salmonella typhimurium LT2
ccagcggcgacag

SEQ ID NO: 3788374 - RNA, 18 nt, Salmonella typhimurium LT2
ccagcggcgcaaugccgc

SEQ ID NO: 3788375 - RNA, 18 nt, Salmonella typhimurium LT2
ccagcggcgccaucacca

SEQ ID NO: 3788376 - RNA, 19 nt, Salmonella typhimurium LT2
ccagcggcgccaucaccau

SEQ ID NO: 3788377 - RNA, 22 nt, Salmonella typhimurium LT2
ccagcgggcuauaggccaucac

SEQ ID NO: 3788378 - RNA, 19 nt, Salmonella typhimurium LT2
ccagcgguguuugccagac

SEQ ID NO: 3788379 - RNA, 15 nt, Salmonella typhimurium LT2
ccagcguaagcgccc

SEQ ID NO: 3788380 - RNA, 17 nt, Salmonella typhimurium LT2
ccagcguaccacgccgc

SEQ ID NO: 3788381 - RNA, 20 nt, Salmonella typhimurium LT2
ccagcguaccacgccgcaca

SEQ ID NO: 3788382 - RNA, 15 nt, Salmonella typhimurium LT2
ccagcguacugccaa

SEQ ID NO: 3788383 - RNA, 15 nt, Salmonella typhimurium LT2
ccagcguaguuucac

SEQ ID NO: 3788384 - RNA, 19 nt, Salmonella typhimurium LT2
ccagcguaguuucacugug

SEQ ID NO: 3788385 - RNA, 21 nt, Salmonella typhimurium LT2
ccagcguauaauuaagcugcg

SEQ ID NO: 3788386 - RNA, 16 nt, Salmonella typhimurium LT2
ccagcgucaacugcgc

SEQ ID NO: 3788387 - RNA, 23 nt, Salmonella typhimurium LT2
ccagcgucaacugcgccugcuca

SEQ ID NO: 3788388 - RNA, 16 nt, Salmonella typhimurium LT2
ccagcgucacuggcca

SEQ ID NO: 3788389 - RNA, 22 nt, Salmonella typhimurium LT2
ccagcgucgucauagcguugau

SEQ ID NO: 3788390 - RNA, 18 nt, Salmonella typhimurium LT2
ccagcgucucagcaggcg

SEQ ID NO: 3788391 - RNA, 17 nt, Salmonella typhimurium LT2
ccagcgugacccagaca

SEQ ID NO: 3788392 - RNA, 17 nt, Salmonella typhimurium LT2
ccagcgugccugccgca

SEQ ID NO: 3788393 - RNA, 16 nt, Salmonella typhimurium LT2
ccagcguuagcgcaaa

SEQ ID NO: 3788394 - RNA, 21 nt, Salmonella typhimurium LT2
ccagcguugaccagccuaccu

SEQ ID NO: 3788395 - RNA, 18 nt, Salmonella typhimurium LT2
ccagcguuggugccgcca

SEQ ID NO: 3788396 - RNA, 21 nt, Salmonella typhimurium LT2
ccagcguuggugccgccagau

SEQ ID NO: 3788397 - RNA, 13 nt, Salmonella typhimurium LT2
ccagcguuucucu

SEQ ID NO: 3788398 - RNA, 18 nt, Salmonella typhimurium LT2
ccagcguuucuggaagua

SEQ ID NO: 3788399 - RNA, 19 nt, Salmonella typhimurium LT2
ccagcguuucuggaaguag

SEQ ID NO: 3788400 - RNA, 13 nt, Salmonella typhimurium LT2
ccagcuaaaaacg

SEQ ID NO: 3788401 - RNA, 14 nt, Salmonella typhimurium LT2
ccagcuaaccuguu

SEQ ID NO: 3788402 - RNA, 15 nt, Salmonella typhimurium LT2
ccagcuauagcgcaa

SEQ ID NO: 3788403 - RNA, 16 nt, Salmonella typhimurium LT2
ccagcuauagcgcaaa

SEQ ID NO: 3788404 - RNA, 21 nt, Salmonella typhimurium LT2
ccagcuauagcgcaaacgcgc

SEQ ID NO: 3788405 - RNA, 16 nt, Salmonella typhimurium LT2
ccagcucaacgccuuu

SEQ ID NO: 3788406 - RNA, 14 nt, Salmonella typhimurium LT2
ccagcucaccagcc

SEQ ID NO: 3788407 - RNA, 18 nt, Salmonella typhimurium LT2
ccagcucaggguccccau

SEQ ID NO: 3788408 - RNA, 15 nt, Salmonella typhimurium LT2
ccagcucauguaguc

SEQ ID NO: 3788409 - RNA, 15 nt, Salmonella typhimurium LT2
ccagcucauuuuuac

SEQ ID NO: 3788410 - RNA, 18 nt, Salmonella typhimurium LT2
ccagcuccauccaccagc

SEQ ID NO: 3788411 - RNA, 13 nt, Salmonella typhimurium LT2
ccagcuccuccga

SEQ ID NO: 3788412 - RNA, 16 nt, Salmonella typhimurium LT2
ccagcucgucuugugu

SEQ ID NO: 3788413 - RNA, 16 nt, Salmonella typhimurium LT2
ccagcucuacaucgcc

SEQ ID NO: 3788414 - RNA, 19 nt, Salmonella typhimurium LT2
ccagcucuacaucgccgcg

SEQ ID NO: 3788415 - RNA, 13 nt, Salmonella typhimurium LT2
ccagcucugccgg

SEQ ID NO: 3788416 - RNA, 12 nt, Salmonella typhimurium LT2
ccagcucuucuu

SEQ ID NO: 3788417 - RNA, 23 nt, Salmonella typhimurium LT2
ccagcucuuucaacuuccgcguu

SEQ ID NO: 3788418 - RNA, 15 nt, Salmonella typhimurium LT2
ccagcugacgcagca

SEQ ID NO: 3788419 - RNA, 19 nt, Salmonella typhimurium LT2
ccagcugacgcagcagcuc

SEQ ID NO: 3788420 - RNA, 20 nt, Salmonella typhimurium LT2
ccagcugacgcagcagcucc

SEQ ID NO: 3788421 - RNA, 24 nt, Salmonella typhimurium LT2
ccagcuguccggcuacaggcguca

SEQ ID NO: 3788422 - RNA, 19 nt, Salmonella typhimurium LT2
ccagcuucaucaucagcag

SEQ ID NO: 3788423 - RNA, 11 nt, Salmonella typhimurium LT2
ccagcuugaau

SEQ ID NO: 3788424 - RNA, 19 nt, Salmonella typhimurium LT2
ccagugacacguaccugcc

SEQ ID NO: 3788425 - RNA, 15 nt, Salmonella typhimurium LT2
ccagugcaacgccuu

SEQ ID NO: 3788426 - RNA, 21 nt, Salmonella typhimurium LT2
ccagugccaccagccggagcc

SEQ ID NO: 3788427 - RNA, 23 nt, Salmonella typhimurium LT2
ccagugccaccagccggagccgg

SEQ ID NO: 3788428 - RNA, 17 nt, Salmonella typhimurium LT2
ccagugccaguuaagca

SEQ ID NO: 3788429 - RNA, 12 nt, Salmonella typhimurium LT2
ccagugccgcca

SEQ ID NO: 3788430 - RNA, 18 nt, Salmonella typhimurium LT2
ccagugccgccagaauca

SEQ ID NO: 3788431 - RNA, 19 nt, Salmonella typhimurium LT2
ccaguggagacacuucagc

SEQ ID NO: 3788432 - RNA, 18 nt, Salmonella typhimurium LT2
ccaguggcgucgguuaua

SEQ ID NO: 3788433 - RNA, 18 nt, Salmonella typhimurium LT2
ccagugguaaaaaaguga

SEQ ID NO: 3788434 - RNA, 21 nt, Salmonella typhimurium LT2
ccaguggucguuagccagaug

SEQ ID NO: 3788435 - RNA, 20 nt, Salmonella typhimurium LT2
ccagugguuccauuccagaa

SEQ ID NO: 3788436 - RNA, 12 nt, Salmonella typhimurium LT2
ccaguuaacaga

SEQ ID NO: 3788437 - RNA, 19 nt, Salmonella typhimurium LT2
ccaguuaacagaaugcuga

SEQ ID NO: 3788438 - RNA, 14 nt, Salmonella typhimurium LT2
ccaguuaauucguc

SEQ ID NO: 3788439 - RNA, 19 nt, Salmonella typhimurium LT2
ccaguuagcgaccgcgccg

SEQ ID NO: 3788440 - RNA, 17 nt, Salmonella typhimurium LT2
ccaguuauccuuaauau

SEQ ID NO: 3788441 - RNA, 13 nt, Salmonella typhimurium LT2
ccaguucaaucag

SEQ ID NO: 3788442 - RNA, 22 nt, Salmonella typhimurium LT2
ccaguucacuccuaagagaaaa

SEQ ID NO: 3788443 - RNA, 22 nt, Salmonella typhimurium LT2
ccaguuccaucuccggcgacca

SEQ ID NO: 3788444 - RNA, 12 nt, Salmonella typhimurium LT2
ccaguuccccau

SEQ ID NO: 3788445 - RNA, 13 nt, Salmonella typhimurium LT2
ccaguuccgccac

SEQ ID NO: 3788446 - RNA, 23 nt, Salmonella typhimurium LT2
ccaguucucaaucgccgcauggg

SEQ ID NO: 3788447 - RNA, 18 nt, Salmonella typhimurium LT2
ccaguucuggcugcgcuu

SEQ ID NO: 3788448 - RNA, 18 nt, Salmonella typhimurium LT2
ccaguugcauacauaaau

SEQ ID NO: 3788449 - RNA, 23 nt, Salmonella typhimurium LT2
ccaguugccaggguucaaccuga

SEQ ID NO: 3788450 - RNA, 14 nt, Salmonella typhimurium LT2
ccaguugcgcaggg

SEQ ID NO: 3788451 - RNA, 17 nt, Salmonella typhimurium LT2
ccaguugcuuaccuugu

SEQ ID NO: 3788452 - RNA, 22 nt, Salmonella typhimurium LT2
ccaguugcuucauaucgccauu

SEQ ID NO: 3788453 - RNA, 18 nt, Salmonella typhimurium LT2
ccaguuggcgaccgcugc

SEQ ID NO: 3788454 - RNA, 17 nt, Salmonella typhimurium LT2
ccaguuguuccagcagc

SEQ ID NO: 3788455 - RNA, 16 nt, Salmonella typhimurium LT2
ccaguuguucuuucac

SEQ ID NO: 3788456 - RNA, 22 nt, Salmonella typhimurium LT2
ccaguuguuuauuccauucauc

SEQ ID NO: 3788457 - RNA, 18 nt, Salmonella typhimurium LT2
ccaguuuaccaaacacga

SEQ ID NO: 3788458 - RNA, 15 nt, Salmonella typhimurium LT2
ccaguuucaaugccc

SEQ ID NO: 3788459 - RNA, 23 nt, Salmonella typhimurium LT2
ccaguuucgccagcggcagcgcg

SEQ ID NO: 3788460 - RNA, 14 nt, Salmonella typhimurium LT2
ccaguuucuucagg

SEQ ID NO: 3788461 - RNA, 19 nt, Salmonella typhimurium LT2
ccaguuugcguucacagca

SEQ ID NO: 3788462 - RNA, 14 nt, Salmonella typhimurium LT2
ccaguuuuuauaac

SEQ ID NO: 3788463 - RNA, 20 nt, Salmonella typhimurium LT2
ccauaaaaauggcauugccc

SEQ ID NO: 3788464 - RNA, 17 nt, Salmonella typhimurium LT2
ccauaaacgguuucagc

SEQ ID NO: 3788465 - RNA, 22 nt, Salmonella typhimurium LT2
ccauaacauaucuccucugcca

SEQ ID NO: 3788466 - RNA, 12 nt, Salmonella typhimurium LT2
ccauaauaaugc

SEQ ID NO: 3788467 - RNA, 14 nt, Salmonella typhimurium LT2
ccauaauaaugcca

SEQ ID NO: 3788468 - RNA, 23 nt, Salmonella typhimurium LT2
ccauaaugacccagucgggaaac

SEQ ID NO: 3788469 - RNA, 12 nt, Salmonella typhimurium LT2
ccauaaugacgc

SEQ ID NO: 3788470 - RNA, 20 nt, Salmonella typhimurium LT2
ccauaaugauccacacuggc

SEQ ID NO: 3788471 - RNA, 23 nt, Salmonella typhimurium LT2
ccauaauuaccggcacaccggcc

SEQ ID NO: 3788472 - RNA, 23 nt, Salmonella typhimurium LT2
ccauaauuuauccuccgaacagg

SEQ ID NO: 3788473 - RNA, 13 nt, Salmonella typhimurium LT2
ccauacagcccau

SEQ ID NO: 3788474 - RNA, 18 nt, Salmonella typhimurium LT2
ccauacagcccauaccac

SEQ ID NO: 3788475 - RNA, 21 nt, Salmonella typhimurium LT2
ccauacauugaguaaauaaau

SEQ ID NO: 3788476 - RNA, 16 nt, Salmonella typhimurium LT2
ccauacccaacagcag

SEQ ID NO: 3788477 - RNA, 12 nt, Salmonella typhimurium LT2
ccauaccggacu

SEQ ID NO: 3788478 - RNA, 16 nt, Salmonella typhimurium LT2
ccauacggaugccgau

SEQ ID NO: 3788479 - RNA, 17 nt, Salmonella typhimurium LT2
ccauacgguggccagac

SEQ ID NO: 3788480 - RNA, 19 nt, Salmonella typhimurium LT2
ccauagaaaucagcagguc

SEQ ID NO: 3788481 - RNA, 14 nt, Salmonella typhimurium LT2
ccauagacaguacg

SEQ ID NO: 3788482 - RNA, 20 nt, Salmonella typhimurium LT2
ccauagauaccuucuucacu

SEQ ID NO: 3788483 - RNA, 16 nt, Salmonella typhimurium LT2
ccauagauuuuuucga

SEQ ID NO: 3788484 - RNA, 20 nt, Salmonella typhimurium LT2
ccauagcgcuaugcgcucca

SEQ ID NO: 3788485 - RNA, 23 nt, Salmonella typhimurium LT2
ccauagucagaucccuaacuggu

SEQ ID NO: 3788486 - RNA, 14 nt, Salmonella typhimurium LT2
ccauauaacagaau

SEQ ID NO: 3788487 - RNA, 21 nt, Salmonella typhimurium LT2
ccauaucagacgcgcaaaacu

SEQ ID NO: 3788488 - RNA, 16 nt, Salmonella typhimurium LT2
ccauaucgaccuuuuu

SEQ ID NO: 3788489 - RNA, 19 nt, Salmonella typhimurium LT2
ccauaucguucaguuucaa

SEQ ID NO: 3788490 - RNA, 15 nt, Salmonella typhimurium LT2
ccauauuuaugcagc

SEQ ID NO: 3788491 - RNA, 11 nt, Salmonella typhimurium LT2
ccauauuuucc

SEQ ID NO: 3788492 - RNA, 23 nt, Salmonella typhimurium LT2
ccauauuuuuucugccaguuucu

SEQ ID NO: 3788493 - RNA, 14 nt, Salmonella typhimurium LT2
ccaucaaauaauac

SEQ ID NO: 3788494 - RNA, 15 nt, Salmonella typhimurium LT2
ccaucaacgccauaa

SEQ ID NO: 3788495 - RNA, 17 nt, Salmonella typhimurium LT2
ccaucaacuucucgcag

SEQ ID NO: 3788496 - RNA, 19 nt, Salmonella typhimurium LT2
ccaucaacuucucgcaggc

SEQ ID NO: 3788497 - RNA, 13 nt, Salmonella typhimurium LT2
ccaucaauaccag

SEQ ID NO: 3788498 - RNA, 15 nt, Salmonella typhimurium LT2
ccaucaaucaccuua

SEQ ID NO: 3788499 - RNA, 17 nt, Salmonella typhimurium LT2
ccaucaauuuugcgccu

SEQ ID NO: 3788500 - RNA, 15 nt, Salmonella typhimurium LT2
ccaucaccgccaguc

SEQ ID NO: 3788501 - RNA, 15 nt, Salmonella typhimurium LT2
ccaucacgcccggau

SEQ ID NO: 3788502 - RNA, 19 nt, Salmonella typhimurium LT2
ccaucacgguuuacgcgca

SEQ ID NO: 3788503 - RNA, 15 nt, Salmonella typhimurium LT2
ccaucagacaggcau

SEQ ID NO: 3788504 - RNA, 13 nt, Salmonella typhimurium LT2
ccaucagcaccuu

SEQ ID NO: 3788505 - RNA, 15 nt, Salmonella typhimurium LT2
ccaucagcaucauca

SEQ ID NO: 3788506 - RNA, 23 nt, Salmonella typhimurium LT2
ccaucagccgcgcuaucaaaaug

SEQ ID NO: 3788507 - RNA, 22 nt, Salmonella typhimurium LT2
ccaucagcgucagcaccaguac

SEQ ID NO: 3788508 - RNA, 14 nt, Salmonella typhimurium LT2
ccaucaggcaauau

SEQ ID NO: 3788509 - RNA, 16 nt, Salmonella typhimurium LT2
ccaucaggcaaucuuu

SEQ ID NO: 3788510 - RNA, 22 nt, Salmonella typhimurium LT2
ccaucaggcaaucuuuaacgcu

SEQ ID NO: 3788511 - RNA, 16 nt, Salmonella typhimurium LT2
ccaucaggcacaaugc

SEQ ID NO: 3788512 - RNA, 15 nt, Salmonella typhimurium LT2
ccaucaggcauaaac

SEQ ID NO: 3788513 - RNA, 18 nt, Salmonella typhimurium LT2
ccaucaggcuuugcgcca

SEQ ID NO: 3788514 - RNA, 15 nt, Salmonella typhimurium LT2
ccaucauaccgccaa

SEQ ID NO: 3788515 - RNA, 15 nt, Salmonella typhimurium LT2
ccaucauagcccaua

SEQ ID NO: 3788516 - RNA, 21 nt, Salmonella typhimurium LT2
ccaucaucaggacucaaucac

SEQ ID NO: 3788517 - RNA, 23 nt, Salmonella typhimurium LT2
ccaucaucaucggcacagccagu

SEQ ID NO: 3788518 - RNA, 22 nt, Salmonella typhimurium LT2
ccaucauggcuuucagauuagc

SEQ ID NO: 3788519 - RNA, 20 nt, Salmonella typhimurium LT2
ccaucauugacuucaacgca

SEQ ID NO: 3788520 - RNA, 16 nt, Salmonella typhimurium LT2
ccauccaccagaaccu

SEQ ID NO: 3788521 - RNA, 13 nt, Salmonella typhimurium LT2
ccauccacgccag

SEQ ID NO: 3788522 - RNA, 14 nt, Salmonella typhimurium LT2
ccauccacgccagc

SEQ ID NO: 3788523 - RNA, 22 nt, Salmonella typhimurium LT2
ccaucccugggccucgccccuu

SEQ ID NO: 3788524 - RNA, 16 nt, Salmonella typhimurium LT2
ccauccggcaaaaagc

SEQ ID NO: 3788525 - RNA, 14 nt, Salmonella typhimurium LT2
ccauccggcaaaau

SEQ ID NO: 3788526 - RNA, 15 nt, Salmonella typhimurium LT2
ccauccggcaaaauu

SEQ ID NO: 3788527 - RNA, 23 nt, Salmonella typhimurium LT2
ccauccggcacggucaaucauca

SEQ ID NO: 3788528 - RNA, 11 nt, Salmonella typhimurium LT2
ccauuuuucag

SEQ ID NO: 3788529 - RNA, 17 nt, Salmonella typhimurium LT2
ccauuuuucagauagcg

SEQ ID NO: 3788530 - RNA, 21 nt, Salmonella typhimurium LT2
ccauuuuucgcccacaucugu

SEQ ID NO: 3788531 - RNA, 13 nt, Salmonella typhimurium LT2
ccauuuuuuuagc

SEQ ID NO: 3788532 - RNA, 21 nt, Salmonella typhimurium LT2
ccauuuuuuuagcuuaaaaaa

SEQ ID NO: 3788533 - RNA, 12 nt, Salmonella typhimurium LT2
cccaaaauaauu

SEQ ID NO: 3788534 - RNA, 13 nt, Salmonella typhimurium LT2
cccaaaauaauuc

SEQ ID NO: 3788535 - RNA, 11 nt, Salmonella typhimurium LT2
cccaaaaugcc

SEQ ID NO: 3788536 - RNA, 18 nt, Salmonella typhimurium LT2
cccaaaaugcggcauccg

SEQ ID NO: 3788537 - RNA, 13 nt, Salmonella typhimurium LT2
cccaaacaccaac

SEQ ID NO: 3788538 - RNA, 20 nt, Salmonella typhimurium LT2
cccaaaucaauuaacugaca

SEQ ID NO: 3788539 - RNA, 13 nt, Salmonella typhimurium LT2
cccaacagcagac

SEQ ID NO: 3788540 - RNA, 16 nt, Salmonella typhimurium LT2
cccaacaucaguucag

SEQ ID NO: 3788541 - RNA, 12 nt, Salmonella typhimurium LT2
cccaaccagccc

SEQ ID NO: 3788542 - RNA, 20 nt, Salmonella typhimurium LT2
cccaacgagagcacuacgcu

SEQ ID NO: 3788543 - RNA, 20 nt, Salmonella typhimurium LT2
cccaacggaugcgccauccc

SEQ ID NO: 3788544 - RNA, 15 nt, Salmonella typhimurium LT2
cccaacugagcgcca

SEQ ID NO: 3788545 - RNA, 23 nt, Salmonella typhimurium LT2
cccaacugccagcggagaucgcu

SEQ ID NO: 3788546 - RNA, 18 nt, Salmonella typhimurium LT2
cccaacuguuaucauaga

SEQ ID NO: 3788547 - RNA, 20 nt, Salmonella typhimurium LT2
cccaauagcgaucgagauaa

SEQ ID NO: 3788548 - RNA, 20 nt, Salmonella typhimurium LT2
cccaauaugaugcuugcucg

SEQ ID NO: 3788549 - RNA, 14 nt, Salmonella typhimurium LT2
cccaaucccaccac

SEQ ID NO: 3788550 - RNA, 22 nt, Salmonella typhimurium LT2
cccaaucuugcguaccacguua

SEQ ID NO: 3788551 - RNA, 18 nt, Salmonella typhimurium LT2
cccacaaucccgccagac

SEQ ID NO: 3788552 - RNA, 12 nt, Salmonella typhimurium LT2
cccacagguagg

SEQ ID NO: 3788553 - RNA, 17 nt, Salmonella typhimurium LT2
cccacauuugaucucau

SEQ ID NO: 3788554 - RNA, 15 nt, Salmonella typhimurium LT2
cccaccacgcagcca

SEQ ID NO: 3788555 - RNA, 20 nt, Salmonella typhimurium LT2
cccaccauaaagcgaauaau

SEQ ID NO: 3788556 - RNA, 21 nt, Salmonella typhimurium LT2
cccaccauaaagcgaauaauu

SEQ ID NO: 3788557 - RNA, 12 nt, Salmonella typhimurium LT2
cccacccagcaa

SEQ ID NO: 3788558 - RNA, 22 nt, Salmonella typhimurium LT2
cccacccagcaauacagccagc

SEQ ID NO: 3788559 - RNA, 18 nt, Salmonella typhimurium LT2
cccacccuuugcagcgcg

SEQ ID NO: 3788560 - RNA, 20 nt, Salmonella typhimurium LT2
cccaccgccggauauguuuu

SEQ ID NO: 3788561 - RNA, 14 nt, Salmonella typhimurium LT2
cccaccggaccgcc

SEQ ID NO: 3788562 - RNA, 17 nt, Salmonella typhimurium LT2
cccacgcauaguccugc

SEQ ID NO: 3788563 - RNA, 18 nt, Salmonella typhimurium LT2
cccacgcauaguccugcc

SEQ ID NO: 3788564 - RNA, 15 nt, Salmonella typhimurium LT2
cccacgcccgccauc

SEQ ID NO: 3788565 - RNA, 19 nt, Salmonella typhimurium LT2
cccacgcccgccaucgccg

SEQ ID NO: 3788566 - RNA, 21 nt, Salmonella typhimurium LT2
cccacgcggaaucgucacaga

SEQ ID NO: 3788567 - RNA, 22 nt, Salmonella typhimurium LT2
cccacgcggaaucgucacagac

SEQ ID NO: 3788568 - RNA, 21 nt, Salmonella typhimurium LT2
cccacgcggcguacgcugcaa

SEQ ID NO: 3788569 - RNA, 21 nt, Salmonella typhimurium LT2
cccacgcuucccagcgucgcc

SEQ ID NO: 3788570 - RNA, 24 nt, Salmonella typhimurium LT2
cccacgggaagaugugccacuccg

SEQ ID NO: 3788571 - RNA, 18 nt, Salmonella typhimurium LT2
cccacgguacgacgcggc

SEQ ID NO: 3788572 - RNA, 23 nt, Salmonella typhimurium LT2
cccacguaagugggaucagguaa

SEQ ID NO: 3788573 - RNA, 12 nt, Salmonella typhimurium LT2
cccacgucagcc

SEQ ID NO: 3788574 - RNA, 14 nt, Salmonella typhimurium LT2
cccacgucauccga

SEQ ID NO: 3788575 - RNA, 13 nt, Salmonella typhimurium LT2
cccacuaacugcc

SEQ ID NO: 3788576 - RNA, 15 nt, Salmonella typhimurium LT2
cccacuaccgccacu

SEQ ID NO: 3788577 - RNA, 20 nt, Salmonella typhimurium LT2
cccacucaaucauugucauu

SEQ ID NO: 3788578 - RNA, 19 nt, Salmonella typhimurium LT2
cccacucauccagcaaaau

SEQ ID NO: 3788579 - RNA, 15 nt, Salmonella typhimurium LT2
cccacugacauuuaa

SEQ ID NO: 3788580 - RNA, 16 nt, Salmonella typhimurium LT2
cccacugaccugcugg

SEQ ID NO: 3788581 - RNA, 20 nt, Salmonella typhimurium LT2
cccacuuauggucguauuuu

SEQ ID NO: 3788582 - RNA, 17 nt, Salmonella typhimurium LT2
cccacuuggcgaucacc

SEQ ID NO: 3788583 - RNA, 23 nt, Salmonella typhimurium LT2
cccacuuggcgaucaccagcacc

SEQ ID NO: 3788584 - RNA, 22 nt, Salmonella typhimurium LT2
cccacuuguaccaacugcugcg

SEQ ID NO: 3788585 - RNA, 19 nt, Salmonella typhimurium LT2
cccacuuguagcgagcgcc

SEQ ID NO: 3788586 - RNA, 20 nt, Salmonella typhimurium LT2
cccacuuguagcgagcgccg

SEQ ID NO: 3788587 - RNA, 21 nt, Salmonella typhimurium LT2
cccacuuguagcgagcgccgu

SEQ ID NO: 3788588 - RNA, 19 nt, Salmonella typhimurium LT2
cccagaaaauuaacgacaa

SEQ ID NO: 3788589 - RNA, 21 nt, Salmonella typhimurium LT2
cccagaaaccgccccuggcaa

SEQ ID NO: 3788590 - RNA, 19 nt, Salmonella typhimurium LT2
cccagaaagaucagcagaa

SEQ ID NO: 3788591 - RNA, 23 nt, Salmonella typhimurium LT2
cccagaaucagcaacacaaucag

SEQ ID NO: 3788592 - RNA, 18 nt, Salmonella typhimurium LT2
cccagaaucccgccuugc

SEQ ID NO: 3788593 - RNA, 17 nt, Salmonella typhimurium LT2
cccagacugugauggcg

SEQ ID NO: 3788594 - RNA, 21 nt, Salmonella typhimurium LT2
cccagagcgcggccuuugccu

SEQ ID NO: 3788595 - RNA, 22 nt, Salmonella typhimurium LT2
cccagagcuuuggcgacuuuuu

SEQ ID NO: 3788596 - RNA, 17 nt, Salmonella typhimurium LT2
cccagagucaccagcac

SEQ ID NO: 3788597 - RNA, 23 nt, Salmonella typhimurium LT2
cccagauaucaggauugaugguc

SEQ ID NO: 3788598 - RNA, 19 nt, Salmonella typhimurium LT2
cccagauauccgcgcucaa

SEQ ID NO: 3788599 - RNA, 19 nt, Salmonella typhimurium LT2
cccagauguugauacagaa

SEQ ID NO: 3788600 - RNA, 20 nt, Salmonella typhimurium LT2
cccagauguugauacagaaa

SEQ ID NO: 3788601 - RNA, 14 nt, Salmonella typhimurium LT2
cccagcaaaccggc

SEQ ID NO: 3788602 - RNA, 20 nt, Salmonella typhimurium LT2
cccagcaauacagccagcac

SEQ ID NO: 3788603 - RNA, 15 nt, Salmonella typhimurium LT2
cccagcagcugcugu

SEQ ID NO: 3788604 - RNA, 21 nt, Salmonella typhimurium LT2
cccagcauauuuuccggcguc

SEQ ID NO: 3788605 - RNA, 21 nt, Salmonella typhimurium LT2
cccagcaucccgcuggcgcca

SEQ ID NO: 3788606 - RNA, 20 nt, Salmonella typhimurium LT2
cccagcccaucggucgcgcg

SEQ ID NO: 3788607 - RNA, 17 nt, Salmonella typhimurium LT2
cccagcccugugccgcu

SEQ ID NO: 3788608 - RNA, 16 nt, Salmonella typhimurium LT2
cccagccugcccgccu

SEQ ID NO: 3788609 - RNA, 13 nt, Salmonella typhimurium LT2
cccagcgccagcc

SEQ ID NO: 3788610 - RNA, 18 nt, Salmonella typhimurium LT2
cccagcgccagccgcgcc

SEQ ID NO: 3788611 - RNA, 17 nt, Salmonella typhimurium LT2
cccagcgcccccagcaa

SEQ ID NO: 3788612 - RNA, 22 nt, Salmonella typhimurium LT2
cccagcgcgaauuugccccaga

SEQ ID NO: 3788613 - RNA, 12 nt, Salmonella typhimurium LT2
cccagcgcgaca

SEQ ID NO: 3788614 - RNA, 17 nt, Salmonella typhimurium LT2
cccagcgcgauacgcag

SEQ ID NO: 3788615 - RNA, 15 nt, Salmonella typhimurium LT2
cccagcgcgccgcag

SEQ ID NO: 3788616 - RNA, 20 nt, Salmonella typhimurium LT2
cccagcgcgccgcagcgccg

SEQ ID NO: 3788617 - RNA, 11 nt, Salmonella typhimurium LT2
cccagcgcugg

SEQ ID NO: 3788618 - RNA, 23 nt, Salmonella typhimurium LT2
cccagcggaugucggucaucagg

SEQ ID NO: 3788619 - RNA, 15 nt, Salmonella typhimurium LT2
cccagcguacugcca

SEQ ID NO: 3788620 - RNA, 18 nt, Salmonella typhimurium LT2
cccagcgucaacugcgcc

SEQ ID NO: 3788621 - RNA, 18 nt, Salmonella typhimurium LT2
cccagcgucgccaguaac

SEQ ID NO: 3788622 - RNA, 21 nt, Salmonella typhimurium LT2
cccagcgugccugccgcagaa

SEQ ID NO: 3788623 - RNA, 18 nt, Salmonella typhimurium LT2
cccagcuaaaaacgccaa

SEQ ID NO: 3788624 - RNA, 22 nt, Salmonella typhimurium LT2
cccagcugacuggcagcggaaa

SEQ ID NO: 3788625 - RNA, 19 nt, Salmonella typhimurium LT2
cccagcuugcccagauccu

SEQ ID NO: 3788626 - RNA, 14 nt, Salmonella typhimurium LT2
cccaggaacaugac

SEQ ID NO: 3788627 - RNA, 13 nt, Salmonella typhimurium LT2
cccaggccagaug

SEQ ID NO: 3788628 - RNA, 20 nt, Salmonella typhimurium LT2
cccaggccauauugaaugcc

SEQ ID NO: 3788629 - RNA, 12 nt, Salmonella typhimurium LT2
cccaggccgcca

SEQ ID NO: 3788630 - RNA, 20 nt, Salmonella typhimurium LT2
cccaggcgcaaggcgucgcu

SEQ ID NO: 3788631 - RNA, 13 nt, Salmonella typhimurium LT2
ccccgccgccagu

SEQ ID NO: 3788632 - RNA, 11 nt, Salmonella typhimurium LT2
ccccgcgacaa

SEQ ID NO: 3788633 - RNA, 14 nt, Salmonella typhimurium LT2
ccccgcuggcgcgg

SEQ ID NO: 3788634 - RNA, 13 nt, Salmonella typhimurium LT2
ccccggcaccacg

SEQ ID NO: 3788635 - RNA, 11 nt, Salmonella typhimurium LT2
ccccggccucg

SEQ ID NO: 3788636 - RNA, 15 nt, Salmonella typhimurium LT2
ccccggcgaaagaaa

SEQ ID NO: 3788637 - RNA, 23 nt, Salmonella typhimurium LT2
ccccggcgggguuuuuuuaugcg

SEQ ID NO: 3788638 - RNA, 13 nt, Salmonella typhimurium LT2
ccccggcuugcgg

SEQ ID NO: 3788639 - RNA, 16 nt, Salmonella typhimurium LT2
ccccggugagcgccgc

SEQ ID NO: 3788640 - RNA, 12 nt, Salmonella typhimurium LT2
ccccgucagucg

SEQ ID NO: 3788641 - RNA, 15 nt, Salmonella typhimurium LT2
ccccgugcccggcau

SEQ ID NO: 3788642 - RNA, 14 nt, Salmonella typhimurium LT2
ccccguucgacaac

SEQ ID NO: 3788643 - RNA, 16 nt, Salmonella typhimurium LT2
ccccguuugcaguccg

SEQ ID NO: 3788644 - RNA, 13 nt, Salmonella typhimurium LT2
ccccuccagccag

SEQ ID NO: 3788645 - RNA, 12 nt, Salmonella typhimurium LT2
ccccugacggga

SEQ ID NO: 3788646 - RNA, 21 nt, Salmonella typhimurium LT2
ccccugaugcguauccagcgc

SEQ ID NO: 3788647 - RNA, 19 nt, Salmonella typhimurium LT2
ccccugcagaugcugcugc

SEQ ID NO: 3788648 - RNA, 20 nt, Salmonella typhimurium LT2
ccccugcccgcgaucgagcg

SEQ ID NO: 3788649 - RNA, 15 nt, Salmonella typhimurium LT2
ccccugcuccugcca

SEQ ID NO: 3788650 - RNA, 21 nt, Salmonella typhimurium LT2
ccccuggacgcgagccacagg

SEQ ID NO: 3788651 - RNA, 15 nt, Salmonella typhimurium LT2
ccccuggcgcgccag

SEQ ID NO: 3788652 - RNA, 17 nt, Salmonella typhimurium LT2
ccccuggcugaaagcaa

SEQ ID NO: 3788653 - RNA, 17 nt, Salmonella typhimurium LT2
ccccuguucaaaagccu

SEQ ID NO: 3788654 - RNA, 16 nt, Salmonella typhimurium LT2
ccccuucaucagccag

SEQ ID NO: 3788655 - RNA, 13 nt, Salmonella typhimurium LT2
ccccuucaucagu

SEQ ID NO: 3788656 - RNA, 23 nt, Salmonella typhimurium LT2
ccccuucccccaaaaugccgccc

SEQ ID NO: 3788657 - RNA, 15 nt, Salmonella typhimurium LT2
ccccuuuacccacca

SEQ ID NO: 3788658 - RNA, 16 nt, Salmonella typhimurium LT2
ccccuuuacccaccag

SEQ ID NO: 3788659 - RNA, 23 nt, Salmonella typhimurium LT2
ccccuuuagcggcauauccggcg

SEQ ID NO: 3788660 - RNA, 20 nt, Salmonella typhimurium LT2
ccccuuucgguucgccgcgc

SEQ ID NO: 3788661 - RNA, 12 nt, Salmonella typhimurium LT2
ccccuuuuucaa

SEQ ID NO: 3788662 - RNA, 21 nt, Salmonella typhimurium LT2
cccgaaaagcguaacgccccc

SEQ ID NO: 3788663 - RNA, 14 nt, Salmonella typhimurium LT2
cccgaaaugguucc

SEQ ID NO: 3788664 - RNA, 14 nt, Salmonella typhimurium LT2
cccgaacaacaaua

SEQ ID NO: 3788665 - RNA, 15 nt, Salmonella typhimurium LT2
cccgacaucagauga

SEQ ID NO: 3788666 - RNA, 13 nt, Salmonella typhimurium LT2
cccgaccacgccc

SEQ ID NO: 3788667 - RNA, 20 nt, Salmonella typhimurium LT2
cccgaccaggacaaaaggcg

SEQ ID NO: 3788668 - RNA, 16 nt, Salmonella typhimurium LT2
cccgacgcuggcgcaa

SEQ ID NO: 3788669 - RNA, 13 nt, Salmonella typhimurium LT2
cccgacugccacc

SEQ ID NO: 3788670 - RNA, 19 nt, Salmonella typhimurium LT2
cccgacugccaccacgcgg

SEQ ID NO: 3788671 - RNA, 14 nt, Salmonella typhimurium LT2
cccgagcgacgccc

SEQ ID NO: 3788672 - RNA, 13 nt, Salmonella typhimurium LT2
cccgauaaccgcg

SEQ ID NO: 3788673 - RNA, 18 nt, Salmonella typhimurium LT2
cccgauaaccgcguucau

SEQ ID NO: 3788674 - RNA, 14 nt, Salmonella typhimurium LT2
cccgauaagcgcug

SEQ ID NO: 3788675 - RNA, 16 nt, Salmonella typhimurium LT2
cccgauaagcgcuggc

SEQ ID NO: 3788676 - RNA, 14 nt, Salmonella typhimurium LT2
cccgauacccgccc

SEQ ID NO: 3788677 - RNA, 15 nt, Salmonella typhimurium LT2
cccgauaccgccagc

SEQ ID NO: 3788678 - RNA, 20 nt, Salmonella typhimurium LT2
cccgaucacggcgaaucgcc

SEQ ID NO: 3788679 - RNA, 19 nt, Salmonella typhimurium LT2
cccgauggcgcugcgcgca

SEQ ID NO: 3788680 - RNA, 20 nt, Salmonella typhimurium LT2
cccgauguccguuuuuucug

SEQ ID NO: 3788681 - RNA, 21 nt, Salmonella typhimurium LT2
cccgaugucgccacgccgccc

SEQ ID NO: 3788682 - RNA, 13 nt, Salmonella typhimurium LT2
cccgauucugcca

SEQ ID NO: 3788683 - RNA, 21 nt, Salmonella typhimurium LT2
cccgcaaaccacgucugcgcu

SEQ ID NO: 3788684 - RNA, 20 nt, Salmonella typhimurium LT2
cccgcaaacuaauggcgcag

SEQ ID NO: 3788685 - RNA, 16 nt, Salmonella typhimurium LT2
cccgcacgcuuucuuc

SEQ ID NO: 3788686 - RNA, 20 nt, Salmonella typhimurium LT2
cccgcagaaaagaccggcgg

SEQ ID NO: 3788687 - RNA, 13 nt, Salmonella typhimurium LT2
cccgcagccacuc

SEQ ID NO: 3788688 - RNA, 10 nt, Salmonella typhimurium LT2
cccgcagcuu

SEQ ID NO: 3788689 - RNA, 15 nt, Salmonella typhimurium LT2
cccgccaccgccagc

SEQ ID NO: 3788690 - RNA, 13 nt, Salmonella typhimurium LT2
cccgccagaugca

SEQ ID NO: 3788691 - RNA, 21 nt, Salmonella typhimurium LT2
cccgccagaugcagcggcagu

SEQ ID NO: 3788692 - RNA, 15 nt, Salmonella typhimurium LT2
cccgccagcacagca

SEQ ID NO: 3788693 - RNA, 11 nt, Salmonella typhimurium LT2
cccgccaggcg

SEQ ID NO: 3788694 - RNA, 18 nt, Salmonella typhimurium LT2
cccgccaggguaucauca

SEQ ID NO: 3788695 - RNA, 16 nt, Salmonella typhimurium LT2
cccgccauccggcauu

SEQ ID NO: 3788696 - RNA, 17 nt, Salmonella typhimurium LT2
cccgccaucguccagcc

SEQ ID NO: 3788697 - RNA, 14 nt, Salmonella typhimurium LT2
cccgcccacaggcu

SEQ ID NO: 3788698 - RNA, 16 nt, Salmonella typhimurium LT2
cccgcccacaggcugc

SEQ ID NO: 3788699 - RNA, 15 nt, Salmonella typhimurium LT2
cccgcccugcccgcc

SEQ ID NO: 3788700 - RNA, 18 nt, Salmonella typhimurium LT2
cccgccgaaggcaacgcc

SEQ ID NO: 3788701 - RNA, 14 nt, Salmonella typhimurium LT2
cccgccgccagccu

SEQ ID NO: 3788702 - RNA, 11 nt, Salmonella typhimurium LT2
cccgccgccau

SEQ ID NO: 3788703 - RNA, 13 nt, Salmonella typhimurium LT2
cccgccgccugau

SEQ ID NO: 3788704 - RNA, 15 nt, Salmonella typhimurium LT2
cccgccgcuggcggg

SEQ ID NO: 3788705 - RNA, 23 nt, Salmonella typhimurium LT2
cccgccgggcgucacccgccggc

SEQ ID NO: 3788706 - RNA, 18 nt, Salmonella typhimurium LT2
cccgccucaaaccaggaa

SEQ ID NO: 3788707 - RNA, 14 nt, Salmonella typhimurium LT2
cccgccugcggaca

SEQ ID NO: 3788708 - RNA, 20 nt, Salmonella typhimurium LT2
cccgcgacgacaacgccugc

SEQ ID NO: 3788709 - RNA, 13 nt, Salmonella typhimurium LT2
cccgcgcgccagc

SEQ ID NO: 3788710 - RNA, 16 nt, Salmonella typhimurium LT2
cccgcgcugaauggca

SEQ ID NO: 3788711 - RNA, 15 nt, Salmonella typhimurium LT2
cccgcggcauggucu

SEQ ID NO: 3788712 - RNA, 20 nt, Salmonella typhimurium LT2
cccgcggcgaucaccacgcc

SEQ ID NO: 3788713 - RNA, 23 nt, Salmonella typhimurium LT2
cccgcgugcggacguagggcugc

SEQ ID NO: 3788714 - RNA, 21 nt, Salmonella typhimurium LT2
cccgcguugcgccaagcgccu

SEQ ID NO: 3788715 - RNA, 22 nt, Salmonella typhimurium LT2
cccgcguugcgccaagcgccuc

SEQ ID NO: 3788716 - RNA, 14 nt, Salmonella typhimurium LT2
cccgcguuggcggc

SEQ ID NO: 3788717 - RNA, 15 nt, Salmonella typhimurium LT2
cccgcugaggccugc

SEQ ID NO: 3788718 - RNA, 20 nt, Salmonella typhimurium LT2
cccgcugauaaaauucccgc

SEQ ID NO: 3788719 - RNA, 22 nt, Salmonella typhimurium LT2
cccgcugauaaaauucccgcgc

SEQ ID NO: 3788720 - RNA, 16 nt, Salmonella typhimurium LT2
cccgcugcgucacgaa

SEQ ID NO: 3788721 - RNA, 16 nt, Salmonella typhimurium LT2
cccgcuggcgccaccg

SEQ ID NO: 3788722 - RNA, 20 nt, Salmonella typhimurium LT2
cccgcugucgggagccucuu

SEQ ID NO: 3788723 - RNA, 15 nt, Salmonella typhimurium LT2
cccgcuuucaccauc

SEQ ID NO: 3788724 - RNA, 21 nt, Salmonella typhimurium LT2
cccggaaauaaacgccagugg

SEQ ID NO: 3788725 - RNA, 21 nt, Salmonella typhimurium LT2
cccggagagaaacaacaccgu

SEQ ID NO: 3788726 - RNA, 16 nt, Salmonella typhimurium LT2
cccggagagagcaacu

SEQ ID NO: 3788727 - RNA, 18 nt, Salmonella typhimurium LT2
cccggagggguuuucgcc

SEQ ID NO: 3788728 - RNA, 18 nt, Salmonella typhimurium LT2
cccggaucaccggcauuu

SEQ ID NO: 3788729 - RNA, 20 nt, Salmonella typhimurium LT2
cccggaucgcuaauuuuuaa

SEQ ID NO: 3788730 - RNA, 19 nt, Salmonella typhimurium LT2
cccggcaauuaccgccagc

SEQ ID NO: 3788731 - RNA, 14 nt, Salmonella typhimurium LT2
cccggcagccccag

SEQ ID NO: 3788732 - RNA, 20 nt, Salmonella typhimurium LT2
cccggcaguccgucgagcgc

SEQ ID NO: 3788733 - RNA, 17 nt, Salmonella typhimurium LT2
cccggccaaucacgcag

SEQ ID NO: 3788734 - RNA, 17 nt, Salmonella typhimurium LT2
cccggccacagcgccag

SEQ ID NO: 3788735 - RNA, 15 nt, Salmonella typhimurium LT2
cccggccaccgccug

SEQ ID NO: 3788736 - RNA, 19 nt, Salmonella typhimurium LT2
cccuggcgcaguggcggcu

SEQ ID NO: 3788737 - RNA, 19 nt, Salmonella typhimurium LT2
cccuggcucaauccaggug

SEQ ID NO: 3788738 - RNA, 21 nt, Salmonella typhimurium LT2
cccuggcucaauccaggugga

SEQ ID NO: 3788739 - RNA, 15 nt, Salmonella typhimurium LT2
cccuggcugcccuuu

SEQ ID NO: 3788740 - RNA, 14 nt, Salmonella typhimurium LT2
cccugggccucgcc

SEQ ID NO: 3788741 - RNA, 22 nt, Salmonella typhimurium LT2
cccuggugggguucccgagcgg

SEQ ID NO: 3788742 - RNA, 20 nt, Salmonella typhimurium LT2
cccugguuaacccgguuuau

SEQ ID NO: 3788743 - RNA, 22 nt, Salmonella typhimurium LT2
cccugguuaacccgguuuaucc

SEQ ID NO: 3788744 - RNA, 18 nt, Salmonella typhimurium LT2
cccuguauacauacauac

SEQ ID NO: 3788745 - RNA, 16 nt, Salmonella typhimurium LT2
cccugucuuccgacag

SEQ ID NO: 3788746 - RNA, 20 nt, Salmonella typhimurium LT2
cccuguggaaacuccagcgg

SEQ ID NO: 3788747 - RNA, 17 nt, Salmonella typhimurium LT2
cccuguucagcacccag

SEQ ID NO: 3788748 - RNA, 18 nt, Salmonella typhimurium LT2
cccuguucgccacccgcc

SEQ ID NO: 3788749 - RNA, 21 nt, Salmonella typhimurium LT2
cccuguucgccacccgccugc

SEQ ID NO: 3788750 - RNA, 15 nt, Salmonella typhimurium LT2
cccuuaaauccggcc

SEQ ID NO: 3788751 - RNA, 16 nt, Salmonella typhimurium LT2
cccuuaaauccggccu

SEQ ID NO: 3788752 - RNA, 13 nt, Salmonella typhimurium LT2
cccuuacaaaaau

SEQ ID NO: 3788753 - RNA, 19 nt, Salmonella typhimurium LT2
cccuuacaaaaaucaugcc

SEQ ID NO: 3788754 - RNA, 12 nt, Salmonella typhimurium LT2
cccuucaccacu

SEQ ID NO: 3788755 - RNA, 13 nt, Salmonella typhimurium LT2
cccuucaggaaua

SEQ ID NO: 3788756 - RNA, 12 nt, Salmonella typhimurium LT2
cccuuccagcga

SEQ ID NO: 3788757 - RNA, 16 nt, Salmonella typhimurium LT2
cccuuccaguugcguc

SEQ ID NO: 3788758 - RNA, 21 nt, Salmonella typhimurium LT2
cccuuccgccggggagggaug

SEQ ID NO: 3788759 - RNA, 23 nt, Salmonella typhimurium LT2
cccuucgcggaauuucaggaagc

SEQ ID NO: 3788760 - RNA, 23 nt, Salmonella typhimurium LT2
cccuucgcuauccaucgccgcgc

SEQ ID NO: 3788761 - RNA, 23 nt, Salmonella typhimurium LT2
cccuucuccggucaucaccagau

SEQ ID NO: 3788762 - RNA, 17 nt, Salmonella typhimurium LT2
cccuucucgcuaauauc

SEQ ID NO: 3788763 - RNA, 20 nt, Salmonella typhimurium LT2
cccuucuuuaugcgccuucu

SEQ ID NO: 3788764 - RNA, 19 nt, Salmonella typhimurium LT2
cccuuucaaaaaagagaag

SEQ ID NO: 3788765 - RNA, 15 nt, Salmonella typhimurium LT2
cccuuucacccgcgc

SEQ ID NO: 3788766 - RNA, 17 nt, Salmonella typhimurium LT2
cccuuucauuucugccu

SEQ ID NO: 3788767 - RNA, 23 nt, Salmonella typhimurium LT2
cccuuucauuucugccugcuuca

SEQ ID NO: 3788768 - RNA, 13 nt, Salmonella typhimurium LT2
cccuuucuuaugc

SEQ ID NO: 3788769 - RNA, 21 nt, Salmonella typhimurium LT2
cccuuucuucucaacgccgga

SEQ ID NO: 3788770 - RNA, 22 nt, Salmonella typhimurium LT2
cccuuucuucucaacgccggau

SEQ ID NO: 3788771 - RNA, 18 nt, Salmonella typhimurium LT2
cccuuuuuaaaaugaccg

SEQ ID NO: 3788772 - RNA, 16 nt, Salmonella typhimurium LT2
cccuuuuucaauaagc

SEQ ID NO: 3788773 - RNA, 13 nt, Salmonella typhimurium LT2
cccuuuuucaauu

SEQ ID NO: 3788774 - RNA, 23 nt, Salmonella typhimurium LT2
cccuuuuugacguaaaucugaaa

SEQ ID NO: 3788775 - RNA, 21 nt, Salmonella typhimurium LT2
cccuuuuugcauucgcuccuc

SEQ ID NO: 3788776 - RNA, 23 nt, Salmonella typhimurium LT2
cccuuuuuugguuauccagcagc

SEQ ID NO: 3788777 - RNA, 10 nt, Salmonella typhimurium LT2
ccgaaaccca

SEQ ID NO: 3788778 - RNA, 20 nt, Salmonella typhimurium LT2
ccgaaagccgguaaucgauc

SEQ ID NO: 3788779 - RNA, 13 nt, Salmonella typhimurium LT2
ccgaaagugguuu

SEQ ID NO: 3788780 - RNA, 15 nt, Salmonella typhimurium LT2
ccgaaauccaccagc

SEQ ID NO: 3788781 - RNA, 16 nt, Salmonella typhimurium LT2
ccgaaauccaccagcg

SEQ ID NO: 3788782 - RNA, 13 nt, Salmonella typhimurium LT2
ccgaaaucgguac

SEQ ID NO: 3788783 - RNA, 15 nt, Salmonella typhimurium LT2
ccgaacaacgccagg

SEQ ID NO: 3788784 - RNA, 16 nt, Salmonella typhimurium LT2
ccgaacgcguccauga

SEQ ID NO: 3788785 - RNA, 21 nt, Salmonella typhimurium LT2
ccgaagaaagcuaucgccauc

SEQ ID NO: 3788786 - RNA, 20 nt, Salmonella typhimurium LT2
ccgaagacuccccugcagau

SEQ ID NO: 3788787 - RNA, 13 nt, Salmonella typhimurium LT2
ccgaagcaggcgg

SEQ ID NO: 3788788 - RNA, 12 nt, Salmonella typhimurium LT2
ccgaagccaacg

SEQ ID NO: 3788789 - RNA, 13 nt, Salmonella typhimurium LT2
ccgaagccaacgc

SEQ ID NO: 3788790 - RNA, 19 nt, Salmonella typhimurium LT2
ccgaagccauuggucauca

SEQ ID NO: 3788791 - RNA, 16 nt, Salmonella typhimurium LT2
ccgaauaagcgacagc

SEQ ID NO: 3788792 - RNA, 21 nt, Salmonella typhimurium LT2
ccgaauaagcgacagcgccau

SEQ ID NO: 3788793 - RNA, 12 nt, Salmonella typhimurium LT2
ccgacaaaacag

SEQ ID NO: 3788794 - RNA, 21 nt, Salmonella typhimurium LT2
ccgacaaccccaaacaccaac

SEQ ID NO: 3788795 - RNA, 21 nt, Salmonella typhimurium LT2
ccgacaaccugaaugccaucc

SEQ ID NO: 3788796 - RNA, 22 nt, Salmonella typhimurium LT2
ccgacaagguauaucaacccgc

SEQ ID NO: 3788797 - RNA, 23 nt, Salmonella typhimurium LT2
ccgacaauagagucuaccgccgu

SEQ ID NO: 3788798 - RNA, 19 nt, Salmonella typhimurium LT2
ccgacaauauucgccgcga

SEQ ID NO: 3788799 - RNA, 16 nt, Salmonella typhimurium LT2
ccgacacauucaggcu

SEQ ID NO: 3788800 - RNA, 14 nt, Salmonella typhimurium LT2
ccgacagcggcgca

SEQ ID NO: 3788801 - RNA, 15 nt, Salmonella typhimurium LT2
ccgacagcggcgcag

SEQ ID NO: 3788802 - RNA, 21 nt, Salmonella typhimurium LT2
ccgacagcguaaugcgccagg

SEQ ID NO: 3788803 - RNA, 20 nt, Salmonella typhimurium LT2
ccgacaggcgcgaaacgccu

SEQ ID NO: 3788804 - RNA, 18 nt, Salmonella typhimurium LT2
ccgacaggcggcagcuua

SEQ ID NO: 3788805 - RNA, 17 nt, Salmonella typhimurium LT2
ccgacauagcugaacaa

SEQ ID NO: 3788806 - RNA, 18 nt, Salmonella typhimurium LT2
ccgacaucgccaguugca

SEQ ID NO: 3788807 - RNA, 18 nt, Salmonella typhimurium LT2
ccgacauugaccagugca

SEQ ID NO: 3788808 - RNA, 21 nt, Salmonella typhimurium LT2
ccgaccaaugacgcuauccgc

SEQ ID NO: 3788809 - RNA, 18 nt, Salmonella typhimurium LT2
ccgaccaggacaaaaggc

SEQ ID NO: 3788810 - RNA, 13 nt, Salmonella typhimurium LT2
ccgaccaguaaga

SEQ ID NO: 3788811 - RNA, 19 nt, Salmonella typhimurium LT2
ccgaccaucgcgccgcugg

SEQ ID NO: 3788812 - RNA, 12 nt, Salmonella typhimurium LT2
ccgaccgccagg

SEQ ID NO: 3788813 - RNA, 15 nt, Salmonella typhimurium LT2
ccgaccgccaggucg

SEQ ID NO: 3788814 - RNA, 15 nt, Salmonella typhimurium LT2
ccgaccgucagcucc

SEQ ID NO: 3788815 - RNA, 14 nt, Salmonella typhimurium LT2
ccgaccgucggcgc

SEQ ID NO: 3788816 - RNA, 19 nt, Salmonella typhimurium LT2
ccgaccuacaagauuugca

SEQ ID NO: 3788817 - RNA, 17 nt, Salmonella typhimurium LT2
ccgaccuguaccgcgac

SEQ ID NO: 3788818 - RNA, 17 nt, Salmonella typhimurium LT2
ccgacgaaaaagccaaa

SEQ ID NO: 3788819 - RNA, 14 nt, Salmonella typhimurium LT2
ccgacgaacaaaau

SEQ ID NO: 3788820 - RNA, 23 nt, Salmonella typhimurium LT2
ccgacgauaaacagauaugaaau

SEQ ID NO: 3788821 - RNA, 16 nt, Salmonella typhimurium LT2
ccgacgauaaccggaa

SEQ ID NO: 3788822 - RNA, 19 nt, Salmonella typhimurium LT2
ccgacgcauuucuccugau

SEQ ID NO: 3788823 - RNA, 21 nt, Salmonella typhimurium LT2
ccgacgccuguucgagguuca

SEQ ID NO: 3788824 - RNA, 23 nt, Salmonella typhimurium LT2
ccgacgcgaauugcgaguaaccu

SEQ ID NO: 3788825 - RNA, 15 nt, Salmonella typhimurium LT2
ccgacgcgaugccag

SEQ ID NO: 3788826 - RNA, 23 nt, Salmonella typhimurium LT2
ccgacggcuucuucacgcagcgc

SEQ ID NO: 3788827 - RNA, 13 nt, Salmonella typhimurium LT2
ccgacguuaucgc

SEQ ID NO: 3788828 - RNA, 16 nt, Salmonella typhimurium LT2
ccgacucccccagauu

SEQ ID NO: 3788829 - RNA, 13 nt, Salmonella typhimurium LT2
ccgacugccacca

SEQ ID NO: 3788830 - RNA, 15 nt, Salmonella typhimurium LT2
ccgagaaacaccaga

SEQ ID NO: 3788831 - RNA, 18 nt, Salmonella typhimurium LT2
ccgagaauuucagcacgc

SEQ ID NO: 3788832 - RNA, 14 nt, Salmonella typhimurium LT2
ccgagaccaggcgg

SEQ ID NO: 3788833 - RNA, 13 nt, Salmonella typhimurium LT2
ccgagacugcccg

SEQ ID NO: 3788834 - RNA, 22 nt, Salmonella typhimurium LT2
ccgagccagaacgagaggagga

SEQ ID NO: 3788835 - RNA, 23 nt, Salmonella typhimurium LT2
ccgagccgcccuucacaaccauc

SEQ ID NO: 3788836 - RNA, 17 nt, Salmonella typhimurium LT2
ccgagcggccaaaggga

SEQ ID NO: 3788837 - RNA, 14 nt, Salmonella typhimurium LT2
ccgaguaacaccgc

SEQ ID NO: 3788838 - RNA, 19 nt, Salmonella typhimurium LT2
ccgagucuacaucaagaga

SEQ ID NO: 3788839 - RNA, 14 nt, Salmonella typhimurium LT2
ccgauaaacgccag

SEQ ID NO: 3788840 - RNA, 21 nt, Salmonella typhimurium LT2
ccgccaacgguaaguugaaag

SEQ ID NO: 3788841 - RNA, 18 nt, Salmonella typhimurium LT2
ccgccaagcgcggacagc

SEQ ID NO: 3788842 - RNA, 16 nt, Salmonella typhimurium LT2
ccgccaauaaccaccu

SEQ ID NO: 3788843 - RNA, 15 nt, Salmonella typhimurium LT2
ccgccaccaccgauc

SEQ ID NO: 3788844 - RNA, 14 nt, Salmonella typhimurium LT2
ccgccaccacgccc

SEQ ID NO: 3788845 - RNA, 12 nt, Salmonella typhimurium LT2
ccgccacccggu

SEQ ID NO: 3788846 - RNA, 14 nt, Salmonella typhimurium LT2
ccgccaccgccagc

SEQ ID NO: 3788847 - RNA, 13 nt, Salmonella typhimurium LT2
ccgccaccgccgc

SEQ ID NO: 3788848 - RNA, 15 nt, Salmonella typhimurium LT2
ccgccaccgccucgc

SEQ ID NO: 3788849 - RNA, 14 nt, Salmonella typhimurium LT2
ccgccaccgcgcgc

SEQ ID NO: 3788850 - RNA, 19 nt, Salmonella typhimurium LT2
ccgccagaaaagaaccgac

SEQ ID NO: 3788851 - RNA, 20 nt, Salmonella typhimurium LT2
ccgccagaaaagaaccgacu

SEQ ID NO: 3788852 - RNA, 21 nt, Salmonella typhimurium LT2
ccgccagacccgcaauaacgc

SEQ ID NO: 3788853 - RNA, 13 nt, Salmonella typhimurium LT2
ccgccagacucag

SEQ ID NO: 3788854 - RNA, 16 nt, Salmonella typhimurium LT2
ccgccagacucagcca

SEQ ID NO: 3788855 - RNA, 13 nt, Salmonella typhimurium LT2
ccgccagcacagc

SEQ ID NO: 3788856 - RNA, 14 nt, Salmonella typhimurium LT2
ccgccagcacagca

SEQ ID NO: 3788857 - RNA, 18 nt, Salmonella typhimurium LT2
ccgccagcaccaggcucg

SEQ ID NO: 3788858 - RNA, 19 nt, Salmonella typhimurium LT2
ccgccagcgacauggcggu

SEQ ID NO: 3788859 - RNA, 20 nt, Salmonella typhimurium LT2
ccgccagcgacauggcgguc

SEQ ID NO: 3788860 - RNA, 12 nt, Salmonella typhimurium LT2
ccgccagcgcgg

SEQ ID NO: 3788861 - RNA, 13 nt, Salmonella typhimurium LT2
ccgccagcggcgc

SEQ ID NO: 3788862 - RNA, 15 nt, Salmonella typhimurium LT2
ccgccagcguaucgc

SEQ ID NO: 3788863 - RNA, 15 nt, Salmonella typhimurium LT2
ccgccagcgucgcca

SEQ ID NO: 3788864 - RNA, 15 nt, Salmonella typhimurium LT2
ccgccagcgucucag

SEQ ID NO: 3788865 - RNA, 19 nt, Salmonella typhimurium LT2
ccgccagcgugacccagac

SEQ ID NO: 3788866 - RNA, 17 nt, Salmonella typhimurium LT2
ccgccagcucgucggcc

SEQ ID NO: 3788867 - RNA, 18 nt, Salmonella typhimurium LT2
ccgccaggguaucaucaa

SEQ ID NO: 3788868 - RNA, 21 nt, Salmonella typhimurium LT2
ccgccaggucuuuaucuauca

SEQ ID NO: 3788869 - RNA, 23 nt, Salmonella typhimurium LT2
ccgccaguaauuuuucucccagc

SEQ ID NO: 3788870 - RNA, 19 nt, Salmonella typhimurium LT2
ccgccauaaacgguuucag

SEQ ID NO: 3788871 - RNA, 12 nt, Salmonella typhimurium LT2
ccgccauaacgc

SEQ ID NO: 3788872 - RNA, 13 nt, Salmonella typhimurium LT2
ccgccauaacggc

SEQ ID NO: 3788873 - RNA, 13 nt, Salmonella typhimurium LT2
ccgccauaauagc

SEQ ID NO: 3788874 - RNA, 19 nt, Salmonella typhimurium LT2
ccgccauacccggcuccca

SEQ ID NO: 3788875 - RNA, 16 nt, Salmonella typhimurium LT2
ccgccauagccggcga

SEQ ID NO: 3788876 - RNA, 18 nt, Salmonella typhimurium LT2
ccgccauaggucagcgcu

SEQ ID NO: 3788877 - RNA, 18 nt, Salmonella typhimurium LT2
ccgccauauccccgccau

SEQ ID NO: 3788878 - RNA, 13 nt, Salmonella typhimurium LT2
ccgccaucaggca

SEQ ID NO: 3788879 - RNA, 15 nt, Salmonella typhimurium LT2
ccgccauccggcaaa

SEQ ID NO: 3788880 - RNA, 22 nt, Salmonella typhimurium LT2
ccgccauccggcaaaaagcuua

SEQ ID NO: 3788881 - RNA, 15 nt, Salmonella typhimurium LT2
ccgccauccggcaag

SEQ ID NO: 3788882 - RNA, 15 nt, Salmonella typhimurium LT2
ccgccauccggcaau

SEQ ID NO: 3788883 - RNA, 15 nt, Salmonella typhimurium LT2
ccgccauccggcaca

SEQ ID NO: 3788884 - RNA, 19 nt, Salmonella typhimurium LT2
ccgccauccggcacaguau

SEQ ID NO: 3788885 - RNA, 19 nt, Salmonella typhimurium LT2
ccgccauccggcacgguca

SEQ ID NO: 3788886 - RNA, 19 nt, Salmonella typhimurium LT2
ccgccauccggcagugccg

SEQ ID NO: 3788887 - RNA, 19 nt, Salmonella typhimurium LT2
ccgccauccggcauuuuuu

SEQ ID NO: 3788888 - RNA, 14 nt, Salmonella typhimurium LT2
ccgccauccggccu

SEQ ID NO: 3788889 - RNA, 14 nt, Salmonella typhimurium LT2
ccgccauccggcga

SEQ ID NO: 3788890 - RNA, 21 nt, Salmonella typhimurium LT2
ccgccaucgcaucgaggcugg

SEQ ID NO: 3788891 - RNA, 13 nt, Salmonella typhimurium LT2
ccgccaucgccag

SEQ ID NO: 3788892 - RNA, 18 nt, Salmonella typhimurium LT2
ccgccaucgccaguaccg

SEQ ID NO: 3788893 - RNA, 16 nt, Salmonella typhimurium LT2
ccgccaucgcugggau

SEQ ID NO: 3788894 - RNA, 20 nt, Salmonella typhimurium LT2
ccgccaucucauucgccagc

SEQ ID NO: 3788895 - RNA, 12 nt, Salmonella typhimurium LT2
ccgccaugaaaa

SEQ ID NO: 3788896 - RNA, 16 nt, Salmonella typhimurium LT2
ccgccaugacgcaccg

SEQ ID NO: 3788897 - RNA, 12 nt, Salmonella typhimurium LT2
ccgccauggcga

SEQ ID NO: 3788898 - RNA, 18 nt, Salmonella typhimurium LT2
ccgccauggcgaauccgu

SEQ ID NO: 3788899 - RNA, 20 nt, Salmonella typhimurium LT2
ccgccauucgcuuccgccgg

SEQ ID NO: 3788900 - RNA, 17 nt, Salmonella typhimurium LT2
ccgcccaacagggcggc

SEQ ID NO: 3788901 - RNA, 15 nt, Salmonella typhimurium LT2
ccgcccaaccagccc

SEQ ID NO: 3788902 - RNA, 22 nt, Salmonella typhimurium LT2
ccgcccagaaagaucagcagaa

SEQ ID NO: 3788903 - RNA, 23 nt, Salmonella typhimurium LT2
ccgcccagauguugauacagaaa

SEQ ID NO: 3788904 - RNA, 20 nt, Salmonella typhimurium LT2
ccgcccaggauacagccgaa

SEQ ID NO: 3788905 - RNA, 14 nt, Salmonella typhimurium LT2
ccgcccauccaggg

SEQ ID NO: 3788906 - RNA, 23 nt, Salmonella typhimurium LT2
ccgccccagcgguaccaccagcg

SEQ ID NO: 3788907 - RNA, 13 nt, Salmonella typhimurium LT2
ccgccccugugga

SEQ ID NO: 3788908 - RNA, 22 nt, Salmonella typhimurium LT2
ccgccccuguggaaucagucgg

SEQ ID NO: 3788909 - RNA, 19 nt, Salmonella typhimurium LT2
ccgcccgcgcucccgccca

SEQ ID NO: 3788910 - RNA, 13 nt, Salmonella typhimurium LT2
ccgcccgcguagc

SEQ ID NO: 3788911 - RNA, 13 nt, Salmonella typhimurium LT2
ccgcccggcgucg

SEQ ID NO: 3788912 - RNA, 23 nt, Salmonella typhimurium LT2
ccgcccguacagacaucaucgaa

SEQ ID NO: 3788913 - RNA, 13 nt, Salmonella typhimurium LT2
ccgcccugcccgc

SEQ ID NO: 3788914 - RNA, 18 nt, Salmonella typhimurium LT2
ccgcccuguccuccaugg

SEQ ID NO: 3788915 - RNA, 14 nt, Salmonella typhimurium LT2
ccgccgacaaccag

SEQ ID NO: 3788916 - RNA, 17 nt, Salmonella typhimurium LT2
ccgccgacaaucgucac

SEQ ID NO: 3788917 - RNA, 14 nt, Salmonella typhimurium LT2
ccgccgaugugcgc

SEQ ID NO: 3788918 - RNA, 18 nt, Salmonella typhimurium LT2
ccgccgcaauuccugacu

SEQ ID NO: 3788919 - RNA, 22 nt, Salmonella typhimurium LT2
ccgccgcaauuccugacugcgc

SEQ ID NO: 3788920 - RNA, 15 nt, Salmonella typhimurium LT2
ccgccgcagauauuu

SEQ ID NO: 3788921 - RNA, 18 nt, Salmonella typhimurium LT2
ccgccgcaggccaucaua

SEQ ID NO: 3788922 - RNA, 14 nt, Salmonella typhimurium LT2
ccgccgccagccau

SEQ ID NO: 3788923 - RNA, 14 nt, Salmonella typhimurium LT2
ccgccgccagguua

SEQ ID NO: 3788924 - RNA, 15 nt, Salmonella typhimurium LT2
ccgccgccaucacca

SEQ ID NO: 3788925 - RNA, 15 nt, Salmonella typhimurium LT2
ccgccgccaucgcca

SEQ ID NO: 3788926 - RNA, 13 nt, Salmonella typhimurium LT2
ccgccgccgcgcu

SEQ ID NO: 3788927 - RNA, 13 nt, Salmonella typhimurium LT2
ccgccgccggacu

SEQ ID NO: 3788928 - RNA, 13 nt, Salmonella typhimurium LT2
ccgccgcgaaaac

SEQ ID NO: 3788929 - RNA, 19 nt, Salmonella typhimurium LT2
ccgccgcgacgaugccaau

SEQ ID NO: 3788930 - RNA, 12 nt, Salmonella typhimurium LT2
ccgccgcgagaa

SEQ ID NO: 3788931 - RNA, 14 nt, Salmonella typhimurium LT2
ccgccgcggccagc

SEQ ID NO: 3788932 - RNA, 14 nt, Salmonella typhimurium LT2
ccgccgcgggcagc

SEQ ID NO: 3788933 - RNA, 18 nt, Salmonella typhimurium LT2
ccgccgcgggcagcagca

SEQ ID NO: 3788934 - RNA, 15 nt, Salmonella typhimurium LT2
ccgccgcuggcgggc

SEQ ID NO: 3788935 - RNA, 18 nt, Salmonella typhimurium LT2
ccgccgcuggucaacacg

SEQ ID NO: 3788936 - RNA, 23 nt, Salmonella typhimurium LT2
ccgccgcuuuaucguaaccgaug

SEQ ID NO: 3788937 - RNA, 20 nt, Salmonella typhimurium LT2
ccgccgggaucagcggcugc

SEQ ID NO: 3788938 - RNA, 17 nt, Salmonella typhimurium LT2
ccgccgggcgucacccg

SEQ ID NO: 3788939 - RNA, 19 nt, Salmonella typhimurium LT2
ccgccgggucagaaaagcu

SEQ ID NO: 3788940 - RNA, 16 nt, Salmonella typhimurium LT2
ccgccgguaaggccaa

SEQ ID NO: 3788941 - RNA, 15 nt, Salmonella typhimurium LT2
ccgccguaacgugcu

SEQ ID NO: 3788942 - RNA, 19 nt, Salmonella typhimurium LT2
ccgccgucgucaccgccgc

SEQ ID NO: 3788943 - RNA, 16 nt, Salmonella typhimurium LT2
ccgccguuaaccgucu

SEQ ID NO: 3788944 - RNA, 20 nt, Salmonella typhimurium LT2
ccgccguuucguugccagag

SEQ ID NO: 3788945 - RNA, 17 nt, Salmonella typhimurium LT2
ccgcuccgggccgauac

SEQ ID NO: 3788946 - RNA, 17 nt, Salmonella typhimurium LT2
ccgcuccguacgcguca

SEQ ID NO: 3788947 - RNA, 15 nt, Salmonella typhimurium LT2
ccgcucgaaucgcca

SEQ ID NO: 3788948 - RNA, 16 nt, Salmonella typhimurium LT2
ccgcucgaaucgccau

SEQ ID NO: 3788949 - RNA, 15 nt, Salmonella typhimurium LT2
ccgcucgccauaucu

SEQ ID NO: 3788950 - RNA, 12 nt, Salmonella typhimurium LT2
ccgcucgccgcc

SEQ ID NO: 3788951 - RNA, 19 nt, Salmonella typhimurium LT2
ccgcucgcuuacgcggcgc

SEQ ID NO: 3788952 - RNA, 22 nt, Salmonella typhimurium LT2
ccgcucgcuuacgcggcgcgcu

SEQ ID NO: 3788953 - RNA, 22 nt, Salmonella typhimurium LT2
ccgcucggcauacaccgccagc

SEQ ID NO: 3788954 - RNA, 14 nt, Salmonella typhimurium LT2
ccgcucugcgccag

SEQ ID NO: 3788955 - RNA, 17 nt, Salmonella typhimurium LT2
ccgcucuucaguaacca

SEQ ID NO: 3788956 - RNA, 15 nt, Salmonella typhimurium LT2
ccgcugaccaucaac

SEQ ID NO: 3788957 - RNA, 19 nt, Salmonella typhimurium LT2
ccgcugacgaccccaggca

SEQ ID NO: 3788958 - RNA, 16 nt, Salmonella typhimurium LT2
ccgcugcaacucccgc

SEQ ID NO: 3788959 - RNA, 20 nt, Salmonella typhimurium LT2
ccgcugcgcucacgcggcgc

SEQ ID NO: 3788960 - RNA, 17 nt, Salmonella typhimurium LT2
ccgcugcgugcgcgcca

SEQ ID NO: 3788961 - RNA, 19 nt, Salmonella typhimurium LT2
ccgcuggcgccaccgcugc

SEQ ID NO: 3788962 - RNA, 15 nt, Salmonella typhimurium LT2
ccgcuggcgcgggga

SEQ ID NO: 3788963 - RNA, 22 nt, Salmonella typhimurium LT2
ccgcuggcgucuucaucaacgu

SEQ ID NO: 3788964 - RNA, 15 nt, Salmonella typhimurium LT2
ccgcuguaauaccag

SEQ ID NO: 3788965 - RNA, 14 nt, Salmonella typhimurium LT2
ccgcugucgccaga

SEQ ID NO: 3788966 - RNA, 14 nt, Salmonella typhimurium LT2
ccgcuucacacugg

SEQ ID NO: 3788967 - RNA, 23 nt, Salmonella typhimurium LT2
ccgcuucaccuuucgccgccaga

SEQ ID NO: 3788968 - RNA, 17 nt, Salmonella typhimurium LT2
ccgcuucauuggcgucu

SEQ ID NO: 3788969 - RNA, 12 nt, Salmonella typhimurium LT2
ccgcuuccagcg

SEQ ID NO: 3788970 - RNA, 17 nt, Salmonella typhimurium LT2
ccgcuuccagcgcgucg

SEQ ID NO: 3788971 - RNA, 14 nt, Salmonella typhimurium LT2
ccgcuuccggcagg

SEQ ID NO: 3788972 - RNA, 16 nt, Salmonella typhimurium LT2
ccgcuucgucgccauc

SEQ ID NO: 3788973 - RNA, 16 nt, Salmonella typhimurium LT2
ccgcuuuaaucaccau

SEQ ID NO: 3788974 - RNA, 15 nt, Salmonella typhimurium LT2
ccgcuuuaccgccuu

SEQ ID NO: 3788975 - RNA, 18 nt, Salmonella typhimurium LT2
ccgcuuuaccgccuuccu

SEQ ID NO: 3788976 - RNA, 22 nt, Salmonella typhimurium LT2
ccgcuuuaugcgcuuccagcau

SEQ ID NO: 3788977 - RNA, 16 nt, Salmonella typhimurium LT2
ccgcuuugcgaacagc

SEQ ID NO: 3788978 - RNA, 21 nt, Salmonella typhimurium LT2
ccgcuuuuccugcugccaucg

SEQ ID NO: 3788979 - RNA, 21 nt, Salmonella typhimurium LT2
ccgcuuuugccgugacuuccg

SEQ ID NO: 3788980 - RNA, 21 nt, Salmonella typhimurium LT2
ccgcuuuugguuuuucaacca

SEQ ID NO: 3788981 - RNA, 12 nt, Salmonella typhimurium LT2
ccgcuuuuuaau

SEQ ID NO: 3788982 - RNA, 16 nt, Salmonella typhimurium LT2
ccgcuuuuuccgccgc

SEQ ID NO: 3788983 - RNA, 17 nt, Salmonella typhimurium LT2
ccgcuuuuuccgccgcc

SEQ ID NO: 3788984 - RNA, 23 nt, Salmonella typhimurium LT2
ccggaaagaauaaucgccgccgg

SEQ ID NO: 3788985 - RNA, 16 nt, Salmonella typhimurium LT2
ccggaaauagagaggg

SEQ ID NO: 3788986 - RNA, 20 nt, Salmonella typhimurium LT2
ccggaaauagagagggccgc

SEQ ID NO: 3788987 - RNA, 22 nt, Salmonella typhimurium LT2
ccggaaauggucgcuccggaac

SEQ ID NO: 3788988 - RNA, 19 nt, Salmonella typhimurium LT2
ccggaaauuugcagcgcug

SEQ ID NO: 3788989 - RNA, 14 nt, Salmonella typhimurium LT2
ccggaacagggccg

SEQ ID NO: 3788990 - RNA, 20 nt, Salmonella typhimurium LT2
ccggaacagggccgcauccc

SEQ ID NO: 3788991 - RNA, 17 nt, Salmonella typhimurium LT2
ccggaacgggcaugacu

SEQ ID NO: 3788992 - RNA, 13 nt, Salmonella typhimurium LT2
ccggaauacacaa

SEQ ID NO: 3788993 - RNA, 15 nt, Salmonella typhimurium LT2
ccggaauccaccaua

SEQ ID NO: 3788994 - RNA, 20 nt, Salmonella typhimurium LT2
ccggaaugguauaaaucccg

SEQ ID NO: 3788995 - RNA, 20 nt, Salmonella typhimurium LT2
ccggaauggucgcgccaggg

SEQ ID NO: 3788996 - RNA, 14 nt, Salmonella typhimurium LT2
ccggacaaggcggu

SEQ ID NO: 3788997 - RNA, 16 nt, Salmonella typhimurium LT2
ccggacagagugucua

SEQ ID NO: 3788998 - RNA, 16 nt, Salmonella typhimurium LT2
ccggaccguuaucaaa

SEQ ID NO: 3788999 - RNA, 11 nt, Salmonella typhimurium LT2
ccggaccuaau

SEQ ID NO: 3789000 - RNA, 19 nt, Salmonella typhimurium LT2
ccggacgacggcaacgcgu

SEQ ID NO: 3789001 - RNA, 17 nt, Salmonella typhimurium LT2
ccggacgccguccaggc

SEQ ID NO: 3789002 - RNA, 15 nt, Salmonella typhimurium LT2
ccggacggcggcugc

SEQ ID NO: 3789003 - RNA, 17 nt, Salmonella typhimurium LT2
ccggacuccagcaacgc

SEQ ID NO: 3789004 - RNA, 21 nt, Salmonella typhimurium LT2
ccggacuccaggcaacguugu

SEQ ID NO: 3789005 - RNA, 23 nt, Salmonella typhimurium LT2
ccggacugauagucauugacagc

SEQ ID NO: 3789006 - RNA, 17 nt, Salmonella typhimurium LT2
ccggagaccuuuuucau

SEQ ID NO: 3789007 - RNA, 19 nt, Salmonella typhimurium LT2
ccggagaggcguucaugcc

SEQ ID NO: 3789008 - RNA, 17 nt, Salmonella typhimurium LT2
ccggaggaccugauuaa

SEQ ID NO: 3789009 - RNA, 21 nt, Salmonella typhimurium LT2
ccggaguuuuuccgggccgac

SEQ ID NO: 3789010 - RNA, 17 nt, Salmonella typhimurium LT2
ccggauaaccgcccgcg

SEQ ID NO: 3789011 - RNA, 22 nt, Salmonella typhimurium LT2
ccggauaacggcgcgaaagcgc

SEQ ID NO: 3789012 - RNA, 20 nt, Salmonella typhimurium LT2
ccggauaagcaaagcgccau

SEQ ID NO: 3789013 - RNA, 20 nt, Salmonella typhimurium LT2
ccggauaagcgcagcgccau

SEQ ID NO: 3789014 - RNA, 21 nt, Salmonella typhimurium LT2
ccggauaagcguaagcgccau

SEQ ID NO: 3789015 - RNA, 21 nt, Salmonella typhimurium LT2
ccggauaagcgucagcgccau

SEQ ID NO: 3789016 - RNA, 20 nt, Salmonella typhimurium LT2
ccggauaagcgugagcgcau

SEQ ID NO: 3789017 - RNA, 13 nt, Salmonella typhimurium LT2
ccggauaaggcgc

SEQ ID NO: 3789018 - RNA, 21 nt, Salmonella typhimurium LT2
ccggauaaggcgcuugugaua

SEQ ID NO: 3789019 - RNA, 23 nt, Salmonella typhimurium LT2
ccggauaaggcggagccgccauc

SEQ ID NO: 3789020 - RNA, 22 nt, Salmonella typhimurium LT2
ccggauaaggcguucacgccgc

SEQ ID NO: 3789021 - RNA, 23 nt, Salmonella typhimurium LT2
ccggauaaggcguuucgccgcca

SEQ ID NO: 3789022 - RNA, 21 nt, Salmonella typhimurium LT2
ccggauaaggcguuugcgccg

SEQ ID NO: 3789023 - RNA, 14 nt, Salmonella typhimurium LT2
ccggauaaggugcu

SEQ ID NO: 3789024 - RNA, 23 nt, Salmonella typhimurium LT2
ccggauaauuuauccaguaacgc

SEQ ID NO: 3789025 - RNA, 16 nt, Salmonella typhimurium LT2
ccggauacaagguauc

SEQ ID NO: 3789026 - RNA, 14 nt, Salmonella typhimurium LT2
ccggauagcgcugu

SEQ ID NO: 3789027 - RNA, 14 nt, Salmonella typhimurium LT2
ccggauauucggug

SEQ ID NO: 3789028 - RNA, 15 nt, Salmonella typhimurium LT2
ccggaucaccggcau

SEQ ID NO: 3789029 - RNA, 12 nt, Salmonella typhimurium LT2
ccggaucgccau

SEQ ID NO: 3789030 - RNA, 18 nt, Salmonella typhimurium LT2
ccggaucgcuaauuuuua

SEQ ID NO: 3789031 - RNA, 17 nt, Salmonella typhimurium LT2
ccggaucgggcuuccag

SEQ ID NO: 3789032 - RNA, 12 nt, Salmonella typhimurium LT2
ccggaugacaca

SEQ ID NO: 3789033 - RNA, 22 nt, Salmonella typhimurium LT2
ccggaugacacaucaccuccag

SEQ ID NO: 3789034 - RNA, 15 nt, Salmonella typhimurium LT2
ccggaugcgacgcgc

SEQ ID NO: 3789035 - RNA, 15 nt, Salmonella typhimurium LT2
ccggaugcgacucca

SEQ ID NO: 3789036 - RNA, 16 nt, Salmonella typhimurium LT2
ccggaugcgccgugcu

SEQ ID NO: 3789037 - RNA, 13 nt, Salmonella typhimurium LT2
ccggaugcggcua

SEQ ID NO: 3789038 - RNA, 22 nt, Salmonella typhimurium LT2
ccggaugcguguucagguuggc

SEQ ID NO: 3789039 - RNA, 17 nt, Salmonella typhimurium LT2
ccggauggagcggcgcu

SEQ ID NO: 3789040 - RNA, 14 nt, Salmonella typhimurium LT2
ccggauggcgcugc

SEQ ID NO: 3789041 - RNA, 18 nt, Salmonella typhimurium LT2
ccggauggcgcugcgcuu

SEQ ID NO: 3789042 - RNA, 21 nt, Salmonella typhimurium LT2
ccggauggcggcgucgccugu

SEQ ID NO: 3789043 - RNA, 23 nt, Salmonella typhimurium LT2
ccggauggcggcgugaccgccuu

SEQ ID NO: 3789044 - RNA, 20 nt, Salmonella typhimurium LT2
ccggauggcggcuuugaacg

SEQ ID NO: 3789045 - RNA, 16 nt, Salmonella typhimurium LT2
ccggauggcgucugau

SEQ ID NO: 3789046 - RNA, 18 nt, Salmonella typhimurium LT2
ccggauggggcaucagcc

SEQ ID NO: 3789047 - RNA, 14 nt, Salmonella typhimurium LT2
ccggauuccagaau

SEQ ID NO: 3789048 - RNA, 15 nt, Salmonella typhimurium LT2
ccggauugcccgcgg

SEQ ID NO: 3789049 - RNA, 15 nt, Salmonella typhimurium LT2
ccgucccagcggaug

SEQ ID NO: 3789050 - RNA, 13 nt, Salmonella typhimurium LT2
ccguccccagcca

SEQ ID NO: 3789051 - RNA, 19 nt, Salmonella typhimurium LT2
ccguccccagcccaucggu

SEQ ID NO: 3789052 - RNA, 14 nt, Salmonella typhimurium LT2
ccgucccuuccgcc

SEQ ID NO: 3789053 - RNA, 20 nt, Salmonella typhimurium LT2
ccgucccuuccgccaccagg

SEQ ID NO: 3789054 - RNA, 15 nt, Salmonella typhimurium LT2
ccguccgccaggccc

SEQ ID NO: 3789055 - RNA, 17 nt, Salmonella typhimurium LT2
ccguccggcaaacccuu

SEQ ID NO: 3789056 - RNA, 11 nt, Salmonella typhimurium LT2
ccguccggcag

SEQ ID NO: 3789057 - RNA, 12 nt, Salmonella typhimurium LT2
ccguccggcagu

SEQ ID NO: 3789058 - RNA, 11 nt, Salmonella typhimurium LT2
ccgucgacgcc

SEQ ID NO: 3789059 - RNA, 21 nt, Salmonella typhimurium LT2
ccgucgagaaaccgcucgccg

SEQ ID NO: 3789060 - RNA, 15 nt, Salmonella typhimurium LT2
ccgucgaugauggcg

SEQ ID NO: 3789061 - RNA, 17 nt, Salmonella typhimurium LT2
ccgucgaugauggcggc

SEQ ID NO: 3789062 - RNA, 14 nt, Salmonella typhimurium LT2
ccgucgcccguccg

SEQ ID NO: 3789063 - RNA, 16 nt, Salmonella typhimurium LT2
ccgucgcccguccgcu

SEQ ID NO: 3789064 - RNA, 12 nt, Salmonella typhimurium LT2
ccgucgccggaa

SEQ ID NO: 3789065 - RNA, 14 nt, Salmonella typhimurium LT2
ccgucgccggccug

SEQ ID NO: 3789066 - RNA, 19 nt, Salmonella typhimurium LT2
ccgucgccugccucgcuga

SEQ ID NO: 3789067 - RNA, 17 nt, Salmonella typhimurium LT2
ccgucgcggcuuucagc

SEQ ID NO: 3789068 - RNA, 18 nt, Salmonella typhimurium LT2
ccgucggcaauuaacauu

SEQ ID NO: 3789069 - RNA, 18 nt, Salmonella typhimurium LT2
ccgucggcagccagaccu

SEQ ID NO: 3789070 - RNA, 16 nt, Salmonella typhimurium LT2
ccgucggcgccagcca

SEQ ID NO: 3789071 - RNA, 17 nt, Salmonella typhimurium LT2
ccgucggcgccagccac

SEQ ID NO: 3789072 - RNA, 18 nt, Salmonella typhimurium LT2
ccgucggcgccagccaca

SEQ ID NO: 3789073 - RNA, 17 nt, Salmonella typhimurium LT2
ccgucggggauggcgga

SEQ ID NO: 3789074 - RNA, 18 nt, Salmonella typhimurium LT2
ccgucggggauggcggau

SEQ ID NO: 3789075 - RNA, 17 nt, Salmonella typhimurium LT2
ccgucguagccaccauc

SEQ ID NO: 3789076 - RNA, 19 nt, Salmonella typhimurium LT2
ccgucgucaccgccgcgcu

SEQ ID NO: 3789077 - RNA, 22 nt, Salmonella typhimurium LT2
ccgucgugccuuucaggcgcgg

SEQ ID NO: 3789078 - RNA, 20 nt, Salmonella typhimurium LT2
ccgucuaaccgggccugaug

SEQ ID NO: 3789079 - RNA, 15 nt, Salmonella typhimurium LT2
ccgucucaaccagca

SEQ ID NO: 3789080 - RNA, 19 nt, Salmonella typhimurium LT2
ccgucucaaccagcaauga

SEQ ID NO: 3789081 - RNA, 13 nt, Salmonella typhimurium LT2
ccgucucaccagg

SEQ ID NO: 3789082 - RNA, 22 nt, Salmonella typhimurium LT2
ccgucuccuccuugugggcagc

SEQ ID NO: 3789083 - RNA, 20 nt, Salmonella typhimurium LT2
ccgucucuuuaucuaacugc

SEQ ID NO: 3789084 - RNA, 22 nt, Salmonella typhimurium LT2
ccgucucuuuaucuaacugcgg

SEQ ID NO: 3789085 - RNA, 20 nt, Salmonella typhimurium LT2
ccgucuggggaaaccugaag

SEQ ID NO: 3789086 - RNA, 20 nt, Salmonella typhimurium LT2
ccgucuuguacaggcgcuca

SEQ ID NO: 3789087 - RNA, 21 nt, Salmonella typhimurium LT2
ccgugaaagcauaccuucaca

SEQ ID NO: 3789088 - RNA, 22 nt, Salmonella typhimurium LT2
ccgugaagcccggcggcgcgau

SEQ ID NO: 3789089 - RNA, 20 nt, Salmonella typhimurium LT2
ccgugaauaaaaccggcaua

SEQ ID NO: 3789090 - RNA, 14 nt, Salmonella typhimurium LT2
ccgugaccugcuga

SEQ ID NO: 3789091 - RNA, 16 nt, Salmonella typhimurium LT2
ccgugaucgaggcgcu

SEQ ID NO: 3789092 - RNA, 19 nt, Salmonella typhimurium LT2
ccgugcaaaaucacgcggc

SEQ ID NO: 3789093 - RNA, 21 nt, Salmonella typhimurium LT2
ccgugcaaaaucacgcggcgc

SEQ ID NO: 3789094 - RNA, 14 nt, Salmonella typhimurium LT2
ccgugcccagcauc

SEQ ID NO: 3789095 - RNA, 15 nt, Salmonella typhimurium LT2
ccgugcgcagaauau

SEQ ID NO: 3789096 - RNA, 20 nt, Salmonella typhimurium LT2
ccgugcgccgacaucgccac

SEQ ID NO: 3789097 - RNA, 20 nt, Salmonella typhimurium LT2
ccguggaagcggaacugaug

SEQ ID NO: 3789098 - RNA, 21 nt, Salmonella typhimurium LT2
ccguggaucucgucgccggug

SEQ ID NO: 3789099 - RNA, 20 nt, Salmonella typhimurium LT2
ccguggcaaaucccguaccg

SEQ ID NO: 3789100 - RNA, 18 nt, Salmonella typhimurium LT2
ccguggcugcgccugcgc

SEQ ID NO: 3789101 - RNA, 12 nt, Salmonella typhimurium LT2
ccguggcuggcg

SEQ ID NO: 3789102 - RNA, 16 nt, Salmonella typhimurium LT2
ccguggugggcgcgac

SEQ ID NO: 3789103 - RNA, 19 nt, Salmonella typhimurium LT2
ccguguaagagcuggucgg

SEQ ID NO: 3789104 - RNA, 20 nt, Salmonella typhimurium LT2
ccguguccaugcaugacgca

SEQ ID NO: 3789105 - RNA, 15 nt, Salmonella typhimurium LT2
ccguguggucgcggc

SEQ ID NO: 3789106 - RNA, 18 nt, Salmonella typhimurium LT2
ccguguggucgcggcuca

SEQ ID NO: 3789107 - RNA, 22 nt, Salmonella typhimurium LT2
ccguuaaaugcccgauggcgcu

SEQ ID NO: 3789108 - RNA, 17 nt, Salmonella typhimurium LT2
ccguuaagauccugacu

SEQ ID NO: 3789109 - RNA, 13 nt, Salmonella typhimurium LT2
ccguuaagcugga

SEQ ID NO: 3789110 - RNA, 13 nt, Salmonella typhimurium LT2
ccguuaccagcau

SEQ ID NO: 3789111 - RNA, 20 nt, Salmonella typhimurium LT2
ccguuagcgcucuucgcucc

SEQ ID NO: 3789112 - RNA, 21 nt, Salmonella typhimurium LT2
ccguuauacaucgcuuuccag

SEQ ID NO: 3789113 - RNA, 14 nt, Salmonella typhimurium LT2
ccguuauccggcaa

SEQ ID NO: 3789114 - RNA, 12 nt, Salmonella typhimurium LT2
ccguuaucggcc

SEQ ID NO: 3789115 - RNA, 18 nt, Salmonella typhimurium LT2
ccguuaucggccugcuca

SEQ ID NO: 3789116 - RNA, 15 nt, Salmonella typhimurium LT2
ccguuaucuuauaaa

SEQ ID NO: 3789117 - RNA, 21 nt, Salmonella typhimurium LT2
ccguuaugcaguucaaaaggu

SEQ ID NO: 3789118 - RNA, 16 nt, Salmonella typhimurium LT2
ccguucagaauggcgu

SEQ ID NO: 3789119 - RNA, 17 nt, Salmonella typhimurium LT2
ccguucaucggcauaca

SEQ ID NO: 3789120 - RNA, 20 nt, Salmonella typhimurium LT2
ccguucauucgccccagcau

SEQ ID NO: 3789121 - RNA, 20 nt, Salmonella typhimurium LT2
ccguucccucugagaacuau

SEQ ID NO: 3789122 - RNA, 13 nt, Salmonella typhimurium LT2
ccguucuuccugg

SEQ ID NO: 3789123 - RNA, 17 nt, Salmonella typhimurium LT2
ccguugauaauaaauug

SEQ ID NO: 3789124 - RNA, 22 nt, Salmonella typhimurium LT2
ccguugccuggcgacccauacc

SEQ ID NO: 3789125 - RNA, 15 nt, Salmonella typhimurium LT2
ccguugcgcccauca

SEQ ID NO: 3789126 - RNA, 19 nt, Salmonella typhimurium LT2
ccguuggauaccacgcaca

SEQ ID NO: 3789127 - RNA, 17 nt, Salmonella typhimurium LT2
ccguuggcuuuaugcac

SEQ ID NO: 3789128 - RNA, 15 nt, Salmonella typhimurium LT2
ccguuuacagccgcc

SEQ ID NO: 3789129 - RNA, 13 nt, Salmonella typhimurium LT2
ccguuucccaggu

SEQ ID NO: 3789130 - RNA, 21 nt, Salmonella typhimurium LT2
ccguuucuuuuucgaucagca

SEQ ID NO: 3789131 - RNA, 19 nt, Salmonella typhimurium LT2
ccguuuguaacauauuuuu

SEQ ID NO: 3789132 - RNA, 17 nt, Salmonella typhimurium LT2
ccguuuuagguucuuca

SEQ ID NO: 3789133 - RNA, 16 nt, Salmonella typhimurium LT2
ccguuuucgcccccag

SEQ ID NO: 3789134 - RNA, 16 nt, Salmonella typhimurium LT2
ccguuuuggcagcgcc

SEQ ID NO: 3789135 - RNA, 13 nt, Salmonella typhimurium LT2
ccuaaaaauagcu

SEQ ID NO: 3789136 - RNA, 23 nt, Salmonella typhimurium LT2
ccuaaaccaaacaccagaucauu

SEQ ID NO: 3789137 - RNA, 13 nt, Salmonella typhimurium LT2
ccuaaauaaauac

SEQ ID NO: 3789138 - RNA, 17 nt, Salmonella typhimurium LT2
ccuaaauaaauaccaaa

SEQ ID NO: 3789139 - RNA, 22 nt, Salmonella typhimurium LT2
ccuaaaucugccaucagcaccu

SEQ ID NO: 3789140 - RNA, 15 nt, Salmonella typhimurium LT2
ccuaacacaugcaag

SEQ ID NO: 3789141 - RNA, 13 nt, Salmonella typhimurium LT2
ccuaacaucauuc

SEQ ID NO: 3789142 - RNA, 15 nt, Salmonella typhimurium LT2
ccuaacaucauuccc

SEQ ID NO: 3789143 - RNA, 17 nt, Salmonella typhimurium LT2
ccuaacguguuaucgcu

SEQ ID NO: 3789144 - RNA, 20 nt, Salmonella typhimurium LT2
ccuaacuggaaaaagaccaa

SEQ ID NO: 3789145 - RNA, 18 nt, Salmonella typhimurium LT2
ccuaagagaaaaccccgu

SEQ ID NO: 3789146 - RNA, 15 nt, Salmonella typhimurium LT2
ccuaagccggcaggc

SEQ ID NO: 3789147 - RNA, 13 nt, Salmonella typhimurium LT2
ccuaauaaaauaa

SEQ ID NO: 3789148 - RNA, 17 nt, Salmonella typhimurium LT2
ccuaauaaccagcccca

SEQ ID NO: 3789149 - RNA, 15 nt, Salmonella typhimurium LT2
ccuaaugagccagau

SEQ ID NO: 3789150 - RNA, 21 nt, Salmonella typhimurium LT2
ccuacaaagaacauaauaaaa

SEQ ID NO: 3789151 - RNA, 19 nt, Salmonella typhimurium LT2
ccuacaaauuacacaauau

SEQ ID NO: 3789152 - RNA, 19 nt, Salmonella typhimurium LT2
ccuacaagaauuuaucgca

SEQ ID NO: 3789153 - RNA, 17 nt, Salmonella typhimurium LT2
ccucuggccaguuucaa

SEQ ID NO: 3789154 - RNA, 23 nt, Salmonella typhimurium LT2
ccucuucauagcguuuuuucauc

SEQ ID NO: 3789155 - RNA, 15 nt, Salmonella typhimurium LT2
ccucuuccagcgcca

SEQ ID NO: 3789156 - RNA, 17 nt, Salmonella typhimurium LT2
ccucuuccccggucagu

SEQ ID NO: 3789157 - RNA, 13 nt, Salmonella typhimurium LT2
ccucuuccgccag

SEQ ID NO: 3789158 - RNA, 20 nt, Salmonella typhimurium LT2
ccucuucuuuuaauugccag

SEQ ID NO: 3789159 - RNA, 18 nt, Salmonella typhimurium LT2
ccucuugucaggcaaaaa

SEQ ID NO: 3789160 - RNA, 16 nt, Salmonella typhimurium LT2
ccucuugucaggcaga

SEQ ID NO: 3789161 - RNA, 12 nt, Salmonella typhimurium LT2
ccucuuuccguu

SEQ ID NO: 3789162 - RNA, 14 nt, Salmonella typhimurium LT2
ccucuuucgccauu

SEQ ID NO: 3789163 - RNA, 15 nt, Salmonella typhimurium LT2
ccucuuucgccgcuu

SEQ ID NO: 3789164 - RNA, 15 nt, Salmonella typhimurium LT2
ccucuuucugauaac

SEQ ID NO: 3789165 - RNA, 19 nt, Salmonella typhimurium LT2
ccugaaagaguacgccgau

SEQ ID NO: 3789166 - RNA, 11 nt, Salmonella typhimurium LT2
ccugaacaggg

SEQ ID NO: 3789167 - RNA, 14 nt, Salmonella typhimurium LT2
ccugaaccagcggc

SEQ ID NO: 3789168 - RNA, 13 nt, Salmonella typhimurium LT2
ccugaacgccgga

SEQ ID NO: 3789169 - RNA, 22 nt, Salmonella typhimurium LT2
ccugaagccagcaaucagccca

SEQ ID NO: 3789170 - RNA, 15 nt, Salmonella typhimurium LT2
ccugaagccauccuc

SEQ ID NO: 3789171 - RNA, 15 nt, Salmonella typhimurium LT2
ccugaaggacaagcu

SEQ ID NO: 3789172 - RNA, 16 nt, Salmonella typhimurium LT2
ccugaaggacaagcug

SEQ ID NO: 3789173 - RNA, 18 nt, Salmonella typhimurium LT2
ccugaaguaucgacgcag

SEQ ID NO: 3789174 - RNA, 22 nt, Salmonella typhimurium LT2
ccugaauaacccgcagcccugc

SEQ ID NO: 3789175 - RNA, 23 nt, Salmonella typhimurium LT2
ccugaauaauggguggcagggca

SEQ ID NO: 3789176 - RNA, 19 nt, Salmonella typhimurium LT2
ccugaauccagacuuuuuu

SEQ ID NO: 3789177 - RNA, 15 nt, Salmonella typhimurium LT2
ccugaauuucacgcu

SEQ ID NO: 3789178 - RNA, 14 nt, Salmonella typhimurium LT2
ccugacaggccgga

SEQ ID NO: 3789179 - RNA, 15 nt, Salmonella typhimurium LT2
ccugacauagcucac

SEQ ID NO: 3789180 - RNA, 23 nt, Salmonella typhimurium LT2
ccugacauuacccggccaggcgu

SEQ ID NO: 3789181 - RNA, 20 nt, Salmonella typhimurium LT2
ccugaccacgacgaccgcca

SEQ ID NO: 3789182 - RNA, 16 nt, Salmonella typhimurium LT2
ccugacgaccauugcc

SEQ ID NO: 3789183 - RNA, 14 nt, Salmonella typhimurium LT2
ccugacgcugagag

SEQ ID NO: 3789184 - RNA, 13 nt, Salmonella typhimurium LT2
ccugacggcagcc

SEQ ID NO: 3789185 - RNA, 13 nt, Salmonella typhimurium LT2
ccugacgggcauu

SEQ ID NO: 3789186 - RNA, 21 nt, Salmonella typhimurium LT2
ccugacuauugcugagcugac

SEQ ID NO: 3789187 - RNA, 14 nt, Salmonella typhimurium LT2
ccugacugaagacg

SEQ ID NO: 3789188 - RNA, 19 nt, Salmonella typhimurium LT2
ccugacuggcugagcucac

SEQ ID NO: 3789189 - RNA, 17 nt, Salmonella typhimurium LT2
ccugacuuuuccauacu

SEQ ID NO: 3789190 - RNA, 19 nt, Salmonella typhimurium LT2
ccugagaaaucaacgugac

SEQ ID NO: 3789191 - RNA, 19 nt, Salmonella typhimurium LT2
ccugagaagaguaaagauc

SEQ ID NO: 3789192 - RNA, 16 nt, Salmonella typhimurium LT2
ccugagccgaaccccu

SEQ ID NO: 3789193 - RNA, 12 nt, Salmonella typhimurium LT2
ccugagcuuucc

SEQ ID NO: 3789194 - RNA, 18 nt, Salmonella typhimurium LT2
ccugaggaagaagcgcac

SEQ ID NO: 3789195 - RNA, 23 nt, Salmonella typhimurium LT2
ccugauaacgaaucgcugcgcca

SEQ ID NO: 3789196 - RNA, 18 nt, Salmonella typhimurium LT2
ccugauaagcgaagcgcc

SEQ ID NO: 3789197 - RNA, 20 nt, Salmonella typhimurium LT2
ccugauaagcgaagcgccau

SEQ ID NO: 3789198 - RNA, 19 nt, Salmonella typhimurium LT2
ccugauaagcgcagcgcau

SEQ ID NO: 3789199 - RNA, 18 nt, Salmonella typhimurium LT2
ccugauaagcgcagcgcc

SEQ ID NO: 3789200 - RNA, 21 nt, Salmonella typhimurium LT2
ccugauauaaucgaaucgccu

SEQ ID NO: 3789201 - RNA, 18 nt, Salmonella typhimurium LT2
ccugauauacaaaaccca

SEQ ID NO: 3789202 - RNA, 14 nt, Salmonella typhimurium LT2
ccugauauccacgc

SEQ ID NO: 3789203 - RNA, 15 nt, Salmonella typhimurium LT2
ccugaucaaggcgca

SEQ ID NO: 3789204 - RNA, 15 nt, Salmonella typhimurium LT2
ccugaucaaucaacu

SEQ ID NO: 3789205 - RNA, 16 nt, Salmonella typhimurium LT2
ccugauccagcucuuc

SEQ ID NO: 3789206 - RNA, 13 nt, Salmonella typhimurium LT2
ccugaucccacag

SEQ ID NO: 3789207 - RNA, 14 nt, Salmonella typhimurium LT2
ccugaucccacagc

SEQ ID NO: 3789208 - RNA, 18 nt, Salmonella typhimurium LT2
ccugauccggcuguucca

SEQ ID NO: 3789209 - RNA, 19 nt, Salmonella typhimurium LT2
ccugauccugcaacagcac

SEQ ID NO: 3789210 - RNA, 20 nt, Salmonella typhimurium LT2
ccugaucgauucucuucuuc

SEQ ID NO: 3789211 - RNA, 21 nt, Salmonella typhimurium LT2
ccugaucgauucucuucuucu

SEQ ID NO: 3789212 - RNA, 15 nt, Salmonella typhimurium LT2
ccugaucgccgacga

SEQ ID NO: 3789213 - RNA, 21 nt, Salmonella typhimurium LT2
ccugaucgugccaugaccauu

SEQ ID NO: 3789214 - RNA, 17 nt, Salmonella typhimurium LT2
ccugaugacgcugcgcu

SEQ ID NO: 3789215 - RNA, 20 nt, Salmonella typhimurium LT2
ccugaugacggcugguaagg

SEQ ID NO: 3789216 - RNA, 16 nt, Salmonella typhimurium LT2
ccugaugcugcgaggc

SEQ ID NO: 3789217 - RNA, 12 nt, Salmonella typhimurium LT2
ccugauggcgcu

SEQ ID NO: 3789218 - RNA, 14 nt, Salmonella typhimurium LT2
ccugauggcgcuac

SEQ ID NO: 3789219 - RNA, 14 nt, Salmonella typhimurium LT2
ccugauggcgcugc

SEQ ID NO: 3789220 - RNA, 19 nt, Salmonella typhimurium LT2
ccugauggcgcugcgccau

SEQ ID NO: 3789221 - RNA, 17 nt, Salmonella typhimurium LT2
ccugaugguuauuuucg

SEQ ID NO: 3789222 - RNA, 21 nt, Salmonella typhimurium LT2
ccugauuaccuaccagcgcgc

SEQ ID NO: 3789223 - RNA, 15 nt, Salmonella typhimurium LT2
ccugauuuaucacgu

SEQ ID NO: 3789224 - RNA, 15 nt, Salmonella typhimurium LT2
ccugauuucugaccg

SEQ ID NO: 3789225 - RNA, 22 nt, Salmonella typhimurium LT2
ccugauuuuuuaauucauauau

SEQ ID NO: 3789226 - RNA, 16 nt, Salmonella typhimurium LT2
ccugcaaaaaaagaaa

SEQ ID NO: 3789227 - RNA, 14 nt, Salmonella typhimurium LT2
ccugcaaaccucuc

SEQ ID NO: 3789228 - RNA, 20 nt, Salmonella typhimurium LT2
ccugcaaaccucucccccgc

SEQ ID NO: 3789229 - RNA, 17 nt, Salmonella typhimurium LT2
ccugcaacagcaccagc

SEQ ID NO: 3789230 - RNA, 20 nt, Salmonella typhimurium LT2
ccugcaacgcgaaauucuug

SEQ ID NO: 3789231 - RNA, 22 nt, Salmonella typhimurium LT2
ccugcaacuccugggcaaaaua

SEQ ID NO: 3789232 - RNA, 19 nt, Salmonella typhimurium LT2
ccugcaauguuuucagcaa

SEQ ID NO: 3789233 - RNA, 23 nt, Salmonella typhimurium LT2
ccugcacguuacccgccagucgg

SEQ ID NO: 3789234 - RNA, 22 nt, Salmonella typhimurium LT2
ccugcacuuccagccacggcgu

SEQ ID NO: 3789235 - RNA, 17 nt, Salmonella typhimurium LT2
ccugcagaauaagcucc

SEQ ID NO: 3789236 - RNA, 18 nt, Salmonella typhimurium LT2
ccugcagacccacuuuca

SEQ ID NO: 3789237 - RNA, 17 nt, Salmonella typhimurium LT2
ccugcaggcaacguuac

SEQ ID NO: 3789238 - RNA, 17 nt, Salmonella typhimurium LT2
ccugcaggcgagugcua

SEQ ID NO: 3789239 - RNA, 23 nt, Salmonella typhimurium LT2
ccugcaggcggugcgcagccacg

SEQ ID NO: 3789240 - RNA, 17 nt, Salmonella typhimurium LT2
ccugcagggaauaagca

SEQ ID NO: 3789241 - RNA, 20 nt, Salmonella typhimurium LT2
ccugcagggaauaagcaccc

SEQ ID NO: 3789242 - RNA, 22 nt, Salmonella typhimurium LT2
ccugcaggguuugcgcagacug

SEQ ID NO: 3789243 - RNA, 21 nt, Salmonella typhimurium LT2
ccugcaguucguacuccugca

SEQ ID NO: 3789244 - RNA, 23 nt, Salmonella typhimurium LT2
ccugcauacucacauucauaaaa

SEQ ID NO: 3789245 - RNA, 14 nt, Salmonella typhimurium LT2
ccugcaucaacagg

SEQ ID NO: 3789246 - RNA, 18 nt, Salmonella typhimurium LT2
ccugcaugaucaugcugc

SEQ ID NO: 3789247 - RNA, 20 nt, Salmonella typhimurium LT2
ccugcauuaacggcaacagu

SEQ ID NO: 3789248 - RNA, 20 nt, Salmonella typhimurium LT2
ccugcauuaugggcaaugau

SEQ ID NO: 3789249 - RNA, 15 nt, Salmonella typhimurium LT2
ccugcauugccugau

SEQ ID NO: 3789250 - RNA, 20 nt, Salmonella typhimurium LT2
ccugccacgcuuuuccuucc

SEQ ID NO: 3789251 - RNA, 19 nt, Salmonella typhimurium LT2
ccugccagagacucucuuu

SEQ ID NO: 3789252 - RNA, 11 nt, Salmonella typhimurium LT2
ccugccagauu

SEQ ID NO: 3789253 - RNA, 18 nt, Salmonella typhimurium LT2
ccugccaguccgcccgcc

SEQ ID NO: 3789254 - RNA, 14 nt, Salmonella typhimurium LT2
ccugcccgccugau

SEQ ID NO: 3789255 - RNA, 12 nt, Salmonella typhimurium LT2
ccugcccuuuca

SEQ ID NO: 3789256 - RNA, 15 nt, Salmonella typhimurium LT2
ccugccgcauguccc

SEQ ID NO: 3789257 - RNA, 21 nt, Salmonella typhimurium LT2
ccuguacccgguacuuucucc

SEQ ID NO: 3789258 - RNA, 17 nt, Salmonella typhimurium LT2
ccuguacuugcgccgcc

SEQ ID NO: 3789259 - RNA, 21 nt, Salmonella typhimurium LT2
ccugucaggaugaaacgacac

SEQ ID NO: 3789260 - RNA, 19 nt, Salmonella typhimurium LT2
ccugucaguaccucgcaua

SEQ ID NO: 3789261 - RNA, 15 nt, Salmonella typhimurium LT2
ccuguccauugcgag

SEQ ID NO: 3789262 - RNA, 17 nt, Salmonella typhimurium LT2
ccuguccgcucgacuuc

SEQ ID NO: 3789263 - RNA, 14 nt, Salmonella typhimurium LT2
ccugucgcccaggc

SEQ ID NO: 3789264 - RNA, 17 nt, Salmonella typhimurium LT2
ccugucgcccaggcgau

SEQ ID NO: 3789265 - RNA, 13 nt, Salmonella typhimurium LT2
ccugucgcgccau

SEQ ID NO: 3789266 - RNA, 18 nt, Salmonella typhimurium LT2
ccugucgcugcucccggc

SEQ ID NO: 3789267 - RNA, 15 nt, Salmonella typhimurium LT2
ccugucgucaccagc

SEQ ID NO: 3789268 - RNA, 19 nt, Salmonella typhimurium LT2
ccugucgucaccagcaggu

SEQ ID NO: 3789269 - RNA, 21 nt, Salmonella typhimurium LT2
ccugucuauuguuuagacaga

SEQ ID NO: 3789270 - RNA, 19 nt, Salmonella typhimurium LT2
ccugucugucgcgggcgaa

SEQ ID NO: 3789271 - RNA, 16 nt, Salmonella typhimurium LT2
ccugucuuuucucucu

SEQ ID NO: 3789272 - RNA, 17 nt, Salmonella typhimurium LT2
ccugucuuuucucucuu

SEQ ID NO: 3789273 - RNA, 23 nt, Salmonella typhimurium LT2
ccugugauuuauguaccgucauc

SEQ ID NO: 3789274 - RNA, 21 nt, Salmonella typhimurium LT2
ccuguggaaacuccagcggca

SEQ ID NO: 3789275 - RNA, 20 nt, Salmonella typhimurium LT2
ccuguggaaucagucgggua

SEQ ID NO: 3789276 - RNA, 18 nt, Salmonella typhimurium LT2
ccuguggguucaucgcca

SEQ ID NO: 3789277 - RNA, 14 nt, Salmonella typhimurium LT2
ccuguuaaucaucg

SEQ ID NO: 3789278 - RNA, 12 nt, Salmonella typhimurium LT2
ccuguucaagug

SEQ ID NO: 3789279 - RNA, 16 nt, Salmonella typhimurium LT2
ccuguucagcacccag

SEQ ID NO: 3789280 - RNA, 15 nt, Salmonella typhimurium LT2
ccuguucaugccaga

SEQ ID NO: 3789281 - RNA, 20 nt, Salmonella typhimurium LT2
ccuguuccagggcuuccaga

SEQ ID NO: 3789282 - RNA, 15 nt, Salmonella typhimurium LT2
ccuguucgccacccg

SEQ ID NO: 3789283 - RNA, 14 nt, Salmonella typhimurium LT2
ccuguucgcuuauu

SEQ ID NO: 3789284 - RNA, 16 nt, Salmonella typhimurium LT2
ccuguugaacaauggu

SEQ ID NO: 3789285 - RNA, 20 nt, Salmonella typhimurium LT2
ccuguugaacaaugguauaa

SEQ ID NO: 3789286 - RNA, 15 nt, Salmonella typhimurium LT2
ccuguuuacggcagg

SEQ ID NO: 3789287 - RNA, 13 nt, Salmonella typhimurium LT2
ccuguuuauauuc

SEQ ID NO: 3789288 - RNA, 13 nt, Salmonella typhimurium LT2
ccuguuuaucuga

SEQ ID NO: 3789289 - RNA, 15 nt, Salmonella typhimurium LT2
ccuguuucgcccgcu

SEQ ID NO: 3789290 - RNA, 20 nt, Salmonella typhimurium LT2
ccuguuuuuucagcgcgccg

SEQ ID NO: 3789291 - RNA, 16 nt, Salmonella typhimurium LT2
ccuuaaucgacuucau

SEQ ID NO: 3789292 - RNA, 24 nt, Salmonella typhimurium LT2
ccuuaauuugugauugcagauaau

SEQ ID NO: 3789293 - RNA, 12 nt, Salmonella typhimurium LT2
ccuuacaaaaau

SEQ ID NO: 3789294 - RNA, 14 nt, Salmonella typhimurium LT2
ccuuacccggccug

SEQ ID NO: 3789295 - RNA, 17 nt, Salmonella typhimurium LT2
ccuuacccggccugcgu

SEQ ID NO: 3789296 - RNA, 13 nt, Salmonella typhimurium LT2
ccuuacggcuccu

SEQ ID NO: 3789297 - RNA, 23 nt, Salmonella typhimurium LT2
ccuuacgguuacagcauccuuua

SEQ ID NO: 3789298 - RNA, 20 nt, Salmonella typhimurium LT2
ccuuacuaucccauuuuuug

SEQ ID NO: 3789299 - RNA, 15 nt, Salmonella typhimurium LT2
ccuuaguaaaaccga

SEQ ID NO: 3789300 - RNA, 21 nt, Salmonella typhimurium LT2
ccuuauauauguucaauauuc

SEQ ID NO: 3789301 - RNA, 20 nt, Salmonella typhimurium LT2
ccuuauccggccuacgagca

SEQ ID NO: 3789302 - RNA, 17 nt, Salmonella typhimurium LT2
ccuuauccggccugccc

SEQ ID NO: 3789303 - RNA, 21 nt, Salmonella typhimurium LT2
ccuuaugcucauugccuuuca

SEQ ID NO: 3789304 - RNA, 22 nt, Salmonella typhimurium LT2
ccuuaugggucacauccagaca

SEQ ID NO: 3789305 - RNA, 18 nt, Salmonella typhimurium LT2
ccuuauucgguuuauccc

SEQ ID NO: 3789306 - RNA, 14 nt, Salmonella typhimurium LT2
ccuucacagguggu

SEQ ID NO: 3789307 - RNA, 23 nt, Salmonella typhimurium LT2
ccuucacauuggcaaaccccugc

SEQ ID NO: 3789308 - RNA, 15 nt, Salmonella typhimurium LT2
ccuucacccagacug

SEQ ID NO: 3789309 - RNA, 16 nt, Salmonella typhimurium LT2
ccuucacccccaucgc

SEQ ID NO: 3789310 - RNA, 14 nt, Salmonella typhimurium LT2
ccuucaccccuuca

SEQ ID NO: 3789311 - RNA, 15 nt, Salmonella typhimurium LT2
ccuucacgccgccaa

SEQ ID NO: 3789312 - RNA, 16 nt, Salmonella typhimurium LT2
ccuucacggucaaacg

SEQ ID NO: 3789313 - RNA, 22 nt, Salmonella typhimurium LT2
ccuucacguuauucggaaugau

SEQ ID NO: 3789314 - RNA, 22 nt, Salmonella typhimurium LT2
ccuucagauucaaacugauaag

SEQ ID NO: 3789315 - RNA, 14 nt, Salmonella typhimurium LT2
ccuucagcgcgccc

SEQ ID NO: 3789316 - RNA, 13 nt, Salmonella typhimurium LT2
ccuucaggcauca

SEQ ID NO: 3789317 - RNA, 19 nt, Salmonella typhimurium LT2
ccuucagguuuuuaagcug

SEQ ID NO: 3789318 - RNA, 14 nt, Salmonella typhimurium LT2
ccuucauauuucaa

SEQ ID NO: 3789319 - RNA, 23 nt, Salmonella typhimurium LT2
ccuucaucaucauaguggcgcac

SEQ ID NO: 3789320 - RNA, 13 nt, Salmonella typhimurium LT2
ccuucaucguuua

SEQ ID NO: 3789321 - RNA, 23 nt, Salmonella typhimurium LT2
ccuucaugcaacacaaucuugau

SEQ ID NO: 3789322 - RNA, 22 nt, Salmonella typhimurium LT2
ccuucauggcguucgccgcaug

SEQ ID NO: 3789323 - RNA, 23 nt, Salmonella typhimurium LT2
ccuucauucagaucaaaaaucug

SEQ ID NO: 3789324 - RNA, 21 nt, Salmonella typhimurium LT2
ccuucauuguccucggcaaca

SEQ ID NO: 3789325 - RNA, 22 nt, Salmonella typhimurium LT2
ccuuccacugguaggcauccag

SEQ ID NO: 3789326 - RNA, 15 nt, Salmonella typhimurium LT2
ccuuccagaaauaaa

SEQ ID NO: 3789327 - RNA, 11 nt, Salmonella typhimurium LT2
ccuuccagcaa

SEQ ID NO: 3789328 - RNA, 11 nt, Salmonella typhimurium LT2
ccuuccagcgc

SEQ ID NO: 3789329 - RNA, 14 nt, Salmonella typhimurium LT2
ccuuccagcgccau

SEQ ID NO: 3789330 - RNA, 15 nt, Salmonella typhimurium LT2
ccuucccccaccacc

SEQ ID NO: 3789331 - RNA, 15 nt, Salmonella typhimurium LT2
ccuuccccggcagcc

SEQ ID NO: 3789332 - RNA, 16 nt, Salmonella typhimurium LT2
ccuuccccggcagccc

SEQ ID NO: 3789333 - RNA, 18 nt, Salmonella typhimurium LT2
ccuuccccggcagcccca

SEQ ID NO: 3789334 - RNA, 13 nt, Salmonella typhimurium LT2
ccuuccccuuuca

SEQ ID NO: 3789335 - RNA, 19 nt, Salmonella typhimurium LT2
ccuucccgcgauaaaaaca

SEQ ID NO: 3789336 - RNA, 14 nt, Salmonella typhimurium LT2
ccuuccgccaccag

SEQ ID NO: 3789337 - RNA, 13 nt, Salmonella typhimurium LT2
ccuuccgccgcaa

SEQ ID NO: 3789338 - RNA, 17 nt, Salmonella typhimurium LT2
ccuuccggccacuccgc

SEQ ID NO: 3789339 - RNA, 13 nt, Salmonella typhimurium LT2
ccuuccggcgucc

SEQ ID NO: 3789340 - RNA, 18 nt, Salmonella typhimurium LT2
ccuuccuccaccaccauc

SEQ ID NO: 3789341 - RNA, 20 nt, Salmonella typhimurium LT2
ccuuccucgucggcaagaau

SEQ ID NO: 3789342 - RNA, 17 nt, Salmonella typhimurium LT2
ccuuccugccagcacag

SEQ ID NO: 3789343 - RNA, 17 nt, Salmonella typhimurium LT2
ccuucgaagaauuccac

SEQ ID NO: 3789344 - RNA, 24 nt, Salmonella typhimurium LT2
ccuucgauaguccauuuuccuaug

SEQ ID NO: 3789345 - RNA, 14 nt, Salmonella typhimurium LT2
ccuucgaucaugcc

SEQ ID NO: 3789346 - RNA, 20 nt, Salmonella typhimurium LT2
ccuucgaugagcgcgaaauc

SEQ ID NO: 3789347 - RNA, 17 nt, Salmonella typhimurium LT2
ccuucgaugaucaugcg

SEQ ID NO: 3789348 - RNA, 17 nt, Salmonella typhimurium LT2
ccuucgcauagccggau

SEQ ID NO: 3789349 - RNA, 13 nt, Salmonella typhimurium LT2
ccuucgccgccca

SEQ ID NO: 3789350 - RNA, 12 nt, Salmonella typhimurium LT2
ccuucgccgccg

SEQ ID NO: 3789351 - RNA, 19 nt, Salmonella typhimurium LT2
ccuucgccgccgcugaauu

SEQ ID NO: 3789352 - RNA, 14 nt, Salmonella typhimurium LT2
ccuucgccuucacg

SEQ ID NO: 3789353 - RNA, 20 nt, Salmonella typhimurium LT2
ccuucgcggugaucccaggc

SEQ ID NO: 3789354 - RNA, 12 nt, Salmonella typhimurium LT2
ccuucgggcgau

SEQ ID NO: 3789355 - RNA, 20 nt, Salmonella typhimurium LT2
ccuucgucacgcgcaaagcu

SEQ ID NO: 3789356 - RNA, 19 nt, Salmonella typhimurium LT2
ccuucguuuuauuugaugc

SEQ ID NO: 3789357 - RNA, 17 nt, Salmonella typhimurium LT2
ccuucucuuuaugcguc

SEQ ID NO: 3789358 - RNA, 16 nt, Salmonella typhimurium LT2
ccuucugcaccccguc

SEQ ID NO: 3789359 - RNA, 21 nt, Salmonella typhimurium LT2
ccuucugcgcccgccugcugu

SEQ ID NO: 3789360 - RNA, 17 nt, Salmonella typhimurium LT2
ccuucuucauauuugcu

SEQ ID NO: 3789361 - RNA, 12 nt, Salmonella typhimurium LT2
cgaaccaucgac

SEQ ID NO: 3789362 - RNA, 22 nt, Salmonella typhimurium LT2
cgaaccaucgacccccaccaug

SEQ ID NO: 3789363 - RNA, 20 nt, Salmonella typhimurium LT2
cgaaccauuugccugccgca

SEQ ID NO: 3789364 - RNA, 21 nt, Salmonella typhimurium LT2
cgaaccggaccagcacaaaaa

SEQ ID NO: 3789365 - RNA, 19 nt, Salmonella typhimurium LT2
cgaaccggcaucggcagcg

SEQ ID NO: 3789366 - RNA, 17 nt, Salmonella typhimurium LT2
cgaaccguaaacgccug

SEQ ID NO: 3789367 - RNA, 22 nt, Salmonella typhimurium LT2
cgaaccugcgccgguuccggca

SEQ ID NO: 3789368 - RNA, 15 nt, Salmonella typhimurium LT2
cgaacgacucacgcg

SEQ ID NO: 3789369 - RNA, 19 nt, Salmonella typhimurium LT2
cgaacgccaacucaacgcc

SEQ ID NO: 3789370 - RNA, 15 nt, Salmonella typhimurium LT2
cgaacgccaggccaa

SEQ ID NO: 3789371 - RNA, 21 nt, Salmonella typhimurium LT2
cgaacgccgccugcgccagcg

SEQ ID NO: 3789372 - RNA, 15 nt, Salmonella typhimurium LT2
cgaacgcguccauga

SEQ ID NO: 3789373 - RNA, 15 nt, Salmonella typhimurium LT2
cgaacgcuaugcgcc

SEQ ID NO: 3789374 - RNA, 15 nt, Salmonella typhimurium LT2
cgaacgcuccacugc

SEQ ID NO: 3789375 - RNA, 16 nt, Salmonella typhimurium LT2
cgaacgcuggcugggu

SEQ ID NO: 3789376 - RNA, 12 nt, Salmonella typhimurium LT2
cgaacggccuga

SEQ ID NO: 3789377 - RNA, 20 nt, Salmonella typhimurium LT2
cgaacggccugaucgaucgc

SEQ ID NO: 3789378 - RNA, 16 nt, Salmonella typhimurium LT2
cgaacggcuuuccagc

SEQ ID NO: 3789379 - RNA, 18 nt, Salmonella typhimurium LT2
cgaacggcuuuccagcag

SEQ ID NO: 3789380 - RNA, 16 nt, Salmonella typhimurium LT2
cgaacgggaucaugau

SEQ ID NO: 3789381 - RNA, 15 nt, Salmonella typhimurium LT2
cgaacugauggcgcu

SEQ ID NO: 3789382 - RNA, 18 nt, Salmonella typhimurium LT2
cgaacugauggcgcuaag

SEQ ID NO: 3789383 - RNA, 14 nt, Salmonella typhimurium LT2
cgaagaauucgcaa

SEQ ID NO: 3789384 - RNA, 18 nt, Salmonella typhimurium LT2
cgaagacuccccugcaga

SEQ ID NO: 3789385 - RNA, 22 nt, Salmonella typhimurium LT2
cgaagaucaggaguaaauaaca

SEQ ID NO: 3789386 - RNA, 15 nt, Salmonella typhimurium LT2
cgaagaucagugaga

SEQ ID NO: 3789387 - RNA, 22 nt, Salmonella typhimurium LT2
cgaagaucguuauccagcagcc

SEQ ID NO: 3789388 - RNA, 23 nt, Salmonella typhimurium LT2
cgaagcucagccaggcgcggcgc

SEQ ID NO: 3789389 - RNA, 14 nt, Salmonella typhimurium LT2
cgaaggaaacgcca

SEQ ID NO: 3789390 - RNA, 17 nt, Salmonella typhimurium LT2
cgaaggcaacgccgcca

SEQ ID NO: 3789391 - RNA, 16 nt, Salmonella typhimurium LT2
cgaaggccagcaccag

SEQ ID NO: 3789392 - RNA, 22 nt, Salmonella typhimurium LT2
cgaaggcgacgcgauagcgcag

SEQ ID NO: 3789393 - RNA, 21 nt, Salmonella typhimurium LT2
cgaagguggcggaauugguag

SEQ ID NO: 3789394 - RNA, 13 nt, Salmonella typhimurium LT2
cgaaguggugggu

SEQ ID NO: 3789395 - RNA, 17 nt, Salmonella typhimurium LT2
cgaaguuuucuucuucg

SEQ ID NO: 3789396 - RNA, 15 nt, Salmonella typhimurium LT2
cgaauaaaauucagc

SEQ ID NO: 3789397 - RNA, 15 nt, Salmonella typhimurium LT2
cgaauaacaaaauga

SEQ ID NO: 3789398 - RNA, 22 nt, Salmonella typhimurium LT2
cgaauaacaaaaugagauugau

SEQ ID NO: 3789399 - RNA, 19 nt, Salmonella typhimurium LT2
cgaauaagcgguucaggcc

SEQ ID NO: 3789400 - RNA, 18 nt, Salmonella typhimurium LT2
cgaauagugauaccagcc

SEQ ID NO: 3789401 - RNA, 15 nt, Salmonella typhimurium LT2
cgaauaucuuuaucc

SEQ ID NO: 3789402 - RNA, 16 nt, Salmonella typhimurium LT2
cgaaucacauccgcca

SEQ ID NO: 3789403 - RNA, 18 nt, Salmonella typhimurium LT2
cgaaucacauccgccagc

SEQ ID NO: 3789404 - RNA, 15 nt, Salmonella typhimurium LT2
cgaaucaggcgugau

SEQ ID NO: 3789405 - RNA, 18 nt, Salmonella typhimurium LT2
cgaauccacuguccagau

SEQ ID NO: 3789406 - RNA, 18 nt, Salmonella typhimurium LT2
cgaauccccaucuccaga

SEQ ID NO: 3789407 - RNA, 12 nt, Salmonella typhimurium LT2
cgaauccggggg

SEQ ID NO: 3789408 - RNA, 20 nt, Salmonella typhimurium LT2
cgaauccgugcgcagaauau

SEQ ID NO: 3789409 - RNA, 21 nt, Salmonella typhimurium LT2
cgaauccuucccccaccacca

SEQ ID NO: 3789410 - RNA, 23 nt, Salmonella typhimurium LT2
cgaauccuucccccaccaccauu

SEQ ID NO: 3789411 - RNA, 16 nt, Salmonella typhimurium LT2
cgaaucgaauacagcg

SEQ ID NO: 3789412 - RNA, 19 nt, Salmonella typhimurium LT2
cgaaucgaauacagcgccu

SEQ ID NO: 3789413 - RNA, 16 nt, Salmonella typhimurium LT2
cgaaugcgccagcgag

SEQ ID NO: 3789414 - RNA, 16 nt, Salmonella typhimurium LT2
cgaaugcugcaucuua

SEQ ID NO: 3789415 - RNA, 13 nt, Salmonella typhimurium LT2
cgaaugcuuccgg

SEQ ID NO: 3789416 - RNA, 22 nt, Salmonella typhimurium LT2
cgaauguuuuuucgcacgccuc

SEQ ID NO: 3789417 - RNA, 20 nt, Salmonella typhimurium LT2
cgaauuccuuuuuccgccac

SEQ ID NO: 3789418 - RNA, 22 nt, Salmonella typhimurium LT2
cgaauucguccacacgccuggc

SEQ ID NO: 3789419 - RNA, 18 nt, Salmonella typhimurium LT2
cgaauuuacugugaucca

SEQ ID NO: 3789420 - RNA, 22 nt, Salmonella typhimurium LT2
cgaauuuagcacccaggauggc

SEQ ID NO: 3789421 - RNA, 15 nt, Salmonella typhimurium LT2
cgacaaacagcgccc

SEQ ID NO: 3789422 - RNA, 18 nt, Salmonella typhimurium LT2
cgacaaaccacugcugua

SEQ ID NO: 3789423 - RNA, 20 nt, Salmonella typhimurium LT2
cgacaaagccaacgccgccc

SEQ ID NO: 3789424 - RNA, 13 nt, Salmonella typhimurium LT2
cgacaaaugaagc

SEQ ID NO: 3789425 - RNA, 15 nt, Salmonella typhimurium LT2
cgacaacaaguccaa

SEQ ID NO: 3789426 - RNA, 23 nt, Salmonella typhimurium LT2
cgacaagccccccgcacagcaca

SEQ ID NO: 3789427 - RNA, 19 nt, Salmonella typhimurium LT2
cgacaagcuaauccccagc

SEQ ID NO: 3789428 - RNA, 22 nt, Salmonella typhimurium LT2
cgacaauauuaccuucgcguaa

SEQ ID NO: 3789429 - RNA, 15 nt, Salmonella typhimurium LT2
cgacaauguccgcca

SEQ ID NO: 3789430 - RNA, 17 nt, Salmonella typhimurium LT2
cgacaauguccgccaga

SEQ ID NO: 3789431 - RNA, 13 nt, Salmonella typhimurium LT2
cgacacaucaucg

SEQ ID NO: 3789432 - RNA, 21 nt, Salmonella typhimurium LT2
cgacacauucaggcuuuccac

SEQ ID NO: 3789433 - RNA, 19 nt, Salmonella typhimurium LT2
cgacaccacgcaggcgacc

SEQ ID NO: 3789434 - RNA, 23 nt, Salmonella typhimurium LT2
cgacaccagcgauaaacgccagc

SEQ ID NO: 3789435 - RNA, 21 nt, Salmonella typhimurium LT2
cgacacgcgcgcugcgccugg

SEQ ID NO: 3789436 - RNA, 22 nt, Salmonella typhimurium LT2
cgacacgcgcgcugcgccugga

SEQ ID NO: 3789437 - RNA, 17 nt, Salmonella typhimurium LT2
cgacagagccaacagaa

SEQ ID NO: 3789438 - RNA, 19 nt, Salmonella typhimurium LT2
cgacagauuggucagcagc

SEQ ID NO: 3789439 - RNA, 16 nt, Salmonella typhimurium LT2
cgacagccaggagucu

SEQ ID NO: 3789440 - RNA, 17 nt, Salmonella typhimurium LT2
cgacagccaggagucua

SEQ ID NO: 3789441 - RNA, 16 nt, Salmonella typhimurium LT2
cgacagcccgccagca

SEQ ID NO: 3789442 - RNA, 23 nt, Salmonella typhimurium LT2
cgacagccgcuaucacagcggca

SEQ ID NO: 3789443 - RNA, 16 nt, Salmonella typhimurium LT2
cgacagcgccaucagc

SEQ ID NO: 3789444 - RNA, 20 nt, Salmonella typhimurium LT2
cgacagcgccaucagcauca

SEQ ID NO: 3789445 - RNA, 15 nt, Salmonella typhimurium LT2
cgacagcgccauccg

SEQ ID NO: 3789446 - RNA, 21 nt, Salmonella typhimurium LT2
cgacagcgccauccggcaguu

SEQ ID NO: 3789447 - RNA, 12 nt, Salmonella typhimurium LT2
cgacagcgcgcc

SEQ ID NO: 3789448 - RNA, 20 nt, Salmonella typhimurium LT2
cgacagcgcuauccggccca

SEQ ID NO: 3789449 - RNA, 15 nt, Salmonella typhimurium LT2
cgacaggcggcagcu

SEQ ID NO: 3789450 - RNA, 21 nt, Salmonella typhimurium LT2
cgacaggcguaaaaccgcgcu

SEQ ID NO: 3789451 - RNA, 22 nt, Salmonella typhimurium LT2
cgacagggcgugaaccagcauc

SEQ ID NO: 3789452 - RNA, 19 nt, Salmonella typhimurium LT2
cgacagggguguuacgcca

SEQ ID NO: 3789453 - RNA, 21 nt, Salmonella typhimurium LT2
cgacaggguuugccagcacca

SEQ ID NO: 3789454 - RNA, 22 nt, Salmonella typhimurium LT2
cgacaggguuugccagcaccag

SEQ ID NO: 3789455 - RNA, 16 nt, Salmonella typhimurium LT2
cgacaguaacugcaaa

SEQ ID NO: 3789456 - RNA, 17 nt, Salmonella typhimurium LT2
cgacaguaccagcagaa

SEQ ID NO: 3789457 - RNA, 14 nt, Salmonella typhimurium LT2
cgacauaaccggca

SEQ ID NO: 3789458 - RNA, 16 nt, Salmonella typhimurium LT2
cgacauaaccggcaac

SEQ ID NO: 3789459 - RNA, 21 nt, Salmonella typhimurium LT2
cgacauaagcugcgacaacaa

SEQ ID NO: 3789460 - RNA, 12 nt, Salmonella typhimurium LT2
cgacauacgcgc

SEQ ID NO: 3789461 - RNA, 14 nt, Salmonella typhimurium LT2
cgacauagcugaac

SEQ ID NO: 3789462 - RNA, 23 nt, Salmonella typhimurium LT2
cgacauauuuucgaugcacgcca

SEQ ID NO: 3789463 - RNA, 13 nt, Salmonella typhimurium LT2
cgacaucacgcaa

SEQ ID NO: 3789464 - RNA, 15 nt, Salmonella typhimurium LT2
cgacuucgcuuccug

SEQ ID NO: 3789465 - RNA, 16 nt, Salmonella typhimurium LT2
cgacuuuccgccacca

SEQ ID NO: 3789466 - RNA, 22 nt, Salmonella typhimurium LT2
cgacuuuucacuuauaaauaaa

SEQ ID NO: 3789467 - RNA, 23 nt, Salmonella typhimurium LT2
cgagaaaaucccauugcccgcug

SEQ ID NO: 3789468 - RNA, 21 nt, Salmonella typhimurium LT2
cgagaaccaacugccaaacca

SEQ ID NO: 3789469 - RNA, 16 nt, Salmonella typhimurium LT2
cgagaacugcugcauc

SEQ ID NO: 3789470 - RNA, 22 nt, Salmonella typhimurium LT2
cgagaagcccagcucauaggau

SEQ ID NO: 3789471 - RNA, 13 nt, Salmonella typhimurium LT2
cgagaaucgccag

SEQ ID NO: 3789472 - RNA, 14 nt, Salmonella typhimurium LT2
cgagaaugucgcca

SEQ ID NO: 3789473 - RNA, 17 nt, Salmonella typhimurium LT2
cgagaaugucgccaugu

SEQ ID NO: 3789474 - RNA, 14 nt, Salmonella typhimurium LT2
cgagacccagcgcg

SEQ ID NO: 3789475 - RNA, 13 nt, Salmonella typhimurium LT2
cgagagaaaaaaa

SEQ ID NO: 3789476 - RNA, 22 nt, Salmonella typhimurium LT2
cgagagaaauagaaaaauccgg

SEQ ID NO: 3789477 - RNA, 20 nt, Salmonella typhimurium LT2
cgagagaauuaacagcgcga

SEQ ID NO: 3789478 - RNA, 15 nt, Salmonella typhimurium LT2
cgagaguuugugaug

SEQ ID NO: 3789479 - RNA, 18 nt, Salmonella typhimurium LT2
cgagauuuuucugcgcca

SEQ ID NO: 3789480 - RNA, 11 nt, Salmonella typhimurium LT2
cgagcagccag

SEQ ID NO: 3789481 - RNA, 14 nt, Salmonella typhimurium LT2
cgagcagccuggcg

SEQ ID NO: 3789482 - RNA, 14 nt, Salmonella typhimurium LT2
cgagcaguucagca

SEQ ID NO: 3789483 - RNA, 17 nt, Salmonella typhimurium LT2
cgagcaguucagcagca

SEQ ID NO: 3789484 - RNA, 22 nt, Salmonella typhimurium LT2
cgagcaguucagcagcaccacu

SEQ ID NO: 3789485 - RNA, 17 nt, Salmonella typhimurium LT2
cgagcaucuccagcgca

SEQ ID NO: 3789486 - RNA, 19 nt, Salmonella typhimurium LT2
cgagccaacguauaaaaug

SEQ ID NO: 3789487 - RNA, 20 nt, Salmonella typhimurium LT2
cgagccauuaaugcaggcag

SEQ ID NO: 3789488 - RNA, 15 nt, Salmonella typhimurium LT2
cgagcccuaucacca

SEQ ID NO: 3789489 - RNA, 14 nt, Salmonella typhimurium LT2
cgagccuucuggcc

SEQ ID NO: 3789490 - RNA, 14 nt, Salmonella typhimurium LT2
cgagccuugccgca

SEQ ID NO: 3789491 - RNA, 20 nt, Salmonella typhimurium LT2
cgagcgacgcccugcccaug

SEQ ID NO: 3789492 - RNA, 15 nt, Salmonella typhimurium LT2
cgagcgccguaccgc

SEQ ID NO: 3789493 - RNA, 17 nt, Salmonella typhimurium LT2
cgagcgcgucagcgccu

SEQ ID NO: 3789494 - RNA, 18 nt, Salmonella typhimurium LT2
cgagcgcgucagcgccuc

SEQ ID NO: 3789495 - RNA, 22 nt, Salmonella typhimurium LT2
cgagcggccaaagggagcagac

SEQ ID NO: 3789496 - RNA, 14 nt, Salmonella typhimurium LT2
cgagcgggucagga

SEQ ID NO: 3789497 - RNA, 17 nt, Salmonella typhimurium LT2
cgagcugcgcguuuagc

SEQ ID NO: 3789498 - RNA, 15 nt, Salmonella typhimurium LT2
cgagcugguuucaau

SEQ ID NO: 3789499 - RNA, 17 nt, Salmonella typhimurium LT2
cgagcuucucgccggaa

SEQ ID NO: 3789500 - RNA, 20 nt, Salmonella typhimurium LT2
cgagcuuugacgacccgcuu

SEQ ID NO: 3789501 - RNA, 18 nt, Salmonella typhimurium LT2
cgaggaacaucagccagc

SEQ ID NO: 3789502 - RNA, 20 nt, Salmonella typhimurium LT2
cgaggaacuguucagccagc

SEQ ID NO: 3789503 - RNA, 23 nt, Salmonella typhimurium LT2
cgaggauacggucgacaccagcg

SEQ ID NO: 3789504 - RNA, 18 nt, Salmonella typhimurium LT2
cgaggauagugauauagc

SEQ ID NO: 3789505 - RNA, 15 nt, Salmonella typhimurium LT2
cgaggcgcccaacgc

SEQ ID NO: 3789506 - RNA, 20 nt, Salmonella typhimurium LT2
cgagggaaggggauuuuccg

SEQ ID NO: 3789507 - RNA, 17 nt, Salmonella typhimurium LT2
cgagggaggcaaucgca

SEQ ID NO: 3789508 - RNA, 15 nt, Salmonella typhimurium LT2
cgaggguggcaccgc

SEQ ID NO: 3789509 - RNA, 17 nt, Salmonella typhimurium LT2
cgaggugaauaaauccu

SEQ ID NO: 3789510 - RNA, 18 nt, Salmonella typhimurium LT2
cgaggugaauaaauccuu

SEQ ID NO: 3789511 - RNA, 22 nt, Salmonella typhimurium LT2
cgagguucaccagcgcgccgcc

SEQ ID NO: 3789512 - RNA, 17 nt, Salmonella typhimurium LT2
cgagguucccgccgcca

SEQ ID NO: 3789513 - RNA, 13 nt, Salmonella typhimurium LT2
cgagucgccgcuu

SEQ ID NO: 3789514 - RNA, 16 nt, Salmonella typhimurium LT2
cgagucgucaguucca

SEQ ID NO: 3789515 - RNA, 18 nt, Salmonella typhimurium LT2
cgagugaaccggacgcuu

SEQ ID NO: 3789516 - RNA, 22 nt, Salmonella typhimurium LT2
cgagugaggaccguacucagau

SEQ ID NO: 3789517 - RNA, 20 nt, Salmonella typhimurium LT2
cgaguggcgcggaaagccuu

SEQ ID NO: 3789518 - RNA, 21 nt, Salmonella typhimurium LT2
cgaguggcgcggaaagccuuc

SEQ ID NO: 3789519 - RNA, 17 nt, Salmonella typhimurium LT2
cgaguuaagcgcccgcg

SEQ ID NO: 3789520 - RNA, 14 nt, Salmonella typhimurium LT2
cgauaaaaacagcg

SEQ ID NO: 3789521 - RNA, 16 nt, Salmonella typhimurium LT2
cgauaaaccaggcagc

SEQ ID NO: 3789522 - RNA, 14 nt, Salmonella typhimurium LT2
cgauaaacgccagc

SEQ ID NO: 3789523 - RNA, 19 nt, Salmonella typhimurium LT2
cgauaaacucaaucaggcu

SEQ ID NO: 3789524 - RNA, 14 nt, Salmonella typhimurium LT2
cgauaaacucagcg

SEQ ID NO: 3789525 - RNA, 17 nt, Salmonella typhimurium LT2
cgauaaacucagcgcca

SEQ ID NO: 3789526 - RNA, 15 nt, Salmonella typhimurium LT2
cgauaaagaacucga

SEQ ID NO: 3789527 - RNA, 18 nt, Salmonella typhimurium LT2
cgauaaagcugggucagg

SEQ ID NO: 3789528 - RNA, 22 nt, Salmonella typhimurium LT2
cgauaaagcugggucaggacag

SEQ ID NO: 3789529 - RNA, 14 nt, Salmonella typhimurium LT2
cgauaaauacccga

SEQ ID NO: 3789530 - RNA, 11 nt, Salmonella typhimurium LT2
cgauaaaucaa

SEQ ID NO: 3789531 - RNA, 14 nt, Salmonella typhimurium LT2
cgauaaaucgccac

SEQ ID NO: 3789532 - RNA, 20 nt, Salmonella typhimurium LT2
cgauaacacggcuggcaaug

SEQ ID NO: 3789533 - RNA, 14 nt, Salmonella typhimurium LT2
cgauaaccaccagc

SEQ ID NO: 3789534 - RNA, 14 nt, Salmonella typhimurium LT2
cgauaaccaggucg

SEQ ID NO: 3789535 - RNA, 15 nt, Salmonella typhimurium LT2
cgauaacccgcgcau

SEQ ID NO: 3789536 - RNA, 15 nt, Salmonella typhimurium LT2
cgauaaccgccgccg

SEQ ID NO: 3789537 - RNA, 19 nt, Salmonella typhimurium LT2
cgauaaccgccgccgcgcu

SEQ ID NO: 3789538 - RNA, 22 nt, Salmonella typhimurium LT2
cgauaaccggacgauuuaagcu

SEQ ID NO: 3789539 - RNA, 14 nt, Salmonella typhimurium LT2
cgauaacgcagcgc

SEQ ID NO: 3789540 - RNA, 15 nt, Salmonella typhimurium LT2
cgauaacucuucauc

SEQ ID NO: 3789541 - RNA, 20 nt, Salmonella typhimurium LT2
cgauaagauccgggcuggca

SEQ ID NO: 3789542 - RNA, 13 nt, Salmonella typhimurium LT2
cgauaagcgccgc

SEQ ID NO: 3789543 - RNA, 20 nt, Salmonella typhimurium LT2
cgauaaggucgcuauccagc

SEQ ID NO: 3789544 - RNA, 14 nt, Salmonella typhimurium LT2
cgauaauaaaauau

SEQ ID NO: 3789545 - RNA, 18 nt, Salmonella typhimurium LT2
cgauaauaauuaccacgc

SEQ ID NO: 3789546 - RNA, 14 nt, Salmonella typhimurium LT2
cgauaauacgcgcg

SEQ ID NO: 3789547 - RNA, 18 nt, Salmonella typhimurium LT2
cgauaauauccagcacgc

SEQ ID NO: 3789548 - RNA, 21 nt, Salmonella typhimurium LT2
cgauaauauccgacgccuguu

SEQ ID NO: 3789549 - RNA, 15 nt, Salmonella typhimurium LT2
cgauaaucaccagcc

SEQ ID NO: 3789550 - RNA, 20 nt, Salmonella typhimurium LT2
cgauaaucauacagcgcagc

SEQ ID NO: 3789551 - RNA, 13 nt, Salmonella typhimurium LT2
cgauacaccuuca

SEQ ID NO: 3789552 - RNA, 21 nt, Salmonella typhimurium LT2
cgauacaggacugacugcugu

SEQ ID NO: 3789553 - RNA, 16 nt, Salmonella typhimurium LT2
cgauacauccggcagg

SEQ ID NO: 3789554 - RNA, 14 nt, Salmonella typhimurium LT2
cgauacccaccagc

SEQ ID NO: 3789555 - RNA, 15 nt, Salmonella typhimurium LT2
cgauacccaccagcg

SEQ ID NO: 3789556 - RNA, 16 nt, Salmonella typhimurium LT2
cgauacccaccagcgu

SEQ ID NO: 3789557 - RNA, 16 nt, Salmonella typhimurium LT2
cgauacccccaaccgu

SEQ ID NO: 3789558 - RNA, 13 nt, Salmonella typhimurium LT2
cgauaccggcaac

SEQ ID NO: 3789559 - RNA, 19 nt, Salmonella typhimurium LT2
cgauacgcacaucaauaaa

SEQ ID NO: 3789560 - RNA, 20 nt, Salmonella typhimurium LT2
cgauacgcgggccgcggcgc

SEQ ID NO: 3789561 - RNA, 17 nt, Salmonella typhimurium LT2
cgauacggcccagaccc

SEQ ID NO: 3789562 - RNA, 22 nt, Salmonella typhimurium LT2
cgauacucacgacuuucaccag

SEQ ID NO: 3789563 - RNA, 22 nt, Salmonella typhimurium LT2
cgauacuccauugucggcagcg

SEQ ID NO: 3789564 - RNA, 23 nt, Salmonella typhimurium LT2
cgauacuggcaguaaaaagaaag

SEQ ID NO: 3789565 - RNA, 13 nt, Salmonella typhimurium LT2
cgauagaccacgc

SEQ ID NO: 3789566 - RNA, 17 nt, Salmonella typhimurium LT2
cgauagaccuucguaau

SEQ ID NO: 3789567 - RNA, 18 nt, Salmonella typhimurium LT2
cgauagacguugagcuca

SEQ ID NO: 3789568 - RNA, 11 nt, Salmonella typhimurium LT2
cgcaaacugcc

SEQ ID NO: 3789569 - RNA, 19 nt, Salmonella typhimurium LT2
cgcaaacugccaggcaauc

SEQ ID NO: 3789570 - RNA, 17 nt, Salmonella typhimurium LT2
cgcaaacuggccacagc

SEQ ID NO: 3789571 - RNA, 19 nt, Salmonella typhimurium LT2
cgcaaaggcguugugcugc

SEQ ID NO: 3789572 - RNA, 18 nt, Salmonella typhimurium LT2
cgcaaagggugaaaucac

SEQ ID NO: 3789573 - RNA, 17 nt, Salmonella typhimurium LT2
cgcaaaugaccagauca

SEQ ID NO: 3789574 - RNA, 19 nt, Salmonella typhimurium LT2
cgcaaauucgucgccgcca

SEQ ID NO: 3789575 - RNA, 16 nt, Salmonella typhimurium LT2
cgcaaauugcgcgccc

SEQ ID NO: 3789576 - RNA, 16 nt, Salmonella typhimurium LT2
cgcaacaacaggccag

SEQ ID NO: 3789577 - RNA, 22 nt, Salmonella typhimurium LT2
cgcaacaggccgcaucgggaaa

SEQ ID NO: 3789578 - RNA, 21 nt, Salmonella typhimurium LT2
cgcaacauugcgccucaccgg

SEQ ID NO: 3789579 - RNA, 17 nt, Salmonella typhimurium LT2
cgcaaccauuaccgcca

SEQ ID NO: 3789580 - RNA, 22 nt, Salmonella typhimurium LT2
cgcaaccgguaucaaacccuuc

SEQ ID NO: 3789581 - RNA, 15 nt, Salmonella typhimurium LT2
cgcaaccuuaaggcc

SEQ ID NO: 3789582 - RNA, 23 nt, Salmonella typhimurium LT2
cgcaacgcuuaucaguccccaca

SEQ ID NO: 3789583 - RNA, 16 nt, Salmonella typhimurium LT2
cgcaacgucagcgauc

SEQ ID NO: 3789584 - RNA, 15 nt, Salmonella typhimurium LT2
cgcaacgucaguacg

SEQ ID NO: 3789585 - RNA, 22 nt, Salmonella typhimurium LT2
cgcaacgugcaggcgccgccau

SEQ ID NO: 3789586 - RNA, 15 nt, Salmonella typhimurium LT2
cgcaacucaucguca

SEQ ID NO: 3789587 - RNA, 15 nt, Salmonella typhimurium LT2
cgcaagacacgcuuc

SEQ ID NO: 3789588 - RNA, 18 nt, Salmonella typhimurium LT2
cgcaagauuccagauagc

SEQ ID NO: 3789589 - RNA, 23 nt, Salmonella typhimurium LT2
cgcaagcgcccuauuuggccugc

SEQ ID NO: 3789590 - RNA, 19 nt, Salmonella typhimurium LT2
cgcaauacagcccgccagc

SEQ ID NO: 3789591 - RNA, 14 nt, Salmonella typhimurium LT2
cgcaauaccggcga

SEQ ID NO: 3789592 - RNA, 23 nt, Salmonella typhimurium LT2
cgcaauacguuugguaccgcugg

SEQ ID NO: 3789593 - RNA, 15 nt, Salmonella typhimurium LT2
cgcaauacuguaagc

SEQ ID NO: 3789594 - RNA, 18 nt, Salmonella typhimurium LT2
cgcaauagggggugacau

SEQ ID NO: 3789595 - RNA, 22 nt, Salmonella typhimurium LT2
cgcaaucacauacagcacuucc

SEQ ID NO: 3789596 - RNA, 14 nt, Salmonella typhimurium LT2
cgcaaucaucacca

SEQ ID NO: 3789597 - RNA, 17 nt, Salmonella typhimurium LT2
cgcaaucccgcgcugcg

SEQ ID NO: 3789598 - RNA, 16 nt, Salmonella typhimurium LT2
cgcaaucggcuuugac

SEQ ID NO: 3789599 - RNA, 22 nt, Salmonella typhimurium LT2
cgcaaucggcuuugacguaaua

SEQ ID NO: 3789600 - RNA, 18 nt, Salmonella typhimurium LT2
cgcaaucuccgccgcuuu

SEQ ID NO: 3789601 - RNA, 19 nt, Salmonella typhimurium LT2
cgcaaucucgcaagauucc

SEQ ID NO: 3789602 - RNA, 21 nt, Salmonella typhimurium LT2
cgcaaucucuuccgcccagau

SEQ ID NO: 3789603 - RNA, 18 nt, Salmonella typhimurium LT2
cgcaaucugcucgacgcg

SEQ ID NO: 3789604 - RNA, 19 nt, Salmonella typhimurium LT2
cgcaaucugcucgacgcgc

SEQ ID NO: 3789605 - RNA, 18 nt, Salmonella typhimurium LT2
cgcaauguggacaaucag

SEQ ID NO: 3789606 - RNA, 20 nt, Salmonella typhimurium LT2
cgcaauuaccgaaaaucuuc

SEQ ID NO: 3789607 - RNA, 22 nt, Salmonella typhimurium LT2
cgcaauuccugacugcgcgccu

SEQ ID NO: 3789608 - RNA, 23 nt, Salmonella typhimurium LT2
cgcaauugguaauuaaaggcagc

SEQ ID NO: 3789609 - RNA, 23 nt, Salmonella typhimurium LT2
cgcacaaagcguucggccugcug

SEQ ID NO: 3789610 - RNA, 14 nt, Salmonella typhimurium LT2
cgcacaagccugca

SEQ ID NO: 3789611 - RNA, 13 nt, Salmonella typhimurium LT2
cgcacacccugca

SEQ ID NO: 3789612 - RNA, 23 nt, Salmonella typhimurium LT2
cgcacagaaucgccguggcauua

SEQ ID NO: 3789613 - RNA, 23 nt, Salmonella typhimurium LT2
cgcacagcagacaaccgacgcau

SEQ ID NO: 3789614 - RNA, 12 nt, Salmonella typhimurium LT2
cgcacagcgcca

SEQ ID NO: 3789615 - RNA, 18 nt, Salmonella typhimurium LT2
cgcacaguuuuccccccu

SEQ ID NO: 3789616 - RNA, 15 nt, Salmonella typhimurium LT2
cgcacauaaucaccg

SEQ ID NO: 3789617 - RNA, 18 nt, Salmonella typhimurium LT2
cgcaccaaaguuaaucag

SEQ ID NO: 3789618 - RNA, 18 nt, Salmonella typhimurium LT2
cgcaccacgcaaaccgcu

SEQ ID NO: 3789619 - RNA, 14 nt, Salmonella typhimurium LT2
cgcaccacugcugu

SEQ ID NO: 3789620 - RNA, 21 nt, Salmonella typhimurium LT2
cgcaccacugcuguagcgucu

SEQ ID NO: 3789621 - RNA, 17 nt, Salmonella typhimurium LT2
cgcaccaguuccccaua

SEQ ID NO: 3789622 - RNA, 12 nt, Salmonella typhimurium LT2
cgcacccgccau

SEQ ID NO: 3789623 - RNA, 21 nt, Salmonella typhimurium LT2
cgcacccgccaucaugcccac

SEQ ID NO: 3789624 - RNA, 14 nt, Salmonella typhimurium LT2
cgcacccgcgcagg

SEQ ID NO: 3789625 - RNA, 20 nt, Salmonella typhimurium LT2
cgcacccggcuuacaacauu

SEQ ID NO: 3789626 - RNA, 15 nt, Salmonella typhimurium LT2
cgcaccuucaucauu

SEQ ID NO: 3789627 - RNA, 16 nt, Salmonella typhimurium LT2
cgcaccuucaucauuc

SEQ ID NO: 3789628 - RNA, 17 nt, Salmonella typhimurium LT2
cgcacgaacauaccgga

SEQ ID NO: 3789629 - RNA, 19 nt, Salmonella typhimurium LT2
cgcacgccagauaaaucag

SEQ ID NO: 3789630 - RNA, 13 nt, Salmonella typhimurium LT2
cgcacgcgcgccc

SEQ ID NO: 3789631 - RNA, 21 nt, Salmonella typhimurium LT2
cgcacgcgucaucggcgcgcu

SEQ ID NO: 3789632 - RNA, 22 nt, Salmonella typhimurium LT2
cgcacggcgcguccucacacug

SEQ ID NO: 3789633 - RNA, 15 nt, Salmonella typhimurium LT2
cgcacggucgcuucc

SEQ ID NO: 3789634 - RNA, 16 nt, Salmonella typhimurium LT2
cgcacguucagcucag

SEQ ID NO: 3789635 - RNA, 21 nt, Salmonella typhimurium LT2
cgcacuaccagaaacaacacg

SEQ ID NO: 3789636 - RNA, 14 nt, Salmonella typhimurium LT2
cgcacucagaaaau

SEQ ID NO: 3789637 - RNA, 13 nt, Salmonella typhimurium LT2
cgcacuccccaga

SEQ ID NO: 3789638 - RNA, 13 nt, Salmonella typhimurium LT2
cgcacucgccgcc

SEQ ID NO: 3789639 - RNA, 21 nt, Salmonella typhimurium LT2
cgcacucucaaacuauuuuua

SEQ ID NO: 3789640 - RNA, 19 nt, Salmonella typhimurium LT2
cgcacugauagccgccagu

SEQ ID NO: 3789641 - RNA, 14 nt, Salmonella typhimurium LT2
cgcacugcaucgaa

SEQ ID NO: 3789642 - RNA, 21 nt, Salmonella typhimurium LT2
cgcacuucacgcuccuugagc

SEQ ID NO: 3789643 - RNA, 22 nt, Salmonella typhimurium LT2
cgcacuucgaaacgaucgauaa

SEQ ID NO: 3789644 - RNA, 17 nt, Salmonella typhimurium LT2
cgcacuuugcagaccuu

SEQ ID NO: 3789645 - RNA, 13 nt, Salmonella typhimurium LT2
cgcagaaccgccg

SEQ ID NO: 3789646 - RNA, 15 nt, Salmonella typhimurium LT2
cgcagacccagacgc

SEQ ID NO: 3789647 - RNA, 23 nt, Salmonella typhimurium LT2
cgcagacccgcaaaccacgucug

SEQ ID NO: 3789648 - RNA, 18 nt, Salmonella typhimurium LT2
cgcagacccgucaggguu

SEQ ID NO: 3789649 - RNA, 22 nt, Salmonella typhimurium LT2
cgcagaccgcguuccaucgcuu

SEQ ID NO: 3789650 - RNA, 16 nt, Salmonella typhimurium LT2
cgcagacgucaacacc

SEQ ID NO: 3789651 - RNA, 16 nt, Salmonella typhimurium LT2
cgcagagcccagcgcg

SEQ ID NO: 3789652 - RNA, 14 nt, Salmonella typhimurium LT2
cgcagagcgcauca

SEQ ID NO: 3789653 - RNA, 15 nt, Salmonella typhimurium LT2
cgcagagucgcagcg

SEQ ID NO: 3789654 - RNA, 19 nt, Salmonella typhimurium LT2
cgcagauaucuuccagcgc

SEQ ID NO: 3789655 - RNA, 24 nt, Salmonella typhimurium LT2
cgcagauaucuuccagcgcgucca

SEQ ID NO: 3789656 - RNA, 16 nt, Salmonella typhimurium LT2
cgcagauauuuccggc

SEQ ID NO: 3789657 - RNA, 14 nt, Salmonella typhimurium LT2
cgcagaucgccugg

SEQ ID NO: 3789658 - RNA, 15 nt, Salmonella typhimurium LT2
cgcagcaaaaaauac

SEQ ID NO: 3789659 - RNA, 14 nt, Salmonella typhimurium LT2
cgcagcaauucugc

SEQ ID NO: 3789660 - RNA, 14 nt, Salmonella typhimurium LT2
cgcagcacaugcaa

SEQ ID NO: 3789661 - RNA, 19 nt, Salmonella typhimurium LT2
cgcagcacuuucgcuucac

SEQ ID NO: 3789662 - RNA, 16 nt, Salmonella typhimurium LT2
cgcagcagcuccccgc

SEQ ID NO: 3789663 - RNA, 14 nt, Salmonella typhimurium LT2
cgcagcaucgccau

SEQ ID NO: 3789664 - RNA, 20 nt, Salmonella typhimurium LT2
cgcagcauuuccgccgccuu

SEQ ID NO: 3789665 - RNA, 15 nt, Salmonella typhimurium LT2
cgcagccacggcgca

SEQ ID NO: 3789666 - RNA, 15 nt, Salmonella typhimurium LT2
cgcagccaguacgcg

SEQ ID NO: 3789667 - RNA, 12 nt, Salmonella typhimurium LT2
cgcagccccagc

SEQ ID NO: 3789668 - RNA, 15 nt, Salmonella typhimurium LT2
cgcagccccagcgcc

SEQ ID NO: 3789669 - RNA, 16 nt, Salmonella typhimurium LT2
cgcagccccagcgcca

SEQ ID NO: 3789670 - RNA, 22 nt, Salmonella typhimurium LT2
cgcagccccagcgccagccgcg

SEQ ID NO: 3789671 - RNA, 22 nt, Salmonella typhimurium LT2
cgcagccccauuugccgcgccu

SEQ ID NO: 3789672 - RNA, 16 nt, Salmonella typhimurium LT2
cgccaaccagaccgga

SEQ ID NO: 3789673 - RNA, 15 nt, Salmonella typhimurium LT2
cgccaaccaucggca

SEQ ID NO: 3789674 - RNA, 23 nt, Salmonella typhimurium LT2
cgccaaccucccaaccaguauga

SEQ ID NO: 3789675 - RNA, 15 nt, Salmonella typhimurium LT2
cgccaacgccaaccg

SEQ ID NO: 3789676 - RNA, 21 nt, Salmonella typhimurium LT2
cgccaacuuuuugcgcaauac

SEQ ID NO: 3789677 - RNA, 13 nt, Salmonella typhimurium LT2
cgccaagcgcgga

SEQ ID NO: 3789678 - RNA, 13 nt, Salmonella typhimurium LT2
cgccaagcgcggc

SEQ ID NO: 3789679 - RNA, 20 nt, Salmonella typhimurium LT2
cgccaagcgcggcagcagcu

SEQ ID NO: 3789680 - RNA, 12 nt, Salmonella typhimurium LT2
cgccaagcggca

SEQ ID NO: 3789681 - RNA, 15 nt, Salmonella typhimurium LT2
cgccaagcugcagaa

SEQ ID NO: 3789682 - RNA, 15 nt, Salmonella typhimurium LT2
cgccaaguacgccuu

SEQ ID NO: 3789683 - RNA, 12 nt, Salmonella typhimurium LT2
cgccaauaccaa

SEQ ID NO: 3789684 - RNA, 16 nt, Salmonella typhimurium LT2
cgccaauaguuaacgc

SEQ ID NO: 3789685 - RNA, 12 nt, Salmonella typhimurium LT2
cgccaauaucca

SEQ ID NO: 3789686 - RNA, 14 nt, Salmonella typhimurium LT2
cgccaauauccauu

SEQ ID NO: 3789687 - RNA, 23 nt, Salmonella typhimurium LT2
cgccaauaugcgcaaggccguua

SEQ ID NO: 3789688 - RNA, 20 nt, Salmonella typhimurium LT2
cgccaaucaacgccgccagg

SEQ ID NO: 3789689 - RNA, 15 nt, Salmonella typhimurium LT2
cgccaaucuguaauu

SEQ ID NO: 3789690 - RNA, 17 nt, Salmonella typhimurium LT2
cgccaauggccgccccc

SEQ ID NO: 3789691 - RNA, 15 nt, Salmonella typhimurium LT2
cgccaauuccugcca

SEQ ID NO: 3789692 - RNA, 17 nt, Salmonella typhimurium LT2
cgccacaccgagacaga

SEQ ID NO: 3789693 - RNA, 13 nt, Salmonella typhimurium LT2
cgccacaucauug

SEQ ID NO: 3789694 - RNA, 17 nt, Salmonella typhimurium LT2
cgccacaucguuggccg

SEQ ID NO: 3789695 - RNA, 14 nt, Salmonella typhimurium LT2
cgccacauucaauu

SEQ ID NO: 3789696 - RNA, 12 nt, Salmonella typhimurium LT2
cgccaccacaaa

SEQ ID NO: 3789697 - RNA, 19 nt, Salmonella typhimurium LT2
cgccaccacauucaggcgg

SEQ ID NO: 3789698 - RNA, 20 nt, Salmonella typhimurium LT2
cgccaccacgcccaacgacc

SEQ ID NO: 3789699 - RNA, 16 nt, Salmonella typhimurium LT2
cgccaccacucggcga

SEQ ID NO: 3789700 - RNA, 14 nt, Salmonella typhimurium LT2
cgccaccagcgcag

SEQ ID NO: 3789701 - RNA, 21 nt, Salmonella typhimurium LT2
cgccaccaucgucgccagacc

SEQ ID NO: 3789702 - RNA, 15 nt, Salmonella typhimurium LT2
cgccaccaugcuggu

SEQ ID NO: 3789703 - RNA, 20 nt, Salmonella typhimurium LT2
cgccacccauuuuccgcugu

SEQ ID NO: 3789704 - RNA, 14 nt, Salmonella typhimurium LT2
cgccacccgccugc

SEQ ID NO: 3789705 - RNA, 21 nt, Salmonella typhimurium LT2
cgccacccgccugcgccuuga

SEQ ID NO: 3789706 - RNA, 15 nt, Salmonella typhimurium LT2
cgccaccgccgccac

SEQ ID NO: 3789707 - RNA, 14 nt, Salmonella typhimurium LT2
cgccaccgcgcgca

SEQ ID NO: 3789708 - RNA, 22 nt, Salmonella typhimurium LT2
cgccaccgggcaacacacgcuu

SEQ ID NO: 3789709 - RNA, 19 nt, Salmonella typhimurium LT2
cgccaccucgcgacgguga

SEQ ID NO: 3789710 - RNA, 17 nt, Salmonella typhimurium LT2
cgccaccuuucugcucc

SEQ ID NO: 3789711 - RNA, 13 nt, Salmonella typhimurium LT2
cgccaccuuugac

SEQ ID NO: 3789712 - RNA, 18 nt, Salmonella typhimurium LT2
cgccaccuuugacgccug

SEQ ID NO: 3789713 - RNA, 17 nt, Salmonella typhimurium LT2
cgccacgaguggcgcgg

SEQ ID NO: 3789714 - RNA, 22 nt, Salmonella typhimurium LT2
cgccacgcagauaucuuccagc

SEQ ID NO: 3789715 - RNA, 15 nt, Salmonella typhimurium LT2
cgccacgcagcgacg

SEQ ID NO: 3789716 - RNA, 22 nt, Salmonella typhimurium LT2
cgccacgccauugcugucgaca

SEQ ID NO: 3789717 - RNA, 15 nt, Salmonella typhimurium LT2
cgccacgccgcccgc

SEQ ID NO: 3789718 - RNA, 16 nt, Salmonella typhimurium LT2
cgccacgccuaaacug

SEQ ID NO: 3789719 - RNA, 15 nt, Salmonella typhimurium LT2
cgccacgcuccuucu

SEQ ID NO: 3789720 - RNA, 22 nt, Salmonella typhimurium LT2
cgccacggccagcagccauucg

SEQ ID NO: 3789721 - RNA, 14 nt, Salmonella typhimurium LT2
cgccacggcuuuua

SEQ ID NO: 3789722 - RNA, 22 nt, Salmonella typhimurium LT2
cgccacgguugucaaauuugcu

SEQ ID NO: 3789723 - RNA, 23 nt, Salmonella typhimurium LT2
cgccacguauuucgcagcgauca

SEQ ID NO: 3789724 - RNA, 14 nt, Salmonella typhimurium LT2
cgccacuaccagcg

SEQ ID NO: 3789725 - RNA, 16 nt, Salmonella typhimurium LT2
cgccacuaccagcgua

SEQ ID NO: 3789726 - RNA, 22 nt, Salmonella typhimurium LT2
cgccacucagcgcuguuuuucc

SEQ ID NO: 3789727 - RNA, 20 nt, Salmonella typhimurium LT2
cgccacugugauacacgccg

SEQ ID NO: 3789728 - RNA, 15 nt, Salmonella typhimurium LT2
cgccacuuccagcgc

SEQ ID NO: 3789729 - RNA, 20 nt, Salmonella typhimurium LT2
cgccacuuccagcgcgccgu

SEQ ID NO: 3789730 - RNA, 20 nt, Salmonella typhimurium LT2
cgccacuucuuugaccagcg

SEQ ID NO: 3789731 - RNA, 16 nt, Salmonella typhimurium LT2
cgccagaacugcguaa

SEQ ID NO: 3789732 - RNA, 16 nt, Salmonella typhimurium LT2
cgccagaauagcgcag

SEQ ID NO: 3789733 - RNA, 22 nt, Salmonella typhimurium LT2
cgccagacacuggaaacagcca

SEQ ID NO: 3789734 - RNA, 23 nt, Salmonella typhimurium LT2
cgccagacccacuaacugccgcu

SEQ ID NO: 3789735 - RNA, 14 nt, Salmonella typhimurium LT2
cgccagacccagcg

SEQ ID NO: 3789736 - RNA, 18 nt, Salmonella typhimurium LT2
cgccagacccgcaauaac

SEQ ID NO: 3789737 - RNA, 18 nt, Salmonella typhimurium LT2
cgccagaccgacgccaac

SEQ ID NO: 3789738 - RNA, 22 nt, Salmonella typhimurium LT2
cgccagaccgcuuaacuccggc

SEQ ID NO: 3789739 - RNA, 16 nt, Salmonella typhimurium LT2
cgccagacucagccag

SEQ ID NO: 3789740 - RNA, 21 nt, Salmonella typhimurium LT2
cgccagacucagccaggucug

SEQ ID NO: 3789741 - RNA, 18 nt, Salmonella typhimurium LT2
cgccagacucgcuucacg

SEQ ID NO: 3789742 - RNA, 21 nt, Salmonella typhimurium LT2
cgccagagcacgaaaagugug

SEQ ID NO: 3789743 - RNA, 16 nt, Salmonella typhimurium LT2
cgccagagcuucaggc

SEQ ID NO: 3789744 - RNA, 21 nt, Salmonella typhimurium LT2
cgccagagcuucaggcgcgau

SEQ ID NO: 3789745 - RNA, 16 nt, Salmonella typhimurium LT2
cgccagauaaaucagc

SEQ ID NO: 3789746 - RNA, 23 nt, Salmonella typhimurium LT2
cgccagauaaccaaucacuaacg

SEQ ID NO: 3789747 - RNA, 18 nt, Salmonella typhimurium LT2
cgccagauaaucacgcca

SEQ ID NO: 3789748 - RNA, 19 nt, Salmonella typhimurium LT2
cgccagauaaucgccgcca

SEQ ID NO: 3789749 - RNA, 15 nt, Salmonella typhimurium LT2
cgccagaucgugcca

SEQ ID NO: 3789750 - RNA, 17 nt, Salmonella typhimurium LT2
cgccagaugcagcggca

SEQ ID NO: 3789751 - RNA, 18 nt, Salmonella typhimurium LT2
cgccagauuaucggccag

SEQ ID NO: 3789752 - RNA, 15 nt, Salmonella typhimurium LT2
cgccagcaacgccca

SEQ ID NO: 3789753 - RNA, 14 nt, Salmonella typhimurium LT2
cgccagcaccaggc

SEQ ID NO: 3789754 - RNA, 14 nt, Salmonella typhimurium LT2
cgccagcagcagcu

SEQ ID NO: 3789755 - RNA, 13 nt, Salmonella typhimurium LT2
cgccagcagcagu

SEQ ID NO: 3789756 - RNA, 15 nt, Salmonella typhimurium LT2
cgccagcagcggcga

SEQ ID NO: 3789757 - RNA, 18 nt, Salmonella typhimurium LT2
cgccagcagggucaggaa

SEQ ID NO: 3789758 - RNA, 22 nt, Salmonella typhimurium LT2
cgccagcauggucuccagcaaa

SEQ ID NO: 3789759 - RNA, 13 nt, Salmonella typhimurium LT2
cgccagccaaacc

SEQ ID NO: 3789760 - RNA, 13 nt, Salmonella typhimurium LT2
cgccagccagccg

SEQ ID NO: 3789761 - RNA, 13 nt, Salmonella typhimurium LT2
cgccagccauucg

SEQ ID NO: 3789762 - RNA, 18 nt, Salmonella typhimurium LT2
cgccagcccuuccagcgg

SEQ ID NO: 3789763 - RNA, 13 nt, Salmonella typhimurium LT2
cgccagccgcagc

SEQ ID NO: 3789764 - RNA, 14 nt, Salmonella typhimurium LT2
cgccagccgcagcu

SEQ ID NO: 3789765 - RNA, 16 nt, Salmonella typhimurium LT2
cgccagccgcagcuca

SEQ ID NO: 3789766 - RNA, 15 nt, Salmonella typhimurium LT2
cgccagccgcgccau

SEQ ID NO: 3789767 - RNA, 19 nt, Salmonella typhimurium LT2
cgccagccgcgccaucucc

SEQ ID NO: 3789768 - RNA, 23 nt, Salmonella typhimurium LT2
cgccagccgcgccaucuccuccu

SEQ ID NO: 3789769 - RNA, 18 nt, Salmonella typhimurium LT2
cgccagccuaucgccaua

SEQ ID NO: 3789770 - RNA, 19 nt, Salmonella typhimurium LT2
cgccagccugaacaucuuc

SEQ ID NO: 3789771 - RNA, 20 nt, Salmonella typhimurium LT2
cgccagcgcauuaccgccgc

SEQ ID NO: 3789772 - RNA, 21 nt, Salmonella typhimurium LT2
cgccagcgcauuccccaccac

SEQ ID NO: 3789773 - RNA, 16 nt, Salmonella typhimurium LT2
cgccagcgccagcagc

SEQ ID NO: 3789774 - RNA, 17 nt, Salmonella typhimurium LT2
cgccagcgccagcagca

SEQ ID NO: 3789775 - RNA, 13 nt, Salmonella typhimurium LT2
cgccagcgccgga

SEQ ID NO: 3789776 - RNA, 20 nt, Salmonella typhimurium LT2
cgccauugcugucgguuaac

SEQ ID NO: 3789777 - RNA, 22 nt, Salmonella typhimurium LT2
cgccauuggcaaucaguacgcg

SEQ ID NO: 3789778 - RNA, 23 nt, Salmonella typhimurium LT2
cgccauuggcucggcgucauccc

SEQ ID NO: 3789779 - RNA, 15 nt, Salmonella typhimurium LT2
cgccauuugcauccg

SEQ ID NO: 3789780 - RNA, 16 nt, Salmonella typhimurium LT2
cgccauuugccagaua

SEQ ID NO: 3789781 - RNA, 18 nt, Salmonella typhimurium LT2
cgccauuugccagauagc

SEQ ID NO: 3789782 - RNA, 18 nt, Salmonella typhimurium LT2
cgcccaaauaguccagca

SEQ ID NO: 3789783 - RNA, 20 nt, Salmonella typhimurium LT2
cgcccaacaccagcacugac

SEQ ID NO: 3789784 - RNA, 14 nt, Salmonella typhimurium LT2
cgcccaaccagccc

SEQ ID NO: 3789785 - RNA, 22 nt, Salmonella typhimurium LT2
cgcccaacggaugcgccauccc

SEQ ID NO: 3789786 - RNA, 22 nt, Salmonella typhimurium LT2
cgcccacaggcugcggcacgcu

SEQ ID NO: 3789787 - RNA, 14 nt, Salmonella typhimurium LT2
cgcccacgcggcgu

SEQ ID NO: 3789788 - RNA, 17 nt, Salmonella typhimurium LT2
cgcccagauauccgcgc

SEQ ID NO: 3789789 - RNA, 12 nt, Salmonella typhimurium LT2
cgcccagauguu

SEQ ID NO: 3789790 - RNA, 17 nt, Salmonella typhimurium LT2
cgcccagcacuaacagc

SEQ ID NO: 3789791 - RNA, 15 nt, Salmonella typhimurium LT2
cgcccagcagggcca

SEQ ID NO: 3789792 - RNA, 20 nt, Salmonella typhimurium LT2
cgcccagcagggccacaacg

SEQ ID NO: 3789793 - RNA, 18 nt, Salmonella typhimurium LT2
cgcccaggccugauaagc

SEQ ID NO: 3789794 - RNA, 23 nt, Salmonella typhimurium LT2
cgcccaggucugaugagcgcagc

SEQ ID NO: 3789795 - RNA, 20 nt, Salmonella typhimurium LT2
cgcccaucaauaccagcccc

SEQ ID NO: 3789796 - RNA, 22 nt, Salmonella typhimurium LT2
cgcccaucaauaccagccccac

SEQ ID NO: 3789797 - RNA, 16 nt, Salmonella typhimurium LT2
cgcccauccagagcag

SEQ ID NO: 3789798 - RNA, 19 nt, Salmonella typhimurium LT2
cgcccauccagagcagucg

SEQ ID NO: 3789799 - RNA, 14 nt, Salmonella typhimurium LT2
cgcccaucccuaau

SEQ ID NO: 3789800 - RNA, 15 nt, Salmonella typhimurium LT2
cgcccauccgcccac

SEQ ID NO: 3789801 - RNA, 14 nt, Salmonella typhimurium LT2
cgcccaucgccaca

SEQ ID NO: 3789802 - RNA, 20 nt, Salmonella typhimurium LT2
cgcccaucgccacagcggaa

SEQ ID NO: 3789803 - RNA, 15 nt, Salmonella typhimurium LT2
cgcccaugcggcuga

SEQ ID NO: 3789804 - RNA, 22 nt, Salmonella typhimurium LT2
cgcccauuagcauuccgcccgc

SEQ ID NO: 3789805 - RNA, 16 nt, Salmonella typhimurium LT2
cgcccauuaugccgca

SEQ ID NO: 3789806 - RNA, 15 nt, Salmonella typhimurium LT2
cgcccauuccgccug

SEQ ID NO: 3789807 - RNA, 16 nt, Salmonella typhimurium LT2
cgcccauuccgccugc

SEQ ID NO: 3789808 - RNA, 12 nt, Salmonella typhimurium LT2
cgccccaaagcg

SEQ ID NO: 3789809 - RNA, 21 nt, Salmonella typhimurium LT2
cgccccaaaucucccccggca

SEQ ID NO: 3789810 - RNA, 22 nt, Salmonella typhimurium LT2
cgccccagaagagcgagucuuu

SEQ ID NO: 3789811 - RNA, 16 nt, Salmonella typhimurium LT2
cgccccagccaaagcc

SEQ ID NO: 3789812 - RNA, 22 nt, Salmonella typhimurium LT2
cgccccaguaacgcgccccaga

SEQ ID NO: 3789813 - RNA, 22 nt, Salmonella typhimurium LT2
cgcccccaugccgccugccgcg

SEQ ID NO: 3789814 - RNA, 20 nt, Salmonella typhimurium LT2
cgccccccuaccggaaucgc

SEQ ID NO: 3789815 - RNA, 13 nt, Salmonella typhimurium LT2
cgcccccuccagu

SEQ ID NO: 3789816 - RNA, 17 nt, Salmonella typhimurium LT2
cgccccucgguuuaucc

SEQ ID NO: 3789817 - RNA, 19 nt, Salmonella typhimurium LT2
cgccccuucaucagccagc

SEQ ID NO: 3789818 - RNA, 16 nt, Salmonella typhimurium LT2
cgccccuugcagcaaa

SEQ ID NO: 3789819 - RNA, 15 nt, Salmonella typhimurium LT2
cgcccgaccacgccc

SEQ ID NO: 3789820 - RNA, 19 nt, Salmonella typhimurium LT2
cgcccgauaauaucacucc

SEQ ID NO: 3789821 - RNA, 22 nt, Salmonella typhimurium LT2
cgcccgauaauaucacucccgc

SEQ ID NO: 3789822 - RNA, 13 nt, Salmonella typhimurium LT2
cgcccgcagcaaa

SEQ ID NO: 3789823 - RNA, 14 nt, Salmonella typhimurium LT2
cgcccgcagcaaaa

SEQ ID NO: 3789824 - RNA, 11 nt, Salmonella typhimurium LT2
cgcccgccaga

SEQ ID NO: 3789825 - RNA, 13 nt, Salmonella typhimurium LT2
cgcccgccaucug

SEQ ID NO: 3789826 - RNA, 15 nt, Salmonella typhimurium LT2
cgcccgcccgccucg

SEQ ID NO: 3789827 - RNA, 14 nt, Salmonella typhimurium LT2
cgcccgccgccagc

SEQ ID NO: 3789828 - RNA, 14 nt, Salmonella typhimurium LT2
cgcccgccgccuga

SEQ ID NO: 3789829 - RNA, 17 nt, Salmonella typhimurium LT2
cgcccgccgccugaugc

SEQ ID NO: 3789830 - RNA, 13 nt, Salmonella typhimurium LT2
cgcccgccgcgag

SEQ ID NO: 3789831 - RNA, 14 nt, Salmonella typhimurium LT2
cgcccgccgcgagc

SEQ ID NO: 3789832 - RNA, 14 nt, Salmonella typhimurium LT2
cgcccgcgcucccg

SEQ ID NO: 3789833 - RNA, 12 nt, Salmonella typhimurium LT2
cgcccgcggcga

SEQ ID NO: 3789834 - RNA, 15 nt, Salmonella typhimurium LT2
cgcccgcucgauagc

SEQ ID NO: 3789835 - RNA, 18 nt, Salmonella typhimurium LT2
cgcccgcucgcgauccuc

SEQ ID NO: 3789836 - RNA, 20 nt, Salmonella typhimurium LT2
cgcccgcuugcaccauggcg

SEQ ID NO: 3789837 - RNA, 23 nt, Salmonella typhimurium LT2
cgcccggagggguuuucgccagc

SEQ ID NO: 3789838 - RNA, 17 nt, Salmonella typhimurium LT2
cgcccggauaacggcgc

SEQ ID NO: 3789839 - RNA, 22 nt, Salmonella typhimurium LT2
cgcccggccccgcgccagccaa

SEQ ID NO: 3789840 - RNA, 14 nt, Salmonella typhimurium LT2
cgcccgguaaacgc

SEQ ID NO: 3789841 - RNA, 16 nt, Salmonella typhimurium LT2
cgcccgguagcauccg

SEQ ID NO: 3789842 - RNA, 22 nt, Salmonella typhimurium LT2
cgcccggugauggugcagcccc

SEQ ID NO: 3789843 - RNA, 17 nt, Salmonella typhimurium LT2
cgcccguacaccugcaa

SEQ ID NO: 3789844 - RNA, 21 nt, Salmonella typhimurium LT2
cgcccguagcgacgccauccg

SEQ ID NO: 3789845 - RNA, 13 nt, Salmonella typhimurium LT2
cgcccguccgcua

SEQ ID NO: 3789846 - RNA, 19 nt, Salmonella typhimurium LT2
cgcccgugacgccaggcag

SEQ ID NO: 3789847 - RNA, 19 nt, Salmonella typhimurium LT2
cgcccguuguccgccagcg

SEQ ID NO: 3789848 - RNA, 14 nt, Salmonella typhimurium LT2
cgcccguuuuuucc

SEQ ID NO: 3789849 - RNA, 15 nt, Salmonella typhimurium LT2
cgcccuccuguugaa

SEQ ID NO: 3789850 - RNA, 16 nt, Salmonella typhimurium LT2
cgcccuccuguugaac

SEQ ID NO: 3789851 - RNA, 23 nt, Salmonella typhimurium LT2
cgcccugaggaguauuauccauu

SEQ ID NO: 3789852 - RNA, 22 nt, Salmonella typhimurium LT2
cgcccugcaggcggugcgcagc

SEQ ID NO: 3789853 - RNA, 15 nt, Salmonella typhimurium LT2
cgcccugcccgccag

SEQ ID NO: 3789854 - RNA, 16 nt, Salmonella typhimurium LT2
cgcccugcccgccagg

SEQ ID NO: 3789855 - RNA, 14 nt, Salmonella typhimurium LT2
cgcccugcgccaga

SEQ ID NO: 3789856 - RNA, 14 nt, Salmonella typhimurium LT2
cgcccugcgcgccu

SEQ ID NO: 3789857 - RNA, 15 nt, Salmonella typhimurium LT2
cgcccugcgcgccuu

SEQ ID NO: 3789858 - RNA, 14 nt, Salmonella typhimurium LT2
cgcccugcgguagc

SEQ ID NO: 3789859 - RNA, 16 nt, Salmonella typhimurium LT2
cgcccugcgucgcgcu

SEQ ID NO: 3789860 - RNA, 16 nt, Salmonella typhimurium LT2
cgcccugcucccacag

SEQ ID NO: 3789861 - RNA, 21 nt, Salmonella typhimurium LT2
cgcccuggaggaacagcgccg

SEQ ID NO: 3789862 - RNA, 15 nt, Salmonella typhimurium LT2
cgcccuguccuccau

SEQ ID NO: 3789863 - RNA, 23 nt, Salmonella typhimurium LT2
cgcccuguggaaacuccagcggc

SEQ ID NO: 3789864 - RNA, 15 nt, Salmonella typhimurium LT2
cgcccuuccgucagc

SEQ ID NO: 3789865 - RNA, 16 nt, Salmonella typhimurium LT2
cgcccuucgucaggag

SEQ ID NO: 3789866 - RNA, 16 nt, Salmonella typhimurium LT2
cgcccuuucaguucaa

SEQ ID NO: 3789867 - RNA, 14 nt, Salmonella typhimurium LT2
cgccgaacaggcca

SEQ ID NO: 3789868 - RNA, 16 nt, Salmonella typhimurium LT2
cgccgaacaggccaug

SEQ ID NO: 3789869 - RNA, 18 nt, Salmonella typhimurium LT2
cgccgaagccaacgcagu

SEQ ID NO: 3789870 - RNA, 13 nt, Salmonella typhimurium LT2
cgccgaagcggca

SEQ ID NO: 3789871 - RNA, 15 nt, Salmonella typhimurium LT2
cgccgaagcggcagu

SEQ ID NO: 3789872 - RNA, 21 nt, Salmonella typhimurium LT2
cgccgaagcugaccagacagu

SEQ ID NO: 3789873 - RNA, 13 nt, Salmonella typhimurium LT2
cgccgacaaaucc

SEQ ID NO: 3789874 - RNA, 19 nt, Salmonella typhimurium LT2
cgccgacaaauccuccggc

SEQ ID NO: 3789875 - RNA, 20 nt, Salmonella typhimurium LT2
cgccgacaaucgucacuuca

SEQ ID NO: 3789876 - RNA, 15 nt, Salmonella typhimurium LT2
cgccgacaucacgca

SEQ ID NO: 3789877 - RNA, 18 nt, Salmonella typhimurium LT2
cgccgacaucgccaccgc

SEQ ID NO: 3789878 - RNA, 20 nt, Salmonella typhimurium LT2
cgccgacauucccugcgcau

SEQ ID NO: 3789879 - RNA, 14 nt, Salmonella typhimurium LT2
cgccgaccauccag

SEQ ID NO: 3789880 - RNA, 18 nt, Salmonella typhimurium LT2
cgccggagaucagcaguu

SEQ ID NO: 3789881 - RNA, 16 nt, Salmonella typhimurium LT2
cgccggagccgccugg

SEQ ID NO: 3789882 - RNA, 23 nt, Salmonella typhimurium LT2
cgccggaugacacaucaccucca

SEQ ID NO: 3789883 - RNA, 19 nt, Salmonella typhimurium LT2
cgccggaugcgccgugcuu

SEQ ID NO: 3789884 - RNA, 19 nt, Salmonella typhimurium LT2
cgccggauggcgacgcgua

SEQ ID NO: 3789885 - RNA, 15 nt, Salmonella typhimurium LT2
cgccggauuccagaa

SEQ ID NO: 3789886 - RNA, 18 nt, Salmonella typhimurium LT2
cgccggauuuaccagcgc

SEQ ID NO: 3789887 - RNA, 20 nt, Salmonella typhimurium LT2
cgccggauuuaccagcgcuu

SEQ ID NO: 3789888 - RNA, 21 nt, Salmonella typhimurium LT2
cgccggcaacagguaccccgc

SEQ ID NO: 3789889 - RNA, 20 nt, Salmonella typhimurium LT2
cgccggcaguuuaagcgccg

SEQ ID NO: 3789890 - RNA, 19 nt, Salmonella typhimurium LT2
cgccggcuucuuccggccc

SEQ ID NO: 3789891 - RNA, 23 nt, Salmonella typhimurium LT2
cgccgggauaaaacaccacaaag

SEQ ID NO: 3789892 - RNA, 17 nt, Salmonella typhimurium LT2
cgccgggcuucacggua

SEQ ID NO: 3789893 - RNA, 24 nt, Salmonella typhimurium LT2
cgccggggauaucaaugcgcguaa

SEQ ID NO: 3789894 - RNA, 13 nt, Salmonella typhimurium LT2
cgccggguuuugu

SEQ ID NO: 3789895 - RNA, 16 nt, Salmonella typhimurium LT2
cgccgguacgcagcag

SEQ ID NO: 3789896 - RNA, 15 nt, Salmonella typhimurium LT2
cgccggucaugccau

SEQ ID NO: 3789897 - RNA, 15 nt, Salmonella typhimurium LT2
cgccggucgccagca

SEQ ID NO: 3789898 - RNA, 22 nt, Salmonella typhimurium LT2
cgccggugucuccgucacuucc

SEQ ID NO: 3789899 - RNA, 21 nt, Salmonella typhimurium LT2
cgccgguuagcgccgcguggc

SEQ ID NO: 3789900 - RNA, 14 nt, Salmonella typhimurium LT2
cgccgguuguccac

SEQ ID NO: 3789901 - RNA, 19 nt, Salmonella typhimurium LT2
cgccguagcugcgcgccgc

SEQ ID NO: 3789902 - RNA, 21 nt, Salmonella typhimurium LT2
cgccguauucgacacaggcgu

SEQ ID NO: 3789903 - RNA, 22 nt, Salmonella typhimurium LT2
cgccguauucgacacaggcgug

SEQ ID NO: 3789904 - RNA, 20 nt, Salmonella typhimurium LT2
cgccgucaggcuugccgcgc

SEQ ID NO: 3789905 - RNA, 12 nt, Salmonella typhimurium LT2
cgccgucauccg

SEQ ID NO: 3789906 - RNA, 18 nt, Salmonella typhimurium LT2
cgccgucgcggcuacgga

SEQ ID NO: 3789907 - RNA, 12 nt, Salmonella typhimurium LT2
cgccgucggcag

SEQ ID NO: 3789908 - RNA, 16 nt, Salmonella typhimurium LT2
cgccgucggcagccag

SEQ ID NO: 3789909 - RNA, 20 nt, Salmonella typhimurium LT2
cgccgucggcagccagaccu

SEQ ID NO: 3789910 - RNA, 22 nt, Salmonella typhimurium LT2
cgccgucuucuucuucgcgcau

SEQ ID NO: 3789911 - RNA, 16 nt, Salmonella typhimurium LT2
cgccgugacggcguaa

SEQ ID NO: 3789912 - RNA, 24 nt, Salmonella typhimurium LT2
cgccgugaguuucagcaucauauc

SEQ ID NO: 3789913 - RNA, 23 nt, Salmonella typhimurium LT2
cgccgugcucauccaacugcgcc

SEQ ID NO: 3789914 - RNA, 22 nt, Salmonella typhimurium LT2
cgccguguugugugccgcgcug

SEQ ID NO: 3789915 - RNA, 12 nt, Salmonella typhimurium LT2
cgccguuaaaua

SEQ ID NO: 3789916 - RNA, 19 nt, Salmonella typhimurium LT2
cgccguucaaacgguagua

SEQ ID NO: 3789917 - RNA, 15 nt, Salmonella typhimurium LT2
cgccguuccauucaa

SEQ ID NO: 3789918 - RNA, 18 nt, Salmonella typhimurium LT2
cgccguuccauuccagaa

SEQ ID NO: 3789919 - RNA, 23 nt, Salmonella typhimurium LT2
cgccguucgcauugguaucggca

SEQ ID NO: 3789920 - RNA, 13 nt, Salmonella typhimurium LT2
cgccguuuccggu

SEQ ID NO: 3789921 - RNA, 22 nt, Salmonella typhimurium LT2
cgccuaaaaucggguggccuaa

SEQ ID NO: 3789922 - RNA, 15 nt, Salmonella typhimurium LT2
cgccuaacagcgccg

SEQ ID NO: 3789923 - RNA, 19 nt, Salmonella typhimurium LT2
cgccuacacaaaaucauuc

SEQ ID NO: 3789924 - RNA, 14 nt, Salmonella typhimurium LT2
cgccuaccgcuucc

SEQ ID NO: 3789925 - RNA, 18 nt, Salmonella typhimurium LT2
cgccuauuuucucuucca

SEQ ID NO: 3789926 - RNA, 13 nt, Salmonella typhimurium LT2
cgccuauuuucug

SEQ ID NO: 3789927 - RNA, 14 nt, Salmonella typhimurium LT2
cgccucagccaacc

SEQ ID NO: 3789928 - RNA, 11 nt, Salmonella typhimurium LT2
cgccucaggcg

SEQ ID NO: 3789929 - RNA, 21 nt, Salmonella typhimurium LT2
cgccucauugauaccuaaacg

SEQ ID NO: 3789930 - RNA, 22 nt, Salmonella typhimurium LT2
cgccuccaccguuugcagccag

SEQ ID NO: 3789931 - RNA, 16 nt, Salmonella typhimurium LT2
cgccuccagcgauagu

SEQ ID NO: 3789932 - RNA, 16 nt, Salmonella typhimurium LT2
cgccuccggccugccu

SEQ ID NO: 3789933 - RNA, 22 nt, Salmonella typhimurium LT2
cgccuccugccgaugccgccgc

SEQ ID NO: 3789934 - RNA, 16 nt, Salmonella typhimurium LT2
cgccucgcgauccgcc

SEQ ID NO: 3789935 - RNA, 18 nt, Salmonella typhimurium LT2
cgccucgcgauccgccag

SEQ ID NO: 3789936 - RNA, 19 nt, Salmonella typhimurium LT2
cgccucgcgauccgccagc

SEQ ID NO: 3789937 - RNA, 18 nt, Salmonella typhimurium LT2
cgccucgcugacgccagc

SEQ ID NO: 3789938 - RNA, 15 nt, Salmonella typhimurium LT2
cgccucguuugcuga

SEQ ID NO: 3789939 - RNA, 13 nt, Salmonella typhimurium LT2
cgccucuaaggcg

SEQ ID NO: 3789940 - RNA, 23 nt, Salmonella typhimurium LT2
cgccucuucgaccgucgcgcccu

SEQ ID NO: 3789941 - RNA, 17 nt, Salmonella typhimurium LT2
cgccugacggcgcuguc

SEQ ID NO: 3789942 - RNA, 13 nt, Salmonella typhimurium LT2
cgccugacugaag

SEQ ID NO: 3789943 - RNA, 15 nt, Salmonella typhimurium LT2
cgccugaucgcgcag

SEQ ID NO: 3789944 - RNA, 20 nt, Salmonella typhimurium LT2
cgccugaucguuacccgugc

SEQ ID NO: 3789945 - RNA, 14 nt, Salmonella typhimurium LT2
cgccugauggcgac

SEQ ID NO: 3789946 - RNA, 17 nt, Salmonella typhimurium LT2
cgccugauggcgacguu

SEQ ID NO: 3789947 - RNA, 11 nt, Salmonella typhimurium LT2
cgccugcacca

SEQ ID NO: 3789948 - RNA, 12 nt, Salmonella typhimurium LT2
cgccugcagauu

SEQ ID NO: 3789949 - RNA, 23 nt, Salmonella typhimurium LT2
cgccugcauaaacgcggccauca

SEQ ID NO: 3789950 - RNA, 20 nt, Salmonella typhimurium LT2
cgccugccauagcaucacca

SEQ ID NO: 3789951 - RNA, 20 nt, Salmonella typhimurium LT2
cgccugccgcgccgccgccu

SEQ ID NO: 3789952 - RNA, 18 nt, Salmonella typhimurium LT2
cgccugccgcgccgggag

SEQ ID NO: 3789953 - RNA, 14 nt, Salmonella typhimurium LT2
cgccugccgcgccu

SEQ ID NO: 3789954 - RNA, 16 nt, Salmonella typhimurium LT2
cgccugccugcgcuac

SEQ ID NO: 3789955 - RNA, 16 nt, Salmonella typhimurium LT2
cgccugcgccuugacg

SEQ ID NO: 3789956 - RNA, 14 nt, Salmonella typhimurium LT2
cgccugcgcgccug

SEQ ID NO: 3789957 - RNA, 16 nt, Salmonella typhimurium LT2
cgccugcgcgccugac

SEQ ID NO: 3789958 - RNA, 21 nt, Salmonella typhimurium LT2
cgccugcggaaucuccggcga

SEQ ID NO: 3789959 - RNA, 18 nt, Salmonella typhimurium LT2
cgccugcggacacggcgu

SEQ ID NO: 3789960 - RNA, 14 nt, Salmonella typhimurium LT2
cgccugcggcguaa

SEQ ID NO: 3789961 - RNA, 22 nt, Salmonella typhimurium LT2
cgccugcgguaaucgccgcgac

SEQ ID NO: 3789962 - RNA, 15 nt, Salmonella typhimurium LT2
cgccugcuccaccag

SEQ ID NO: 3789963 - RNA, 16 nt, Salmonella typhimurium LT2
cgccugcuccaccagc

SEQ ID NO: 3789964 - RNA, 19 nt, Salmonella typhimurium LT2
cgccugcuccaccagcgca

SEQ ID NO: 3789965 - RNA, 12 nt, Salmonella typhimurium LT2
cgccugcuccgu

SEQ ID NO: 3789966 - RNA, 18 nt, Salmonella typhimurium LT2
cgccugcuccguccacgc

SEQ ID NO: 3789967 - RNA, 15 nt, Salmonella typhimurium LT2
cgccugcugccagcc

SEQ ID NO: 3789968 - RNA, 20 nt, Salmonella typhimurium LT2
cgccugcugccagccgccgc

SEQ ID NO: 3789969 - RNA, 22 nt, Salmonella typhimurium LT2
cgccuggcaacgucgacccgcc

SEQ ID NO: 3789970 - RNA, 19 nt, Salmonella typhimurium LT2
cgccuggcgaaacgccuga

SEQ ID NO: 3789971 - RNA, 14 nt, Salmonella typhimurium LT2
cgccuggcggcaga

SEQ ID NO: 3789972 - RNA, 17 nt, Salmonella typhimurium LT2
cgccuggcggcagaccg

SEQ ID NO: 3789973 - RNA, 16 nt, Salmonella typhimurium LT2
cgccuggcgguaugaa

SEQ ID NO: 3789974 - RNA, 16 nt, Salmonella typhimurium LT2
cgccuggcguuaucau

SEQ ID NO: 3789975 - RNA, 20 nt, Salmonella typhimurium LT2
cgccuggcuugcggguuuug

SEQ ID NO: 3789976 - RNA, 21 nt, Salmonella typhimurium LT2
cgccugggcggcaacccgcuc

SEQ ID NO: 3789977 - RNA, 22 nt, Salmonella typhimurium LT2
cgccuggucuuccgcaucguuc

SEQ ID NO: 3789978 - RNA, 14 nt, Salmonella typhimurium LT2
cgccuguagcguaa

SEQ ID NO: 3789979 - RNA, 20 nt, Salmonella typhimurium LT2
cgccugugcuuucgccacca

SEQ ID NO: 3789980 - RNA, 21 nt, Salmonella typhimurium LT2
cgccugugcuuucgccaccag

SEQ ID NO: 3789981 - RNA, 13 nt, Salmonella typhimurium LT2
cgccuguucauca

SEQ ID NO: 3789982 - RNA, 16 nt, Salmonella typhimurium LT2
cgccuguugcaugacg

SEQ ID NO: 3789983 - RNA, 15 nt, Salmonella typhimurium LT2
cgccuuacccggccu

SEQ ID NO: 3789984 - RNA, 12 nt, Salmonella typhimurium LT2
cgcgccaccauc

SEQ ID NO: 3789985 - RNA, 11 nt, Salmonella typhimurium LT2
cgcgccaccgg

SEQ ID NO: 3789986 - RNA, 21 nt, Salmonella typhimurium LT2
cgcgccacgcagauaucuucc

SEQ ID NO: 3789987 - RNA, 12 nt, Salmonella typhimurium LT2
cgcgccacgcca

SEQ ID NO: 3789988 - RNA, 13 nt, Salmonella typhimurium LT2
cgcgccacgccau

SEQ ID NO: 3789989 - RNA, 23 nt, Salmonella typhimurium LT2
cgcgccacgccauugcugucgac

SEQ ID NO: 3789990 - RNA, 17 nt, Salmonella typhimurium LT2
cgcgccacgucggauaa

SEQ ID NO: 3789991 - RNA, 13 nt, Salmonella typhimurium LT2
cgcgccacuucca

SEQ ID NO: 3789992 - RNA, 13 nt, Salmonella typhimurium LT2
cgcgccagcacca

SEQ ID NO: 3789993 - RNA, 12 nt, Salmonella typhimurium LT2
cgcgccagcagg

SEQ ID NO: 3789994 - RNA, 21 nt, Salmonella typhimurium LT2
cgcgccagcauggucuccagc

SEQ ID NO: 3789995 - RNA, 12 nt, Salmonella typhimurium LT2
cgcgccagccaa

SEQ ID NO: 3789996 - RNA, 13 nt, Salmonella typhimurium LT2
cgcgccagcgcca

SEQ ID NO: 3789997 - RNA, 19 nt, Salmonella typhimurium LT2
cgcgccagcggacuccacg

SEQ ID NO: 3789998 - RNA, 13 nt, Salmonella typhimurium LT2
cgcgccagcgucg

SEQ ID NO: 3789999 - RNA, 19 nt, Salmonella typhimurium LT2
cgcgccagcguggcuaacg

SEQ ID NO: 3790000 - RNA, 12 nt, Salmonella typhimurium LT2
cgcgccagcuca

SEQ ID NO: 3790001 - RNA, 13 nt, Salmonella typhimurium LT2
cgcgccagggcgc

SEQ ID NO: 3790002 - RNA, 19 nt, Salmonella typhimurium LT2
cgcgccaggucucauagcg

SEQ ID NO: 3790003 - RNA, 19 nt, Salmonella typhimurium LT2
cgcgccagucaucgccgcu

SEQ ID NO: 3790004 - RNA, 22 nt, Salmonella typhimurium LT2
cgcgccaguuuggugaugcgau

SEQ ID NO: 3790005 - RNA, 17 nt, Salmonella typhimurium LT2
cgcgccaucuccuccuc

SEQ ID NO: 3790006 - RNA, 18 nt, Salmonella typhimurium LT2
cgcgccaugcgcggcauc

SEQ ID NO: 3790007 - RNA, 19 nt, Salmonella typhimurium LT2
cgcgccaugcgcggcauca

SEQ ID NO: 3790008 - RNA, 17 nt, Salmonella typhimurium LT2
cgcgccauuugccagau

SEQ ID NO: 3790009 - RNA, 14 nt, Salmonella typhimurium LT2
cgcgcccagcagca

SEQ ID NO: 3790010 - RNA, 17 nt, Salmonella typhimurium LT2
cgcgcccagcagggcca

SEQ ID NO: 3790011 - RNA, 22 nt, Salmonella typhimurium LT2
cgcgcccaguuucuucaggcca

SEQ ID NO: 3790012 - RNA, 14 nt, Salmonella typhimurium LT2
cgcgcccgacgcgc

SEQ ID NO: 3790013 - RNA, 16 nt, Salmonella typhimurium LT2
cgcgcccgacgcgcca

SEQ ID NO: 3790014 - RNA, 20 nt, Salmonella typhimurium LT2
cgcgcccgaucguccgccuc

SEQ ID NO: 3790015 - RNA, 20 nt, Salmonella typhimurium LT2
cgcgcccgccaccagcacag

SEQ ID NO: 3790016 - RNA, 15 nt, Salmonella typhimurium LT2
cgcgcccgccgccaa

SEQ ID NO: 3790017 - RNA, 13 nt, Salmonella typhimurium LT2
cgcgcccgcuucc

SEQ ID NO: 3790018 - RNA, 23 nt, Salmonella typhimurium LT2
cgcgccgaagcugaccagacagu

SEQ ID NO: 3790019 - RNA, 13 nt, Salmonella typhimurium LT2
cgcgccgagagaa

SEQ ID NO: 3790020 - RNA, 22 nt, Salmonella typhimurium LT2
cgcgccgccaacgccaacauag

SEQ ID NO: 3790021 - RNA, 13 nt, Salmonella typhimurium LT2
cgcgccgccgcca

SEQ ID NO: 3790022 - RNA, 14 nt, Salmonella typhimurium LT2
cgcgccgccgccaa

SEQ ID NO: 3790023 - RNA, 15 nt, Salmonella typhimurium LT2
cgcgccgccgccaac

SEQ ID NO: 3790024 - RNA, 14 nt, Salmonella typhimurium LT2
cgcgccgccgccug

SEQ ID NO: 3790025 - RNA, 18 nt, Salmonella typhimurium LT2
cgcgccgccucgaucucc

SEQ ID NO: 3790026 - RNA, 15 nt, Salmonella typhimurium LT2
cgcgccgccugcgcu

SEQ ID NO: 3790027 - RNA, 12 nt, Salmonella typhimurium LT2
cgcgccgcgcag

SEQ ID NO: 3790028 - RNA, 13 nt, Salmonella typhimurium LT2
cgcgccgcgcagc

SEQ ID NO: 3790029 - RNA, 13 nt, Salmonella typhimurium LT2
cgcgccgcgcgca

SEQ ID NO: 3790030 - RNA, 17 nt, Salmonella typhimurium LT2
cgcgccggucgccagca

SEQ ID NO: 3790031 - RNA, 23 nt, Salmonella typhimurium LT2
cgcgccgguucucccaccgcgca

SEQ ID NO: 3790032 - RNA, 17 nt, Salmonella typhimurium LT2
cgcgccgucgccugccu

SEQ ID NO: 3790033 - RNA, 11 nt, Salmonella typhimurium LT2
cgcgccguucg

SEQ ID NO: 3790034 - RNA, 17 nt, Salmonella typhimurium LT2
cgcgccuaccagcgcua

SEQ ID NO: 3790035 - RNA, 14 nt, Salmonella typhimurium LT2
cgcgccuaccgcca

SEQ ID NO: 3790036 - RNA, 17 nt, Salmonella typhimurium LT2
cgcgccuagcgcgcgca

SEQ ID NO: 3790037 - RNA, 16 nt, Salmonella typhimurium LT2
cgcgccuccccugccg

SEQ ID NO: 3790038 - RNA, 15 nt, Salmonella typhimurium LT2
cgcgccuccggccug

SEQ ID NO: 3790039 - RNA, 16 nt, Salmonella typhimurium LT2
cgcgccugacgcggac

SEQ ID NO: 3790040 - RNA, 12 nt, Salmonella typhimurium LT2
cgcgccugccaa

SEQ ID NO: 3790041 - RNA, 15 nt, Salmonella typhimurium LT2
cgcgccugcucccgc

SEQ ID NO: 3790042 - RNA, 17 nt, Salmonella typhimurium LT2
cgcgccuuacguaccgg

SEQ ID NO: 3790043 - RNA, 12 nt, Salmonella typhimurium LT2
cgcgcgaaggcg

SEQ ID NO: 3790044 - RNA, 15 nt, Salmonella typhimurium LT2
cgcgcgacagagcca

SEQ ID NO: 3790045 - RNA, 21 nt, Salmonella typhimurium LT2
cgcgcgacagagccaacagaa

SEQ ID NO: 3790046 - RNA, 16 nt, Salmonella typhimurium LT2
cgcgcgacccagcgca

SEQ ID NO: 3790047 - RNA, 19 nt, Salmonella typhimurium LT2
cgcgcgacuuaucuuccac

SEQ ID NO: 3790048 - RNA, 21 nt, Salmonella typhimurium LT2
cgcgcgccagucaucgccgcu

SEQ ID NO: 3790049 - RNA, 12 nt, Salmonella typhimurium LT2
cgcgcgccgccu

SEQ ID NO: 3790050 - RNA, 13 nt, Salmonella typhimurium LT2
cgcgcgccgccug

SEQ ID NO: 3790051 - RNA, 19 nt, Salmonella typhimurium LT2
cgcgcgcuuaaucgagagc

SEQ ID NO: 3790052 - RNA, 16 nt, Salmonella typhimurium LT2
cgcgcggauuccgccg

SEQ ID NO: 3790053 - RNA, 15 nt, Salmonella typhimurium LT2
cgcgcggcaggccuu

SEQ ID NO: 3790054 - RNA, 13 nt, Salmonella typhimurium LT2
cgcgcggcugccg

SEQ ID NO: 3790055 - RNA, 14 nt, Salmonella typhimurium LT2
cgcgcguagcagca

SEQ ID NO: 3790056 - RNA, 13 nt, Salmonella typhimurium LT2
cgcgcgucagcgu

SEQ ID NO: 3790057 - RNA, 19 nt, Salmonella typhimurium LT2
cgcgcgucgcuaaucagca

SEQ ID NO: 3790058 - RNA, 21 nt, Salmonella typhimurium LT2
cgcgcgugguaucgcggcagc

SEQ ID NO: 3790059 - RNA, 15 nt, Salmonella typhimurium LT2
cgcgcuaucaacgcc

SEQ ID NO: 3790060 - RNA, 22 nt, Salmonella typhimurium LT2
cgcgcuaucaacgccuccaggc

SEQ ID NO: 3790061 - RNA, 16 nt, Salmonella typhimurium LT2
cgcgcuaucgguauca

SEQ ID NO: 3790062 - RNA, 16 nt, Salmonella typhimurium LT2
cgcgcuauuccaguuu

SEQ ID NO: 3790063 - RNA, 23 nt, Salmonella typhimurium LT2
cgcgcuauucugcuguuccuggu

SEQ ID NO: 3790064 - RNA, 19 nt, Salmonella typhimurium LT2
cgcgcucaaauggucccug

SEQ ID NO: 3790065 - RNA, 15 nt, Salmonella typhimurium LT2
cgcgcucaagcuggg

SEQ ID NO: 3790066 - RNA, 23 nt, Salmonella typhimurium LT2
cgcgcucaccuccgccaccagcg

SEQ ID NO: 3790067 - RNA, 11 nt, Salmonella typhimurium LT2
cgcgcucgcca

SEQ ID NO: 3790068 - RNA, 14 nt, Salmonella typhimurium LT2
cgcgcucggcagca

SEQ ID NO: 3790069 - RNA, 17 nt, Salmonella typhimurium LT2
cgcgcucuuccgccagc

SEQ ID NO: 3790070 - RNA, 14 nt, Salmonella typhimurium LT2
cgcgcugaccgcac

SEQ ID NO: 3790071 - RNA, 16 nt, Salmonella typhimurium LT2
cgcgcugcaaaaugau

SEQ ID NO: 3790072 - RNA, 13 nt, Salmonella typhimurium LT2
cgcgcugccgccc

SEQ ID NO: 3790073 - RNA, 15 nt, Salmonella typhimurium LT2
cgcgcugccgcccuu

SEQ ID NO: 3790074 - RNA, 12 nt, Salmonella typhimurium LT2
cgcgcuggcaag

SEQ ID NO: 3790075 - RNA, 20 nt, Salmonella typhimurium LT2
cgcgcuggugggacuguuca

SEQ ID NO: 3790076 - RNA, 17 nt, Salmonella typhimurium LT2
cgcgcuguauaaucccg

SEQ ID NO: 3790077 - RNA, 16 nt, Salmonella typhimurium LT2
cgcgcugucugccggc

SEQ ID NO: 3790078 - RNA, 14 nt, Salmonella typhimurium LT2
cgcgcuuaaucgag

SEQ ID NO: 3790079 - RNA, 19 nt, Salmonella typhimurium LT2
cgcgcuuccugccaggccg

SEQ ID NO: 3790080 - RNA, 24 nt, Salmonella typhimurium LT2
cgcgcuuuagggcuuccucgccac

SEQ ID NO: 3790081 - RNA, 16 nt, Salmonella typhimurium LT2
cgcgcuuuucgccagc

SEQ ID NO: 3790082 - RNA, 18 nt, Salmonella typhimurium LT2
cgcgcuuuuuuggcguag

SEQ ID NO: 3790083 - RNA, 18 nt, Salmonella typhimurium LT2
cgcggaaagccuucauca

SEQ ID NO: 3790084 - RNA, 21 nt, Salmonella typhimurium LT2
cgcggaaagccuucaucauca

SEQ ID NO: 3790085 - RNA, 20 nt, Salmonella typhimurium LT2
cgcggaagcgaccggcguca

SEQ ID NO: 3790086 - RNA, 19 nt, Salmonella typhimurium LT2
cgcggaaggaccgucgcac

SEQ ID NO: 3790087 - RNA, 13 nt, Salmonella typhimurium LT2
cgcggaaucguca

SEQ ID NO: 3790088 - RNA, 23 nt, Salmonella typhimurium LT2
cgcggaaucgucacagaccccgc

SEQ ID NO: 3790089 - RNA, 19 nt, Salmonella typhimurium LT2
cgcguggaaauaaucugua

SEQ ID NO: 3790090 - RNA, 18 nt, Salmonella typhimurium LT2
cgcgugguaucgcggcag

SEQ ID NO: 3790091 - RNA, 16 nt, Salmonella typhimurium LT2
cgcguuaagccccucg

SEQ ID NO: 3790092 - RNA, 14 nt, Salmonella typhimurium LT2
cgcguuaauaccgu

SEQ ID NO: 3790093 - RNA, 23 nt, Salmonella typhimurium LT2
cgcguucauccagcgcgcggcau

SEQ ID NO: 3790094 - RNA, 19 nt, Salmonella typhimurium LT2
cgcguucgccgucacgccg

SEQ ID NO: 3790095 - RNA, 18 nt, Salmonella typhimurium LT2
cgcguucugaauaaauug

SEQ ID NO: 3790096 - RNA, 14 nt, Salmonella typhimurium LT2
cgcguucuggcgau

SEQ ID NO: 3790097 - RNA, 15 nt, Salmonella typhimurium LT2
cgcguugaugaaucu

SEQ ID NO: 3790098 - RNA, 12 nt, Salmonella typhimurium LT2
cgcguugccgca

SEQ ID NO: 3790099 - RNA, 21 nt, Salmonella typhimurium LT2
cgcguuguugaucauaaauuc

SEQ ID NO: 3790100 - RNA, 16 nt, Salmonella typhimurium LT2
cgcguuuaccaccgga

SEQ ID NO: 3790101 - RNA, 17 nt, Salmonella typhimurium LT2
cgcguuuagcgccagca

SEQ ID NO: 3790102 - RNA, 15 nt, Salmonella typhimurium LT2
cgcguuuaucaccaa

SEQ ID NO: 3790103 - RNA, 17 nt, Salmonella typhimurium LT2
cgcguuuaucacccuga

SEQ ID NO: 3790104 - RNA, 23 nt, Salmonella typhimurium LT2
cgcguuuuaaaccgcgauaaacc

SEQ ID NO: 3790105 - RNA, 17 nt, Salmonella typhimurium LT2
cgcguuuuccagcaucc

SEQ ID NO: 3790106 - RNA, 13 nt, Salmonella typhimurium LT2
cgcguuuucucau

SEQ ID NO: 3790107 - RNA, 14 nt, Salmonella typhimurium LT2
cgcguuuugccgcu

SEQ ID NO: 3790108 - RNA, 18 nt, Salmonella typhimurium LT2
cgcguuuuucugcccauu

SEQ ID NO: 3790109 - RNA, 15 nt, Salmonella typhimurium LT2
cgcuaaaaaacaggc

SEQ ID NO: 3790110 - RNA, 23 nt, Salmonella typhimurium LT2
cgcuaaaccacaugaccagcgcc

SEQ ID NO: 3790111 - RNA, 17 nt, Salmonella typhimurium LT2
cgcuaaccaggccagau

SEQ ID NO: 3790112 - RNA, 15 nt, Salmonella typhimurium LT2
cgcuaagccagccaa

SEQ ID NO: 3790113 - RNA, 12 nt, Salmonella typhimurium LT2
cgcuaaucccgc

SEQ ID NO: 3790114 - RNA, 22 nt, Salmonella typhimurium LT2
cgcuaauccggccugucaggau

SEQ ID NO: 3790115 - RNA, 14 nt, Salmonella typhimurium LT2
cgcuaaugcccggc

SEQ ID NO: 3790116 - RNA, 17 nt, Salmonella typhimurium LT2
cgcuaauuuucagggug

SEQ ID NO: 3790117 - RNA, 18 nt, Salmonella typhimurium LT2
cgcuacaauccaggacgu

SEQ ID NO: 3790118 - RNA, 13 nt, Salmonella typhimurium LT2
cgcuacagggcgu

SEQ ID NO: 3790119 - RNA, 17 nt, Salmonella typhimurium LT2
cgcuaccagcgcggcgc

SEQ ID NO: 3790120 - RNA, 19 nt, Salmonella typhimurium LT2
cgcuaccagcgcggcgcca

SEQ ID NO: 3790121 - RNA, 18 nt, Salmonella typhimurium LT2
cgcuaccgcaauacgcuu

SEQ ID NO: 3790122 - RNA, 12 nt, Salmonella typhimurium LT2
cgcuaccuuuuu

SEQ ID NO: 3790123 - RNA, 20 nt, Salmonella typhimurium LT2
cgcuacgcuuaucaggccua

SEQ ID NO: 3790124 - RNA, 14 nt, Salmonella typhimurium LT2
cgcuacguuuaucu

SEQ ID NO: 3790125 - RNA, 17 nt, Salmonella typhimurium LT2
cgcuacguuuaucuggc

SEQ ID NO: 3790126 - RNA, 14 nt, Salmonella typhimurium LT2
cgcuacucagcguc

SEQ ID NO: 3790127 - RNA, 15 nt, Salmonella typhimurium LT2
cgcuacucagcguca

SEQ ID NO: 3790128 - RNA, 18 nt, Salmonella typhimurium LT2
cgcuacuccgcccuaauc

SEQ ID NO: 3790129 - RNA, 15 nt, Salmonella typhimurium LT2
cgcuacugccgccau

SEQ ID NO: 3790130 - RNA, 16 nt, Salmonella typhimurium LT2
cgcuacugccgccauc

SEQ ID NO: 3790131 - RNA, 18 nt, Salmonella typhimurium LT2
cgcuagcuucagguguua

SEQ ID NO: 3790132 - RNA, 23 nt, Salmonella typhimurium LT2
cgcuauaagcggcgucauccgga

SEQ ID NO: 3790133 - RNA, 14 nt, Salmonella typhimurium LT2
cgcuauauuccagc

SEQ ID NO: 3790134 - RNA, 21 nt, Salmonella typhimurium LT2
cgcuaucaacgccuccaggcu

SEQ ID NO: 3790135 - RNA, 15 nt, Salmonella typhimurium LT2
cgcuaucacagcggc

SEQ ID NO: 3790136 - RNA, 12 nt, Salmonella typhimurium LT2
cgcuaucaggca

SEQ ID NO: 3790137 - RNA, 14 nt, Salmonella typhimurium LT2
cgcuauccagcagu

SEQ ID NO: 3790138 - RNA, 18 nt, Salmonella typhimurium LT2
cgcuauccaggccgucgg

SEQ ID NO: 3790139 - RNA, 15 nt, Salmonella typhimurium LT2
cgcuauccaucgccg

SEQ ID NO: 3790140 - RNA, 15 nt, Salmonella typhimurium LT2
cgcuaucgaccaccg

SEQ ID NO: 3790141 - RNA, 17 nt, Salmonella typhimurium LT2
cgcuaucgaccagcacc

SEQ ID NO: 3790142 - RNA, 12 nt, Salmonella typhimurium LT2
cgcuaucgccaa

SEQ ID NO: 3790143 - RNA, 12 nt, Salmonella typhimurium LT2
cgcuaucgccga

SEQ ID NO: 3790144 - RNA, 17 nt, Salmonella typhimurium LT2
cgcuaucugcuccgcca

SEQ ID NO: 3790145 - RNA, 16 nt, Salmonella typhimurium LT2
cgcuaugaugacuggu

SEQ ID NO: 3790146 - RNA, 15 nt, Salmonella typhimurium LT2
cgcuauguucaugcu

SEQ ID NO: 3790147 - RNA, 19 nt, Salmonella typhimurium LT2
cgcuauuaccccgcggcau

SEQ ID NO: 3790148 - RNA, 20 nt, Salmonella typhimurium LT2
cgcuauuggaagaaauccca

SEQ ID NO: 3790149 - RNA, 16 nt, Salmonella typhimurium LT2
cgcucaaaaaaggccc

SEQ ID NO: 3790150 - RNA, 21 nt, Salmonella typhimurium LT2
cgcucaaauaucccuucucau

SEQ ID NO: 3790151 - RNA, 18 nt, Salmonella typhimurium LT2
cgcucaacauugcucaua

SEQ ID NO: 3790152 - RNA, 16 nt, Salmonella typhimurium LT2
cgcucaacgauuucgc

SEQ ID NO: 3790153 - RNA, 21 nt, Salmonella typhimurium LT2
cgcucaacgcguucauccagc

SEQ ID NO: 3790154 - RNA, 13 nt, Salmonella typhimurium LT2
cgcucaauaauau

SEQ ID NO: 3790155 - RNA, 15 nt, Salmonella typhimurium LT2
cgcucaauaauaucc

SEQ ID NO: 3790156 - RNA, 16 nt, Salmonella typhimurium LT2
cgcucaauaauauccu

SEQ ID NO: 3790157 - RNA, 14 nt, Salmonella typhimurium LT2
cgcucaauguggcu

SEQ ID NO: 3790158 - RNA, 22 nt, Salmonella typhimurium LT2
cgcucaauuauuaaucuuuaca

SEQ ID NO: 3790159 - RNA, 15 nt, Salmonella typhimurium LT2
cgcucaccgacuccu

SEQ ID NO: 3790160 - RNA, 14 nt, Salmonella typhimurium LT2
cgcucaccggcccc

SEQ ID NO: 3790161 - RNA, 16 nt, Salmonella typhimurium LT2
cgcucaccuccgccac

SEQ ID NO: 3790162 - RNA, 20 nt, Salmonella typhimurium LT2
cgcucaccuccgccaccagc

SEQ ID NO: 3790163 - RNA, 13 nt, Salmonella typhimurium LT2
cgcucacgauaac

SEQ ID NO: 3790164 - RNA, 14 nt, Salmonella typhimurium LT2
cgcucacgauaacg

SEQ ID NO: 3790165 - RNA, 21 nt, Salmonella typhimurium LT2
cgcucacgguuucuacuucca

SEQ ID NO: 3790166 - RNA, 16 nt, Salmonella typhimurium LT2
cgcucacuaccgccgc

SEQ ID NO: 3790167 - RNA, 17 nt, Salmonella typhimurium LT2
cgcucacugguugccca

SEQ ID NO: 3790168 - RNA, 22 nt, Salmonella typhimurium LT2
cgcucagaacaauaucgauagc

SEQ ID NO: 3790169 - RNA, 15 nt, Salmonella typhimurium LT2
cgcucagauaacaua

SEQ ID NO: 3790170 - RNA, 18 nt, Salmonella typhimurium LT2
cgcucaggagcgccugac

SEQ ID NO: 3790171 - RNA, 23 nt, Salmonella typhimurium LT2
cgcucagguuguccagcagcagc

SEQ ID NO: 3790172 - RNA, 15 nt, Salmonella typhimurium LT2
cgcucagucacuuca

SEQ ID NO: 3790173 - RNA, 20 nt, Salmonella typhimurium LT2
cgcucaucacaucgcgcagc

SEQ ID NO: 3790174 - RNA, 15 nt, Salmonella typhimurium LT2
cgcucaugcgcgucc

SEQ ID NO: 3790175 - RNA, 22 nt, Salmonella typhimurium LT2
cgcucauuaaaccgcgcggcau

SEQ ID NO: 3790176 - RNA, 15 nt, Salmonella typhimurium LT2
cgcuccacgcguccu

SEQ ID NO: 3790177 - RNA, 19 nt, Salmonella typhimurium LT2
cgcuccacugauaguccau

SEQ ID NO: 3790178 - RNA, 11 nt, Salmonella typhimurium LT2
cgcuccagaag

SEQ ID NO: 3790179 - RNA, 18 nt, Salmonella typhimurium LT2
cgcuccagaccaccagcg

SEQ ID NO: 3790180 - RNA, 21 nt, Salmonella typhimurium LT2
cgcuccagaccaccagcgaca

SEQ ID NO: 3790181 - RNA, 14 nt, Salmonella typhimurium LT2
cgcuccagcaguuc

SEQ ID NO: 3790182 - RNA, 12 nt, Salmonella typhimurium LT2
cgcucccgccca

SEQ ID NO: 3790183 - RNA, 22 nt, Salmonella typhimurium LT2
cgcucccggaaccgaccgcgau

SEQ ID NO: 3790184 - RNA, 13 nt, Salmonella typhimurium LT2
cgcucccggcacc

SEQ ID NO: 3790185 - RNA, 15 nt, Salmonella typhimurium LT2
cgcuccgacaaacuu

SEQ ID NO: 3790186 - RNA, 21 nt, Salmonella typhimurium LT2
cgcuccgacaaacuucaucgc

SEQ ID NO: 3790187 - RNA, 21 nt, Salmonella typhimurium LT2
cgcuccggcacuggcgcuggc

SEQ ID NO: 3790188 - RNA, 21 nt, Salmonella typhimurium LT2
cgcuccugcgguacggccagc

SEQ ID NO: 3790189 - RNA, 14 nt, Salmonella typhimurium LT2
cgcuccugcuccca

SEQ ID NO: 3790190 - RNA, 16 nt, Salmonella typhimurium LT2
cgcuccugcucccaga

SEQ ID NO: 3790191 - RNA, 14 nt, Salmonella typhimurium LT2
cgcuccugcucuuc

SEQ ID NO: 3790192 - RNA, 19 nt, Salmonella typhimurium LT2
cgcuccuugagcgccugga

SEQ ID NO: 3790193 - RNA, 15 nt, Salmonella typhimurium LT2
cgcucgaaucgccau

SEQ ID NO: 3790194 - RNA, 15 nt, Salmonella typhimurium LT2
cgcuggcugccgcca

SEQ ID NO: 3790195 - RNA, 18 nt, Salmonella typhimurium LT2
cgcugguaauccguggca

SEQ ID NO: 3790196 - RNA, 21 nt, Salmonella typhimurium LT2
cgcuggucagcagaaacuggc

SEQ ID NO: 3790197 - RNA, 16 nt, Salmonella typhimurium LT2
cgcuggugccaaucuc

SEQ ID NO: 3790198 - RNA, 15 nt, Salmonella typhimurium LT2
cgcugguuggcgcgc

SEQ ID NO: 3790199 - RNA, 15 nt, Salmonella typhimurium LT2
cgcuguaaaccggcc

SEQ ID NO: 3790200 - RNA, 16 nt, Salmonella typhimurium LT2
cgcuguaaaccggccc

SEQ ID NO: 3790201 - RNA, 17 nt, Salmonella typhimurium LT2
cgcuguaaaucugauaa

SEQ ID NO: 3790202 - RNA, 21 nt, Salmonella typhimurium LT2
cgcuguaaauguuguuccaga

SEQ ID NO: 3790203 - RNA, 18 nt, Salmonella typhimurium LT2
cgcuguaacuucacgcca

SEQ ID NO: 3790204 - RNA, 19 nt, Salmonella typhimurium LT2
cgcuguaacuucacgccau

SEQ ID NO: 3790205 - RNA, 19 nt, Salmonella typhimurium LT2
cgcuguaccgccauccggc

SEQ ID NO: 3790206 - RNA, 14 nt, Salmonella typhimurium LT2
cgcugucaccagca

SEQ ID NO: 3790207 - RNA, 16 nt, Salmonella typhimurium LT2
cgcugucaccagcagc

SEQ ID NO: 3790208 - RNA, 22 nt, Salmonella typhimurium LT2
cgcugucaccagcagcauuuca

SEQ ID NO: 3790209 - RNA, 13 nt, Salmonella typhimurium LT2
cgcugucagcaca

SEQ ID NO: 3790210 - RNA, 18 nt, Salmonella typhimurium LT2
cgcugucgcuaauccggc

SEQ ID NO: 3790211 - RNA, 19 nt, Salmonella typhimurium LT2
cgcugucgcuaauccggcc

SEQ ID NO: 3790212 - RNA, 15 nt, Salmonella typhimurium LT2
cgcugucggcgguaa

SEQ ID NO: 3790213 - RNA, 24 nt, Salmonella typhimurium LT2
cgcugucuauccacugucgggcaa

SEQ ID NO: 3790214 - RNA, 21 nt, Salmonella typhimurium LT2
cgcugugacaggcgcuguucu

SEQ ID NO: 3790215 - RNA, 19 nt, Salmonella typhimurium LT2
cgcugugcggcgugcagau

SEQ ID NO: 3790216 - RNA, 20 nt, Salmonella typhimurium LT2
cgcuguuguugacaccacgg

SEQ ID NO: 3790217 - RNA, 17 nt, Salmonella typhimurium LT2
cgcuuaacggcccaggc

SEQ ID NO: 3790218 - RNA, 14 nt, Salmonella typhimurium LT2
cgcuuaacuccggc

SEQ ID NO: 3790219 - RNA, 20 nt, Salmonella typhimurium LT2
cgcuuaaugaggccaccagu

SEQ ID NO: 3790220 - RNA, 20 nt, Salmonella typhimurium LT2
cgcuuaauggcgucaaucaa

SEQ ID NO: 3790221 - RNA, 16 nt, Salmonella typhimurium LT2
cgcuuacaguuuaucu

SEQ ID NO: 3790222 - RNA, 21 nt, Salmonella typhimurium LT2
cgcuuaccacuuugcgcuccu

SEQ ID NO: 3790223 - RNA, 19 nt, Salmonella typhimurium LT2
cgcuuaccaggccuacacg

SEQ ID NO: 3790224 - RNA, 14 nt, Salmonella typhimurium LT2
cgcuuaccgggccu

SEQ ID NO: 3790225 - RNA, 19 nt, Salmonella typhimurium LT2
cgcuuaccgggccuaccgc

SEQ ID NO: 3790226 - RNA, 18 nt, Salmonella typhimurium LT2
cgcuuacgcggcgcgcuc

SEQ ID NO: 3790227 - RNA, 19 nt, Salmonella typhimurium LT2
cgcuuaucaggccuacaac

SEQ ID NO: 3790228 - RNA, 20 nt, Salmonella typhimurium LT2
cgcuuaucaggccuacaacg

SEQ ID NO: 3790229 - RNA, 23 nt, Salmonella typhimurium LT2
cgcuuaucaggccuacaucuggc

SEQ ID NO: 3790230 - RNA, 17 nt, Salmonella typhimurium LT2
cgcuuaucaggccuacc

SEQ ID NO: 3790231 - RNA, 15 nt, Salmonella typhimurium LT2
cgcuuauccagccac

SEQ ID NO: 3790232 - RNA, 14 nt, Salmonella typhimurium LT2
cgcuuauccggccu

SEQ ID NO: 3790233 - RNA, 18 nt, Salmonella typhimurium LT2
cgcuuaucgccguaaccg

SEQ ID NO: 3790234 - RNA, 19 nt, Salmonella typhimurium LT2
cgcuuaucgggccuacaag

SEQ ID NO: 3790235 - RNA, 17 nt, Salmonella typhimurium LT2
cgcuuaucgggcuuacg

SEQ ID NO: 3790236 - RNA, 18 nt, Salmonella typhimurium LT2
cgcuuauuccuccgccga

SEQ ID NO: 3790237 - RNA, 19 nt, Salmonella typhimurium LT2
cgcuuauucggccuacaga

SEQ ID NO: 3790238 - RNA, 20 nt, Salmonella typhimurium LT2
cgcuuauucggcuuacccaa

SEQ ID NO: 3790239 - RNA, 14 nt, Salmonella typhimurium LT2
cgcuuauugaugac

SEQ ID NO: 3790240 - RNA, 14 nt, Salmonella typhimurium LT2
cgcuucaccggcgu

SEQ ID NO: 3790241 - RNA, 22 nt, Salmonella typhimurium LT2
cgcuucacgagcggucaggcca

SEQ ID NO: 3790242 - RNA, 14 nt, Salmonella typhimurium LT2
cgcuucacgcggau

SEQ ID NO: 3790243 - RNA, 22 nt, Salmonella typhimurium LT2
cgcuuccagaugaagcgcaucg

SEQ ID NO: 3790244 - RNA, 15 nt, Salmonella typhimurium LT2
cgcuuccagcgcguc

SEQ ID NO: 3790245 - RNA, 17 nt, Salmonella typhimurium LT2
cgcuuccaguuuugcca

SEQ ID NO: 3790246 - RNA, 15 nt, Salmonella typhimurium LT2
cgcuucccagcgucg

SEQ ID NO: 3790247 - RNA, 11 nt, Salmonella typhimurium LT2
cgcuucccagu

SEQ ID NO: 3790248 - RNA, 13 nt, Salmonella typhimurium LT2
cgcuuccgucacc

SEQ ID NO: 3790249 - RNA, 16 nt, Salmonella typhimurium LT2
cgcuucgaugcguuca

SEQ ID NO: 3790250 - RNA, 14 nt, Salmonella typhimurium LT2
cgcuucgcgcgcca

SEQ ID NO: 3790251 - RNA, 19 nt, Salmonella typhimurium LT2
cgcuucgcucccucaucaa

SEQ ID NO: 3790252 - RNA, 20 nt, Salmonella typhimurium LT2
cgcuucgcuuaccaggccua

SEQ ID NO: 3790253 - RNA, 20 nt, Salmonella typhimurium LT2
cgcuucgcuuaucaggccua

SEQ ID NO: 3790254 - RNA, 17 nt, Salmonella typhimurium LT2
cgcuucgcuuauccggc

SEQ ID NO: 3790255 - RNA, 19 nt, Salmonella typhimurium LT2
cgcuucgcuugcccggccu

SEQ ID NO: 3790256 - RNA, 21 nt, Salmonella typhimurium LT2
cgcuucggugaucuccucgcc

SEQ ID NO: 3790257 - RNA, 16 nt, Salmonella typhimurium LT2
cgcuucuacagccacc

SEQ ID NO: 3790258 - RNA, 17 nt, Salmonella typhimurium LT2
cgcuucuucuaccaccu

SEQ ID NO: 3790259 - RNA, 18 nt, Salmonella typhimurium LT2
cgcuugacucugaagcgg

SEQ ID NO: 3790260 - RNA, 15 nt, Salmonella typhimurium LT2
cgcuugagcaggcuu

SEQ ID NO: 3790261 - RNA, 18 nt, Salmonella typhimurium LT2
cgcuugagcgccuuaucg

SEQ ID NO: 3790262 - RNA, 16 nt, Salmonella typhimurium LT2
cgcuugcaccauggcg

SEQ ID NO: 3790263 - RNA, 12 nt, Salmonella typhimurium LT2
cgcuugccacua

SEQ ID NO: 3790264 - RNA, 21 nt, Salmonella typhimurium LT2
cgcuugccaguacgccaggcu

SEQ ID NO: 3790265 - RNA, 19 nt, Salmonella typhimurium LT2
cgcuugcccggaucgccau

SEQ ID NO: 3790266 - RNA, 17 nt, Salmonella typhimurium LT2
cgcuugcccggccuaca

SEQ ID NO: 3790267 - RNA, 23 nt, Salmonella typhimurium LT2
cgcuuguaaauugcgucaucauc

SEQ ID NO: 3790268 - RNA, 14 nt, Salmonella typhimurium LT2
cgcuuuaccgccuu

SEQ ID NO: 3790269 - RNA, 15 nt, Salmonella typhimurium LT2
cgcuuuaccgccuuc

SEQ ID NO: 3790270 - RNA, 21 nt, Salmonella typhimurium LT2
cgcuuucaaaaugacaaauuu

SEQ ID NO: 3790271 - RNA, 22 nt, Salmonella typhimurium LT2
cgcuuucaaaaugacaaauuua

SEQ ID NO: 3790272 - RNA, 16 nt, Salmonella typhimurium LT2
cgcuuucaccgccuca

SEQ ID NO: 3790273 - RNA, 13 nt, Salmonella typhimurium LT2
cgcuuucauacga

SEQ ID NO: 3790274 - RNA, 14 nt, Salmonella typhimurium LT2
cgcuuuccauuacg

SEQ ID NO: 3790275 - RNA, 20 nt, Salmonella typhimurium LT2
cgcuuucgccacgcucacuu

SEQ ID NO: 3790276 - RNA, 13 nt, Salmonella typhimurium LT2
cgcuuucgccugg

SEQ ID NO: 3790277 - RNA, 17 nt, Salmonella typhimurium LT2
cgcuuucuucuucacga

SEQ ID NO: 3790278 - RNA, 13 nt, Salmonella typhimurium LT2
cgcuuugaucagc

SEQ ID NO: 3790279 - RNA, 15 nt, Salmonella typhimurium LT2
cgcuuugccagcauc

SEQ ID NO: 3790280 - RNA, 17 nt, Salmonella typhimurium LT2
cgcuuugcuuauccggc

SEQ ID NO: 3790281 - RNA, 20 nt, Salmonella typhimurium LT2
cgcuuugcuuauccggccua

SEQ ID NO: 3790282 - RNA, 22 nt, Salmonella typhimurium LT2
cgcuuugcuuauccggccuaca

SEQ ID NO: 3790283 - RNA, 19 nt, Salmonella typhimurium LT2
cgcuuugugcuccaccagc

SEQ ID NO: 3790284 - RNA, 20 nt, Salmonella typhimurium LT2
cgcuuugugcuccaccagcc

SEQ ID NO: 3790285 - RNA, 16 nt, Salmonella typhimurium LT2
cgcuuuuaggcugaaa

SEQ ID NO: 3790286 - RNA, 14 nt, Salmonella typhimurium LT2
cgcuuuuauccggc

SEQ ID NO: 3790287 - RNA, 16 nt, Salmonella typhimurium LT2
cgcuuuuccaggcgac

SEQ ID NO: 3790288 - RNA, 13 nt, Salmonella typhimurium LT2
cgcuuuuccccgc

SEQ ID NO: 3790289 - RNA, 20 nt, Salmonella typhimurium LT2
cgcuuuugccgugacuuccg

SEQ ID NO: 3790290 - RNA, 18 nt, Salmonella typhimurium LT2
cgcuuuugcgucaucagu

SEQ ID NO: 3790291 - RNA, 19 nt, Salmonella typhimurium LT2
cgcuuuuuaccggcgacca

SEQ ID NO: 3790292 - RNA, 14 nt, Salmonella typhimurium LT2
cgcuuuuugcgcca

SEQ ID NO: 3790293 - RNA, 12 nt, Salmonella typhimurium LT2
cgcuuuuuguag

SEQ ID NO: 3790294 - RNA, 14 nt, Salmonella typhimurium LT2
cgcuuuuuucucug

SEQ ID NO: 3790295 - RNA, 21 nt, Salmonella typhimurium LT2
cggaaaccagauaccccgcca

SEQ ID NO: 3790296 - RNA, 16 nt, Salmonella typhimurium LT2
cggaaaccccagguca

SEQ ID NO: 3790297 - RNA, 20 nt, Salmonella typhimurium LT2
cggaaacgucauuuuuucaa

SEQ ID NO: 3790298 - RNA, 16 nt, Salmonella typhimurium LT2
cggauagcguagcgcc

SEQ ID NO: 3790299 - RNA, 18 nt, Salmonella typhimurium LT2
cggauagcguagcgccau

SEQ ID NO: 3790300 - RNA, 21 nt, Salmonella typhimurium LT2
cggauagcucgcuguaccgcc

SEQ ID NO: 3790301 - RNA, 23 nt, Salmonella typhimurium LT2
cggauagcucgcuguaccgccau

SEQ ID NO: 3790302 - RNA, 19 nt, Salmonella typhimurium LT2
cggauaguaucuuauccgg

SEQ ID NO: 3790303 - RNA, 14 nt, Salmonella typhimurium LT2
cggauagucaucgc

SEQ ID NO: 3790304 - RNA, 15 nt, Salmonella typhimurium LT2
cggauagucaucgcc

SEQ ID NO: 3790305 - RNA, 16 nt, Salmonella typhimurium LT2
cggauaugcagcagcc

SEQ ID NO: 3790306 - RNA, 19 nt, Salmonella typhimurium LT2
cggaucaaaaaggugagca

SEQ ID NO: 3790307 - RNA, 15 nt, Salmonella typhimurium LT2
cggaucaauaaacag

SEQ ID NO: 3790308 - RNA, 19 nt, Salmonella typhimurium LT2
cggaucaaucaccaccagg

SEQ ID NO: 3790309 - RNA, 20 nt, Salmonella typhimurium LT2
cggaucaaucaccaccaggu

SEQ ID NO: 3790310 - RNA, 16 nt, Salmonella typhimurium LT2
cggaucaccggcauuu

SEQ ID NO: 3790311 - RNA, 19 nt, Salmonella typhimurium LT2
cggaucagccugagcgcca

SEQ ID NO: 3790312 - RNA, 18 nt, Salmonella typhimurium LT2
cggaucgacggcaacaua

SEQ ID NO: 3790313 - RNA, 21 nt, Salmonella typhimurium LT2
cggaucgccaucgacagcagc

SEQ ID NO: 3790314 - RNA, 15 nt, Salmonella typhimurium LT2
cggaucggaacgcga

SEQ ID NO: 3790315 - RNA, 17 nt, Salmonella typhimurium LT2
cggaugacacaucaccu

SEQ ID NO: 3790316 - RNA, 20 nt, Salmonella typhimurium LT2
cggaugacgacaucugcaca

SEQ ID NO: 3790317 - RNA, 15 nt, Salmonella typhimurium LT2
cggaugacgccgcuu

SEQ ID NO: 3790318 - RNA, 20 nt, Salmonella typhimurium LT2
cggaugaggcgcagccgcca

SEQ ID NO: 3790319 - RNA, 15 nt, Salmonella typhimurium LT2
cggaugaucaacggc

SEQ ID NO: 3790320 - RNA, 17 nt, Salmonella typhimurium LT2
cggaugccgcaucuuua

SEQ ID NO: 3790321 - RNA, 21 nt, Salmonella typhimurium LT2
cggaugcgcaaucacccacgu

SEQ ID NO: 3790322 - RNA, 15 nt, Salmonella typhimurium LT2
cggaugcgccgugcu

SEQ ID NO: 3790323 - RNA, 14 nt, Salmonella typhimurium LT2
cggaugcgggccga

SEQ ID NO: 3790324 - RNA, 15 nt, Salmonella typhimurium LT2
cggauggagcggcgc

SEQ ID NO: 3790325 - RNA, 20 nt, Salmonella typhimurium LT2
cggauggccugcucgauacc

SEQ ID NO: 3790326 - RNA, 13 nt, Salmonella typhimurium LT2
cggauggcgacgc

SEQ ID NO: 3790327 - RNA, 14 nt, Salmonella typhimurium LT2
cggauggcgcugcg

SEQ ID NO: 3790328 - RNA, 16 nt, Salmonella typhimurium LT2
cggauggcggcuaccu

SEQ ID NO: 3790329 - RNA, 18 nt, Salmonella typhimurium LT2
cggaugguggcguaaaua

SEQ ID NO: 3790330 - RNA, 15 nt, Salmonella typhimurium LT2
cggaugugagcgcau

SEQ ID NO: 3790331 - RNA, 20 nt, Salmonella typhimurium LT2
cggauucaauauugaacauu

SEQ ID NO: 3790332 - RNA, 14 nt, Salmonella typhimurium LT2
cggauuccagaaua

SEQ ID NO: 3790333 - RNA, 22 nt, Salmonella typhimurium LT2
cggauucucuaacgucagcgcc

SEQ ID NO: 3790334 - RNA, 14 nt, Salmonella typhimurium LT2
cggauucuuccucu

SEQ ID NO: 3790335 - RNA, 18 nt, Salmonella typhimurium LT2
cggauugccgcgcucaau

SEQ ID NO: 3790336 - RNA, 24 nt, Salmonella typhimurium LT2
cggauugccuucucugucgagcau

SEQ ID NO: 3790337 - RNA, 22 nt, Salmonella typhimurium LT2
cggauugucaucugacugcgug

SEQ ID NO: 3790338 - RNA, 16 nt, Salmonella typhimurium LT2
cggauuucguaccgaa

SEQ ID NO: 3790339 - RNA, 20 nt, Salmonella typhimurium LT2
cggcaaaaaauauagccauu

SEQ ID NO: 3790340 - RNA, 23 nt, Salmonella typhimurium LT2
cggcaaacacaaaaugcccuucu

SEQ ID NO: 3790341 - RNA, 23 nt, Salmonella typhimurium LT2
cggcaaacacaaucacacccagc

SEQ ID NO: 3790342 - RNA, 15 nt, Salmonella typhimurium LT2
cggcaaacagccuca

SEQ ID NO: 3790343 - RNA, 23 nt, Salmonella typhimurium LT2
cggcaaacggggggauucauuau

SEQ ID NO: 3790344 - RNA, 18 nt, Salmonella typhimurium LT2
cggcaaagucuucauggu

SEQ ID NO: 3790345 - RNA, 17 nt, Salmonella typhimurium LT2
cggcaaauacaucgcca

SEQ ID NO: 3790346 - RNA, 16 nt, Salmonella typhimurium LT2
cggcaaccaacgccca

SEQ ID NO: 3790347 - RNA, 23 nt, Salmonella typhimurium LT2
cggcaaccagcccaugaaugagc

SEQ ID NO: 3790348 - RNA, 12 nt, Salmonella typhimurium LT2
cggcaacccgcu

SEQ ID NO: 3790349 - RNA, 22 nt, Salmonella typhimurium LT2
cggcaacccuuuggccaccagc

SEQ ID NO: 3790350 - RNA, 13 nt, Salmonella typhimurium LT2
cggcaaccggauc

SEQ ID NO: 3790351 - RNA, 12 nt, Salmonella typhimurium LT2
cggcaacugcgc

SEQ ID NO: 3790352 - RNA, 18 nt, Salmonella typhimurium LT2
cggcaagcgcgccauaac

SEQ ID NO: 3790353 - RNA, 17 nt, Salmonella typhimurium LT2
cggcaagcgcugggcga

SEQ ID NO: 3790354 - RNA, 15 nt, Salmonella typhimurium LT2
cggcaauaagcgcca

SEQ ID NO: 3790355 - RNA, 16 nt, Salmonella typhimurium LT2
cggcaauaucccgcca

SEQ ID NO: 3790356 - RNA, 23 nt, Salmonella typhimurium LT2
cggcaauauccugugucggcaga

SEQ ID NO: 3790357 - RNA, 15 nt, Salmonella typhimurium LT2
cggcaaucaauacag

SEQ ID NO: 3790358 - RNA, 17 nt, Salmonella typhimurium LT2
cggcaaucagcgccccc

SEQ ID NO: 3790359 - RNA, 14 nt, Salmonella typhimurium LT2
cggcaauccaucac

SEQ ID NO: 3790360 - RNA, 23 nt, Salmonella typhimurium LT2
cggcaauggcuuaguaggcuggc

SEQ ID NO: 3790361 - RNA, 15 nt, Salmonella typhimurium LT2
cggcaauuaccgcca

SEQ ID NO: 3790362 - RNA, 16 nt, Salmonella typhimurium LT2
cggcaauuuccggcga

SEQ ID NO: 3790363 - RNA, 15 nt, Salmonella typhimurium LT2
cggcacaaccuggcu

SEQ ID NO: 3790364 - RNA, 13 nt, Salmonella typhimurium LT2
cggcacacagcac

SEQ ID NO: 3790365 - RNA, 13 nt, Salmonella typhimurium LT2
cggcacagccagu

SEQ ID NO: 3790366 - RNA, 19 nt, Salmonella typhimurium LT2
cggcacauauuccggcgcu

SEQ ID NO: 3790367 - RNA, 15 nt, Salmonella typhimurium LT2
cggcaccacauuaaa

SEQ ID NO: 3790368 - RNA, 13 nt, Salmonella typhimurium LT2
cggcaccagaauc

SEQ ID NO: 3790369 - RNA, 13 nt, Salmonella typhimurium LT2
cggcaccagccag

SEQ ID NO: 3790370 - RNA, 19 nt, Salmonella typhimurium LT2
cggcaccauuggcgcguca

SEQ ID NO: 3790371 - RNA, 14 nt, Salmonella typhimurium LT2
cggcacgagcacug

SEQ ID NO: 3790372 - RNA, 13 nt, Salmonella typhimurium LT2
cggcacgcaggcu

SEQ ID NO: 3790373 - RNA, 13 nt, Salmonella typhimurium LT2
cggcacgccagcg

SEQ ID NO: 3790374 - RNA, 20 nt, Salmonella typhimurium LT2
cggcacgcuaaaccacauga

SEQ ID NO: 3790375 - RNA, 17 nt, Salmonella typhimurium LT2
cggcacgguaaaccucu

SEQ ID NO: 3790376 - RNA, 23 nt, Salmonella typhimurium LT2
cggcacguacugcaccaaauccu

SEQ ID NO: 3790377 - RNA, 20 nt, Salmonella typhimurium LT2
cggcacguugucccaggcca

SEQ ID NO: 3790378 - RNA, 16 nt, Salmonella typhimurium LT2
cggcacguuuuccagg

SEQ ID NO: 3790379 - RNA, 17 nt, Salmonella typhimurium LT2
cggcacguuuuccaggu

SEQ ID NO: 3790380 - RNA, 23 nt, Salmonella typhimurium LT2
cggcacucaccucuuccgccagg

SEQ ID NO: 3790381 - RNA, 15 nt, Salmonella typhimurium LT2
cggcacugcuuuucg

SEQ ID NO: 3790382 - RNA, 13 nt, Salmonella typhimurium LT2
cggcacuggcgcu

SEQ ID NO: 3790383 - RNA, 14 nt, Salmonella typhimurium LT2
cggcagacgauagc

SEQ ID NO: 3790384 - RNA, 16 nt, Salmonella typhimurium LT2
cggcagauccuggcgc

SEQ ID NO: 3790385 - RNA, 17 nt, Salmonella typhimurium LT2
cggcagauuaccggcaa

SEQ ID NO: 3790386 - RNA, 18 nt, Salmonella typhimurium LT2
cggcagauuaccggcaau

SEQ ID NO: 3790387 - RNA, 14 nt, Salmonella typhimurium LT2
cggcagcagcuuca

SEQ ID NO: 3790388 - RNA, 17 nt, Salmonella typhimurium LT2
cggcagccgacagcgua

SEQ ID NO: 3790389 - RNA, 16 nt, Salmonella typhimurium LT2
cggcagccgccaccac

SEQ ID NO: 3790390 - RNA, 17 nt, Salmonella typhimurium LT2
cggcagccgccaccaca

SEQ ID NO: 3790391 - RNA, 16 nt, Salmonella typhimurium LT2
cggcagccggaacggg

SEQ ID NO: 3790392 - RNA, 21 nt, Salmonella typhimurium LT2
cggcagccugccgcaucugac

SEQ ID NO: 3790393 - RNA, 23 nt, Salmonella typhimurium LT2
cggcagcgcauaagccacuucaa

SEQ ID NO: 3790394 - RNA, 20 nt, Salmonella typhimurium LT2
cggcagcgggugagcgcuau

SEQ ID NO: 3790395 - RNA, 18 nt, Salmonella typhimurium LT2
cggcagcgucguccagcc

SEQ ID NO: 3790396 - RNA, 22 nt, Salmonella typhimurium LT2
cggcagcgucguccagcccggc

SEQ ID NO: 3790397 - RNA, 13 nt, Salmonella typhimurium LT2
cggcagcguuacg

SEQ ID NO: 3790398 - RNA, 17 nt, Salmonella typhimurium LT2
cggcaggaugaaugacu

SEQ ID NO: 3790399 - RNA, 13 nt, Salmonella typhimurium LT2
cggcaggcaauac

SEQ ID NO: 3790400 - RNA, 22 nt, Salmonella typhimurium LT2
cggcaggcaucgcgccgccggg

SEQ ID NO: 3790401 - RNA, 18 nt, Salmonella typhimurium LT2
cggcaggcccgauaaacg

SEQ ID NO: 3790402 - RNA, 16 nt, Salmonella typhimurium LT2
cggcgagguacugcau

SEQ ID NO: 3790403 - RNA, 15 nt, Salmonella typhimurium LT2
cggcgagucgcgccc

SEQ ID NO: 3790404 - RNA, 16 nt, Salmonella typhimurium LT2
cggcgagucgcgccca

SEQ ID NO: 3790405 - RNA, 16 nt, Salmonella typhimurium LT2
cggcgauagcgcccca

SEQ ID NO: 3790406 - RNA, 22 nt, Salmonella typhimurium LT2
cggcgcaaacaguacgcccgcu

SEQ ID NO: 3790407 - RNA, 17 nt, Salmonella typhimurium LT2
cggcgcaaauggcugcg

SEQ ID NO: 3790408 - RNA, 21 nt, Salmonella typhimurium LT2
cggcgcaaccauuaccgccaa

SEQ ID NO: 3790409 - RNA, 19 nt, Salmonella typhimurium LT2
cggcgcacacccugcagac

SEQ ID NO: 3790410 - RNA, 19 nt, Salmonella typhimurium LT2
cggcgcagacacugccacc

SEQ ID NO: 3790411 - RNA, 12 nt, Salmonella typhimurium LT2
cggcgcagcgaa

SEQ ID NO: 3790412 - RNA, 13 nt, Salmonella typhimurium LT2
cggcgcagggcga

SEQ ID NO: 3790413 - RNA, 18 nt, Salmonella typhimurium LT2
cggcgcauuuucggcagc

SEQ ID NO: 3790414 - RNA, 22 nt, Salmonella typhimurium LT2
cggcgcauuuucggcagcgcga

SEQ ID NO: 3790415 - RNA, 22 nt, Salmonella typhimurium LT2
cggcgccaacaaucgggaacag

SEQ ID NO: 3790416 - RNA, 20 nt, Salmonella typhimurium LT2
cggcgccaaucaccgccagc

SEQ ID NO: 3790417 - RNA, 21 nt, Salmonella typhimurium LT2
cggcgccaaucaccgccagca

SEQ ID NO: 3790418 - RNA, 15 nt, Salmonella typhimurium LT2
cggcgccacgcgcca

SEQ ID NO: 3790419 - RNA, 17 nt, Salmonella typhimurium LT2
cggcgccauccggcaga

SEQ ID NO: 3790420 - RNA, 22 nt, Salmonella typhimurium LT2
cggcgccaugauccagcggaac

SEQ ID NO: 3790421 - RNA, 19 nt, Salmonella typhimurium LT2
cggcgccauuccugccgcc

SEQ ID NO: 3790422 - RNA, 23 nt, Salmonella typhimurium LT2
cggcgcccagccugcccgccuga

SEQ ID NO: 3790423 - RNA, 15 nt, Salmonella typhimurium LT2
cggcgccgaagcagg

SEQ ID NO: 3790424 - RNA, 23 nt, Salmonella typhimurium LT2
cggcgccgugaguuucagcauca

SEQ ID NO: 3790425 - RNA, 21 nt, Salmonella typhimurium LT2
cggcgccuuuaauuccgccgg

SEQ ID NO: 3790426 - RNA, 17 nt, Salmonella typhimurium LT2
cggcgcgaaagcgccuu

SEQ ID NO: 3790427 - RNA, 14 nt, Salmonella typhimurium LT2
cggcgcgaaucccg

SEQ ID NO: 3790428 - RNA, 18 nt, Salmonella typhimurium LT2
cggcgcgaaucccgcguu

SEQ ID NO: 3790429 - RNA, 19 nt, Salmonella typhimurium LT2
cggcgcgauauccaccacu

SEQ ID NO: 3790430 - RNA, 14 nt, Salmonella typhimurium LT2
cggcgcgccaccau

SEQ ID NO: 3790431 - RNA, 24 nt, Salmonella typhimurium LT2
cggcgcgccgcuggcgaccagccu

SEQ ID NO: 3790432 - RNA, 20 nt, Salmonella typhimurium LT2
cggcgcgccuuccagcaauu

SEQ ID NO: 3790433 - RNA, 13 nt, Salmonella typhimurium LT2
cggcgcgcguggc

SEQ ID NO: 3790434 - RNA, 15 nt, Salmonella typhimurium LT2
cggcgcgcugccgcc

SEQ ID NO: 3790435 - RNA, 13 nt, Salmonella typhimurium LT2
cggcgcggaaggg

SEQ ID NO: 3790436 - RNA, 18 nt, Salmonella typhimurium LT2
cggcgcggggaacacaau

SEQ ID NO: 3790437 - RNA, 17 nt, Salmonella typhimurium LT2
cggcgcgguuuccggua

SEQ ID NO: 3790438 - RNA, 16 nt, Salmonella typhimurium LT2
cggcgcguucagcauc

SEQ ID NO: 3790439 - RNA, 17 nt, Salmonella typhimurium LT2
cggcgcguugccgccga

SEQ ID NO: 3790440 - RNA, 14 nt, Salmonella typhimurium LT2
cggcgcucgccagc

SEQ ID NO: 3790441 - RNA, 16 nt, Salmonella typhimurium LT2
cggcgcuggcgcgcua

SEQ ID NO: 3790442 - RNA, 17 nt, Salmonella typhimurium LT2
cggcgcugucguuccac

SEQ ID NO: 3790443 - RNA, 15 nt, Salmonella typhimurium LT2
cggcgcuucgcagcg

SEQ ID NO: 3790444 - RNA, 21 nt, Salmonella typhimurium LT2
cggcgcuuucgauaaucugac

SEQ ID NO: 3790445 - RNA, 16 nt, Salmonella typhimurium LT2
cggcggaaaagcgccc

SEQ ID NO: 3790446 - RNA, 17 nt, Salmonella typhimurium LT2
cggcggaaagggccggg

SEQ ID NO: 3790447 - RNA, 16 nt, Salmonella typhimurium LT2
cggcggcacggcguca

SEQ ID NO: 3790448 - RNA, 13 nt, Salmonella typhimurium LT2
cggcggccaaccc

SEQ ID NO: 3790449 - RNA, 20 nt, Salmonella typhimurium LT2
cggcggccaaccccggcaaa

SEQ ID NO: 3790450 - RNA, 19 nt, Salmonella typhimurium LT2
cggcggcgcaucgcucacc

SEQ ID NO: 3790451 - RNA, 12 nt, Salmonella typhimurium LT2
cggcggcggcgg

SEQ ID NO: 3790452 - RNA, 14 nt, Salmonella typhimurium LT2
cggcggcguacagc

SEQ ID NO: 3790453 - RNA, 14 nt, Salmonella typhimurium LT2
cggcggcuagcgca

SEQ ID NO: 3790454 - RNA, 20 nt, Salmonella typhimurium LT2
cggcgggaaguuguuacgaa

SEQ ID NO: 3790455 - RNA, 17 nt, Salmonella typhimurium LT2
cggcggguauggcaaug

SEQ ID NO: 3790456 - RNA, 14 nt, Salmonella typhimurium LT2
cggcggucagccag

SEQ ID NO: 3790457 - RNA, 13 nt, Salmonella typhimurium LT2
cggcggucgccgc

SEQ ID NO: 3790458 - RNA, 13 nt, Salmonella typhimurium LT2
cggcggucugcgc

SEQ ID NO: 3790459 - RNA, 21 nt, Salmonella typhimurium LT2
cggcgguuauccgccagcgca

SEQ ID NO: 3790460 - RNA, 20 nt, Salmonella typhimurium LT2
cggcguaaaagcgauaaaga

SEQ ID NO: 3790461 - RNA, 15 nt, Salmonella typhimurium LT2
cggcguaaacacguu

SEQ ID NO: 3790462 - RNA, 23 nt, Salmonella typhimurium LT2
cggcguaaaccccuucaccacuu

SEQ ID NO: 3790463 - RNA, 21 nt, Salmonella typhimurium LT2
cggcguaauccagcuucaggc

SEQ ID NO: 3790464 - RNA, 14 nt, Salmonella typhimurium LT2
cggcguaauugcgc

SEQ ID NO: 3790465 - RNA, 17 nt, Salmonella typhimurium LT2
cggcguaccgcgcgccc

SEQ ID NO: 3790466 - RNA, 19 nt, Salmonella typhimurium LT2
cggcguaucauagcggcua

SEQ ID NO: 3790467 - RNA, 18 nt, Salmonella typhimurium LT2
cggcguauuuaaaacgca

SEQ ID NO: 3790468 - RNA, 21 nt, Salmonella typhimurium LT2
cggcguauuuaaaacgcacga

SEQ ID NO: 3790469 - RNA, 19 nt, Salmonella typhimurium LT2
cggcgucaaauccaccgcc

SEQ ID NO: 3790470 - RNA, 23 nt, Salmonella typhimurium LT2
cggcgucaaauccaccgccagca

SEQ ID NO: 3790471 - RNA, 21 nt, Salmonella typhimurium LT2
cggcgucacguucgucgccgg

SEQ ID NO: 3790472 - RNA, 16 nt, Salmonella typhimurium LT2
cggcgucgcggcaaua

SEQ ID NO: 3790473 - RNA, 23 nt, Salmonella typhimurium LT2
cggcgucuaccuggguagcgcca

SEQ ID NO: 3790474 - RNA, 14 nt, Salmonella typhimurium LT2
cggcgucugaugaa

SEQ ID NO: 3790475 - RNA, 22 nt, Salmonella typhimurium LT2
cggcgucuggguuugcagcaga

SEQ ID NO: 3790476 - RNA, 22 nt, Salmonella typhimurium LT2
cggcgucuucauccucgccaua

SEQ ID NO: 3790477 - RNA, 20 nt, Salmonella typhimurium LT2
cggcgugaacgccuuauccu

SEQ ID NO: 3790478 - RNA, 14 nt, Salmonella typhimurium LT2
cggcgugaaucccc

SEQ ID NO: 3790479 - RNA, 17 nt, Salmonella typhimurium LT2
cggcgugaccaccgccu

SEQ ID NO: 3790480 - RNA, 18 nt, Salmonella typhimurium LT2
cggcgugccgauucccgc

SEQ ID NO: 3790481 - RNA, 17 nt, Salmonella typhimurium LT2
cggcguggcgcauucca

SEQ ID NO: 3790482 - RNA, 22 nt, Salmonella typhimurium LT2
cggcguuagugcccagcgcgac

SEQ ID NO: 3790483 - RNA, 23 nt, Salmonella typhimurium LT2
cggcguuagugcccagcgcgacc

SEQ ID NO: 3790484 - RNA, 13 nt, Salmonella typhimurium LT2
cggcguuccgcac

SEQ ID NO: 3790485 - RNA, 12 nt, Salmonella typhimurium LT2
cggcguucugcg

SEQ ID NO: 3790486 - RNA, 19 nt, Salmonella typhimurium LT2
cggcguuggcgauuuccag

SEQ ID NO: 3790487 - RNA, 15 nt, Salmonella typhimurium LT2
cggcguuggcugcuc

SEQ ID NO: 3790488 - RNA, 18 nt, Salmonella typhimurium LT2
cggcguuguuaugcguca

SEQ ID NO: 3790489 - RNA, 23 nt, Salmonella typhimurium LT2
cggcguuucaagcaguuccagca

SEQ ID NO: 3790490 - RNA, 17 nt, Salmonella typhimurium LT2
cggcguuucacuucuga

SEQ ID NO: 3790491 - RNA, 14 nt, Salmonella typhimurium LT2
cggcguuucguaau

SEQ ID NO: 3790492 - RNA, 17 nt, Salmonella typhimurium LT2
cggcguuuugccgggcg

SEQ ID NO: 3790493 - RNA, 18 nt, Salmonella typhimurium LT2
cggcguuuuuuccugcug

SEQ ID NO: 3790494 - RNA, 22 nt, Salmonella typhimurium LT2
cggcuaacaacguuacgccagc

SEQ ID NO: 3790495 - RNA, 21 nt, Salmonella typhimurium LT2
cggcuacaggcgucacggcga

SEQ ID NO: 3790496 - RNA, 22 nt, Salmonella typhimurium LT2
cggcuaccucuuauccggcugc

SEQ ID NO: 3790497 - RNA, 21 nt, Salmonella typhimurium LT2
cggcuacgaaccgagcggucg

SEQ ID NO: 3790498 - RNA, 17 nt, Salmonella typhimurium LT2
cggcuacgcagcggcga

SEQ ID NO: 3790499 - RNA, 22 nt, Salmonella typhimurium LT2
cggcuacggaguucaccgccgg

SEQ ID NO: 3790500 - RNA, 15 nt, Salmonella typhimurium LT2
cggcuacuccggcgc

SEQ ID NO: 3790501 - RNA, 16 nt, Salmonella typhimurium LT2
cggcuagcgcaguuug

SEQ ID NO: 3790502 - RNA, 17 nt, Salmonella typhimurium LT2
cggcuauguagcgcuga

SEQ ID NO: 3790503 - RNA, 23 nt, Salmonella typhimurium LT2
cggcuauguagcgcugaagcccg

SEQ ID NO: 3790504 - RNA, 21 nt, Salmonella typhimurium LT2
cggcucaaacggccugcgcug

SEQ ID NO: 3790505 - RNA, 24 nt, Salmonella typhimurium LT2
cgggcucgccgugccuggcgaacg

SEQ ID NO: 3790506 - RNA, 21 nt, Salmonella typhimurium LT2
cgggcugauauuuucaggcac

SEQ ID NO: 3790507 - RNA, 18 nt, Salmonella typhimurium LT2
cgggcugcaagggaaucu

SEQ ID NO: 3790508 - RNA, 17 nt, Salmonella typhimurium LT2
cgggcuuaacccaacgc

SEQ ID NO: 3790509 - RNA, 18 nt, Salmonella typhimurium LT2
cgggcuuacgaguggcga

SEQ ID NO: 3790510 - RNA, 19 nt, Salmonella typhimurium LT2
cgggcuuacgaguggcgau

SEQ ID NO: 3790511 - RNA, 23 nt, Salmonella typhimurium LT2
cgggcuuccaguacgcugacgaa

SEQ ID NO: 3790512 - RNA, 23 nt, Salmonella typhimurium LT2
cgggcuuuugaauaaucccgcag

SEQ ID NO: 3790513 - RNA, 13 nt, Salmonella typhimurium LT2
cggggaagcgacg

SEQ ID NO: 3790514 - RNA, 18 nt, Salmonella typhimurium LT2
cggggauaaucagcagcg

SEQ ID NO: 3790515 - RNA, 22 nt, Salmonella typhimurium LT2
cggggaucaaaauuaagcgacc

SEQ ID NO: 3790516 - RNA, 19 nt, Salmonella typhimurium LT2
cggggaucguucugcugau

SEQ ID NO: 3790517 - RNA, 15 nt, Salmonella typhimurium LT2
cggggcaucaugaug

SEQ ID NO: 3790518 - RNA, 16 nt, Salmonella typhimurium LT2
cggggccagcgccagu

SEQ ID NO: 3790519 - RNA, 19 nt, Salmonella typhimurium LT2
cggggccagcgccaguacu

SEQ ID NO: 3790520 - RNA, 16 nt, Salmonella typhimurium LT2
cgggggcgacagcccc

SEQ ID NO: 3790521 - RNA, 16 nt, Salmonella typhimurium LT2
cgggggcgaucagcag

SEQ ID NO: 3790522 - RNA, 20 nt, Salmonella typhimurium LT2
cgggggcgaucagcagguca

SEQ ID NO: 3790523 - RNA, 16 nt, Salmonella typhimurium LT2
cggggguuguucagcg

SEQ ID NO: 3790524 - RNA, 21 nt, Salmonella typhimurium LT2
cgggguuagcguuucaaccgc

SEQ ID NO: 3790525 - RNA, 18 nt, Salmonella typhimurium LT2
cgggguucgggcagcgcu

SEQ ID NO: 3790526 - RNA, 14 nt, Salmonella typhimurium LT2
cggguaaacgcagc

SEQ ID NO: 3790527 - RNA, 16 nt, Salmonella typhimurium LT2
cggguaacagcauuga

SEQ ID NO: 3790528 - RNA, 17 nt, Salmonella typhimurium LT2
cggguaacagcauugag

SEQ ID NO: 3790529 - RNA, 23 nt, Salmonella typhimurium LT2
cggguaacagcauugaggcuacc

SEQ ID NO: 3790530 - RNA, 23 nt, Salmonella typhimurium LT2
cggguaagcgcaagcgccacccg

SEQ ID NO: 3790531 - RNA, 20 nt, Salmonella typhimurium LT2
cggguaaggcgaagccgcca

SEQ ID NO: 3790532 - RNA, 21 nt, Salmonella typhimurium LT2
cggguaaugagaccagcgucg

SEQ ID NO: 3790533 - RNA, 15 nt, Salmonella typhimurium LT2
cggguagagcuuuuc

SEQ ID NO: 3790534 - RNA, 20 nt, Salmonella typhimurium LT2
cggguauggcaaugcccccu

SEQ ID NO: 3790535 - RNA, 15 nt, Salmonella typhimurium LT2
cggguauucaucggc

SEQ ID NO: 3790536 - RNA, 15 nt, Salmonella typhimurium LT2
cgggucaaaagcgug

SEQ ID NO: 3790537 - RNA, 14 nt, Salmonella typhimurium LT2
cgggucagcggggu

SEQ ID NO: 3790538 - RNA, 18 nt, Salmonella typhimurium LT2
cggguccagucgcgccgc

SEQ ID NO: 3790539 - RNA, 14 nt, Salmonella typhimurium LT2
cggguccgcccggc

SEQ ID NO: 3790540 - RNA, 22 nt, Salmonella typhimurium LT2
cgggucggacgagcgcgucagc

SEQ ID NO: 3790541 - RNA, 20 nt, Salmonella typhimurium LT2
cgggucuacaucggaagcgg

SEQ ID NO: 3790542 - RNA, 18 nt, Salmonella typhimurium LT2
cgggucugcgcgccggaa

SEQ ID NO: 3790543 - RNA, 19 nt, Salmonella typhimurium LT2
cggguucgcgcgccgcuuc

SEQ ID NO: 3790544 - RNA, 12 nt, Salmonella typhimurium LT2
cggguugcugau

SEQ ID NO: 3790545 - RNA, 15 nt, Salmonella typhimurium LT2
cggguuuugaaaucu

SEQ ID NO: 3790546 - RNA, 15 nt, Salmonella typhimurium LT2
cggguuuugagcagc

SEQ ID NO: 3790547 - RNA, 14 nt, Salmonella typhimurium LT2
cggguuuuuacuuu

SEQ ID NO: 3790548 - RNA, 13 nt, Salmonella typhimurium LT2
cgguaaaaacagc

SEQ ID NO: 3790549 - RNA, 18 nt, Salmonella typhimurium LT2
cgguaaaaauaucugaau

SEQ ID NO: 3790550 - RNA, 19 nt, Salmonella typhimurium LT2
cgguaaaaccuaacgccug

SEQ ID NO: 3790551 - RNA, 15 nt, Salmonella typhimurium LT2
cgguaaaccaggcca

SEQ ID NO: 3790552 - RNA, 14 nt, Salmonella typhimurium LT2
cgguaaaccucuuu

SEQ ID NO: 3790553 - RNA, 15 nt, Salmonella typhimurium LT2
cgguaaacgggcuua

SEQ ID NO: 3790554 - RNA, 18 nt, Salmonella typhimurium LT2
cgguaaacgugccacagu

SEQ ID NO: 3790555 - RNA, 17 nt, Salmonella typhimurium LT2
cgguaaagcagugcagu

SEQ ID NO: 3790556 - RNA, 15 nt, Salmonella typhimurium LT2
cgguaaaggcgaccg

SEQ ID NO: 3790557 - RNA, 18 nt, Salmonella typhimurium LT2
cgguaaaucaacaaccgg

SEQ ID NO: 3790558 - RNA, 20 nt, Salmonella typhimurium LT2
cgguaaauuucacuucgccc

SEQ ID NO: 3790559 - RNA, 21 nt, Salmonella typhimurium LT2
cgguaaauuucuugaucaauc

SEQ ID NO: 3790560 - RNA, 20 nt, Salmonella typhimurium LT2
cgguaacagcuugaucauca

SEQ ID NO: 3790561 - RNA, 15 nt, Salmonella typhimurium LT2
cgguaacaggcacca

SEQ ID NO: 3790562 - RNA, 22 nt, Salmonella typhimurium LT2
cgguaacgcaacucaucgucau

SEQ ID NO: 3790563 - RNA, 22 nt, Salmonella typhimurium LT2
cgguaacggcccguagggugag

SEQ ID NO: 3790564 - RNA, 22 nt, Salmonella typhimurium LT2
cgguaagcccauggcaggcagc

SEQ ID NO: 3790565 - RNA, 17 nt, Salmonella typhimurium LT2
cgguaagcgcagcgcca

SEQ ID NO: 3790566 - RNA, 16 nt, Salmonella typhimurium LT2
cgguaagucaaccagc

SEQ ID NO: 3790567 - RNA, 16 nt, Salmonella typhimurium LT2
cgguaagucugauaac

SEQ ID NO: 3790568 - RNA, 20 nt, Salmonella typhimurium LT2
cgguacaaaccccacccgcu

SEQ ID NO: 3790569 - RNA, 13 nt, Salmonella typhimurium LT2
cgguacagcaucc

SEQ ID NO: 3790570 - RNA, 19 nt, Salmonella typhimurium LT2
cgguaccaaagucaucaau

SEQ ID NO: 3790571 - RNA, 13 nt, Salmonella typhimurium LT2
cgguaccaccagc

SEQ ID NO: 3790572 - RNA, 20 nt, Salmonella typhimurium LT2
cgguaccgcuugggccaccu

SEQ ID NO: 3790573 - RNA, 13 nt, Salmonella typhimurium LT2
cgguaccggcauu

SEQ ID NO: 3790574 - RNA, 14 nt, Salmonella typhimurium LT2
cgguacgacgccgu

SEQ ID NO: 3790575 - RNA, 21 nt, Salmonella typhimurium LT2
cgguacgacuuauucaaucaa

SEQ ID NO: 3790576 - RNA, 16 nt, Salmonella typhimurium LT2
cgguacgcaucaccag

SEQ ID NO: 3790577 - RNA, 14 nt, Salmonella typhimurium LT2
cgguacuccgccau

SEQ ID NO: 3790578 - RNA, 14 nt, Salmonella typhimurium LT2
cgguacucuuuuuc

SEQ ID NO: 3790579 - RNA, 16 nt, Salmonella typhimurium LT2
cgguacuggagaccgg

SEQ ID NO: 3790580 - RNA, 18 nt, Salmonella typhimurium LT2
cgguagcaugcguaaauu

SEQ ID NO: 3790581 - RNA, 22 nt, Salmonella typhimurium LT2
cgguagcuguaccagaucgccu

SEQ ID NO: 3790582 - RNA, 18 nt, Salmonella typhimurium LT2
cgguagcuucagcggcgc

SEQ ID NO: 3790583 - RNA, 16 nt, Salmonella typhimurium LT2
cgguauagaucaggcg

SEQ ID NO: 3790584 - RNA, 16 nt, Salmonella typhimurium LT2
cgguauaucacgccau

SEQ ID NO: 3790585 - RNA, 18 nt, Salmonella typhimurium LT2
cgguauccgcuauaugaa

SEQ ID NO: 3790586 - RNA, 17 nt, Salmonella typhimurium LT2
cgguauccuccugccag

SEQ ID NO: 3790587 - RNA, 22 nt, Salmonella typhimurium LT2
cgguaucgacaaccgccugcgu

SEQ ID NO: 3790588 - RNA, 17 nt, Salmonella typhimurium LT2
cgguaugaaagccaucg

SEQ ID NO: 3790589 - RNA, 19 nt, Salmonella typhimurium LT2
cgguaugcguugcaaauau

SEQ ID NO: 3790590 - RNA, 18 nt, Salmonella typhimurium LT2
cgguauuaacccgcagcc

SEQ ID NO: 3790591 - RNA, 18 nt, Salmonella typhimurium LT2
cgguauugauacaggcgc

SEQ ID NO: 3790592 - RNA, 19 nt, Salmonella typhimurium LT2
cggucaaaagcugcauccg

SEQ ID NO: 3790593 - RNA, 16 nt, Salmonella typhimurium LT2
cggucaacgcgccgcc

SEQ ID NO: 3790594 - RNA, 16 nt, Salmonella typhimurium LT2
cggucaacguuucccc

SEQ ID NO: 3790595 - RNA, 22 nt, Salmonella typhimurium LT2
cggucaagcuaaagauagccac

SEQ ID NO: 3790596 - RNA, 18 nt, Salmonella typhimurium LT2
cggucaccugaccacgac

SEQ ID NO: 3790597 - RNA, 12 nt, Salmonella typhimurium LT2
cggucagaccgu

SEQ ID NO: 3790598 - RNA, 12 nt, Salmonella typhimurium LT2
cggucagccagc

SEQ ID NO: 3790599 - RNA, 15 nt, Salmonella typhimurium LT2
cggucagcggcgcgc

SEQ ID NO: 3790600 - RNA, 16 nt, Salmonella typhimurium LT2
cggucagcuuuucagc

SEQ ID NO: 3790601 - RNA, 19 nt, Salmonella typhimurium LT2
cggucagggugaaucccgc

SEQ ID NO: 3790602 - RNA, 22 nt, Salmonella typhimurium LT2
cggucagggugaaucccgccau

SEQ ID NO: 3790603 - RNA, 22 nt, Salmonella typhimurium LT2
cggucaguccaagcguuuuacg

SEQ ID NO: 3790604 - RNA, 22 nt, Salmonella typhimurium LT2
cggucaguguuuccauacauuu

SEQ ID NO: 3790605 - RNA, 17 nt, Salmonella typhimurium LT2
cggucauuaauccccgg

SEQ ID NO: 3790606 - RNA, 15 nt, Salmonella typhimurium LT2
cggucccuggcuggu

SEQ ID NO: 3790607 - RNA, 21 nt, Salmonella typhimurium LT2
cgguccguuuucgcccccagc

SEQ ID NO: 3790608 - RNA, 17 nt, Salmonella typhimurium LT2
cggucgagcguaauucc

SEQ ID NO: 3790609 - RNA, 21 nt, Salmonella typhimurium LT2
cguaacugcgguaaauaaugc

SEQ ID NO: 3790610 - RNA, 18 nt, Salmonella typhimurium LT2
cguaacuggauuccuggc

SEQ ID NO: 3790611 - RNA, 17 nt, Salmonella typhimurium LT2
cguaacuguugccccgc

SEQ ID NO: 3790612 - RNA, 20 nt, Salmonella typhimurium LT2
cguaacuguugccccgcuuu

SEQ ID NO: 3790613 - RNA, 22 nt, Salmonella typhimurium LT2
cguaagcgcccguccaugagua

SEQ ID NO: 3790614 - RNA, 12 nt, Salmonella typhimurium LT2
cguaagcgcguu

SEQ ID NO: 3790615 - RNA, 21 nt, Salmonella typhimurium LT2
cguaauacgauccucgccauu

SEQ ID NO: 3790616 - RNA, 17 nt, Salmonella typhimurium LT2
cguaauauacgccaccu

SEQ ID NO: 3790617 - RNA, 19 nt, Salmonella typhimurium LT2
cguaauaugggcacaaccc

SEQ ID NO: 3790618 - RNA, 22 nt, Salmonella typhimurium LT2
cguaauaugggcacaacccuaa

SEQ ID NO: 3790619 - RNA, 22 nt, Salmonella typhimurium LT2
cguaauccgccucugccguagc

SEQ ID NO: 3790620 - RNA, 15 nt, Salmonella typhimurium LT2
cguaauccggccugg

SEQ ID NO: 3790621 - RNA, 21 nt, Salmonella typhimurium LT2
cguaaucuuuucauauuauuu

SEQ ID NO: 3790622 - RNA, 20 nt, Salmonella typhimurium LT2
cguaaugcgccccggcggcg

SEQ ID NO: 3790623 - RNA, 22 nt, Salmonella typhimurium LT2
cguaauuaaccgcgccgcuggc

SEQ ID NO: 3790624 - RNA, 18 nt, Salmonella typhimurium LT2
cguaauucaugcaacuuc

SEQ ID NO: 3790625 - RNA, 19 nt, Salmonella typhimurium LT2
cguaauuugcgacauggcg

SEQ ID NO: 3790626 - RNA, 15 nt, Salmonella typhimurium LT2
cguacaaaggggcca

SEQ ID NO: 3790627 - RNA, 12 nt, Salmonella typhimurium LT2
cguacagacgcu

SEQ ID NO: 3790628 - RNA, 17 nt, Salmonella typhimurium LT2
cguacauaacagcagca

SEQ ID NO: 3790629 - RNA, 20 nt, Salmonella typhimurium LT2
cguacauguccagaucuuca

SEQ ID NO: 3790630 - RNA, 21 nt, Salmonella typhimurium LT2
cguaccacgccgcacacagcg

SEQ ID NO: 3790631 - RNA, 13 nt, Salmonella typhimurium LT2
cguaccagcgccc

SEQ ID NO: 3790632 - RNA, 13 nt, Salmonella typhimurium LT2
cguaccccaaucu

SEQ ID NO: 3790633 - RNA, 18 nt, Salmonella typhimurium LT2
cguaccgcguuuaacgca

SEQ ID NO: 3790634 - RNA, 17 nt, Salmonella typhimurium LT2
cguaccgcuaucgccaa

SEQ ID NO: 3790635 - RNA, 17 nt, Salmonella typhimurium LT2
cguaccggcgcucagcc

SEQ ID NO: 3790636 - RNA, 20 nt, Salmonella typhimurium LT2
cguaccggcgcucagccaga

SEQ ID NO: 3790637 - RNA, 18 nt, Salmonella typhimurium LT2
cguaccguaaaccgcguu

SEQ ID NO: 3790638 - RNA, 16 nt, Salmonella typhimurium LT2
cguaccguugccgccg

SEQ ID NO: 3790639 - RNA, 16 nt, Salmonella typhimurium LT2
cguacgcauccgcguu

SEQ ID NO: 3790640 - RNA, 13 nt, Salmonella typhimurium LT2
cguacggaaggua

SEQ ID NO: 3790641 - RNA, 19 nt, Salmonella typhimurium LT2
cguacuaaagagcgccuga

SEQ ID NO: 3790642 - RNA, 22 nt, Salmonella typhimurium LT2
cguacuccaggcgcugcuggca

SEQ ID NO: 3790643 - RNA, 21 nt, Salmonella typhimurium LT2
cguacugaaauaacucuggau

SEQ ID NO: 3790644 - RNA, 19 nt, Salmonella typhimurium LT2
cguagacgaccagggaacu

SEQ ID NO: 3790645 - RNA, 20 nt, Salmonella typhimurium LT2
cguagauuuucaucauaucu

SEQ ID NO: 3790646 - RNA, 16 nt, Salmonella typhimurium LT2
cguagcagaagacgcu

SEQ ID NO: 3790647 - RNA, 12 nt, Salmonella typhimurium LT2
cguagcagacgu

SEQ ID NO: 3790648 - RNA, 24 nt, Salmonella typhimurium LT2
cguagccaaaagcgccacgcguca

SEQ ID NO: 3790649 - RNA, 13 nt, Salmonella typhimurium LT2
cguagccagagcg

SEQ ID NO: 3790650 - RNA, 19 nt, Salmonella typhimurium LT2
cguagcccagcgccgcauc

SEQ ID NO: 3790651 - RNA, 22 nt, Salmonella typhimurium LT2
cguagccgaccaccauccggca

SEQ ID NO: 3790652 - RNA, 17 nt, Salmonella typhimurium LT2
cguagccgccgagcgcc

SEQ ID NO: 3790653 - RNA, 19 nt, Salmonella typhimurium LT2
cguagccgccgagcgccgu

SEQ ID NO: 3790654 - RNA, 19 nt, Salmonella typhimurium LT2
cguagccgggugcgcgucg

SEQ ID NO: 3790655 - RNA, 13 nt, Salmonella typhimurium LT2
cguagcgcaucuc

SEQ ID NO: 3790656 - RNA, 12 nt, Salmonella typhimurium LT2
cguagcgccaac

SEQ ID NO: 3790657 - RNA, 11 nt, Salmonella typhimurium LT2
cguagcgccau

SEQ ID NO: 3790658 - RNA, 19 nt, Salmonella typhimurium LT2
cguagcgccaucaggcaua

SEQ ID NO: 3790659 - RNA, 20 nt, Salmonella typhimurium LT2
cguagcgcgcggauauggcg

SEQ ID NO: 3790660 - RNA, 19 nt, Salmonella typhimurium LT2
cguagcggucacccggcac

SEQ ID NO: 3790661 - RNA, 17 nt, Salmonella typhimurium LT2
cguagcguacugcagcg

SEQ ID NO: 3790662 - RNA, 20 nt, Salmonella typhimurium LT2
cguagcguucauucccgcca

SEQ ID NO: 3790663 - RNA, 21 nt, Salmonella typhimurium LT2
cguagcuggucgccagcgccg

SEQ ID NO: 3790664 - RNA, 19 nt, Salmonella typhimurium LT2
cguagcuguaacaguccgu

SEQ ID NO: 3790665 - RNA, 23 nt, Salmonella typhimurium LT2
cguagcuuugcgccagauaacca

SEQ ID NO: 3790666 - RNA, 17 nt, Salmonella typhimurium LT2
cguaggcaacaauuucu

SEQ ID NO: 3790667 - RNA, 13 nt, Salmonella typhimurium LT2
cguaggccaggca

SEQ ID NO: 3790668 - RNA, 18 nt, Salmonella typhimurium LT2
cguaggccggauaaggcg

SEQ ID NO: 3790669 - RNA, 15 nt, Salmonella typhimurium LT2
cguaggucgcgaaca

SEQ ID NO: 3790670 - RNA, 17 nt, Salmonella typhimurium LT2
cguagguucgacuccua

SEQ ID NO: 3790671 - RNA, 14 nt, Salmonella typhimurium LT2
cguagguuggcuga

SEQ ID NO: 3790672 - RNA, 19 nt, Salmonella typhimurium LT2
cguaguacgcgcgccggug

SEQ ID NO: 3790673 - RNA, 22 nt, Salmonella typhimurium LT2
cguaguagucaggaucgcuggc

SEQ ID NO: 3790674 - RNA, 22 nt, Salmonella typhimurium LT2
cguagugccacaacgccugaug

SEQ ID NO: 3790675 - RNA, 17 nt, Salmonella typhimurium LT2
cguagugcuucucuuca

SEQ ID NO: 3790676 - RNA, 18 nt, Salmonella typhimurium LT2
cguaguuggccuucuccg

SEQ ID NO: 3790677 - RNA, 19 nt, Salmonella typhimurium LT2
cguaguuggccuucuccgc

SEQ ID NO: 3790678 - RNA, 22 nt, Salmonella typhimurium LT2
cguaguuuauucuucuccucuu

SEQ ID NO: 3790679 - RNA, 19 nt, Salmonella typhimurium LT2
cguauaaggcgaagcccau

SEQ ID NO: 3790680 - RNA, 14 nt, Salmonella typhimurium LT2
cguauagccaggca

SEQ ID NO: 3790681 - RNA, 19 nt, Salmonella typhimurium LT2
cguauauacccaaaauaau

SEQ ID NO: 3790682 - RNA, 22 nt, Salmonella typhimurium LT2
cguaucacuaauuugcgauucc

SEQ ID NO: 3790683 - RNA, 14 nt, Salmonella typhimurium LT2
cguaucacuguaaa

SEQ ID NO: 3790684 - RNA, 12 nt, Salmonella typhimurium LT2
cguauccagcgc

SEQ ID NO: 3790685 - RNA, 13 nt, Salmonella typhimurium LT2
cguauccagcgcg

SEQ ID NO: 3790686 - RNA, 19 nt, Salmonella typhimurium LT2
cguauccaggguuuacugc

SEQ ID NO: 3790687 - RNA, 17 nt, Salmonella typhimurium LT2
cguauccgccaccauga

SEQ ID NO: 3790688 - RNA, 20 nt, Salmonella typhimurium LT2
cguauccggcaagucagacc

SEQ ID NO: 3790689 - RNA, 17 nt, Salmonella typhimurium LT2
cguaugcagccaggcca

SEQ ID NO: 3790690 - RNA, 18 nt, Salmonella typhimurium LT2
cguaugcagccaggccau

SEQ ID NO: 3790691 - RNA, 20 nt, Salmonella typhimurium LT2
cguauggcauccuaacuggg

SEQ ID NO: 3790692 - RNA, 14 nt, Salmonella typhimurium LT2
cguaugguucaggu

SEQ ID NO: 3790693 - RNA, 13 nt, Salmonella typhimurium LT2
cguauuagauaag

SEQ ID NO: 3790694 - RNA, 20 nt, Salmonella typhimurium LT2
cguauuagcaaaucuucauu

SEQ ID NO: 3790695 - RNA, 14 nt, Salmonella typhimurium LT2
cguauuaugccgac

SEQ ID NO: 3790696 - RNA, 19 nt, Salmonella typhimurium LT2
cguauucucaaccagccga

SEQ ID NO: 3790697 - RNA, 20 nt, Salmonella typhimurium LT2
cguauugagcagcggcugga

SEQ ID NO: 3790698 - RNA, 12 nt, Salmonella typhimurium LT2
cgucaaaacagg

SEQ ID NO: 3790699 - RNA, 18 nt, Salmonella typhimurium LT2
cgucaaaacuuauuuuau

SEQ ID NO: 3790700 - RNA, 20 nt, Salmonella typhimurium LT2
cgucaaaaugaucagaccau

SEQ ID NO: 3790701 - RNA, 19 nt, Salmonella typhimurium LT2
cgucaaacagcuuaacgau

SEQ ID NO: 3790702 - RNA, 15 nt, Salmonella typhimurium LT2
cgucaaacaguucag

SEQ ID NO: 3790703 - RNA, 18 nt, Salmonella typhimurium LT2
cgucaaacucuuccgggc

SEQ ID NO: 3790704 - RNA, 16 nt, Salmonella typhimurium LT2
cgucaaagaguuccug

SEQ ID NO: 3790705 - RNA, 22 nt, Salmonella typhimurium LT2
cgucaacaaugcuuucaccagu

SEQ ID NO: 3790706 - RNA, 16 nt, Salmonella typhimurium LT2
cgucaacaccuccagu

SEQ ID NO: 3790707 - RNA, 22 nt, Salmonella typhimurium LT2
cgucaacgcacuguaacgcacu

SEQ ID NO: 3790708 - RNA, 21 nt, Salmonella typhimurium LT2
cgucaaucaggaaagagccgc

SEQ ID NO: 3790709 - RNA, 14 nt, Salmonella typhimurium LT2
cgucaaugaucagc

SEQ ID NO: 3790710 - RNA, 14 nt, Salmonella typhimurium LT2
cgucaaugcccggc

SEQ ID NO: 3790711 - RNA, 23 nt, Salmonella typhimurium LT2
cgucacaaaaacacccgcagccg

SEQ ID NO: 3790712 - RNA, 18 nt, Salmonella typhimurium LT2
cgucgaggaagcugcgca

SEQ ID NO: 3790713 - RNA, 22 nt, Salmonella typhimurium LT2
cgucgaggaagcugcgcagcac

SEQ ID NO: 3790714 - RNA, 22 nt, Salmonella typhimurium LT2
cgucgaugugaauccaggccag

SEQ ID NO: 3790715 - RNA, 14 nt, Salmonella typhimurium LT2
cgucgccaaagcag

SEQ ID NO: 3790716 - RNA, 19 nt, Salmonella typhimurium LT2
cgucgccagacccagcgcu

SEQ ID NO: 3790717 - RNA, 14 nt, Salmonella typhimurium LT2
cgucgccauaucca

SEQ ID NO: 3790718 - RNA, 22 nt, Salmonella typhimurium LT2
cgucgccauauccaagccccuc

SEQ ID NO: 3790719 - RNA, 14 nt, Salmonella typhimurium LT2
cgucgccauccggc

SEQ ID NO: 3790720 - RNA, 16 nt, Salmonella typhimurium LT2
cgucgccauccggcaa

SEQ ID NO: 3790721 - RNA, 23 nt, Salmonella typhimurium LT2
cgucgccggugcuguagcugccc

SEQ ID NO: 3790722 - RNA, 16 nt, Salmonella typhimurium LT2
cgucgccguuaagauc

SEQ ID NO: 3790723 - RNA, 19 nt, Salmonella typhimurium LT2
cgucgccugaaugcacugc

SEQ ID NO: 3790724 - RNA, 21 nt, Salmonella typhimurium LT2
cgucgccuguuucugcgccgc

SEQ ID NO: 3790725 - RNA, 22 nt, Salmonella typhimurium LT2
cgucgccuguuucugcgccgcu

SEQ ID NO: 3790726 - RNA, 11 nt, Salmonella typhimurium LT2
cgucgccuucc

SEQ ID NO: 3790727 - RNA, 15 nt, Salmonella typhimurium LT2
cgucgcgacguccgc

SEQ ID NO: 3790728 - RNA, 17 nt, Salmonella typhimurium LT2
cgucgcgaucgcgccag

SEQ ID NO: 3790729 - RNA, 17 nt, Salmonella typhimurium LT2
cgucgcgcauggcaggg

SEQ ID NO: 3790730 - RNA, 16 nt, Salmonella typhimurium LT2
cgucgcgcgccgccuc

SEQ ID NO: 3790731 - RNA, 14 nt, Salmonella typhimurium LT2
cgucgcgcgcugug

SEQ ID NO: 3790732 - RNA, 19 nt, Salmonella typhimurium LT2
cgucgcgcucguaggccag

SEQ ID NO: 3790733 - RNA, 17 nt, Salmonella typhimurium LT2
cgucgcucccggcacca

SEQ ID NO: 3790734 - RNA, 13 nt, Salmonella typhimurium LT2
cgucggcaucgug

SEQ ID NO: 3790735 - RNA, 23 nt, Salmonella typhimurium LT2
cgucggcauggucagcauaauau

SEQ ID NO: 3790736 - RNA, 16 nt, Salmonella typhimurium LT2
cgucggcgaugugccu

SEQ ID NO: 3790737 - RNA, 18 nt, Salmonella typhimurium LT2
cgucgggaaguccuucuc

SEQ ID NO: 3790738 - RNA, 19 nt, Salmonella typhimurium LT2
cgucggguucgcgcgccgc

SEQ ID NO: 3790739 - RNA, 19 nt, Salmonella typhimurium LT2
cgucgguagaugcugaugu

SEQ ID NO: 3790740 - RNA, 18 nt, Salmonella typhimurium LT2
cgucggugccuggcuggc

SEQ ID NO: 3790741 - RNA, 18 nt, Salmonella typhimurium LT2
cgucgguucgucgagcag

SEQ ID NO: 3790742 - RNA, 15 nt, Salmonella typhimurium LT2
cgucguaaaaccugc

SEQ ID NO: 3790743 - RNA, 20 nt, Salmonella typhimurium LT2
cgucgucauucauggcgcgc

SEQ ID NO: 3790744 - RNA, 21 nt, Salmonella typhimurium LT2
cgucguccagcccggcggaua

SEQ ID NO: 3790745 - RNA, 19 nt, Salmonella typhimurium LT2
cgucgugcagcgccgccug

SEQ ID NO: 3790746 - RNA, 22 nt, Salmonella typhimurium LT2
cgucguucgcguaugggcgcga

SEQ ID NO: 3790747 - RNA, 16 nt, Salmonella typhimurium LT2
cgucuaccagcucucc

SEQ ID NO: 3790748 - RNA, 19 nt, Salmonella typhimurium LT2
cgucuaccguuucgaccgu

SEQ ID NO: 3790749 - RNA, 17 nt, Salmonella typhimurium LT2
cgucuacgccaucauug

SEQ ID NO: 3790750 - RNA, 19 nt, Salmonella typhimurium LT2
cgucuccagacaauccgcg

SEQ ID NO: 3790751 - RNA, 14 nt, Salmonella typhimurium LT2
cgucucccgacacc

SEQ ID NO: 3790752 - RNA, 21 nt, Salmonella typhimurium LT2
cgucuccggcgcgccgcuggc

SEQ ID NO: 3790753 - RNA, 15 nt, Salmonella typhimurium LT2
cgucucgcacucgcc

SEQ ID NO: 3790754 - RNA, 21 nt, Salmonella typhimurium LT2
cgucucgccgcggugauccuc

SEQ ID NO: 3790755 - RNA, 18 nt, Salmonella typhimurium LT2
cgucucuuucauggaaau

SEQ ID NO: 3790756 - RNA, 20 nt, Salmonella typhimurium LT2
cgucugaagaaguucuucug

SEQ ID NO: 3790757 - RNA, 22 nt, Salmonella typhimurium LT2
cgucugaauggacucgaaccau

SEQ ID NO: 3790758 - RNA, 16 nt, Salmonella typhimurium LT2
cgucugaccgccgcga

SEQ ID NO: 3790759 - RNA, 22 nt, Salmonella typhimurium LT2
cgucugaguauacagacagcag

SEQ ID NO: 3790760 - RNA, 21 nt, Salmonella typhimurium LT2
cgucugauugcgcccuccggc

SEQ ID NO: 3790761 - RNA, 16 nt, Salmonella typhimurium LT2
cgucugcccuccugaa

SEQ ID NO: 3790762 - RNA, 16 nt, Salmonella typhimurium LT2
cgucugcgcuuucagc

SEQ ID NO: 3790763 - RNA, 15 nt, Salmonella typhimurium LT2
cgucuggguuucagc

SEQ ID NO: 3790764 - RNA, 20 nt, Salmonella typhimurium LT2
cgucugguaauaggccggag

SEQ ID NO: 3790765 - RNA, 19 nt, Salmonella typhimurium LT2
cgucugguacggccaccag

SEQ ID NO: 3790766 - RNA, 20 nt, Salmonella typhimurium LT2
cgucugguacggccaccagg

SEQ ID NO: 3790767 - RNA, 14 nt, Salmonella typhimurium LT2
cgucuguuguucuu

SEQ ID NO: 3790768 - RNA, 14 nt, Salmonella typhimurium LT2
cgucuuauccggcc

SEQ ID NO: 3790769 - RNA, 15 nt, Salmonella typhimurium LT2
cgucuuauccggccu

SEQ ID NO: 3790770 - RNA, 16 nt, Salmonella typhimurium LT2
cgucuuauccggccuc

SEQ ID NO: 3790771 - RNA, 17 nt, Salmonella typhimurium LT2
cgucuuauccggccugc

SEQ ID NO: 3790772 - RNA, 14 nt, Salmonella typhimurium LT2
cgucuuauccggua

SEQ ID NO: 3790773 - RNA, 13 nt, Salmonella typhimurium LT2
cgucuucauccau

SEQ ID NO: 3790774 - RNA, 18 nt, Salmonella typhimurium LT2
cgucuucaucguucauug

SEQ ID NO: 3790775 - RNA, 17 nt, Salmonella typhimurium LT2
cgucuucaucuucgucu

SEQ ID NO: 3790776 - RNA, 23 nt, Salmonella typhimurium LT2
cgucuucuuccacuucagccagc

SEQ ID NO: 3790777 - RNA, 19 nt, Salmonella typhimurium LT2
cgugaaaaaugacgccggg

SEQ ID NO: 3790778 - RNA, 23 nt, Salmonella typhimurium LT2
cgugaaaauaaaauauccagcgu

SEQ ID NO: 3790779 - RNA, 22 nt, Salmonella typhimurium LT2
cgugaaaaugcguccagaggau

SEQ ID NO: 3790780 - RNA, 18 nt, Salmonella typhimurium LT2
cgugaaauuuccuccgcc

SEQ ID NO: 3790781 - RNA, 16 nt, Salmonella typhimurium LT2
cgugaacaaugccauu

SEQ ID NO: 3790782 - RNA, 22 nt, Salmonella typhimurium LT2
cgugaacaaugccauuuuugca

SEQ ID NO: 3790783 - RNA, 16 nt, Salmonella typhimurium LT2
cgugaaccagcauccc

SEQ ID NO: 3790784 - RNA, 20 nt, Salmonella typhimurium LT2
cgugaagaucagcagagcgg

SEQ ID NO: 3790785 - RNA, 19 nt, Salmonella typhimurium LT2
cgugaauguccugcggcac

SEQ ID NO: 3790786 - RNA, 18 nt, Salmonella typhimurium LT2
cgugaauuaauggucaga

SEQ ID NO: 3790787 - RNA, 19 nt, Salmonella typhimurium LT2
cgugacaugcgcauugacg

SEQ ID NO: 3790788 - RNA, 12 nt, Salmonella typhimurium LT2
cgugaccaucgc

SEQ ID NO: 3790789 - RNA, 20 nt, Salmonella typhimurium LT2
cgugaccgauaaaaaagccu

SEQ ID NO: 3790790 - RNA, 17 nt, Salmonella typhimurium LT2
cgugaccguuucaaaga

SEQ ID NO: 3790791 - RNA, 11 nt, Salmonella typhimurium LT2
cgugaccugcu

SEQ ID NO: 3790792 - RNA, 16 nt, Salmonella typhimurium LT2
cgugacuguucacauc

SEQ ID NO: 3790793 - RNA, 19 nt, Salmonella typhimurium LT2
cgugagaaguaagcgccag

SEQ ID NO: 3790794 - RNA, 22 nt, Salmonella typhimurium LT2
cgugagaucguuauuaaacaga

SEQ ID NO: 3790795 - RNA, 20 nt, Salmonella typhimurium LT2
cgugagcaaccaacgcgaua

SEQ ID NO: 3790796 - RNA, 13 nt, Salmonella typhimurium LT2
cgugagcgcgccg

SEQ ID NO: 3790797 - RNA, 14 nt, Salmonella typhimurium LT2
cgugagcgcgccgc

SEQ ID NO: 3790798 - RNA, 13 nt, Salmonella typhimurium LT2
cgugagcgcguca

SEQ ID NO: 3790799 - RNA, 17 nt, Salmonella typhimurium LT2
cgugagcgcgucaucau

SEQ ID NO: 3790800 - RNA, 17 nt, Salmonella typhimurium LT2
cgugaguggcggcacgc

SEQ ID NO: 3790801 - RNA, 20 nt, Salmonella typhimurium LT2
cgugagugguagaaacuggc

SEQ ID NO: 3790802 - RNA, 20 nt, Salmonella typhimurium LT2
cgugaguuucagcaucauau

SEQ ID NO: 3790803 - RNA, 13 nt, Salmonella typhimurium LT2
cgugaguuuuaac

SEQ ID NO: 3790804 - RNA, 23 nt, Salmonella typhimurium LT2
cgugauaaacgguucagucagcg

SEQ ID NO: 3790805 - RNA, 19 nt, Salmonella typhimurium LT2
cgugauaaagcugacgcgc

SEQ ID NO: 3790806 - RNA, 20 nt, Salmonella typhimurium LT2
cgugauaaagguauagugga

SEQ ID NO: 3790807 - RNA, 21 nt, Salmonella typhimurium LT2
cgugauaauucccccauccgc

SEQ ID NO: 3790808 - RNA, 20 nt, Salmonella typhimurium LT2
cgugaugcgacgcgcucacc

SEQ ID NO: 3790809 - RNA, 21 nt, Salmonella typhimurium LT2
cgugaugcgacgcgcucaccu

SEQ ID NO: 3790810 - RNA, 15 nt, Salmonella typhimurium LT2
cgugaugcuuuuuac

SEQ ID NO: 3790811 - RNA, 13 nt, Salmonella typhimurium LT2
cgugauggaacau

SEQ ID NO: 3790812 - RNA, 17 nt, Salmonella typhimurium LT2
cgugaugggcgaucgcc

SEQ ID NO: 3790813 - RNA, 18 nt, Salmonella typhimurium LT2
cgugauucacccgcguga

SEQ ID NO: 3790814 - RNA, 17 nt, Salmonella typhimurium LT2
cgugauugagcagauca

SEQ ID NO: 3790815 - RNA, 15 nt, Salmonella typhimurium LT2
cguucagcucagcgc

SEQ ID NO: 3790816 - RNA, 23 nt, Salmonella typhimurium LT2
cguucagcucagcgccccagcca

SEQ ID NO: 3790817 - RNA, 19 nt, Salmonella typhimurium LT2
cguucauaguuugcauaac

SEQ ID NO: 3790818 - RNA, 13 nt, Salmonella typhimurium LT2
cguucaucaggca

SEQ ID NO: 3790819 - RNA, 14 nt, Salmonella typhimurium LT2
cguucaucaggcaa

SEQ ID NO: 3790820 - RNA, 19 nt, Salmonella typhimurium LT2
cguucauucgccccagcau

SEQ ID NO: 3790821 - RNA, 16 nt, Salmonella typhimurium LT2
cguucauugcuuucuu

SEQ ID NO: 3790822 - RNA, 14 nt, Salmonella typhimurium LT2
cguuccaggcgcuc

SEQ ID NO: 3790823 - RNA, 15 nt, Salmonella typhimurium LT2
cguuccccaacagcg

SEQ ID NO: 3790824 - RNA, 14 nt, Salmonella typhimurium LT2
cguucccgcaggcc

SEQ ID NO: 3790825 - RNA, 14 nt, Salmonella typhimurium LT2
cguuccuuaucagc

SEQ ID NO: 3790826 - RNA, 18 nt, Salmonella typhimurium LT2
cguucgacaacggaucgc

SEQ ID NO: 3790827 - RNA, 20 nt, Salmonella typhimurium LT2
cguucgcauauucugcgaaa

SEQ ID NO: 3790828 - RNA, 20 nt, Salmonella typhimurium LT2
cguucggcaaaacgccgcag

SEQ ID NO: 3790829 - RNA, 16 nt, Salmonella typhimurium LT2
cguucgggucaagaaa

SEQ ID NO: 3790830 - RNA, 13 nt, Salmonella typhimurium LT2
cguucggguuuuc

SEQ ID NO: 3790831 - RNA, 13 nt, Salmonella typhimurium LT2
cguucgucgccgg

SEQ ID NO: 3790832 - RNA, 17 nt, Salmonella typhimurium LT2
cguucugguugaccgga

SEQ ID NO: 3790833 - RNA, 14 nt, Salmonella typhimurium LT2
cguucugugcgccg

SEQ ID NO: 3790834 - RNA, 11 nt, Salmonella typhimurium LT2
cguucuuccug

SEQ ID NO: 3790835 - RNA, 14 nt, Salmonella typhimurium LT2
cguugaaaaccugc

SEQ ID NO: 3790836 - RNA, 11 nt, Salmonella typhimurium LT2
cguugaaaacg

SEQ ID NO: 3790837 - RNA, 19 nt, Salmonella typhimurium LT2
cguugaauuccaucggcau

SEQ ID NO: 3790838 - RNA, 22 nt, Salmonella typhimurium LT2
cguugaccagccuaccugccgc

SEQ ID NO: 3790839 - RNA, 15 nt, Salmonella typhimurium LT2
cguugacgugagaga

SEQ ID NO: 3790840 - RNA, 23 nt, Salmonella typhimurium LT2
cguugagcguguccucugcugcg

SEQ ID NO: 3790841 - RNA, 15 nt, Salmonella typhimurium LT2
cguugauagacgaca

SEQ ID NO: 3790842 - RNA, 13 nt, Salmonella typhimurium LT2
cguugauaucuuc

SEQ ID NO: 3790843 - RNA, 21 nt, Salmonella typhimurium LT2
cguugaucuccgcgcaaucgc

SEQ ID NO: 3790844 - RNA, 12 nt, Salmonella typhimurium LT2
cguugaugauaa

SEQ ID NO: 3790845 - RNA, 15 nt, Salmonella typhimurium LT2
cguugcaaucgccug

SEQ ID NO: 3790846 - RNA, 14 nt, Salmonella typhimurium LT2
cguugccagaguuc

SEQ ID NO: 3790847 - RNA, 15 nt, Salmonella typhimurium LT2
cguugccagcggcca

SEQ ID NO: 3790848 - RNA, 16 nt, Salmonella typhimurium LT2
cguugccagcggccag

SEQ ID NO: 3790849 - RNA, 19 nt, Salmonella typhimurium LT2
cguugccauagcgggcagc

SEQ ID NO: 3790850 - RNA, 22 nt, Salmonella typhimurium LT2
cguugccaucgcacucuccggc

SEQ ID NO: 3790851 - RNA, 22 nt, Salmonella typhimurium LT2
cguugcccaucgcaacgccggu

SEQ ID NO: 3790852 - RNA, 19 nt, Salmonella typhimurium LT2
cguugccgcccaccugcag

SEQ ID NO: 3790853 - RNA, 22 nt, Salmonella typhimurium LT2
cguugccgcccaccugcagcag

SEQ ID NO: 3790854 - RNA, 15 nt, Salmonella typhimurium LT2
cguugccugaaaagg

SEQ ID NO: 3790855 - RNA, 17 nt, Salmonella typhimurium LT2
cguugcgaaucagguac

SEQ ID NO: 3790856 - RNA, 16 nt, Salmonella typhimurium LT2
cguugcgacuaucggc

SEQ ID NO: 3790857 - RNA, 22 nt, Salmonella typhimurium LT2
cguugcuggacauauuccagaa

SEQ ID NO: 3790858 - RNA, 20 nt, Salmonella typhimurium LT2
cguuggaauaaaucacaacg

SEQ ID NO: 3790859 - RNA, 17 nt, Salmonella typhimurium LT2
cguuggccgccggacag

SEQ ID NO: 3790860 - RNA, 20 nt, Salmonella typhimurium LT2
cguuggcguaaaucaggcca

SEQ ID NO: 3790861 - RNA, 19 nt, Salmonella typhimurium LT2
cguuggcgucaucgacauu

SEQ ID NO: 3790862 - RNA, 19 nt, Salmonella typhimurium LT2
cguuggcuugaucaacgcc

SEQ ID NO: 3790863 - RNA, 16 nt, Salmonella typhimurium LT2
cguuggcuuuuguagg

SEQ ID NO: 3790864 - RNA, 17 nt, Salmonella typhimurium LT2
cguugggugaggcguag

SEQ ID NO: 3790865 - RNA, 18 nt, Salmonella typhimurium LT2
cguugguagacccggcau

SEQ ID NO: 3790866 - RNA, 13 nt, Salmonella typhimurium LT2
cguuguaggccug

SEQ ID NO: 3790867 - RNA, 20 nt, Salmonella typhimurium LT2
cguuguaguuaucgccgaaa

SEQ ID NO: 3790868 - RNA, 13 nt, Salmonella typhimurium LT2
cguuguauaaaca

SEQ ID NO: 3790869 - RNA, 15 nt, Salmonella typhimurium LT2
cguugugcugcggca

SEQ ID NO: 3790870 - RNA, 12 nt, Salmonella typhimurium LT2
cguuuaaacggg

SEQ ID NO: 3790871 - RNA, 14 nt, Salmonella typhimurium LT2
cguuuaaagcgcuc

SEQ ID NO: 3790872 - RNA, 21 nt, Salmonella typhimurium LT2
cguuuaacugaacaucgccgu

SEQ ID NO: 3790873 - RNA, 16 nt, Salmonella typhimurium LT2
cguuuauaccccacca

SEQ ID NO: 3790874 - RNA, 23 nt, Salmonella typhimurium LT2
cguuuauauaaaaauagcuggcu

SEQ ID NO: 3790875 - RNA, 13 nt, Salmonella typhimurium LT2
cguuuauuauuug

SEQ ID NO: 3790876 - RNA, 13 nt, Salmonella typhimurium LT2
cguuuauucuuuu

SEQ ID NO: 3790877 - RNA, 20 nt, Salmonella typhimurium LT2
cguuucaacaaacucagcca

SEQ ID NO: 3790878 - RNA, 19 nt, Salmonella typhimurium LT2
cguuucacaaccuccacgc

SEQ ID NO: 3790879 - RNA, 20 nt, Salmonella typhimurium LT2
cguuucacaucgcccacuaa

SEQ ID NO: 3790880 - RNA, 22 nt, Salmonella typhimurium LT2
cguuucauccugacaggccgga

SEQ ID NO: 3790881 - RNA, 20 nt, Salmonella typhimurium LT2
cguuucccggauaaauguuu

SEQ ID NO: 3790882 - RNA, 19 nt, Salmonella typhimurium LT2
cguuuccgccaguuuugca

SEQ ID NO: 3790883 - RNA, 23 nt, Salmonella typhimurium LT2
cguuuccugcgccagcaccaugg

SEQ ID NO: 3790884 - RNA, 18 nt, Salmonella typhimurium LT2
cguuucgauaaccaccag

SEQ ID NO: 3790885 - RNA, 16 nt, Salmonella typhimurium LT2
cguuucgccaguuuac

SEQ ID NO: 3790886 - RNA, 14 nt, Salmonella typhimurium LT2
cguuucgccgccau

SEQ ID NO: 3790887 - RNA, 20 nt, Salmonella typhimurium LT2
cguuucgggaacguucccau

SEQ ID NO: 3790888 - RNA, 20 nt, Salmonella typhimurium LT2
cguuucguguuguccggcca

SEQ ID NO: 3790889 - RNA, 19 nt, Salmonella typhimurium LT2
cguuucguuuagcgccugc

SEQ ID NO: 3790890 - RNA, 12 nt, Salmonella typhimurium LT2
cguuucucuugu

SEQ ID NO: 3790891 - RNA, 17 nt, Salmonella typhimurium LT2
cguuucuguaaaucaac

SEQ ID NO: 3790892 - RNA, 15 nt, Salmonella typhimurium LT2
cguuucuuucaucag

SEQ ID NO: 3790893 - RNA, 14 nt, Salmonella typhimurium LT2
cguuugaacagcag

SEQ ID NO: 3790894 - RNA, 15 nt, Salmonella typhimurium LT2
cguuugcagcggaag

SEQ ID NO: 3790895 - RNA, 19 nt, Salmonella typhimurium LT2
cguuugcauaggccccggu

SEQ ID NO: 3790896 - RNA, 15 nt, Salmonella typhimurium LT2
cguuugcgccggauc

SEQ ID NO: 3790897 - RNA, 15 nt, Salmonella typhimurium LT2
cguuuguaacagcag

SEQ ID NO: 3790898 - RNA, 21 nt, Salmonella typhimurium LT2
cguuugucuucugccagcagc

SEQ ID NO: 3790899 - RNA, 16 nt, Salmonella typhimurium LT2
cguuuuacaccagcuu

SEQ ID NO: 3790900 - RNA, 19 nt, Salmonella typhimurium LT2
cguuuuacaccagcuuuua

SEQ ID NO: 3790901 - RNA, 18 nt, Salmonella typhimurium LT2
cguuuuagguucuucaau

SEQ ID NO: 3790902 - RNA, 20 nt, Salmonella typhimurium LT2
cguuuuauuugaugccuggc

SEQ ID NO: 3790903 - RNA, 19 nt, Salmonella typhimurium LT2
cguuuucauuagccgccag

SEQ ID NO: 3790904 - RNA, 16 nt, Salmonella typhimurium LT2
cguuuuccaucaccau

SEQ ID NO: 3790905 - RNA, 16 nt, Salmonella typhimurium LT2
cguuuucgucaacaua

SEQ ID NO: 3790906 - RNA, 16 nt, Salmonella typhimurium LT2
cguuuugcagcgccau

SEQ ID NO: 3790907 - RNA, 17 nt, Salmonella typhimurium LT2
cguuuugcugccacguc

SEQ ID NO: 3790908 - RNA, 12 nt, Salmonella typhimurium LT2
cguuuugcuguc

SEQ ID NO: 3790909 - RNA, 17 nt, Salmonella typhimurium LT2
cguuuuggcagcgcccg

SEQ ID NO: 3790910 - RNA, 19 nt, Salmonella typhimurium LT2
cguuuuggguaaauaccag

SEQ ID NO: 3790911 - RNA, 18 nt, Salmonella typhimurium LT2
cguuuuguugccgcccgu

SEQ ID NO: 3790912 - RNA, 18 nt, Salmonella typhimurium LT2
cguuuuuaucgcucgucg

SEQ ID NO: 3790913 - RNA, 17 nt, Salmonella typhimurium LT2
cguuuuucagccgcgca

SEQ ID NO: 3790914 - RNA, 15 nt, Salmonella typhimurium LT2
cguuuuucucaucaa

SEQ ID NO: 3790915 - RNA, 22 nt, Salmonella typhimurium LT2
cguuuuucugaagcguaacagc

SEQ ID NO: 3790916 - RNA, 18 nt, Salmonella typhimurium LT2
cguuuuuuacgucagcaa

SEQ ID NO: 3790917 - RNA, 14 nt, Salmonella typhimurium LT2
cuaaaaaccagaac

SEQ ID NO: 3790918 - RNA, 21 nt, Salmonella typhimurium LT2
cuaaacaauuugcccagcgcu

SEQ ID NO: 3790919 - RNA, 16 nt, Salmonella typhimurium LT2
cuaccgcgaugugcug

SEQ ID NO: 3790920 - RNA, 15 nt, Salmonella typhimurium LT2
cuaccgcgccagccg

SEQ ID NO: 3790921 - RNA, 17 nt, Salmonella typhimurium LT2
cuaccgcuucgcgcgcc

SEQ ID NO: 3790922 - RNA, 14 nt, Salmonella typhimurium LT2
cuaccggauaaauu

SEQ ID NO: 3790923 - RNA, 16 nt, Salmonella typhimurium LT2
cuaccgggcagcaucu

SEQ ID NO: 3790924 - RNA, 17 nt, Salmonella typhimurium LT2
cuaccggggcgcucgcc

SEQ ID NO: 3790925 - RNA, 15 nt, Salmonella typhimurium LT2
cuaccgucagcagca

SEQ ID NO: 3790926 - RNA, 17 nt, Salmonella typhimurium LT2
cuaccugcacuuuaagc

SEQ ID NO: 3790927 - RNA, 16 nt, Salmonella typhimurium LT2
cuaccugcagggugaa

SEQ ID NO: 3790928 - RNA, 18 nt, Salmonella typhimurium LT2
cuaccugcagggugaaga

SEQ ID NO: 3790929 - RNA, 12 nt, Salmonella typhimurium LT2
cuacgaacgcga

SEQ ID NO: 3790930 - RNA, 13 nt, Salmonella typhimurium LT2
cuacgccuccugc

SEQ ID NO: 3790931 - RNA, 15 nt, Salmonella typhimurium LT2
cuacgccuccugccg

SEQ ID NO: 3790932 - RNA, 19 nt, Salmonella typhimurium LT2
cuacgcucauaaaaaagaa

SEQ ID NO: 3790933 - RNA, 20 nt, Salmonella typhimurium LT2
cuacgcucauaaaaaagaau

SEQ ID NO: 3790934 - RNA, 21 nt, Salmonella typhimurium LT2
cuacgcugccauccucauuuu

SEQ ID NO: 3790935 - RNA, 18 nt, Salmonella typhimurium LT2
cuacgcuuaucaggccua

SEQ ID NO: 3790936 - RNA, 13 nt, Salmonella typhimurium LT2
cuacggcaaacac

SEQ ID NO: 3790937 - RNA, 13 nt, Salmonella typhimurium LT2
cuacggcgcacag

SEQ ID NO: 3790938 - RNA, 15 nt, Salmonella typhimurium LT2
cuacgguaaaccagg

SEQ ID NO: 3790939 - RNA, 15 nt, Salmonella typhimurium LT2
cuacggucaguuguc

SEQ ID NO: 3790940 - RNA, 22 nt, Salmonella typhimurium LT2
cuacgucaggaaacgcgccgga

SEQ ID NO: 3790941 - RNA, 18 nt, Salmonella typhimurium LT2
cuacguucaucaggcaau

SEQ ID NO: 3790942 - RNA, 19 nt, Salmonella typhimurium LT2
cuacguugaccucaucacc

SEQ ID NO: 3790943 - RNA, 23 nt, Salmonella typhimurium LT2
cuacuacauagcuauauuuuuua

SEQ ID NO: 3790944 - RNA, 15 nt, Salmonella typhimurium LT2
cuacuaucaucugac

SEQ ID NO: 3790945 - RNA, 20 nt, Salmonella typhimurium LT2
cuacuccgcgagcagccaga

SEQ ID NO: 3790946 - RNA, 18 nt, Salmonella typhimurium LT2
cuacucugcucgccagua

SEQ ID NO: 3790947 - RNA, 15 nt, Salmonella typhimurium LT2
cuacucuugagccag

SEQ ID NO: 3790948 - RNA, 12 nt, Salmonella typhimurium LT2
cuacugaaaagu

SEQ ID NO: 3790949 - RNA, 12 nt, Salmonella typhimurium LT2
cuacugccgcca

SEQ ID NO: 3790950 - RNA, 18 nt, Salmonella typhimurium LT2
cuacugccgccaucgcug

SEQ ID NO: 3790951 - RNA, 18 nt, Salmonella typhimurium LT2
cuacuggcugguuucucc

SEQ ID NO: 3790952 - RNA, 17 nt, Salmonella typhimurium LT2
cuacuucaauuuuccag

SEQ ID NO: 3790953 - RNA, 16 nt, Salmonella typhimurium LT2
cuagacuacaugccaa

SEQ ID NO: 3790954 - RNA, 20 nt, Salmonella typhimurium LT2
cuagaugaugauuuaugaau

SEQ ID NO: 3790955 - RNA, 23 nt, Salmonella typhimurium LT2
cuagaugaugauuuaugaauagc

SEQ ID NO: 3790956 - RNA, 13 nt, Salmonella typhimurium LT2
cuagcauaagcac

SEQ ID NO: 3790957 - RNA, 22 nt, Salmonella typhimurium LT2
cuagccgccguguugugugccg

SEQ ID NO: 3790958 - RNA, 21 nt, Salmonella typhimurium LT2
cuagcuucagguguuaguguc

SEQ ID NO: 3790959 - RNA, 21 nt, Salmonella typhimurium LT2
cuagcuucagguguuaguguu

SEQ ID NO: 3790960 - RNA, 22 nt, Salmonella typhimurium LT2
cuagucaggcacaaaaaacaaa

SEQ ID NO: 3790961 - RNA, 13 nt, Salmonella typhimurium LT2
cuaguccugauau

SEQ ID NO: 3790962 - RNA, 14 nt, Salmonella typhimurium LT2
cuauaacagcgcca

SEQ ID NO: 3790963 - RNA, 23 nt, Salmonella typhimurium LT2
cuauaauugcuuuuuuccacaga

SEQ ID NO: 3790964 - RNA, 12 nt, Salmonella typhimurium LT2
cuauacaguaaa

SEQ ID NO: 3790965 - RNA, 14 nt, Salmonella typhimurium LT2
cuauacgcggcgua

SEQ ID NO: 3790966 - RNA, 18 nt, Salmonella typhimurium LT2
cuauacgguaaaucauuu

SEQ ID NO: 3790967 - RNA, 15 nt, Salmonella typhimurium LT2
cuauagauauuaaac

SEQ ID NO: 3790968 - RNA, 16 nt, Salmonella typhimurium LT2
cuauagcuuuucauau

SEQ ID NO: 3790969 - RNA, 12 nt, Salmonella typhimurium LT2
cuauauaaaauc

SEQ ID NO: 3790970 - RNA, 15 nt, Salmonella typhimurium LT2
cuauauauucuucuu

SEQ ID NO: 3790971 - RNA, 20 nt, Salmonella typhimurium LT2
cuauaugcaggcauaaaaaa

SEQ ID NO: 3790972 - RNA, 19 nt, Salmonella typhimurium LT2
cuauauuuuuuaucagacu

SEQ ID NO: 3790973 - RNA, 17 nt, Salmonella typhimurium LT2
cuaucaagauaaaaaga

SEQ ID NO: 3790974 - RNA, 20 nt, Salmonella typhimurium LT2
cuaucaagggugcuggcaau

SEQ ID NO: 3790975 - RNA, 17 nt, Salmonella typhimurium LT2
cuaucacaugugcgcua

SEQ ID NO: 3790976 - RNA, 20 nt, Salmonella typhimurium LT2
cuaucaccgccucgaccccu

SEQ ID NO: 3790977 - RNA, 22 nt, Salmonella typhimurium LT2
cuaucaccgcgaugaccaucaa

SEQ ID NO: 3790978 - RNA, 16 nt, Salmonella typhimurium LT2
cuaucaggcaauacgc

SEQ ID NO: 3790979 - RNA, 21 nt, Salmonella typhimurium LT2
cuaucaggcaauacgcugccg

SEQ ID NO: 3790980 - RNA, 15 nt, Salmonella typhimurium LT2
cuauccacagcgaau

SEQ ID NO: 3790981 - RNA, 11 nt, Salmonella typhimurium LT2
cuauccacgca

SEQ ID NO: 3790982 - RNA, 18 nt, Salmonella typhimurium LT2
cuauccacgcagacgccg

SEQ ID NO: 3790983 - RNA, 14 nt, Salmonella typhimurium LT2
cuauccagcucacc

SEQ ID NO: 3790984 - RNA, 15 nt, Salmonella typhimurium LT2
cuauccagcucaccg

SEQ ID NO: 3790985 - RNA, 19 nt, Salmonella typhimurium LT2
cuauccagggcacugucau

SEQ ID NO: 3790986 - RNA, 14 nt, Salmonella typhimurium LT2
cuauccagucagcg

SEQ ID NO: 3790987 - RNA, 15 nt, Salmonella typhimurium LT2
cuaucccauuuuuug

SEQ ID NO: 3790988 - RNA, 21 nt, Salmonella typhimurium LT2
cuauccgccgccagccauaaa

SEQ ID NO: 3790989 - RNA, 22 nt, Salmonella typhimurium LT2
cuauccgccgccagccauaaau

SEQ ID NO: 3790990 - RNA, 14 nt, Salmonella typhimurium LT2
cuauccucaacuug

SEQ ID NO: 3790991 - RNA, 23 nt, Salmonella typhimurium LT2
cuauccucuuuuaucacccggau

SEQ ID NO: 3790992 - RNA, 17 nt, Salmonella typhimurium LT2
cuaucgaccagcaccug

SEQ ID NO: 3790993 - RNA, 22 nt, Salmonella typhimurium LT2
cuaucgcccaaauaguccagca

SEQ ID NO: 3790994 - RNA, 12 nt, Salmonella typhimurium LT2
cuaucgccgccc

SEQ ID NO: 3790995 - RNA, 15 nt, Salmonella typhimurium LT2
cuaucgcugcgcugc

SEQ ID NO: 3790996 - RNA, 20 nt, Salmonella typhimurium LT2
cuaucgcuucucccugacug

SEQ ID NO: 3790997 - RNA, 20 nt, Salmonella typhimurium LT2
cuaucggcaaaccaugaucg

SEQ ID NO: 3790998 - RNA, 20 nt, Salmonella typhimurium LT2
cuaucgguaguguuaucgcc

SEQ ID NO: 3790999 - RNA, 14 nt, Salmonella typhimurium LT2
cuaucuucgauaaa

SEQ ID NO: 3791000 - RNA, 13 nt, Salmonella typhimurium LT2
cuaucuuuuuaag

SEQ ID NO: 3791001 - RNA, 15 nt, Salmonella typhimurium LT2
cuaugccaagcgcaa

SEQ ID NO: 3791002 - RNA, 14 nt, Salmonella typhimurium LT2
cuaugcuccccccc

SEQ ID NO: 3791003 - RNA, 19 nt, Salmonella typhimurium LT2
cuaugcucccccccuuccc

SEQ ID NO: 3791004 - RNA, 18 nt, Salmonella typhimurium LT2
cuaugguaauuuaaagua

SEQ ID NO: 3791005 - RNA, 20 nt, Salmonella typhimurium LT2
cuauguaaagaaugaaaaaa

SEQ ID NO: 3791006 - RNA, 14 nt, Salmonella typhimurium LT2
cuauguacucugau

SEQ ID NO: 3791007 - RNA, 13 nt, Salmonella typhimurium LT2
cuauguagcgcug

SEQ ID NO: 3791008 - RNA, 23 nt, Salmonella typhimurium LT2
cuauguagcgcugaagcccgcga

SEQ ID NO: 3791009 - RNA, 18 nt, Salmonella typhimurium LT2
cuauguucaugcuggcuu

SEQ ID NO: 3791010 - RNA, 16 nt, Salmonella typhimurium LT2
cuauuaucggcaccau

SEQ ID NO: 3791011 - RNA, 14 nt, Salmonella typhimurium LT2
cuauuauuuuucua

SEQ ID NO: 3791012 - RNA, 21 nt, Salmonella typhimurium LT2
cuauucaugccgaccagggcg

SEQ ID NO: 3791013 - RNA, 18 nt, Salmonella typhimurium LT2
cuauuccagagaguuuuc

SEQ ID NO: 3791014 - RNA, 16 nt, Salmonella typhimurium LT2
cuauuccaguuuuuau

SEQ ID NO: 3791015 - RNA, 14 nt, Salmonella typhimurium LT2
cuauucccaggcaa

SEQ ID NO: 3791016 - RNA, 20 nt, Salmonella typhimurium LT2
cuauucccaggcaaaugauu

SEQ ID NO: 3791017 - RNA, 13 nt, Salmonella typhimurium LT2
cuauucuuaucau

SEQ ID NO: 3791018 - RNA, 16 nt, Salmonella typhimurium LT2
cuauugccugauggcg

SEQ ID NO: 3791019 - RNA, 19 nt, Salmonella typhimurium LT2
cuauuuaaaaaccgccccc

SEQ ID NO: 3791020 - RNA, 22 nt, Salmonella typhimurium LT2
cuauuucaguacagccaaaaau

SEQ ID NO: 3791021 - RNA, 21 nt, Salmonella typhimurium LT2
cuauuucuguauaauuauuug

SEQ ID NO: 3791022 - RNA, 13 nt, Salmonella typhimurium LT2
cuauuugcagauu

SEQ ID NO: 3791023 - RNA, 21 nt, Salmonella typhimurium LT2
cucaucaauggauuuauggca

SEQ ID NO: 3791024 - RNA, 22 nt, Salmonella typhimurium LT2
cucaucaauucuuuaauuugug

SEQ ID NO: 3791025 - RNA, 17 nt, Salmonella typhimurium LT2
cucaucacagccacacu

SEQ ID NO: 3791026 - RNA, 21 nt, Salmonella typhimurium LT2
cucaucaguuugcgauaagcg

SEQ ID NO: 3791027 - RNA, 17 nt, Salmonella typhimurium LT2
cucauccagcaaaauaa

SEQ ID NO: 3791028 - RNA, 13 nt, Salmonella typhimurium LT2
cucauccagcaac

SEQ ID NO: 3791029 - RNA, 15 nt, Salmonella typhimurium LT2
cucaucccccagccg

SEQ ID NO: 3791030 - RNA, 16 nt, Salmonella typhimurium LT2
cucaucccccagccgc

SEQ ID NO: 3791031 - RNA, 13 nt, Salmonella typhimurium LT2
cucauccggcagc

SEQ ID NO: 3791032 - RNA, 11 nt, Salmonella typhimurium LT2
cucaucgacuu

SEQ ID NO: 3791033 - RNA, 17 nt, Salmonella typhimurium LT2
cucaucuucuuuuuccg

SEQ ID NO: 3791034 - RNA, 13 nt, Salmonella typhimurium LT2
cucaucuuuuaca

SEQ ID NO: 3791035 - RNA, 16 nt, Salmonella typhimurium LT2
cucaugcaacuggcaa

SEQ ID NO: 3791036 - RNA, 14 nt, Salmonella typhimurium LT2
cucaugcguaaauc

SEQ ID NO: 3791037 - RNA, 16 nt, Salmonella typhimurium LT2
cucaugugcagcaucc

SEQ ID NO: 3791038 - RNA, 17 nt, Salmonella typhimurium LT2
cucauguucaagcuggu

SEQ ID NO: 3791039 - RNA, 23 nt, Salmonella typhimurium LT2
cucauuaccggcugccgauagca

SEQ ID NO: 3791040 - RNA, 16 nt, Salmonella typhimurium LT2
cucauuauccagugcg

SEQ ID NO: 3791041 - RNA, 16 nt, Salmonella typhimurium LT2
cucauuaugccucccg

SEQ ID NO: 3791042 - RNA, 16 nt, Salmonella typhimurium LT2
cucauucagcaacugc

SEQ ID NO: 3791043 - RNA, 15 nt, Salmonella typhimurium LT2
cucauucagcggcug

SEQ ID NO: 3791044 - RNA, 23 nt, Salmonella typhimurium LT2
cucauuggguaugcgcaaaucaa

SEQ ID NO: 3791045 - RNA, 22 nt, Salmonella typhimurium LT2
cucauuucucaaaaacaccauu

SEQ ID NO: 3791046 - RNA, 18 nt, Salmonella typhimurium LT2
cucauuuuguugcuccag

SEQ ID NO: 3791047 - RNA, 23 nt, Salmonella typhimurium LT2
cucauuuuugaguuugucaucca

SEQ ID NO: 3791048 - RNA, 13 nt, Salmonella typhimurium LT2
cuccaauaaauau

SEQ ID NO: 3791049 - RNA, 14 nt, Salmonella typhimurium LT2
cuccacaguucaau

SEQ ID NO: 3791050 - RNA, 20 nt, Salmonella typhimurium LT2
cuccaccgccuggcgcgacu

SEQ ID NO: 3791051 - RNA, 18 nt, Salmonella typhimurium LT2
cuccaccgugucauagcc

SEQ ID NO: 3791052 - RNA, 12 nt, Salmonella typhimurium LT2
cuccaccucgcg

SEQ ID NO: 3791053 - RNA, 18 nt, Salmonella typhimurium LT2
cuccacgcccagcgccgg

SEQ ID NO: 3791054 - RNA, 16 nt, Salmonella typhimurium LT2
cuccacguauaauaau

SEQ ID NO: 3791055 - RNA, 13 nt, Salmonella typhimurium LT2
cuccagagcgccg

SEQ ID NO: 3791056 - RNA, 16 nt, Salmonella typhimurium LT2
cuccagcaaaucaauu

SEQ ID NO: 3791057 - RNA, 17 nt, Salmonella typhimurium LT2
cuccagcaucauuuuuu

SEQ ID NO: 3791058 - RNA, 13 nt, Salmonella typhimurium LT2
cuccagccagcgc

SEQ ID NO: 3791059 - RNA, 15 nt, Salmonella typhimurium LT2
cuccagccgcugccu

SEQ ID NO: 3791060 - RNA, 20 nt, Salmonella typhimurium LT2
cuccagccgucuuucccggc

SEQ ID NO: 3791061 - RNA, 20 nt, Salmonella typhimurium LT2
cuccagcgaggccucuccuc

SEQ ID NO: 3791062 - RNA, 13 nt, Salmonella typhimurium LT2
cuccagcgccugc

SEQ ID NO: 3791063 - RNA, 14 nt, Salmonella typhimurium LT2
cuccagcgccugcu

SEQ ID NO: 3791064 - RNA, 22 nt, Salmonella typhimurium LT2
cuccagcgccugcugcaacguc

SEQ ID NO: 3791065 - RNA, 22 nt, Salmonella typhimurium LT2
cuccagcgggcuggcauucauu

SEQ ID NO: 3791066 - RNA, 16 nt, Salmonella typhimurium LT2
cuccagcucagggucc

SEQ ID NO: 3791067 - RNA, 22 nt, Salmonella typhimurium LT2
cuccagcuggcuggcauugccg

SEQ ID NO: 3791068 - RNA, 21 nt, Salmonella typhimurium LT2
cuccaggaacaggcccgccag

SEQ ID NO: 3791069 - RNA, 22 nt, Salmonella typhimurium LT2
cuccaggaacaggcccgccaga

SEQ ID NO: 3791070 - RNA, 18 nt, Salmonella typhimurium LT2
cuccaggaugugaggcag

SEQ ID NO: 3791071 - RNA, 16 nt, Salmonella typhimurium LT2
cuccaggccaagcgcc

SEQ ID NO: 3791072 - RNA, 16 nt, Salmonella typhimurium LT2
cuccaggcgcugcugg

SEQ ID NO: 3791073 - RNA, 16 nt, Salmonella typhimurium LT2
cuccaggcguuuauga

SEQ ID NO: 3791074 - RNA, 15 nt, Salmonella typhimurium LT2
cuccaguaauucccg

SEQ ID NO: 3791075 - RNA, 22 nt, Salmonella typhimurium LT2
cuccaguugauacaggaauaac

SEQ ID NO: 3791076 - RNA, 20 nt, Salmonella typhimurium LT2
cuccaguuguuccagcagcu

SEQ ID NO: 3791077 - RNA, 22 nt, Salmonella typhimurium LT2
cuccaguuguuccagcagcuca

SEQ ID NO: 3791078 - RNA, 15 nt, Salmonella typhimurium LT2
cuccaguuucgccag

SEQ ID NO: 3791079 - RNA, 23 nt, Salmonella typhimurium LT2
cuccaucagacguuuauacccca

SEQ ID NO: 3791080 - RNA, 15 nt, Salmonella typhimurium LT2
cuccaucauaucgcg

SEQ ID NO: 3791081 - RNA, 14 nt, Salmonella typhimurium LT2
cuccaucaucgcca

SEQ ID NO: 3791082 - RNA, 16 nt, Salmonella typhimurium LT2
cuccauugcagcgugg

SEQ ID NO: 3791083 - RNA, 19 nt, Salmonella typhimurium LT2
cuccauuuuggggaaaaua

SEQ ID NO: 3791084 - RNA, 19 nt, Salmonella typhimurium LT2
cucccaaauuuuuuuagca

SEQ ID NO: 3791085 - RNA, 11 nt, Salmonella typhimurium LT2
cucccaacaga

SEQ ID NO: 3791086 - RNA, 13 nt, Salmonella typhimurium LT2
cucccacauuuca

SEQ ID NO: 3791087 - RNA, 16 nt, Salmonella typhimurium LT2
cucccacccgcgcgcu

SEQ ID NO: 3791088 - RNA, 21 nt, Salmonella typhimurium LT2
cucccacccgcgcgcuuucca

SEQ ID NO: 3791089 - RNA, 14 nt, Salmonella typhimurium LT2
cucccacucuucca

SEQ ID NO: 3791090 - RNA, 20 nt, Salmonella typhimurium LT2
cucccacucuuccagcaccg

SEQ ID NO: 3791091 - RNA, 18 nt, Salmonella typhimurium LT2
cucccacugccguagcgc

SEQ ID NO: 3791092 - RNA, 14 nt, Salmonella typhimurium LT2
cucccagaugaaaa

SEQ ID NO: 3791093 - RNA, 17 nt, Salmonella typhimurium LT2
cucccaggccgccaccg

SEQ ID NO: 3791094 - RNA, 17 nt, Salmonella typhimurium LT2
cucccaggcgcgcagcu

SEQ ID NO: 3791095 - RNA, 21 nt, Salmonella typhimurium LT2
cucccaggcgcgcagcugcca

SEQ ID NO: 3791096 - RNA, 16 nt, Salmonella typhimurium LT2
cucccauuugcgggug

SEQ ID NO: 3791097 - RNA, 22 nt, Salmonella typhimurium LT2
cuccccaacaucauuacugcuu

SEQ ID NO: 3791098 - RNA, 16 nt, Salmonella typhimurium LT2
cuccccacgaaagucu

SEQ ID NO: 3791099 - RNA, 18 nt, Salmonella typhimurium LT2
cuccccacgaaagucugu

SEQ ID NO: 3791100 - RNA, 13 nt, Salmonella typhimurium LT2
cucccccccuucc

SEQ ID NO: 3791101 - RNA, 14 nt, Salmonella typhimurium LT2
cucccccggcacca

SEQ ID NO: 3791102 - RNA, 18 nt, Salmonella typhimurium LT2
cucccccggcaccacgca

SEQ ID NO: 3791103 - RNA, 14 nt, Salmonella typhimurium LT2
cuccccgccccagc

SEQ ID NO: 3791104 - RNA, 22 nt, Salmonella typhimurium LT2
cuccccgccccagcagcagccg

SEQ ID NO: 3791105 - RNA, 14 nt, Salmonella typhimurium LT2
cuccccgccgcggc

SEQ ID NO: 3791106 - RNA, 13 nt, Salmonella typhimurium LT2
cuccccugccggc

SEQ ID NO: 3791107 - RNA, 19 nt, Salmonella typhimurium LT2
cuccccuguuugcaucacg

SEQ ID NO: 3791108 - RNA, 23 nt, Salmonella typhimurium LT2
cuccccuguuugcaucacgcgcu

SEQ ID NO: 3791109 - RNA, 16 nt, Salmonella typhimurium LT2
cucccgaauggcuuca

SEQ ID NO: 3791110 - RNA, 15 nt, Salmonella typhimurium LT2
cucccgcacgcuggc

SEQ ID NO: 3791111 - RNA, 22 nt, Salmonella typhimurium LT2
cucccgccagaugcagcggcag

SEQ ID NO: 3791112 - RNA, 21 nt, Salmonella typhimurium LT2
cucccggaugcaccaucucuu

SEQ ID NO: 3791113 - RNA, 17 nt, Salmonella typhimurium LT2
cucccggcgcccauccg

SEQ ID NO: 3791114 - RNA, 17 nt, Salmonella typhimurium LT2
cucccgucgccuguuuc

SEQ ID NO: 3791115 - RNA, 16 nt, Salmonella typhimurium LT2
cucccgugacguuuug

SEQ ID NO: 3791116 - RNA, 14 nt, Salmonella typhimurium LT2
cucccguuccaggc

SEQ ID NO: 3791117 - RNA, 16 nt, Salmonella typhimurium LT2
cucccucacccuucac

SEQ ID NO: 3791118 - RNA, 21 nt, Salmonella typhimurium LT2
cucccugccaggccaucugau

SEQ ID NO: 3791119 - RNA, 21 nt, Salmonella typhimurium LT2
cucccuuaagggugacggugu

SEQ ID NO: 3791120 - RNA, 20 nt, Salmonella typhimurium LT2
cucccuugccagcgcaucca

SEQ ID NO: 3791121 - RNA, 17 nt, Salmonella typhimurium LT2
cucccuuucuucucaac

SEQ ID NO: 3791122 - RNA, 23 nt, Salmonella typhimurium LT2
cucccuuucuucucaacgccgga

SEQ ID NO: 3791123 - RNA, 15 nt, Salmonella typhimurium LT2
cuccgcaauuuccug

SEQ ID NO: 3791124 - RNA, 18 nt, Salmonella typhimurium LT2
cuccgcagcuucaucauu

SEQ ID NO: 3791125 - RNA, 16 nt, Salmonella typhimurium LT2
cuccgccaccagcgcu

SEQ ID NO: 3791126 - RNA, 20 nt, Salmonella typhimurium LT2
cuccgccagagcuucaggcg

SEQ ID NO: 3791127 - RNA, 17 nt, Salmonella typhimurium LT2
cucggcgucaucccggu

SEQ ID NO: 3791128 - RNA, 18 nt, Salmonella typhimurium LT2
cucggguacacucucggg

SEQ ID NO: 3791129 - RNA, 15 nt, Salmonella typhimurium LT2
cucggguauggcggc

SEQ ID NO: 3791130 - RNA, 16 nt, Salmonella typhimurium LT2
cucgguaaccauccau

SEQ ID NO: 3791131 - RNA, 23 nt, Salmonella typhimurium LT2
cucgguauaaauuuccgcagcca

SEQ ID NO: 3791132 - RNA, 21 nt, Salmonella typhimurium LT2
cucggugcauuugucgcuguu

SEQ ID NO: 3791133 - RNA, 13 nt, Salmonella typhimurium LT2
cucgguuuauccc

SEQ ID NO: 3791134 - RNA, 14 nt, Salmonella typhimurium LT2
cucguaccaggccc

SEQ ID NO: 3791135 - RNA, 16 nt, Salmonella typhimurium LT2
cucguaggccagcgcu

SEQ ID NO: 3791136 - RNA, 15 nt, Salmonella typhimurium LT2
cucgucgccagggcg

SEQ ID NO: 3791137 - RNA, 17 nt, Salmonella typhimurium LT2
cucgucggccagcgccg

SEQ ID NO: 3791138 - RNA, 20 nt, Salmonella typhimurium LT2
cucgucgguaaaaaugcaau

SEQ ID NO: 3791139 - RNA, 20 nt, Salmonella typhimurium LT2
cucgugaacagggugacuca

SEQ ID NO: 3791140 - RNA, 17 nt, Salmonella typhimurium LT2
cucgugaucgccaaagc

SEQ ID NO: 3791141 - RNA, 14 nt, Salmonella typhimurium LT2
cucguugcgucgug

SEQ ID NO: 3791142 - RNA, 21 nt, Salmonella typhimurium LT2
cucguugguagacccggcauu

SEQ ID NO: 3791143 - RNA, 11 nt, Salmonella typhimurium LT2
cucuaaagcgc

SEQ ID NO: 3791144 - RNA, 14 nt, Salmonella typhimurium LT2
cucuaaagcgcuga

SEQ ID NO: 3791145 - RNA, 12 nt, Salmonella typhimurium LT2
cucuaaauguug

SEQ ID NO: 3791146 - RNA, 12 nt, Salmonella typhimurium LT2
cucuaaccaacu

SEQ ID NO: 3791147 - RNA, 13 nt, Salmonella typhimurium LT2
cucuaaccaacug

SEQ ID NO: 3791148 - RNA, 17 nt, Salmonella typhimurium LT2
cucuaaccaacugagcu

SEQ ID NO: 3791149 - RNA, 17 nt, Salmonella typhimurium LT2
cucuaacgucagcgcca

SEQ ID NO: 3791150 - RNA, 24 nt, Salmonella typhimurium LT2
cucuaacgucagcgccacccauuu

SEQ ID NO: 3791151 - RNA, 21 nt, Salmonella typhimurium LT2
cucuaaggcggugucaucuuc

SEQ ID NO: 3791152 - RNA, 16 nt, Salmonella typhimurium LT2
cucuaccccuucugcc

SEQ ID NO: 3791153 - RNA, 18 nt, Salmonella typhimurium LT2
cucuauaccauaaaugaa

SEQ ID NO: 3791154 - RNA, 13 nt, Salmonella typhimurium LT2
cucuauaguaaau

SEQ ID NO: 3791155 - RNA, 20 nt, Salmonella typhimurium LT2
cucuaucaagggugcuggca

SEQ ID NO: 3791156 - RNA, 20 nt, Salmonella typhimurium LT2
cucuauccggaggccuucuu

SEQ ID NO: 3791157 - RNA, 15 nt, Salmonella typhimurium LT2
cucuaucggcaaacc

SEQ ID NO: 3791158 - RNA, 18 nt, Salmonella typhimurium LT2
cucuaugaaugccggaug

SEQ ID NO: 3791159 - RNA, 14 nt, Salmonella typhimurium LT2
cucuauuaaaauaa

SEQ ID NO: 3791160 - RNA, 12 nt, Salmonella typhimurium LT2
cucuauuuuuuu

SEQ ID NO: 3791161 - RNA, 12 nt, Salmonella typhimurium LT2
cucucaacauaa

SEQ ID NO: 3791162 - RNA, 21 nt, Salmonella typhimurium LT2
cucucaacauaauaaagccgg

SEQ ID NO: 3791163 - RNA, 17 nt, Salmonella typhimurium LT2
cucucaccgcccaggcc

SEQ ID NO: 3791164 - RNA, 18 nt, Salmonella typhimurium LT2
cucucaccgcccaggcca

SEQ ID NO: 3791165 - RNA, 18 nt, Salmonella typhimurium LT2
cucucaggcaguaacucu

SEQ ID NO: 3791166 - RNA, 13 nt, Salmonella typhimurium LT2
cucucauauucca

SEQ ID NO: 3791167 - RNA, 14 nt, Salmonella typhimurium LT2
cucuccagggcaac

SEQ ID NO: 3791168 - RNA, 23 nt, Salmonella typhimurium LT2
cucuccaguuugcguucacagca

SEQ ID NO: 3791169 - RNA, 18 nt, Salmonella typhimurium LT2
cucuccgcaauuaauuua

SEQ ID NO: 3791170 - RNA, 12 nt, Salmonella typhimurium LT2
cucuccgccugc

SEQ ID NO: 3791171 - RNA, 21 nt, Salmonella typhimurium LT2
cucuccggcucgucccgcagc

SEQ ID NO: 3791172 - RNA, 22 nt, Salmonella typhimurium LT2
cucuccugucguuagugggauc

SEQ ID NO: 3791173 - RNA, 19 nt, Salmonella typhimurium LT2
cucucgccacgcuccauca

SEQ ID NO: 3791174 - RNA, 21 nt, Salmonella typhimurium LT2
cucucuggcgcauuccagacc

SEQ ID NO: 3791175 - RNA, 16 nt, Salmonella typhimurium LT2
cucucuuuaaucaccc

SEQ ID NO: 3791176 - RNA, 19 nt, Salmonella typhimurium LT2
cucucuuucaccagcgcca

SEQ ID NO: 3791177 - RNA, 19 nt, Salmonella typhimurium LT2
cucugagaacuauuugccu

SEQ ID NO: 3791178 - RNA, 18 nt, Salmonella typhimurium LT2
cucugccaguugcucaua

SEQ ID NO: 3791179 - RNA, 20 nt, Salmonella typhimurium LT2
cucugccgguuggccggccc

SEQ ID NO: 3791180 - RNA, 15 nt, Salmonella typhimurium LT2
cucugcgcaauguuc

SEQ ID NO: 3791181 - RNA, 13 nt, Salmonella typhimurium LT2
cucugcgcacgac

SEQ ID NO: 3791182 - RNA, 22 nt, Salmonella typhimurium LT2
cucugcgcguaaacgcaacacc

SEQ ID NO: 3791183 - RNA, 19 nt, Salmonella typhimurium LT2
cucugcugugccaguaccg

SEQ ID NO: 3791184 - RNA, 13 nt, Salmonella typhimurium LT2
cucugcuuuuuca

SEQ ID NO: 3791185 - RNA, 14 nt, Salmonella typhimurium LT2
cucuggcggcguga

SEQ ID NO: 3791186 - RNA, 16 nt, Salmonella typhimurium LT2
cucugguuucccugcc

SEQ ID NO: 3791187 - RNA, 15 nt, Salmonella typhimurium LT2
cucuguugccgcccg

SEQ ID NO: 3791188 - RNA, 18 nt, Salmonella typhimurium LT2
cucuuaccgcuaaaauac

SEQ ID NO: 3791189 - RNA, 14 nt, Salmonella typhimurium LT2
cucuuauuguagug

SEQ ID NO: 3791190 - RNA, 15 nt, Salmonella typhimurium LT2
cucuucacccuucuu

SEQ ID NO: 3791191 - RNA, 18 nt, Salmonella typhimurium LT2
cucuucagcguccggaaa

SEQ ID NO: 3791192 - RNA, 17 nt, Salmonella typhimurium LT2
cucuucaucgcgccucc

SEQ ID NO: 3791193 - RNA, 23 nt, Salmonella typhimurium LT2
cucuucaucgcgccuccccugcc

SEQ ID NO: 3791194 - RNA, 15 nt, Salmonella typhimurium LT2
cucuuccaaccgugu

SEQ ID NO: 3791195 - RNA, 16 nt, Salmonella typhimurium LT2
cucuuccagauacgga

SEQ ID NO: 3791196 - RNA, 20 nt, Salmonella typhimurium LT2
cucuuccagcugcucuucuu

SEQ ID NO: 3791197 - RNA, 17 nt, Salmonella typhimurium LT2
cucuuccaucagccagg

SEQ ID NO: 3791198 - RNA, 12 nt, Salmonella typhimurium LT2
cucuuccgccag

SEQ ID NO: 3791199 - RNA, 15 nt, Salmonella typhimurium LT2
cucuuccuccccagg

SEQ ID NO: 3791200 - RNA, 17 nt, Salmonella typhimurium LT2
cucuuccuccccaggcg

SEQ ID NO: 3791201 - RNA, 21 nt, Salmonella typhimurium LT2
cucuucggcggcccauucgcc

SEQ ID NO: 3791202 - RNA, 12 nt, Salmonella typhimurium LT2
cucuucggcuuc

SEQ ID NO: 3791203 - RNA, 21 nt, Salmonella typhimurium LT2
cucuucguucauccgucuggc

SEQ ID NO: 3791204 - RNA, 16 nt, Salmonella typhimurium LT2
cucuucugaccaucuu

SEQ ID NO: 3791205 - RNA, 17 nt, Salmonella typhimurium LT2
cucuucuggcucccgca

SEQ ID NO: 3791206 - RNA, 13 nt, Salmonella typhimurium LT2
cucuucuuuuaau

SEQ ID NO: 3791207 - RNA, 20 nt, Salmonella typhimurium LT2
cucuugcacaauacuuuuug

SEQ ID NO: 3791208 - RNA, 16 nt, Salmonella typhimurium LT2
cucuugcgagcgucag

SEQ ID NO: 3791209 - RNA, 15 nt, Salmonella typhimurium LT2
cucuuggguuauuuc

SEQ ID NO: 3791210 - RNA, 15 nt, Salmonella typhimurium LT2
cucuuggucauaaua

SEQ ID NO: 3791211 - RNA, 20 nt, Salmonella typhimurium LT2
cucuugugcuuccagcucca

SEQ ID NO: 3791212 - RNA, 13 nt, Salmonella typhimurium LT2
cucuuuaacaauu

SEQ ID NO: 3791213 - RNA, 14 nt, Salmonella typhimurium LT2
cucuuuaccgccaa

SEQ ID NO: 3791214 - RNA, 21 nt, Salmonella typhimurium LT2
cucuuucaccagcgccagaau

SEQ ID NO: 3791215 - RNA, 17 nt, Salmonella typhimurium LT2
cucuuucacuuucaggu

SEQ ID NO: 3791216 - RNA, 13 nt, Salmonella typhimurium LT2
cucuuucagccgg

SEQ ID NO: 3791217 - RNA, 20 nt, Salmonella typhimurium LT2
cucuuucagccggcuaucuu

SEQ ID NO: 3791218 - RNA, 12 nt, Salmonella typhimurium LT2
cucuuucaugga

SEQ ID NO: 3791219 - RNA, 15 nt, Salmonella typhimurium LT2
cucuuuccagcgaca

SEQ ID NO: 3791220 - RNA, 18 nt, Salmonella typhimurium LT2
cucuuucccuucacucuu

SEQ ID NO: 3791221 - RNA, 15 nt, Salmonella typhimurium LT2
cucuuucgacuggac

SEQ ID NO: 3791222 - RNA, 17 nt, Salmonella typhimurium LT2
cucuuucgguagccaca

SEQ ID NO: 3791223 - RNA, 20 nt, Salmonella typhimurium LT2
cucuuucgguagccacagau

SEQ ID NO: 3791224 - RNA, 21 nt, Salmonella typhimurium LT2
cucuuugaacagccagaagcc

SEQ ID NO: 3791225 - RNA, 20 nt, Salmonella typhimurium LT2
cucuuugacgaccgcggccu

SEQ ID NO: 3791226 - RNA, 14 nt, Salmonella typhimurium LT2
cucuuuugcuucaa

SEQ ID NO: 3791227 - RNA, 20 nt, Salmonella typhimurium LT2
cugaaaaaccgucggcaaua

SEQ ID NO: 3791228 - RNA, 13 nt, Salmonella typhimurium LT2
cugaaaaaucccc

SEQ ID NO: 3791229 - RNA, 17 nt, Salmonella typhimurium LT2
cugaaacagaauaaacg

SEQ ID NO: 3791230 - RNA, 19 nt, Salmonella typhimurium LT2
cugaaaccgccguuuuaac

SEQ ID NO: 3791231 - RNA, 21 nt, Salmonella typhimurium LT2
cugaaagcaccgguuaacaua

SEQ ID NO: 3791232 - RNA, 15 nt, Salmonella typhimurium LT2
cugacucaucacauc

SEQ ID NO: 3791233 - RNA, 13 nt, Salmonella typhimurium LT2
cugacugcauaau

SEQ ID NO: 3791234 - RNA, 19 nt, Salmonella typhimurium LT2
cugacugcauaauggugga

SEQ ID NO: 3791235 - RNA, 17 nt, Salmonella typhimurium LT2
cugacugccgccggcuu

SEQ ID NO: 3791236 - RNA, 16 nt, Salmonella typhimurium LT2
cugacugguuuguugc

SEQ ID NO: 3791237 - RNA, 13 nt, Salmonella typhimurium LT2
cugagaaaaauac

SEQ ID NO: 3791238 - RNA, 17 nt, Salmonella typhimurium LT2
cugagaaaucaacguga

SEQ ID NO: 3791239 - RNA, 14 nt, Salmonella typhimurium LT2
cugagaaccccaga

SEQ ID NO: 3791240 - RNA, 16 nt, Salmonella typhimurium LT2
cugagaauuuccaguu

SEQ ID NO: 3791241 - RNA, 18 nt, Salmonella typhimurium LT2
cugagaauuuccaguuca

SEQ ID NO: 3791242 - RNA, 13 nt, Salmonella typhimurium LT2
cugagacgccugc

SEQ ID NO: 3791243 - RNA, 18 nt, Salmonella typhimurium LT2
cugagaucaaacaagaga

SEQ ID NO: 3791244 - RNA, 15 nt, Salmonella typhimurium LT2
cugagaugacgccau

SEQ ID NO: 3791245 - RNA, 23 nt, Salmonella typhimurium LT2
cugagauggcacaauaaccagau

SEQ ID NO: 3791246 - RNA, 15 nt, Salmonella typhimurium LT2
cugagcaaacucaau

SEQ ID NO: 3791247 - RNA, 19 nt, Salmonella typhimurium LT2
cugagcaaacucaaugacu

SEQ ID NO: 3791248 - RNA, 15 nt, Salmonella typhimurium LT2
cugagcagccagccc

SEQ ID NO: 3791249 - RNA, 18 nt, Salmonella typhimurium LT2
cugagcagccagcccagc

SEQ ID NO: 3791250 - RNA, 12 nt, Salmonella typhimurium LT2
cugagcauacac

SEQ ID NO: 3791251 - RNA, 18 nt, Salmonella typhimurium LT2
cugagccucuaaauguug

SEQ ID NO: 3791252 - RNA, 16 nt, Salmonella typhimurium LT2
cugagcgccagcgugc

SEQ ID NO: 3791253 - RNA, 19 nt, Salmonella typhimurium LT2
cugagcggcucauccagca

SEQ ID NO: 3791254 - RNA, 20 nt, Salmonella typhimurium LT2
cugagcggcucauccagcaa

SEQ ID NO: 3791255 - RNA, 20 nt, Salmonella typhimurium LT2
cugaggaguauuauccauug

SEQ ID NO: 3791256 - RNA, 21 nt, Salmonella typhimurium LT2
cugaguauacagacagcagau

SEQ ID NO: 3791257 - RNA, 20 nt, Salmonella typhimurium LT2
cugagucacagaauacccuc

SEQ ID NO: 3791258 - RNA, 17 nt, Salmonella typhimurium LT2
cugagugacgggcuggc

SEQ ID NO: 3791259 - RNA, 17 nt, Salmonella typhimurium LT2
cugagugugucuuuuac

SEQ ID NO: 3791260 - RNA, 22 nt, Salmonella typhimurium LT2
cugaguuacgaucguuugccca

SEQ ID NO: 3791261 - RNA, 14 nt, Salmonella typhimurium LT2
cugaguucgccaug

SEQ ID NO: 3791262 - RNA, 21 nt, Salmonella typhimurium LT2
cugaguucggcauggggucag

SEQ ID NO: 3791263 - RNA, 17 nt, Salmonella typhimurium LT2
cugaguuuagccagcag

SEQ ID NO: 3791264 - RNA, 18 nt, Salmonella typhimurium LT2
cugaguuucaccgccaga

SEQ ID NO: 3791265 - RNA, 22 nt, Salmonella typhimurium LT2
cugaguuucaccgccagagcac

SEQ ID NO: 3791266 - RNA, 23 nt, Salmonella typhimurium LT2
cugaguuucucccgccagaugca

SEQ ID NO: 3791267 - RNA, 14 nt, Salmonella typhimurium LT2
cugauaagcacagg

SEQ ID NO: 3791268 - RNA, 19 nt, Salmonella typhimurium LT2
cugauaagcgaagcgccau

SEQ ID NO: 3791269 - RNA, 18 nt, Salmonella typhimurium LT2
cugauaagcgcagcgcca

SEQ ID NO: 3791270 - RNA, 19 nt, Salmonella typhimurium LT2
cugauaagcgcagcgccau

SEQ ID NO: 3791271 - RNA, 15 nt, Salmonella typhimurium LT2
cugauaagcguagcg

SEQ ID NO: 3791272 - RNA, 18 nt, Salmonella typhimurium LT2
cugauaagcguagcgcca

SEQ ID NO: 3791273 - RNA, 19 nt, Salmonella typhimurium LT2
cugauaagggccggaaaaa

SEQ ID NO: 3791274 - RNA, 16 nt, Salmonella typhimurium LT2
cugauaagguaaagcc

SEQ ID NO: 3791275 - RNA, 17 nt, Salmonella typhimurium LT2
cugauaaucccguuccg

SEQ ID NO: 3791276 - RNA, 16 nt, Salmonella typhimurium LT2
cugauaaucgagacug

SEQ ID NO: 3791277 - RNA, 14 nt, Salmonella typhimurium LT2
cugauacagccaaa

SEQ ID NO: 3791278 - RNA, 20 nt, Salmonella typhimurium LT2
cugauaccgcguuugcgcaa

SEQ ID NO: 3791279 - RNA, 21 nt, Salmonella typhimurium LT2
cugauaccgucuuccuuccac

SEQ ID NO: 3791280 - RNA, 23 nt, Salmonella typhimurium LT2
cugauacuuauuacgguaucagc

SEQ ID NO: 3791281 - RNA, 19 nt, Salmonella typhimurium LT2
cugauagcccauccagcac

SEQ ID NO: 3791282 - RNA, 18 nt, Salmonella typhimurium LT2
cugauagccguaaauaau

SEQ ID NO: 3791283 - RNA, 19 nt, Salmonella typhimurium LT2
cugauagcuaaccagcgag

SEQ ID NO: 3791284 - RNA, 15 nt, Salmonella typhimurium LT2
cugauaguggcguuu

SEQ ID NO: 3791285 - RNA, 14 nt, Salmonella typhimurium LT2
cugauaguuuaaau

SEQ ID NO: 3791286 - RNA, 20 nt, Salmonella typhimurium LT2
cugauaguuuaaauccagcg

SEQ ID NO: 3791287 - RNA, 15 nt, Salmonella typhimurium LT2
cugauauaacccuca

SEQ ID NO: 3791288 - RNA, 18 nt, Salmonella typhimurium LT2
cugauauacgaagcgcca

SEQ ID NO: 3791289 - RNA, 19 nt, Salmonella typhimurium LT2
cugauauacgaagcgccau

SEQ ID NO: 3791290 - RNA, 22 nt, Salmonella typhimurium LT2
cugauaucggcugcuguaacag

SEQ ID NO: 3791291 - RNA, 21 nt, Salmonella typhimurium LT2
cugauauucccguuccagcuu

SEQ ID NO: 3791292 - RNA, 22 nt, Salmonella typhimurium LT2
cugauauugcauuugcguccau

SEQ ID NO: 3791293 - RNA, 15 nt, Salmonella typhimurium LT2
cugaucagccgcgac

SEQ ID NO: 3791294 - RNA, 17 nt, Salmonella typhimurium LT2
cugauccagcucuucuu

SEQ ID NO: 3791295 - RNA, 20 nt, Salmonella typhimurium LT2
cugaucgacgaaaucccggc

SEQ ID NO: 3791296 - RNA, 18 nt, Salmonella typhimurium LT2
cugaucgagaucgccaaa

SEQ ID NO: 3791297 - RNA, 16 nt, Salmonella typhimurium LT2
cugaucgauucucuuc

SEQ ID NO: 3791298 - RNA, 16 nt, Salmonella typhimurium LT2
cugaucgcgcagacag

SEQ ID NO: 3791299 - RNA, 22 nt, Salmonella typhimurium LT2
cugaucgcgcagacaguggcca

SEQ ID NO: 3791300 - RNA, 15 nt, Salmonella typhimurium LT2
cugaucgcugagcgc

SEQ ID NO: 3791301 - RNA, 18 nt, Salmonella typhimurium LT2
cugaucgucggugaaaac

SEQ ID NO: 3791302 - RNA, 14 nt, Salmonella typhimurium LT2
cugaucguggccac

SEQ ID NO: 3791303 - RNA, 21 nt, Salmonella typhimurium LT2
cugaucguggccacacuucgg

SEQ ID NO: 3791304 - RNA, 17 nt, Salmonella typhimurium LT2
cugaucguuuuugucca

SEQ ID NO: 3791305 - RNA, 21 nt, Salmonella typhimurium LT2
cugaucguuuuuguccauaaa

SEQ ID NO: 3791306 - RNA, 16 nt, Salmonella typhimurium LT2
cugaugaacguagucg

SEQ ID NO: 3791307 - RNA, 21 nt, Salmonella typhimurium LT2
cugaugaacguagucguugua

SEQ ID NO: 3791308 - RNA, 15 nt, Salmonella typhimurium LT2
cugaugaacuacgcc

SEQ ID NO: 3791309 - RNA, 16 nt, Salmonella typhimurium LT2
cugaugacaaagccgg

SEQ ID NO: 3791310 - RNA, 17 nt, Salmonella typhimurium LT2
cugaugaccgccgucau

SEQ ID NO: 3791311 - RNA, 17 nt, Salmonella typhimurium LT2
cugaugauuggccucca

SEQ ID NO: 3791312 - RNA, 22 nt, Salmonella typhimurium LT2
cugaugccauaaaaugcugggc

SEQ ID NO: 3791313 - RNA, 22 nt, Salmonella typhimurium LT2
cugaugcccagguuagcagcca

SEQ ID NO: 3791314 - RNA, 13 nt, Salmonella typhimurium LT2
cugaugccgucga

SEQ ID NO: 3791315 - RNA, 20 nt, Salmonella typhimurium LT2
cugaugcgcguuuagcgcca

SEQ ID NO: 3791316 - RNA, 18 nt, Salmonella typhimurium LT2
cugaugcgcuauaaaaau

SEQ ID NO: 3791317 - RNA, 17 nt, Salmonella typhimurium LT2
cugaugcguauccagcg

SEQ ID NO: 3791318 - RNA, 18 nt, Salmonella typhimurium LT2
cugaugcgucagauaaaa

SEQ ID NO: 3791319 - RNA, 19 nt, Salmonella typhimurium LT2
cugaugcuggcagaaggca

SEQ ID NO: 3791320 - RNA, 19 nt, Salmonella typhimurium LT2
cugauggcgcagcgccauc

SEQ ID NO: 3791321 - RNA, 14 nt, Salmonella typhimurium LT2
cugauggcgcgcca

SEQ ID NO: 3791322 - RNA, 18 nt, Salmonella typhimurium LT2
cugauggcgcuacgcuua

SEQ ID NO: 3791323 - RNA, 18 nt, Salmonella typhimurium LT2
cugauggcgcuacguuua

SEQ ID NO: 3791324 - RNA, 17 nt, Salmonella typhimurium LT2
cugauggcgcugcgcuu

SEQ ID NO: 3791325 - RNA, 14 nt, Salmonella typhimurium LT2
cugauguaccugcg

SEQ ID NO: 3791326 - RNA, 19 nt, Salmonella typhimurium LT2
cugauguaccugcguuaaa

SEQ ID NO: 3791327 - RNA, 23 nt, Salmonella typhimurium LT2
cugaugucccaucguaacgccgu

SEQ ID NO: 3791328 - RNA, 23 nt, Salmonella typhimurium LT2
cugaugucguuguaguuaucgcc

SEQ ID NO: 3791329 - RNA, 20 nt, Salmonella typhimurium LT2
cugaugugacguuuucaggu

SEQ ID NO: 3791330 - RNA, 22 nt, Salmonella typhimurium LT2
cugauuaaucagcucagcaaca

SEQ ID NO: 3791331 - RNA, 18 nt, Salmonella typhimurium LT2
cugauuaccuaccagcgc

SEQ ID NO: 3791332 - RNA, 15 nt, Salmonella typhimurium LT2
cugauuauucaguac

SEQ ID NO: 3791333 - RNA, 22 nt, Salmonella typhimurium LT2
cugauuauucaguaccgccuuc

SEQ ID NO: 3791334 - RNA, 21 nt, Salmonella typhimurium LT2
cugauucuuaucugugggucu

SEQ ID NO: 3791335 - RNA, 21 nt, Salmonella typhimurium LT2
cugccguaaacaggcaggccc

SEQ ID NO: 3791336 - RNA, 12 nt, Salmonella typhimurium LT2
cugccguaccgu

SEQ ID NO: 3791337 - RNA, 19 nt, Salmonella typhimurium LT2
cugccgucaaugccgggca

SEQ ID NO: 3791338 - RNA, 22 nt, Salmonella typhimurium LT2
cugccgucaaugccgggcagac

SEQ ID NO: 3791339 - RNA, 14 nt, Salmonella typhimurium LT2
cugccgucccagcg

SEQ ID NO: 3791340 - RNA, 22 nt, Salmonella typhimurium LT2
cugccguccgaucucguuaacg

SEQ ID NO: 3791341 - RNA, 16 nt, Salmonella typhimurium LT2
cugccguccugaucaa

SEQ ID NO: 3791342 - RNA, 16 nt, Salmonella typhimurium LT2
cugccuaaauugacgc

SEQ ID NO: 3791343 - RNA, 11 nt, Salmonella typhimurium LT2
cugccuaacug

SEQ ID NO: 3791344 - RNA, 12 nt, Salmonella typhimurium LT2
cugccugcagac

SEQ ID NO: 3791345 - RNA, 15 nt, Salmonella typhimurium LT2
cugccugucuuuucu

SEQ ID NO: 3791346 - RNA, 22 nt, Salmonella typhimurium LT2
cugccuguuuacggcaggcccg

SEQ ID NO: 3791347 - RNA, 19 nt, Salmonella typhimurium LT2
cugccuuuguacagcuugc

SEQ ID NO: 3791348 - RNA, 21 nt, Salmonella typhimurium LT2
cugccuuuguacagcuugccg

SEQ ID NO: 3791349 - RNA, 18 nt, Salmonella typhimurium LT2
cugccuuuuuuagcgugu

SEQ ID NO: 3791350 - RNA, 18 nt, Salmonella typhimurium LT2
cugccuuuuuuauugccu

SEQ ID NO: 3791351 - RNA, 14 nt, Salmonella typhimurium LT2
cugcgaagccaccg

SEQ ID NO: 3791352 - RNA, 16 nt, Salmonella typhimurium LT2
cugcgaaucccggcca

SEQ ID NO: 3791353 - RNA, 14 nt, Salmonella typhimurium LT2
cugcgaggccaacg

SEQ ID NO: 3791354 - RNA, 17 nt, Salmonella typhimurium LT2
cugcgaucaucauuccc

SEQ ID NO: 3791355 - RNA, 12 nt, Salmonella typhimurium LT2
cugcgcagcacu

SEQ ID NO: 3791356 - RNA, 21 nt, Salmonella typhimurium LT2
cugcgcagcgcgcggaugacg

SEQ ID NO: 3791357 - RNA, 23 nt, Salmonella typhimurium LT2
cugcgcaggucgccagaagccgu

SEQ ID NO: 3791358 - RNA, 20 nt, Salmonella typhimurium LT2
cugcgcauacgucaugccuu

SEQ ID NO: 3791359 - RNA, 19 nt, Salmonella typhimurium LT2
cugcgcauauuccggcgac

SEQ ID NO: 3791360 - RNA, 16 nt, Salmonella typhimurium LT2
cugcgcauccucuuuc

SEQ ID NO: 3791361 - RNA, 14 nt, Salmonella typhimurium LT2
cugcgccaaaucgg

SEQ ID NO: 3791362 - RNA, 14 nt, Salmonella typhimurium LT2
cugcgccacgcgcu

SEQ ID NO: 3791363 - RNA, 17 nt, Salmonella typhimurium LT2
cugcgccagcagcggcg

SEQ ID NO: 3791364 - RNA, 13 nt, Salmonella typhimurium LT2
cugcgccagcaug

SEQ ID NO: 3791365 - RNA, 15 nt, Salmonella typhimurium LT2
cugcgccagccagac

SEQ ID NO: 3791366 - RNA, 19 nt, Salmonella typhimurium LT2
cugcgccagccagacggcg

SEQ ID NO: 3791367 - RNA, 23 nt, Salmonella typhimurium LT2
cugcgccauguucauaaagugcc

SEQ ID NO: 3791368 - RNA, 18 nt, Salmonella typhimurium LT2
cugcgccauuaacgcggu

SEQ ID NO: 3791369 - RNA, 14 nt, Salmonella typhimurium LT2
cugcgcccgccugc

SEQ ID NO: 3791370 - RNA, 19 nt, Salmonella typhimurium LT2
cugcgcccgcucugcgcca

SEQ ID NO: 3791371 - RNA, 16 nt, Salmonella typhimurium LT2
cugcgccgcgccgccc

SEQ ID NO: 3791372 - RNA, 17 nt, Salmonella typhimurium LT2
cugcgccgcgccgcccc

SEQ ID NO: 3791373 - RNA, 15 nt, Salmonella typhimurium LT2
cugcgccgguuccgg

SEQ ID NO: 3791374 - RNA, 14 nt, Salmonella typhimurium LT2
cugcgccucaagcg

SEQ ID NO: 3791375 - RNA, 14 nt, Salmonella typhimurium LT2
cugcgccucagcca

SEQ ID NO: 3791376 - RNA, 16 nt, Salmonella typhimurium LT2
cugcgccucagccacg

SEQ ID NO: 3791377 - RNA, 15 nt, Salmonella typhimurium LT2
cugcgccugcauauc

SEQ ID NO: 3791378 - RNA, 14 nt, Salmonella typhimurium LT2
cugcgccugcgcga

SEQ ID NO: 3791379 - RNA, 16 nt, Salmonella typhimurium LT2
cugcgccugcgcgagc

SEQ ID NO: 3791380 - RNA, 15 nt, Salmonella typhimurium LT2
cugcgccugcucagc

SEQ ID NO: 3791381 - RNA, 22 nt, Salmonella typhimurium LT2
cugcgcgauaucugccgcgcca

SEQ ID NO: 3791382 - RNA, 22 nt, Salmonella typhimurium LT2
cugcgcgccgcccugcaucaug

SEQ ID NO: 3791383 - RNA, 22 nt, Salmonella typhimurium LT2
cugcgcguagcggucacccggc

SEQ ID NO: 3791384 - RNA, 17 nt, Salmonella typhimurium LT2
cugcgcgucccucucca

SEQ ID NO: 3791385 - RNA, 22 nt, Salmonella typhimurium LT2
cugcgcgucccucuccagggca

SEQ ID NO: 3791386 - RNA, 21 nt, Salmonella typhimurium LT2
cugcgcguucggguuuuccug

SEQ ID NO: 3791387 - RNA, 17 nt, Salmonella typhimurium LT2
cugcgcucacgcggcgc

SEQ ID NO: 3791388 - RNA, 19 nt, Salmonella typhimurium LT2
cugcgcucauauacccugc

SEQ ID NO: 3791389 - RNA, 15 nt, Salmonella typhimurium LT2
cugcgcucgcccuuc

SEQ ID NO: 3791390 - RNA, 14 nt, Salmonella typhimurium LT2
cugcgcugacggcg

SEQ ID NO: 3791391 - RNA, 17 nt, Salmonella typhimurium LT2
cugcgcugacggcggca

SEQ ID NO: 3791392 - RNA, 15 nt, Salmonella typhimurium LT2
cugcgcuuaacgcuu

SEQ ID NO: 3791393 - RNA, 15 nt, Salmonella typhimurium LT2
cugcgcuuauccggc

SEQ ID NO: 3791394 - RNA, 16 nt, Salmonella typhimurium LT2
cugcgcuuauccggcc

SEQ ID NO: 3791395 - RNA, 17 nt, Salmonella typhimurium LT2
cugcgcuuauccggccu

SEQ ID NO: 3791396 - RNA, 14 nt, Salmonella typhimurium LT2
cugcgcuuucagcu

SEQ ID NO: 3791397 - RNA, 14 nt, Salmonella typhimurium LT2
cugcgcuuuccagg

SEQ ID NO: 3791398 - RNA, 15 nt, Salmonella typhimurium LT2
cugcgcuuuccaggc

SEQ ID NO: 3791399 - RNA, 23 nt, Salmonella typhimurium LT2
cugcgcuuuccaggccagcgaca

SEQ ID NO: 3791400 - RNA, 11 nt, Salmonella typhimurium LT2
cugcgcuuuga

SEQ ID NO: 3791401 - RNA, 21 nt, Salmonella typhimurium LT2
cugcgcuuuuucaucaucugu

SEQ ID NO: 3791402 - RNA, 12 nt, Salmonella typhimurium LT2
cugcggaacgcc

SEQ ID NO: 3791403 - RNA, 16 nt, Salmonella typhimurium LT2
cugcggaacgccccuc

SEQ ID NO: 3791404 - RNA, 18 nt, Salmonella typhimurium LT2
cugcggaacgccccucgg

SEQ ID NO: 3791405 - RNA, 13 nt, Salmonella typhimurium LT2
cugcggaauuuua

SEQ ID NO: 3791406 - RNA, 13 nt, Salmonella typhimurium LT2
cugcggccaugau

SEQ ID NO: 3791407 - RNA, 14 nt, Salmonella typhimurium LT2
cugcggccugccca

SEQ ID NO: 3791408 - RNA, 20 nt, Salmonella typhimurium LT2
cugcggcgcuuugcgcucag

SEQ ID NO: 3791409 - RNA, 18 nt, Salmonella typhimurium LT2
cugcggcuauauaaaauc

SEQ ID NO: 3791410 - RNA, 15 nt, Salmonella typhimurium LT2
cugcggcucgccaau

SEQ ID NO: 3791411 - RNA, 14 nt, Salmonella typhimurium LT2
cugcggcuuuuuca

SEQ ID NO: 3791412 - RNA, 14 nt, Salmonella typhimurium LT2
cugcgggaaguagc

SEQ ID NO: 3791413 - RNA, 19 nt, Salmonella typhimurium LT2
cugcgguauuaacccgcag

SEQ ID NO: 3791414 - RNA, 23 nt, Salmonella typhimurium LT2
cugcgguauuaacccgcagccgg

SEQ ID NO: 3791415 - RNA, 17 nt, Salmonella typhimurium LT2
cugcguaaaaucagcau

SEQ ID NO: 3791416 - RNA, 21 nt, Salmonella typhimurium LT2
cugcguaaaccauuucuccug

SEQ ID NO: 3791417 - RNA, 22 nt, Salmonella typhimurium LT2
cugcguaauguugauaucacuc

SEQ ID NO: 3791418 - RNA, 18 nt, Salmonella typhimurium LT2
cugcguaccgcuuccgcu

SEQ ID NO: 3791419 - RNA, 14 nt, Salmonella typhimurium LT2
cugcgucaaugacu

SEQ ID NO: 3791420 - RNA, 13 nt, Salmonella typhimurium LT2
cugcgucacagac

SEQ ID NO: 3791421 - RNA, 22 nt, Salmonella typhimurium LT2
cugcgucaugucguuagaacca

SEQ ID NO: 3791422 - RNA, 15 nt, Salmonella typhimurium LT2
cugcgugaagacaca

SEQ ID NO: 3791423 - RNA, 16 nt, Salmonella typhimurium LT2
cugcgugaagacacaa

SEQ ID NO: 3791424 - RNA, 18 nt, Salmonella typhimurium LT2
cugcgugaugcaucagaa

SEQ ID NO: 3791425 - RNA, 12 nt, Salmonella typhimurium LT2
cugcguuaucgc

SEQ ID NO: 3791426 - RNA, 11 nt, Salmonella typhimurium LT2
cugcguugccg

SEQ ID NO: 3791427 - RNA, 15 nt, Salmonella typhimurium LT2
cugcguugccgccuu

SEQ ID NO: 3791428 - RNA, 19 nt, Salmonella typhimurium LT2
cugcguugggugcagcguc

SEQ ID NO: 3791429 - RNA, 12 nt, Salmonella typhimurium LT2
cugcguuucauu

SEQ ID NO: 3791430 - RNA, 20 nt, Salmonella typhimurium LT2
cugcuaaacgaaccgucauc

SEQ ID NO: 3791431 - RNA, 24 nt, Salmonella typhimurium LT2
cugcuaguggauaaacauuacguu

SEQ ID NO: 3791432 - RNA, 21 nt, Salmonella typhimurium LT2
cugcuaucaggauucgacggc

SEQ ID NO: 3791433 - RNA, 14 nt, Salmonella typhimurium LT2
cugcucaaggcaau

SEQ ID NO: 3791434 - RNA, 17 nt, Salmonella typhimurium LT2
cugcucaaucgcaugac

SEQ ID NO: 3791435 - RNA, 19 nt, Salmonella typhimurium LT2
cugcucauaacccuccugc

SEQ ID NO: 3791436 - RNA, 15 nt, Salmonella typhimurium LT2
cugcuccagcguggc

SEQ ID NO: 3791437 - RNA, 16 nt, Salmonella typhimurium LT2
cugcucccucacgcgu

SEQ ID NO: 3791438 - RNA, 18 nt, Salmonella typhimurium LT2
cugcuccggcuuaaugcc

SEQ ID NO: 3791439 - RNA, 23 nt, Salmonella typhimurium LT2
cugcuccugccagauuuucuuua

SEQ ID NO: 3791440 - RNA, 23 nt, Salmonella typhimurium LT2
cuggcccggcaguugcugucgcu

SEQ ID NO: 3791441 - RNA, 16 nt, Salmonella typhimurium LT2
cuggccguuugcugcu

SEQ ID NO: 3791442 - RNA, 20 nt, Salmonella typhimurium LT2
cuggccguuuucccggcaau

SEQ ID NO: 3791443 - RNA, 19 nt, Salmonella typhimurium LT2
cuggccuagaugaaugacu

SEQ ID NO: 3791444 - RNA, 16 nt, Salmonella typhimurium LT2
cuggccuccagcacuu

SEQ ID NO: 3791445 - RNA, 13 nt, Salmonella typhimurium LT2
cuggccugcugug

SEQ ID NO: 3791446 - RNA, 15 nt, Salmonella typhimurium LT2
cuggccugcugugag

SEQ ID NO: 3791447 - RNA, 23 nt, Salmonella typhimurium LT2
cuggccugucguacuccaggcgc

SEQ ID NO: 3791448 - RNA, 18 nt, Salmonella typhimurium LT2
cuggccuuccagauaggu

SEQ ID NO: 3791449 - RNA, 21 nt, Salmonella typhimurium LT2
cuggcgaaagcgaccggcacu

SEQ ID NO: 3791450 - RNA, 15 nt, Salmonella typhimurium LT2
cuggcgcaaaugggc

SEQ ID NO: 3791451 - RNA, 14 nt, Salmonella typhimurium LT2
cuggcgcaaccggc

SEQ ID NO: 3791452 - RNA, 20 nt, Salmonella typhimurium LT2
cuggcgcaaccggcguggug

SEQ ID NO: 3791453 - RNA, 16 nt, Salmonella typhimurium LT2
cuggcgcacaggccug

SEQ ID NO: 3791454 - RNA, 22 nt, Salmonella typhimurium LT2
cuggcgcacgcgucaucggcgc

SEQ ID NO: 3791455 - RNA, 14 nt, Salmonella typhimurium LT2
cuggcgcagccgcu

SEQ ID NO: 3791456 - RNA, 19 nt, Salmonella typhimurium LT2
cuggcgcagcgcuuuugcc

SEQ ID NO: 3791457 - RNA, 13 nt, Salmonella typhimurium LT2
cuggcgcagcuuc

SEQ ID NO: 3791458 - RNA, 17 nt, Salmonella typhimurium LT2
cuggcgcgccagcucuu

SEQ ID NO: 3791459 - RNA, 14 nt, Salmonella typhimurium LT2
cuggcgcgccugcu

SEQ ID NO: 3791460 - RNA, 15 nt, Salmonella typhimurium LT2
cuggcgcgccugcuc

SEQ ID NO: 3791461 - RNA, 20 nt, Salmonella typhimurium LT2
cuggcgcgccugcuccacca

SEQ ID NO: 3791462 - RNA, 18 nt, Salmonella typhimurium LT2
cuggcgcggggaacacaa

SEQ ID NO: 3791463 - RNA, 17 nt, Salmonella typhimurium LT2
cuggcgcggggaacacu

SEQ ID NO: 3791464 - RNA, 16 nt, Salmonella typhimurium LT2
cuggcgcggggaacau

SEQ ID NO: 3791465 - RNA, 18 nt, Salmonella typhimurium LT2
cuggcgcuuuaagugcau

SEQ ID NO: 3791466 - RNA, 23 nt, Salmonella typhimurium LT2
cuggcgcuuuaagugcaucgcca

SEQ ID NO: 3791467 - RNA, 18 nt, Salmonella typhimurium LT2
cuggcggccccucuucca

SEQ ID NO: 3791468 - RNA, 22 nt, Salmonella typhimurium LT2
cuggcggcgcucaauguggcuu

SEQ ID NO: 3791469 - RNA, 13 nt, Salmonella typhimurium LT2
cuggcggcucagg

SEQ ID NO: 3791470 - RNA, 14 nt, Salmonella typhimurium LT2
cuggcggcucaggg

SEQ ID NO: 3791471 - RNA, 20 nt, Salmonella typhimurium LT2
cuggcgguaaauacgcggca

SEQ ID NO: 3791472 - RNA, 22 nt, Salmonella typhimurium LT2
cuggcgguaugaaagccaucgc

SEQ ID NO: 3791473 - RNA, 16 nt, Salmonella typhimurium LT2
cuggcggucaauacgu

SEQ ID NO: 3791474 - RNA, 20 nt, Salmonella typhimurium LT2
cuggcggucgggaacgcugu

SEQ ID NO: 3791475 - RNA, 22 nt, Salmonella typhimurium LT2
cuggcguaguaugacccgcccc

SEQ ID NO: 3791476 - RNA, 21 nt, Salmonella typhimurium LT2
cuggcguaugcuuucagcaug

SEQ ID NO: 3791477 - RNA, 19 nt, Salmonella typhimurium LT2
cuggcgugacguguggcgc

SEQ ID NO: 3791478 - RNA, 20 nt, Salmonella typhimurium LT2
cuggcguuuccgcuaccgcu

SEQ ID NO: 3791479 - RNA, 15 nt, Salmonella typhimurium LT2
cuggcuaucgccgua

SEQ ID NO: 3791480 - RNA, 15 nt, Salmonella typhimurium LT2
cuggcucaauccagg

SEQ ID NO: 3791481 - RNA, 18 nt, Salmonella typhimurium LT2
cuggcucaauccaggugg

SEQ ID NO: 3791482 - RNA, 14 nt, Salmonella typhimurium LT2
cuggcucacugacu

SEQ ID NO: 3791483 - RNA, 11 nt, Salmonella typhimurium LT2
cuggcucagac

SEQ ID NO: 3791484 - RNA, 13 nt, Salmonella typhimurium LT2
cuggcucagacca

SEQ ID NO: 3791485 - RNA, 12 nt, Salmonella typhimurium LT2
cuggcucaggcg

SEQ ID NO: 3791486 - RNA, 17 nt, Salmonella typhimurium LT2
cuggcucccgcagccac

SEQ ID NO: 3791487 - RNA, 21 nt, Salmonella typhimurium LT2
cuggcugacagaagccccgcu

SEQ ID NO: 3791488 - RNA, 14 nt, Salmonella typhimurium LT2
cuggcugagaaaaa

SEQ ID NO: 3791489 - RNA, 15 nt, Salmonella typhimurium LT2
cuggcugcggccucc

SEQ ID NO: 3791490 - RNA, 18 nt, Salmonella typhimurium LT2
cuggcuggucagcguacc

SEQ ID NO: 3791491 - RNA, 15 nt, Salmonella typhimurium LT2
cuggcuuaccugcuc

SEQ ID NO: 3791492 - RNA, 20 nt, Salmonella typhimurium LT2
cuggcuugauguagucgcuc

SEQ ID NO: 3791493 - RNA, 21 nt, Salmonella typhimurium LT2
cuggcuugcgcuauccgcgcu

SEQ ID NO: 3791494 - RNA, 21 nt, Salmonella typhimurium LT2
cuggcuuguucaucgccgugg

SEQ ID NO: 3791495 - RNA, 17 nt, Salmonella typhimurium LT2
cuggcuuuauauaaaaa

SEQ ID NO: 3791496 - RNA, 19 nt, Salmonella typhimurium LT2
cuggcuuugcgccacuuca

SEQ ID NO: 3791497 - RNA, 16 nt, Salmonella typhimurium LT2
cuggcuuugcgccggc

SEQ ID NO: 3791498 - RNA, 20 nt, Salmonella typhimurium LT2
cuggcuuugcuggcacugcg

SEQ ID NO: 3791499 - RNA, 18 nt, Salmonella typhimurium LT2
cugggauaagcagaacaa

SEQ ID NO: 3791500 - RNA, 22 nt, Salmonella typhimurium LT2
cugggcaaucaucagaccgaua

SEQ ID NO: 3791501 - RNA, 20 nt, Salmonella typhimurium LT2
cugggccgccacgaccugca

SEQ ID NO: 3791502 - RNA, 14 nt, Salmonella typhimurium LT2
cugggccucgcccc

SEQ ID NO: 3791503 - RNA, 16 nt, Salmonella typhimurium LT2
cugggccucgccccuu

SEQ ID NO: 3791504 - RNA, 18 nt, Salmonella typhimurium LT2
cugggcgaagguggcgga

SEQ ID NO: 3791505 - RNA, 22 nt, Salmonella typhimurium LT2
cugggcgagggaggcaaucgca

SEQ ID NO: 3791506 - RNA, 23 nt, Salmonella typhimurium LT2
cugggcggcaacccgcuccagaa

SEQ ID NO: 3791507 - RNA, 18 nt, Salmonella typhimurium LT2
cugggcugauacgccugg

SEQ ID NO: 3791508 - RNA, 16 nt, Salmonella typhimurium LT2
cuggggguaacacaaa

SEQ ID NO: 3791509 - RNA, 16 nt, Salmonella typhimurium LT2
cuggguagaguaaccc

SEQ ID NO: 3791510 - RNA, 17 nt, Salmonella typhimurium LT2
cugggucacgauaacca

SEQ ID NO: 3791511 - RNA, 18 nt, Salmonella typhimurium LT2
cugggucugcugggcgau

SEQ ID NO: 3791512 - RNA, 19 nt, Salmonella typhimurium LT2
cugggugugaucgccgcga

SEQ ID NO: 3791513 - RNA, 14 nt, Salmonella typhimurium LT2
cuggguugcccaaa

SEQ ID NO: 3791514 - RNA, 16 nt, Salmonella typhimurium LT2
cuggguuugcugaauc

SEQ ID NO: 3791515 - RNA, 21 nt, Salmonella typhimurium LT2
cuggguuuugucgguaauguc

SEQ ID NO: 3791516 - RNA, 20 nt, Salmonella typhimurium LT2
cugguaaaacgauauugccu

SEQ ID NO: 3791517 - RNA, 19 nt, Salmonella typhimurium LT2
cugguaaccguaacgcucc

SEQ ID NO: 3791518 - RNA, 23 nt, Salmonella typhimurium LT2
cugguaaccguaacgcuccugga

SEQ ID NO: 3791519 - RNA, 22 nt, Salmonella typhimurium LT2
cugguaagagagccuuauaggc

SEQ ID NO: 3791520 - RNA, 18 nt, Salmonella typhimurium LT2
cugguaagcugcggcaga

SEQ ID NO: 3791521 - RNA, 19 nt, Salmonella typhimurium LT2
cugguaaugucauccagcg

SEQ ID NO: 3791522 - RNA, 17 nt, Salmonella typhimurium LT2
cugguacguccauccgc

SEQ ID NO: 3791523 - RNA, 21 nt, Salmonella typhimurium LT2
cugguacguccauccgccggg

SEQ ID NO: 3791524 - RNA, 18 nt, Salmonella typhimurium LT2
cugguagagaucgacaaa

SEQ ID NO: 3791525 - RNA, 15 nt, Salmonella typhimurium LT2
cugguauaaaaacug

SEQ ID NO: 3791526 - RNA, 18 nt, Salmonella typhimurium LT2
cugguauaggccaggcua

SEQ ID NO: 3791527 - RNA, 14 nt, Salmonella typhimurium LT2
cuggucagcgcaau

SEQ ID NO: 3791528 - RNA, 15 nt, Salmonella typhimurium LT2
cuggucagcgcgcca

SEQ ID NO: 3791529 - RNA, 18 nt, Salmonella typhimurium LT2
cuggucagguaagcccuu

SEQ ID NO: 3791530 - RNA, 15 nt, Salmonella typhimurium LT2
cuggucauccccguc

SEQ ID NO: 3791531 - RNA, 18 nt, Salmonella typhimurium LT2
cuggucaucgaaccgggu

SEQ ID NO: 3791532 - RNA, 21 nt, Salmonella typhimurium LT2
cuggucgagaacguaaaagac

SEQ ID NO: 3791533 - RNA, 21 nt, Salmonella typhimurium LT2
cuggucgaggacggccugacg

SEQ ID NO: 3791534 - RNA, 15 nt, Salmonella typhimurium LT2
cuggucgccagcgcc

SEQ ID NO: 3791535 - RNA, 18 nt, Salmonella typhimurium LT2
cuggucgccagcgccgga

SEQ ID NO: 3791536 - RNA, 15 nt, Salmonella typhimurium LT2
cuggucgggcaggcu

SEQ ID NO: 3791537 - RNA, 18 nt, Salmonella typhimurium LT2
cuggucggugauugucca

SEQ ID NO: 3791538 - RNA, 14 nt, Salmonella typhimurium LT2
cuggucuuccgcau

SEQ ID NO: 3791539 - RNA, 20 nt, Salmonella typhimurium LT2
cuggugaaacguguuuaucc

SEQ ID NO: 3791540 - RNA, 18 nt, Salmonella typhimurium LT2
cuggugaagacgcugcaa

SEQ ID NO: 3791541 - RNA, 15 nt, Salmonella typhimurium LT2
cuggugauaaagcag

SEQ ID NO: 3791542 - RNA, 14 nt, Salmonella typhimurium LT2
cuggugaucuggcc

SEQ ID NO: 3791543 - RNA, 23 nt, Salmonella typhimurium LT2
cuggugcagcaagcggcugucau

SEQ ID NO: 3791544 - RNA, 22 nt, Salmonella typhimurium LT2
cugugcgagcgcccgccgcgag

SEQ ID NO: 3791545 - RNA, 14 nt, Salmonella typhimurium LT2
cuguggguucaucg

SEQ ID NO: 3791546 - RNA, 20 nt, Salmonella typhimurium LT2
cuguggguugccauauuuuc

SEQ ID NO: 3791547 - RNA, 21 nt, Salmonella typhimurium LT2
cuguguacacaauugccaugg

SEQ ID NO: 3791548 - RNA, 19 nt, Salmonella typhimurium LT2
cuguguacgccaagcugca

SEQ ID NO: 3791549 - RNA, 23 nt, Salmonella typhimurium LT2
cuguguagaaauucugcaggcca

SEQ ID NO: 3791550 - RNA, 24 nt, Salmonella typhimurium LT2
cuguguauucugcgccagccagcu

SEQ ID NO: 3791551 - RNA, 18 nt, Salmonella typhimurium LT2
cugugucguccgggccug

SEQ ID NO: 3791552 - RNA, 16 nt, Salmonella typhimurium LT2
cuguuaauuucauaaa

SEQ ID NO: 3791553 - RNA, 16 nt, Salmonella typhimurium LT2
cuguuaauuucccgcu

SEQ ID NO: 3791554 - RNA, 17 nt, Salmonella typhimurium LT2
cuguuacgcugguuugu

SEQ ID NO: 3791555 - RNA, 13 nt, Salmonella typhimurium LT2
cuguuaucaggca

SEQ ID NO: 3791556 - RNA, 17 nt, Salmonella typhimurium LT2
cuguuaugaaacccgcc

SEQ ID NO: 3791557 - RNA, 19 nt, Salmonella typhimurium LT2
cuguucaacaugcugaccg

SEQ ID NO: 3791558 - RNA, 14 nt, Salmonella typhimurium LT2
cuguucacauccag

SEQ ID NO: 3791559 - RNA, 16 nt, Salmonella typhimurium LT2
cuguucaucaaagaaa

SEQ ID NO: 3791560 - RNA, 15 nt, Salmonella typhimurium LT2
cuguuccagcugcga

SEQ ID NO: 3791561 - RNA, 18 nt, Salmonella typhimurium LT2
cuguuccaugacguucaa

SEQ ID NO: 3791562 - RNA, 19 nt, Salmonella typhimurium LT2
cuguuccgaaauaaaucga

SEQ ID NO: 3791563 - RNA, 18 nt, Salmonella typhimurium LT2
cuguucgcuuaaccguga

SEQ ID NO: 3791564 - RNA, 18 nt, Salmonella typhimurium LT2
cuguucguucaaaucgca

SEQ ID NO: 3791565 - RNA, 23 nt, Salmonella typhimurium LT2
cuguucuggauagucuucaagcc

SEQ ID NO: 3791566 - RNA, 11 nt, Salmonella typhimurium LT2
cuguucugucc

SEQ ID NO: 3791567 - RNA, 23 nt, Salmonella typhimurium LT2
cuguucuucacgcgaagcgccga

SEQ ID NO: 3791568 - RNA, 15 nt, Salmonella typhimurium LT2
cuguucuuucucuau

SEQ ID NO: 3791569 - RNA, 16 nt, Salmonella typhimurium LT2
cuguugaaagccccgg

SEQ ID NO: 3791570 - RNA, 23 nt, Salmonella typhimurium LT2
cuguugccccgcuuucagcguug

SEQ ID NO: 3791571 - RNA, 15 nt, Salmonella typhimurium LT2
cuguugccgcccguc

SEQ ID NO: 3791572 - RNA, 20 nt, Salmonella typhimurium LT2
cuguugccuuugcgcgcgau

SEQ ID NO: 3791573 - RNA, 17 nt, Salmonella typhimurium LT2
cuguugcgccagcacgc

SEQ ID NO: 3791574 - RNA, 14 nt, Salmonella typhimurium LT2
cuguugcugugcau

SEQ ID NO: 3791575 - RNA, 19 nt, Salmonella typhimurium LT2
cuguuggaugcgcgacugc

SEQ ID NO: 3791576 - RNA, 15 nt, Salmonella typhimurium LT2
cuguuuaauccggua

SEQ ID NO: 3791577 - RNA, 21 nt, Salmonella typhimurium LT2
cuguuuacaggcgauuuuuua

SEQ ID NO: 3791578 - RNA, 17 nt, Salmonella typhimurium LT2
cuguuucaacacaucca

SEQ ID NO: 3791579 - RNA, 19 nt, Salmonella typhimurium LT2
cuguuucaccguagcauca

SEQ ID NO: 3791580 - RNA, 22 nt, Salmonella typhimurium LT2
cuguuucaccguagcaucauca

SEQ ID NO: 3791581 - RNA, 18 nt, Salmonella typhimurium LT2
cuguuucacgccuuuuga

SEQ ID NO: 3791582 - RNA, 16 nt, Salmonella typhimurium LT2
cuguuuccaguuaccg

SEQ ID NO: 3791583 - RNA, 22 nt, Salmonella typhimurium LT2
cuguuucuccguuguugcacca

SEQ ID NO: 3791584 - RNA, 23 nt, Salmonella typhimurium LT2
cuguuucuccguuguugcaccac

SEQ ID NO: 3791585 - RNA, 13 nt, Salmonella typhimurium LT2
cuguuugcagugg

SEQ ID NO: 3791586 - RNA, 18 nt, Salmonella typhimurium LT2
cuguuuugcuucuucagc

SEQ ID NO: 3791587 - RNA, 23 nt, Salmonella typhimurium LT2
cuguuuuuggaaacuaugcaaaa

SEQ ID NO: 3791588 - RNA, 13 nt, Salmonella typhimurium LT2
cuuaaaaaauccu

SEQ ID NO: 3791589 - RNA, 15 nt, Salmonella typhimurium LT2
cuuaaaauagccagc

SEQ ID NO: 3791590 - RNA, 11 nt, Salmonella typhimurium LT2
cuuaaacagaa

SEQ ID NO: 3791591 - RNA, 17 nt, Salmonella typhimurium LT2
cuuaaacagaauuuaug

SEQ ID NO: 3791592 - RNA, 21 nt, Salmonella typhimurium LT2
cuuaaacaucgcccuccagcu

SEQ ID NO: 3791593 - RNA, 15 nt, Salmonella typhimurium LT2
cuuaaacgccggauu

SEQ ID NO: 3791594 - RNA, 21 nt, Salmonella typhimurium LT2
cuuaaacgccggauuccagaa

SEQ ID NO: 3791595 - RNA, 13 nt, Salmonella typhimurium LT2
cuuaaaggcggca

SEQ ID NO: 3791596 - RNA, 20 nt, Salmonella typhimurium LT2
cuuaaaguacuucacaauca

SEQ ID NO: 3791597 - RNA, 17 nt, Salmonella typhimurium LT2
cuuaaauaaaaaugaua

SEQ ID NO: 3791598 - RNA, 13 nt, Salmonella typhimurium LT2
cuuaaauaugaaa

SEQ ID NO: 3791599 - RNA, 19 nt, Salmonella typhimurium LT2
cuuaaauaugaaagagaaa

SEQ ID NO: 3791600 - RNA, 14 nt, Salmonella typhimurium LT2
cuuaaaugccgccg

SEQ ID NO: 3791601 - RNA, 21 nt, Salmonella typhimurium LT2
cuuaaauggcgcuguaaggca

SEQ ID NO: 3791602 - RNA, 13 nt, Salmonella typhimurium LT2
cuuaaauuuuuaa

SEQ ID NO: 3791603 - RNA, 12 nt, Salmonella typhimurium LT2
cuuaacacaaac

SEQ ID NO: 3791604 - RNA, 19 nt, Salmonella typhimurium LT2
cuuaacagaauugcgccac

SEQ ID NO: 3791605 - RNA, 16 nt, Salmonella typhimurium LT2
cuuaacgauaacguca

SEQ ID NO: 3791606 - RNA, 14 nt, Salmonella typhimurium LT2
cuuaacgauuuuau

SEQ ID NO: 3791607 - RNA, 13 nt, Salmonella typhimurium LT2
cuuaauacagcaa

SEQ ID NO: 3791608 - RNA, 22 nt, Salmonella typhimurium LT2
cuuaauaccauagcggcucagg

SEQ ID NO: 3791609 - RNA, 23 nt, Salmonella typhimurium LT2
cuuaauacccauuucuucuucaa

SEQ ID NO: 3791610 - RNA, 17 nt, Salmonella typhimurium LT2
cuuaauacgcagaucuu

SEQ ID NO: 3791611 - RNA, 18 nt, Salmonella typhimurium LT2
cuuaauacucgccccguu

SEQ ID NO: 3791612 - RNA, 12 nt, Salmonella typhimurium LT2
cuuaauccagcc

SEQ ID NO: 3791613 - RNA, 15 nt, Salmonella typhimurium LT2
cuuaaugcucuccag

SEQ ID NO: 3791614 - RNA, 16 nt, Salmonella typhimurium LT2
cuuaaugcucugcugu

SEQ ID NO: 3791615 - RNA, 20 nt, Salmonella typhimurium LT2
cuuaauuugcagaaagauuu

SEQ ID NO: 3791616 - RNA, 16 nt, Salmonella typhimurium LT2
cuuaccaaaagcauug

SEQ ID NO: 3791617 - RNA, 13 nt, Salmonella typhimurium LT2
cuuaccaaacagc

SEQ ID NO: 3791618 - RNA, 18 nt, Salmonella typhimurium LT2
cuuaccaggucuuaccua

SEQ ID NO: 3791619 - RNA, 20 nt, Salmonella typhimurium LT2
cuuacccagagucaccagca

SEQ ID NO: 3791620 - RNA, 23 nt, Salmonella typhimurium LT2
cuuacccggccuacacaucaucu

SEQ ID NO: 3791621 - RNA, 17 nt, Salmonella typhimurium LT2
cuuaccgcggucaccuu

SEQ ID NO: 3791622 - RNA, 15 nt, Salmonella typhimurium LT2
cuuaccgggcaucug

SEQ ID NO: 3791623 - RNA, 23 nt, Salmonella typhimurium LT2
cuuaccuauuuuaaauucccagc

SEQ ID NO: 3791624 - RNA, 19 nt, Salmonella typhimurium LT2
cuuaccuuguucuuccauu

SEQ ID NO: 3791625 - RNA, 23 nt, Salmonella typhimurium LT2
cuuacgaacugcggcuuuuucac

SEQ ID NO: 3791626 - RNA, 20 nt, Salmonella typhimurium LT2
cuuacgaagauugucgauca

SEQ ID NO: 3791627 - RNA, 15 nt, Salmonella typhimurium LT2
cuuacgauauuuuuc

SEQ ID NO: 3791628 - RNA, 19 nt, Salmonella typhimurium LT2
cuuacgaugagcguggcgu

SEQ ID NO: 3791629 - RNA, 15 nt, Salmonella typhimurium LT2
cuuacgcggcgcgcu

SEQ ID NO: 3791630 - RNA, 22 nt, Salmonella typhimurium LT2
cuuacgcggcgcgcucuuuuuc

SEQ ID NO: 3791631 - RNA, 21 nt, Salmonella typhimurium LT2
cuuacggacguggggguucaa

SEQ ID NO: 3791632 - RNA, 13 nt, Salmonella typhimurium LT2
cuuacugcugucc

SEQ ID NO: 3791633 - RNA, 17 nt, Salmonella typhimurium LT2
cuuacugcuguccgcca

SEQ ID NO: 3791634 - RNA, 22 nt, Salmonella typhimurium LT2
cuuagacaucaaaauuaccuuu

SEQ ID NO: 3791635 - RNA, 15 nt, Salmonella typhimurium LT2
cuuagcuaucugccc

SEQ ID NO: 3791636 - RNA, 19 nt, Salmonella typhimurium LT2
cuuagcuggccaaucagcg

SEQ ID NO: 3791637 - RNA, 18 nt, Salmonella typhimurium LT2
cuuagggggcuaccggag

SEQ ID NO: 3791638 - RNA, 14 nt, Salmonella typhimurium LT2
cuuagguuuguagc

SEQ ID NO: 3791639 - RNA, 17 nt, Salmonella typhimurium LT2
cuuauacugauaucuau

SEQ ID NO: 3791640 - RNA, 17 nt, Salmonella typhimurium LT2
cuuauauauguucaaua

SEQ ID NO: 3791641 - RNA, 14 nt, Salmonella typhimurium LT2
cuuaucaaaccagu

SEQ ID NO: 3791642 - RNA, 22 nt, Salmonella typhimurium LT2
cuuaucagcguguuucaucuca

SEQ ID NO: 3791643 - RNA, 12 nt, Salmonella typhimurium LT2
cuuaucaggccu

SEQ ID NO: 3791644 - RNA, 21 nt, Salmonella typhimurium LT2
cuuaucaggccuacaguuuca

SEQ ID NO: 3791645 - RNA, 19 nt, Salmonella typhimurium LT2
cuuaucaggccuaccagcc

SEQ ID NO: 3791646 - RNA, 14 nt, Salmonella typhimurium LT2
cuuauccacgcccu

SEQ ID NO: 3791647 - RNA, 13 nt, Salmonella typhimurium LT2
cuuauccagccac

SEQ ID NO: 3791648 - RNA, 17 nt, Salmonella typhimurium LT2
cuuccacugcaucucuu

SEQ ID NO: 3791649 - RNA, 16 nt, Salmonella typhimurium LT2
cuuccacugcggcauu

SEQ ID NO: 3791650 - RNA, 21 nt, Salmonella typhimurium LT2
cuuccacugcggcauuacgcg

SEQ ID NO: 3791651 - RNA, 22 nt, Salmonella typhimurium LT2
cuuccagcacgauauccagcac

SEQ ID NO: 3791652 - RNA, 20 nt, Salmonella typhimurium LT2
cuuccagcgcauggaagaaa

SEQ ID NO: 3791653 - RNA, 14 nt, Salmonella typhimurium LT2
cuuccagcgcgccg

SEQ ID NO: 3791654 - RNA, 22 nt, Salmonella typhimurium LT2
cuuccagcgcgccgucaucgcu

SEQ ID NO: 3791655 - RNA, 20 nt, Salmonella typhimurium LT2
cuuccagcgcguccagcccg

SEQ ID NO: 3791656 - RNA, 13 nt, Salmonella typhimurium LT2
cuuccagcggcag

SEQ ID NO: 3791657 - RNA, 15 nt, Salmonella typhimurium LT2
cuuccagcggcaggc

SEQ ID NO: 3791658 - RNA, 19 nt, Salmonella typhimurium LT2
cuuccagcgucacuggcca

SEQ ID NO: 3791659 - RNA, 15 nt, Salmonella typhimurium LT2
cuuccagcgucucca

SEQ ID NO: 3791660 - RNA, 12 nt, Salmonella typhimurium LT2
cuuccagcucca

SEQ ID NO: 3791661 - RNA, 22 nt, Salmonella typhimurium LT2
cuuccaggauacacauggagaa

SEQ ID NO: 3791662 - RNA, 13 nt, Salmonella typhimurium LT2
cuuccaggguagc

SEQ ID NO: 3791663 - RNA, 14 nt, Salmonella typhimurium LT2
cuuccaguugcguc

SEQ ID NO: 3791664 - RNA, 13 nt, Salmonella typhimurium LT2
cuuccaguugcuu

SEQ ID NO: 3791665 - RNA, 15 nt, Salmonella typhimurium LT2
cuuccaucagccagg

SEQ ID NO: 3791666 - RNA, 23 nt, Salmonella typhimurium LT2
cuucccauauuuuuucugccagu

SEQ ID NO: 3791667 - RNA, 23 nt, Salmonella typhimurium LT2
cuucccccaaaaugccgcccauc

SEQ ID NO: 3791668 - RNA, 20 nt, Salmonella typhimurium LT2
cuucccccguuugcaguccg

SEQ ID NO: 3791669 - RNA, 17 nt, Salmonella typhimurium LT2
cuuccccggucagucca

SEQ ID NO: 3791670 - RNA, 20 nt, Salmonella typhimurium LT2
cuuccccuguaacugcaccu

SEQ ID NO: 3791671 - RNA, 15 nt, Salmonella typhimurium LT2
cuucccgacgcuggc

SEQ ID NO: 3791672 - RNA, 23 nt, Salmonella typhimurium LT2
cuucccgcaaacuggccacagca

SEQ ID NO: 3791673 - RNA, 18 nt, Salmonella typhimurium LT2
cuucccugaccagcgacg

SEQ ID NO: 3791674 - RNA, 17 nt, Salmonella typhimurium LT2
cuuccgaccgcagcgaa

SEQ ID NO: 3791675 - RNA, 19 nt, Salmonella typhimurium LT2
cuuccgcaccgccagucaa

SEQ ID NO: 3791676 - RNA, 12 nt, Salmonella typhimurium LT2
cuuccgcaucgu

SEQ ID NO: 3791677 - RNA, 13 nt, Salmonella typhimurium LT2
cuuccgccaccac

SEQ ID NO: 3791678 - RNA, 23 nt, Salmonella typhimurium LT2
cuuccgccagcgccagcagcagu

SEQ ID NO: 3791679 - RNA, 17 nt, Salmonella typhimurium LT2
cuuccgccagcgcguuc

SEQ ID NO: 3791680 - RNA, 19 nt, Salmonella typhimurium LT2
cuuccgccauacccggcuc

SEQ ID NO: 3791681 - RNA, 14 nt, Salmonella typhimurium LT2
cuuccgccugauaa

SEQ ID NO: 3791682 - RNA, 18 nt, Salmonella typhimurium LT2
cuuccggcacucuucuuc

SEQ ID NO: 3791683 - RNA, 16 nt, Salmonella typhimurium LT2
cuuccggcgagagaau

SEQ ID NO: 3791684 - RNA, 18 nt, Salmonella typhimurium LT2
cuuccgggauagcacuac

SEQ ID NO: 3791685 - RNA, 15 nt, Salmonella typhimurium LT2
cuuccgggcgggcgc

SEQ ID NO: 3791686 - RNA, 22 nt, Salmonella typhimurium LT2
cuuccucaauauuaucuucguc

SEQ ID NO: 3791687 - RNA, 18 nt, Salmonella typhimurium LT2
cuuccucauuauugccca

SEQ ID NO: 3791688 - RNA, 15 nt, Salmonella typhimurium LT2
cuuccuccaccacca

SEQ ID NO: 3791689 - RNA, 16 nt, Salmonella typhimurium LT2
cuuccuccaccaccau

SEQ ID NO: 3791690 - RNA, 21 nt, Salmonella typhimurium LT2
cuuccugaaagaguacgccga

SEQ ID NO: 3791691 - RNA, 14 nt, Salmonella typhimurium LT2
cuuccugccagcac

SEQ ID NO: 3791692 - RNA, 23 nt, Salmonella typhimurium LT2
cuuccugcgcugucaccagcagc

SEQ ID NO: 3791693 - RNA, 21 nt, Salmonella typhimurium LT2
cuuccuggaugcuuaaaaucc

SEQ ID NO: 3791694 - RNA, 17 nt, Salmonella typhimurium LT2
cuuccuggggaacagaa

SEQ ID NO: 3791695 - RNA, 19 nt, Salmonella typhimurium LT2
cuuccuggggaacagaagc

SEQ ID NO: 3791696 - RNA, 17 nt, Salmonella typhimurium LT2
cuuccuuugccuuucuu

SEQ ID NO: 3791697 - RNA, 14 nt, Salmonella typhimurium LT2
cuucgaaacgaucg

SEQ ID NO: 3791698 - RNA, 17 nt, Salmonella typhimurium LT2
cuucgaaugucucaaua

SEQ ID NO: 3791699 - RNA, 18 nt, Salmonella typhimurium LT2
cuucgaaugucucaauau

SEQ ID NO: 3791700 - RNA, 12 nt, Salmonella typhimurium LT2
cuucgauaaacg

SEQ ID NO: 3791701 - RNA, 18 nt, Salmonella typhimurium LT2
cuucgauaacaucaagcc

SEQ ID NO: 3791702 - RNA, 14 nt, Salmonella typhimurium LT2
cuucgauaauaaaa

SEQ ID NO: 3791703 - RNA, 20 nt, Salmonella typhimurium LT2
cuucgauaauaaaauauuau

SEQ ID NO: 3791704 - RNA, 21 nt, Salmonella typhimurium LT2
cuucgauaguccauuuuccua

SEQ ID NO: 3791705 - RNA, 19 nt, Salmonella typhimurium LT2
cuucgaugagaugcgcggu

SEQ ID NO: 3791706 - RNA, 13 nt, Salmonella typhimurium LT2
cuucgcacugccc

SEQ ID NO: 3791707 - RNA, 15 nt, Salmonella typhimurium LT2
cuucgcagaucgccu

SEQ ID NO: 3791708 - RNA, 19 nt, Salmonella typhimurium LT2
cuucgcagaucgccuggau

SEQ ID NO: 3791709 - RNA, 19 nt, Salmonella typhimurium LT2
cuucgccaaacacccagcc

SEQ ID NO: 3791710 - RNA, 21 nt, Salmonella typhimurium LT2
cuucgccaacuuuuugcgcaa

SEQ ID NO: 3791711 - RNA, 15 nt, Salmonella typhimurium LT2
cuucgccaaucgccg

SEQ ID NO: 3791712 - RNA, 13 nt, Salmonella typhimurium LT2
cuucgccacugug

SEQ ID NO: 3791713 - RNA, 15 nt, Salmonella typhimurium LT2
cuucgccauccggua

SEQ ID NO: 3791714 - RNA, 20 nt, Salmonella typhimurium LT2
cuucgccaucuccaucauuu

SEQ ID NO: 3791715 - RNA, 16 nt, Salmonella typhimurium LT2
cuucgcccaucgccgc

SEQ ID NO: 3791716 - RNA, 20 nt, Salmonella typhimurium LT2
cuucgccguuaucggccugc

SEQ ID NO: 3791717 - RNA, 16 nt, Salmonella typhimurium LT2
cuucgccucagccaac

SEQ ID NO: 3791718 - RNA, 19 nt, Salmonella typhimurium LT2
cuucgccuucgccggcaac

SEQ ID NO: 3791719 - RNA, 21 nt, Salmonella typhimurium LT2
cuucgccuuucaccagcgccu

SEQ ID NO: 3791720 - RNA, 19 nt, Salmonella typhimurium LT2
cuucgcgcagccagcgccc

SEQ ID NO: 3791721 - RNA, 16 nt, Salmonella typhimurium LT2
cuucgcguaaugcaau

SEQ ID NO: 3791722 - RNA, 13 nt, Salmonella typhimurium LT2
cuucgcucucuuu

SEQ ID NO: 3791723 - RNA, 22 nt, Salmonella typhimurium LT2
cuucgcugaaaaugacuucauc

SEQ ID NO: 3791724 - RNA, 23 nt, Salmonella typhimurium LT2
cuucgcugaaaaugacuucaucg

SEQ ID NO: 3791725 - RNA, 15 nt, Salmonella typhimurium LT2
cuucgcuuagcuucc

SEQ ID NO: 3791726 - RNA, 22 nt, Salmonella typhimurium LT2
cuucgcuuauccggccuacgau

SEQ ID NO: 3791727 - RNA, 14 nt, Salmonella typhimurium LT2
cuucgcuuccugga

SEQ ID NO: 3791728 - RNA, 18 nt, Salmonella typhimurium LT2
cuucggacuccugacgcu

SEQ ID NO: 3791729 - RNA, 13 nt, Salmonella typhimurium LT2
cuucggcgccauu

SEQ ID NO: 3791730 - RNA, 18 nt, Salmonella typhimurium LT2
cuucggcgccauuccugc

SEQ ID NO: 3791731 - RNA, 14 nt, Salmonella typhimurium LT2
cuucggucagaucc

SEQ ID NO: 3791732 - RNA, 18 nt, Salmonella typhimurium LT2
cuucggucagauccuggc

SEQ ID NO: 3791733 - RNA, 15 nt, Salmonella typhimurium LT2
cuucgguccggcgcu

SEQ ID NO: 3791734 - RNA, 22 nt, Salmonella typhimurium LT2
cuucgguugccugcgucauccc

SEQ ID NO: 3791735 - RNA, 14 nt, Salmonella typhimurium LT2
cuucguauuucuuc

SEQ ID NO: 3791736 - RNA, 17 nt, Salmonella typhimurium LT2
cuucgucaaugcugcuu

SEQ ID NO: 3791737 - RNA, 16 nt, Salmonella typhimurium LT2
cuucgucgucuucauc

SEQ ID NO: 3791738 - RNA, 17 nt, Salmonella typhimurium LT2
cuucgucgucuucaucc

SEQ ID NO: 3791739 - RNA, 14 nt, Salmonella typhimurium LT2
cuucgucuuuauuc

SEQ ID NO: 3791740 - RNA, 23 nt, Salmonella typhimurium LT2
cuucguggaacugcagcgcgucg

SEQ ID NO: 3791741 - RNA, 16 nt, Salmonella typhimurium LT2
cuucguucaguuccag

SEQ ID NO: 3791742 - RNA, 15 nt, Salmonella typhimurium LT2
cuucguucauccguc

SEQ ID NO: 3791743 - RNA, 23 nt, Salmonella typhimurium LT2
cuucguuuccugucucuauuaac

SEQ ID NO: 3791744 - RNA, 23 nt, Salmonella typhimurium LT2
cuucguuuuauuugaugccuggc

SEQ ID NO: 3791745 - RNA, 19 nt, Salmonella typhimurium LT2
cuucuaacgcaacggaagg

SEQ ID NO: 3791746 - RNA, 16 nt, Salmonella typhimurium LT2
cuucuaauuccaggau

SEQ ID NO: 3791747 - RNA, 14 nt, Salmonella typhimurium LT2
cuucuaccgcuucg

SEQ ID NO: 3791748 - RNA, 18 nt, Salmonella typhimurium LT2
cuucuaccuucaccccca

SEQ ID NO: 3791749 - RNA, 21 nt, Salmonella typhimurium LT2
cuucuacgcgacgcauugcca

SEQ ID NO: 3791750 - RNA, 12 nt, Salmonella typhimurium LT2
cuucuauccacu

SEQ ID NO: 3791751 - RNA, 16 nt, Salmonella typhimurium LT2
cuucuauuucuuuauu

SEQ ID NO: 3791752 - RNA, 13 nt, Salmonella typhimurium LT2
cuuuaacgcuggc

SEQ ID NO: 3791753 - RNA, 15 nt, Salmonella typhimurium LT2
cuuuaagugcaucgc

SEQ ID NO: 3791754 - RNA, 13 nt, Salmonella typhimurium LT2
cuuuaaucacccg

SEQ ID NO: 3791755 - RNA, 20 nt, Salmonella typhimurium LT2
cuuuaaucuuagacaucaaa

SEQ ID NO: 3791756 - RNA, 22 nt, Salmonella typhimurium LT2
cuuuaaugcaucucguaaauca

SEQ ID NO: 3791757 - RNA, 23 nt, Salmonella typhimurium LT2
cuuuaaugcaucucguaaaucaa

SEQ ID NO: 3791758 - RNA, 16 nt, Salmonella typhimurium LT2
cuuuaauuaaauuuuc

SEQ ID NO: 3791759 - RNA, 15 nt, Salmonella typhimurium LT2
cuuuacccaccagcc

SEQ ID NO: 3791760 - RNA, 14 nt, Salmonella typhimurium LT2
cuuuacccagcggg

SEQ ID NO: 3791761 - RNA, 15 nt, Salmonella typhimurium LT2
cuuuacccggcgcaa

SEQ ID NO: 3791762 - RNA, 17 nt, Salmonella typhimurium LT2
cuuuacccuuacggcca

SEQ ID NO: 3791763 - RNA, 19 nt, Salmonella typhimurium LT2
cuuuacccuuacggccacu

SEQ ID NO: 3791764 - RNA, 20 nt, Salmonella typhimurium LT2
cuuuaccgccaaacgccgca

SEQ ID NO: 3791765 - RNA, 17 nt, Salmonella typhimurium LT2
cuuuaccgucagccacu

SEQ ID NO: 3791766 - RNA, 14 nt, Salmonella typhimurium LT2
cuuuaccgugaaug

SEQ ID NO: 3791767 - RNA, 15 nt, Salmonella typhimurium LT2
cuuuacgaugagcaa

SEQ ID NO: 3791768 - RNA, 21 nt, Salmonella typhimurium LT2
cuuuacgcagauaacuuccuu

SEQ ID NO: 3791769 - RNA, 15 nt, Salmonella typhimurium LT2
cuuuacgcagcaaga

SEQ ID NO: 3791770 - RNA, 18 nt, Salmonella typhimurium LT2
cuuuacguacccgcgccg

SEQ ID NO: 3791771 - RNA, 16 nt, Salmonella typhimurium LT2
cuuuacugaaucucag

SEQ ID NO: 3791772 - RNA, 20 nt, Salmonella typhimurium LT2
cuuuagaaaaagaaaccucc

SEQ ID NO: 3791773 - RNA, 21 nt, Salmonella typhimurium LT2
cuuuagauaauuucgcauaau

SEQ ID NO: 3791774 - RNA, 15 nt, Salmonella typhimurium LT2
cuuuagccauucccg

SEQ ID NO: 3791775 - RNA, 20 nt, Salmonella typhimurium LT2
cuuuaggcggcgccgcgccg

SEQ ID NO: 3791776 - RNA, 23 nt, Salmonella typhimurium LT2
cuuuauaaaaagcacaucaggaa

SEQ ID NO: 3791777 - RNA, 20 nt, Salmonella typhimurium LT2
cuuuauaaaucaggaaaaag

SEQ ID NO: 3791778 - RNA, 13 nt, Salmonella typhimurium LT2
cuuuauauaaaaa

SEQ ID NO: 3791779 - RNA, 14 nt, Salmonella typhimurium LT2
cuuuauauaaaaaa

SEQ ID NO: 3791780 - RNA, 12 nt, Salmonella typhimurium LT2
cuuuaucaauag

SEQ ID NO: 3791781 - RNA, 21 nt, Salmonella typhimurium LT2
cuuuauccagcggugcgcggu

SEQ ID NO: 3791782 - RNA, 22 nt, Salmonella typhimurium LT2
cuuuaucuucugcugcucccuc

SEQ ID NO: 3791783 - RNA, 20 nt, Salmonella typhimurium LT2
cuuuaugaauaucaacgcca

SEQ ID NO: 3791784 - RNA, 20 nt, Salmonella typhimurium LT2
cuuuaugggcauuucauuua

SEQ ID NO: 3791785 - RNA, 21 nt, Salmonella typhimurium LT2
cuuuaugucaguaauauauua

SEQ ID NO: 3791786 - RNA, 22 nt, Salmonella typhimurium LT2
cuuuauuaaaaagcagccagac

SEQ ID NO: 3791787 - RNA, 22 nt, Salmonella typhimurium LT2
cuuucaauacuccacaguucaa

SEQ ID NO: 3791788 - RNA, 21 nt, Salmonella typhimurium LT2
cuuucaauacuucgacaauau

SEQ ID NO: 3791789 - RNA, 21 nt, Salmonella typhimurium LT2
cuuucaauagucgacagcccg

SEQ ID NO: 3791790 - RNA, 15 nt, Salmonella typhimurium LT2
cuuucacagcuccug

SEQ ID NO: 3791791 - RNA, 24 nt, Salmonella typhimurium LT2
cuuucaccagugaucggcuggaca

SEQ ID NO: 3791792 - RNA, 18 nt, Salmonella typhimurium LT2
cuuucacccccagcugac

SEQ ID NO: 3791793 - RNA, 18 nt, Salmonella typhimurium LT2
cuuucaccggucgcaaga

SEQ ID NO: 3791794 - RNA, 13 nt, Salmonella typhimurium LT2
cuuucagaucggc

SEQ ID NO: 3791795 - RNA, 13 nt, Salmonella typhimurium LT2
cuuucagauuuuu

SEQ ID NO: 3791796 - RNA, 22 nt, Salmonella typhimurium LT2
cuuucagccggcuaucuucuuc

SEQ ID NO: 3791797 - RNA, 12 nt, Salmonella typhimurium LT2
cuuucaucuuua

SEQ ID NO: 3791798 - RNA, 14 nt, Salmonella typhimurium LT2
cuuucauuccuuua

SEQ ID NO: 3791799 - RNA, 17 nt, Salmonella typhimurium LT2
cuuucauuccuuuagcu

SEQ ID NO: 3791800 - RNA, 15 nt, Salmonella typhimurium LT2
cuuuccaaagcgaag

SEQ ID NO: 3791801 - RNA, 23 nt, Salmonella typhimurium LT2
cuuuccacaaucccggcaacugc

SEQ ID NO: 3791802 - RNA, 17 nt, Salmonella typhimurium LT2
cuuuccagcucaaccgc

SEQ ID NO: 3791803 - RNA, 15 nt, Salmonella typhimurium LT2
cuuuccagcuccagc

SEQ ID NO: 3791804 - RNA, 20 nt, Salmonella typhimurium LT2
cuuuccaggccagcgacacg

SEQ ID NO: 3791805 - RNA, 13 nt, Salmonella typhimurium LT2
cuuucccggcaug

SEQ ID NO: 3791806 - RNA, 15 nt, Salmonella typhimurium LT2
cuuuccgcaccgcuu

SEQ ID NO: 3791807 - RNA, 17 nt, Salmonella typhimurium LT2
cuuuccgccaugaaaaa

SEQ ID NO: 3791808 - RNA, 19 nt, Salmonella typhimurium LT2
cuuuccgccaugaaaaaaa

SEQ ID NO: 3791809 - RNA, 15 nt, Salmonella typhimurium LT2
cuuuccguacgguuu

SEQ ID NO: 3791810 - RNA, 13 nt, Salmonella typhimurium LT2
cuuuccugacaaa

SEQ ID NO: 3791811 - RNA, 17 nt, Salmonella typhimurium LT2
cuuuccugaucaaucaa

SEQ ID NO: 3791812 - RNA, 15 nt, Salmonella typhimurium LT2
cuuucgacgucacca

SEQ ID NO: 3791813 - RNA, 17 nt, Salmonella typhimurium LT2
cuuucgacgucaccauc

SEQ ID NO: 3791814 - RNA, 21 nt, Salmonella typhimurium LT2
cuuucgcaacauccgaaagcu

SEQ ID NO: 3791815 - RNA, 21 nt, Salmonella typhimurium LT2
cuuucgcaaucugauaaacaa

SEQ ID NO: 3791816 - RNA, 15 nt, Salmonella typhimurium LT2
cuuucgccagaaccg

SEQ ID NO: 3791817 - RNA, 14 nt, Salmonella typhimurium LT2
cuuucgccagccgc

SEQ ID NO: 3791818 - RNA, 15 nt, Salmonella typhimurium LT2
cuuucgccagcggcg

SEQ ID NO: 3791819 - RNA, 20 nt, Salmonella typhimurium LT2
cuuucgccaguucauucgcc

SEQ ID NO: 3791820 - RNA, 15 nt, Salmonella typhimurium LT2
cuuucgcuguaggcc

SEQ ID NO: 3791821 - RNA, 22 nt, Salmonella typhimurium LT2
cuuucggguugcccugcuuguc

SEQ ID NO: 3791822 - RNA, 18 nt, Salmonella typhimurium LT2
cuuucgguagccacagau

SEQ ID NO: 3791823 - RNA, 18 nt, Salmonella typhimurium LT2
cuuucgucacuaacucca

SEQ ID NO: 3791824 - RNA, 23 nt, Salmonella typhimurium LT2
cuuucgucacuaacuccagcauc

SEQ ID NO: 3791825 - RNA, 12 nt, Salmonella typhimurium LT2
cuuucuacaaau

SEQ ID NO: 3791826 - RNA, 14 nt, Salmonella typhimurium LT2
cuuucucacuugca

SEQ ID NO: 3791827 - RNA, 19 nt, Salmonella typhimurium LT2
cuuucucggcgaggacccg

SEQ ID NO: 3791828 - RNA, 22 nt, Salmonella typhimurium LT2
cuuucucggcgaggacccgugg

SEQ ID NO: 3791829 - RNA, 17 nt, Salmonella typhimurium LT2
cuuucucuaugguggcu

SEQ ID NO: 3791830 - RNA, 21 nt, Salmonella typhimurium LT2
cuuucugaauuucacgcuuca

SEQ ID NO: 3791831 - RNA, 14 nt, Salmonella typhimurium LT2
cuuucugguaaccg

SEQ ID NO: 3791832 - RNA, 22 nt, Salmonella typhimurium LT2
cuuucuguuaauaaucgaacug

SEQ ID NO: 3791833 - RNA, 18 nt, Salmonella typhimurium LT2
cuuucuugccacuggccu

SEQ ID NO: 3791834 - RNA, 14 nt, Salmonella typhimurium LT2
cuuucuuuaacacc

SEQ ID NO: 3791835 - RNA, 11 nt, Salmonella typhimurium LT2
cuuucuuucuc

SEQ ID NO: 3791836 - RNA, 14 nt, Salmonella typhimurium LT2
cuuugaaaaucaca

SEQ ID NO: 3791837 - RNA, 18 nt, Salmonella typhimurium LT2
cuuugaaaaucacaucgc

SEQ ID NO: 3791838 - RNA, 17 nt, Salmonella typhimurium LT2
cuuugaccagcaucgcc

SEQ ID NO: 3791839 - RNA, 15 nt, Salmonella typhimurium LT2
cuuugaccagcgacg

SEQ ID NO: 3791840 - RNA, 12 nt, Salmonella typhimurium LT2
cuuugagaaagc

SEQ ID NO: 3791841 - RNA, 13 nt, Salmonella typhimurium LT2
cuuugagaaagcu

SEQ ID NO: 3791842 - RNA, 15 nt, Salmonella typhimurium LT2
cuuugagcagcgcca

SEQ ID NO: 3791843 - RNA, 22 nt, Salmonella typhimurium LT2
cuuugagcaucaaacuuuuaaa

SEQ ID NO: 3791844 - RNA, 22 nt, Salmonella typhimurium LT2
cuuugaucagcacgcggaacac

SEQ ID NO: 3791845 - RNA, 14 nt, Salmonella typhimurium LT2
cuuugauggcuuua

SEQ ID NO: 3791846 - RNA, 16 nt, Salmonella typhimurium LT2
cuuugauggcuuuaaa

SEQ ID NO: 3791847 - RNA, 14 nt, Salmonella typhimurium LT2
cuuugcaacagggc

SEQ ID NO: 3791848 - RNA, 12 nt, Salmonella typhimurium LT2
cuuugcccagaa

SEQ ID NO: 3791849 - RNA, 20 nt, Salmonella typhimurium LT2
cuuugcccgagcgcuggcau

SEQ ID NO: 3791850 - RNA, 13 nt, Salmonella typhimurium LT2
cuuugccuuucuu

SEQ ID NO: 3791851 - RNA, 16 nt, Salmonella typhimurium LT2
cuuugcgaacagcgca

SEQ ID NO: 3791852 - RNA, 18 nt, Salmonella typhimurium LT2
cuuugcgauagcccggca

SEQ ID NO: 3791853 - RNA, 20 nt, Salmonella typhimurium LT2
cuuugcgccauuucaauaau

SEQ ID NO: 3791854 - RNA, 14 nt, Salmonella typhimurium LT2
cuuugcgccgccag

SEQ ID NO: 3791855 - RNA, 17 nt, Salmonella typhimurium LT2
cuuugcgcgucucuccc

SEQ ID NO: 3791856 - RNA, 14 nt, Salmonella typhimurium LT2
gaaaagcuggcuga

SEQ ID NO: 3791857 - RNA, 20 nt, Salmonella typhimurium LT2
gaaaagcuguagcauaaaug

SEQ ID NO: 3791858 - RNA, 20 nt, Salmonella typhimurium LT2
gaaaaggaagaauaaauaac

SEQ ID NO: 3791859 - RNA, 18 nt, Salmonella typhimurium LT2
gaaaaggaauaccugcgc

SEQ ID NO: 3791860 - RNA, 22 nt, Salmonella typhimurium LT2
gaaaaggccuggcugagaaaaa

SEQ ID NO: 3791861 - RNA, 23 nt, Salmonella typhimurium LT2
gaaaaggccuggcugagaaaaau

SEQ ID NO: 3791862 - RNA, 22 nt, Salmonella typhimurium LT2
gaaaagguuccggcgaucacca

SEQ ID NO: 3791863 - RNA, 23 nt, Salmonella typhimurium LT2
gaaaauaaacgcuugacucugaa

SEQ ID NO: 3791864 - RNA, 13 nt, Salmonella typhimurium LT2
gaaaauacucccg

SEQ ID NO: 3791865 - RNA, 14 nt, Salmonella typhimurium LT2
gaaaauagaggaaa

SEQ ID NO: 3791866 - RNA, 11 nt, Salmonella typhimurium LT2
gaaaauauauu

SEQ ID NO: 3791867 - RNA, 17 nt, Salmonella typhimurium LT2
gaaaauaugaugcuauc

SEQ ID NO: 3791868 - RNA, 17 nt, Salmonella typhimurium LT2
gaaaaucagcgacuggu

SEQ ID NO: 3791869 - RNA, 20 nt, Salmonella typhimurium LT2
gaaaaucagugaacacccug

SEQ ID NO: 3791870 - RNA, 22 nt, Salmonella typhimurium LT2
gaaaaucagugaacacccugcc

SEQ ID NO: 3791871 - RNA, 21 nt, Salmonella typhimurium LT2
gaaaaucgacuggugauuuuu

SEQ ID NO: 3791872 - RNA, 15 nt, Salmonella typhimurium LT2
gaaaaucuucuucag

SEQ ID NO: 3791873 - RNA, 16 nt, Salmonella typhimurium LT2
gaaaaugaaaaauccg

SEQ ID NO: 3791874 - RNA, 17 nt, Salmonella typhimurium LT2
gaaaaugguuuugccca

SEQ ID NO: 3791875 - RNA, 17 nt, Salmonella typhimurium LT2
gaaaauuccuggauuaa

SEQ ID NO: 3791876 - RNA, 22 nt, Salmonella typhimurium LT2
gaaaauuguccacggggcggca

SEQ ID NO: 3791877 - RNA, 14 nt, Salmonella typhimurium LT2
gaaacaagaagcac

SEQ ID NO: 3791878 - RNA, 15 nt, Salmonella typhimurium LT2
gaaacaagcggcggc

SEQ ID NO: 3791879 - RNA, 12 nt, Salmonella typhimurium LT2
gaaacaccagaa

SEQ ID NO: 3791880 - RNA, 16 nt, Salmonella typhimurium LT2
gaaacaggcugacaaa

SEQ ID NO: 3791881 - RNA, 14 nt, Salmonella typhimurium LT2
gaaacauauauauc

SEQ ID NO: 3791882 - RNA, 13 nt, Salmonella typhimurium LT2
gaaacccaaauaa

SEQ ID NO: 3791883 - RNA, 16 nt, Salmonella typhimurium LT2
gaaacccaaauaacca

SEQ ID NO: 3791884 - RNA, 22 nt, Salmonella typhimurium LT2
gaaaccccaaaucagcaaaaac

SEQ ID NO: 3791885 - RNA, 14 nt, Salmonella typhimurium LT2
gaaacccgccaccg

SEQ ID NO: 3791886 - RNA, 16 nt, Salmonella typhimurium LT2
gaaacccgccaccgcc

SEQ ID NO: 3791887 - RNA, 17 nt, Salmonella typhimurium LT2
gaaacccgcucgcccgc

SEQ ID NO: 3791888 - RNA, 21 nt, Salmonella typhimurium LT2
gaaacccucggcgaacaggcg

SEQ ID NO: 3791889 - RNA, 15 nt, Salmonella typhimurium LT2
gaaaccgcagaaaaa

SEQ ID NO: 3791890 - RNA, 15 nt, Salmonella typhimurium LT2
gaaaccgcccugcag

SEQ ID NO: 3791891 - RNA, 16 nt, Salmonella typhimurium LT2
gaaaccgcccugcagg

SEQ ID NO: 3791892 - RNA, 14 nt, Salmonella typhimurium LT2
gaaaccgcucgccg

SEQ ID NO: 3791893 - RNA, 18 nt, Salmonella typhimurium LT2
gaaaccgcucgccgccuc

SEQ ID NO: 3791894 - RNA, 21 nt, Salmonella typhimurium LT2
gaaaccggcgucuuuugcugc

SEQ ID NO: 3791895 - RNA, 12 nt, Salmonella typhimurium LT2
gaaaccuccgca

SEQ ID NO: 3791896 - RNA, 17 nt, Salmonella typhimurium LT2
gaaacgaaagcucaggc

SEQ ID NO: 3791897 - RNA, 23 nt, Salmonella typhimurium LT2
gaaacgaucgauaaagcgauuac

SEQ ID NO: 3791898 - RNA, 18 nt, Salmonella typhimurium LT2
gaaacgcacccgcgcagg

SEQ ID NO: 3791899 - RNA, 20 nt, Salmonella typhimurium LT2
gaaacgcauacgcagcacuu

SEQ ID NO: 3791900 - RNA, 12 nt, Salmonella typhimurium LT2
gaaacgccaggc

SEQ ID NO: 3791901 - RNA, 14 nt, Salmonella typhimurium LT2
gaaacgccaggcac

SEQ ID NO: 3791902 - RNA, 17 nt, Salmonella typhimurium LT2
gaaacgccuuauccggc

SEQ ID NO: 3791903 - RNA, 15 nt, Salmonella typhimurium LT2
gaaacgcgccggaag

SEQ ID NO: 3791904 - RNA, 20 nt, Salmonella typhimurium LT2
gaaacgcuuucuggggugaa

SEQ ID NO: 3791905 - RNA, 15 nt, Salmonella typhimurium LT2
gaaacgggaaagccc

SEQ ID NO: 3791906 - RNA, 14 nt, Salmonella typhimurium LT2
gaaacgguccuggu

SEQ ID NO: 3791907 - RNA, 19 nt, Salmonella typhimurium LT2
gaaacgugcauuauuuuag

SEQ ID NO: 3791908 - RNA, 16 nt, Salmonella typhimurium LT2
gaaacguguuuauccc

SEQ ID NO: 3791909 - RNA, 22 nt, Salmonella typhimurium LT2
gaaacucgugaagaucagcaga

SEQ ID NO: 3791910 - RNA, 23 nt, Salmonella typhimurium LT2
gaaacugauaguuuaaauccagc

SEQ ID NO: 3791911 - RNA, 12 nt, Salmonella typhimurium LT2
gaaacugauauu

SEQ ID NO: 3791912 - RNA, 18 nt, Salmonella typhimurium LT2
gaaacugcugccgcagca

SEQ ID NO: 3791913 - RNA, 20 nt, Salmonella typhimurium LT2
gaaacuuaucauuuuuucua

SEQ ID NO: 3791914 - RNA, 18 nt, Salmonella typhimurium LT2
gaaagaaaacuuuccaac

SEQ ID NO: 3791915 - RNA, 16 nt, Salmonella typhimurium LT2
gaaagacgcgcucggc

SEQ ID NO: 3791916 - RNA, 21 nt, Salmonella typhimurium LT2
gaaagacggcagcgccauccg

SEQ ID NO: 3791917 - RNA, 16 nt, Salmonella typhimurium LT2
gaaagauagcaggccc

SEQ ID NO: 3791918 - RNA, 14 nt, Salmonella typhimurium LT2
gaaagcaaccagaa

SEQ ID NO: 3791919 - RNA, 13 nt, Salmonella typhimurium LT2
gaaagcacuucuc

SEQ ID NO: 3791920 - RNA, 14 nt, Salmonella typhimurium LT2
gaaagcagguuuug

SEQ ID NO: 3791921 - RNA, 18 nt, Salmonella typhimurium LT2
gaaagccucuuccgccug

SEQ ID NO: 3791922 - RNA, 16 nt, Salmonella typhimurium LT2
gaaagcgaaaauaaag

SEQ ID NO: 3791923 - RNA, 17 nt, Salmonella typhimurium LT2
gaaagcgaaaauaaagg

SEQ ID NO: 3791924 - RNA, 22 nt, Salmonella typhimurium LT2
gaaagcgacucauccacauacu

SEQ ID NO: 3791925 - RNA, 17 nt, Salmonella typhimurium LT2
gaaagcguaauaugcac

SEQ ID NO: 3791926 - RNA, 12 nt, Salmonella typhimurium LT2
gaaagcugcacc

SEQ ID NO: 3791927 - RNA, 12 nt, Salmonella typhimurium LT2
gaaagcugcgcc

SEQ ID NO: 3791928 - RNA, 17 nt, Salmonella typhimurium LT2
gaaaggcgucagccgcc

SEQ ID NO: 3791929 - RNA, 21 nt, Salmonella typhimurium LT2
gaaaggcgucagccgccauca

SEQ ID NO: 3791930 - RNA, 15 nt, Salmonella typhimurium LT2
gaaagggacgaugau

SEQ ID NO: 3791931 - RNA, 16 nt, Salmonella typhimurium LT2
gaaagggaucaaugua

SEQ ID NO: 3791932 - RNA, 22 nt, Salmonella typhimurium LT2
gaaagggccgggaaagauaaua

SEQ ID NO: 3791933 - RNA, 20 nt, Salmonella typhimurium LT2
gaaagucuuuuguuuuucuc

SEQ ID NO: 3791934 - RNA, 21 nt, Salmonella typhimurium LT2
gaaagugggcgcuuuguuacu

SEQ ID NO: 3791935 - RNA, 21 nt, Salmonella typhimurium LT2
gaaaguggugggugaugacgg

SEQ ID NO: 3791936 - RNA, 21 nt, Salmonella typhimurium LT2
gaaagugguuuuaagcuucuu

SEQ ID NO: 3791937 - RNA, 17 nt, Salmonella typhimurium LT2
gaaaguuuucgccacgu

SEQ ID NO: 3791938 - RNA, 21 nt, Salmonella typhimurium LT2
gaaauaaagaaaguagaucac

SEQ ID NO: 3791939 - RNA, 18 nt, Salmonella typhimurium LT2
gaaauaaaucgauagcga

SEQ ID NO: 3791940 - RNA, 18 nt, Salmonella typhimurium LT2
gaaauaacgcacuaccag

SEQ ID NO: 3791941 - RNA, 15 nt, Salmonella typhimurium LT2
gaaauaacgugcccu

SEQ ID NO: 3791942 - RNA, 14 nt, Salmonella typhimurium LT2
gaaauaaucuguag

SEQ ID NO: 3791943 - RNA, 15 nt, Salmonella typhimurium LT2
gaaauagacgagcga

SEQ ID NO: 3791944 - RNA, 18 nt, Salmonella typhimurium LT2
gaaauauuaucgccauca

SEQ ID NO: 3791945 - RNA, 19 nt, Salmonella typhimurium LT2
gaaaucacaaacaccacca

SEQ ID NO: 3791946 - RNA, 23 nt, Salmonella typhimurium LT2
gaaaucacaaacaccaccaguaa

SEQ ID NO: 3791947 - RNA, 17 nt, Salmonella typhimurium LT2
gaaaucacgccacagua

SEQ ID NO: 3791948 - RNA, 21 nt, Salmonella typhimurium LT2
gaaaucacgcucaucggcggc

SEQ ID NO: 3791949 - RNA, 22 nt, Salmonella typhimurium LT2
gaaaucacgcucaucggcggca

SEQ ID NO: 3791950 - RNA, 12 nt, Salmonella typhimurium LT2
gaaaucagcaca

SEQ ID NO: 3791951 - RNA, 13 nt, Salmonella typhimurium LT2
gaaaucagcaggu

SEQ ID NO: 3791952 - RNA, 17 nt, Salmonella typhimurium LT2
gaaaucauauaaaacag

SEQ ID NO: 3791953 - RNA, 13 nt, Salmonella typhimurium LT2
gaaaucauuucau

SEQ ID NO: 3791954 - RNA, 18 nt, Salmonella typhimurium LT2
gaaaucccggaggcgaua

SEQ ID NO: 3791955 - RNA, 16 nt, Salmonella typhimurium LT2
gaaauccgcuuugagc

SEQ ID NO: 3791956 - RNA, 21 nt, Salmonella typhimurium LT2
gaaaucgccgggcuauccggc

SEQ ID NO: 3791957 - RNA, 15 nt, Salmonella typhimurium LT2
gaaaucgucgccaac

SEQ ID NO: 3791958 - RNA, 18 nt, Salmonella typhimurium LT2
gaaaucgugcgccccagg

SEQ ID NO: 3791959 - RNA, 19 nt, Salmonella typhimurium LT2
gaaaucucgcuaaucauca

SEQ ID NO: 3791960 - RNA, 23 nt, Salmonella typhimurium LT2
gaacugucugaaucaaugcaucu

SEQ ID NO: 3791961 - RNA, 16 nt, Salmonella typhimurium LT2
gaacuguucagccagc

SEQ ID NO: 3791962 - RNA, 17 nt, Salmonella typhimurium LT2
gaacuguucagccagca

SEQ ID NO: 3791963 - RNA, 12 nt, Salmonella typhimurium LT2
gaacuuauccac

SEQ ID NO: 3791964 - RNA, 19 nt, Salmonella typhimurium LT2
gaacuucgcgguugcgccc

SEQ ID NO: 3791965 - RNA, 14 nt, Salmonella typhimurium LT2
gaacuugucaucgc

SEQ ID NO: 3791966 - RNA, 17 nt, Salmonella typhimurium LT2
gaacuuugcgaaaaagu

SEQ ID NO: 3791967 - RNA, 20 nt, Salmonella typhimurium LT2
gaagaaaaaggcaauaaagu

SEQ ID NO: 3791968 - RNA, 19 nt, Salmonella typhimurium LT2
gaagaaaccgcagaaaaag

SEQ ID NO: 3791969 - RNA, 20 nt, Salmonella typhimurium LT2
gaagaaacggaaaucacgca

SEQ ID NO: 3791970 - RNA, 14 nt, Salmonella typhimurium LT2
gaagaaagacgcgc

SEQ ID NO: 3791971 - RNA, 16 nt, Salmonella typhimurium LT2
gaagaaagcuaucgcc

SEQ ID NO: 3791972 - RNA, 22 nt, Salmonella typhimurium LT2
gaagaagcgcacuuuccauaau

SEQ ID NO: 3791973 - RNA, 17 nt, Salmonella typhimurium LT2
gaagaauucgcaaugug

SEQ ID NO: 3791974 - RNA, 17 nt, Salmonella typhimurium LT2
gaagacgcugcaacucu

SEQ ID NO: 3791975 - RNA, 13 nt, Salmonella typhimurium LT2
gaagacuauccag

SEQ ID NO: 3791976 - RNA, 17 nt, Salmonella typhimurium LT2
gaagacuccccugcaga

SEQ ID NO: 3791977 - RNA, 18 nt, Salmonella typhimurium LT2
gaagagagauaguugagc

SEQ ID NO: 3791978 - RNA, 23 nt, Salmonella typhimurium LT2
gaagagauugaguuugauagcgc

SEQ ID NO: 3791979 - RNA, 19 nt, Salmonella typhimurium LT2
gaagaguuaacuucuccuc

SEQ ID NO: 3791980 - RNA, 21 nt, Salmonella typhimurium LT2
gaagaguuaacuucuccucca

SEQ ID NO: 3791981 - RNA, 22 nt, Salmonella typhimurium LT2
gaagaguuaacuucuccuccau

SEQ ID NO: 3791982 - RNA, 20 nt, Salmonella typhimurium LT2
gaagaguuguugaccaacaa

SEQ ID NO: 3791983 - RNA, 22 nt, Salmonella typhimurium LT2
gaagaguuguugaccaacaauc

SEQ ID NO: 3791984 - RNA, 20 nt, Salmonella typhimurium LT2
gaagauagcgggcaaugcca

SEQ ID NO: 3791985 - RNA, 16 nt, Salmonella typhimurium LT2
gaagaucagcagagcg

SEQ ID NO: 3791986 - RNA, 18 nt, Salmonella typhimurium LT2
gaagaucaggaguaaaua

SEQ ID NO: 3791987 - RNA, 16 nt, Salmonella typhimurium LT2
gaagaucguuauccag

SEQ ID NO: 3791988 - RNA, 15 nt, Salmonella typhimurium LT2
gaagcaagugcugga

SEQ ID NO: 3791989 - RNA, 23 nt, Salmonella typhimurium LT2
gaagcaauucuucgaaugucuca

SEQ ID NO: 3791990 - RNA, 16 nt, Salmonella typhimurium LT2
gaagcacauccaugua

SEQ ID NO: 3791991 - RNA, 15 nt, Salmonella typhimurium LT2
gaagcacgacacaaa

SEQ ID NO: 3791992 - RNA, 13 nt, Salmonella typhimurium LT2
gaagcagcagacu

SEQ ID NO: 3791993 - RNA, 17 nt, Salmonella typhimurium LT2
gaagcagcuuauccggc

SEQ ID NO: 3791994 - RNA, 17 nt, Salmonella typhimurium LT2
gaagcaggcggagaagg

SEQ ID NO: 3791995 - RNA, 19 nt, Salmonella typhimurium LT2
gaagcagguguuauuuuug

SEQ ID NO: 3791996 - RNA, 19 nt, Salmonella typhimurium LT2
gaagcauccguuucccucu

SEQ ID NO: 3791997 - RNA, 21 nt, Salmonella typhimurium LT2
gaagccauccucacgcaacca

SEQ ID NO: 3791998 - RNA, 19 nt, Salmonella typhimurium LT2
gaagccccgcugcggaugu

SEQ ID NO: 3791999 - RNA, 20 nt, Salmonella typhimurium LT2
gaagcccggccacagcgcca

SEQ ID NO: 3792000 - RNA, 23 nt, Salmonella typhimurium LT2
gaagcccggccacagcgccagac

SEQ ID NO: 3792001 - RNA, 20 nt, Salmonella typhimurium LT2
gaagccgauaaacgccacga

SEQ ID NO: 3792002 - RNA, 14 nt, Salmonella typhimurium LT2
gaagccuuucuguu

SEQ ID NO: 3792003 - RNA, 13 nt, Salmonella typhimurium LT2
gaagcgaccggcg

SEQ ID NO: 3792004 - RNA, 19 nt, Salmonella typhimurium LT2
gaagcgaccggcgucauca

SEQ ID NO: 3792005 - RNA, 22 nt, Salmonella typhimurium LT2
gaagcgauguauuuauccacgc

SEQ ID NO: 3792006 - RNA, 21 nt, Salmonella typhimurium LT2
gaagcgauuuauccaccgcca

SEQ ID NO: 3792007 - RNA, 16 nt, Salmonella typhimurium LT2
gaagcgcauaucuuac

SEQ ID NO: 3792008 - RNA, 13 nt, Salmonella typhimurium LT2
gaagcgccauccg

SEQ ID NO: 3792009 - RNA, 18 nt, Salmonella typhimurium LT2
gaagcgcguucgucccac

SEQ ID NO: 3792010 - RNA, 20 nt, Salmonella typhimurium LT2
gaagcgcguuggcguuaccu

SEQ ID NO: 3792011 - RNA, 23 nt, Salmonella typhimurium LT2
gaagcggcgcaauuuuccccgau

SEQ ID NO: 3792012 - RNA, 18 nt, Salmonella typhimurium LT2
gaagcggcgccauccggc

SEQ ID NO: 3792013 - RNA, 19 nt, Salmonella typhimurium LT2
gaagcggcgccauccggca

SEQ ID NO: 3792014 - RNA, 17 nt, Salmonella typhimurium LT2
gaagcgggaaagcguaa

SEQ ID NO: 3792015 - RNA, 18 nt, Salmonella typhimurium LT2
gaagcggguauuauacuu

SEQ ID NO: 3792016 - RNA, 14 nt, Salmonella typhimurium LT2
gaagcguaacagcg

SEQ ID NO: 3792017 - RNA, 20 nt, Salmonella typhimurium LT2
gaagcguaacagcgcuauca

SEQ ID NO: 3792018 - RNA, 21 nt, Salmonella typhimurium LT2
gaagcguauuucugucagcgu

SEQ ID NO: 3792019 - RNA, 16 nt, Salmonella typhimurium LT2
gaagcgucauccggca

SEQ ID NO: 3792020 - RNA, 16 nt, Salmonella typhimurium LT2
gaagcucagccaggcg

SEQ ID NO: 3792021 - RNA, 22 nt, Salmonella typhimurium LT2
gaagcucaugugcagcauccag

SEQ ID NO: 3792022 - RNA, 23 nt, Salmonella typhimurium LT2
gaagcucaugugcagcauccagc

SEQ ID NO: 3792023 - RNA, 14 nt, Salmonella typhimurium LT2
gaaggaauaaaaua

SEQ ID NO: 3792024 - RNA, 12 nt, Salmonella typhimurium LT2
gaaggacaagcu

SEQ ID NO: 3792025 - RNA, 17 nt, Salmonella typhimurium LT2
gaaggacaagcugcgcc

SEQ ID NO: 3792026 - RNA, 18 nt, Salmonella typhimurium LT2
gaaggaugaccggcuauc

SEQ ID NO: 3792027 - RNA, 15 nt, Salmonella typhimurium LT2
gaaggcaacgccgcc

SEQ ID NO: 3792028 - RNA, 16 nt, Salmonella typhimurium LT2
gaaggcaucuucagac

SEQ ID NO: 3792029 - RNA, 12 nt, Salmonella typhimurium LT2
gaaggccugugg

SEQ ID NO: 3792030 - RNA, 20 nt, Salmonella typhimurium LT2
gaaggcgaaaacauugcgcc

SEQ ID NO: 3792031 - RNA, 21 nt, Salmonella typhimurium LT2
gaaggcgacgcgauagcgcag

SEQ ID NO: 3792032 - RNA, 16 nt, Salmonella typhimurium LT2
gaaggcgcccgggaga

SEQ ID NO: 3792033 - RNA, 20 nt, Salmonella typhimurium LT2
gaaggcucaaauuuggcuca

SEQ ID NO: 3792034 - RNA, 15 nt, Salmonella typhimurium LT2
gaaggcuucggucag

SEQ ID NO: 3792035 - RNA, 14 nt, Salmonella typhimurium LT2
gaaggcuuuuccau

SEQ ID NO: 3792036 - RNA, 16 nt, Salmonella typhimurium LT2
gaaggcuuuuccauac

SEQ ID NO: 3792037 - RNA, 17 nt, Salmonella typhimurium LT2
gaagggcagaucgagga

SEQ ID NO: 3792038 - RNA, 14 nt, Salmonella typhimurium LT2
gaagguaaaaguag

SEQ ID NO: 3792039 - RNA, 22 nt, Salmonella typhimurium LT2
gaagguauccagccaggucagc

SEQ ID NO: 3792040 - RNA, 23 nt, Salmonella typhimurium LT2
gaaggucauuaucaauggcuuca

SEQ ID NO: 3792041 - RNA, 15 nt, Salmonella typhimurium LT2
gaaggucgcauccgc

SEQ ID NO: 3792042 - RNA, 22 nt, Salmonella typhimurium LT2
gaaggucgcgccgccgccaacg

SEQ ID NO: 3792043 - RNA, 17 nt, Salmonella typhimurium LT2
gaaggucggcugaauca

SEQ ID NO: 3792044 - RNA, 14 nt, Salmonella typhimurium LT2
gaagguuuuucccg

SEQ ID NO: 3792045 - RNA, 12 nt, Salmonella typhimurium LT2
gaaguaaaaaaa

SEQ ID NO: 3792046 - RNA, 13 nt, Salmonella typhimurium LT2
gaaguaagcgcca

SEQ ID NO: 3792047 - RNA, 19 nt, Salmonella typhimurium LT2
gaaguagcaaaucaucgcc

SEQ ID NO: 3792048 - RNA, 17 nt, Salmonella typhimurium LT2
gaaguagcagagaaaag

SEQ ID NO: 3792049 - RNA, 18 nt, Salmonella typhimurium LT2
gaaguauccuggaacaaa

SEQ ID NO: 3792050 - RNA, 14 nt, Salmonella typhimurium LT2
gaagucuaucugua

SEQ ID NO: 3792051 - RNA, 23 nt, Salmonella typhimurium LT2
gaagucuggcugcggccuccgca

SEQ ID NO: 3792052 - RNA, 19 nt, Salmonella typhimurium LT2
gaagugcagcguuuccagc

SEQ ID NO: 3792053 - RNA, 15 nt, Salmonella typhimurium LT2
gaagugccaguaacu

SEQ ID NO: 3792054 - RNA, 23 nt, Salmonella typhimurium LT2
gaagugccaguaacucaucgcca

SEQ ID NO: 3792055 - RNA, 15 nt, Salmonella typhimurium LT2
gaagugccuguacuu

SEQ ID NO: 3792056 - RNA, 20 nt, Salmonella typhimurium LT2
gaagugguggcgaacaggcu

SEQ ID NO: 3792057 - RNA, 15 nt, Salmonella typhimurium LT2
gaaguuaccgcgcca

SEQ ID NO: 3792058 - RNA, 18 nt, Salmonella typhimurium LT2
gaaguuaccgcgccaggc

SEQ ID NO: 3792059 - RNA, 17 nt, Salmonella typhimurium LT2
gaaguucuucuggcgca

SEQ ID NO: 3792060 - RNA, 22 nt, Salmonella typhimurium LT2
gaaguugccgccauaggucagc

SEQ ID NO: 3792061 - RNA, 13 nt, Salmonella typhimurium LT2
gaaguuugcacuu

SEQ ID NO: 3792062 - RNA, 14 nt, Salmonella typhimurium LT2
gaauaaaacugcca

SEQ ID NO: 3792063 - RNA, 18 nt, Salmonella typhimurium LT2
gaauuugaacucuuucag

SEQ ID NO: 3792064 - RNA, 14 nt, Salmonella typhimurium LT2
gaauuugccccaga

SEQ ID NO: 3792065 - RNA, 15 nt, Salmonella typhimurium LT2
gaauuuguugguuua

SEQ ID NO: 3792066 - RNA, 21 nt, Salmonella typhimurium LT2
gaauuuuccgccgugauucau

SEQ ID NO: 3792067 - RNA, 21 nt, Salmonella typhimurium LT2
gaauuuuguagguuccgacaa

SEQ ID NO: 3792068 - RNA, 13 nt, Salmonella typhimurium LT2
gacaaaaauacca

SEQ ID NO: 3792069 - RNA, 21 nt, Salmonella typhimurium LT2
gacaaaauaaagugaaauaaa

SEQ ID NO: 3792070 - RNA, 21 nt, Salmonella typhimurium LT2
gacaaaaucuuuccagcucca

SEQ ID NO: 3792071 - RNA, 19 nt, Salmonella typhimurium LT2
gacaaacaccgagccagaa

SEQ ID NO: 3792072 - RNA, 13 nt, Salmonella typhimurium LT2
gacaaauuauaaa

SEQ ID NO: 3792073 - RNA, 16 nt, Salmonella typhimurium LT2
gacaaauuguuuaaaa

SEQ ID NO: 3792074 - RNA, 16 nt, Salmonella typhimurium LT2
gacaacaacaucugug

SEQ ID NO: 3792075 - RNA, 11 nt, Salmonella typhimurium LT2
gacaaccagcg

SEQ ID NO: 3792076 - RNA, 22 nt, Salmonella typhimurium LT2
gacaaccccaaacaccaacaaa

SEQ ID NO: 3792077 - RNA, 23 nt, Salmonella typhimurium LT2
gacaacccgucaccgccagugca

SEQ ID NO: 3792078 - RNA, 14 nt, Salmonella typhimurium LT2
gacaaccugcccuu

SEQ ID NO: 3792079 - RNA, 14 nt, Salmonella typhimurium LT2
gacaacgaccagug

SEQ ID NO: 3792080 - RNA, 13 nt, Salmonella typhimurium LT2
gacaacgcauugc

SEQ ID NO: 3792081 - RNA, 17 nt, Salmonella typhimurium LT2
gacaacgccgccuggca

SEQ ID NO: 3792082 - RNA, 15 nt, Salmonella typhimurium LT2
gacaacgcgccgcgg

SEQ ID NO: 3792083 - RNA, 18 nt, Salmonella typhimurium LT2
gacaacgcuccagcaguu

SEQ ID NO: 3792084 - RNA, 15 nt, Salmonella typhimurium LT2
gacaacggcggauga

SEQ ID NO: 3792085 - RNA, 19 nt, Salmonella typhimurium LT2
gacaacguaaacggcagcc

SEQ ID NO: 3792086 - RNA, 15 nt, Salmonella typhimurium LT2
gacaacuauugcugc

SEQ ID NO: 3792087 - RNA, 21 nt, Salmonella typhimurium LT2
gacaacuucuaauuuuuccag

SEQ ID NO: 3792088 - RNA, 17 nt, Salmonella typhimurium LT2
gacaagaaucacguaau

SEQ ID NO: 3792089 - RNA, 13 nt, Salmonella typhimurium LT2
gacaagcugcgcc

SEQ ID NO: 3792090 - RNA, 19 nt, Salmonella typhimurium LT2
gacaaggcgguacuccgcc

SEQ ID NO: 3792091 - RNA, 17 nt, Salmonella typhimurium LT2
gacaaguauaugucuga

SEQ ID NO: 3792092 - RNA, 18 nt, Salmonella typhimurium LT2
gacaauaaacuggcugug

SEQ ID NO: 3792093 - RNA, 19 nt, Salmonella typhimurium LT2
gacaauaacggccucaauu

SEQ ID NO: 3792094 - RNA, 15 nt, Salmonella typhimurium LT2
gacaauaugaccacu

SEQ ID NO: 3792095 - RNA, 18 nt, Salmonella typhimurium LT2
gacaaucucaaugccacg

SEQ ID NO: 3792096 - RNA, 22 nt, Salmonella typhimurium LT2
gacaaucucaaugccacgccgu

SEQ ID NO: 3792097 - RNA, 23 nt, Salmonella typhimurium LT2
gacaaucuccuccggcuucagca

SEQ ID NO: 3792098 - RNA, 15 nt, Salmonella typhimurium LT2
gacaaugauuugcaa

SEQ ID NO: 3792099 - RNA, 22 nt, Salmonella typhimurium LT2
gacaauuuugauaagagaaaau

SEQ ID NO: 3792100 - RNA, 16 nt, Salmonella typhimurium LT2
gacacagaugccguuu

SEQ ID NO: 3792101 - RNA, 19 nt, Salmonella typhimurium LT2
gacacagcguacaauggca

SEQ ID NO: 3792102 - RNA, 21 nt, Salmonella typhimurium LT2
gacacagcguacaauggcagg

SEQ ID NO: 3792103 - RNA, 13 nt, Salmonella typhimurium LT2
gacacaggccuga

SEQ ID NO: 3792104 - RNA, 19 nt, Salmonella typhimurium LT2
gacacagguaagccuggca

SEQ ID NO: 3792105 - RNA, 15 nt, Salmonella typhimurium LT2
gacacaguauucacc

SEQ ID NO: 3792106 - RNA, 17 nt, Salmonella typhimurium LT2
gacacauaaccugaaua

SEQ ID NO: 3792107 - RNA, 14 nt, Salmonella typhimurium LT2
gacacaucaccucc

SEQ ID NO: 3792108 - RNA, 14 nt, Salmonella typhimurium LT2
gacacaucaucgcu

SEQ ID NO: 3792109 - RNA, 16 nt, Salmonella typhimurium LT2
gacacaucaucgcugg

SEQ ID NO: 3792110 - RNA, 21 nt, Salmonella typhimurium LT2
gacacauugaugcuggggauu

SEQ ID NO: 3792111 - RNA, 13 nt, Salmonella typhimurium LT2
gacaccacgcagg

SEQ ID NO: 3792112 - RNA, 19 nt, Salmonella typhimurium LT2
gacaccagcgauaaacgcc

SEQ ID NO: 3792113 - RNA, 22 nt, Salmonella typhimurium LT2
gacaccagcgauaaacgccagc

SEQ ID NO: 3792114 - RNA, 15 nt, Salmonella typhimurium LT2
gacaccgcaaaccgu

SEQ ID NO: 3792115 - RNA, 15 nt, Salmonella typhimurium LT2
gacacgcugcauaua

SEQ ID NO: 3792116 - RNA, 20 nt, Salmonella typhimurium LT2
gacacggaacaacgcaacac

SEQ ID NO: 3792117 - RNA, 15 nt, Salmonella typhimurium LT2
gacacguuaauuauu

SEQ ID NO: 3792118 - RNA, 13 nt, Salmonella typhimurium LT2
gacacuauuuuuc

SEQ ID NO: 3792119 - RNA, 15 nt, Salmonella typhimurium LT2
gacacuauuuuucag

SEQ ID NO: 3792120 - RNA, 11 nt, Salmonella typhimurium LT2
gacacucaucc

SEQ ID NO: 3792121 - RNA, 23 nt, Salmonella typhimurium LT2
gacacuugcgcaucgcaucaggg

SEQ ID NO: 3792122 - RNA, 14 nt, Salmonella typhimurium LT2
gacacuuuauucuc

SEQ ID NO: 3792123 - RNA, 20 nt, Salmonella typhimurium LT2
gacacuuuccgacguuuuuc

SEQ ID NO: 3792124 - RNA, 14 nt, Salmonella typhimurium LT2
gacagaaaaaauag

SEQ ID NO: 3792125 - RNA, 23 nt, Salmonella typhimurium LT2
gacagaacguucaaaacgacugg

SEQ ID NO: 3792126 - RNA, 14 nt, Salmonella typhimurium LT2
gacagaacugauuu

SEQ ID NO: 3792127 - RNA, 18 nt, Salmonella typhimurium LT2
gacagaacugauuuccgg

SEQ ID NO: 3792128 - RNA, 17 nt, Salmonella typhimurium LT2
gacagaauaaugcccac

SEQ ID NO: 3792129 - RNA, 16 nt, Salmonella typhimurium LT2
gacagaauaugcauau

SEQ ID NO: 3792130 - RNA, 14 nt, Salmonella typhimurium LT2
gacagaccacagau

SEQ ID NO: 3792131 - RNA, 14 nt, Salmonella typhimurium LT2
gacagacgcaucuu

SEQ ID NO: 3792132 - RNA, 19 nt, Salmonella typhimurium LT2
gacagacuucauuuuccac

SEQ ID NO: 3792133 - RNA, 19 nt, Salmonella typhimurium LT2
gacagagcucgucaaaaau

SEQ ID NO: 3792134 - RNA, 12 nt, Salmonella typhimurium LT2
gacagaguccac

SEQ ID NO: 3792135 - RNA, 16 nt, Salmonella typhimurium LT2
gacagauaacaccagc

SEQ ID NO: 3792136 - RNA, 17 nt, Salmonella typhimurium LT2
gacagauaacaccagcg

SEQ ID NO: 3792137 - RNA, 18 nt, Salmonella typhimurium LT2
gacagcaaguugcgccac

SEQ ID NO: 3792138 - RNA, 22 nt, Salmonella typhimurium LT2
gacagcaaguugcgccacugcc

SEQ ID NO: 3792139 - RNA, 17 nt, Salmonella typhimurium LT2
gacagcaauaucagcca

SEQ ID NO: 3792140 - RNA, 12 nt, Salmonella typhimurium LT2
gacagcaaugag

SEQ ID NO: 3792141 - RNA, 19 nt, Salmonella typhimurium LT2
gacagcaggaacggcagga

SEQ ID NO: 3792142 - RNA, 15 nt, Salmonella typhimurium LT2
gacagcccgccagca

SEQ ID NO: 3792143 - RNA, 16 nt, Salmonella typhimurium LT2
gacagcccgccagcau

SEQ ID NO: 3792144 - RNA, 23 nt, Salmonella typhimurium LT2
gacagccgcuaucacagcggcau

SEQ ID NO: 3792145 - RNA, 23 nt, Salmonella typhimurium LT2
gacagcgaacaguguaaacgcca

SEQ ID NO: 3792146 - RNA, 23 nt, Salmonella typhimurium LT2
gacagcgccaucagcaucaucac

SEQ ID NO: 3792147 - RNA, 12 nt, Salmonella typhimurium LT2
gacagcgcgccc

SEQ ID NO: 3792148 - RNA, 18 nt, Salmonella typhimurium LT2
gacagcgcgcccagcagg

SEQ ID NO: 3792149 - RNA, 19 nt, Salmonella typhimurium LT2
gacagcgcgcccagcaggg

SEQ ID NO: 3792150 - RNA, 21 nt, Salmonella typhimurium LT2
gacagcggcgcagacacugcc

SEQ ID NO: 3792151 - RNA, 16 nt, Salmonella typhimurium LT2
gacagcguaaugcgcc

SEQ ID NO: 3792152 - RNA, 17 nt, Salmonella typhimurium LT2
gacagcguaaugcgcca

SEQ ID NO: 3792153 - RNA, 21 nt, Salmonella typhimurium LT2
gacagcguaguuuauucuucu

SEQ ID NO: 3792154 - RNA, 19 nt, Salmonella typhimurium LT2
gacagcuuauacugauauc

SEQ ID NO: 3792155 - RNA, 20 nt, Salmonella typhimurium LT2
gacagcuuauacugauaucu

SEQ ID NO: 3792156 - RNA, 20 nt, Salmonella typhimurium LT2
gacaggagcgccguggaaaa

SEQ ID NO: 3792157 - RNA, 14 nt, Salmonella typhimurium LT2
gacaggaguauagc

SEQ ID NO: 3792158 - RNA, 17 nt, Salmonella typhimurium LT2
gacaggcacaacaauau

SEQ ID NO: 3792159 - RNA, 20 nt, Salmonella typhimurium LT2
gacagggcgugaaccagcau

SEQ ID NO: 3792160 - RNA, 22 nt, Salmonella typhimurium LT2
gacagggcgugaaccagcaucc

SEQ ID NO: 3792161 - RNA, 20 nt, Salmonella typhimurium LT2
gacaggguuugccagcacca

SEQ ID NO: 3792162 - RNA, 21 nt, Salmonella typhimurium LT2
gacagguacgcggagagauga

SEQ ID NO: 3792163 - RNA, 22 nt, Salmonella typhimurium LT2
gacagguacgcggagagaugaa

SEQ ID NO: 3792164 - RNA, 16 nt, Salmonella typhimurium LT2
gacaguaccagcagaa

SEQ ID NO: 3792165 - RNA, 18 nt, Salmonella typhimurium LT2
gacaguacgaucaugaau

SEQ ID NO: 3792166 - RNA, 13 nt, Salmonella typhimurium LT2
gacagugcgccau

SEQ ID NO: 3792167 - RNA, 20 nt, Salmonella typhimurium LT2
gaccgucgcgcccuccucca

SEQ ID NO: 3792168 - RNA, 23 nt, Salmonella typhimurium LT2
gaccgucguuucguguuguccgg

SEQ ID NO: 3792169 - RNA, 18 nt, Salmonella typhimurium LT2
gaccgugagaaucgauca

SEQ ID NO: 3792170 - RNA, 21 nt, Salmonella typhimurium LT2
gaccgugccggauggcggagu

SEQ ID NO: 3792171 - RNA, 15 nt, Salmonella typhimurium LT2
gaccguuucaaagaa

SEQ ID NO: 3792172 - RNA, 15 nt, Salmonella typhimurium LT2
gaccuaauaaccagc

SEQ ID NO: 3792173 - RNA, 12 nt, Salmonella typhimurium LT2
gaccuacaaauu

SEQ ID NO: 3792174 - RNA, 14 nt, Salmonella typhimurium LT2
gaccuacaggccga

SEQ ID NO: 3792175 - RNA, 12 nt, Salmonella typhimurium LT2
gaccucaaaaua

SEQ ID NO: 3792176 - RNA, 22 nt, Salmonella typhimurium LT2
gaccugaauauucggcuccaga

SEQ ID NO: 3792177 - RNA, 23 nt, Salmonella typhimurium LT2
gaccugcaguucguacuccugca

SEQ ID NO: 3792178 - RNA, 22 nt, Salmonella typhimurium LT2
gaccugcauuucccauccgccg

SEQ ID NO: 3792179 - RNA, 21 nt, Salmonella typhimurium LT2
gaccugccgcgccugauucau

SEQ ID NO: 3792180 - RNA, 17 nt, Salmonella typhimurium LT2
gaccugccggauggcgg

SEQ ID NO: 3792181 - RNA, 18 nt, Salmonella typhimurium LT2
gaccuggugcucaaucag

SEQ ID NO: 3792182 - RNA, 16 nt, Salmonella typhimurium LT2
gaccuguuccaugacg

SEQ ID NO: 3792183 - RNA, 17 nt, Salmonella typhimurium LT2
gaccuguuccaugacgu

SEQ ID NO: 3792184 - RNA, 17 nt, Salmonella typhimurium LT2
gaccuuaucucgcugac

SEQ ID NO: 3792185 - RNA, 15 nt, Salmonella typhimurium LT2
gaccuuuuucaucac

SEQ ID NO: 3792186 - RNA, 19 nt, Salmonella typhimurium LT2
gacgaacgcuaugcgccag

SEQ ID NO: 3792187 - RNA, 17 nt, Salmonella typhimurium LT2
gacgaauaauccuuccu

SEQ ID NO: 3792188 - RNA, 17 nt, Salmonella typhimurium LT2
gacgacaucuuuuccug

SEQ ID NO: 3792189 - RNA, 20 nt, Salmonella typhimurium LT2
gacgaccagggaacucacgc

SEQ ID NO: 3792190 - RNA, 23 nt, Salmonella typhimurium LT2
gacgaccguaauagcaauacuuu

SEQ ID NO: 3792191 - RNA, 16 nt, Salmonella typhimurium LT2
gacgacggcaggggcg

SEQ ID NO: 3792192 - RNA, 21 nt, Salmonella typhimurium LT2
gacgacguucgauacuauaac

SEQ ID NO: 3792193 - RNA, 23 nt, Salmonella typhimurium LT2
gacgacguucgauacuauaacgc

SEQ ID NO: 3792194 - RNA, 14 nt, Salmonella typhimurium LT2
gacgagcgaaaaac

SEQ ID NO: 3792195 - RNA, 16 nt, Salmonella typhimurium LT2
gacgagcgaaaaacug

SEQ ID NO: 3792196 - RNA, 15 nt, Salmonella typhimurium LT2
gacgagcgacgaggc

SEQ ID NO: 3792197 - RNA, 19 nt, Salmonella typhimurium LT2
gacgagcggugcaaaaaua

SEQ ID NO: 3792198 - RNA, 22 nt, Salmonella typhimurium LT2
gacgauaaccggacgauuuaag

SEQ ID NO: 3792199 - RNA, 15 nt, Salmonella typhimurium LT2
gacgauaaggcugca

SEQ ID NO: 3792200 - RNA, 17 nt, Salmonella typhimurium LT2
gacgauacgucauauca

SEQ ID NO: 3792201 - RNA, 17 nt, Salmonella typhimurium LT2
gacgauagccaugcccg

SEQ ID NO: 3792202 - RNA, 16 nt, Salmonella typhimurium LT2
gacgauagucagcgca

SEQ ID NO: 3792203 - RNA, 19 nt, Salmonella typhimurium LT2
gacgauauucaagcuguug

SEQ ID NO: 3792204 - RNA, 15 nt, Salmonella typhimurium LT2
gacgaucagcgcauu

SEQ ID NO: 3792205 - RNA, 18 nt, Salmonella typhimurium LT2
gacgaugaugagauacgu

SEQ ID NO: 3792206 - RNA, 20 nt, Salmonella typhimurium LT2
gacgauggaaagaacacagg

SEQ ID NO: 3792207 - RNA, 16 nt, Salmonella typhimurium LT2
gacgcaacucacgcca

SEQ ID NO: 3792208 - RNA, 13 nt, Salmonella typhimurium LT2
gacgcaagcaucg

SEQ ID NO: 3792209 - RNA, 23 nt, Salmonella typhimurium LT2
gacgcagacgauaccagggcgau

SEQ ID NO: 3792210 - RNA, 23 nt, Salmonella typhimurium LT2
gacgcagacgucaacaccuccag

SEQ ID NO: 3792211 - RNA, 18 nt, Salmonella typhimurium LT2
gacgcagcagcuccccgc

SEQ ID NO: 3792212 - RNA, 20 nt, Salmonella typhimurium LT2
gacgcaggcgcaaaaaauau

SEQ ID NO: 3792213 - RNA, 17 nt, Salmonella typhimurium LT2
gacgcaucuuuuucccg

SEQ ID NO: 3792214 - RNA, 16 nt, Salmonella typhimurium LT2
gacgcauuuggguuca

SEQ ID NO: 3792215 - RNA, 15 nt, Salmonella typhimurium LT2
gacgccaaccgccau

SEQ ID NO: 3792216 - RNA, 12 nt, Salmonella typhimurium LT2
gacgccaauucc

SEQ ID NO: 3792217 - RNA, 20 nt, Salmonella typhimurium LT2
gacgccagauaaucacgcca

SEQ ID NO: 3792218 - RNA, 16 nt, Salmonella typhimurium LT2
gacgccagccagccgu

SEQ ID NO: 3792219 - RNA, 12 nt, Salmonella typhimurium LT2
gacgccaggcag

SEQ ID NO: 3792220 - RNA, 15 nt, Salmonella typhimurium LT2
gacgccaugggguga

SEQ ID NO: 3792221 - RNA, 14 nt, Salmonella typhimurium LT2
gacgcccaaccagu

SEQ ID NO: 3792222 - RNA, 17 nt, Salmonella typhimurium LT2
gacgccgacauaagcug

SEQ ID NO: 3792223 - RNA, 18 nt, Salmonella typhimurium LT2
gacgccgaccccggcggg

SEQ ID NO: 3792224 - RNA, 13 nt, Salmonella typhimurium LT2
gacgccgccaucc

SEQ ID NO: 3792225 - RNA, 15 nt, Salmonella typhimurium LT2
gacgccggucaugcc

SEQ ID NO: 3792226 - RNA, 17 nt, Salmonella typhimurium LT2
gacgccguccaggcucg

SEQ ID NO: 3792227 - RNA, 23 nt, Salmonella typhimurium LT2
gacgccgucugguacggccacca

SEQ ID NO: 3792228 - RNA, 20 nt, Salmonella typhimurium LT2
gacgccucguuugcugagca

SEQ ID NO: 3792229 - RNA, 16 nt, Salmonella typhimurium LT2
gacgccuuagccugaa

SEQ ID NO: 3792230 - RNA, 18 nt, Salmonella typhimurium LT2
gacgccuuagccugaauu

SEQ ID NO: 3792231 - RNA, 14 nt, Salmonella typhimurium LT2
gacgcgaagcggcg

SEQ ID NO: 3792232 - RNA, 21 nt, Salmonella typhimurium LT2
gacgcgacuuuuuucacccag

SEQ ID NO: 3792233 - RNA, 17 nt, Salmonella typhimurium LT2
gacgcgcacccggcuac

SEQ ID NO: 3792234 - RNA, 13 nt, Salmonella typhimurium LT2
gacgcgcagcacc

SEQ ID NO: 3792235 - RNA, 13 nt, Salmonella typhimurium LT2
gacgcgcaggccg

SEQ ID NO: 3792236 - RNA, 20 nt, Salmonella typhimurium LT2
gacgcgccacuuccagcgcg

SEQ ID NO: 3792237 - RNA, 13 nt, Salmonella typhimurium LT2
gacgcgccagcgg

SEQ ID NO: 3792238 - RNA, 16 nt, Salmonella typhimurium LT2
gacgcgcucggcagca

SEQ ID NO: 3792239 - RNA, 22 nt, Salmonella typhimurium LT2
gacgcggaacuggugaaacagg

SEQ ID NO: 3792240 - RNA, 14 nt, Salmonella typhimurium LT2
gacgcggcuccggc

SEQ ID NO: 3792241 - RNA, 21 nt, Salmonella typhimurium LT2
gacgcguagcgucuuauccgg

SEQ ID NO: 3792242 - RNA, 13 nt, Salmonella typhimurium LT2
gacgcguggugaa

SEQ ID NO: 3792243 - RNA, 21 nt, Salmonella typhimurium LT2
gacgcuacgcgucgccauccg

SEQ ID NO: 3792244 - RNA, 18 nt, Salmonella typhimurium LT2
gacgcuauaacugaaggg

SEQ ID NO: 3792245 - RNA, 20 nt, Salmonella typhimurium LT2
gacgcucgacguccagcgcg

SEQ ID NO: 3792246 - RNA, 15 nt, Salmonella typhimurium LT2
gacgcucuuccucaa

SEQ ID NO: 3792247 - RNA, 18 nt, Salmonella typhimurium LT2
gacgcucuuuggagauuu

SEQ ID NO: 3792248 - RNA, 15 nt, Salmonella typhimurium LT2
gacgcugagagaacu

SEQ ID NO: 3792249 - RNA, 14 nt, Salmonella typhimurium LT2
gacgcugauagcca

SEQ ID NO: 3792250 - RNA, 14 nt, Salmonella typhimurium LT2
gacgcugaugaaaa

SEQ ID NO: 3792251 - RNA, 12 nt, Salmonella typhimurium LT2
gacgcugccaca

SEQ ID NO: 3792252 - RNA, 18 nt, Salmonella typhimurium LT2
gacgcugcgcuuauccgg

SEQ ID NO: 3792253 - RNA, 16 nt, Salmonella typhimurium LT2
gacgcuggaaccaggu

SEQ ID NO: 3792254 - RNA, 20 nt, Salmonella typhimurium LT2
gacgcuggaaguacgccucg

SEQ ID NO: 3792255 - RNA, 21 nt, Salmonella typhimurium LT2
gacgcuuugcauuaucgaugc

SEQ ID NO: 3792256 - RNA, 21 nt, Salmonella typhimurium LT2
gacgcuuugcuguacauaucc

SEQ ID NO: 3792257 - RNA, 15 nt, Salmonella typhimurium LT2
gacgcuuuuauccgg

SEQ ID NO: 3792258 - RNA, 13 nt, Salmonella typhimurium LT2
gacggaaaccagc

SEQ ID NO: 3792259 - RNA, 14 nt, Salmonella typhimurium LT2
gacggaaaccagca

SEQ ID NO: 3792260 - RNA, 17 nt, Salmonella typhimurium LT2
gacggaaaccagcauaa

SEQ ID NO: 3792261 - RNA, 11 nt, Salmonella typhimurium LT2
gacggaagagu

SEQ ID NO: 3792262 - RNA, 15 nt, Salmonella typhimurium LT2
gacggacccugacca

SEQ ID NO: 3792263 - RNA, 20 nt, Salmonella typhimurium LT2
gacggauacgcugcgucagg

SEQ ID NO: 3792264 - RNA, 22 nt, Salmonella typhimurium LT2
gacggauuggcgcucaacagcc

SEQ ID NO: 3792265 - RNA, 24 nt, Salmonella typhimurium LT2
gacggcaacggcgacaagaauaug

SEQ ID NO: 3792266 - RNA, 22 nt, Salmonella typhimurium LT2
gacggcaauagaacgucgcgcg

SEQ ID NO: 3792267 - RNA, 18 nt, Salmonella typhimurium LT2
gacggcagcgccauccgg

SEQ ID NO: 3792268 - RNA, 20 nt, Salmonella typhimurium LT2
gacggcaggcggcaaucagc

SEQ ID NO: 3792269 - RNA, 23 nt, Salmonella typhimurium LT2
gacggcagucgcuacaaccagcg

SEQ ID NO: 3792270 - RNA, 20 nt, Salmonella typhimurium LT2
gacggcaucggcaucuuccu

SEQ ID NO: 3792271 - RNA, 18 nt, Salmonella typhimurium LT2
gacuucaacgcaggcgaa

SEQ ID NO: 3792272 - RNA, 22 nt, Salmonella typhimurium LT2
gacuucacccacugcacgcgau

SEQ ID NO: 3792273 - RNA, 17 nt, Salmonella typhimurium LT2
gacuucacuuucaagcc

SEQ ID NO: 3792274 - RNA, 14 nt, Salmonella typhimurium LT2
gacuucauuuucca

SEQ ID NO: 3792275 - RNA, 23 nt, Salmonella typhimurium LT2
gacuucauuuuccacaauaccgu

SEQ ID NO: 3792276 - RNA, 14 nt, Salmonella typhimurium LT2
gacuucuucuacca

SEQ ID NO: 3792277 - RNA, 18 nt, Salmonella typhimurium LT2
gacuugucggcaaucuca

SEQ ID NO: 3792278 - RNA, 20 nt, Salmonella typhimurium LT2
gacuuuaaacgucaugcugu

SEQ ID NO: 3792279 - RNA, 23 nt, Salmonella typhimurium LT2
gacuuuacaccccacuauucagu

SEQ ID NO: 3792280 - RNA, 21 nt, Salmonella typhimurium LT2
gacuuugcccuuuuugcauuc

SEQ ID NO: 3792281 - RNA, 13 nt, Salmonella typhimurium LT2
gacuuuggauaaa

SEQ ID NO: 3792282 - RNA, 13 nt, Salmonella typhimurium LT2
gacuuuuccuucc

SEQ ID NO: 3792283 - RNA, 20 nt, Salmonella typhimurium LT2
gacuuuuugaaaucacgcca

SEQ ID NO: 3792284 - RNA, 22 nt, Salmonella typhimurium LT2
gacuuuuugaaaucacgccaca

SEQ ID NO: 3792285 - RNA, 20 nt, Salmonella typhimurium LT2
gacuuuuuucaaauccagcu

SEQ ID NO: 3792286 - RNA, 17 nt, Salmonella typhimurium LT2
gagaaaaaaauccagua

SEQ ID NO: 3792287 - RNA, 20 nt, Salmonella typhimurium LT2
gagaaaaagcaauaauccgc

SEQ ID NO: 3792288 - RNA, 16 nt, Salmonella typhimurium LT2
gagaaaaccccguaca

SEQ ID NO: 3792289 - RNA, 22 nt, Salmonella typhimurium LT2
gagaaaaccccguacaggacgg

SEQ ID NO: 3792290 - RNA, 16 nt, Salmonella typhimurium LT2
gagaaaacgcggccug

SEQ ID NO: 3792291 - RNA, 21 nt, Salmonella typhimurium LT2
gagaaaaguuggcauaaugaa

SEQ ID NO: 3792292 - RNA, 12 nt, Salmonella typhimurium LT2
gagaaaauaccg

SEQ ID NO: 3792293 - RNA, 20 nt, Salmonella typhimurium LT2
gagaaaauaccgcacaucac

SEQ ID NO: 3792294 - RNA, 20 nt, Salmonella typhimurium LT2
gagaaaucaacgaaaucaga

SEQ ID NO: 3792295 - RNA, 23 nt, Salmonella typhimurium LT2
gagaaaucaacgaaaucagagac

SEQ ID NO: 3792296 - RNA, 14 nt, Salmonella typhimurium LT2
gagaaccugaacaa

SEQ ID NO: 3792297 - RNA, 20 nt, Salmonella typhimurium LT2
gagaacgccgggccugccag

SEQ ID NO: 3792298 - RNA, 15 nt, Salmonella typhimurium LT2
gagaacuauuugccu

SEQ ID NO: 3792299 - RNA, 21 nt, Salmonella typhimurium LT2
gagaagcccggccacagcgcc

SEQ ID NO: 3792300 - RNA, 22 nt, Salmonella typhimurium LT2
gagaagcccggccacagcgcca

SEQ ID NO: 3792301 - RNA, 23 nt, Salmonella typhimurium LT2
gagaagccuuuuuucaccaguuu

SEQ ID NO: 3792302 - RNA, 14 nt, Salmonella typhimurium LT2
gagaauauuaacgg

SEQ ID NO: 3792303 - RNA, 18 nt, Salmonella typhimurium LT2
gagaaucaccuggcagcc

SEQ ID NO: 3792304 - RNA, 21 nt, Salmonella typhimurium LT2
gagaaucgaucagcuuaaagg

SEQ ID NO: 3792305 - RNA, 17 nt, Salmonella typhimurium LT2
gagaaugcgagcaaaac

SEQ ID NO: 3792306 - RNA, 15 nt, Salmonella typhimurium LT2
gagaauggaugugaa

SEQ ID NO: 3792307 - RNA, 23 nt, Salmonella typhimurium LT2
gagaauguggguauccacgccug

SEQ ID NO: 3792308 - RNA, 19 nt, Salmonella typhimurium LT2
gagaauucugcgcgucggc

SEQ ID NO: 3792309 - RNA, 13 nt, Salmonella typhimurium LT2
gagaauuuuuagc

SEQ ID NO: 3792310 - RNA, 16 nt, Salmonella typhimurium LT2
gagacgccgcccaaug

SEQ ID NO: 3792311 - RNA, 13 nt, Salmonella typhimurium LT2
gagacucaaagaa

SEQ ID NO: 3792312 - RNA, 13 nt, Salmonella typhimurium LT2
gagacugauaaug

SEQ ID NO: 3792313 - RNA, 12 nt, Salmonella typhimurium LT2
gagagaaaaaaa

SEQ ID NO: 3792314 - RNA, 18 nt, Salmonella typhimurium LT2
gagagaaaaaaauccagu

SEQ ID NO: 3792315 - RNA, 15 nt, Salmonella typhimurium LT2
gagagaaaaucacgc

SEQ ID NO: 3792316 - RNA, 22 nt, Salmonella typhimurium LT2
gagagacguucauuucuuccag

SEQ ID NO: 3792317 - RNA, 15 nt, Salmonella typhimurium LT2
gagagauccugagaa

SEQ ID NO: 3792318 - RNA, 15 nt, Salmonella typhimurium LT2
gagagaugccgccag

SEQ ID NO: 3792319 - RNA, 21 nt, Salmonella typhimurium LT2
gagagaugccgccaguugggc

SEQ ID NO: 3792320 - RNA, 15 nt, Salmonella typhimurium LT2
gagagcagcgccagc

SEQ ID NO: 3792321 - RNA, 18 nt, Salmonella typhimurium LT2
gagagcaucaucugccau

SEQ ID NO: 3792322 - RNA, 23 nt, Salmonella typhimurium LT2
gagagcgauaaacucagcgccag

SEQ ID NO: 3792323 - RNA, 16 nt, Salmonella typhimurium LT2
gagagcguauccagca

SEQ ID NO: 3792324 - RNA, 13 nt, Salmonella typhimurium LT2
gagaggaggagau

SEQ ID NO: 3792325 - RNA, 22 nt, Salmonella typhimurium LT2
gagaggcugaaggcgcuccccu

SEQ ID NO: 3792326 - RNA, 16 nt, Salmonella typhimurium LT2
gagaguaugcccgcga

SEQ ID NO: 3792327 - RNA, 19 nt, Salmonella typhimurium LT2
gagauaauagcugaacaua

SEQ ID NO: 3792328 - RNA, 16 nt, Salmonella typhimurium LT2
gagauaauccagccac

SEQ ID NO: 3792329 - RNA, 20 nt, Salmonella typhimurium LT2
gagauaaugcuuucgccagc

SEQ ID NO: 3792330 - RNA, 15 nt, Salmonella typhimurium LT2
gagauaauuuaugau

SEQ ID NO: 3792331 - RNA, 18 nt, Salmonella typhimurium LT2
gagauauagaccagcgcc

SEQ ID NO: 3792332 - RNA, 18 nt, Salmonella typhimurium LT2
gagauauuuugucaggcc

SEQ ID NO: 3792333 - RNA, 20 nt, Salmonella typhimurium LT2
gagaucgaacugacccgcca

SEQ ID NO: 3792334 - RNA, 21 nt, Salmonella typhimurium LT2
gagaucgacaaaccacugcug

SEQ ID NO: 3792335 - RNA, 22 nt, Salmonella typhimurium LT2
gagaucgacaacaacaucugug

SEQ ID NO: 3792336 - RNA, 16 nt, Salmonella typhimurium LT2
gagaucgcuuuccagc

SEQ ID NO: 3792337 - RNA, 16 nt, Salmonella typhimurium LT2
gagaucgguaauuucc

SEQ ID NO: 3792338 - RNA, 17 nt, Salmonella typhimurium LT2
gagaucgguaauuucca

SEQ ID NO: 3792339 - RNA, 18 nt, Salmonella typhimurium LT2
gagaucgguaauuuccac

SEQ ID NO: 3792340 - RNA, 21 nt, Salmonella typhimurium LT2
gagaucguuauuaaacagaca

SEQ ID NO: 3792341 - RNA, 17 nt, Salmonella typhimurium LT2
gagaucuuccgccacca

SEQ ID NO: 3792342 - RNA, 19 nt, Salmonella typhimurium LT2
gagaucuuuccauuucagc

SEQ ID NO: 3792343 - RNA, 21 nt, Salmonella typhimurium LT2
gagaucuuuccauuucagccc

SEQ ID NO: 3792344 - RNA, 18 nt, Salmonella typhimurium LT2
gagaugaucguuuccagc

SEQ ID NO: 3792345 - RNA, 13 nt, Salmonella typhimurium LT2
gagaugcaggcca

SEQ ID NO: 3792346 - RNA, 14 nt, Salmonella typhimurium LT2
gagaugcaggccaa

SEQ ID NO: 3792347 - RNA, 17 nt, Salmonella typhimurium LT2
gagaugcaggccaagca

SEQ ID NO: 3792348 - RNA, 22 nt, Salmonella typhimurium LT2
gagaugcaggccaagcagcgcc

SEQ ID NO: 3792349 - RNA, 17 nt, Salmonella typhimurium LT2
gagaugcauaaaaaaac

SEQ ID NO: 3792350 - RNA, 19 nt, Salmonella typhimurium LT2
gagauguuuuaccaguaca

SEQ ID NO: 3792351 - RNA, 23 nt, Salmonella typhimurium LT2
gagauuacugcgugcuggcggcc

SEQ ID NO: 3792352 - RNA, 15 nt, Salmonella typhimurium LT2
gagauucaauaacgu

SEQ ID NO: 3792353 - RNA, 14 nt, Salmonella typhimurium LT2
gagauuggcucuuu

SEQ ID NO: 3792354 - RNA, 15 nt, Salmonella typhimurium LT2
gagcaaaacacagcu

SEQ ID NO: 3792355 - RNA, 17 nt, Salmonella typhimurium LT2
gagcaaaaccagacgcc

SEQ ID NO: 3792356 - RNA, 15 nt, Salmonella typhimurium LT2
gagcaaacucaauga

SEQ ID NO: 3792357 - RNA, 22 nt, Salmonella typhimurium LT2
gagcaaacucaaugacuuuaau

SEQ ID NO: 3792358 - RNA, 17 nt, Salmonella typhimurium LT2
gagcaaggccaaauagg

SEQ ID NO: 3792359 - RNA, 14 nt, Salmonella typhimurium LT2
gagcaaucaguuca

SEQ ID NO: 3792360 - RNA, 13 nt, Salmonella typhimurium LT2
gagcaaugggaag

SEQ ID NO: 3792361 - RNA, 15 nt, Salmonella typhimurium LT2
gagcaaugggaagga

SEQ ID NO: 3792362 - RNA, 12 nt, Salmonella typhimurium LT2
gagcaauuuccu

SEQ ID NO: 3792363 - RNA, 23 nt, Salmonella typhimurium LT2
gagcagaaaaagucauuuucaug

SEQ ID NO: 3792364 - RNA, 18 nt, Salmonella typhimurium LT2
gagcagaucgcggcaaug

SEQ ID NO: 3792365 - RNA, 11 nt, Salmonella typhimurium LT2
gagcagcagga

SEQ ID NO: 3792366 - RNA, 12 nt, Salmonella typhimurium LT2
gagcagcaggac

SEQ ID NO: 3792367 - RNA, 11 nt, Salmonella typhimurium LT2
gagcagccugg

SEQ ID NO: 3792368 - RNA, 19 nt, Salmonella typhimurium LT2
gagcagcgccagcgacaga

SEQ ID NO: 3792369 - RNA, 16 nt, Salmonella typhimurium LT2
gagcagcgccaucugc

SEQ ID NO: 3792370 - RNA, 17 nt, Salmonella typhimurium LT2
gagcaggacgcgcgcga

SEQ ID NO: 3792371 - RNA, 20 nt, Salmonella typhimurium LT2
gagcaggcccccuucaucgu

SEQ ID NO: 3792372 - RNA, 22 nt, Salmonella typhimurium LT2
gagcaggcuuacgauauuuuuc

SEQ ID NO: 3792373 - RNA, 18 nt, Salmonella typhimurium LT2
gagcagguuacucuucca

SEQ ID NO: 3792374 - RNA, 19 nt, Salmonella typhimurium LT2
gagcagguuacucuuccac

SEQ ID NO: 3792375 - RNA, 18 nt, Salmonella typhimurium LT2
gagguaaauuagcgcgaa

SEQ ID NO: 3792376 - RNA, 16 nt, Salmonella typhimurium LT2
gagguaaucagaucgg

SEQ ID NO: 3792377 - RNA, 16 nt, Salmonella typhimurium LT2
gaggucauuauucagg

SEQ ID NO: 3792378 - RNA, 19 nt, Salmonella typhimurium LT2
gaggucguuucccccgcga

SEQ ID NO: 3792379 - RNA, 15 nt, Salmonella typhimurium LT2
gaggugcucucccag

SEQ ID NO: 3792380 - RNA, 13 nt, Salmonella typhimurium LT2
gagguggaauaca

SEQ ID NO: 3792381 - RNA, 14 nt, Salmonella typhimurium LT2
gagguggugccugu

SEQ ID NO: 3792382 - RNA, 13 nt, Salmonella typhimurium LT2
gagguguuuccag

SEQ ID NO: 3792383 - RNA, 19 nt, Salmonella typhimurium LT2
gagguuaaucuucagggcg

SEQ ID NO: 3792384 - RNA, 21 nt, Salmonella typhimurium LT2
gagguuccaggcacucaaccu

SEQ ID NO: 3792385 - RNA, 18 nt, Salmonella typhimurium LT2
gagguucccgccgccauc

SEQ ID NO: 3792386 - RNA, 22 nt, Salmonella typhimurium LT2
gagguucccgccgccaucgcca

SEQ ID NO: 3792387 - RNA, 19 nt, Salmonella typhimurium LT2
gagguucgccucccucacc

SEQ ID NO: 3792388 - RNA, 23 nt, Salmonella typhimurium LT2
gagguugagauccugauccugca

SEQ ID NO: 3792389 - RNA, 15 nt, Salmonella typhimurium LT2
gaguaaagccugccc

SEQ ID NO: 3792390 - RNA, 19 nt, Salmonella typhimurium LT2
gaguaaauaaaaaccauuu

SEQ ID NO: 3792391 - RNA, 14 nt, Salmonella typhimurium LT2
gaguaaauaaauca

SEQ ID NO: 3792392 - RNA, 14 nt, Salmonella typhimurium LT2
gaguaacaccgcgg

SEQ ID NO: 3792393 - RNA, 16 nt, Salmonella typhimurium LT2
gaguaaugaaaccgaa

SEQ ID NO: 3792394 - RNA, 23 nt, Salmonella typhimurium LT2
gaguaaugaaaccgaauccuuug

SEQ ID NO: 3792395 - RNA, 23 nt, Salmonella typhimurium LT2
gaguacgccgauagcggcggcgc

SEQ ID NO: 3792396 - RNA, 22 nt, Salmonella typhimurium LT2
gaguaguguaauaccacugccc

SEQ ID NO: 3792397 - RNA, 20 nt, Salmonella typhimurium LT2
gaguauagcggcguuuauau

SEQ ID NO: 3792398 - RNA, 18 nt, Salmonella typhimurium LT2
gaguaucggcgauuaagu

SEQ ID NO: 3792399 - RNA, 23 nt, Salmonella typhimurium LT2
gagucacagaauacccuccgcca

SEQ ID NO: 3792400 - RNA, 13 nt, Salmonella typhimurium LT2
gagucaccagcac

SEQ ID NO: 3792401 - RNA, 17 nt, Salmonella typhimurium LT2
gagucagaaacggccag

SEQ ID NO: 3792402 - RNA, 17 nt, Salmonella typhimurium LT2
gagucagacaccagccc

SEQ ID NO: 3792403 - RNA, 16 nt, Salmonella typhimurium LT2
gagucaggcggucaga

SEQ ID NO: 3792404 - RNA, 12 nt, Salmonella typhimurium LT2
gaguccagccau

SEQ ID NO: 3792405 - RNA, 13 nt, Salmonella typhimurium LT2
gaguccagcggca

SEQ ID NO: 3792406 - RNA, 16 nt, Salmonella typhimurium LT2
gaguccugccggacug

SEQ ID NO: 3792407 - RNA, 21 nt, Salmonella typhimurium LT2
gagucgacugguaggccugau

SEQ ID NO: 3792408 - RNA, 17 nt, Salmonella typhimurium LT2
gagucgguacuccccuu

SEQ ID NO: 3792409 - RNA, 13 nt, Salmonella typhimurium LT2
gagucgucaaauu

SEQ ID NO: 3792410 - RNA, 12 nt, Salmonella typhimurium LT2
gagucguuaucc

SEQ ID NO: 3792411 - RNA, 23 nt, Salmonella typhimurium LT2
gagucguuauccagaucuucaga

SEQ ID NO: 3792412 - RNA, 19 nt, Salmonella typhimurium LT2
gagucugaaaacucacgcc

SEQ ID NO: 3792413 - RNA, 20 nt, Salmonella typhimurium LT2
gagucuuauccgacugacca

SEQ ID NO: 3792414 - RNA, 11 nt, Salmonella typhimurium LT2
gagugaacacg

SEQ ID NO: 3792415 - RNA, 20 nt, Salmonella typhimurium LT2
gagugaccucaugggcccgc

SEQ ID NO: 3792416 - RNA, 21 nt, Salmonella typhimurium LT2
gagugauccaccaccagcauc

SEQ ID NO: 3792417 - RNA, 19 nt, Salmonella typhimurium LT2
gagugcguucuuccacuuc

SEQ ID NO: 3792418 - RNA, 15 nt, Salmonella typhimurium LT2
gagugcucaauaagc

SEQ ID NO: 3792419 - RNA, 17 nt, Salmonella typhimurium LT2
gaguggcgaaauuggua

SEQ ID NO: 3792420 - RNA, 18 nt, Salmonella typhimurium LT2
gagugguagaaacuggca

SEQ ID NO: 3792421 - RNA, 22 nt, Salmonella typhimurium LT2
gagugugucuuuuacgccagga

SEQ ID NO: 3792422 - RNA, 22 nt, Salmonella typhimurium LT2
gaguucaacgccgaacaggcca

SEQ ID NO: 3792423 - RNA, 16 nt, Salmonella typhimurium LT2
gaguucauagcgcaca

SEQ ID NO: 3792424 - RNA, 13 nt, Salmonella typhimurium LT2
gaguuccggauac

SEQ ID NO: 3792425 - RNA, 12 nt, Salmonella typhimurium LT2
gaguuccuccug

SEQ ID NO: 3792426 - RNA, 17 nt, Salmonella typhimurium LT2
gaguugaaaccgcgcuc

SEQ ID NO: 3792427 - RNA, 23 nt, Salmonella typhimurium LT2
gaguugcuuaaaggcggcaaggg

SEQ ID NO: 3792428 - RNA, 14 nt, Salmonella typhimurium LT2
gaguuucaccgcca

SEQ ID NO: 3792429 - RNA, 10 nt, Salmonella typhimurium LT2
gaguuuuaac

SEQ ID NO: 3792430 - RNA, 17 nt, Salmonella typhimurium LT2
gaguuuuuuauggcaga

SEQ ID NO: 3792431 - RNA, 20 nt, Salmonella typhimurium LT2
gauaaaaacgcgucagcguu

SEQ ID NO: 3792432 - RNA, 19 nt, Salmonella typhimurium LT2
gauaaaauccgaaaugacc

SEQ ID NO: 3792433 - RNA, 13 nt, Salmonella typhimurium LT2
gauaaaauuguua

SEQ ID NO: 3792434 - RNA, 12 nt, Salmonella typhimurium LT2
gauaaacaccuu

SEQ ID NO: 3792435 - RNA, 14 nt, Salmonella typhimurium LT2
gauaaacagcagcg

SEQ ID NO: 3792436 - RNA, 15 nt, Salmonella typhimurium LT2
gauaaacagcagcgc

SEQ ID NO: 3792437 - RNA, 18 nt, Salmonella typhimurium LT2
gauaaacagguaaaacaa

SEQ ID NO: 3792438 - RNA, 15 nt, Salmonella typhimurium LT2
gauaaaccaggcagc

SEQ ID NO: 3792439 - RNA, 17 nt, Salmonella typhimurium LT2
gauaaacgacagcgcca

SEQ ID NO: 3792440 - RNA, 20 nt, Salmonella typhimurium LT2
gauaaacgccagcccuucca

SEQ ID NO: 3792441 - RNA, 19 nt, Salmonella typhimurium LT2
gauaaacgcccgcaaaagc

SEQ ID NO: 3792442 - RNA, 15 nt, Salmonella typhimurium LT2
gauaaagaauagccu

SEQ ID NO: 3792443 - RNA, 15 nt, Salmonella typhimurium LT2
gauaaagagcaggcc

SEQ ID NO: 3792444 - RNA, 17 nt, Salmonella typhimurium LT2
gauaaagagcaggccaa

SEQ ID NO: 3792445 - RNA, 15 nt, Salmonella typhimurium LT2
gauaaagcagcgaca

SEQ ID NO: 3792446 - RNA, 17 nt, Salmonella typhimurium LT2
gauaaagcuuucaucuu

SEQ ID NO: 3792447 - RNA, 22 nt, Salmonella typhimurium LT2
gauaaaggauugugguaagcaa

SEQ ID NO: 3792448 - RNA, 22 nt, Salmonella typhimurium LT2
gauaaaguuagcguuauggaag

SEQ ID NO: 3792449 - RNA, 14 nt, Salmonella typhimurium LT2
gauaaauaaaaaau

SEQ ID NO: 3792450 - RNA, 12 nt, Salmonella typhimurium LT2
gauaaaucagcc

SEQ ID NO: 3792451 - RNA, 13 nt, Salmonella typhimurium LT2
gauaaaucaucau

SEQ ID NO: 3792452 - RNA, 15 nt, Salmonella typhimurium LT2
gauaaaucaucaucg

SEQ ID NO: 3792453 - RNA, 17 nt, Salmonella typhimurium LT2
gauaaauugcggcauga

SEQ ID NO: 3792454 - RNA, 20 nt, Salmonella typhimurium LT2
gauaacaccagcgauccaga

SEQ ID NO: 3792455 - RNA, 19 nt, Salmonella typhimurium LT2
gauaacaguauuuguucag

SEQ ID NO: 3792456 - RNA, 11 nt, Salmonella typhimurium LT2
gauaaccagaa

SEQ ID NO: 3792457 - RNA, 12 nt, Salmonella typhimurium LT2
gauaaccagguc

SEQ ID NO: 3792458 - RNA, 18 nt, Salmonella typhimurium LT2
gauaaccaucgcgcagcc

SEQ ID NO: 3792459 - RNA, 14 nt, Salmonella typhimurium LT2
gauaacccggcgca

SEQ ID NO: 3792460 - RNA, 16 nt, Salmonella typhimurium LT2
gauaaccgcccgcggc

SEQ ID NO: 3792461 - RNA, 17 nt, Salmonella typhimurium LT2
gauaaccuauuuugcaa

SEQ ID NO: 3792462 - RNA, 23 nt, Salmonella typhimurium LT2
gauaaccuauuuugcaaaacuga

SEQ ID NO: 3792463 - RNA, 15 nt, Salmonella typhimurium LT2
gauaacgcagcgcgg

SEQ ID NO: 3792464 - RNA, 15 nt, Salmonella typhimurium LT2
gauaacgcaggcgau

SEQ ID NO: 3792465 - RNA, 16 nt, Salmonella typhimurium LT2
gauaacgcucuuaccg

SEQ ID NO: 3792466 - RNA, 20 nt, Salmonella typhimurium LT2
gauaacggucguucccuacc

SEQ ID NO: 3792467 - RNA, 13 nt, Salmonella typhimurium LT2
gauaacguccggc

SEQ ID NO: 3792468 - RNA, 23 nt, Salmonella typhimurium LT2
gauaacuuccuuugccuuucuua

SEQ ID NO: 3792469 - RNA, 19 nt, Salmonella typhimurium LT2
gauaagaaagauaaaauac

SEQ ID NO: 3792470 - RNA, 19 nt, Salmonella typhimurium LT2
gauaagaaguaaacagaau

SEQ ID NO: 3792471 - RNA, 21 nt, Salmonella typhimurium LT2
gauaagacugauauccaucgg

SEQ ID NO: 3792472 - RNA, 15 nt, Salmonella typhimurium LT2
gauaagauaggagac

SEQ ID NO: 3792473 - RNA, 18 nt, Salmonella typhimurium LT2
gauaagcaagcgccaucg

SEQ ID NO: 3792474 - RNA, 20 nt, Salmonella typhimurium LT2
gauaagcaccguaaacggcu

SEQ ID NO: 3792475 - RNA, 17 nt, Salmonella typhimurium LT2
gauaagcaccugcauuu

SEQ ID NO: 3792476 - RNA, 12 nt, Salmonella typhimurium LT2
gauaagcaguga

SEQ ID NO: 3792477 - RNA, 20 nt, Salmonella typhimurium LT2
gauaagcauagcgccaucag

SEQ ID NO: 3792478 - RNA, 21 nt, Salmonella typhimurium LT2
gauaagcauuagcgccauccg

SEQ ID NO: 3792479 - RNA, 23 nt, Salmonella typhimurium LT2
gauagcgccccaaagcgcauccg

SEQ ID NO: 3792480 - RNA, 19 nt, Salmonella typhimurium LT2
gauagcgcuuuccaguccc

SEQ ID NO: 3792481 - RNA, 13 nt, Salmonella typhimurium LT2
gauagcggcggcg

SEQ ID NO: 3792482 - RNA, 19 nt, Salmonella typhimurium LT2
gauagcguagcgccauccg

SEQ ID NO: 3792483 - RNA, 15 nt, Salmonella typhimurium LT2
gauagcgucaacgcu

SEQ ID NO: 3792484 - RNA, 17 nt, Salmonella typhimurium LT2
gauagcguuuuccagcu

SEQ ID NO: 3792485 - RNA, 21 nt, Salmonella typhimurium LT2
gauagcugaagugcggauaga

SEQ ID NO: 3792486 - RNA, 14 nt, Salmonella typhimurium LT2
gauaggccgcuaua

SEQ ID NO: 3792487 - RNA, 22 nt, Salmonella typhimurium LT2
gauaggcgcgucauaaccgcag

SEQ ID NO: 3792488 - RNA, 14 nt, Salmonella typhimurium LT2
gauagggccaggcg

SEQ ID NO: 3792489 - RNA, 16 nt, Salmonella typhimurium LT2
gauaguaucuuauccg

SEQ ID NO: 3792490 - RNA, 17 nt, Salmonella typhimurium LT2
gauagucauugacagca

SEQ ID NO: 3792491 - RNA, 18 nt, Salmonella typhimurium LT2
gauagugauauagcgcca

SEQ ID NO: 3792492 - RNA, 18 nt, Salmonella typhimurium LT2
gauaguguaaacgcgcca

SEQ ID NO: 3792493 - RNA, 20 nt, Salmonella typhimurium LT2
gauagugucgccauaaauca

SEQ ID NO: 3792494 - RNA, 14 nt, Salmonella typhimurium LT2
gauaguuaauaaug

SEQ ID NO: 3792495 - RNA, 15 nt, Salmonella typhimurium LT2
gauaguuaauaaugg

SEQ ID NO: 3792496 - RNA, 17 nt, Salmonella typhimurium LT2
gauaguugagcagcgcg

SEQ ID NO: 3792497 - RNA, 18 nt, Salmonella typhimurium LT2
gauaguuuuaauaucuau

SEQ ID NO: 3792498 - RNA, 11 nt, Salmonella typhimurium LT2
gauauaacgca

SEQ ID NO: 3792499 - RNA, 18 nt, Salmonella typhimurium LT2
gauauaacgugccgacca

SEQ ID NO: 3792500 - RNA, 22 nt, Salmonella typhimurium LT2
gauauaccaugccgccauuuua

SEQ ID NO: 3792501 - RNA, 21 nt, Salmonella typhimurium LT2
gauauagagcccucuauccac

SEQ ID NO: 3792502 - RNA, 21 nt, Salmonella typhimurium LT2
gauauagcaacguccgcagcc

SEQ ID NO: 3792503 - RNA, 16 nt, Salmonella typhimurium LT2
gauauauucagcaaau

SEQ ID NO: 3792504 - RNA, 23 nt, Salmonella typhimurium LT2
gauauccacaauguugauggcgc

SEQ ID NO: 3792505 - RNA, 19 nt, Salmonella typhimurium LT2
gauauccagcaaugcacug

SEQ ID NO: 3792506 - RNA, 22 nt, Salmonella typhimurium LT2
gauauccgcgcucaacacauaa

SEQ ID NO: 3792507 - RNA, 17 nt, Salmonella typhimurium LT2
gauaucgcacuggauca

SEQ ID NO: 3792508 - RNA, 17 nt, Salmonella typhimurium LT2
gauaucgccugguguga

SEQ ID NO: 3792509 - RNA, 16 nt, Salmonella typhimurium LT2
gauaucgcuuacagca

SEQ ID NO: 3792510 - RNA, 22 nt, Salmonella typhimurium LT2
gauaucuuccagcgcguccagc

SEQ ID NO: 3792511 - RNA, 23 nt, Salmonella typhimurium LT2
gauaucuuccagcgcguccagcc

SEQ ID NO: 3792512 - RNA, 14 nt, Salmonella typhimurium LT2
gauaugaauaauuu

SEQ ID NO: 3792513 - RNA, 23 nt, Salmonella typhimurium LT2
gauaugacccgggcgugacaggg

SEQ ID NO: 3792514 - RNA, 20 nt, Salmonella typhimurium LT2
gauaugcaggggcaguaaau

SEQ ID NO: 3792515 - RNA, 15 nt, Salmonella typhimurium LT2
gauauggccgcguuu

SEQ ID NO: 3792516 - RNA, 23 nt, Salmonella typhimurium LT2
gauauggccguuuucaugcacga

SEQ ID NO: 3792517 - RNA, 14 nt, Salmonella typhimurium LT2
gauauggcggcggc

SEQ ID NO: 3792518 - RNA, 24 nt, Salmonella typhimurium LT2
gauaugguuacuggcuaguauauu

SEQ ID NO: 3792519 - RNA, 13 nt, Salmonella typhimurium LT2
gauauuccauacg

SEQ ID NO: 3792520 - RNA, 15 nt, Salmonella typhimurium LT2
gauauuccauacggu

SEQ ID NO: 3792521 - RNA, 23 nt, Salmonella typhimurium LT2
gauauucguccaccuaaagaggg

SEQ ID NO: 3792522 - RNA, 15 nt, Salmonella typhimurium LT2
gauauucugcacgca

SEQ ID NO: 3792523 - RNA, 20 nt, Salmonella typhimurium LT2
gauauucugcacgcacgacg

SEQ ID NO: 3792524 - RNA, 16 nt, Salmonella typhimurium LT2
gauauugccuuauuca

SEQ ID NO: 3792525 - RNA, 19 nt, Salmonella typhimurium LT2
gauauugcguaagcagcug

SEQ ID NO: 3792526 - RNA, 20 nt, Salmonella typhimurium LT2
gauauugugcauacugauuu

SEQ ID NO: 3792527 - RNA, 22 nt, Salmonella typhimurium LT2
gauauuuuagggcguaaauaua

SEQ ID NO: 3792528 - RNA, 18 nt, Salmonella typhimurium LT2
gauauuuucaccuccacg

SEQ ID NO: 3792529 - RNA, 21 nt, Salmonella typhimurium LT2
gauauuuuguuuuaaauucaa

SEQ ID NO: 3792530 - RNA, 18 nt, Salmonella typhimurium LT2
gauauuuuucuugagcug

SEQ ID NO: 3792531 - RNA, 16 nt, Salmonella typhimurium LT2
gaucaaacuccgcgcu

SEQ ID NO: 3792532 - RNA, 22 nt, Salmonella typhimurium LT2
gaucaacuucguucaguuccag

SEQ ID NO: 3792533 - RNA, 21 nt, Salmonella typhimurium LT2
gaucaccagcaccgccagcgc

SEQ ID NO: 3792534 - RNA, 14 nt, Salmonella typhimurium LT2
gaucaccagcccuu

SEQ ID NO: 3792535 - RNA, 13 nt, Salmonella typhimurium LT2
gaucaccagcgca

SEQ ID NO: 3792536 - RNA, 17 nt, Salmonella typhimurium LT2
gaucacccacaccacag

SEQ ID NO: 3792537 - RNA, 16 nt, Salmonella typhimurium LT2
gaucacccacaucagc

SEQ ID NO: 3792538 - RNA, 18 nt, Salmonella typhimurium LT2
gaucacccacaucagcgg

SEQ ID NO: 3792539 - RNA, 19 nt, Salmonella typhimurium LT2
gaucacgccguccagcacc

SEQ ID NO: 3792540 - RNA, 17 nt, Salmonella typhimurium LT2
gaucacggcuucaacuu

SEQ ID NO: 3792541 - RNA, 15 nt, Salmonella typhimurium LT2
gaucagaccaucggc

SEQ ID NO: 3792542 - RNA, 13 nt, Salmonella typhimurium LT2
gaucagcaaaaua

SEQ ID NO: 3792543 - RNA, 21 nt, Salmonella typhimurium LT2
gaucagcaccacgcccggauc

SEQ ID NO: 3792544 - RNA, 15 nt, Salmonella typhimurium LT2
gaucagcagaacaaa

SEQ ID NO: 3792545 - RNA, 13 nt, Salmonella typhimurium LT2
gaucagcagaucc

SEQ ID NO: 3792546 - RNA, 21 nt, Salmonella typhimurium LT2
gaucagcauagcgccuucagg

SEQ ID NO: 3792547 - RNA, 21 nt, Salmonella typhimurium LT2
gaucagccugagcgccagcgu

SEQ ID NO: 3792548 - RNA, 18 nt, Salmonella typhimurium LT2
gaucagcggcgccgcaau

SEQ ID NO: 3792549 - RNA, 16 nt, Salmonella typhimurium LT2
gaucagcggcugcaaa

SEQ ID NO: 3792550 - RNA, 17 nt, Salmonella typhimurium LT2
gaucaggaaaucuucca

SEQ ID NO: 3792551 - RNA, 20 nt, Salmonella typhimurium LT2
gaucaggccgcagacggaga

SEQ ID NO: 3792552 - RNA, 20 nt, Salmonella typhimurium LT2
gaucaggcgcuugcgccgcc

SEQ ID NO: 3792553 - RNA, 16 nt, Salmonella typhimurium LT2
gaucaggcgucagcgg

SEQ ID NO: 3792554 - RNA, 16 nt, Salmonella typhimurium LT2
gaucaggggucagcgu

SEQ ID NO: 3792555 - RNA, 16 nt, Salmonella typhimurium LT2
gaucaguaacaggacg

SEQ ID NO: 3792556 - RNA, 13 nt, Salmonella typhimurium LT2
gaucauacugaac

SEQ ID NO: 3792557 - RNA, 13 nt, Salmonella typhimurium LT2
gaucaucagcacg

SEQ ID NO: 3792558 - RNA, 15 nt, Salmonella typhimurium LT2
gaucaucauggcuga

SEQ ID NO: 3792559 - RNA, 19 nt, Salmonella typhimurium LT2
gaucaucccgagauuguca

SEQ ID NO: 3792560 - RNA, 20 nt, Salmonella typhimurium LT2
gaucaucguaccaauaccca

SEQ ID NO: 3792561 - RNA, 13 nt, Salmonella typhimurium LT2
gaucauuggccag

SEQ ID NO: 3792562 - RNA, 23 nt, Salmonella typhimurium LT2
gauccaacacaucgacaugcaga

SEQ ID NO: 3792563 - RNA, 16 nt, Salmonella typhimurium LT2
gauccaccaccagcau

SEQ ID NO: 3792564 - RNA, 20 nt, Salmonella typhimurium LT2
gauccaccaccagcaucacg

SEQ ID NO: 3792565 - RNA, 23 nt, Salmonella typhimurium LT2
gauccacugagcgcgccaugaga

SEQ ID NO: 3792566 - RNA, 15 nt, Salmonella typhimurium LT2
gauccacugcauccu

SEQ ID NO: 3792567 - RNA, 20 nt, Salmonella typhimurium LT2
gauccagaacugcgaaauca

SEQ ID NO: 3792568 - RNA, 18 nt, Salmonella typhimurium LT2
gauccagcgauugacggu

SEQ ID NO: 3792569 - RNA, 12 nt, Salmonella typhimurium LT2
gauccagcgccg

SEQ ID NO: 3792570 - RNA, 20 nt, Salmonella typhimurium LT2
gauccaucgguucucugcca

SEQ ID NO: 3792571 - RNA, 21 nt, Salmonella typhimurium LT2
gauccaucgguucucugccau

SEQ ID NO: 3792572 - RNA, 13 nt, Salmonella typhimurium LT2
gaucccaggccgg

SEQ ID NO: 3792573 - RNA, 16 nt, Salmonella typhimurium LT2
gaucccaggccggcau

SEQ ID NO: 3792574 - RNA, 20 nt, Salmonella typhimurium LT2
gauccccucuuccaucagcc

SEQ ID NO: 3792575 - RNA, 21 nt, Salmonella typhimurium LT2
gauccccucuuccaucagcca

SEQ ID NO: 3792576 - RNA, 20 nt, Salmonella typhimurium LT2
gaucccggcgccgccgagga

SEQ ID NO: 3792577 - RNA, 20 nt, Salmonella typhimurium LT2
gaucccgggcgauaaaccag

SEQ ID NO: 3792578 - RNA, 14 nt, Salmonella typhimurium LT2
gaucccuaauaaaa

SEQ ID NO: 3792579 - RNA, 19 nt, Salmonella typhimurium LT2
gauccgacaugaugccaaa

SEQ ID NO: 3792580 - RNA, 21 nt, Salmonella typhimurium LT2
gauccgacaugaugccaaaua

SEQ ID NO: 3792581 - RNA, 20 nt, Salmonella typhimurium LT2
gauccgaugcgcuuuacugu

SEQ ID NO: 3792582 - RNA, 16 nt, Salmonella typhimurium LT2
gaugccagaucugcau

SEQ ID NO: 3792583 - RNA, 15 nt, Salmonella typhimurium LT2
gaugcccguaaagcu

SEQ ID NO: 3792584 - RNA, 19 nt, Salmonella typhimurium LT2
gaugccgaccgucggcgca

SEQ ID NO: 3792585 - RNA, 18 nt, Salmonella typhimurium LT2
gaugccgccgacaaccag

SEQ ID NO: 3792586 - RNA, 19 nt, Salmonella typhimurium LT2
gaugccgccgacaaccagc

SEQ ID NO: 3792587 - RNA, 20 nt, Salmonella typhimurium LT2
gaugccguuuuaacgucauc

SEQ ID NO: 3792588 - RNA, 21 nt, Salmonella typhimurium LT2
gaugccguuuuaacgucauca

SEQ ID NO: 3792589 - RNA, 18 nt, Salmonella typhimurium LT2
gaugccugccgggccugc

SEQ ID NO: 3792590 - RNA, 12 nt, Salmonella typhimurium LT2
gaugccuggcag

SEQ ID NO: 3792591 - RNA, 23 nt, Salmonella typhimurium LT2
gaugccugguggcgacgcguggc

SEQ ID NO: 3792592 - RNA, 19 nt, Salmonella typhimurium LT2
gaugcgacgcgcucaccuc

SEQ ID NO: 3792593 - RNA, 18 nt, Salmonella typhimurium LT2
gaugcgcaaucacccacg

SEQ ID NO: 3792594 - RNA, 13 nt, Salmonella typhimurium LT2
gaugcgccaguac

SEQ ID NO: 3792595 - RNA, 18 nt, Salmonella typhimurium LT2
gaugcgccaguucagcgu

SEQ ID NO: 3792596 - RNA, 13 nt, Salmonella typhimurium LT2
gaugcgccauccc

SEQ ID NO: 3792597 - RNA, 14 nt, Salmonella typhimurium LT2
gaugcgccauccca

SEQ ID NO: 3792598 - RNA, 16 nt, Salmonella typhimurium LT2
gaugcgccgugcuugu

SEQ ID NO: 3792599 - RNA, 21 nt, Salmonella typhimurium LT2
gaugcgcguuuagcgccagca

SEQ ID NO: 3792600 - RNA, 19 nt, Salmonella typhimurium LT2
gaugcgcguuuuccaccag

SEQ ID NO: 3792601 - RNA, 16 nt, Salmonella typhimurium LT2
gaugcgcuauaaaaau

SEQ ID NO: 3792602 - RNA, 13 nt, Salmonella typhimurium LT2
gaugcgcucacgc

SEQ ID NO: 3792603 - RNA, 20 nt, Salmonella typhimurium LT2
gaugcgcucauaaccgcgau

SEQ ID NO: 3792604 - RNA, 13 nt, Salmonella typhimurium LT2
gaugcggccaggg

SEQ ID NO: 3792605 - RNA, 22 nt, Salmonella typhimurium LT2
gaugcggcuagcgccuuauccg

SEQ ID NO: 3792606 - RNA, 17 nt, Salmonella typhimurium LT2
gaugcguauccagcgcg

SEQ ID NO: 3792607 - RNA, 22 nt, Salmonella typhimurium LT2
gaugcguucuagcuuaucgcca

SEQ ID NO: 3792608 - RNA, 16 nt, Salmonella typhimurium LT2
gaugcguugagcgugu

SEQ ID NO: 3792609 - RNA, 18 nt, Salmonella typhimurium LT2
gaugcguuggcucgcugc

SEQ ID NO: 3792610 - RNA, 17 nt, Salmonella typhimurium LT2
gaugcucagggcauccg

SEQ ID NO: 3792611 - RNA, 15 nt, Salmonella typhimurium LT2
gaugcucgcucauca

SEQ ID NO: 3792612 - RNA, 18 nt, Salmonella typhimurium LT2
gaugcugaauagccagcc

SEQ ID NO: 3792613 - RNA, 19 nt, Salmonella typhimurium LT2
gaugcugauguccgcagcc

SEQ ID NO: 3792614 - RNA, 21 nt, Salmonella typhimurium LT2
gaugcugcgcaucuggggcgc

SEQ ID NO: 3792615 - RNA, 19 nt, Salmonella typhimurium LT2
gaugcugucuuagugaaau

SEQ ID NO: 3792616 - RNA, 13 nt, Salmonella typhimurium LT2
gaugcuuauuauu

SEQ ID NO: 3792617 - RNA, 22 nt, Salmonella typhimurium LT2
gaugcuugccauauugccgcac

SEQ ID NO: 3792618 - RNA, 19 nt, Salmonella typhimurium LT2
gauggaaagaacacaggca

SEQ ID NO: 3792619 - RNA, 15 nt, Salmonella typhimurium LT2
gauggaacagacgcc

SEQ ID NO: 3792620 - RNA, 17 nt, Salmonella typhimurium LT2
gauggacaauccgcgaa

SEQ ID NO: 3792621 - RNA, 18 nt, Salmonella typhimurium LT2
gauggacaauccgcgaau

SEQ ID NO: 3792622 - RNA, 19 nt, Salmonella typhimurium LT2
gauggacggauuggcgcuc

SEQ ID NO: 3792623 - RNA, 21 nt, Salmonella typhimurium LT2
gauggagcggcgcuuauucgg

SEQ ID NO: 3792624 - RNA, 15 nt, Salmonella typhimurium LT2
gauggauaaccugcc

SEQ ID NO: 3792625 - RNA, 12 nt, Salmonella typhimurium LT2
gauggcaaauaa

SEQ ID NO: 3792626 - RNA, 13 nt, Salmonella typhimurium LT2
gauggcaaauaau

SEQ ID NO: 3792627 - RNA, 15 nt, Salmonella typhimurium LT2
gauggccgacuaaaa

SEQ ID NO: 3792628 - RNA, 17 nt, Salmonella typhimurium LT2
gauggccgaugaugcgc

SEQ ID NO: 3792629 - RNA, 13 nt, Salmonella typhimurium LT2
gauggccucauca

SEQ ID NO: 3792630 - RNA, 20 nt, Salmonella typhimurium LT2
gauggcgaaggaguucgguu

SEQ ID NO: 3792631 - RNA, 21 nt, Salmonella typhimurium LT2
gauggcgacacuugcgcaucg

SEQ ID NO: 3792632 - RNA, 23 nt, Salmonella typhimurium LT2
gauggcgacuaacgucuuauccg

SEQ ID NO: 3792633 - RNA, 21 nt, Salmonella typhimurium LT2
gauggcgauucauaugcgcca

SEQ ID NO: 3792634 - RNA, 19 nt, Salmonella typhimurium LT2
gauggcgcgacgcuuauca

SEQ ID NO: 3792635 - RNA, 20 nt, Salmonella typhimurium LT2
gauggcgcgacgcuuaucag

SEQ ID NO: 3792636 - RNA, 18 nt, Salmonella typhimurium LT2
gauggcgcuaagccagcc

SEQ ID NO: 3792637 - RNA, 19 nt, Salmonella typhimurium LT2
gauggcgcuacgcuuauca

SEQ ID NO: 3792638 - RNA, 20 nt, Salmonella typhimurium LT2
gauggcgcuacgcuuauccg

SEQ ID NO: 3792639 - RNA, 19 nt, Salmonella typhimurium LT2
gauggcgcugcgcgcaucg

SEQ ID NO: 3792640 - RNA, 17 nt, Salmonella typhimurium LT2
gauggcgcugcgcuuau

SEQ ID NO: 3792641 - RNA, 19 nt, Salmonella typhimurium LT2
gauggcgcugcgcuuauca

SEQ ID NO: 3792642 - RNA, 20 nt, Salmonella typhimurium LT2
gauggcgcugcgcuuaucag

SEQ ID NO: 3792643 - RNA, 20 nt, Salmonella typhimurium LT2
gauggcgcugcgcuuauccg

SEQ ID NO: 3792644 - RNA, 15 nt, Salmonella typhimurium LT2
gauggcgcugucgcu

SEQ ID NO: 3792645 - RNA, 19 nt, Salmonella typhimurium LT2
gauggcgcuucgcuuacca

SEQ ID NO: 3792646 - RNA, 19 nt, Salmonella typhimurium LT2
gauggcgcuucgcuuauca

SEQ ID NO: 3792647 - RNA, 20 nt, Salmonella typhimurium LT2
gauggcgcuuugcuuauccg

SEQ ID NO: 3792648 - RNA, 22 nt, Salmonella typhimurium LT2
gauggcggcuaccucuuauccg

SEQ ID NO: 3792649 - RNA, 17 nt, Salmonella typhimurium LT2
gauggcguaagcuuauc

SEQ ID NO: 3792650 - RNA, 18 nt, Salmonella typhimurium LT2
gauggcguaagcuuaucg

SEQ ID NO: 3792651 - RNA, 17 nt, Salmonella typhimurium LT2
gauggcguuuagcuggc

SEQ ID NO: 3792652 - RNA, 15 nt, Salmonella typhimurium LT2
gauggcuuuacccgg

SEQ ID NO: 3792653 - RNA, 16 nt, Salmonella typhimurium LT2
gauggggcaugcuaua

SEQ ID NO: 3792654 - RNA, 16 nt, Salmonella typhimurium LT2
gaugguaauauuaaaa

SEQ ID NO: 3792655 - RNA, 19 nt, Salmonella typhimurium LT2
gaugguauaaaucacgcug

SEQ ID NO: 3792656 - RNA, 19 nt, Salmonella typhimurium LT2
gaugguaugcgaagguggc

SEQ ID NO: 3792657 - RNA, 17 nt, Salmonella typhimurium LT2
gauggucggcgcuggcg

SEQ ID NO: 3792658 - RNA, 15 nt, Salmonella typhimurium LT2
gaugguggcgucggc

SEQ ID NO: 3792659 - RNA, 23 nt, Salmonella typhimurium LT2
gaugguuaaauucauauuuaaau

SEQ ID NO: 3792660 - RNA, 13 nt, Salmonella typhimurium LT2
gauguaaaaaugc

SEQ ID NO: 3792661 - RNA, 14 nt, Salmonella typhimurium LT2
gauguaaucugaca

SEQ ID NO: 3792662 - RNA, 14 nt, Salmonella typhimurium LT2
gauguauuuaucca

SEQ ID NO: 3792663 - RNA, 15 nt, Salmonella typhimurium LT2
gaugucauaaucgcc

SEQ ID NO: 3792664 - RNA, 21 nt, Salmonella typhimurium LT2
gaugucaucgccauccugcaa

SEQ ID NO: 3792665 - RNA, 14 nt, Salmonella typhimurium LT2
gauguccaggcgac

SEQ ID NO: 3792666 - RNA, 12 nt, Salmonella typhimurium LT2
gauguccgguug

SEQ ID NO: 3792667 - RNA, 20 nt, Salmonella typhimurium LT2
gauguccguuuuuucugucg

SEQ ID NO: 3792668 - RNA, 14 nt, Salmonella typhimurium LT2
gaugugaauccagg

SEQ ID NO: 3792669 - RNA, 17 nt, Salmonella typhimurium LT2
gaugugaauccaggcca

SEQ ID NO: 3792670 - RNA, 19 nt, Salmonella typhimurium LT2
gaugugcuuuuuauuuuuc

SEQ ID NO: 3792671 - RNA, 13 nt, Salmonella typhimurium LT2
gauguuaaagguc

SEQ ID NO: 3792672 - RNA, 21 nt, Salmonella typhimurium LT2
gauguuaaaggucagaagcug

SEQ ID NO: 3792673 - RNA, 17 nt, Salmonella typhimurium LT2
gauguuuucagcauuaa

SEQ ID NO: 3792674 - RNA, 19 nt, Salmonella typhimurium LT2
gauuaacaagcagauaccg

SEQ ID NO: 3792675 - RNA, 23 nt, Salmonella typhimurium LT2
gauuaaggccggcauuuuauuca

SEQ ID NO: 3792676 - RNA, 20 nt, Salmonella typhimurium LT2
gauuaauaauugagcgcaaa

SEQ ID NO: 3792677 - RNA, 16 nt, Salmonella typhimurium LT2
gauuaaucagcagaua

SEQ ID NO: 3792678 - RNA, 20 nt, Salmonella typhimurium LT2
gauuaaucgucaucccgguu

SEQ ID NO: 3792679 - RNA, 12 nt, Salmonella typhimurium LT2
gauuaaugcgau

SEQ ID NO: 3792680 - RNA, 19 nt, Salmonella typhimurium LT2
gauuaaugcugcaccacac

SEQ ID NO: 3792681 - RNA, 20 nt, Salmonella typhimurium LT2
gauuaaugcugcaccacacc

SEQ ID NO: 3792682 - RNA, 15 nt, Salmonella typhimurium LT2
gauuacaaagggcaa

SEQ ID NO: 3792683 - RNA, 19 nt, Salmonella typhimurium LT2
gauuacgacuuacgcagca

SEQ ID NO: 3792684 - RNA, 20 nt, Salmonella typhimurium LT2
gauuacucccuugccagcgc

SEQ ID NO: 3792685 - RNA, 16 nt, Salmonella typhimurium LT2
gauuacucuucauuca

SEQ ID NO: 3792686 - RNA, 14 nt, Salmonella typhimurium LT2
gcaaauaauaccac

SEQ ID NO: 3792687 - RNA, 16 nt, Salmonella typhimurium LT2
gcaaauacaucgccac

SEQ ID NO: 3792688 - RNA, 19 nt, Salmonella typhimurium LT2
gcaaauaccacaucagacc

SEQ ID NO: 3792689 - RNA, 19 nt, Salmonella typhimurium LT2
gcaaauagguuuuaugcau

SEQ ID NO: 3792690 - RNA, 19 nt, Salmonella typhimurium LT2
gcaaaucaucgccaugacc

SEQ ID NO: 3792691 - RNA, 16 nt, Salmonella typhimurium LT2
gcaaaucccguaccgg

SEQ ID NO: 3792692 - RNA, 14 nt, Salmonella typhimurium LT2
gcaaaucgccauca

SEQ ID NO: 3792693 - RNA, 17 nt, Salmonella typhimurium LT2
gcaaaucgcccaucaca

SEQ ID NO: 3792694 - RNA, 23 nt, Salmonella typhimurium LT2
gcaaauucuguaucgcuuauuuu

SEQ ID NO: 3792695 - RNA, 22 nt, Salmonella typhimurium LT2
gcaacaaacauaagcaaauccu

SEQ ID NO: 3792696 - RNA, 12 nt, Salmonella typhimurium LT2
gcaacaaagccu

SEQ ID NO: 3792697 - RNA, 20 nt, Salmonella typhimurium LT2
gcaacaacaaacacaaucac

SEQ ID NO: 3792698 - RNA, 13 nt, Salmonella typhimurium LT2
gcaacaacaggcc

SEQ ID NO: 3792699 - RNA, 22 nt, Salmonella typhimurium LT2
gcaacaacaggccagaauaacg

SEQ ID NO: 3792700 - RNA, 11 nt, Salmonella typhimurium LT2
gcaacaacagu

SEQ ID NO: 3792701 - RNA, 21 nt, Salmonella typhimurium LT2
gcaacaacaguugcagcaccu

SEQ ID NO: 3792702 - RNA, 21 nt, Salmonella typhimurium LT2
gcaacaauuucuacugauuua

SEQ ID NO: 3792703 - RNA, 13 nt, Salmonella typhimurium LT2
gcaacacaggccg

SEQ ID NO: 3792704 - RNA, 17 nt, Salmonella typhimurium LT2
gcaacaccaccgcccgc

SEQ ID NO: 3792705 - RNA, 13 nt, Salmonella typhimurium LT2
gcaacaccauccc

SEQ ID NO: 3792706 - RNA, 17 nt, Salmonella typhimurium LT2
gcaacacgauccccauc

SEQ ID NO: 3792707 - RNA, 19 nt, Salmonella typhimurium LT2
gcaacacggugcggcauua

SEQ ID NO: 3792708 - RNA, 12 nt, Salmonella typhimurium LT2
gcaacagauuga

SEQ ID NO: 3792709 - RNA, 15 nt, Salmonella typhimurium LT2
gcaacagcaagucgc

SEQ ID NO: 3792710 - RNA, 18 nt, Salmonella typhimurium LT2
gcaacagcaagucgcggg

SEQ ID NO: 3792711 - RNA, 15 nt, Salmonella typhimurium LT2
gcaacagcaccagaa

SEQ ID NO: 3792712 - RNA, 17 nt, Salmonella typhimurium LT2
gcaacagcaccagcagg

SEQ ID NO: 3792713 - RNA, 23 nt, Salmonella typhimurium LT2
gcaacagcaccagcaggugguac

SEQ ID NO: 3792714 - RNA, 12 nt, Salmonella typhimurium LT2
gcaacaggguga

SEQ ID NO: 3792715 - RNA, 22 nt, Salmonella typhimurium LT2
gcaacagggugauuucgcccgc

SEQ ID NO: 3792716 - RNA, 20 nt, Salmonella typhimurium LT2
gcaacagguuaaccaugccc

SEQ ID NO: 3792717 - RNA, 23 nt, Salmonella typhimurium LT2
gcaacaguucacgacugauaggc

SEQ ID NO: 3792718 - RNA, 14 nt, Salmonella typhimurium LT2
gcaacauagcaucg

SEQ ID NO: 3792719 - RNA, 22 nt, Salmonella typhimurium LT2
gcaacaugaaagggaaaccgcu

SEQ ID NO: 3792720 - RNA, 15 nt, Salmonella typhimurium LT2
gcaacaugaccagcg

SEQ ID NO: 3792721 - RNA, 17 nt, Salmonella typhimurium LT2
gcaacaugaccagcgca

SEQ ID NO: 3792722 - RNA, 13 nt, Salmonella typhimurium LT2
gcaacaugcccac

SEQ ID NO: 3792723 - RNA, 13 nt, Salmonella typhimurium LT2
gcaaccaaagccg

SEQ ID NO: 3792724 - RNA, 23 nt, Salmonella typhimurium LT2
gcaaccaaagccggcgccauuuc

SEQ ID NO: 3792725 - RNA, 18 nt, Salmonella typhimurium LT2
gcaaccaacgcccaacug

SEQ ID NO: 3792726 - RNA, 16 nt, Salmonella typhimurium LT2
gcaaccagcccaugaa

SEQ ID NO: 3792727 - RNA, 17 nt, Salmonella typhimurium LT2
gcaaccagcuaaccugu

SEQ ID NO: 3792728 - RNA, 18 nt, Salmonella typhimurium LT2
gcaaccauuaccgccaac

SEQ ID NO: 3792729 - RNA, 23 nt, Salmonella typhimurium LT2
gcaaccauuaccgccaacaucgc

SEQ ID NO: 3792730 - RNA, 14 nt, Salmonella typhimurium LT2
gcaaccccucaucg

SEQ ID NO: 3792731 - RNA, 19 nt, Salmonella typhimurium LT2
gcaacccgacugccaccac

SEQ ID NO: 3792732 - RNA, 12 nt, Salmonella typhimurium LT2
gcaacccggcua

SEQ ID NO: 3792733 - RNA, 21 nt, Salmonella typhimurium LT2
gcaacccguaccuccagcgac

SEQ ID NO: 3792734 - RNA, 21 nt, Salmonella typhimurium LT2
gcaacccugccgucucaacca

SEQ ID NO: 3792735 - RNA, 20 nt, Salmonella typhimurium LT2
gcaaccgcaucacgcgaagc

SEQ ID NO: 3792736 - RNA, 18 nt, Salmonella typhimurium LT2
gcaaccgcucuccgcaau

SEQ ID NO: 3792737 - RNA, 23 nt, Salmonella typhimurium LT2
gcaaccuccgcaccuucaucauu

SEQ ID NO: 3792738 - RNA, 14 nt, Salmonella typhimurium LT2
gcaaccugagcgcg

SEQ ID NO: 3792739 - RNA, 21 nt, Salmonella typhimurium LT2
gcaaccuuaaacaucgcccuc

SEQ ID NO: 3792740 - RNA, 14 nt, Salmonella typhimurium LT2
gcaaccuuacguuu

SEQ ID NO: 3792741 - RNA, 17 nt, Salmonella typhimurium LT2
gcaacgaaaaucauccg

SEQ ID NO: 3792742 - RNA, 17 nt, Salmonella typhimurium LT2
gcaacgacgucuuucuu

SEQ ID NO: 3792743 - RNA, 20 nt, Salmonella typhimurium LT2
gcaacgacgucuuucuucgc

SEQ ID NO: 3792744 - RNA, 21 nt, Salmonella typhimurium LT2
gcaacgagaacccacuuugcu

SEQ ID NO: 3792745 - RNA, 21 nt, Salmonella typhimurium LT2
gcaacgaucccuaauaaaaua

SEQ ID NO: 3792746 - RNA, 22 nt, Salmonella typhimurium LT2
gcaacgauucguaaauugacug

SEQ ID NO: 3792747 - RNA, 17 nt, Salmonella typhimurium LT2
gcaacgccgcauccugu

SEQ ID NO: 3792748 - RNA, 15 nt, Salmonella typhimurium LT2
gcaacgccggugccu

SEQ ID NO: 3792749 - RNA, 23 nt, Salmonella typhimurium LT2
gcaacgccguacuccagcccauc

SEQ ID NO: 3792750 - RNA, 20 nt, Salmonella typhimurium LT2
gcaacgcuucugagaauuug

SEQ ID NO: 3792751 - RNA, 14 nt, Salmonella typhimurium LT2
gcaacggaagcuga

SEQ ID NO: 3792752 - RNA, 15 nt, Salmonella typhimurium LT2
gcaacggccagcgca

SEQ ID NO: 3792753 - RNA, 17 nt, Salmonella typhimurium LT2
gcaacggccagcgcagg

SEQ ID NO: 3792754 - RNA, 11 nt, Salmonella typhimurium LT2
gcaacggcgcc

SEQ ID NO: 3792755 - RNA, 16 nt, Salmonella typhimurium LT2
gcaacgggacggcggc

SEQ ID NO: 3792756 - RNA, 23 nt, Salmonella typhimurium LT2
gcaacgggacggcggccagcauu

SEQ ID NO: 3792757 - RNA, 20 nt, Salmonella typhimurium LT2
gcaacgggcaguccggcggc

SEQ ID NO: 3792758 - RNA, 20 nt, Salmonella typhimurium LT2
gcaacggugagaccauugca

SEQ ID NO: 3792759 - RNA, 12 nt, Salmonella typhimurium LT2
gcaacgucagua

SEQ ID NO: 3792760 - RNA, 15 nt, Salmonella typhimurium LT2
gcaacguccgcagcc

SEQ ID NO: 3792761 - RNA, 19 nt, Salmonella typhimurium LT2
gcaacguccucuuucgaca

SEQ ID NO: 3792762 - RNA, 14 nt, Salmonella typhimurium LT2
gcaacgucgacccg

SEQ ID NO: 3792763 - RNA, 17 nt, Salmonella typhimurium LT2
gcaacgucgacccgccc

SEQ ID NO: 3792764 - RNA, 14 nt, Salmonella typhimurium LT2
gcaacgugaacugc

SEQ ID NO: 3792765 - RNA, 18 nt, Salmonella typhimurium LT2
gcaacgugaacugcgccu

SEQ ID NO: 3792766 - RNA, 21 nt, Salmonella typhimurium LT2
gcaacgugaacugcgccugca

SEQ ID NO: 3792767 - RNA, 22 nt, Salmonella typhimurium LT2
gcaacgugcaggcgccgccauc

SEQ ID NO: 3792768 - RNA, 21 nt, Salmonella typhimurium LT2
gcaacguuucuuucaucagau

SEQ ID NO: 3792769 - RNA, 16 nt, Salmonella typhimurium LT2
gcaacguuuuccugcg

SEQ ID NO: 3792770 - RNA, 14 nt, Salmonella typhimurium LT2
gcaacucaucguca

SEQ ID NO: 3792771 - RNA, 22 nt, Salmonella typhimurium LT2
gcaacugagcgaauccccgggc

SEQ ID NO: 3792772 - RNA, 17 nt, Salmonella typhimurium LT2
gcaacugauuaaucugc

SEQ ID NO: 3792773 - RNA, 14 nt, Salmonella typhimurium LT2
gcaacuguuuuacc

SEQ ID NO: 3792774 - RNA, 21 nt, Salmonella typhimurium LT2
gcaacuguuuuaccaaaucaa

SEQ ID NO: 3792775 - RNA, 14 nt, Salmonella typhimurium LT2
gcaagaaaaguuuc

SEQ ID NO: 3792776 - RNA, 19 nt, Salmonella typhimurium LT2
gcaagaaucacgccgauga

SEQ ID NO: 3792777 - RNA, 18 nt, Salmonella typhimurium LT2
gcaagacccgaaccugcg

SEQ ID NO: 3792778 - RNA, 18 nt, Salmonella typhimurium LT2
gcaagacccgacaguaaa

SEQ ID NO: 3792779 - RNA, 18 nt, Salmonella typhimurium LT2
gcaagagagcaacauacc

SEQ ID NO: 3792780 - RNA, 22 nt, Salmonella typhimurium LT2
gcaagauuccagauagcgcugc

SEQ ID NO: 3792781 - RNA, 17 nt, Salmonella typhimurium LT2
gcaagcauaaaaaacau

SEQ ID NO: 3792782 - RNA, 16 nt, Salmonella typhimurium LT2
gcaagcaucugauaua

SEQ ID NO: 3792783 - RNA, 19 nt, Salmonella typhimurium LT2
gcaagccaaacucuuccac

SEQ ID NO: 3792784 - RNA, 14 nt, Salmonella typhimurium LT2
gcaagcgccagcau

SEQ ID NO: 3792785 - RNA, 17 nt, Salmonella typhimurium LT2
gcaagcgcuaagcaaca

SEQ ID NO: 3792786 - RNA, 19 nt, Salmonella typhimurium LT2
gcaaggaaaaccaguaacg

SEQ ID NO: 3792787 - RNA, 15 nt, Salmonella typhimurium LT2
gcaaggccguuaucc

SEQ ID NO: 3792788 - RNA, 16 nt, Salmonella typhimurium LT2
gcaagggaagagauua

SEQ ID NO: 3792789 - RNA, 15 nt, Salmonella typhimurium LT2
gcaagggaaucucuu

SEQ ID NO: 3792790 - RNA, 18 nt, Salmonella typhimurium LT2
gcacaucauuauccagcc

SEQ ID NO: 3792791 - RNA, 21 nt, Salmonella typhimurium LT2
gcacauccauguacuccuggu

SEQ ID NO: 3792792 - RNA, 17 nt, Salmonella typhimurium LT2
gcacaucgccauuaaaa

SEQ ID NO: 3792793 - RNA, 18 nt, Salmonella typhimurium LT2
gcacaucgccauuaaaag

SEQ ID NO: 3792794 - RNA, 19 nt, Salmonella typhimurium LT2
gcacaugauggugacuguc

SEQ ID NO: 3792795 - RNA, 20 nt, Salmonella typhimurium LT2
gcacaugcagcgcaaacuca

SEQ ID NO: 3792796 - RNA, 13 nt, Salmonella typhimurium LT2
gcacauuacaggc

SEQ ID NO: 3792797 - RNA, 21 nt, Salmonella typhimurium LT2
gcaccaaaguuaaucagcgcu

SEQ ID NO: 3792798 - RNA, 17 nt, Salmonella typhimurium LT2
gcaccaaauccuccagc

SEQ ID NO: 3792799 - RNA, 20 nt, Salmonella typhimurium LT2
gcaccaccggacucggcuga

SEQ ID NO: 3792800 - RNA, 22 nt, Salmonella typhimurium LT2
gcaccaccugcuguugcggaau

SEQ ID NO: 3792801 - RNA, 17 nt, Salmonella typhimurium LT2
gcaccacgcaaaccgcu

SEQ ID NO: 3792802 - RNA, 13 nt, Salmonella typhimurium LT2
gcaccacucccca

SEQ ID NO: 3792803 - RNA, 16 nt, Salmonella typhimurium LT2
gcaccagaaucauuaa

SEQ ID NO: 3792804 - RNA, 12 nt, Salmonella typhimurium LT2
gcaccagaccga

SEQ ID NO: 3792805 - RNA, 13 nt, Salmonella typhimurium LT2
gcaccagcaacac

SEQ ID NO: 3792806 - RNA, 13 nt, Salmonella typhimurium LT2
gcaccagccagga

SEQ ID NO: 3792807 - RNA, 20 nt, Salmonella typhimurium LT2
gcaccaggaagacuauccag

SEQ ID NO: 3792808 - RNA, 23 nt, Salmonella typhimurium LT2
gcaccaggauacguucaucuucc

SEQ ID NO: 3792809 - RNA, 23 nt, Salmonella typhimurium LT2
gcaccaguucacuccuaagagaa

SEQ ID NO: 3792810 - RNA, 18 nt, Salmonella typhimurium LT2
gcaccaucuuuuccggca

SEQ ID NO: 3792811 - RNA, 22 nt, Salmonella typhimurium LT2
gcaccaucuuuuccggcagggu

SEQ ID NO: 3792812 - RNA, 17 nt, Salmonella typhimurium LT2
gcaccauggcuauccac

SEQ ID NO: 3792813 - RNA, 19 nt, Salmonella typhimurium LT2
gcaccauuaucgcgccgga

SEQ ID NO: 3792814 - RNA, 17 nt, Salmonella typhimurium LT2
gcaccauucccacgcau

SEQ ID NO: 3792815 - RNA, 17 nt, Salmonella typhimurium LT2
gcacccaucuuuaccaa

SEQ ID NO: 3792816 - RNA, 18 nt, Salmonella typhimurium LT2
gcaccccggccacguagc

SEQ ID NO: 3792817 - RNA, 20 nt, Salmonella typhimurium LT2
gcacccgccaucaugcccac

SEQ ID NO: 3792818 - RNA, 19 nt, Salmonella typhimurium LT2
gcacccggcuuacaacauu

SEQ ID NO: 3792819 - RNA, 16 nt, Salmonella typhimurium LT2
gcaccgaugacaauaa

SEQ ID NO: 3792820 - RNA, 17 nt, Salmonella typhimurium LT2
gcaccgaugacaauaau

SEQ ID NO: 3792821 - RNA, 15 nt, Salmonella typhimurium LT2
gcaccgccaaacgcg

SEQ ID NO: 3792822 - RNA, 16 nt, Salmonella typhimurium LT2
gcaccgccagcgccgc

SEQ ID NO: 3792823 - RNA, 20 nt, Salmonella typhimurium LT2
gcaccgcgaccaguucaccg

SEQ ID NO: 3792824 - RNA, 20 nt, Salmonella typhimurium LT2
gcaccgcuaaaaaacaggcg

SEQ ID NO: 3792825 - RNA, 15 nt, Salmonella typhimurium LT2
gcaccguaaacggcu

SEQ ID NO: 3792826 - RNA, 17 nt, Salmonella typhimurium LT2
gcaccguggaagcggaa

SEQ ID NO: 3792827 - RNA, 15 nt, Salmonella typhimurium LT2
gcaccguuccgccac

SEQ ID NO: 3792828 - RNA, 21 nt, Salmonella typhimurium LT2
gcaccucaauaugaaauucuu

SEQ ID NO: 3792829 - RNA, 21 nt, Salmonella typhimurium LT2
gcaccucgaccagacugauaa

SEQ ID NO: 3792830 - RNA, 18 nt, Salmonella typhimurium LT2
gcaccuggagcgccuccc

SEQ ID NO: 3792831 - RNA, 18 nt, Salmonella typhimurium LT2
gcaccuguuucugcuggc

SEQ ID NO: 3792832 - RNA, 20 nt, Salmonella typhimurium LT2
gcaccuguuucugcuggccu

SEQ ID NO: 3792833 - RNA, 16 nt, Salmonella typhimurium LT2
gcaccuuauccggccu

SEQ ID NO: 3792834 - RNA, 13 nt, Salmonella typhimurium LT2
gcaccuucaucau

SEQ ID NO: 3792835 - RNA, 17 nt, Salmonella typhimurium LT2
gcaccuucaucauucac

SEQ ID NO: 3792836 - RNA, 22 nt, Salmonella typhimurium LT2
gcacgaacauaccggagccugg

SEQ ID NO: 3792837 - RNA, 14 nt, Salmonella typhimurium LT2
gcacgacaacgcgc

SEQ ID NO: 3792838 - RNA, 16 nt, Salmonella typhimurium LT2
gcacgacacaaaagca

SEQ ID NO: 3792839 - RNA, 18 nt, Salmonella typhimurium LT2
gcacgauauccagcaccu

SEQ ID NO: 3792840 - RNA, 19 nt, Salmonella typhimurium LT2
gcacgaugcauaugcacag

SEQ ID NO: 3792841 - RNA, 12 nt, Salmonella typhimurium LT2
gcacgccagcgg

SEQ ID NO: 3792842 - RNA, 12 nt, Salmonella typhimurium LT2
gcacgccagggu

SEQ ID NO: 3792843 - RNA, 14 nt, Salmonella typhimurium LT2
gcacgccaggguaa

SEQ ID NO: 3792844 - RNA, 15 nt, Salmonella typhimurium LT2
gcacgccaucgccug

SEQ ID NO: 3792845 - RNA, 14 nt, Salmonella typhimurium LT2
gcacgcccaucggc

SEQ ID NO: 3792846 - RNA, 18 nt, Salmonella typhimurium LT2
gcacgcccaucggcacac

SEQ ID NO: 3792847 - RNA, 20 nt, Salmonella typhimurium LT2
gcacgccgcucgaaucgcca

SEQ ID NO: 3792848 - RNA, 15 nt, Salmonella typhimurium LT2
gcacgccggccccgc

SEQ ID NO: 3792849 - RNA, 14 nt, Salmonella typhimurium LT2
gcacgccuuccugg

SEQ ID NO: 3792850 - RNA, 22 nt, Salmonella typhimurium LT2
gcacgcuauauuccagccagga

SEQ ID NO: 3792851 - RNA, 18 nt, Salmonella typhimurium LT2
gcacgcuggcaucaauau

SEQ ID NO: 3792852 - RNA, 18 nt, Salmonella typhimurium LT2
gcacgcuuuggcaggccu

SEQ ID NO: 3792853 - RNA, 15 nt, Salmonella typhimurium LT2
gcacggcuucacgua

SEQ ID NO: 3792854 - RNA, 23 nt, Salmonella typhimurium LT2
gcacguaggccugauaagcgcag

SEQ ID NO: 3792855 - RNA, 18 nt, Salmonella typhimurium LT2
gcacgucgguaaagcgca

SEQ ID NO: 3792856 - RNA, 23 nt, Salmonella typhimurium LT2
gcacgucgguaaagcgcaccagc

SEQ ID NO: 3792857 - RNA, 23 nt, Salmonella typhimurium LT2
gcacguuaaagccgaccaucgcg

SEQ ID NO: 3792858 - RNA, 15 nt, Salmonella typhimurium LT2
gcacguucugcuggu

SEQ ID NO: 3792859 - RNA, 16 nt, Salmonella typhimurium LT2
gcacuaacagcagcaa

SEQ ID NO: 3792860 - RNA, 22 nt, Salmonella typhimurium LT2
gcacuaacagcagcaacaaacc

SEQ ID NO: 3792861 - RNA, 22 nt, Salmonella typhimurium LT2
gcacuaacgauagaggguugau

SEQ ID NO: 3792862 - RNA, 14 nt, Salmonella typhimurium LT2
gcacuacaucauuc

SEQ ID NO: 3792863 - RNA, 19 nt, Salmonella typhimurium LT2
gcacuacggauggcccugc

SEQ ID NO: 3792864 - RNA, 18 nt, Salmonella typhimurium LT2
gcacuacggcaaacacaa

SEQ ID NO: 3792865 - RNA, 24 nt, Salmonella typhimurium LT2
gcacuacgguccaguugcccucuu

SEQ ID NO: 3792866 - RNA, 13 nt, Salmonella typhimurium LT2
gcacucaccucuu

SEQ ID NO: 3792867 - RNA, 14 nt, Salmonella typhimurium LT2
gcacucaccucuuc

SEQ ID NO: 3792868 - RNA, 15 nt, Salmonella typhimurium LT2
gcacucagaaaauua

SEQ ID NO: 3792869 - RNA, 17 nt, Salmonella typhimurium LT2
gcacucagaaaauuauu

SEQ ID NO: 3792870 - RNA, 22 nt, Salmonella typhimurium LT2
gcacucagaaaauuauuuuaaa

SEQ ID NO: 3792871 - RNA, 18 nt, Salmonella typhimurium LT2
gcacuccccggcuugcgg

SEQ ID NO: 3792872 - RNA, 22 nt, Salmonella typhimurium LT2
gcacuccccggcuugcggggag

SEQ ID NO: 3792873 - RNA, 13 nt, Salmonella typhimurium LT2
gcacucgccgcca

SEQ ID NO: 3792874 - RNA, 15 nt, Salmonella typhimurium LT2
gcacucugcgccagg

SEQ ID NO: 3792875 - RNA, 22 nt, Salmonella typhimurium LT2
gcacugacgucaacucgcggcc

SEQ ID NO: 3792876 - RNA, 21 nt, Salmonella typhimurium LT2
gcacuggcuuacucgcccugc

SEQ ID NO: 3792877 - RNA, 19 nt, Salmonella typhimurium LT2
gcacugggcgaagguggcg

SEQ ID NO: 3792878 - RNA, 16 nt, Salmonella typhimurium LT2
gcacugguagaaaaac

SEQ ID NO: 3792879 - RNA, 18 nt, Salmonella typhimurium LT2
gcacuguaacgcacuggu

SEQ ID NO: 3792880 - RNA, 19 nt, Salmonella typhimurium LT2
gcacuguauaugcuacacg

SEQ ID NO: 3792881 - RNA, 14 nt, Salmonella typhimurium LT2
gcacuguggcggcu

SEQ ID NO: 3792882 - RNA, 19 nt, Salmonella typhimurium LT2
gcacuuccugaaucaccag

SEQ ID NO: 3792883 - RNA, 20 nt, Salmonella typhimurium LT2
gcacuuccugaaucaccagc

SEQ ID NO: 3792884 - RNA, 17 nt, Salmonella typhimurium LT2
gcacuugagaaauuauu

SEQ ID NO: 3792885 - RNA, 13 nt, Salmonella typhimurium LT2
gcacuuuaaacca

SEQ ID NO: 3792886 - RNA, 12 nt, Salmonella typhimurium LT2
gcacuuucauug

SEQ ID NO: 3792887 - RNA, 22 nt, Salmonella typhimurium LT2
gcacuuucauugccguuaacug

SEQ ID NO: 3792888 - RNA, 18 nt, Salmonella typhimurium LT2
gcacuuuccagccccuuc

SEQ ID NO: 3792889 - RNA, 20 nt, Salmonella typhimurium LT2
gcagaaaaagcccccaucac

SEQ ID NO: 3792890 - RNA, 20 nt, Salmonella typhimurium LT2
gcagaaaaagucauuuucau

SEQ ID NO: 3792891 - RNA, 22 nt, Salmonella typhimurium LT2
gcagaaaccggggagcuauccc

SEQ ID NO: 3792892 - RNA, 15 nt, Salmonella typhimurium LT2
gcagaaaggcgugca

SEQ ID NO: 3792893 - RNA, 17 nt, Salmonella typhimurium LT2
gcagcgcgacauagagc

SEQ ID NO: 3792894 - RNA, 17 nt, Salmonella typhimurium LT2
gcagcgcgauaucauuc

SEQ ID NO: 3792895 - RNA, 18 nt, Salmonella typhimurium LT2
gcagcgcgcgacccagcg

SEQ ID NO: 3792896 - RNA, 20 nt, Salmonella typhimurium LT2
gcagcgcgcgacccagcgca

SEQ ID NO: 3792897 - RNA, 15 nt, Salmonella typhimurium LT2
gcagcgcgcggauga

SEQ ID NO: 3792898 - RNA, 13 nt, Salmonella typhimurium LT2
gcagcgcggccug

SEQ ID NO: 3792899 - RNA, 14 nt, Salmonella typhimurium LT2
gcagcgcggccugc

SEQ ID NO: 3792900 - RNA, 21 nt, Salmonella typhimurium LT2
gcagcgcggcgucgccgccgu

SEQ ID NO: 3792901 - RNA, 20 nt, Salmonella typhimurium LT2
gcagcggcgguuauccgcca

SEQ ID NO: 3792902 - RNA, 14 nt, Salmonella typhimurium LT2
gcagcggcucgcgu

SEQ ID NO: 3792903 - RNA, 15 nt, Salmonella typhimurium LT2
gcagcggcugcgccu

SEQ ID NO: 3792904 - RNA, 13 nt, Salmonella typhimurium LT2
gcagcgguccaaa

SEQ ID NO: 3792905 - RNA, 19 nt, Salmonella typhimurium LT2
gcagcguaauacaggcgau

SEQ ID NO: 3792906 - RNA, 15 nt, Salmonella typhimurium LT2
gcagcgucggcuuca

SEQ ID NO: 3792907 - RNA, 20 nt, Salmonella typhimurium LT2
gcagcgucgucgguaaacgg

SEQ ID NO: 3792908 - RNA, 22 nt, Salmonella typhimurium LT2
gcagcgucugcccuccugaaua

SEQ ID NO: 3792909 - RNA, 21 nt, Salmonella typhimurium LT2
gcagcgugguuuccggcagcu

SEQ ID NO: 3792910 - RNA, 15 nt, Salmonella typhimurium LT2
gcagcuccccgccgc

SEQ ID NO: 3792911 - RNA, 19 nt, Salmonella typhimurium LT2
gcagcuccccgccgcggcg

SEQ ID NO: 3792912 - RNA, 21 nt, Salmonella typhimurium LT2
gcagcucuucgccguuaucgg

SEQ ID NO: 3792913 - RNA, 22 nt, Salmonella typhimurium LT2
gcagcugcuguaugauuucacc

SEQ ID NO: 3792914 - RNA, 13 nt, Salmonella typhimurium LT2
gcagcuuauccgg

SEQ ID NO: 3792915 - RNA, 15 nt, Salmonella typhimurium LT2
gcagcuuaucuuuuu

SEQ ID NO: 3792916 - RNA, 22 nt, Salmonella typhimurium LT2
gcagcuugccuuguuucgucaa

SEQ ID NO: 3792917 - RNA, 14 nt, Salmonella typhimurium LT2
gcaggaaccacauc

SEQ ID NO: 3792918 - RNA, 14 nt, Salmonella typhimurium LT2
gcaggacagcgaca

SEQ ID NO: 3792919 - RNA, 23 nt, Salmonella typhimurium LT2
gcaggacguugccgcccaccugc

SEQ ID NO: 3792920 - RNA, 15 nt, Salmonella typhimurium LT2
gcaggacuuaaaaac

SEQ ID NO: 3792921 - RNA, 15 nt, Salmonella typhimurium LT2
gcaggauacggcgcu

SEQ ID NO: 3792922 - RNA, 22 nt, Salmonella typhimurium LT2
gcaggaucccgaauaucgcgag

SEQ ID NO: 3792923 - RNA, 23 nt, Salmonella typhimurium LT2
gcaggaucuccagaucgccacga

SEQ ID NO: 3792924 - RNA, 14 nt, Salmonella typhimurium LT2
gcaggaugaaugac

SEQ ID NO: 3792925 - RNA, 19 nt, Salmonella typhimurium LT2
gcaggauucgaaccugcga

SEQ ID NO: 3792926 - RNA, 21 nt, Salmonella typhimurium LT2
gcaggauuuguaucacaauca

SEQ ID NO: 3792927 - RNA, 15 nt, Salmonella typhimurium LT2
gcaggcaacaugacc

SEQ ID NO: 3792928 - RNA, 21 nt, Salmonella typhimurium LT2
gcaggcacuacggugugccug

SEQ ID NO: 3792929 - RNA, 13 nt, Salmonella typhimurium LT2
gcaggcagcgcca

SEQ ID NO: 3792930 - RNA, 14 nt, Salmonella typhimurium LT2
gcaggcagcgucgc

SEQ ID NO: 3792931 - RNA, 17 nt, Salmonella typhimurium LT2
gcaggcaggucuccagc

SEQ ID NO: 3792932 - RNA, 13 nt, Salmonella typhimurium LT2
gcaggcauggcca

SEQ ID NO: 3792933 - RNA, 16 nt, Salmonella typhimurium LT2
gcaggcauggccaaug

SEQ ID NO: 3792934 - RNA, 17 nt, Salmonella typhimurium LT2
gcaggcauuaaaaaaac

SEQ ID NO: 3792935 - RNA, 17 nt, Salmonella typhimurium LT2
gcaggccaaacagcggc

SEQ ID NO: 3792936 - RNA, 18 nt, Salmonella typhimurium LT2
gcaggccaaauagggcgc

SEQ ID NO: 3792937 - RNA, 16 nt, Salmonella typhimurium LT2
gcaggccaagcagcgc

SEQ ID NO: 3792938 - RNA, 14 nt, Salmonella typhimurium LT2
gcaggccaggcguu

SEQ ID NO: 3792939 - RNA, 16 nt, Salmonella typhimurium LT2
gcaggccggcagccug

SEQ ID NO: 3792940 - RNA, 19 nt, Salmonella typhimurium LT2
gcaggccggcagccugccg

SEQ ID NO: 3792941 - RNA, 18 nt, Salmonella typhimurium LT2
gcaggcgaaggaggacgg

SEQ ID NO: 3792942 - RNA, 21 nt, Salmonella typhimurium LT2
gcaggcgaccucgcagguacg

SEQ ID NO: 3792943 - RNA, 18 nt, Salmonella typhimurium LT2
gcaggcgauagccccagu

SEQ ID NO: 3792944 - RNA, 21 nt, Salmonella typhimurium LT2
gcaggcgauagccccaguaaa

SEQ ID NO: 3792945 - RNA, 22 nt, Salmonella typhimurium LT2
gcaggcgauagccccaguaaau

SEQ ID NO: 3792946 - RNA, 12 nt, Salmonella typhimurium LT2
gcaggcgccgcc

SEQ ID NO: 3792947 - RNA, 21 nt, Salmonella typhimurium LT2
gcaggcgccuuauccggccug

SEQ ID NO: 3792948 - RNA, 20 nt, Salmonella typhimurium LT2
gcaggcgcgaccucaucaaa

SEQ ID NO: 3792949 - RNA, 19 nt, Salmonella typhimurium LT2
gcaggcggcaaucagcgcc

SEQ ID NO: 3792950 - RNA, 23 nt, Salmonella typhimurium LT2
gcaggcgggugcgcagccccagc

SEQ ID NO: 3792951 - RNA, 16 nt, Salmonella typhimurium LT2
gcaggcggugcgcagc

SEQ ID NO: 3792952 - RNA, 20 nt, Salmonella typhimurium LT2
gcaggcggugcgcagccacg

SEQ ID NO: 3792953 - RNA, 18 nt, Salmonella typhimurium LT2
gcaggcgucaaaacaggu

SEQ ID NO: 3792954 - RNA, 22 nt, Salmonella typhimurium LT2
gcaggcgucauagccgcgcguc

SEQ ID NO: 3792955 - RNA, 20 nt, Salmonella typhimurium LT2
gcaggcuaugcucccccccu

SEQ ID NO: 3792956 - RNA, 16 nt, Salmonella typhimurium LT2
gcaggcucuuuuucuc

SEQ ID NO: 3792957 - RNA, 17 nt, Salmonella typhimurium LT2
gcaggcuuccacgcacg

SEQ ID NO: 3792958 - RNA, 24 nt, Salmonella typhimurium LT2
gcaggcuugcccauucgccgacgc

SEQ ID NO: 3792959 - RNA, 14 nt, Salmonella typhimurium LT2
gcagggaacacccg

SEQ ID NO: 3792960 - RNA, 20 nt, Salmonella typhimurium LT2
gcagggacuccugcgccgga

SEQ ID NO: 3792961 - RNA, 22 nt, Salmonella typhimurium LT2
gcagggacuccugcgccggacg

SEQ ID NO: 3792962 - RNA, 16 nt, Salmonella typhimurium LT2
gcagggcaggggccag

SEQ ID NO: 3792963 - RNA, 15 nt, Salmonella typhimurium LT2
gcagggcaugauuac

SEQ ID NO: 3792964 - RNA, 20 nt, Salmonella typhimurium LT2
gcagggccgcguuaacgccg

SEQ ID NO: 3792965 - RNA, 12 nt, Salmonella typhimurium LT2
gcagggcugcug

SEQ ID NO: 3792966 - RNA, 18 nt, Salmonella typhimurium LT2
gcaggguuugaccucauc

SEQ ID NO: 3792967 - RNA, 19 nt, Salmonella typhimurium LT2
gcagguaucguauccgguc

SEQ ID NO: 3792968 - RNA, 10 nt, Salmonella typhimurium LT2
gcaggucggc

SEQ ID NO: 3792969 - RNA, 20 nt, Salmonella typhimurium LT2
gcagguuuuacuucuucagg

SEQ ID NO: 3792970 - RNA, 22 nt, Salmonella typhimurium LT2
gcagguuuugcagauccgcgau

SEQ ID NO: 3792971 - RNA, 17 nt, Salmonella typhimurium LT2
gcaguaaaaagaaagcu

SEQ ID NO: 3792972 - RNA, 21 nt, Salmonella typhimurium LT2
gcaguacgcgcaaccgcauca

SEQ ID NO: 3792973 - RNA, 13 nt, Salmonella typhimurium LT2
gcaguacggcgca

SEQ ID NO: 3792974 - RNA, 15 nt, Salmonella typhimurium LT2
gcaguagagaggggc

SEQ ID NO: 3792975 - RNA, 12 nt, Salmonella typhimurium LT2
gcaguagccaug

SEQ ID NO: 3792976 - RNA, 13 nt, Salmonella typhimurium LT2
gcaguagccaugc

SEQ ID NO: 3792977 - RNA, 22 nt, Salmonella typhimurium LT2
gcaguagcgcuuugacaucggg

SEQ ID NO: 3792978 - RNA, 20 nt, Salmonella typhimurium LT2
gcaguauugcaccaggaaga

SEQ ID NO: 3792979 - RNA, 22 nt, Salmonella typhimurium LT2
gcagucaaaacgacauaaccgg

SEQ ID NO: 3792980 - RNA, 15 nt, Salmonella typhimurium LT2
gcagucacagaucca

SEQ ID NO: 3792981 - RNA, 20 nt, Salmonella typhimurium LT2
gcagucagugaaaaaccgau

SEQ ID NO: 3792982 - RNA, 16 nt, Salmonella typhimurium LT2
gcaguccaacaaggau

SEQ ID NO: 3792983 - RNA, 17 nt, Salmonella typhimurium LT2
gcagucgcuacaaccag

SEQ ID NO: 3792984 - RNA, 16 nt, Salmonella typhimurium LT2
gcagugacauuuaucu

SEQ ID NO: 3792985 - RNA, 17 nt, Salmonella typhimurium LT2
gcagugagauugacaga

SEQ ID NO: 3792986 - RNA, 21 nt, Salmonella typhimurium LT2
gcagugagauugacagaauaa

SEQ ID NO: 3792987 - RNA, 14 nt, Salmonella typhimurium LT2
gcagugcacugccu

SEQ ID NO: 3792988 - RNA, 22 nt, Salmonella typhimurium LT2
gcagugcaguauugcaccagga

SEQ ID NO: 3792989 - RNA, 20 nt, Salmonella typhimurium LT2
gcaguggcauguucccaugu

SEQ ID NO: 3792990 - RNA, 13 nt, Salmonella typhimurium LT2
gcaguggcggcua

SEQ ID NO: 3792991 - RNA, 17 nt, Salmonella typhimurium LT2
gcaguguaucgaagauc

SEQ ID NO: 3792992 - RNA, 21 nt, Salmonella typhimurium LT2
gcagugucaaauuguacuuuu

SEQ ID NO: 3792993 - RNA, 19 nt, Salmonella typhimurium LT2
gcagugugcuccuggcgca

SEQ ID NO: 3792994 - RNA, 14 nt, Salmonella typhimurium LT2
gcaguguuaaucuc

SEQ ID NO: 3792995 - RNA, 12 nt, Salmonella typhimurium LT2
gcaguucaauau

SEQ ID NO: 3792996 - RNA, 13 nt, Salmonella typhimurium LT2
gcaguucagcagc

SEQ ID NO: 3792997 - RNA, 14 nt, Salmonella typhimurium LT2
gcaucgugccggaa

SEQ ID NO: 3792998 - RNA, 22 nt, Salmonella typhimurium LT2
gcaucguuugcaguuccgcaau

SEQ ID NO: 3792999 - RNA, 22 nt, Salmonella typhimurium LT2
gcaucugaaaaaccuccggcua

SEQ ID NO: 3793000 - RNA, 13 nt, Salmonella typhimurium LT2
gcaucugaccuac

SEQ ID NO: 3793001 - RNA, 21 nt, Salmonella typhimurium LT2
gcaucugaccuacaaucgucu

SEQ ID NO: 3793002 - RNA, 21 nt, Salmonella typhimurium LT2
gcaucugauauaucuucaucg

SEQ ID NO: 3793003 - RNA, 15 nt, Salmonella typhimurium LT2
gcaucugcgcguagc

SEQ ID NO: 3793004 - RNA, 20 nt, Salmonella typhimurium LT2
gcaucugggcugacaaaaau

SEQ ID NO: 3793005 - RNA, 18 nt, Salmonella typhimurium LT2
gcaucuuccucugugccg

SEQ ID NO: 3793006 - RNA, 17 nt, Salmonella typhimurium LT2
gcaucuuuaaccgccug

SEQ ID NO: 3793007 - RNA, 19 nt, Salmonella typhimurium LT2
gcaucuuuccggaacgcgu

SEQ ID NO: 3793008 - RNA, 21 nt, Salmonella typhimurium LT2
gcaucuuuccggaacgcguuu

SEQ ID NO: 3793009 - RNA, 13 nt, Salmonella typhimurium LT2
gcaucuuuugccg

SEQ ID NO: 3793010 - RNA, 16 nt, Salmonella typhimurium LT2
gcaugaacguucgccu

SEQ ID NO: 3793011 - RNA, 18 nt, Salmonella typhimurium LT2
gcaugaauaaccucccgc

SEQ ID NO: 3793012 - RNA, 20 nt, Salmonella typhimurium LT2
gcaugaauaaccucccgccg

SEQ ID NO: 3793013 - RNA, 18 nt, Salmonella typhimurium LT2
gcaugacaucagaagugc

SEQ ID NO: 3793014 - RNA, 12 nt, Salmonella typhimurium LT2
gcaugaccaucc

SEQ ID NO: 3793015 - RNA, 23 nt, Salmonella typhimurium LT2
gcaugacgggggcgaucagcagg

SEQ ID NO: 3793016 - RNA, 16 nt, Salmonella typhimurium LT2
gcaugagcaaaaugcu

SEQ ID NO: 3793017 - RNA, 13 nt, Salmonella typhimurium LT2
gcaugagccagcc

SEQ ID NO: 3793018 - RNA, 14 nt, Salmonella typhimurium LT2
gcaugagccagccc

SEQ ID NO: 3793019 - RNA, 19 nt, Salmonella typhimurium LT2
gcaugaggguuguuuucug

SEQ ID NO: 3793020 - RNA, 13 nt, Salmonella typhimurium LT2
gcaugauaccgau

SEQ ID NO: 3793021 - RNA, 22 nt, Salmonella typhimurium LT2
gcaugauaucgagugaaccgga

SEQ ID NO: 3793022 - RNA, 21 nt, Salmonella typhimurium LT2
gcaugaucauacugccgccgu

SEQ ID NO: 3793023 - RNA, 22 nt, Salmonella typhimurium LT2
gcaugaucauacugccgccgug

SEQ ID NO: 3793024 - RNA, 17 nt, Salmonella typhimurium LT2
gcaugaucuauccaaua

SEQ ID NO: 3793025 - RNA, 19 nt, Salmonella typhimurium LT2
gcaugauggcgaacagccc

SEQ ID NO: 3793026 - RNA, 22 nt, Salmonella typhimurium LT2
gcaugaugggcgcacagcgcca

SEQ ID NO: 3793027 - RNA, 22 nt, Salmonella typhimurium LT2
gcaugauggucgccagcgucuu

SEQ ID NO: 3793028 - RNA, 14 nt, Salmonella typhimurium LT2
gcaugcaaacgucc

SEQ ID NO: 3793029 - RNA, 22 nt, Salmonella typhimurium LT2
gcaugccccucgacaggaguau

SEQ ID NO: 3793030 - RNA, 12 nt, Salmonella typhimurium LT2
gcaugccgcagg

SEQ ID NO: 3793031 - RNA, 13 nt, Salmonella typhimurium LT2
gcaugccgcaggc

SEQ ID NO: 3793032 - RNA, 16 nt, Salmonella typhimurium LT2
gcauggcagauaaacc

SEQ ID NO: 3793033 - RNA, 23 nt, Salmonella typhimurium LT2
gcauggcagccccggcauccagu

SEQ ID NO: 3793034 - RNA, 17 nt, Salmonella typhimurium LT2
gcauggcgucggcgacu

SEQ ID NO: 3793035 - RNA, 23 nt, Salmonella typhimurium LT2
gcauggcgucucagcggagugcu

SEQ ID NO: 3793036 - RNA, 17 nt, Salmonella typhimurium LT2
gcauggguaaagcccau

SEQ ID NO: 3793037 - RNA, 18 nt, Salmonella typhimurium LT2
gcaugguguucagauggc

SEQ ID NO: 3793038 - RNA, 23 nt, Salmonella typhimurium LT2
gcaugguuacgcgacgugcugug

SEQ ID NO: 3793039 - RNA, 14 nt, Salmonella typhimurium LT2
gcauguaguaagcc

SEQ ID NO: 3793040 - RNA, 16 nt, Salmonella typhimurium LT2
gcauguccggcgacuc

SEQ ID NO: 3793041 - RNA, 18 nt, Salmonella typhimurium LT2
gcaugucguauccccagu

SEQ ID NO: 3793042 - RNA, 21 nt, Salmonella typhimurium LT2
gcauuaacccggccccgacaa

SEQ ID NO: 3793043 - RNA, 17 nt, Salmonella typhimurium LT2
gcauuaacguccauacc

SEQ ID NO: 3793044 - RNA, 22 nt, Salmonella typhimurium LT2
gcauuaauaugcgcaaucaccc

SEQ ID NO: 3793045 - RNA, 13 nt, Salmonella typhimurium LT2
gcauuaauuucuu

SEQ ID NO: 3793046 - RNA, 15 nt, Salmonella typhimurium LT2
gcauuaccagcaaua

SEQ ID NO: 3793047 - RNA, 20 nt, Salmonella typhimurium LT2
gcauuaccagcaauaacagg

SEQ ID NO: 3793048 - RNA, 15 nt, Salmonella typhimurium LT2
gcauuacccccgcca

SEQ ID NO: 3793049 - RNA, 19 nt, Salmonella typhimurium LT2
gcauuagcaugggcuaaag

SEQ ID NO: 3793050 - RNA, 14 nt, Salmonella typhimurium LT2
gcauuaggcuuuuc

SEQ ID NO: 3793051 - RNA, 20 nt, Salmonella typhimurium LT2
gcauuauacgccuauuuucu

SEQ ID NO: 3793052 - RNA, 20 nt, Salmonella typhimurium LT2
gcauuauauuggcuggccug

SEQ ID NO: 3793053 - RNA, 17 nt, Salmonella typhimurium LT2
gcauuaucgaugcguau

SEQ ID NO: 3793054 - RNA, 18 nt, Salmonella typhimurium LT2
gcauuauucggcuuuuac

SEQ ID NO: 3793055 - RNA, 22 nt, Salmonella typhimurium LT2
gcauucauaagcaaacaggggg

SEQ ID NO: 3793056 - RNA, 16 nt, Salmonella typhimurium LT2
gcauuccccaucgcga

SEQ ID NO: 3793057 - RNA, 17 nt, Salmonella typhimurium LT2
gcauucgaauccuccug

SEQ ID NO: 3793058 - RNA, 14 nt, Salmonella typhimurium LT2
gcauucgcuugccc

SEQ ID NO: 3793059 - RNA, 17 nt, Salmonella typhimurium LT2
gcauucucgccgugacu

SEQ ID NO: 3793060 - RNA, 21 nt, Salmonella typhimurium LT2
gcauucucuguugccgcccgu

SEQ ID NO: 3793061 - RNA, 20 nt, Salmonella typhimurium LT2
gcauucuuugcuuuguaaag

SEQ ID NO: 3793062 - RNA, 19 nt, Salmonella typhimurium LT2
gcauugaggcuacccagac

SEQ ID NO: 3793063 - RNA, 23 nt, Salmonella typhimurium LT2
gcauugccauguuaauaccagcg

SEQ ID NO: 3793064 - RNA, 20 nt, Salmonella typhimurium LT2
gcauugcccuguaaggggca

SEQ ID NO: 3793065 - RNA, 16 nt, Salmonella typhimurium LT2
gcauugcucaacugga

SEQ ID NO: 3793066 - RNA, 14 nt, Salmonella typhimurium LT2
gcauuggcaaugaa

SEQ ID NO: 3793067 - RNA, 19 nt, Salmonella typhimurium LT2
gcauuggcguuaccggcag

SEQ ID NO: 3793068 - RNA, 17 nt, Salmonella typhimurium LT2
gcauugggauggauaaa

SEQ ID NO: 3793069 - RNA, 18 nt, Salmonella typhimurium LT2
gcauugugaggaaccucu

SEQ ID NO: 3793070 - RNA, 19 nt, Salmonella typhimurium LT2
gcauuuaacggcuuacugc

SEQ ID NO: 3793071 - RNA, 20 nt, Salmonella typhimurium LT2
gcauuuaucuuuaaacuuuu

SEQ ID NO: 3793072 - RNA, 19 nt, Salmonella typhimurium LT2
gcauuucaaagcguucuga

SEQ ID NO: 3793073 - RNA, 22 nt, Salmonella typhimurium LT2
gcauuucaaucgccaccacauu

SEQ ID NO: 3793074 - RNA, 16 nt, Salmonella typhimurium LT2
gcauuucuaccggcag

SEQ ID NO: 3793075 - RNA, 20 nt, Salmonella typhimurium LT2
gcauuugcgcuuucagcgca

SEQ ID NO: 3793076 - RNA, 20 nt, Salmonella typhimurium LT2
gcauuugcguccauaucaga

SEQ ID NO: 3793077 - RNA, 18 nt, Salmonella typhimurium LT2
gcauuugcuuucaucaau

SEQ ID NO: 3793078 - RNA, 22 nt, Salmonella typhimurium LT2
gcauuuguagcggcaacagcac

SEQ ID NO: 3793079 - RNA, 15 nt, Salmonella typhimurium LT2
gcauuuucaaugucg

SEQ ID NO: 3793080 - RNA, 16 nt, Salmonella typhimurium LT2
gcauuuucaaugucgc

SEQ ID NO: 3793081 - RNA, 16 nt, Salmonella typhimurium LT2
gcauuuuuaagcuggc

SEQ ID NO: 3793082 - RNA, 21 nt, Salmonella typhimurium LT2
gcauuuuuaucagaccugccu

SEQ ID NO: 3793083 - RNA, 22 nt, Salmonella typhimurium LT2
gcauuuuucauggugaacaugg

SEQ ID NO: 3793084 - RNA, 15 nt, Salmonella typhimurium LT2
gcauuuuuucuucag

SEQ ID NO: 3793085 - RNA, 17 nt, Salmonella typhimurium LT2
gccaaaaaaggcagcca

SEQ ID NO: 3793086 - RNA, 23 nt, Salmonella typhimurium LT2
gccaaaaaaggcagccaggaacg

SEQ ID NO: 3793087 - RNA, 18 nt, Salmonella typhimurium LT2
gccaaaaaaucagcaauc

SEQ ID NO: 3793088 - RNA, 22 nt, Salmonella typhimurium LT2
gccaaaacccaccagcagggca

SEQ ID NO: 3793089 - RNA, 23 nt, Salmonella typhimurium LT2
gccaaaacccagaaucagcaaca

SEQ ID NO: 3793090 - RNA, 19 nt, Salmonella typhimurium LT2
gccaaaauggacagggucg

SEQ ID NO: 3793091 - RNA, 15 nt, Salmonella typhimurium LT2
gccaaaccagacccg

SEQ ID NO: 3793092 - RNA, 17 nt, Salmonella typhimurium LT2
gccaaacccgccacagg

SEQ ID NO: 3793093 - RNA, 17 nt, Salmonella typhimurium LT2
gccaaacccugcgccac

SEQ ID NO: 3793094 - RNA, 17 nt, Salmonella typhimurium LT2
gccaaacgggcaagcca

SEQ ID NO: 3793095 - RNA, 12 nt, Salmonella typhimurium LT2
gccaaagcgccc

SEQ ID NO: 3793096 - RNA, 13 nt, Salmonella typhimurium LT2
gccaaagcgggca

SEQ ID NO: 3793097 - RNA, 12 nt, Salmonella typhimurium LT2
gccaaagggagc

SEQ ID NO: 3793098 - RNA, 16 nt, Salmonella typhimurium LT2
gccaaagggagcagac

SEQ ID NO: 3793099 - RNA, 18 nt, Salmonella typhimurium LT2
gccaaagucauugcugcc

SEQ ID NO: 3793100 - RNA, 15 nt, Salmonella typhimurium LT2
gccacgcccacgcug

SEQ ID NO: 3793101 - RNA, 14 nt, Salmonella typhimurium LT2
gccacgcccgccgc

SEQ ID NO: 3793102 - RNA, 12 nt, Salmonella typhimurium LT2
gccacgccgagg

SEQ ID NO: 3793103 - RNA, 14 nt, Salmonella typhimurium LT2
gccacgccgcccgc

SEQ ID NO: 3793104 - RNA, 22 nt, Salmonella typhimurium LT2
gccacgccguagcugcgcgccg

SEQ ID NO: 3793105 - RNA, 14 nt, Salmonella typhimurium LT2
gccacgcgccagcc

SEQ ID NO: 3793106 - RNA, 16 nt, Salmonella typhimurium LT2
gccacgcgccagccgu

SEQ ID NO: 3793107 - RNA, 17 nt, Salmonella typhimurium LT2
gccacgcucgcuggugc

SEQ ID NO: 3793108 - RNA, 19 nt, Salmonella typhimurium LT2
gccacgcucgcuggugcca

SEQ ID NO: 3793109 - RNA, 22 nt, Salmonella typhimurium LT2
gccacggagagcggcuggaaga

SEQ ID NO: 3793110 - RNA, 15 nt, Salmonella typhimurium LT2
gccacggauggccuc

SEQ ID NO: 3793111 - RNA, 17 nt, Salmonella typhimurium LT2
gccacggccagcagcca

SEQ ID NO: 3793112 - RNA, 24 nt, Salmonella typhimurium LT2
gccacggcuuuuacgccauuggca

SEQ ID NO: 3793113 - RNA, 16 nt, Salmonella typhimurium LT2
gccacggucggcaaug

SEQ ID NO: 3793114 - RNA, 19 nt, Salmonella typhimurium LT2
gccacgguguggcccagcg

SEQ ID NO: 3793115 - RNA, 20 nt, Salmonella typhimurium LT2
gccacguauuucgcagcgau

SEQ ID NO: 3793116 - RNA, 14 nt, Salmonella typhimurium LT2
gccacuaccagcgu

SEQ ID NO: 3793117 - RNA, 13 nt, Salmonella typhimurium LT2
gccacuagcucag

SEQ ID NO: 3793118 - RNA, 17 nt, Salmonella typhimurium LT2
gccacuagcucagcugg

SEQ ID NO: 3793119 - RNA, 13 nt, Salmonella typhimurium LT2
gccacuccgccag

SEQ ID NO: 3793120 - RNA, 14 nt, Salmonella typhimurium LT2
gccacuccgccagu

SEQ ID NO: 3793121 - RNA, 15 nt, Salmonella typhimurium LT2
gccacugcccagaga

SEQ ID NO: 3793122 - RNA, 13 nt, Salmonella typhimurium LT2
gccacugcgccau

SEQ ID NO: 3793123 - RNA, 15 nt, Salmonella typhimurium LT2
gccacugcuggccca

SEQ ID NO: 3793124 - RNA, 11 nt, Salmonella typhimurium LT2
gccacuggccu

SEQ ID NO: 3793125 - RNA, 12 nt, Salmonella typhimurium LT2
gccacuguccug

SEQ ID NO: 3793126 - RNA, 13 nt, Salmonella typhimurium LT2
gccacuguccuga

SEQ ID NO: 3793127 - RNA, 19 nt, Salmonella typhimurium LT2
gccacuucacuggcggcaa

SEQ ID NO: 3793128 - RNA, 22 nt, Salmonella typhimurium LT2
gccacuucacuggcggcaagcu

SEQ ID NO: 3793129 - RNA, 18 nt, Salmonella typhimurium LT2
gccacuuccagcgcgccg

SEQ ID NO: 3793130 - RNA, 21 nt, Salmonella typhimurium LT2
gccacuuccagcgcgccguca

SEQ ID NO: 3793131 - RNA, 12 nt, Salmonella typhimurium LT2
gccacuuccuga

SEQ ID NO: 3793132 - RNA, 14 nt, Salmonella typhimurium LT2
gccacuucuuccag

SEQ ID NO: 3793133 - RNA, 18 nt, Salmonella typhimurium LT2
gccacuucuuccagcggc

SEQ ID NO: 3793134 - RNA, 23 nt, Salmonella typhimurium LT2
gccacuucuuccagcggcaggcc

SEQ ID NO: 3793135 - RNA, 18 nt, Salmonella typhimurium LT2
gccacuucuuugaccagc

SEQ ID NO: 3793136 - RNA, 23 nt, Salmonella typhimurium LT2
gccagaaauugccguacagauug

SEQ ID NO: 3793137 - RNA, 20 nt, Salmonella typhimurium LT2
gccagaagagaagcuuuuuc

SEQ ID NO: 3793138 - RNA, 22 nt, Salmonella typhimurium LT2
gccagaagagaauggccagcac

SEQ ID NO: 3793139 - RNA, 23 nt, Salmonella typhimurium LT2
gccagaagagaauggccagcaca

SEQ ID NO: 3793140 - RNA, 14 nt, Salmonella typhimurium LT2
gccagaauuuccgc

SEQ ID NO: 3793141 - RNA, 19 nt, Salmonella typhimurium LT2
gccagacagauaacaccag

SEQ ID NO: 3793142 - RNA, 13 nt, Salmonella typhimurium LT2
gccagacaggcuu

SEQ ID NO: 3793143 - RNA, 20 nt, Salmonella typhimurium LT2
gccagaccauuaacgccgcc

SEQ ID NO: 3793144 - RNA, 16 nt, Salmonella typhimurium LT2
gccagacccagcgcua

SEQ ID NO: 3793145 - RNA, 14 nt, Salmonella typhimurium LT2
gccagacgccgcgc

SEQ ID NO: 3793146 - RNA, 20 nt, Salmonella typhimurium LT2
gccagacgccgcgccgcggc

SEQ ID NO: 3793147 - RNA, 14 nt, Salmonella typhimurium LT2
gccagacgcgcagc

SEQ ID NO: 3793148 - RNA, 14 nt, Salmonella typhimurium LT2
gccagacucagcca

SEQ ID NO: 3793149 - RNA, 21 nt, Salmonella typhimurium LT2
gccagacucagccaggucuga

SEQ ID NO: 3793150 - RNA, 10 nt, Salmonella typhimurium LT2
gccagagaaa

SEQ ID NO: 3793151 - RNA, 23 nt, Salmonella typhimurium LT2
gccagagaaagucgcuccagggc

SEQ ID NO: 3793152 - RNA, 14 nt, Salmonella typhimurium LT2
gccagagagcguuu

SEQ ID NO: 3793153 - RNA, 18 nt, Salmonella typhimurium LT2
gccagagauaauuuuccc

SEQ ID NO: 3793154 - RNA, 11 nt, Salmonella typhimurium LT2
gccagagcagg

SEQ ID NO: 3793155 - RNA, 16 nt, Salmonella typhimurium LT2
gccagagcgcgcuggc

SEQ ID NO: 3793156 - RNA, 21 nt, Salmonella typhimurium LT2
gccagaggcuaaucaggaaga

SEQ ID NO: 3793157 - RNA, 19 nt, Salmonella typhimurium LT2
gccagauaaagcagcgaca

SEQ ID NO: 3793158 - RNA, 20 nt, Salmonella typhimurium LT2
gccagauaaagcagcgacaa

SEQ ID NO: 3793159 - RNA, 17 nt, Salmonella typhimurium LT2
gccagauaaucgccgcc

SEQ ID NO: 3793160 - RNA, 21 nt, Salmonella typhimurium LT2
gccagauaaucgccgccagcu

SEQ ID NO: 3793161 - RNA, 13 nt, Salmonella typhimurium LT2
gccagauccggcg

SEQ ID NO: 3793162 - RNA, 14 nt, Salmonella typhimurium LT2
gccagaugauagug

SEQ ID NO: 3793163 - RNA, 23 nt, Salmonella typhimurium LT2
gccagaugaucagcauagcgccu

SEQ ID NO: 3793164 - RNA, 15 nt, Salmonella typhimurium LT2
gccagaugcagcggc

SEQ ID NO: 3793165 - RNA, 21 nt, Salmonella typhimurium LT2
gccagaugcccguaaagcucg

SEQ ID NO: 3793166 - RNA, 22 nt, Salmonella typhimurium LT2
gccagauggaaaccggcgucuu

SEQ ID NO: 3793167 - RNA, 21 nt, Salmonella typhimurium LT2
gccagauggauaaccugccgg

SEQ ID NO: 3793168 - RNA, 15 nt, Salmonella typhimurium LT2
gccagaugucgccag

SEQ ID NO: 3793169 - RNA, 22 nt, Salmonella typhimurium LT2
gccagauuaucggccagcgcca

SEQ ID NO: 3793170 - RNA, 18 nt, Salmonella typhimurium LT2
gccagcaacgcccagaua

SEQ ID NO: 3793171 - RNA, 17 nt, Salmonella typhimurium LT2
gccagcaauacccagaa

SEQ ID NO: 3793172 - RNA, 14 nt, Salmonella typhimurium LT2
gccagcaccagcag

SEQ ID NO: 3793173 - RNA, 19 nt, Salmonella typhimurium LT2
gccagcaccagcagcgcau

SEQ ID NO: 3793174 - RNA, 15 nt, Salmonella typhimurium LT2
gccagcaccauggcu

SEQ ID NO: 3793175 - RNA, 14 nt, Salmonella typhimurium LT2
gccagcagcauaaa

SEQ ID NO: 3793176 - RNA, 20 nt, Salmonella typhimurium LT2
gccagcagcauaaaaccgcc

SEQ ID NO: 3793177 - RNA, 18 nt, Salmonella typhimurium LT2
gccagcagggucaggaac

SEQ ID NO: 3793178 - RNA, 11 nt, Salmonella typhimurium LT2
gccagcaguug

SEQ ID NO: 3793179 - RNA, 20 nt, Salmonella typhimurium LT2
gccagcaguuuuucaaucuu

SEQ ID NO: 3793180 - RNA, 23 nt, Salmonella typhimurium LT2
gccagcaguuuuucaaucuuagc

SEQ ID NO: 3793181 - RNA, 17 nt, Salmonella typhimurium LT2
gccagcauacaaagcag

SEQ ID NO: 3793182 - RNA, 13 nt, Salmonella typhimurium LT2
gccagcauauaaa

SEQ ID NO: 3793183 - RNA, 16 nt, Salmonella typhimurium LT2
gccagcaucauggcau

SEQ ID NO: 3793184 - RNA, 16 nt, Salmonella typhimurium LT2
gccagcaugguuaaaa

SEQ ID NO: 3793185 - RNA, 19 nt, Salmonella typhimurium LT2
gccagcauugauuuuucau

SEQ ID NO: 3793186 - RNA, 18 nt, Salmonella typhimurium LT2
gccagccaaaacgucgug

SEQ ID NO: 3793187 - RNA, 12 nt, Salmonella typhimurium LT2
gccagccaaagc

SEQ ID NO: 3793188 - RNA, 18 nt, Salmonella typhimurium LT2
gccagccaaauagcgcca

SEQ ID NO: 3793189 - RNA, 19 nt, Salmonella typhimurium LT2
gccagccaaauagcgccag

SEQ ID NO: 3793190 - RNA, 15 nt, Salmonella typhimurium LT2
gccagccagcgggcu

SEQ ID NO: 3793191 - RNA, 21 nt, Salmonella typhimurium LT2
gccagccagucgccaggcaag

SEQ ID NO: 3793192 - RNA, 22 nt, Salmonella typhimurium LT2
gccagcccagcgcaaccugcgc

SEQ ID NO: 3793193 - RNA, 15 nt, Salmonella typhimurium LT2
gccagccccagcccu

SEQ ID NO: 3793194 - RNA, 22 nt, Salmonella typhimurium LT2
gccagcccgaucaucuccugua

SEQ ID NO: 3793195 - RNA, 12 nt, Salmonella typhimurium LT2
gccagccgcagc

SEQ ID NO: 3793196 - RNA, 18 nt, Salmonella typhimurium LT2
gccagccgccaaaaauau

SEQ ID NO: 3793197 - RNA, 13 nt, Salmonella typhimurium LT2
gccagccgccgcc

SEQ ID NO: 3793198 - RNA, 14 nt, Salmonella typhimurium LT2
gccagccgccgccg

SEQ ID NO: 3793199 - RNA, 14 nt, Salmonella typhimurium LT2
gccagccgcgccau

SEQ ID NO: 3793200 - RNA, 12 nt, Salmonella typhimurium LT2
gccagccggaaa

SEQ ID NO: 3793201 - RNA, 16 nt, Salmonella typhimurium LT2
gccagccguuccgcua

SEQ ID NO: 3793202 - RNA, 21 nt, Salmonella typhimurium LT2
gccagccugaacaucuuccag

SEQ ID NO: 3793203 - RNA, 13 nt, Salmonella typhimurium LT2
gccagccugagga

SEQ ID NO: 3793204 - RNA, 18 nt, Salmonella typhimurium LT2
gccauauugccgcacaug

SEQ ID NO: 3793205 - RNA, 13 nt, Salmonella typhimurium LT2
gccauauugcugu

SEQ ID NO: 3793206 - RNA, 18 nt, Salmonella typhimurium LT2
gccaucaauuuugcgccu

SEQ ID NO: 3793207 - RNA, 13 nt, Salmonella typhimurium LT2
gccaucaccaucg

SEQ ID NO: 3793208 - RNA, 13 nt, Salmonella typhimurium LT2
gccaucacgcugc

SEQ ID NO: 3793209 - RNA, 19 nt, Salmonella typhimurium LT2
gccaucacgcugcggucuu

SEQ ID NO: 3793210 - RNA, 16 nt, Salmonella typhimurium LT2
gccaucagagccgaaa

SEQ ID NO: 3793211 - RNA, 15 nt, Salmonella typhimurium LT2
gccaucaggaaauuc

SEQ ID NO: 3793212 - RNA, 18 nt, Salmonella typhimurium LT2
gccaucaggcaaucuuua

SEQ ID NO: 3793213 - RNA, 17 nt, Salmonella typhimurium LT2
gccaucaggcacaaugc

SEQ ID NO: 3793214 - RNA, 13 nt, Salmonella typhimurium LT2
gccaucaggcacu

SEQ ID NO: 3793215 - RNA, 19 nt, Salmonella typhimurium LT2
gccaucaggcaugaccugc

SEQ ID NO: 3793216 - RNA, 19 nt, Salmonella typhimurium LT2
gccaucaggcaugccaaac

SEQ ID NO: 3793217 - RNA, 19 nt, Salmonella typhimurium LT2
gccaucaggccccccuugu

SEQ ID NO: 3793218 - RNA, 13 nt, Salmonella typhimurium LT2
gccaucaggccua

SEQ ID NO: 3793219 - RNA, 19 nt, Salmonella typhimurium LT2
gccaucaggccuacgauua

SEQ ID NO: 3793220 - RNA, 19 nt, Salmonella typhimurium LT2
gccaucaggcgauggcgca

SEQ ID NO: 3793221 - RNA, 22 nt, Salmonella typhimurium LT2
gccaucaggcgggguuguuuua

SEQ ID NO: 3793222 - RNA, 23 nt, Salmonella typhimurium LT2
gccaucaggcgguuuauccggcg

SEQ ID NO: 3793223 - RNA, 16 nt, Salmonella typhimurium LT2
gccaucaugcaggccg

SEQ ID NO: 3793224 - RNA, 14 nt, Salmonella typhimurium LT2
gccaucaugcccac

SEQ ID NO: 3793225 - RNA, 17 nt, Salmonella typhimurium LT2
gccauccaccaggcaug

SEQ ID NO: 3793226 - RNA, 13 nt, Salmonella typhimurium LT2
gccauccagcacc

SEQ ID NO: 3793227 - RNA, 14 nt, Salmonella typhimurium LT2
gccauccagcacca

SEQ ID NO: 3793228 - RNA, 15 nt, Salmonella typhimurium LT2
gccauccauugcgcc

SEQ ID NO: 3793229 - RNA, 15 nt, Salmonella typhimurium LT2
gccauccgacaacau

SEQ ID NO: 3793230 - RNA, 11 nt, Salmonella typhimurium LT2
gccauccggca

SEQ ID NO: 3793231 - RNA, 12 nt, Salmonella typhimurium LT2
gccauccggcaa

SEQ ID NO: 3793232 - RNA, 15 nt, Salmonella typhimurium LT2
gccauccggcaaaaa

SEQ ID NO: 3793233 - RNA, 21 nt, Salmonella typhimurium LT2
gccauccggcaaaaagcuuac

SEQ ID NO: 3793234 - RNA, 15 nt, Salmonella typhimurium LT2
gccauccggcaaucc

SEQ ID NO: 3793235 - RNA, 16 nt, Salmonella typhimurium LT2
gccauccggcaauuaa

SEQ ID NO: 3793236 - RNA, 13 nt, Salmonella typhimurium LT2
gccauccggcaca

SEQ ID NO: 3793237 - RNA, 23 nt, Salmonella typhimurium LT2
gccauccggcacgccaucgccug

SEQ ID NO: 3793238 - RNA, 20 nt, Salmonella typhimurium LT2
gccauccggcacuacagcgu

SEQ ID NO: 3793239 - RNA, 18 nt, Salmonella typhimurium LT2
gccauccggcaucucuuc

SEQ ID NO: 3793240 - RNA, 20 nt, Salmonella typhimurium LT2
gccaucgacagcagcgcuuu

SEQ ID NO: 3793241 - RNA, 14 nt, Salmonella typhimurium LT2
gccaucgacagcgc

SEQ ID NO: 3793242 - RNA, 15 nt, Salmonella typhimurium LT2
gccaucgacagcgcc

SEQ ID NO: 3793243 - RNA, 22 nt, Salmonella typhimurium LT2
gccaucgacagcgccauauaaa

SEQ ID NO: 3793244 - RNA, 13 nt, Salmonella typhimurium LT2
gccaucgccgcca

SEQ ID NO: 3793245 - RNA, 14 nt, Salmonella typhimurium LT2
gccaucgcggcgca

SEQ ID NO: 3793246 - RNA, 21 nt, Salmonella typhimurium LT2
gccaucggacauauuuuacca

SEQ ID NO: 3793247 - RNA, 16 nt, Salmonella typhimurium LT2
gccaucggccagcagg

SEQ ID NO: 3793248 - RNA, 21 nt, Salmonella typhimurium LT2
gccaucggcuaagccaaaaau

SEQ ID NO: 3793249 - RNA, 17 nt, Salmonella typhimurium LT2
gccaucgggcaauggca

SEQ ID NO: 3793250 - RNA, 17 nt, Salmonella typhimurium LT2
gccaucgggcauuucag

SEQ ID NO: 3793251 - RNA, 23 nt, Salmonella typhimurium LT2
gccaucgucaccggaucgcugag

SEQ ID NO: 3793252 - RNA, 14 nt, Salmonella typhimurium LT2
gccaucucauucgc

SEQ ID NO: 3793253 - RNA, 17 nt, Salmonella typhimurium LT2
gccaucucauucgccag

SEQ ID NO: 3793254 - RNA, 15 nt, Salmonella typhimurium LT2
gccaucuccggcagc

SEQ ID NO: 3793255 - RNA, 16 nt, Salmonella typhimurium LT2
gccaucuucacgcagc

SEQ ID NO: 3793256 - RNA, 14 nt, Salmonella typhimurium LT2
gccaucuuccagca

SEQ ID NO: 3793257 - RNA, 16 nt, Salmonella typhimurium LT2
gccaucuuccagcauc

SEQ ID NO: 3793258 - RNA, 17 nt, Salmonella typhimurium LT2
gccaucuuccagcauca

SEQ ID NO: 3793259 - RNA, 18 nt, Salmonella typhimurium LT2
gccaugacgccaagcugc

SEQ ID NO: 3793260 - RNA, 18 nt, Salmonella typhimurium LT2
gccaugaucgccgccauc

SEQ ID NO: 3793261 - RNA, 21 nt, Salmonella typhimurium LT2
gccaugaucgccgccaucggc

SEQ ID NO: 3793262 - RNA, 16 nt, Salmonella typhimurium LT2
gccaugaugagcgcca

SEQ ID NO: 3793263 - RNA, 14 nt, Salmonella typhimurium LT2
gccaugcauaugaa

SEQ ID NO: 3793264 - RNA, 14 nt, Salmonella typhimurium LT2
gccaugccagcagu

SEQ ID NO: 3793265 - RNA, 15 nt, Salmonella typhimurium LT2
gccaugcccggcggc

SEQ ID NO: 3793266 - RNA, 16 nt, Salmonella typhimurium LT2
gccaugcccggcggcg

SEQ ID NO: 3793267 - RNA, 17 nt, Salmonella typhimurium LT2
gccaugcccggcggcgg

SEQ ID NO: 3793268 - RNA, 13 nt, Salmonella typhimurium LT2
gccaugccgaaga

SEQ ID NO: 3793269 - RNA, 16 nt, Salmonella typhimurium LT2
gccaugcgcggcauca

SEQ ID NO: 3793270 - RNA, 22 nt, Salmonella typhimurium LT2
gccaugcgcggcaucagccugc

SEQ ID NO: 3793271 - RNA, 13 nt, Salmonella typhimurium LT2
gccauggccgcag

SEQ ID NO: 3793272 - RNA, 15 nt, Salmonella typhimurium LT2
gccauggccgcagcc

SEQ ID NO: 3793273 - RNA, 16 nt, Salmonella typhimurium LT2
gccaugucuuuuucag

SEQ ID NO: 3793274 - RNA, 16 nt, Salmonella typhimurium LT2
gccauguuaauaccag

SEQ ID NO: 3793275 - RNA, 19 nt, Salmonella typhimurium LT2
gccauguugcguaaauaaa

SEQ ID NO: 3793276 - RNA, 17 nt, Salmonella typhimurium LT2
gccauuaaacucaucgc

SEQ ID NO: 3793277 - RNA, 13 nt, Salmonella typhimurium LT2
gccauuaaccaga

SEQ ID NO: 3793278 - RNA, 19 nt, Salmonella typhimurium LT2
gccauuaaugcaggcagca

SEQ ID NO: 3793279 - RNA, 14 nt, Salmonella typhimurium LT2
gccauuaucaccau

SEQ ID NO: 3793280 - RNA, 22 nt, Salmonella typhimurium LT2
gccauuaucaccauucccagcg

SEQ ID NO: 3793281 - RNA, 13 nt, Salmonella typhimurium LT2
gccauuccaagaa

SEQ ID NO: 3793282 - RNA, 14 nt, Salmonella typhimurium LT2
gccauuccagccgg

SEQ ID NO: 3793283 - RNA, 12 nt, Salmonella typhimurium LT2
gccauuccagcu

SEQ ID NO: 3793284 - RNA, 23 nt, Salmonella typhimurium LT2
gccauuccccacgccaucgcggc

SEQ ID NO: 3793285 - RNA, 18 nt, Salmonella typhimurium LT2
gccauuccgcuucuucca

SEQ ID NO: 3793286 - RNA, 20 nt, Salmonella typhimurium LT2
gccauuccuuuaaauauccg

SEQ ID NO: 3793287 - RNA, 19 nt, Salmonella typhimurium LT2
gccauucgcccagucauca

SEQ ID NO: 3793288 - RNA, 21 nt, Salmonella typhimurium LT2
gccauucgcuuccgccgggaa

SEQ ID NO: 3793289 - RNA, 13 nt, Salmonella typhimurium LT2
gccauugaagucc

SEQ ID NO: 3793290 - RNA, 12 nt, Salmonella typhimurium LT2
gccauugccgcg

SEQ ID NO: 3793291 - RNA, 20 nt, Salmonella typhimurium LT2
gccauuucaauaauauguuc

SEQ ID NO: 3793292 - RNA, 13 nt, Salmonella typhimurium LT2
gccauuuccagcc

SEQ ID NO: 3793293 - RNA, 17 nt, Salmonella typhimurium LT2
gccauuuccugauuuuu

SEQ ID NO: 3793294 - RNA, 18 nt, Salmonella typhimurium LT2
gccauuucugcucacggu

SEQ ID NO: 3793295 - RNA, 16 nt, Salmonella typhimurium LT2
gcccaaaacgcgccag

SEQ ID NO: 3793296 - RNA, 18 nt, Salmonella typhimurium LT2
gcccaaaacgcgccaggu

SEQ ID NO: 3793297 - RNA, 15 nt, Salmonella typhimurium LT2
gcccaaaaugcggca

SEQ ID NO: 3793298 - RNA, 22 nt, Salmonella typhimurium LT2
gcccaaaaugcggcauccggcu

SEQ ID NO: 3793299 - RNA, 16 nt, Salmonella typhimurium LT2
gcccaaauaguccagc

SEQ ID NO: 3793300 - RNA, 18 nt, Salmonella typhimurium LT2
gcccaaauaguccagcag

SEQ ID NO: 3793301 - RNA, 19 nt, Salmonella typhimurium LT2
gcccaaauaguccagcagc

SEQ ID NO: 3793302 - RNA, 20 nt, Salmonella typhimurium LT2
gcccaaauaguccagcagcc

SEQ ID NO: 3793303 - RNA, 16 nt, Salmonella typhimurium LT2
gcccaacaccagcacu

SEQ ID NO: 3793304 - RNA, 19 nt, Salmonella typhimurium LT2
gcccaacagcaauguuuca

SEQ ID NO: 3793305 - RNA, 13 nt, Salmonella typhimurium LT2
gcccaaccagugg

SEQ ID NO: 3793306 - RNA, 16 nt, Salmonella typhimurium LT2
gcccaacugccagcgg

SEQ ID NO: 3793307 - RNA, 17 nt, Salmonella typhimurium LT2
gcccaacugccagcgga

SEQ ID NO: 3793308 - RNA, 19 nt, Salmonella typhimurium LT2
gcccacaaugacagaaaug

SEQ ID NO: 3793309 - RNA, 15 nt, Salmonella typhimurium LT2
gcccgagcgcuggca

SEQ ID NO: 3793310 - RNA, 19 nt, Salmonella typhimurium LT2
gcccgauaagcaaagcgcc

SEQ ID NO: 3793311 - RNA, 19 nt, Salmonella typhimurium LT2
gcccgauaagcaagcgcca

SEQ ID NO: 3793312 - RNA, 13 nt, Salmonella typhimurium LT2
gcccgaucguccg

SEQ ID NO: 3793313 - RNA, 20 nt, Salmonella typhimurium LT2
gcccgauggcgcugcgcgca

SEQ ID NO: 3793314 - RNA, 21 nt, Salmonella typhimurium LT2
gcccgauggcgcugcgcgcau

SEQ ID NO: 3793315 - RNA, 23 nt, Salmonella typhimurium LT2
gcccgcaaucucuggccaggcau

SEQ ID NO: 3793316 - RNA, 17 nt, Salmonella typhimurium LT2
gcccgcacucgcgcuuc

SEQ ID NO: 3793317 - RNA, 16 nt, Salmonella typhimurium LT2
gcccgcauucgcggca

SEQ ID NO: 3793318 - RNA, 16 nt, Salmonella typhimurium LT2
gcccgccaauauccgg

SEQ ID NO: 3793319 - RNA, 12 nt, Salmonella typhimurium LT2
gcccgccagcac

SEQ ID NO: 3793320 - RNA, 14 nt, Salmonella typhimurium LT2
gcccgccagcacag

SEQ ID NO: 3793321 - RNA, 13 nt, Salmonella typhimurium LT2
gcccgccagcaua

SEQ ID NO: 3793322 - RNA, 13 nt, Salmonella typhimurium LT2
gcccgccagcggg

SEQ ID NO: 3793323 - RNA, 13 nt, Salmonella typhimurium LT2
gcccgccgccaau

SEQ ID NO: 3793324 - RNA, 18 nt, Salmonella typhimurium LT2
gcccgccgccugaugcug

SEQ ID NO: 3793325 - RNA, 13 nt, Salmonella typhimurium LT2
gcccgcgccaucc

SEQ ID NO: 3793326 - RNA, 23 nt, Salmonella typhimurium LT2
gcccgcgccgggguggauggcgc

SEQ ID NO: 3793327 - RNA, 18 nt, Salmonella typhimurium LT2
gcccgcgucguugaugca

SEQ ID NO: 3793328 - RNA, 21 nt, Salmonella typhimurium LT2
gcccgcguugcgccaagcgcc

SEQ ID NO: 3793329 - RNA, 13 nt, Salmonella typhimurium LT2
gcccgcugcgcac

SEQ ID NO: 3793330 - RNA, 14 nt, Salmonella typhimurium LT2
gcccgcugcgccgc

SEQ ID NO: 3793331 - RNA, 22 nt, Salmonella typhimurium LT2
gcccgcuucauuggcgucugcu

SEQ ID NO: 3793332 - RNA, 14 nt, Salmonella typhimurium LT2
gcccgcuuccguca

SEQ ID NO: 3793333 - RNA, 20 nt, Salmonella typhimurium LT2
gcccggaaauaaacgccagu

SEQ ID NO: 3793334 - RNA, 20 nt, Salmonella typhimurium LT2
gcccggacgaaccuggcggu

SEQ ID NO: 3793335 - RNA, 19 nt, Salmonella typhimurium LT2
gcccggacgccguccaggc

SEQ ID NO: 3793336 - RNA, 21 nt, Salmonella typhimurium LT2
gcccggagggguuuucgccag

SEQ ID NO: 3793337 - RNA, 21 nt, Salmonella typhimurium LT2
gcccggauaacggcgcgaaag

SEQ ID NO: 3793338 - RNA, 14 nt, Salmonella typhimurium LT2
gcccggaucgccau

SEQ ID NO: 3793339 - RNA, 14 nt, Salmonella typhimurium LT2
gcccggcaaacggg

SEQ ID NO: 3793340 - RNA, 21 nt, Salmonella typhimurium LT2
gcccggcaggcaucgcgccgc

SEQ ID NO: 3793341 - RNA, 21 nt, Salmonella typhimurium LT2
gcccggcaugucgccagccag

SEQ ID NO: 3793342 - RNA, 11 nt, Salmonella typhimurium LT2
gcccggccagu

SEQ ID NO: 3793343 - RNA, 17 nt, Salmonella typhimurium LT2
gcccggcgccauccggc

SEQ ID NO: 3793344 - RNA, 17 nt, Salmonella typhimurium LT2
gcccggcgcgacaccuu

SEQ ID NO: 3793345 - RNA, 13 nt, Salmonella typhimurium LT2
gcccggcgcggca

SEQ ID NO: 3793346 - RNA, 18 nt, Salmonella typhimurium LT2
gcccggcggcacggcgcu

SEQ ID NO: 3793347 - RNA, 11 nt, Salmonella typhimurium LT2
gcccggcggcg

SEQ ID NO: 3793348 - RNA, 21 nt, Salmonella typhimurium LT2
gcccggcggcgcgaugccugc

SEQ ID NO: 3793349 - RNA, 13 nt, Salmonella typhimurium LT2
gcccggcggcggc

SEQ ID NO: 3793350 - RNA, 21 nt, Salmonella typhimurium LT2
gcccggcguucucccgggccg

SEQ ID NO: 3793351 - RNA, 23 nt, Salmonella typhimurium LT2
gcccggcuccgucauauuuucag

SEQ ID NO: 3793352 - RNA, 13 nt, Salmonella typhimurium LT2
gcccggcuggcga

SEQ ID NO: 3793353 - RNA, 14 nt, Salmonella typhimurium LT2
gcccggcuucccau

SEQ ID NO: 3793354 - RNA, 15 nt, Salmonella typhimurium LT2
gcccggcuuucuguu

SEQ ID NO: 3793355 - RNA, 21 nt, Salmonella typhimurium LT2
gcccgggagaacgccgggccu

SEQ ID NO: 3793356 - RNA, 16 nt, Salmonella typhimurium LT2
gcccggguaaugcugc

SEQ ID NO: 3793357 - RNA, 15 nt, Salmonella typhimurium LT2
gcccgguaaacgcuu

SEQ ID NO: 3793358 - RNA, 16 nt, Salmonella typhimurium LT2
gcccgguaagcacaac

SEQ ID NO: 3793359 - RNA, 20 nt, Salmonella typhimurium LT2
gcccgguaagcgcagcgcca

SEQ ID NO: 3793360 - RNA, 19 nt, Salmonella typhimurium LT2
gcccggucacacuuaccgg

SEQ ID NO: 3793361 - RNA, 19 nt, Salmonella typhimurium LT2
gcccggugauggugcagcc

SEQ ID NO: 3793362 - RNA, 15 nt, Salmonella typhimurium LT2
gcccgguggcgccgc

SEQ ID NO: 3793363 - RNA, 14 nt, Salmonella typhimurium LT2
gcccgguggcgcug

SEQ ID NO: 3793364 - RNA, 13 nt, Salmonella typhimurium LT2
gcccgguucaccg

SEQ ID NO: 3793365 - RNA, 20 nt, Salmonella typhimurium LT2
gcccgguucgaacgacagaa

SEQ ID NO: 3793366 - RNA, 19 nt, Salmonella typhimurium LT2
gcccguaccgcggcgcugc

SEQ ID NO: 3793367 - RNA, 17 nt, Salmonella typhimurium LT2
gcccguagcgacgccau

SEQ ID NO: 3793368 - RNA, 18 nt, Salmonella typhimurium LT2
gcccguaucacugauaua

SEQ ID NO: 3793369 - RNA, 23 nt, Salmonella typhimurium LT2
gcccgucaccauuaacaucagaa

SEQ ID NO: 3793370 - RNA, 23 nt, Salmonella typhimurium LT2
gcccgucagagcgaggcccaucg

SEQ ID NO: 3793371 - RNA, 14 nt, Salmonella typhimurium LT2
gcccgugacgccag

SEQ ID NO: 3793372 - RNA, 24 nt, Salmonella typhimurium LT2
gcccgugaucggagaaauagacga

SEQ ID NO: 3793373 - RNA, 14 nt, Salmonella typhimurium LT2
gcccguucucgccg

SEQ ID NO: 3793374 - RNA, 17 nt, Salmonella typhimurium LT2
gcccguucucgccgcgu

SEQ ID NO: 3793375 - RNA, 18 nt, Salmonella typhimurium LT2
gcccguucucgccgcguu

SEQ ID NO: 3793376 - RNA, 14 nt, Salmonella typhimurium LT2
gcccguuuuaccgg

SEQ ID NO: 3793377 - RNA, 15 nt, Salmonella typhimurium LT2
gcccguuuuuuccag

SEQ ID NO: 3793378 - RNA, 20 nt, Salmonella typhimurium LT2
gcccucaacauugccggcau

SEQ ID NO: 3793379 - RNA, 19 nt, Salmonella typhimurium LT2
gcccucuuccagcgccaaa

SEQ ID NO: 3793380 - RNA, 16 nt, Salmonella typhimurium LT2
gcccucuuccggcgcu

SEQ ID NO: 3793381 - RNA, 19 nt, Salmonella typhimurium LT2
gcccugaagggcggcugga

SEQ ID NO: 3793382 - RNA, 23 nt, Salmonella typhimurium LT2
gcccugaagggcggcuggauaaa

SEQ ID NO: 3793383 - RNA, 22 nt, Salmonella typhimurium LT2
gcccugaggaguauuauccauu

SEQ ID NO: 3793384 - RNA, 16 nt, Salmonella typhimurium LT2
gcccugaucccacagc

SEQ ID NO: 3793385 - RNA, 23 nt, Salmonella typhimurium LT2
gcccugaugauuuaaaaguacaa

SEQ ID NO: 3793386 - RNA, 13 nt, Salmonella typhimurium LT2
gcccugauggcgc

SEQ ID NO: 3793387 - RNA, 16 nt, Salmonella typhimurium LT2
gcccugauggcgcgcc

SEQ ID NO: 3793388 - RNA, 13 nt, Salmonella typhimurium LT2
gcccugcaaaagu

SEQ ID NO: 3793389 - RNA, 12 nt, Salmonella typhimurium LT2
gcccugccacca

SEQ ID NO: 3793390 - RNA, 14 nt, Salmonella typhimurium LT2
gcccugccaccagc

SEQ ID NO: 3793391 - RNA, 15 nt, Salmonella typhimurium LT2
gcccugccaccagcg

SEQ ID NO: 3793392 - RNA, 18 nt, Salmonella typhimurium LT2
gcccugcccaugaagcga

SEQ ID NO: 3793393 - RNA, 15 nt, Salmonella typhimurium LT2
gcccugcccgccagg

SEQ ID NO: 3793394 - RNA, 17 nt, Salmonella typhimurium LT2
gcccugcgccucaagcg

SEQ ID NO: 3793395 - RNA, 21 nt, Salmonella typhimurium LT2
gcccugcuugucgaucaucag

SEQ ID NO: 3793396 - RNA, 14 nt, Salmonella typhimurium LT2
gcccuguccuccau

SEQ ID NO: 3793397 - RNA, 18 nt, Salmonella typhimurium LT2
gcccugugccgcuggugc

SEQ ID NO: 3793398 - RNA, 18 nt, Salmonella typhimurium LT2
gcccuguuucgcaggccg

SEQ ID NO: 3793399 - RNA, 21 nt, Salmonella typhimurium LT2
gcccuuacaaaaaucaugcca

SEQ ID NO: 3793400 - RNA, 12 nt, Salmonella typhimurium LT2
gcccuuccagcu

SEQ ID NO: 3793401 - RNA, 17 nt, Salmonella typhimurium LT2
gcccuuccgucagcguc

SEQ ID NO: 3793402 - RNA, 22 nt, Salmonella typhimurium LT2
gcccuucgcccaucgccgccuc

SEQ ID NO: 3793403 - RNA, 22 nt, Salmonella typhimurium LT2
gcccuucgucaggaggccugaa

SEQ ID NO: 3793404 - RNA, 19 nt, Salmonella typhimurium LT2
gcccuucuccggucaucac

SEQ ID NO: 3793405 - RNA, 17 nt, Salmonella typhimurium LT2
gcccuuuaguaaaguua

SEQ ID NO: 3793406 - RNA, 14 nt, Salmonella typhimurium LT2
gcccuuucaguuca

SEQ ID NO: 3793407 - RNA, 11 nt, Salmonella typhimurium LT2
gcccuuucuua

SEQ ID NO: 3793408 - RNA, 13 nt, Salmonella typhimurium LT2
gcccuuucuucaa

SEQ ID NO: 3793409 - RNA, 12 nt, Salmonella typhimurium LT2
gcccuuugcccu

SEQ ID NO: 3793410 - RNA, 12 nt, Salmonella typhimurium LT2
gccgaaagcgau

SEQ ID NO: 3793411 - RNA, 18 nt, Salmonella typhimurium LT2
gccgaaagcgaucacauu

SEQ ID NO: 3793412 - RNA, 12 nt, Salmonella typhimurium LT2
gccgaacaggcc

SEQ ID NO: 3793413 - RNA, 14 nt, Salmonella typhimurium LT2
gccgcccagcgaac

SEQ ID NO: 3793414 - RNA, 21 nt, Salmonella typhimurium LT2
gccgcccaggccugauaagcg

SEQ ID NO: 3793415 - RNA, 12 nt, Salmonella typhimurium LT2
gccgcccaucaa

SEQ ID NO: 3793416 - RNA, 15 nt, Salmonella typhimurium LT2
gccgcccaucaauac

SEQ ID NO: 3793417 - RNA, 22 nt, Salmonella typhimurium LT2
gccgcccaucaauaccagcccc

SEQ ID NO: 3793418 - RNA, 19 nt, Salmonella typhimurium LT2
gccgcccaucgccacagcg

SEQ ID NO: 3793419 - RNA, 18 nt, Salmonella typhimurium LT2
gccgcccccaugccgccu

SEQ ID NO: 3793420 - RNA, 23 nt, Salmonella typhimurium LT2
gccgcccgcaugguaaacgcauc

SEQ ID NO: 3793421 - RNA, 16 nt, Salmonella typhimurium LT2
gccgccgacaaccagc

SEQ ID NO: 3793422 - RNA, 17 nt, Salmonella typhimurium LT2
gccgccgacaggauguc

SEQ ID NO: 3793423 - RNA, 14 nt, Salmonella typhimurium LT2
gccgccgagcgccg

SEQ ID NO: 3793424 - RNA, 11 nt, Salmonella typhimurium LT2
gccgccgcagg

SEQ ID NO: 3793425 - RNA, 14 nt, Salmonella typhimurium LT2
gccgccgcaggaca

SEQ ID NO: 3793426 - RNA, 16 nt, Salmonella typhimurium LT2
gccgccgcaggacagc

SEQ ID NO: 3793427 - RNA, 12 nt, Salmonella typhimurium LT2
gccgccgccagg

SEQ ID NO: 3793428 - RNA, 13 nt, Salmonella typhimurium LT2
gccgccgccaucg

SEQ ID NO: 3793429 - RNA, 14 nt, Salmonella typhimurium LT2
gccgccgccugcca

SEQ ID NO: 3793430 - RNA, 15 nt, Salmonella typhimurium LT2
gccgccgcgcucgcg

SEQ ID NO: 3793431 - RNA, 22 nt, Salmonella typhimurium LT2
gccgccgggaucagcggcugca

SEQ ID NO: 3793432 - RNA, 18 nt, Salmonella typhimurium LT2
gccgccgggcuucacggu

SEQ ID NO: 3793433 - RNA, 18 nt, Salmonella typhimurium LT2
gccgccgggucaccgggg

SEQ ID NO: 3793434 - RNA, 19 nt, Salmonella typhimurium LT2
gccgccggugucuccguca

SEQ ID NO: 3793435 - RNA, 15 nt, Salmonella typhimurium LT2
gccgccguaacgugc

SEQ ID NO: 3793436 - RNA, 21 nt, Salmonella typhimurium LT2
gccgccguaacgugcuccagc

SEQ ID NO: 3793437 - RNA, 15 nt, Salmonella typhimurium LT2
gccgccguccaggcc

SEQ ID NO: 3793438 - RNA, 20 nt, Salmonella typhimurium LT2
gccgccgugguaaauacgcu

SEQ ID NO: 3793439 - RNA, 16 nt, Salmonella typhimurium LT2
gccgccguuuuauuug

SEQ ID NO: 3793440 - RNA, 17 nt, Salmonella typhimurium LT2
gccgccuaucgccagca

SEQ ID NO: 3793441 - RNA, 13 nt, Salmonella typhimurium LT2
gccgccucccccu

SEQ ID NO: 3793442 - RNA, 14 nt, Salmonella typhimurium LT2
gccgccucccccuc

SEQ ID NO: 3793443 - RNA, 19 nt, Salmonella typhimurium LT2
gccgccucgcguagcgcca

SEQ ID NO: 3793444 - RNA, 22 nt, Salmonella typhimurium LT2
gccgccucgcuuaaaccaccau

SEQ ID NO: 3793445 - RNA, 14 nt, Salmonella typhimurium LT2
gccgccugaugcug

SEQ ID NO: 3793446 - RNA, 15 nt, Salmonella typhimurium LT2
gccgccugaugcugg

SEQ ID NO: 3793447 - RNA, 12 nt, Salmonella typhimurium LT2
gccgccugcacg

SEQ ID NO: 3793448 - RNA, 22 nt, Salmonella typhimurium LT2
gccgccugcacggcgucaucca

SEQ ID NO: 3793449 - RNA, 13 nt, Salmonella typhimurium LT2
gccgccuggccug

SEQ ID NO: 3793450 - RNA, 17 nt, Salmonella typhimurium LT2
gccgcgacagucgcaga

SEQ ID NO: 3793451 - RNA, 21 nt, Salmonella typhimurium LT2
gccgcgagaaauaccaaauau

SEQ ID NO: 3793452 - RNA, 24 nt, Salmonella typhimurium LT2
gccgcgauacauugucgcagcgcu

SEQ ID NO: 3793453 - RNA, 20 nt, Salmonella typhimurium LT2
gccgcgauagaccacgccau

SEQ ID NO: 3793454 - RNA, 20 nt, Salmonella typhimurium LT2
gccgcgauguuugcucgcca

SEQ ID NO: 3793455 - RNA, 20 nt, Salmonella typhimurium LT2
gccgcgcacgccgcucgaau

SEQ ID NO: 3793456 - RNA, 13 nt, Salmonella typhimurium LT2
gccgcgcagcgca

SEQ ID NO: 3793457 - RNA, 17 nt, Salmonella typhimurium LT2
gccgcgccaccgggccg

SEQ ID NO: 3793458 - RNA, 20 nt, Salmonella typhimurium LT2
gccgcgccagaccgcuuaac

SEQ ID NO: 3793459 - RNA, 13 nt, Salmonella typhimurium LT2
gccgcgccagacg

SEQ ID NO: 3793460 - RNA, 19 nt, Salmonella typhimurium LT2
gccgcgccagacgcccuuc

SEQ ID NO: 3793461 - RNA, 13 nt, Salmonella typhimurium LT2
gccgcgcccagca

SEQ ID NO: 3793462 - RNA, 13 nt, Salmonella typhimurium LT2
gccgcgcccagcg

SEQ ID NO: 3793463 - RNA, 17 nt, Salmonella typhimurium LT2
gccgcgccgacauagcu

SEQ ID NO: 3793464 - RNA, 12 nt, Salmonella typhimurium LT2
gccgcgccgccg

SEQ ID NO: 3793465 - RNA, 14 nt, Salmonella typhimurium LT2
gccgcgccgcgcac

SEQ ID NO: 3793466 - RNA, 17 nt, Salmonella typhimurium LT2
gccgcgccggacuccag

SEQ ID NO: 3793467 - RNA, 21 nt, Salmonella typhimurium LT2
gccgcgccggacuccagcaac

SEQ ID NO: 3793468 - RNA, 18 nt, Salmonella typhimurium LT2
gccgcgccgggagcguua

SEQ ID NO: 3793469 - RNA, 18 nt, Salmonella typhimurium LT2
gccgcgccuaccagcgcu

SEQ ID NO: 3793470 - RNA, 14 nt, Salmonella typhimurium LT2
gccgcgcgccgccu

SEQ ID NO: 3793471 - RNA, 18 nt, Salmonella typhimurium LT2
gccgcgcgccgccucuuc

SEQ ID NO: 3793472 - RNA, 19 nt, Salmonella typhimurium LT2
gccgcgcguaaauaccacc

SEQ ID NO: 3793473 - RNA, 13 nt, Salmonella typhimurium LT2
gccgcgcuggaua

SEQ ID NO: 3793474 - RNA, 14 nt, Salmonella typhimurium LT2
gccgcgcugguugg

SEQ ID NO: 3793475 - RNA, 24 nt, Salmonella typhimurium LT2
gccgcggaccuuuugccgcccagu

SEQ ID NO: 3793476 - RNA, 16 nt, Salmonella typhimurium LT2
gccgcguuucucgccg

SEQ ID NO: 3793477 - RNA, 16 nt, Salmonella typhimurium LT2
gccgcguuuugccgcu

SEQ ID NO: 3793478 - RNA, 19 nt, Salmonella typhimurium LT2
gccgcuaaaacacccgcaa

SEQ ID NO: 3793479 - RNA, 19 nt, Salmonella typhimurium LT2
gccgcuacucagcccaucc

SEQ ID NO: 3793480 - RNA, 17 nt, Salmonella typhimurium LT2
gccgcuacugccgccau

SEQ ID NO: 3793481 - RNA, 19 nt, Salmonella typhimurium LT2
gccgcuacugccgccaucg

SEQ ID NO: 3793482 - RNA, 13 nt, Salmonella typhimurium LT2
gccgcuaugacga

SEQ ID NO: 3793483 - RNA, 19 nt, Salmonella typhimurium LT2
gccgcuaugcaauuguucc

SEQ ID NO: 3793484 - RNA, 19 nt, Salmonella typhimurium LT2
gccgcucaggguaaucacc

SEQ ID NO: 3793485 - RNA, 22 nt, Salmonella typhimurium LT2
gccgcucgccugcgcucauaua

SEQ ID NO: 3793486 - RNA, 14 nt, Salmonella typhimurium LT2
gccgcugagaaaaa

SEQ ID NO: 3793487 - RNA, 19 nt, Salmonella typhimurium LT2
gccgcugagaaaaagcgaa

SEQ ID NO: 3793488 - RNA, 18 nt, Salmonella typhimurium LT2
gccgcugcgagcagcgaa

SEQ ID NO: 3793489 - RNA, 14 nt, Salmonella typhimurium LT2
gccgcugcuggcga

SEQ ID NO: 3793490 - RNA, 17 nt, Salmonella typhimurium LT2
gccgcuggcgaccagcc

SEQ ID NO: 3793491 - RNA, 16 nt, Salmonella typhimurium LT2
gccgcuggucaacacg

SEQ ID NO: 3793492 - RNA, 17 nt, Salmonella typhimurium LT2
gccgcugucgccagaau

SEQ ID NO: 3793493 - RNA, 18 nt, Salmonella typhimurium LT2
gccgcugucgccagaaug

SEQ ID NO: 3793494 - RNA, 17 nt, Salmonella typhimurium LT2
gccgcuuccggcaggua

SEQ ID NO: 3793495 - RNA, 20 nt, Salmonella typhimurium LT2
gccgcuugccaguacgccag

SEQ ID NO: 3793496 - RNA, 18 nt, Salmonella typhimurium LT2
gccgcuuuaccgccuucc

SEQ ID NO: 3793497 - RNA, 23 nt, Salmonella typhimurium LT2
gccgcuuuccgccgccgccaucg

SEQ ID NO: 3793498 - RNA, 24 nt, Salmonella typhimurium LT2
gccgcuuuuuaauuuaugcgccag

SEQ ID NO: 3793499 - RNA, 19 nt, Salmonella typhimurium LT2
gccgcuuuuuccgccgccg

SEQ ID NO: 3793500 - RNA, 21 nt, Salmonella typhimurium LT2
gccgcuuuuuccgccgccgug

SEQ ID NO: 3793501 - RNA, 22 nt, Salmonella typhimurium LT2
gccggaaagaauaaucgccgcc

SEQ ID NO: 3793502 - RNA, 23 nt, Salmonella typhimurium LT2
gccggaaaggauauaagcgccau

SEQ ID NO: 3793503 - RNA, 16 nt, Salmonella typhimurium LT2
gccggaacucuuguua

SEQ ID NO: 3793504 - RNA, 16 nt, Salmonella typhimurium LT2
gccggaauagcaggca

SEQ ID NO: 3793505 - RNA, 22 nt, Salmonella typhimurium LT2
gccggaaucgcgauccagcccc

SEQ ID NO: 3793506 - RNA, 14 nt, Salmonella typhimurium LT2
gccggacaggcgac

SEQ ID NO: 3793507 - RNA, 12 nt, Salmonella typhimurium LT2
gccggaccugcg

SEQ ID NO: 3793508 - RNA, 16 nt, Salmonella typhimurium LT2
gccggacgccacgcuc

SEQ ID NO: 3793509 - RNA, 14 nt, Salmonella typhimurium LT2
gccggacggcggcu

SEQ ID NO: 3793510 - RNA, 17 nt, Salmonella typhimurium LT2
gccggacggcggcugcg

SEQ ID NO: 3793511 - RNA, 13 nt, Salmonella typhimurium LT2
gccggacuccagc

SEQ ID NO: 3793512 - RNA, 13 nt, Salmonella typhimurium LT2
gccggagaccggc

SEQ ID NO: 3793513 - RNA, 12 nt, Salmonella typhimurium LT2
gccggagaccuu

SEQ ID NO: 3793514 - RNA, 21 nt, Salmonella typhimurium LT2
gccggagaguucauagcgcac

SEQ ID NO: 3793515 - RNA, 16 nt, Salmonella typhimurium LT2
gccggagcugauacgg

SEQ ID NO: 3793516 - RNA, 20 nt, Salmonella typhimurium LT2
gccggauaagcaaagcgcca

SEQ ID NO: 3793517 - RNA, 21 nt, Salmonella typhimurium LT2
gccguggcggugacuuccuga

SEQ ID NO: 3793518 - RNA, 16 nt, Salmonella typhimurium LT2
gccguuaacgggucuu

SEQ ID NO: 3793519 - RNA, 23 nt, Salmonella typhimurium LT2
gccguuaaucgauaagccagcga

SEQ ID NO: 3793520 - RNA, 15 nt, Salmonella typhimurium LT2
gccguuaauuuucac

SEQ ID NO: 3793521 - RNA, 15 nt, Salmonella typhimurium LT2
gccguuaccguggcg

SEQ ID NO: 3793522 - RNA, 19 nt, Salmonella typhimurium LT2
gccguuauccagucgccag

SEQ ID NO: 3793523 - RNA, 23 nt, Salmonella typhimurium LT2
gccguucaaagccgccauccggc

SEQ ID NO: 3793524 - RNA, 15 nt, Salmonella typhimurium LT2
gccguucauuugcaa

SEQ ID NO: 3793525 - RNA, 14 nt, Salmonella typhimurium LT2
gccguuccauucca

SEQ ID NO: 3793526 - RNA, 13 nt, Salmonella typhimurium LT2
gccguuccgcaac

SEQ ID NO: 3793527 - RNA, 23 nt, Salmonella typhimurium LT2
gccguugaguuugacugccagac

SEQ ID NO: 3793528 - RNA, 22 nt, Salmonella typhimurium LT2
gccguugcgucaaugcccggca

SEQ ID NO: 3793529 - RNA, 22 nt, Salmonella typhimurium LT2
gccguugcuguuccagccgcca

SEQ ID NO: 3793530 - RNA, 19 nt, Salmonella typhimurium LT2
gccguuuuagguucuucaa

SEQ ID NO: 3793531 - RNA, 20 nt, Salmonella typhimurium LT2
gccguuuuccggucgcgcaa

SEQ ID NO: 3793532 - RNA, 17 nt, Salmonella typhimurium LT2
gccguuuuggcagcgcc

SEQ ID NO: 3793533 - RNA, 18 nt, Salmonella typhimurium LT2
gccguuuuggcagcgccc

SEQ ID NO: 3793534 - RNA, 14 nt, Salmonella typhimurium LT2
gccuaacagcgccg

SEQ ID NO: 3793535 - RNA, 15 nt, Salmonella typhimurium LT2
gccuaacgccagcau

SEQ ID NO: 3793536 - RNA, 17 nt, Salmonella typhimurium LT2
gccuaacuggaaaaaga

SEQ ID NO: 3793537 - RNA, 16 nt, Salmonella typhimurium LT2
gccuaagaccagcacc

SEQ ID NO: 3793538 - RNA, 18 nt, Salmonella typhimurium LT2
gccuaagcccaccaucag

SEQ ID NO: 3793539 - RNA, 12 nt, Salmonella typhimurium LT2
gccuaaugacgg

SEQ ID NO: 3793540 - RNA, 22 nt, Salmonella typhimurium LT2
gccuaaugacggacgcagacca

SEQ ID NO: 3793541 - RNA, 14 nt, Salmonella typhimurium LT2
gccuaaugagccag

SEQ ID NO: 3793542 - RNA, 12 nt, Salmonella typhimurium LT2
gccuacaaagcc

SEQ ID NO: 3793543 - RNA, 11 nt, Salmonella typhimurium LT2
gccuacagcau

SEQ ID NO: 3793544 - RNA, 16 nt, Salmonella typhimurium LT2
gccuacagcaucccgc

SEQ ID NO: 3793545 - RNA, 14 nt, Salmonella typhimurium LT2
gccuaccagcgcua

SEQ ID NO: 3793546 - RNA, 15 nt, Salmonella typhimurium LT2
gccuacccgcgugcg

SEQ ID NO: 3793547 - RNA, 15 nt, Salmonella typhimurium LT2
gccuaccgauaaauc

SEQ ID NO: 3793548 - RNA, 22 nt, Salmonella typhimurium LT2
gccuaccgauaaaucaaacgca

SEQ ID NO: 3793549 - RNA, 13 nt, Salmonella typhimurium LT2
gccuaccgccaua

SEQ ID NO: 3793550 - RNA, 15 nt, Salmonella typhimurium LT2
gccuaccugccgcca

SEQ ID NO: 3793551 - RNA, 15 nt, Salmonella typhimurium LT2
gccuacgacagcgcu

SEQ ID NO: 3793552 - RNA, 17 nt, Salmonella typhimurium LT2
gccuacgacagcgcugg

SEQ ID NO: 3793553 - RNA, 23 nt, Salmonella typhimurium LT2
gccuagaugaaugacuguccacg

SEQ ID NO: 3793554 - RNA, 18 nt, Salmonella typhimurium LT2
gccuagcgcgcgcaguuu

SEQ ID NO: 3793555 - RNA, 16 nt, Salmonella typhimurium LT2
gccuaguucugcgcca

SEQ ID NO: 3793556 - RNA, 18 nt, Salmonella typhimurium LT2
gccuaguucugcgccagu

SEQ ID NO: 3793557 - RNA, 14 nt, Salmonella typhimurium LT2
gccuaucaccgcga

SEQ ID NO: 3793558 - RNA, 16 nt, Salmonella typhimurium LT2
gccuauguuaugcaca

SEQ ID NO: 3793559 - RNA, 21 nt, Salmonella typhimurium LT2
gccucaaccaacggcgcuggc

SEQ ID NO: 3793560 - RNA, 21 nt, Salmonella typhimurium LT2
gccucaauugccgucagcucc

SEQ ID NO: 3793561 - RNA, 13 nt, Salmonella typhimurium LT2
gccucaccccaug

SEQ ID NO: 3793562 - RNA, 19 nt, Salmonella typhimurium LT2
gccucagccaaccuacgcg

SEQ ID NO: 3793563 - RNA, 14 nt, Salmonella typhimurium LT2
gccucaucugcuuc

SEQ ID NO: 3793564 - RNA, 12 nt, Salmonella typhimurium LT2
gccucauggcgg

SEQ ID NO: 3793565 - RNA, 11 nt, Salmonella typhimurium LT2
gccucauugau

SEQ ID NO: 3793566 - RNA, 19 nt, Salmonella typhimurium LT2
gccuccaccaccucuuucg

SEQ ID NO: 3793567 - RNA, 20 nt, Salmonella typhimurium LT2
gccuccaggcuacccacccc

SEQ ID NO: 3793568 - RNA, 20 nt, Salmonella typhimurium LT2
gccuccauuuuggggaaaau

SEQ ID NO: 3793569 - RNA, 18 nt, Salmonella typhimurium LT2
gccuccgcguagcccagc

SEQ ID NO: 3793570 - RNA, 21 nt, Salmonella typhimurium LT2
gccuccgcguagcccagcgcc

SEQ ID NO: 3793571 - RNA, 18 nt, Salmonella typhimurium LT2
gccuccggaugacgccgc

SEQ ID NO: 3793572 - RNA, 15 nt, Salmonella typhimurium LT2
gccuccugccgaugc

SEQ ID NO: 3793573 - RNA, 20 nt, Salmonella typhimurium LT2
gccucgaccccuucgccuuc

SEQ ID NO: 3793574 - RNA, 15 nt, Salmonella typhimurium LT2
gccucgaucuccucg

SEQ ID NO: 3793575 - RNA, 16 nt, Salmonella typhimurium LT2
gccucgccaaagcgcu

SEQ ID NO: 3793576 - RNA, 21 nt, Salmonella typhimurium LT2
gccucgcucucuuucaccagc

SEQ ID NO: 3793577 - RNA, 18 nt, Salmonella typhimurium LT2
gccucgcugacgccagcc

SEQ ID NO: 3793578 - RNA, 22 nt, Salmonella typhimurium LT2
gccucgcugacgccagccagcc

SEQ ID NO: 3793579 - RNA, 19 nt, Salmonella typhimurium LT2
gccucggcgcccagcgugc

SEQ ID NO: 3793580 - RNA, 15 nt, Salmonella typhimurium LT2
gccucguucccagcg

SEQ ID NO: 3793581 - RNA, 21 nt, Salmonella typhimurium LT2
gccucguuugcugagcagcca

SEQ ID NO: 3793582 - RNA, 23 nt, Salmonella typhimurium LT2
gccucguuugcugagcagccagc

SEQ ID NO: 3793583 - RNA, 15 nt, Salmonella typhimurium LT2
gccucuccucgaugc

SEQ ID NO: 3793584 - RNA, 15 nt, Salmonella typhimurium LT2
gccucugucuugucu

SEQ ID NO: 3793585 - RNA, 22 nt, Salmonella typhimurium LT2
gccucuuaucaggcgacccaua

SEQ ID NO: 3793586 - RNA, 22 nt, Salmonella typhimurium LT2
gccucuuccgccugauaaaacg

SEQ ID NO: 3793587 - RNA, 22 nt, Salmonella typhimurium LT2
gccucuucuaaaucauaccagc

SEQ ID NO: 3793588 - RNA, 21 nt, Salmonella typhimurium LT2
gccucuucuggcucccgcagc

SEQ ID NO: 3793589 - RNA, 20 nt, Salmonella typhimurium LT2
gccucuuuuuagcagcaaua

SEQ ID NO: 3793590 - RNA, 19 nt, Salmonella typhimurium LT2
gccucuuuuuucgccacgc

SEQ ID NO: 3793591 - RNA, 17 nt, Salmonella typhimurium LT2
gccugaaaauagcgcca

SEQ ID NO: 3793592 - RNA, 21 nt, Salmonella typhimurium LT2
gccugaagccagcaaucagcc

SEQ ID NO: 3793593 - RNA, 13 nt, Salmonella typhimurium LT2
gccugaauaauga

SEQ ID NO: 3793594 - RNA, 16 nt, Salmonella typhimurium LT2
gccugaauaaugaccu

SEQ ID NO: 3793595 - RNA, 11 nt, Salmonella typhimurium LT2
gccugaaugca

SEQ ID NO: 3793596 - RNA, 18 nt, Salmonella typhimurium LT2
gccugaaugcacugcuga

SEQ ID NO: 3793597 - RNA, 12 nt, Salmonella typhimurium LT2
gccugaaugcuc

SEQ ID NO: 3793598 - RNA, 20 nt, Salmonella typhimurium LT2
gccugaauuagguuacguug

SEQ ID NO: 3793599 - RNA, 22 nt, Salmonella typhimurium LT2
gccugacaggagcgccguggaa

SEQ ID NO: 3793600 - RNA, 16 nt, Salmonella typhimurium LT2
gccugaccauugcugu

SEQ ID NO: 3793601 - RNA, 18 nt, Salmonella typhimurium LT2
gccugacgaauagcgcgc

SEQ ID NO: 3793602 - RNA, 21 nt, Salmonella typhimurium LT2
gccugacgaccauugccaaug

SEQ ID NO: 3793603 - RNA, 18 nt, Salmonella typhimurium LT2
gccugacggcgcugucac

SEQ ID NO: 3793604 - RNA, 15 nt, Salmonella typhimurium LT2
gccugagcgccagcg

SEQ ID NO: 3793605 - RNA, 13 nt, Salmonella typhimurium LT2
gccugagcuuucc

SEQ ID NO: 3793606 - RNA, 16 nt, Salmonella typhimurium LT2
gccugauaaaacgcag

SEQ ID NO: 3793607 - RNA, 16 nt, Salmonella typhimurium LT2
gccugauaagcacagg

SEQ ID NO: 3793608 - RNA, 19 nt, Salmonella typhimurium LT2
gccugauaagcacaggcca

SEQ ID NO: 3793609 - RNA, 20 nt, Salmonella typhimurium LT2
gccugauaagcauagcgcca

SEQ ID NO: 3793610 - RNA, 22 nt, Salmonella typhimurium LT2
gccugauaagcauagcgccauc

SEQ ID NO: 3793611 - RNA, 20 nt, Salmonella typhimurium LT2
gccugauaagcgaagcgcca

SEQ ID NO: 3793612 - RNA, 20 nt, Salmonella typhimurium LT2
gccugauaagcguagcgcca

SEQ ID NO: 3793613 - RNA, 18 nt, Salmonella typhimurium LT2
gccugaucgcgcagacag

SEQ ID NO: 3793614 - RNA, 12 nt, Salmonella typhimurium LT2
gccugaucuuuc

SEQ ID NO: 3793615 - RNA, 21 nt, Salmonella typhimurium LT2
gccugaugaaaggccaucaca

SEQ ID NO: 3793616 - RNA, 23 nt, Salmonella typhimurium LT2
gccugaugagguuacguucauca

SEQ ID NO: 3793617 - RNA, 23 nt, Salmonella typhimurium LT2
gccugaugcacauuguccggcag

SEQ ID NO: 3793618 - RNA, 12 nt, Salmonella typhimurium LT2
gccugaugcugc

SEQ ID NO: 3793619 - RNA, 15 nt, Salmonella typhimurium LT2
gccugaugcugcgca

SEQ ID NO: 3793620 - RNA, 13 nt, Salmonella typhimurium LT2
gccugauggcgac

SEQ ID NO: 3793621 - RNA, 16 nt, Salmonella typhimurium LT2
gccuuccgcaccgcca

SEQ ID NO: 3793622 - RNA, 18 nt, Salmonella typhimurium LT2
gccuuccgcaccgccagu

SEQ ID NO: 3793623 - RNA, 14 nt, Salmonella typhimurium LT2
gccuuccugccagc

SEQ ID NO: 3793624 - RNA, 20 nt, Salmonella typhimurium LT2
gccuucgaagaauuccaccu

SEQ ID NO: 3793625 - RNA, 23 nt, Salmonella typhimurium LT2
gccuucgaagaauuccaccuuac

SEQ ID NO: 3793626 - RNA, 14 nt, Salmonella typhimurium LT2
gccuucgccgccgc

SEQ ID NO: 3793627 - RNA, 13 nt, Salmonella typhimurium LT2
gccuucgccggca

SEQ ID NO: 3793628 - RNA, 22 nt, Salmonella typhimurium LT2
gccuucggucguuugccgugca

SEQ ID NO: 3793629 - RNA, 20 nt, Salmonella typhimurium LT2
gccuucguuauaaggccugc

SEQ ID NO: 3793630 - RNA, 13 nt, Salmonella typhimurium LT2
gccuugacaggaa

SEQ ID NO: 3793631 - RNA, 17 nt, Salmonella typhimurium LT2
gccuugacaggaaacag

SEQ ID NO: 3793632 - RNA, 13 nt, Salmonella typhimurium LT2
gccuugagcaaaa

SEQ ID NO: 3793633 - RNA, 14 nt, Salmonella typhimurium LT2
gccuugcaaaccgg

SEQ ID NO: 3793634 - RNA, 21 nt, Salmonella typhimurium LT2
gccuugcccguauugaagcga

SEQ ID NO: 3793635 - RNA, 18 nt, Salmonella typhimurium LT2
gccuugcgacauguugua

SEQ ID NO: 3793636 - RNA, 21 nt, Salmonella typhimurium LT2
gccuuguagcgcugcccaauc

SEQ ID NO: 3793637 - RNA, 13 nt, Salmonella typhimurium LT2
gccuuuauccagc

SEQ ID NO: 3793638 - RNA, 14 nt, Salmonella typhimurium LT2
gccuuuauccagcg

SEQ ID NO: 3793639 - RNA, 21 nt, Salmonella typhimurium LT2
gccuuuaugggcuuugcaagc

SEQ ID NO: 3793640 - RNA, 14 nt, Salmonella typhimurium LT2
gccuuucaccauca

SEQ ID NO: 3793641 - RNA, 18 nt, Salmonella typhimurium LT2
gccuuucaccaucagcau

SEQ ID NO: 3793642 - RNA, 20 nt, Salmonella typhimurium LT2
gccuuucacgcguucaauau

SEQ ID NO: 3793643 - RNA, 17 nt, Salmonella typhimurium LT2
gccuuucagaucggcaa

SEQ ID NO: 3793644 - RNA, 22 nt, Salmonella typhimurium LT2
gccuuucagucgacaacaucau

SEQ ID NO: 3793645 - RNA, 18 nt, Salmonella typhimurium LT2
gccuuucggcagcgggau

SEQ ID NO: 3793646 - RNA, 17 nt, Salmonella typhimurium LT2
gccuuugacgccgggaa

SEQ ID NO: 3793647 - RNA, 12 nt, Salmonella typhimurium LT2
gccuuuggccug

SEQ ID NO: 3793648 - RNA, 15 nt, Salmonella typhimurium LT2
gccuuuggccuggag

SEQ ID NO: 3793649 - RNA, 14 nt, Salmonella typhimurium LT2
gccuuuuauaauaa

SEQ ID NO: 3793650 - RNA, 23 nt, Salmonella typhimurium LT2
gccuuuuauaauaaaagcucguc

SEQ ID NO: 3793651 - RNA, 23 nt, Salmonella typhimurium LT2
gccuuuuaucaaugcacugacuu

SEQ ID NO: 3793652 - RNA, 22 nt, Salmonella typhimurium LT2
gccuuuucauauggaagcuguu

SEQ ID NO: 3793653 - RNA, 18 nt, Salmonella typhimurium LT2
gccuuuucccccagcauc

SEQ ID NO: 3793654 - RNA, 13 nt, Salmonella typhimurium LT2
gccuuuuggcagc

SEQ ID NO: 3793655 - RNA, 16 nt, Salmonella typhimurium LT2
gccuuuuuaaauauua

SEQ ID NO: 3793656 - RNA, 18 nt, Salmonella typhimurium LT2
gccuuuuuuaauccagga

SEQ ID NO: 3793657 - RNA, 20 nt, Salmonella typhimurium LT2
gccuuuuuuaauccaggaau

SEQ ID NO: 3793658 - RNA, 15 nt, Salmonella typhimurium LT2
gcgaaaacagcuggc

SEQ ID NO: 3793659 - RNA, 18 nt, Salmonella typhimurium LT2
gcgaaaagcgugcgccuu

SEQ ID NO: 3793660 - RNA, 15 nt, Salmonella typhimurium LT2
gcgaaaaggccuggc

SEQ ID NO: 3793661 - RNA, 12 nt, Salmonella typhimurium LT2
gcgaaaauaaag

SEQ ID NO: 3793662 - RNA, 15 nt, Salmonella typhimurium LT2
gcgaaaauaggcuuu

SEQ ID NO: 3793663 - RNA, 18 nt, Salmonella typhimurium LT2
gcgaaacagggcaaggau

SEQ ID NO: 3793664 - RNA, 21 nt, Salmonella typhimurium LT2
gcgaaacgccuuauccggccu

SEQ ID NO: 3793665 - RNA, 14 nt, Salmonella typhimurium LT2
gcgaaacggcagcg

SEQ ID NO: 3793666 - RNA, 17 nt, Salmonella typhimurium LT2
gcgaaacuccagcgaua

SEQ ID NO: 3793667 - RNA, 12 nt, Salmonella typhimurium LT2
gcgaaagaaaau

SEQ ID NO: 3793668 - RNA, 19 nt, Salmonella typhimurium LT2
gcgaaagaaaauuguccac

SEQ ID NO: 3793669 - RNA, 19 nt, Salmonella typhimurium LT2
gcgaaagagaauguaggcc

SEQ ID NO: 3793670 - RNA, 23 nt, Salmonella typhimurium LT2
gcgaaagcacuucucgcgcauca

SEQ ID NO: 3793671 - RNA, 21 nt, Salmonella typhimurium LT2
gcgaaaguaaccaacgucauu

SEQ ID NO: 3793672 - RNA, 16 nt, Salmonella typhimurium LT2
gcgaaaucaaaaggcg

SEQ ID NO: 3793673 - RNA, 17 nt, Salmonella typhimurium LT2
gcgaaaucauuucaucu

SEQ ID NO: 3793674 - RNA, 14 nt, Salmonella typhimurium LT2
gcgaaauugguaga

SEQ ID NO: 3793675 - RNA, 20 nt, Salmonella typhimurium LT2
gcgaaauuuaauauaugaac

SEQ ID NO: 3793676 - RNA, 22 nt, Salmonella typhimurium LT2
gcgaacagacguuacaucuccu

SEQ ID NO: 3793677 - RNA, 12 nt, Salmonella typhimurium LT2
gcgaacagcgca

SEQ ID NO: 3793678 - RNA, 14 nt, Salmonella typhimurium LT2
gcgaacaggcguaa

SEQ ID NO: 3793679 - RNA, 15 nt, Salmonella typhimurium LT2
gcgaaccaucauuaa

SEQ ID NO: 3793680 - RNA, 13 nt, Salmonella typhimurium LT2
gcgaaccggacca

SEQ ID NO: 3793681 - RNA, 13 nt, Salmonella typhimurium LT2
gcgaacgauacca

SEQ ID NO: 3793682 - RNA, 20 nt, Salmonella typhimurium LT2
gcgaacgccuuauccggccu

SEQ ID NO: 3793683 - RNA, 14 nt, Salmonella typhimurium LT2
gcgaacguccagcg

SEQ ID NO: 3793684 - RNA, 18 nt, Salmonella typhimurium LT2
gcgaacguuugaccugca

SEQ ID NO: 3793685 - RNA, 14 nt, Salmonella typhimurium LT2
gcgaacuucaccag

SEQ ID NO: 3793686 - RNA, 13 nt, Salmonella typhimurium LT2
gcgaacuugccgg

SEQ ID NO: 3793687 - RNA, 15 nt, Salmonella typhimurium LT2
gcgaacuugccggaa

SEQ ID NO: 3793688 - RNA, 22 nt, Salmonella typhimurium LT2
gcgaagaucguuauccagcagc

SEQ ID NO: 3793689 - RNA, 12 nt, Salmonella typhimurium LT2
gcgaagccacuu

SEQ ID NO: 3793690 - RNA, 17 nt, Salmonella typhimurium LT2
gcgaagcgccaucaggc

SEQ ID NO: 3793691 - RNA, 12 nt, Salmonella typhimurium LT2
gcgaaggccagc

SEQ ID NO: 3793692 - RNA, 14 nt, Salmonella typhimurium LT2
gcgaaggccagcac

SEQ ID NO: 3793693 - RNA, 16 nt, Salmonella typhimurium LT2
gcgaagugcagcguuu

SEQ ID NO: 3793694 - RNA, 23 nt, Salmonella typhimurium LT2
gcgaagugcagcguuuccagcca

SEQ ID NO: 3793695 - RNA, 24 nt, Salmonella typhimurium LT2
gcgaauaaugcauccgccagauga

SEQ ID NO: 3793696 - RNA, 20 nt, Salmonella typhimurium LT2
gcgaauaauguuguccacaa

SEQ ID NO: 3793697 - RNA, 21 nt, Salmonella typhimurium LT2
gcgaauacccagcuuucucac

SEQ ID NO: 3793698 - RNA, 14 nt, Salmonella typhimurium LT2
gcgaauaccuuccc

SEQ ID NO: 3793699 - RNA, 18 nt, Salmonella typhimurium LT2
gcgaauaccuucccgcga

SEQ ID NO: 3793700 - RNA, 15 nt, Salmonella typhimurium LT2
gcgaauagccagaca

SEQ ID NO: 3793701 - RNA, 15 nt, Salmonella typhimurium LT2
gcgaauagcgcgcua

SEQ ID NO: 3793702 - RNA, 17 nt, Salmonella typhimurium LT2
gcgaauagucgccgcgg

SEQ ID NO: 3793703 - RNA, 15 nt, Salmonella typhimurium LT2
gcgaauagugcagaa

SEQ ID NO: 3793704 - RNA, 18 nt, Salmonella typhimurium LT2
gcgaaucacauccgccag

SEQ ID NO: 3793705 - RNA, 18 nt, Salmonella typhimurium LT2
gcgaaucauguuuuucuc

SEQ ID NO: 3793706 - RNA, 13 nt, Salmonella typhimurium LT2
gcgaauccagauc

SEQ ID NO: 3793707 - RNA, 15 nt, Salmonella typhimurium LT2
gcgaauccagcgccg

SEQ ID NO: 3793708 - RNA, 15 nt, Salmonella typhimurium LT2
gcgaauccggcggcu

SEQ ID NO: 3793709 - RNA, 23 nt, Salmonella typhimurium LT2
gcgaauccgugcgcagaauauac

SEQ ID NO: 3793710 - RNA, 17 nt, Salmonella typhimurium LT2
gcgaauccuaaacucaa

SEQ ID NO: 3793711 - RNA, 18 nt, Salmonella typhimurium LT2
gcgaaucgacaauccgcc

SEQ ID NO: 3793712 - RNA, 23 nt, Salmonella typhimurium LT2
gcgaaucuggauagucaggcgau

SEQ ID NO: 3793713 - RNA, 14 nt, Salmonella typhimurium LT2
gcgaaugcgcgcca

SEQ ID NO: 3793714 - RNA, 15 nt, Salmonella typhimurium LT2
gcgaaugcgcgccau

SEQ ID NO: 3793715 - RNA, 18 nt, Salmonella typhimurium LT2
gcgaauugcgaguaaccu

SEQ ID NO: 3793716 - RNA, 16 nt, Salmonella typhimurium LT2
gcgaauuuccugccag

SEQ ID NO: 3793717 - RNA, 20 nt, Salmonella typhimurium LT2
gcgaauuuuauuaagcaggc

SEQ ID NO: 3793718 - RNA, 21 nt, Salmonella typhimurium LT2
gcgaauuuuauuaagcaggcc

SEQ ID NO: 3793719 - RNA, 22 nt, Salmonella typhimurium LT2
gcgaauuuuauuaagcaggccg

SEQ ID NO: 3793720 - RNA, 15 nt, Salmonella typhimurium LT2
gcgacaaacagcgcc

SEQ ID NO: 3793721 - RNA, 11 nt, Salmonella typhimurium LT2
gcgacaaauga

SEQ ID NO: 3793722 - RNA, 17 nt, Salmonella typhimurium LT2
gcgacaaccuguaggcc

SEQ ID NO: 3793723 - RNA, 13 nt, Salmonella typhimurium LT2
gcgacaacgccgg

SEQ ID NO: 3793724 - RNA, 10 nt, Salmonella typhimurium LT2
gcgacaagaa

SEQ ID NO: 3793725 - RNA, 20 nt, Salmonella typhimurium LT2
gcgacaaugaagcauaaaaa

SEQ ID NO: 3793726 - RNA, 21 nt, Salmonella typhimurium LT2
gcgaucaccagcaccgccagc

SEQ ID NO: 3793727 - RNA, 13 nt, Salmonella typhimurium LT2
gcgaucacgccgu

SEQ ID NO: 3793728 - RNA, 19 nt, Salmonella typhimurium LT2
gcgaucagacgcugguugu

SEQ ID NO: 3793729 - RNA, 13 nt, Salmonella typhimurium LT2
gcgaucagcaggu

SEQ ID NO: 3793730 - RNA, 17 nt, Salmonella typhimurium LT2
gcgaucagcgccaccac

SEQ ID NO: 3793731 - RNA, 15 nt, Salmonella typhimurium LT2
gcgaucaggcgucag

SEQ ID NO: 3793732 - RNA, 14 nt, Salmonella typhimurium LT2
gcgauccagaccgg

SEQ ID NO: 3793733 - RNA, 14 nt, Salmonella typhimurium LT2
gcgauccagcccca

SEQ ID NO: 3793734 - RNA, 21 nt, Salmonella typhimurium LT2
gcgauccagccccagcgccag

SEQ ID NO: 3793735 - RNA, 22 nt, Salmonella typhimurium LT2
gcgauccagccgcaguugccag

SEQ ID NO: 3793736 - RNA, 20 nt, Salmonella typhimurium LT2
gcgauccagcgggccgacga

SEQ ID NO: 3793737 - RNA, 22 nt, Salmonella typhimurium LT2
gcgaucccaauugaucggccag

SEQ ID NO: 3793738 - RNA, 14 nt, Salmonella typhimurium LT2
gcgauccugaaaug

SEQ ID NO: 3793739 - RNA, 19 nt, Salmonella typhimurium LT2
gcgaucgccccgaccagga

SEQ ID NO: 3793740 - RNA, 21 nt, Salmonella typhimurium LT2
gcgaucgccgucguucagcca

SEQ ID NO: 3793741 - RNA, 13 nt, Salmonella typhimurium LT2
gcgaucgcgccag

SEQ ID NO: 3793742 - RNA, 14 nt, Salmonella typhimurium LT2
gcgaucgcgccagc

SEQ ID NO: 3793743 - RNA, 13 nt, Salmonella typhimurium LT2
gcgaucgcggcaa

SEQ ID NO: 3793744 - RNA, 16 nt, Salmonella typhimurium LT2
gcgaucgucggugccu

SEQ ID NO: 3793745 - RNA, 17 nt, Salmonella typhimurium LT2
gcgaucucuuuggccag

SEQ ID NO: 3793746 - RNA, 22 nt, Salmonella typhimurium LT2
gcgaucugugucguccgggccu

SEQ ID NO: 3793747 - RNA, 20 nt, Salmonella typhimurium LT2
gcgaucuucauagucgcuuu

SEQ ID NO: 3793748 - RNA, 16 nt, Salmonella typhimurium LT2
gcgaugaacaucgaca

SEQ ID NO: 3793749 - RNA, 21 nt, Salmonella typhimurium LT2
gcgaugaccaucaaauaauac

SEQ ID NO: 3793750 - RNA, 12 nt, Salmonella typhimurium LT2
gcgaugagcgcc

SEQ ID NO: 3793751 - RNA, 14 nt, Salmonella typhimurium LT2
gcgaugagcgccag

SEQ ID NO: 3793752 - RNA, 19 nt, Salmonella typhimurium LT2
gcgaugagcgccagcaaca

SEQ ID NO: 3793753 - RNA, 13 nt, Salmonella typhimurium LT2
gcgaugauagccg

SEQ ID NO: 3793754 - RNA, 17 nt, Salmonella typhimurium LT2
gcgaugcaaccccugac

SEQ ID NO: 3793755 - RNA, 12 nt, Salmonella typhimurium LT2
gcgaugccacca

SEQ ID NO: 3793756 - RNA, 22 nt, Salmonella typhimurium LT2
gcgaugccaccagccuaaaaac

SEQ ID NO: 3793757 - RNA, 14 nt, Salmonella typhimurium LT2
gcgaugccugccgg

SEQ ID NO: 3793758 - RNA, 19 nt, Salmonella typhimurium LT2
gcgaugcgcgagccguaaa

SEQ ID NO: 3793759 - RNA, 16 nt, Salmonella typhimurium LT2
gcgaugcuaucgguag

SEQ ID NO: 3793760 - RNA, 18 nt, Salmonella typhimurium LT2
gcgauggucauuccagcu

SEQ ID NO: 3793761 - RNA, 21 nt, Salmonella typhimurium LT2
gcgauggucgauauugcuguc

SEQ ID NO: 3793762 - RNA, 23 nt, Salmonella typhimurium LT2
gcgauggucuucuuucagguucc

SEQ ID NO: 3793763 - RNA, 18 nt, Salmonella typhimurium LT2
gcgauguaagaggccgua

SEQ ID NO: 3793764 - RNA, 15 nt, Salmonella typhimurium LT2
gcgaugugccuguaa

SEQ ID NO: 3793765 - RNA, 13 nt, Salmonella typhimurium LT2
gcgaugugcuggg

SEQ ID NO: 3793766 - RNA, 20 nt, Salmonella typhimurium LT2
gcgauguucggguaaacgcu

SEQ ID NO: 3793767 - RNA, 22 nt, Salmonella typhimurium LT2
gcgauguuuucccucgccccgg

SEQ ID NO: 3793768 - RNA, 14 nt, Salmonella typhimurium LT2
gcgauucaucgaca

SEQ ID NO: 3793769 - RNA, 14 nt, Salmonella typhimurium LT2
gcgauucgcccacg

SEQ ID NO: 3793770 - RNA, 17 nt, Salmonella typhimurium LT2
gcgauuugccgcgccuu

SEQ ID NO: 3793771 - RNA, 20 nt, Salmonella typhimurium LT2
gcgcaaacaguacgcccgcu

SEQ ID NO: 3793772 - RNA, 12 nt, Salmonella typhimurium LT2
gcgcaaagcugc

SEQ ID NO: 3793773 - RNA, 14 nt, Salmonella typhimurium LT2
gcgcaaaucgccau

SEQ ID NO: 3793774 - RNA, 12 nt, Salmonella typhimurium LT2
gcgcaaccggcg

SEQ ID NO: 3793775 - RNA, 12 nt, Salmonella typhimurium LT2
gcgcaaccugcg

SEQ ID NO: 3793776 - RNA, 13 nt, Salmonella typhimurium LT2
gcgcaacugggaa

SEQ ID NO: 3793777 - RNA, 18 nt, Salmonella typhimurium LT2
gcgcaauauaaucgccca

SEQ ID NO: 3793778 - RNA, 23 nt, Salmonella typhimurium LT2
gcgcaauaugaaaccgcccugca

SEQ ID NO: 3793779 - RNA, 22 nt, Salmonella typhimurium LT2
gcgcaauaugcagaucgacggu

SEQ ID NO: 3793780 - RNA, 14 nt, Salmonella typhimurium LT2
gcgcaauaugguau

SEQ ID NO: 3793781 - RNA, 12 nt, Salmonella typhimurium LT2
gcgcaaucgccg

SEQ ID NO: 3793782 - RNA, 21 nt, Salmonella typhimurium LT2
gcgcaaucgggccugcuccgu

SEQ ID NO: 3793783 - RNA, 22 nt, Salmonella typhimurium LT2
gcgcaaucgguaaaggucgccg

SEQ ID NO: 3793784 - RNA, 13 nt, Salmonella typhimurium LT2
gcgcaaugccgcc

SEQ ID NO: 3793785 - RNA, 15 nt, Salmonella typhimurium LT2
gcgcaaugccgccga

SEQ ID NO: 3793786 - RNA, 13 nt, Salmonella typhimurium LT2
gcgcaaugcugac

SEQ ID NO: 3793787 - RNA, 22 nt, Salmonella typhimurium LT2
gcgcaauuucauucaccaccgg

SEQ ID NO: 3793788 - RNA, 12 nt, Salmonella typhimurium LT2
gcgcacaagccu

SEQ ID NO: 3793789 - RNA, 13 nt, Salmonella typhimurium LT2
gcgcacagcgcca

SEQ ID NO: 3793790 - RNA, 13 nt, Salmonella typhimurium LT2
gcgcacaugcagc

SEQ ID NO: 3793791 - RNA, 22 nt, Salmonella typhimurium LT2
gcgcaccagccggugcucgccg

SEQ ID NO: 3793792 - RNA, 13 nt, Salmonella typhimurium LT2
gcgcaccaguuca

SEQ ID NO: 3793793 - RNA, 16 nt, Salmonella typhimurium LT2
gcgcaccccggccacg

SEQ ID NO: 3793794 - RNA, 13 nt, Salmonella typhimurium LT2
gcgcacccgcugg

SEQ ID NO: 3793795 - RNA, 22 nt, Salmonella typhimurium LT2
gcgcaccuucaacagcucgcca

SEQ ID NO: 3793796 - RNA, 18 nt, Salmonella typhimurium LT2
gcgcacgcccaucggcac

SEQ ID NO: 3793797 - RNA, 15 nt, Salmonella typhimurium LT2
gcgcacggcgcgucc

SEQ ID NO: 3793798 - RNA, 15 nt, Salmonella typhimurium LT2
gcgcacucagaaaau

SEQ ID NO: 3793799 - RNA, 16 nt, Salmonella typhimurium LT2
gcgcacucagaaaauu

SEQ ID NO: 3793800 - RNA, 13 nt, Salmonella typhimurium LT2
gcgcacugcucgu

SEQ ID NO: 3793801 - RNA, 16 nt, Salmonella typhimurium LT2
gcgcagaaccauacug

SEQ ID NO: 3793802 - RNA, 16 nt, Salmonella typhimurium LT2
gcgcagagauagccag

SEQ ID NO: 3793803 - RNA, 14 nt, Salmonella typhimurium LT2
gcgcagcaguugca

SEQ ID NO: 3793804 - RNA, 13 nt, Salmonella typhimurium LT2
gcgcagccccagc

SEQ ID NO: 3793805 - RNA, 17 nt, Salmonella typhimurium LT2
gcgcagcgccaucaggc

SEQ ID NO: 3793806 - RNA, 19 nt, Salmonella typhimurium LT2
gcgcagcgccaucaggcau

SEQ ID NO: 3793807 - RNA, 20 nt, Salmonella typhimurium LT2
gcgcagcgccaucaggcaug

SEQ ID NO: 3793808 - RNA, 18 nt, Salmonella typhimurium LT2
gcgcagcgccaucaggcc

SEQ ID NO: 3793809 - RNA, 14 nt, Salmonella typhimurium LT2
gcgcagcgcccagc

SEQ ID NO: 3793810 - RNA, 17 nt, Salmonella typhimurium LT2
gcgcagcgcccagcagc

SEQ ID NO: 3793811 - RNA, 21 nt, Salmonella typhimurium LT2
gcgcagcgcgcgacccagcgc

SEQ ID NO: 3793812 - RNA, 22 nt, Salmonella typhimurium LT2
gcgcagcgcuuuugccgcgccc

SEQ ID NO: 3793813 - RNA, 12 nt, Salmonella typhimurium LT2
gcgcaggccagg

SEQ ID NO: 3793814 - RNA, 14 nt, Salmonella typhimurium LT2
gcgcaggccaggcg

SEQ ID NO: 3793815 - RNA, 13 nt, Salmonella typhimurium LT2
gcgcaggccguca

SEQ ID NO: 3793816 - RNA, 21 nt, Salmonella typhimurium LT2
gcgcagggcgauauccagcgc

SEQ ID NO: 3793817 - RNA, 18 nt, Salmonella typhimurium LT2
gcgcagguuuugcagauc

SEQ ID NO: 3793818 - RNA, 23 nt, Salmonella typhimurium LT2
gcgcagguuuugcagauccgcga

SEQ ID NO: 3793819 - RNA, 13 nt, Salmonella typhimurium LT2
gcgcagucacaga

SEQ ID NO: 3793820 - RNA, 19 nt, Salmonella typhimurium LT2
gcgcagucagugaaaaacc

SEQ ID NO: 3793821 - RNA, 23 nt, Salmonella typhimurium LT2
gcgcauacgcuguccagucaaaa

SEQ ID NO: 3793822 - RNA, 17 nt, Salmonella typhimurium LT2
gcgcauacgucaugccu

SEQ ID NO: 3793823 - RNA, 17 nt, Salmonella typhimurium LT2
gcgcauaggcuuugcug

SEQ ID NO: 3793824 - RNA, 16 nt, Salmonella typhimurium LT2
gcgcauauuccggcga

SEQ ID NO: 3793825 - RNA, 20 nt, Salmonella typhimurium LT2
gcgcaucaaauacgcgcgcc

SEQ ID NO: 3793826 - RNA, 21 nt, Salmonella typhimurium LT2
gcgcaucaaauacgcgcgccg

SEQ ID NO: 3793827 - RNA, 15 nt, Salmonella typhimurium LT2
gcgcaucaacgccag

SEQ ID NO: 3793828 - RNA, 19 nt, Salmonella typhimurium LT2
gcgcaucaacgccaggcag

SEQ ID NO: 3793829 - RNA, 19 nt, Salmonella typhimurium LT2
gcgcaucaaugucgcgcuc

SEQ ID NO: 3793830 - RNA, 12 nt, Salmonella typhimurium LT2
gcgcaucaguac

SEQ ID NO: 3793831 - RNA, 16 nt, Salmonella typhimurium LT2
gcgcccuccuccagcg

SEQ ID NO: 3793832 - RNA, 16 nt, Salmonella typhimurium LT2
gcgccgaagcugacca

SEQ ID NO: 3793833 - RNA, 20 nt, Salmonella typhimurium LT2
gcgccgacaaauccuccggc

SEQ ID NO: 3793834 - RNA, 20 nt, Salmonella typhimurium LT2
gcgccgacauagcugaacaa

SEQ ID NO: 3793835 - RNA, 19 nt, Salmonella typhimurium LT2
gcgccgacaucgccaccgc

SEQ ID NO: 3793836 - RNA, 20 nt, Salmonella typhimurium LT2
gcgccgauaacacggcuggc

SEQ ID NO: 3793837 - RNA, 17 nt, Salmonella typhimurium LT2
gcgccgcaaugccgccu

SEQ ID NO: 3793838 - RNA, 17 nt, Salmonella typhimurium LT2
gcgccgcacaucggcag

SEQ ID NO: 3793839 - RNA, 14 nt, Salmonella typhimurium LT2
gcgccgcagcgccg

SEQ ID NO: 3793840 - RNA, 21 nt, Salmonella typhimurium LT2
gcgccgccaacgauacagcac

SEQ ID NO: 3793841 - RNA, 17 nt, Salmonella typhimurium LT2
gcgccgccaacgccaac

SEQ ID NO: 3793842 - RNA, 13 nt, Salmonella typhimurium LT2
gcgccgccagcga

SEQ ID NO: 3793843 - RNA, 15 nt, Salmonella typhimurium LT2
gcgccgccagcgacu

SEQ ID NO: 3793844 - RNA, 23 nt, Salmonella typhimurium LT2
gcgccgccgaacagacggcggcu

SEQ ID NO: 3793845 - RNA, 14 nt, Salmonella typhimurium LT2
gcgccgccgccaac

SEQ ID NO: 3793846 - RNA, 14 nt, Salmonella typhimurium LT2
gcgccgcgccaccg

SEQ ID NO: 3793847 - RNA, 16 nt, Salmonella typhimurium LT2
gcgccgcgccuaccag

SEQ ID NO: 3793848 - RNA, 21 nt, Salmonella typhimurium LT2
gcgccgcucaucaccagcagc

SEQ ID NO: 3793849 - RNA, 17 nt, Salmonella typhimurium LT2
gcgccgcugagaaaaag

SEQ ID NO: 3793850 - RNA, 16 nt, Salmonella typhimurium LT2
gcgccgcugcguaccg

SEQ ID NO: 3793851 - RNA, 18 nt, Salmonella typhimurium LT2
gcgccgcuuccaggcggu

SEQ ID NO: 3793852 - RNA, 23 nt, Salmonella typhimurium LT2
gcgccggauauguuugacaagca

SEQ ID NO: 3793853 - RNA, 16 nt, Salmonella typhimurium LT2
gcgccggauuuaccag

SEQ ID NO: 3793854 - RNA, 16 nt, Salmonella typhimurium LT2
gcgccggucgccagca

SEQ ID NO: 3793855 - RNA, 16 nt, Salmonella typhimurium LT2
gcgccgguuccggcau

SEQ ID NO: 3793856 - RNA, 21 nt, Salmonella typhimurium LT2
gcgccgucaggcuugccgcgc

SEQ ID NO: 3793857 - RNA, 20 nt, Salmonella typhimurium LT2
gcgccguccauaaugacgcu

SEQ ID NO: 3793858 - RNA, 14 nt, Salmonella typhimurium LT2
gcgccguccugcaa

SEQ ID NO: 3793859 - RNA, 20 nt, Salmonella typhimurium LT2
gcgccgugaguuucagcauc

SEQ ID NO: 3793860 - RNA, 15 nt, Salmonella typhimurium LT2
gcgccgugcccagca

SEQ ID NO: 3793861 - RNA, 21 nt, Salmonella typhimurium LT2
gcgccguucggaguugauggu

SEQ ID NO: 3793862 - RNA, 16 nt, Salmonella typhimurium LT2
gcgccguuuacagccg

SEQ ID NO: 3793863 - RNA, 17 nt, Salmonella typhimurium LT2
gcgccuaccgccauaga

SEQ ID NO: 3793864 - RNA, 12 nt, Salmonella typhimurium LT2
gcgccucagcca

SEQ ID NO: 3793865 - RNA, 21 nt, Salmonella typhimurium LT2
gcgccuccgcguagcccagcg

SEQ ID NO: 3793866 - RNA, 16 nt, Salmonella typhimurium LT2
gcgccuccgugguagu

SEQ ID NO: 3793867 - RNA, 14 nt, Salmonella typhimurium LT2
gcgccucgcgcggc

SEQ ID NO: 3793868 - RNA, 19 nt, Salmonella typhimurium LT2
gcgccucgcugacgccagc

SEQ ID NO: 3793869 - RNA, 23 nt, Salmonella typhimurium LT2
gcgccucgcugacgccagccagc

SEQ ID NO: 3793870 - RNA, 19 nt, Salmonella typhimurium LT2
gcgccugaagauacgccag

SEQ ID NO: 3793871 - RNA, 17 nt, Salmonella typhimurium LT2
gcgccugaugccgccgu

SEQ ID NO: 3793872 - RNA, 18 nt, Salmonella typhimurium LT2
gcgccugcauacucacau

SEQ ID NO: 3793873 - RNA, 14 nt, Salmonella typhimurium LT2
gcgccugccauagc

SEQ ID NO: 3793874 - RNA, 23 nt, Salmonella typhimurium LT2
gcgccugcgccaguucauccagc

SEQ ID NO: 3793875 - RNA, 14 nt, Salmonella typhimurium LT2
gcgccugcgcugca

SEQ ID NO: 3793876 - RNA, 18 nt, Salmonella typhimurium LT2
gcgccugcggcaggcaau

SEQ ID NO: 3793877 - RNA, 16 nt, Salmonella typhimurium LT2
gcgccugcuccaccag

SEQ ID NO: 3793878 - RNA, 14 nt, Salmonella typhimurium LT2
gcgccugcucccgc

SEQ ID NO: 3793879 - RNA, 15 nt, Salmonella typhimurium LT2
gcgccugcugccugc

SEQ ID NO: 3793880 - RNA, 20 nt, Salmonella typhimurium LT2
gcgccugucgggccuacaga

SEQ ID NO: 3793881 - RNA, 20 nt, Salmonella typhimurium LT2
gcgccugugcuuucgccacc

SEQ ID NO: 3793882 - RNA, 22 nt, Salmonella typhimurium LT2
gcgccugugcuuucgccaccag

SEQ ID NO: 3793883 - RNA, 18 nt, Salmonella typhimurium LT2
gcgccuuaccguaugcaa

SEQ ID NO: 3793884 - RNA, 13 nt, Salmonella typhimurium LT2
gcgccuuauccgg

SEQ ID NO: 3793885 - RNA, 17 nt, Salmonella typhimurium LT2
gcgccuuauucaggcga

SEQ ID NO: 3793886 - RNA, 14 nt, Salmonella typhimurium LT2
gcgccuucaggcau

SEQ ID NO: 3793887 - RNA, 13 nt, Salmonella typhimurium LT2
gcgccuuccagca

SEQ ID NO: 3793888 - RNA, 14 nt, Salmonella typhimurium LT2
gcgccuuccagcaa

SEQ ID NO: 3793889 - RNA, 15 nt, Salmonella typhimurium LT2
gcgccuuccagcaau

SEQ ID NO: 3793890 - RNA, 14 nt, Salmonella typhimurium LT2
gcgccuuccggcca

SEQ ID NO: 3793891 - RNA, 18 nt, Salmonella typhimurium LT2
gcgccuugcaaaccgggu

SEQ ID NO: 3793892 - RNA, 20 nt, Salmonella typhimurium LT2
gcgccuugcgauaacccgcu

SEQ ID NO: 3793893 - RNA, 20 nt, Salmonella typhimurium LT2
gcgccuugucugaccgggcg

SEQ ID NO: 3793894 - RNA, 21 nt, Salmonella typhimurium LT2
gcgccuuguuuucaucugcug

SEQ ID NO: 3793895 - RNA, 19 nt, Salmonella typhimurium LT2
gcgccuuuaauuccgccgg

SEQ ID NO: 3793896 - RNA, 18 nt, Salmonella typhimurium LT2
gcgccuuuuggcagcagc

SEQ ID NO: 3793897 - RNA, 16 nt, Salmonella typhimurium LT2
gcgcgaaaagaaacug

SEQ ID NO: 3793898 - RNA, 15 nt, Salmonella typhimurium LT2
gcgcgaaagcgccuu

SEQ ID NO: 3793899 - RNA, 19 nt, Salmonella typhimurium LT2
gcgcgaacggcaucuacug

SEQ ID NO: 3793900 - RNA, 19 nt, Salmonella typhimurium LT2
gcgcgaaucgacaauccgc

SEQ ID NO: 3793901 - RNA, 22 nt, Salmonella typhimurium LT2
gcgcgacauccgcuuuugguuu

SEQ ID NO: 3793902 - RNA, 15 nt, Salmonella typhimurium LT2
gcgcgaccacgccag

SEQ ID NO: 3793903 - RNA, 19 nt, Salmonella typhimurium LT2
gcgcgaccacgccagccag

SEQ ID NO: 3793904 - RNA, 17 nt, Salmonella typhimurium LT2
gcgcgauauccaccuga

SEQ ID NO: 3793905 - RNA, 16 nt, Salmonella typhimurium LT2
gcgcgaucaucgcauu

SEQ ID NO: 3793906 - RNA, 20 nt, Salmonella typhimurium LT2
gcgcgaucucuuuggccagu

SEQ ID NO: 3793907 - RNA, 20 nt, Salmonella typhimurium LT2
gcgcgaugccugccgggccu

SEQ ID NO: 3793908 - RNA, 17 nt, Salmonella typhimurium LT2
gcgcgcacacaauagca

SEQ ID NO: 3793909 - RNA, 19 nt, Salmonella typhimurium LT2
gcgcgcagaccacgaauca

SEQ ID NO: 3793910 - RNA, 19 nt, Salmonella typhimurium LT2
gcgcgcaucgggccguccg

SEQ ID NO: 3793911 - RNA, 18 nt, Salmonella typhimurium LT2
gcgcgccaaacggcagcu

SEQ ID NO: 3793912 - RNA, 20 nt, Salmonella typhimurium LT2
gcgcgccaauccaugccggc

SEQ ID NO: 3793913 - RNA, 12 nt, Salmonella typhimurium LT2
gcgcgccaccau

SEQ ID NO: 3793914 - RNA, 12 nt, Salmonella typhimurium LT2
gcgcgccagcgc

SEQ ID NO: 3793915 - RNA, 15 nt, Salmonella typhimurium LT2
gcgcgccagcgcauc

SEQ ID NO: 3793916 - RNA, 14 nt, Salmonella typhimurium LT2
gcgcgccagcgcca

SEQ ID NO: 3793917 - RNA, 16 nt, Salmonella typhimurium LT2
gcgcgccagcgccaau

SEQ ID NO: 3793918 - RNA, 16 nt, Salmonella typhimurium LT2
gcgcgccagcggacuc

SEQ ID NO: 3793919 - RNA, 16 nt, Salmonella typhimurium LT2
gcgcgccagcguggcu

SEQ ID NO: 3793920 - RNA, 15 nt, Salmonella typhimurium LT2
gcgcgccagcucuuc

SEQ ID NO: 3793921 - RNA, 14 nt, Salmonella typhimurium LT2
gcgcgcccagcagg

SEQ ID NO: 3793922 - RNA, 15 nt, Salmonella typhimurium LT2
gcgcgcccgcuuccg

SEQ ID NO: 3793923 - RNA, 23 nt, Salmonella typhimurium LT2
gcgcgccgaaaauauacaccuga

SEQ ID NO: 3793924 - RNA, 19 nt, Salmonella typhimurium LT2
gcgcgccgcacaucggcag

SEQ ID NO: 3793925 - RNA, 12 nt, Salmonella typhimurium LT2
gcgcgccgcagc

SEQ ID NO: 3793926 - RNA, 13 nt, Salmonella typhimurium LT2
gcgcgccgcagcg

SEQ ID NO: 3793927 - RNA, 12 nt, Salmonella typhimurium LT2
gcgcgccgccug

SEQ ID NO: 3793928 - RNA, 11 nt, Salmonella typhimurium LT2
gcgcgccgcgc

SEQ ID NO: 3793929 - RNA, 15 nt, Salmonella typhimurium LT2
gcgcgccgcgcagca

SEQ ID NO: 3793930 - RNA, 22 nt, Salmonella typhimurium LT2
gcgcgccgcuggcgaccagccu

SEQ ID NO: 3793931 - RNA, 19 nt, Salmonella typhimurium LT2
gcgcgccgggcuucauacc

SEQ ID NO: 3793932 - RNA, 20 nt, Salmonella typhimurium LT2
gcgcgccggugaucccacca

SEQ ID NO: 3793933 - RNA, 13 nt, Salmonella typhimurium LT2
gcgcgccugacgc

SEQ ID NO: 3793934 - RNA, 16 nt, Salmonella typhimurium LT2
gcgcgccugccgccag

SEQ ID NO: 3793935 - RNA, 16 nt, Salmonella typhimurium LT2
gcgcugcaaaaugaug

SEQ ID NO: 3793936 - RNA, 18 nt, Salmonella typhimurium LT2
gcgcugcacaaucgccag

SEQ ID NO: 3793937 - RNA, 22 nt, Salmonella typhimurium LT2
gcgcugcacgugugcugcguca

SEQ ID NO: 3793938 - RNA, 23 nt, Salmonella typhimurium LT2
gcgcugccgucaaugccgggcag

SEQ ID NO: 3793939 - RNA, 12 nt, Salmonella typhimurium LT2
gcgcugcgccag

SEQ ID NO: 3793940 - RNA, 19 nt, Salmonella typhimurium LT2
gcgcugcgccaucaggcau

SEQ ID NO: 3793941 - RNA, 15 nt, Salmonella typhimurium LT2
gcgcugcgcgcaucg

SEQ ID NO: 3793942 - RNA, 15 nt, Salmonella typhimurium LT2
gcgcugcgcuuaccg

SEQ ID NO: 3793943 - RNA, 16 nt, Salmonella typhimurium LT2
gcgcugcgcuuaccgg

SEQ ID NO: 3793944 - RNA, 17 nt, Salmonella typhimurium LT2
gcgcugcgcuuaucagg

SEQ ID NO: 3793945 - RNA, 20 nt, Salmonella typhimurium LT2
gcgcugcgcuuaucaggccu

SEQ ID NO: 3793946 - RNA, 17 nt, Salmonella typhimurium LT2
gcgcugcggucagggcu

SEQ ID NO: 3793947 - RNA, 22 nt, Salmonella typhimurium LT2
gcgcugcgguuuacgccaugca

SEQ ID NO: 3793948 - RNA, 14 nt, Salmonella typhimurium LT2
gcgcuggaaagcgg

SEQ ID NO: 3793949 - RNA, 17 nt, Salmonella typhimurium LT2
gcgcuggaucagauucc

SEQ ID NO: 3793950 - RNA, 19 nt, Salmonella typhimurium LT2
gcgcuggcaagcgccagca

SEQ ID NO: 3793951 - RNA, 23 nt, Salmonella typhimurium LT2
gcgcuggcgcacgcgucaucggc

SEQ ID NO: 3793952 - RNA, 22 nt, Salmonella typhimurium LT2
gcgcuggcuguucguaggcugg

SEQ ID NO: 3793953 - RNA, 20 nt, Salmonella typhimurium LT2
gcgcuggggguaggauaaaa

SEQ ID NO: 3793954 - RNA, 18 nt, Salmonella typhimurium LT2
gcgcuggugacaucgccg

SEQ ID NO: 3793955 - RNA, 21 nt, Salmonella typhimurium LT2
gcgcuggugggacuguucagc

SEQ ID NO: 3793956 - RNA, 23 nt, Salmonella typhimurium LT2
gcgcugguuggcgcgcucgcauu

SEQ ID NO: 3793957 - RNA, 23 nt, Salmonella typhimurium LT2
gcgcuguauaaucccgcggcgga

SEQ ID NO: 3793958 - RNA, 16 nt, Salmonella typhimurium LT2
gcgcugucaccagcag

SEQ ID NO: 3793959 - RNA, 17 nt, Salmonella typhimurium LT2
gcgcugucaccagcagc

SEQ ID NO: 3793960 - RNA, 20 nt, Salmonella typhimurium LT2
gcgcugucgcuaauccggcc

SEQ ID NO: 3793961 - RNA, 16 nt, Salmonella typhimurium LT2
gcgcugucgcuuaccg

SEQ ID NO: 3793962 - RNA, 15 nt, Salmonella typhimurium LT2
gcgcugucugccggc

SEQ ID NO: 3793963 - RNA, 24 nt, Salmonella typhimurium LT2
gcgcuuaucaggccuaccagccga

SEQ ID NO: 3793964 - RNA, 19 nt, Salmonella typhimurium LT2
gcgcuuauccggccuacag

SEQ ID NO: 3793965 - RNA, 13 nt, Salmonella typhimurium LT2
gcgcuucgccugc

SEQ ID NO: 3793966 - RNA, 15 nt, Salmonella typhimurium LT2
gcgcuucgccugccg

SEQ ID NO: 3793967 - RNA, 19 nt, Salmonella typhimurium LT2
gcgcuucgcuugcccggcc

SEQ ID NO: 3793968 - RNA, 19 nt, Salmonella typhimurium LT2
gcgcuucgugaaaaccuaa

SEQ ID NO: 3793969 - RNA, 21 nt, Salmonella typhimurium LT2
gcgcuucguugagcuuaucgg

SEQ ID NO: 3793970 - RNA, 18 nt, Salmonella typhimurium LT2
gcgcuucguuuccugucu

SEQ ID NO: 3793971 - RNA, 23 nt, Salmonella typhimurium LT2
gcgcuucuaacaaaacagauuaa

SEQ ID NO: 3793972 - RNA, 19 nt, Salmonella typhimurium LT2
gcgcuucuuugaagcguuc

SEQ ID NO: 3793973 - RNA, 15 nt, Salmonella typhimurium LT2
gcgcuugauccaguu

SEQ ID NO: 3793974 - RNA, 18 nt, Salmonella typhimurium LT2
gcgcuuuccaggccagcg

SEQ ID NO: 3793975 - RNA, 23 nt, Salmonella typhimurium LT2
gcgcuuugcuuauccggccuaca

SEQ ID NO: 3793976 - RNA, 16 nt, Salmonella typhimurium LT2
gcgcuuuggcugccag

SEQ ID NO: 3793977 - RNA, 17 nt, Salmonella typhimurium LT2
gcgcuuuggcugccagu

SEQ ID NO: 3793978 - RNA, 13 nt, Salmonella typhimurium LT2
gcgcuuugugcuc

SEQ ID NO: 3793979 - RNA, 18 nt, Salmonella typhimurium LT2
gcgcuuuucgccagcgca

SEQ ID NO: 3793980 - RNA, 14 nt, Salmonella typhimurium LT2
gcgcuuuugccgcg

SEQ ID NO: 3793981 - RNA, 17 nt, Salmonella typhimurium LT2
gcgcuuuugccgcgccc

SEQ ID NO: 3793982 - RNA, 12 nt, Salmonella typhimurium LT2
gcgcuuuuucac

SEQ ID NO: 3793983 - RNA, 21 nt, Salmonella typhimurium LT2
gcgcuuuuucacgaccagcca

SEQ ID NO: 3793984 - RNA, 22 nt, Salmonella typhimurium LT2
gcgcuuuuucacgaccagccaa

SEQ ID NO: 3793985 - RNA, 15 nt, Salmonella typhimurium LT2
gcgcuuuuuccagcg

SEQ ID NO: 3793986 - RNA, 17 nt, Salmonella typhimurium LT2
gcgcuuuuuccagcgca

SEQ ID NO: 3793987 - RNA, 21 nt, Salmonella typhimurium LT2
gcggaaaggacguucuucucc

SEQ ID NO: 3793988 - RNA, 20 nt, Salmonella typhimurium LT2
gcggaaauacccuuaugaua

SEQ ID NO: 3793989 - RNA, 15 nt, Salmonella typhimurium LT2
gcggaacaucgcuuu

SEQ ID NO: 3793990 - RNA, 13 nt, Salmonella typhimurium LT2
gcggaaccauuuu

SEQ ID NO: 3793991 - RNA, 23 nt, Salmonella typhimurium LT2
gcggaaccauuuuccccagaauc

SEQ ID NO: 3793992 - RNA, 20 nt, Salmonella typhimurium LT2
gcggaaccuguucaugccag

SEQ ID NO: 3793993 - RNA, 23 nt, Salmonella typhimurium LT2
gcggaacgucuuuuuccagcagc

SEQ ID NO: 3793994 - RNA, 16 nt, Salmonella typhimurium LT2
gcggaacucaucauca

SEQ ID NO: 3793995 - RNA, 15 nt, Salmonella typhimurium LT2
gcggaagaucgccau

SEQ ID NO: 3793996 - RNA, 19 nt, Salmonella typhimurium LT2
gcggaagcaaaauagcauu

SEQ ID NO: 3793997 - RNA, 14 nt, Salmonella typhimurium LT2
gcggaagcgaccgg

SEQ ID NO: 3793998 - RNA, 14 nt, Salmonella typhimurium LT2
gcggaaggcgccuc

SEQ ID NO: 3793999 - RNA, 22 nt, Salmonella typhimurium LT2
gcggaaggcgccucgcgcggcg

SEQ ID NO: 3794000 - RNA, 22 nt, Salmonella typhimurium LT2
gcggaauccccgccgccaguaa

SEQ ID NO: 3794001 - RNA, 18 nt, Salmonella typhimurium LT2
gcggaaucgcuuccuggg

SEQ ID NO: 3794002 - RNA, 20 nt, Salmonella typhimurium LT2
gcggaaugaccugagcgugc

SEQ ID NO: 3794003 - RNA, 13 nt, Salmonella typhimurium LT2
gcggaaugcccac

SEQ ID NO: 3794004 - RNA, 18 nt, Salmonella typhimurium LT2
gcggaaugcccacgcuuc

SEQ ID NO: 3794005 - RNA, 22 nt, Salmonella typhimurium LT2
gcggaauucccacaucgcgauu

SEQ ID NO: 3794006 - RNA, 16 nt, Salmonella typhimurium LT2
gcggaauuucaggaag

SEQ ID NO: 3794007 - RNA, 18 nt, Salmonella typhimurium LT2
gcggaauuuuauccuggg

SEQ ID NO: 3794008 - RNA, 15 nt, Salmonella typhimurium LT2
gcggacacccgcagc

SEQ ID NO: 3794009 - RNA, 13 nt, Salmonella typhimurium LT2
gcggacacggcgu

SEQ ID NO: 3794010 - RNA, 12 nt, Salmonella typhimurium LT2
gcggacagcggc

SEQ ID NO: 3794011 - RNA, 20 nt, Salmonella typhimurium LT2
gcggacggcuaauaugccag

SEQ ID NO: 3794012 - RNA, 19 nt, Salmonella typhimurium LT2
gcggagaagacgccgccgc

SEQ ID NO: 3794013 - RNA, 18 nt, Salmonella typhimurium LT2
gcggagaguucgcggaag

SEQ ID NO: 3794014 - RNA, 16 nt, Salmonella typhimurium LT2
gcggagaucgcucccg

SEQ ID NO: 3794015 - RNA, 17 nt, Salmonella typhimurium LT2
gcggagaucgcucccgc

SEQ ID NO: 3794016 - RNA, 13 nt, Salmonella typhimurium LT2
gcggagaucgcuu

SEQ ID NO: 3794017 - RNA, 21 nt, Salmonella typhimurium LT2
gcggauaaauagugacgccgc

SEQ ID NO: 3794018 - RNA, 24 nt, Salmonella typhimurium LT2
gcggauaaauagugacgccgccau

SEQ ID NO: 3794019 - RNA, 19 nt, Salmonella typhimurium LT2
gcggauaagcgcagcgcca

SEQ ID NO: 3794020 - RNA, 20 nt, Salmonella typhimurium LT2
gcggauaagcgcagcgccau

SEQ ID NO: 3794021 - RNA, 15 nt, Salmonella typhimurium LT2
gcggauaauccgcca

SEQ ID NO: 3794022 - RNA, 18 nt, Salmonella typhimurium LT2
gcggauacagcggcgcgc

SEQ ID NO: 3794023 - RNA, 21 nt, Salmonella typhimurium LT2
gcggauacagcggcgcgccaa

SEQ ID NO: 3794024 - RNA, 16 nt, Salmonella typhimurium LT2
gcggauagacgauaua

SEQ ID NO: 3794025 - RNA, 16 nt, Salmonella typhimurium LT2
gcggauaugcagcagc

SEQ ID NO: 3794026 - RNA, 17 nt, Salmonella typhimurium LT2
gcggauaugcagcagcc

SEQ ID NO: 3794027 - RNA, 23 nt, Salmonella typhimurium LT2
gcggaucaaacuccgcgcuggca

SEQ ID NO: 3794028 - RNA, 14 nt, Salmonella typhimurium LT2
gcggauccggcgca

SEQ ID NO: 3794029 - RNA, 22 nt, Salmonella typhimurium LT2
gcggaucgccaucgacagcagc

SEQ ID NO: 3794030 - RNA, 16 nt, Salmonella typhimurium LT2
gcggaugaaacagucc

SEQ ID NO: 3794031 - RNA, 12 nt, Salmonella typhimurium LT2
gcggaugcgcca

SEQ ID NO: 3794032 - RNA, 21 nt, Salmonella typhimurium LT2
gcggaugcgccauccaccagg

SEQ ID NO: 3794033 - RNA, 17 nt, Salmonella typhimurium LT2
gcggaugcugcgccagc

SEQ ID NO: 3794034 - RNA, 19 nt, Salmonella typhimurium LT2
gcggaugguggcguaaaua

SEQ ID NO: 3794035 - RNA, 19 nt, Salmonella typhimurium LT2
gcggaugucggucaucagg

SEQ ID NO: 3794036 - RNA, 18 nt, Salmonella typhimurium LT2
gcggauguuaaugaauaa

SEQ ID NO: 3794037 - RNA, 19 nt, Salmonella typhimurium LT2
gcggauuccaguagcgcgc

SEQ ID NO: 3794038 - RNA, 12 nt, Salmonella typhimurium LT2
gcgggcagcagc

SEQ ID NO: 3794039 - RNA, 21 nt, Salmonella typhimurium LT2
gcgggcagcauugaccaccau

SEQ ID NO: 3794040 - RNA, 12 nt, Salmonella typhimurium LT2
gcgggcauuuuu

SEQ ID NO: 3794041 - RNA, 11 nt, Salmonella typhimurium LT2
gcgggccgcgg

SEQ ID NO: 3794042 - RNA, 17 nt, Salmonella typhimurium LT2
gcgggccgcggcgcgca

SEQ ID NO: 3794043 - RNA, 22 nt, Salmonella typhimurium LT2
gcgggccguaaaguucccagcg

SEQ ID NO: 3794044 - RNA, 15 nt, Salmonella typhimurium LT2
gcgggccguggccag

SEQ ID NO: 3794045 - RNA, 23 nt, Salmonella typhimurium LT2
gcgggcguugcugcacgccgcgc

SEQ ID NO: 3794046 - RNA, 16 nt, Salmonella typhimurium LT2
gcgggcuauaggccau

SEQ ID NO: 3794047 - RNA, 23 nt, Salmonella typhimurium LT2
gcgggcuguuuuccagcggcuuc

SEQ ID NO: 3794048 - RNA, 21 nt, Salmonella typhimurium LT2
gcgggcuuuuuuugcccgcuc

SEQ ID NO: 3794049 - RNA, 21 nt, Salmonella typhimurium LT2
gcggggaacacaauuaaagcc

SEQ ID NO: 3794050 - RNA, 19 nt, Salmonella typhimurium LT2
gcggggauaaucagcagcg

SEQ ID NO: 3794051 - RNA, 22 nt, Salmonella typhimurium LT2
gcggggauaaucagcagcgacg

SEQ ID NO: 3794052 - RNA, 21 nt, Salmonella typhimurium LT2
gcgggguucgggcagcgcuuc

SEQ ID NO: 3794053 - RNA, 13 nt, Salmonella typhimurium LT2
gcggguaaacaga

SEQ ID NO: 3794054 - RNA, 13 nt, Salmonella typhimurium LT2
gcgggucaaaagc

SEQ ID NO: 3794055 - RNA, 23 nt, Salmonella typhimurium LT2
gcgggucaacgccaagcgcggca

SEQ ID NO: 3794056 - RNA, 16 nt, Salmonella typhimurium LT2
gcgggugagcgcuauc

SEQ ID NO: 3794057 - RNA, 14 nt, Salmonella typhimurium LT2
gcgggugaugacgc

SEQ ID NO: 3794058 - RNA, 23 nt, Salmonella typhimurium LT2
gcgggugcgcagccccagcgcca

SEQ ID NO: 3794059 - RNA, 14 nt, Salmonella typhimurium LT2
gcggguuagcgccg

SEQ ID NO: 3794060 - RNA, 15 nt, Salmonella typhimurium LT2
gcggguucccccacu

SEQ ID NO: 3794061 - RNA, 14 nt, Salmonella typhimurium LT2
gcggguucuuucuu

SEQ ID NO: 3794062 - RNA, 22 nt, Salmonella typhimurium LT2
gcgguaaaaccuaacgccugca

SEQ ID NO: 3794063 - RNA, 22 nt, Salmonella typhimurium LT2
gcgguaaauacgcggcacguuu

SEQ ID NO: 3794064 - RNA, 18 nt, Salmonella typhimurium LT2
gcgguaacaggcaccagc

SEQ ID NO: 3794065 - RNA, 15 nt, Salmonella typhimurium LT2
gcgguaacguaacug

SEQ ID NO: 3794066 - RNA, 16 nt, Salmonella typhimurium LT2
gcgguaaggcaccggu

SEQ ID NO: 3794067 - RNA, 22 nt, Salmonella typhimurium LT2
gcgguaagucaaccagcccuuc

SEQ ID NO: 3794068 - RNA, 15 nt, Salmonella typhimurium LT2
gcgguaauaugccag

SEQ ID NO: 3794069 - RNA, 13 nt, Salmonella typhimurium LT2
gcgguaaucgccg

SEQ ID NO: 3794070 - RNA, 18 nt, Salmonella typhimurium LT2
gcgguaaucgccgcgaca

SEQ ID NO: 3794071 - RNA, 17 nt, Salmonella typhimurium LT2
gcgguacagcaucccgc

SEQ ID NO: 3794072 - RNA, 14 nt, Salmonella typhimurium LT2
gcgguacaggcugu

SEQ ID NO: 3794073 - RNA, 22 nt, Salmonella typhimurium LT2
gcgguaccauaccugcggccau

SEQ ID NO: 3794074 - RNA, 21 nt, Salmonella typhimurium LT2
gcgguaccggcauuacccagu

SEQ ID NO: 3794075 - RNA, 16 nt, Salmonella typhimurium LT2
gcgguacgaaucgccg

SEQ ID NO: 3794076 - RNA, 18 nt, Salmonella typhimurium LT2
gcgguacgccuugagcaa

SEQ ID NO: 3794077 - RNA, 20 nt, Salmonella typhimurium LT2
gcgguacgccuugagcaaaa

SEQ ID NO: 3794078 - RNA, 13 nt, Salmonella typhimurium LT2
gcgguacggacau

SEQ ID NO: 3794079 - RNA, 18 nt, Salmonella typhimurium LT2
gcgguacuccgccauccg

SEQ ID NO: 3794080 - RNA, 20 nt, Salmonella typhimurium LT2
gcgguagaaaguacaucauu

SEQ ID NO: 3794081 - RNA, 20 nt, Salmonella typhimurium LT2
gcgguagauucuaucuguuu

SEQ ID NO: 3794082 - RNA, 12 nt, Salmonella typhimurium LT2
gcgguagcgccg

SEQ ID NO: 3794083 - RNA, 13 nt, Salmonella typhimurium LT2
gcgguaggcguca

SEQ ID NO: 3794084 - RNA, 23 nt, Salmonella typhimurium LT2
gcgguauaacugccuuauccggc

SEQ ID NO: 3794085 - RNA, 14 nt, Salmonella typhimurium LT2
gcgguauacaccag

SEQ ID NO: 3794086 - RNA, 17 nt, Salmonella typhimurium LT2
gcgguauagaucaggcg

SEQ ID NO: 3794087 - RNA, 22 nt, Salmonella typhimurium LT2
gcgguaucaaugcgacagcggc

SEQ ID NO: 3794088 - RNA, 23 nt, Salmonella typhimurium LT2
gcgguaucaaugcgacagcggca

SEQ ID NO: 3794089 - RNA, 16 nt, Salmonella typhimurium LT2
gcgguauccuccugcc

SEQ ID NO: 3794090 - RNA, 18 nt, Salmonella typhimurium LT2
gcgguaugaaagccaucg

SEQ ID NO: 3794091 - RNA, 16 nt, Salmonella typhimurium LT2
gcggucaaaagcugca

SEQ ID NO: 3794092 - RNA, 23 nt, Salmonella typhimurium LT2
gcggucagcacagcgaugaugau

SEQ ID NO: 3794093 - RNA, 13 nt, Salmonella typhimurium LT2
gcggucaggccag

SEQ ID NO: 3794094 - RNA, 22 nt, Salmonella typhimurium LT2
gcggucagggugaauaccagcg

SEQ ID NO: 3794095 - RNA, 23 nt, Salmonella typhimurium LT2
gcggucagggugaaucccgccau

SEQ ID NO: 3794096 - RNA, 20 nt, Salmonella typhimurium LT2
gcggucagugauuuccgggu

SEQ ID NO: 3794097 - RNA, 13 nt, Salmonella typhimurium LT2
gcgguccgcccau

SEQ ID NO: 3794098 - RNA, 19 nt, Salmonella typhimurium LT2
gcgguccggcauccaaccg

SEQ ID NO: 3794099 - RNA, 23 nt, Salmonella typhimurium LT2
gcggucgauuuugccuucaauuc

SEQ ID NO: 3794100 - RNA, 19 nt, Salmonella typhimurium LT2
gcggucgccugccgcaugu

SEQ ID NO: 3794101 - RNA, 16 nt, Salmonella typhimurium LT2
gcggucgcugauaauc

SEQ ID NO: 3794102 - RNA, 19 nt, Salmonella typhimurium LT2
gcggucgcuuuuugcgcca

SEQ ID NO: 3794103 - RNA, 19 nt, Salmonella typhimurium LT2
gcggucuucaacaccgaca

SEQ ID NO: 3794104 - RNA, 15 nt, Salmonella typhimurium LT2
gcggugaaacuguuu

SEQ ID NO: 3794105 - RNA, 13 nt, Salmonella typhimurium LT2
gcggugaucccag

SEQ ID NO: 3794106 - RNA, 17 nt, Salmonella typhimurium LT2
gcggugauccuccugca

SEQ ID NO: 3794107 - RNA, 22 nt, Salmonella typhimurium LT2
gcggugcaugaauaucaaacca

SEQ ID NO: 3794108 - RNA, 17 nt, Salmonella typhimurium LT2
gcggugcucuuuuguca

SEQ ID NO: 3794109 - RNA, 17 nt, Salmonella typhimurium LT2
gcgguggguagcggcaa

SEQ ID NO: 3794110 - RNA, 18 nt, Salmonella typhimurium LT2
gcgguguaaaagccagca

SEQ ID NO: 3794111 - RNA, 23 nt, Salmonella typhimurium LT2
gcgguuacagucuuuggaguaga

SEQ ID NO: 3794112 - RNA, 15 nt, Salmonella typhimurium LT2
gcgguuacguccggc

SEQ ID NO: 3794113 - RNA, 14 nt, Salmonella typhimurium LT2
gcgguuacguucgg

SEQ ID NO: 3794114 - RNA, 16 nt, Salmonella typhimurium LT2
gcgguucaggccggau

SEQ ID NO: 3794115 - RNA, 15 nt, Salmonella typhimurium LT2
gcgguugcagcaaaa

SEQ ID NO: 3794116 - RNA, 23 nt, Salmonella typhimurium LT2
gcgguugcggcggggauaaucag

SEQ ID NO: 3794117 - RNA, 20 nt, Salmonella typhimurium LT2
gcgguuuaaugcuaucccag

SEQ ID NO: 3794118 - RNA, 23 nt, Salmonella typhimurium LT2
gcgguuuaccgugaagcccggcg

SEQ ID NO: 3794119 - RNA, 15 nt, Salmonella typhimurium LT2
gcgguuuagccgcca

SEQ ID NO: 3794120 - RNA, 13 nt, Salmonella typhimurium LT2
gcgguuuauccgg

SEQ ID NO: 3794121 - RNA, 21 nt, Salmonella typhimurium LT2
gcgguuugacgacuuuaucaa

SEQ ID NO: 3794122 - RNA, 19 nt, Salmonella typhimurium LT2
gcgguuuucaauaauaaaa

SEQ ID NO: 3794123 - RNA, 15 nt, Salmonella typhimurium LT2
gcguaaaaccgcgcu

SEQ ID NO: 3794124 - RNA, 20 nt, Salmonella typhimurium LT2
gcguaaaccccuucaccacu

SEQ ID NO: 3794125 - RNA, 21 nt, Salmonella typhimurium LT2
gcguaaauaccaccugccaaa

SEQ ID NO: 3794126 - RNA, 17 nt, Salmonella typhimurium LT2
gcguaaauaccuuccgg

SEQ ID NO: 3794127 - RNA, 20 nt, Salmonella typhimurium LT2
gcguaaauaccuuccggcgu

SEQ ID NO: 3794128 - RNA, 15 nt, Salmonella typhimurium LT2
gcguaaaucaggcca

SEQ ID NO: 3794129 - RNA, 13 nt, Salmonella typhimurium LT2
gcguaacagcgcu

SEQ ID NO: 3794130 - RNA, 14 nt, Salmonella typhimurium LT2
gcguaacgccacau

SEQ ID NO: 3794131 - RNA, 18 nt, Salmonella typhimurium LT2
gcguaacgccacauauaa

SEQ ID NO: 3794132 - RNA, 18 nt, Salmonella typhimurium LT2
gcguaacgccuccaccgu

SEQ ID NO: 3794133 - RNA, 22 nt, Salmonella typhimurium LT2
gcguaacguugauuuggaggcc

SEQ ID NO: 3794134 - RNA, 22 nt, Salmonella typhimurium LT2
gcguaaggugaaauacccgccg

SEQ ID NO: 3794135 - RNA, 15 nt, Salmonella typhimurium LT2
gcguaagucguaccg

SEQ ID NO: 3794136 - RNA, 16 nt, Salmonella typhimurium LT2
gcguaaugagcgucgc

SEQ ID NO: 3794137 - RNA, 13 nt, Salmonella typhimurium LT2
gcguaauggccac

SEQ ID NO: 3794138 - RNA, 20 nt, Salmonella typhimurium LT2
gcguaauggccaccagcaca

SEQ ID NO: 3794139 - RNA, 14 nt, Salmonella typhimurium LT2
gcguaauuugcgac

SEQ ID NO: 3794140 - RNA, 22 nt, Salmonella typhimurium LT2
gcguaauuuugccacccacuuc

SEQ ID NO: 3794141 - RNA, 18 nt, Salmonella typhimurium LT2
gcgugcgaauuucggcaa

SEQ ID NO: 3794142 - RNA, 14 nt, Salmonella typhimurium LT2
gcgugcgcuacggc

SEQ ID NO: 3794143 - RNA, 15 nt, Salmonella typhimurium LT2
gcgugcgcuuccacu

SEQ ID NO: 3794144 - RNA, 18 nt, Salmonella typhimurium LT2
gcguggaaaacagcgccg

SEQ ID NO: 3794145 - RNA, 17 nt, Salmonella typhimurium LT2
gcguggcguaucggcag

SEQ ID NO: 3794146 - RNA, 15 nt, Salmonella typhimurium LT2
gcguggcguuccagu

SEQ ID NO: 3794147 - RNA, 14 nt, Salmonella typhimurium LT2
gcguggguucacag

SEQ ID NO: 3794148 - RNA, 19 nt, Salmonella typhimurium LT2
gcgugguaucgcggcagcg

SEQ ID NO: 3794149 - RNA, 23 nt, Salmonella typhimurium LT2
gcgugguaucgcggcagcgcugc

SEQ ID NO: 3794150 - RNA, 20 nt, Salmonella typhimurium LT2
gcgugguaucucgucgccag

SEQ ID NO: 3794151 - RNA, 24 nt, Salmonella typhimurium LT2
gcgugguaucucgucgccagggcg

SEQ ID NO: 3794152 - RNA, 21 nt, Salmonella typhimurium LT2
gcgugguggauauccagcaua

SEQ ID NO: 3794153 - RNA, 18 nt, Salmonella typhimurium LT2
gcgugguuuccggcagcu

SEQ ID NO: 3794154 - RNA, 17 nt, Salmonella typhimurium LT2
gcguguaaaccgccaga

SEQ ID NO: 3794155 - RNA, 19 nt, Salmonella typhimurium LT2
gcguguaacugcaaacgcg

SEQ ID NO: 3794156 - RNA, 15 nt, Salmonella typhimurium LT2
gcguguacauuauca

SEQ ID NO: 3794157 - RNA, 21 nt, Salmonella typhimurium LT2
gcgugucgccggggcgcuggc

SEQ ID NO: 3794158 - RNA, 13 nt, Salmonella typhimurium LT2
gcguguggugagg

SEQ ID NO: 3794159 - RNA, 23 nt, Salmonella typhimurium LT2
gcguguuguacagcaauaaaagg

SEQ ID NO: 3794160 - RNA, 23 nt, Salmonella typhimurium LT2
gcguuaagccguguaaauccaga

SEQ ID NO: 3794161 - RNA, 13 nt, Salmonella typhimurium LT2
gcguuacaggaca

SEQ ID NO: 3794162 - RNA, 18 nt, Salmonella typhimurium LT2
gcguuacgggaacagaau

SEQ ID NO: 3794163 - RNA, 20 nt, Salmonella typhimurium LT2
gcguuagugcccagcgcgac

SEQ ID NO: 3794164 - RNA, 16 nt, Salmonella typhimurium LT2
gcguuauugaccaucg

SEQ ID NO: 3794165 - RNA, 15 nt, Salmonella typhimurium LT2
gcguucaaaaucaaa

SEQ ID NO: 3794166 - RNA, 18 nt, Salmonella typhimurium LT2
gcguucaauauucgcgcc

SEQ ID NO: 3794167 - RNA, 15 nt, Salmonella typhimurium LT2
gcguucacgccgcca

SEQ ID NO: 3794168 - RNA, 14 nt, Salmonella typhimurium LT2
gcguucauccagcg

SEQ ID NO: 3794169 - RNA, 17 nt, Salmonella typhimurium LT2
gcguucauccagcgcgc

SEQ ID NO: 3794170 - RNA, 18 nt, Salmonella typhimurium LT2
gcguucauggcgcgacau

SEQ ID NO: 3794171 - RNA, 23 nt, Salmonella typhimurium LT2
gcguucauggcgcgacauggcga

SEQ ID NO: 3794172 - RNA, 13 nt, Salmonella typhimurium LT2
gcguuccagcauu

SEQ ID NO: 3794173 - RNA, 15 nt, Salmonella typhimurium LT2
gcguucccaguuccg

SEQ ID NO: 3794174 - RNA, 17 nt, Salmonella typhimurium LT2
gcguuccgcucagcguc

SEQ ID NO: 3794175 - RNA, 18 nt, Salmonella typhimurium LT2
gcguuccgcucagcguca

SEQ ID NO: 3794176 - RNA, 13 nt, Salmonella typhimurium LT2
gcguuccuuauca

SEQ ID NO: 3794177 - RNA, 22 nt, Salmonella typhimurium LT2
gcguucgaccguuuccgccagu

SEQ ID NO: 3794178 - RNA, 19 nt, Salmonella typhimurium LT2
gcguucgccaaagcaguga

SEQ ID NO: 3794179 - RNA, 20 nt, Salmonella typhimurium LT2
gcguucgcgcaguucaucca

SEQ ID NO: 3794180 - RNA, 17 nt, Salmonella typhimurium LT2
gcguucggccugcugca

SEQ ID NO: 3794181 - RNA, 17 nt, Salmonella typhimurium LT2
gcguucggguuuuccug

SEQ ID NO: 3794182 - RNA, 20 nt, Salmonella typhimurium LT2
gcguucuggaguuuaaacac

SEQ ID NO: 3794183 - RNA, 13 nt, Salmonella typhimurium LT2
gcguucuuccacu

SEQ ID NO: 3794184 - RNA, 20 nt, Salmonella typhimurium LT2
gcguugaauuccaucggcau

SEQ ID NO: 3794185 - RNA, 13 nt, Salmonella typhimurium LT2
gcguugauggcgu

SEQ ID NO: 3794186 - RNA, 12 nt, Salmonella typhimurium LT2
gcguugcagcca

SEQ ID NO: 3794187 - RNA, 20 nt, Salmonella typhimurium LT2
gcguugccaucgcacucucc

SEQ ID NO: 3794188 - RNA, 12 nt, Salmonella typhimurium LT2
gcguuggcugcu

SEQ ID NO: 3794189 - RNA, 16 nt, Salmonella typhimurium LT2
gcguugucuaccgcgc

SEQ ID NO: 3794190 - RNA, 15 nt, Salmonella typhimurium LT2
gcguuguuccugagu

SEQ ID NO: 3794191 - RNA, 16 nt, Salmonella typhimurium LT2
gcguuuaccaccggaa

SEQ ID NO: 3794192 - RNA, 17 nt, Salmonella typhimurium LT2
gcguuuaccaccggaaa

SEQ ID NO: 3794193 - RNA, 15 nt, Salmonella typhimurium LT2
gcguuucacuucuga

SEQ ID NO: 3794194 - RNA, 17 nt, Salmonella typhimurium LT2
gcguuucagcuuccagu

SEQ ID NO: 3794195 - RNA, 14 nt, Salmonella typhimurium LT2
gcguuuccacgaca

SEQ ID NO: 3794196 - RNA, 15 nt, Salmonella typhimurium LT2
gcguuuccacgacaa

SEQ ID NO: 3794197 - RNA, 16 nt, Salmonella typhimurium LT2
gcguuuccagccaguc

SEQ ID NO: 3794198 - RNA, 22 nt, Salmonella typhimurium LT2
gcguuucgcgcgcgccugccgc

SEQ ID NO: 3794199 - RNA, 13 nt, Salmonella typhimurium LT2
gcguuucguaaug

SEQ ID NO: 3794200 - RNA, 22 nt, Salmonella typhimurium LT2
gcguuucguaauggccuacaca

SEQ ID NO: 3794201 - RNA, 15 nt, Salmonella typhimurium LT2
gcguuugcgccgcca

SEQ ID NO: 3794202 - RNA, 16 nt, Salmonella typhimurium LT2
gcguuugcgccgccau

SEQ ID NO: 3794203 - RNA, 13 nt, Salmonella typhimurium LT2
gcguuuguaaugc

SEQ ID NO: 3794204 - RNA, 22 nt, Salmonella typhimurium LT2
gcguuugucuucuuaguaacau

SEQ ID NO: 3794205 - RNA, 13 nt, Salmonella typhimurium LT2
gcguuuuccagcg

SEQ ID NO: 3794206 - RNA, 18 nt, Salmonella typhimurium LT2
gcguuuuccaucaucagg

SEQ ID NO: 3794207 - RNA, 23 nt, Salmonella typhimurium LT2
gcguuuugacuuugaccagcauc

SEQ ID NO: 3794208 - RNA, 15 nt, Salmonella typhimurium LT2
gcguuuuuaccggcu

SEQ ID NO: 3794209 - RNA, 15 nt, Salmonella typhimurium LT2
gcuaaaacagauaac

SEQ ID NO: 3794210 - RNA, 12 nt, Salmonella typhimurium LT2
gcuaaaauaccc

SEQ ID NO: 3794211 - RNA, 17 nt, Salmonella typhimurium LT2
gcuaaacaauuugccca

SEQ ID NO: 3794212 - RNA, 14 nt, Salmonella typhimurium LT2
gcuaaacagcgccg

SEQ ID NO: 3794213 - RNA, 18 nt, Salmonella typhimurium LT2
gcuaaacguagcauuucc

SEQ ID NO: 3794214 - RNA, 14 nt, Salmonella typhimurium LT2
gcuaaagcaucggg

SEQ ID NO: 3794215 - RNA, 19 nt, Salmonella typhimurium LT2
gcuaaagcgacuuauccgg

SEQ ID NO: 3794216 - RNA, 13 nt, Salmonella typhimurium LT2
gcuaaagucagca

SEQ ID NO: 3794217 - RNA, 19 nt, Salmonella typhimurium LT2
gcuaaaucacgcaggucau

SEQ ID NO: 3794218 - RNA, 15 nt, Salmonella typhimurium LT2
gcuaaaucagugaug

SEQ ID NO: 3794219 - RNA, 20 nt, Salmonella typhimurium LT2
gcuaaaucguccgccgucgg

SEQ ID NO: 3794220 - RNA, 23 nt, Salmonella typhimurium LT2
gcuaaaugacaaauagaagccac

SEQ ID NO: 3794221 - RNA, 18 nt, Salmonella typhimurium LT2
gcuaaccagcgagcuaca

SEQ ID NO: 3794222 - RNA, 13 nt, Salmonella typhimurium LT2
gcuaaccaggcca

SEQ ID NO: 3794223 - RNA, 16 nt, Salmonella typhimurium LT2
gcuaaccuguucagcc

SEQ ID NO: 3794224 - RNA, 17 nt, Salmonella typhimurium LT2
gcuaaccuguucagccg

SEQ ID NO: 3794225 - RNA, 12 nt, Salmonella typhimurium LT2
gcuaacgcgcac

SEQ ID NO: 3794226 - RNA, 20 nt, Salmonella typhimurium LT2
gcuaacgcgccuccggccug

SEQ ID NO: 3794227 - RNA, 23 nt, Salmonella typhimurium LT2
gcuaagcguuacggaaaaaauac

SEQ ID NO: 3794228 - RNA, 22 nt, Salmonella typhimurium LT2
gcuaagggcaccagcaacacau

SEQ ID NO: 3794229 - RNA, 16 nt, Salmonella typhimurium LT2
gcuaauauccagccac

SEQ ID NO: 3794230 - RNA, 23 nt, Salmonella typhimurium LT2
gcuaaucaccaccucaaacgaug

SEQ ID NO: 3794231 - RNA, 22 nt, Salmonella typhimurium LT2
gcuaaucaggaagaaagacgcg

SEQ ID NO: 3794232 - RNA, 20 nt, Salmonella typhimurium LT2
gcuaaucaggacaucaaagg

SEQ ID NO: 3794233 - RNA, 18 nt, Salmonella typhimurium LT2
gcuaauccccccuuuuuu

SEQ ID NO: 3794234 - RNA, 18 nt, Salmonella typhimurium LT2
gcuaaucccgcucgccag

SEQ ID NO: 3794235 - RNA, 18 nt, Salmonella typhimurium LT2
gcuaaugaggaaaaagcc

SEQ ID NO: 3794236 - RNA, 22 nt, Salmonella typhimurium LT2
gcuaauucucccugccaggcca

SEQ ID NO: 3794237 - RNA, 16 nt, Salmonella typhimurium LT2
gcuaauugguagcuuu

SEQ ID NO: 3794238 - RNA, 17 nt, Salmonella typhimurium LT2
gcuaauuuucagggugg

SEQ ID NO: 3794239 - RNA, 19 nt, Salmonella typhimurium LT2
gcuacacgcgaauagccag

SEQ ID NO: 3794240 - RNA, 17 nt, Salmonella typhimurium LT2
gcuacagacgcauuaaa

SEQ ID NO: 3794241 - RNA, 12 nt, Salmonella typhimurium LT2
gcuacaggcguc

SEQ ID NO: 3794242 - RNA, 22 nt, Salmonella typhimurium LT2
gcuacaguguuaacgcgugcuc

SEQ ID NO: 3794243 - RNA, 14 nt, Salmonella typhimurium LT2
gcuaccagcgcggc

SEQ ID NO: 3794244 - RNA, 19 nt, Salmonella typhimurium LT2
gcuaccgauucgcgcguca

SEQ ID NO: 3794245 - RNA, 20 nt, Salmonella typhimurium LT2
gcucacgcuuauccggccua

SEQ ID NO: 3794246 - RNA, 23 nt, Salmonella typhimurium LT2
gcucacgguuucuacuuccacca

SEQ ID NO: 3794247 - RNA, 17 nt, Salmonella typhimurium LT2
gcucacuaccgccgcga

SEQ ID NO: 3794248 - RNA, 21 nt, Salmonella typhimurium LT2
gcucacuaccgcgaugugcug

SEQ ID NO: 3794249 - RNA, 21 nt, Salmonella typhimurium LT2
gcucacugguugcccauggca

SEQ ID NO: 3794250 - RNA, 18 nt, Salmonella typhimurium LT2
gcucacuuuucuuuccug

SEQ ID NO: 3794251 - RNA, 19 nt, Salmonella typhimurium LT2
gcucagaccauauucacgc

SEQ ID NO: 3794252 - RNA, 21 nt, Salmonella typhimurium LT2
gcucagauaacauaugaguua

SEQ ID NO: 3794253 - RNA, 13 nt, Salmonella typhimurium LT2
gcucagccaggcg

SEQ ID NO: 3794254 - RNA, 22 nt, Salmonella typhimurium LT2
gcucagcgucugcacgccaaua

SEQ ID NO: 3794255 - RNA, 22 nt, Salmonella typhimurium LT2
gcucagcuggauagagcaucaa

SEQ ID NO: 3794256 - RNA, 13 nt, Salmonella typhimurium LT2
gcucaggaucaau

SEQ ID NO: 3794257 - RNA, 19 nt, Salmonella typhimurium LT2
gcucaggccaaucacccca

SEQ ID NO: 3794258 - RNA, 14 nt, Salmonella typhimurium LT2
gcucaggcgcgaau

SEQ ID NO: 3794259 - RNA, 19 nt, Salmonella typhimurium LT2
gcucaggcgcgaauaaugc

SEQ ID NO: 3794260 - RNA, 19 nt, Salmonella typhimurium LT2
gcucaggcguugacuuacg

SEQ ID NO: 3794261 - RNA, 13 nt, Salmonella typhimurium LT2
gcucagggucaga

SEQ ID NO: 3794262 - RNA, 21 nt, Salmonella typhimurium LT2
gcucaggguuuucuaccgcag

SEQ ID NO: 3794263 - RNA, 21 nt, Salmonella typhimurium LT2
gcucagguuguccagcagcag

SEQ ID NO: 3794264 - RNA, 14 nt, Salmonella typhimurium LT2
gcucaguauggcca

SEQ ID NO: 3794265 - RNA, 20 nt, Salmonella typhimurium LT2
gcucagucacuucaaccuuu

SEQ ID NO: 3794266 - RNA, 18 nt, Salmonella typhimurium LT2
gcucaguccagccgccgc

SEQ ID NO: 3794267 - RNA, 18 nt, Salmonella typhimurium LT2
gcucaguugcguucccag

SEQ ID NO: 3794268 - RNA, 15 nt, Salmonella typhimurium LT2
gcucaguugguuaga

SEQ ID NO: 3794269 - RNA, 21 nt, Salmonella typhimurium LT2
gcucaguugguuagagcacau

SEQ ID NO: 3794270 - RNA, 13 nt, Salmonella typhimurium LT2
gcucauaaacgcg

SEQ ID NO: 3794271 - RNA, 17 nt, Salmonella typhimurium LT2
gcucauaacccuccugc

SEQ ID NO: 3794272 - RNA, 19 nt, Salmonella typhimurium LT2
gcucauaacccuccugccu

SEQ ID NO: 3794273 - RNA, 17 nt, Salmonella typhimurium LT2
gcucauaccgccgccca

SEQ ID NO: 3794274 - RNA, 19 nt, Salmonella typhimurium LT2
gcucauaccuggcuugaug

SEQ ID NO: 3794275 - RNA, 18 nt, Salmonella typhimurium LT2
gcucaucaaacagcggca

SEQ ID NO: 3794276 - RNA, 22 nt, Salmonella typhimurium LT2
gcucaucaaacagcggcacuuc

SEQ ID NO: 3794277 - RNA, 18 nt, Salmonella typhimurium LT2
gcucaucacaucgcgcag

SEQ ID NO: 3794278 - RNA, 16 nt, Salmonella typhimurium LT2
gcucaucaccagcagc

SEQ ID NO: 3794279 - RNA, 14 nt, Salmonella typhimurium LT2
gcucauccagcagc

SEQ ID NO: 3794280 - RNA, 15 nt, Salmonella typhimurium LT2
gcucauccagcagca

SEQ ID NO: 3794281 - RNA, 16 nt, Salmonella typhimurium LT2
gcucauccagcagcau

SEQ ID NO: 3794282 - RNA, 13 nt, Salmonella typhimurium LT2
gcucaucggcggc

SEQ ID NO: 3794283 - RNA, 22 nt, Salmonella typhimurium LT2
gcucaucgggcgaagccugacg

SEQ ID NO: 3794284 - RNA, 13 nt, Salmonella typhimurium LT2
gcucaucucaagc

SEQ ID NO: 3794285 - RNA, 15 nt, Salmonella typhimurium LT2
gcucaugacaucgcc

SEQ ID NO: 3794286 - RNA, 14 nt, Salmonella typhimurium LT2
gcucaugcgcgucc

SEQ ID NO: 3794287 - RNA, 22 nt, Salmonella typhimurium LT2
gcucaugcgcgucccggcagug

SEQ ID NO: 3794288 - RNA, 19 nt, Salmonella typhimurium LT2
gcucaugugcagcauccag

SEQ ID NO: 3794289 - RNA, 15 nt, Salmonella typhimurium LT2
gcucauuaaaccgcg

SEQ ID NO: 3794290 - RNA, 23 nt, Salmonella typhimurium LT2
gcucauucuccgggauagcaauc

SEQ ID NO: 3794291 - RNA, 16 nt, Salmonella typhimurium LT2
gcucauuucagcgagu

SEQ ID NO: 3794292 - RNA, 13 nt, Salmonella typhimurium LT2
gcucauuucccaa

SEQ ID NO: 3794293 - RNA, 15 nt, Salmonella typhimurium LT2
gcucauuugcggcgu

SEQ ID NO: 3794294 - RNA, 15 nt, Salmonella typhimurium LT2
gcuccaccagcccgc

SEQ ID NO: 3794295 - RNA, 15 nt, Salmonella typhimurium LT2
gcuccaccagcgcau

SEQ ID NO: 3794296 - RNA, 13 nt, Salmonella typhimurium LT2
gcuccacuggccc

SEQ ID NO: 3794297 - RNA, 22 nt, Salmonella typhimurium LT2
gcuccagaaucucgaaacaaua

SEQ ID NO: 3794298 - RNA, 19 nt, Salmonella typhimurium LT2
gcuccagaccaccagcgac

SEQ ID NO: 3794299 - RNA, 21 nt, Salmonella typhimurium LT2
gcuccagaccaccagcgacau

SEQ ID NO: 3794300 - RNA, 13 nt, Salmonella typhimurium LT2
gcuccagagcgcc

SEQ ID NO: 3794301 - RNA, 23 nt, Salmonella typhimurium LT2
gcuccagagcgccguggaaaaau

SEQ ID NO: 3794302 - RNA, 12 nt, Salmonella typhimurium LT2
gcuccagcauca

SEQ ID NO: 3794303 - RNA, 14 nt, Salmonella typhimurium LT2
gcuccagcaucaca

SEQ ID NO: 3794304 - RNA, 12 nt, Salmonella typhimurium LT2
gcuccagccgcu

SEQ ID NO: 3794305 - RNA, 17 nt, Salmonella typhimurium LT2
gcuccagcgccagcucc

SEQ ID NO: 3794306 - RNA, 18 nt, Salmonella typhimurium LT2
gcuccagcgccugcugca

SEQ ID NO: 3794307 - RNA, 21 nt, Salmonella typhimurium LT2
gcuccagcgccugcugcaacg

SEQ ID NO: 3794308 - RNA, 18 nt, Salmonella typhimurium LT2
gcuccagcuucaucauca

SEQ ID NO: 3794309 - RNA, 22 nt, Salmonella typhimurium LT2
gcuccagcuucaucaucagcag

SEQ ID NO: 3794310 - RNA, 21 nt, Salmonella typhimurium LT2
gcuccaguuguuccagcagcu

SEQ ID NO: 3794311 - RNA, 15 nt, Salmonella typhimurium LT2
gcuccauagaaauca

SEQ ID NO: 3794312 - RNA, 18 nt, Salmonella typhimurium LT2
gcuccauagaaaucagca

SEQ ID NO: 3794313 - RNA, 19 nt, Salmonella typhimurium LT2
gcuccauagaaaucagcag

SEQ ID NO: 3794314 - RNA, 16 nt, Salmonella typhimurium LT2
gcucccacucuuccag

SEQ ID NO: 3794315 - RNA, 18 nt, Salmonella typhimurium LT2
gcucccacucuuccagca

SEQ ID NO: 3794316 - RNA, 12 nt, Salmonella typhimurium LT2
gcuccccgccgc

SEQ ID NO: 3794317 - RNA, 20 nt, Salmonella typhimurium LT2
gcucccgcagccacucccga

SEQ ID NO: 3794318 - RNA, 20 nt, Salmonella typhimurium LT2
gcucccgcauggacaaggau

SEQ ID NO: 3794319 - RNA, 15 nt, Salmonella typhimurium LT2
gcucccgcgccuaug

SEQ ID NO: 3794320 - RNA, 16 nt, Salmonella typhimurium LT2
gcucccgcgccuaugu

SEQ ID NO: 3794321 - RNA, 15 nt, Salmonella typhimurium LT2
gcucccguuccaggc

SEQ ID NO: 3794322 - RNA, 15 nt, Salmonella typhimurium LT2
gcucccucgaaugcu

SEQ ID NO: 3794323 - RNA, 12 nt, Salmonella typhimurium LT2
gcuccgcacggu

SEQ ID NO: 3794324 - RNA, 11 nt, Salmonella typhimurium LT2
gcuccgccaga

SEQ ID NO: 3794325 - RNA, 13 nt, Salmonella typhimurium LT2
gcuccgccagagc

SEQ ID NO: 3794326 - RNA, 22 nt, Salmonella typhimurium LT2
gcuccgccagcaaugccgccgc

SEQ ID NO: 3794327 - RNA, 14 nt, Salmonella typhimurium LT2
gcuccgccccgccu

SEQ ID NO: 3794328 - RNA, 13 nt, Salmonella typhimurium LT2
gcuccggcacugg

SEQ ID NO: 3794329 - RNA, 20 nt, Salmonella typhimurium LT2
gcuccggcacuggcgcuggc

SEQ ID NO: 3794330 - RNA, 14 nt, Salmonella typhimurium LT2
gcuccgggccguga

SEQ ID NO: 3794331 - RNA, 17 nt, Salmonella typhimurium LT2
gcuccgguaucgccggc

SEQ ID NO: 3794332 - RNA, 14 nt, Salmonella typhimurium LT2
gcuccguacgcguc

SEQ ID NO: 3794333 - RNA, 15 nt, Salmonella typhimurium LT2
gcuccguaggccgga

SEQ ID NO: 3794334 - RNA, 17 nt, Salmonella typhimurium LT2
gcuccguccugugucuu

SEQ ID NO: 3794335 - RNA, 15 nt, Salmonella typhimurium LT2
gcuccucagcgcuua

SEQ ID NO: 3794336 - RNA, 12 nt, Salmonella typhimurium LT2
gcuccuccaauc

SEQ ID NO: 3794337 - RNA, 13 nt, Salmonella typhimurium LT2
gcuccucgcgaau

SEQ ID NO: 3794338 - RNA, 13 nt, Salmonella typhimurium LT2
gcuccugcgggag

SEQ ID NO: 3794339 - RNA, 12 nt, Salmonella typhimurium LT2
gcuccuggaacc

SEQ ID NO: 3794340 - RNA, 17 nt, Salmonella typhimurium LT2
gcucgacgcgcugcggu

SEQ ID NO: 3794341 - RNA, 20 nt, Salmonella typhimurium LT2
gcucgauaaucccggcgcgc

SEQ ID NO: 3794342 - RNA, 22 nt, Salmonella typhimurium LT2
gcucgcacugauagccgccagu

SEQ ID NO: 3794343 - RNA, 18 nt, Salmonella typhimurium LT2
gcucgcaggccauaaaac

SEQ ID NO: 3794344 - RNA, 13 nt, Salmonella typhimurium LT2
gcucgcauugcuc

SEQ ID NO: 3794345 - RNA, 20 nt, Salmonella typhimurium LT2
gcucgccagcauacgucugc

SEQ ID NO: 3794346 - RNA, 14 nt, Salmonella typhimurium LT2
gcucgcccgcagca

SEQ ID NO: 3794347 - RNA, 17 nt, Salmonella typhimurium LT2
gcucgcccgcagcaaaa

SEQ ID NO: 3794348 - RNA, 17 nt, Salmonella typhimurium LT2
gcucgcccgcgcucugg

SEQ ID NO: 3794349 - RNA, 19 nt, Salmonella typhimurium LT2
gcucgccguuuuuuaaccg

SEQ ID NO: 3794350 - RNA, 17 nt, Salmonella typhimurium LT2
gcucgcgcagauagagc

SEQ ID NO: 3794351 - RNA, 13 nt, Salmonella typhimurium LT2
gcucgcggcggac

SEQ ID NO: 3794352 - RNA, 18 nt, Salmonella typhimurium LT2
gcucgcuaccuuuuuuca

SEQ ID NO: 3794353 - RNA, 11 nt, Salmonella typhimurium LT2
gcucgcuggug

SEQ ID NO: 3794354 - RNA, 21 nt, Salmonella typhimurium LT2
gcucgcuguaccgccauccgg

SEQ ID NO: 3794355 - RNA, 22 nt, Salmonella typhimurium LT2
gcucgcuguaccgccauccggc

SEQ ID NO: 3794356 - RNA, 22 nt, Salmonella typhimurium LT2
gcucgcuuaaugaggccaccag

SEQ ID NO: 3794357 - RNA, 19 nt, Salmonella typhimurium LT2
gcucgcuuacgcggcgcgc

SEQ ID NO: 3794358 - RNA, 17 nt, Salmonella typhimurium LT2
gcucggcagcagcgcgc

SEQ ID NO: 3794359 - RNA, 20 nt, Salmonella typhimurium LT2
gcucggcauacaccgccagc

SEQ ID NO: 3794360 - RNA, 20 nt, Salmonella typhimurium LT2
gcucggcuaucgccacuacg

SEQ ID NO: 3794361 - RNA, 18 nt, Salmonella typhimurium LT2
gcucggguauggcggcau

SEQ ID NO: 3794362 - RNA, 13 nt, Salmonella typhimurium LT2
gcucgguggcggu

SEQ ID NO: 3794363 - RNA, 17 nt, Salmonella typhimurium LT2
gcucguaggccagcgcu

SEQ ID NO: 3794364 - RNA, 19 nt, Salmonella typhimurium LT2
gcucguaggccagcgcuuu

SEQ ID NO: 3794365 - RNA, 22 nt, Salmonella typhimurium LT2
gcucgucgaagcuuuucaccaa

SEQ ID NO: 3794366 - RNA, 21 nt, Salmonella typhimurium LT2
gcucgucgccuuccagcgacu

SEQ ID NO: 3794367 - RNA, 14 nt, Salmonella typhimurium LT2
gcucuaaaaaggaa

SEQ ID NO: 3794368 - RNA, 13 nt, Salmonella typhimurium LT2
gcucuaaccaacu

SEQ ID NO: 3794369 - RNA, 20 nt, Salmonella typhimurium LT2
gcucuaucgccgcccgcaug

SEQ ID NO: 3794370 - RNA, 15 nt, Salmonella typhimurium LT2
gcucuauuugcauag

SEQ ID NO: 3794371 - RNA, 19 nt, Salmonella typhimurium LT2
gcucucccagcugagcuaa

SEQ ID NO: 3794372 - RNA, 16 nt, Salmonella typhimurium LT2
gcucuccgccgcgggc

SEQ ID NO: 3794373 - RNA, 22 nt, Salmonella typhimurium LT2
gcucuccgccgcgggcagcagc

SEQ ID NO: 3794374 - RNA, 18 nt, Salmonella typhimurium LT2
gcucuccuacaccaccag

SEQ ID NO: 3794375 - RNA, 22 nt, Salmonella typhimurium LT2
gcucuccuccaaagguauggag

SEQ ID NO: 3794376 - RNA, 15 nt, Salmonella typhimurium LT2
gcucucuuccagguu

SEQ ID NO: 3794377 - RNA, 20 nt, Salmonella typhimurium LT2
gcucucuuucaccagcgcca

SEQ ID NO: 3794378 - RNA, 19 nt, Salmonella typhimurium LT2
gcucugccaguagcugcuc

SEQ ID NO: 3794379 - RNA, 14 nt, Salmonella typhimurium LT2
gcucuggcgugaaa

SEQ ID NO: 3794380 - RNA, 15 nt, Salmonella typhimurium LT2
gcucuguggggggaa

SEQ ID NO: 3794381 - RNA, 21 nt, Salmonella typhimurium LT2
gcucuucgccguuaucggccu

SEQ ID NO: 3794382 - RNA, 23 nt, Salmonella typhimurium LT2
gcucuucguggaacugcagcgcg

SEQ ID NO: 3794383 - RNA, 17 nt, Salmonella typhimurium LT2
gcucuucuucgcucucg

SEQ ID NO: 3794384 - RNA, 15 nt, Salmonella typhimurium LT2
gcucuugcggcugca

SEQ ID NO: 3794385 - RNA, 22 nt, Salmonella typhimurium LT2
gcucuuuaccguauugccagau

SEQ ID NO: 3794386 - RNA, 13 nt, Salmonella typhimurium LT2
gcucuuucaacug

SEQ ID NO: 3794387 - RNA, 17 nt, Salmonella typhimurium LT2
gcucuuucaacuuccgc

SEQ ID NO: 3794388 - RNA, 23 nt, Salmonella typhimurium LT2
gcucuuuugucacaagaaggccu

SEQ ID NO: 3794389 - RNA, 14 nt, Salmonella typhimurium LT2
gcugaaaaccgcau

SEQ ID NO: 3794390 - RNA, 21 nt, Salmonella typhimurium LT2
gcugaaaaccgcaucaagccc

SEQ ID NO: 3794391 - RNA, 22 nt, Salmonella typhimurium LT2
gcugaaaaugacuucaucgcca

SEQ ID NO: 3794392 - RNA, 13 nt, Salmonella typhimurium LT2
gcugaaagcgccu

SEQ ID NO: 3794393 - RNA, 23 nt, Salmonella typhimurium LT2
gcugaacauacguuuaaagcgcu

SEQ ID NO: 3794394 - RNA, 15 nt, Salmonella typhimurium LT2
gcugaacggacuuga

SEQ ID NO: 3794395 - RNA, 14 nt, Salmonella typhimurium LT2
gcugaagcccgcga

SEQ ID NO: 3794396 - RNA, 16 nt, Salmonella typhimurium LT2
gcugaaguaauguuca

SEQ ID NO: 3794397 - RNA, 17 nt, Salmonella typhimurium LT2
gcugaauagccagcccc

SEQ ID NO: 3794398 - RNA, 22 nt, Salmonella typhimurium LT2
gcugaauggcaaccuuaccggc

SEQ ID NO: 3794399 - RNA, 14 nt, Salmonella typhimurium LT2
gcugacaaggcgau

SEQ ID NO: 3794400 - RNA, 15 nt, Salmonella typhimurium LT2
gcugacaaucugcug

SEQ ID NO: 3794401 - RNA, 18 nt, Salmonella typhimurium LT2
gcugacaaucugcuggaa

SEQ ID NO: 3794402 - RNA, 17 nt, Salmonella typhimurium LT2
gcugacacucauccaga

SEQ ID NO: 3794403 - RNA, 13 nt, Salmonella typhimurium LT2
gcugacaucaucc

SEQ ID NO: 3794404 - RNA, 17 nt, Salmonella typhimurium LT2
gcugacaucauccacgg

SEQ ID NO: 3794405 - RNA, 22 nt, Salmonella typhimurium LT2
gcugacaucauccacggcauca

SEQ ID NO: 3794406 - RNA, 20 nt, Salmonella typhimurium LT2
gcugaccgcuuucccggcau

SEQ ID NO: 3794407 - RNA, 15 nt, Salmonella typhimurium LT2
gcugacgacauucag

SEQ ID NO: 3794408 - RNA, 14 nt, Salmonella typhimurium LT2
gcugacgcagcagc

SEQ ID NO: 3794409 - RNA, 14 nt, Salmonella typhimurium LT2
gcugacgccagcca

SEQ ID NO: 3794410 - RNA, 16 nt, Salmonella typhimurium LT2
gcugacgccagccagc

SEQ ID NO: 3794411 - RNA, 21 nt, Salmonella typhimurium LT2
gcugacggauacgcugcguca

SEQ ID NO: 3794412 - RNA, 13 nt, Salmonella typhimurium LT2
gcugacggcgcga

SEQ ID NO: 3794413 - RNA, 17 nt, Salmonella typhimurium LT2
gcugacguuacgcggug

SEQ ID NO: 3794414 - RNA, 21 nt, Salmonella typhimurium LT2
gcugacguucgacccgcaaug

SEQ ID NO: 3794415 - RNA, 18 nt, Salmonella typhimurium LT2
gcugacguuuuccucguu

SEQ ID NO: 3794416 - RNA, 14 nt, Salmonella typhimurium LT2
gcugacucgcgcaa

SEQ ID NO: 3794417 - RNA, 15 nt, Salmonella typhimurium LT2
gcugacucgcgcaau

SEQ ID NO: 3794418 - RNA, 13 nt, Salmonella typhimurium LT2
gcugagaaaaaua

SEQ ID NO: 3794419 - RNA, 14 nt, Salmonella typhimurium LT2
gcugagaaaaauac

SEQ ID NO: 3794420 - RNA, 15 nt, Salmonella typhimurium LT2
gcugagcgccaucag

SEQ ID NO: 3794421 - RNA, 23 nt, Salmonella typhimurium LT2
gcugagcggcucauccagcaaca

SEQ ID NO: 3794422 - RNA, 21 nt, Salmonella typhimurium LT2
gcugagcgugaucgucuccug

SEQ ID NO: 3794423 - RNA, 16 nt, Salmonella typhimurium LT2
gcugagcuaaucaccc

SEQ ID NO: 3794424 - RNA, 17 nt, Salmonella typhimurium LT2
gcugagcuaaucaccca

SEQ ID NO: 3794425 - RNA, 20 nt, Salmonella typhimurium LT2
gcugagugguucgccaucca

SEQ ID NO: 3794426 - RNA, 14 nt, Salmonella typhimurium LT2
gcugaguucaggca

SEQ ID NO: 3794427 - RNA, 16 nt, Salmonella typhimurium LT2
gcugaguucaggcacg

SEQ ID NO: 3794428 - RNA, 22 nt, Salmonella typhimurium LT2
gcugaguuucucccgccagaug

SEQ ID NO: 3794429 - RNA, 19 nt, Salmonella typhimurium LT2
gcugauaacuaauggcauu

SEQ ID NO: 3794430 - RNA, 22 nt, Salmonella typhimurium LT2
gcugauaacuaauggcauuucc

SEQ ID NO: 3794431 - RNA, 16 nt, Salmonella typhimurium LT2
gcugauauuuucaccu

SEQ ID NO: 3794432 - RNA, 17 nt, Salmonella typhimurium LT2
gcugaucagccgcgaca

SEQ ID NO: 3794433 - RNA, 13 nt, Salmonella typhimurium LT2
gcugaugacgcgc

SEQ ID NO: 3794434 - RNA, 21 nt, Salmonella typhimurium LT2
gcugaugccagauggcaagau

SEQ ID NO: 3794435 - RNA, 23 nt, Salmonella typhimurium LT2
gcugaugcccagguuagcagcca

SEQ ID NO: 3794436 - RNA, 23 nt, Salmonella typhimurium LT2
gcugaugcgcuauaaaaaucgca

SEQ ID NO: 3794437 - RNA, 12 nt, Salmonella typhimurium LT2
gcugaugguuuc

SEQ ID NO: 3794438 - RNA, 16 nt, Salmonella typhimurium LT2
gcugauguccgcagcc

SEQ ID NO: 3794439 - RNA, 19 nt, Salmonella typhimurium LT2
gcugauguccgcagccgca

SEQ ID NO: 3794440 - RNA, 21 nt, Salmonella typhimurium LT2
gcugauuggcgguagcggaau

SEQ ID NO: 3794441 - RNA, 19 nt, Salmonella typhimurium LT2
gcugauugggauaaacaca

SEQ ID NO: 3794442 - RNA, 15 nt, Salmonella typhimurium LT2
gcugauuuguuaucu

SEQ ID NO: 3794443 - RNA, 20 nt, Salmonella typhimurium LT2
gcugauuuguuaucuacagu

SEQ ID NO: 3794444 - RNA, 18 nt, Salmonella typhimurium LT2
gcugcaaagcaucugccg

SEQ ID NO: 3794445 - RNA, 17 nt, Salmonella typhimurium LT2
gcugcaaaucaccacau

SEQ ID NO: 3794446 - RNA, 17 nt, Salmonella typhimurium LT2
gcugcaacccgccgcca

SEQ ID NO: 3794447 - RNA, 13 nt, Salmonella typhimurium LT2
gcugcaacgucgc

SEQ ID NO: 3794448 - RNA, 15 nt, Salmonella typhimurium LT2
gcugcaacucuccca

SEQ ID NO: 3794449 - RNA, 18 nt, Salmonella typhimurium LT2
gcugcaacuucaccuucg

SEQ ID NO: 3794450 - RNA, 20 nt, Salmonella typhimurium LT2
gcugcacaaucgccagcccc

SEQ ID NO: 3794451 - RNA, 22 nt, Salmonella typhimurium LT2
gcugcacaaucgccagccccag

SEQ ID NO: 3794452 - RNA, 19 nt, Salmonella typhimurium LT2
gcugcagcccuuacgcuuu

SEQ ID NO: 3794453 - RNA, 16 nt, Salmonella typhimurium LT2
gcugguuggcgcgcuc

SEQ ID NO: 3794454 - RNA, 21 nt, Salmonella typhimurium LT2
gcugguuggcgcgcucgcauu

SEQ ID NO: 3794455 - RNA, 14 nt, Salmonella typhimurium LT2
gcuguaaaccggcc

SEQ ID NO: 3794456 - RNA, 18 nt, Salmonella typhimurium LT2
gcuguaaaucgcgcccga

SEQ ID NO: 3794457 - RNA, 17 nt, Salmonella typhimurium LT2
gcuguaacuucacgcca

SEQ ID NO: 3794458 - RNA, 18 nt, Salmonella typhimurium LT2
gcuguaauugaggauugc

SEQ ID NO: 3794459 - RNA, 16 nt, Salmonella typhimurium LT2
gcuguacauauccagu

SEQ ID NO: 3794460 - RNA, 12 nt, Salmonella typhimurium LT2
gcuguacgacug

SEQ ID NO: 3794461 - RNA, 17 nt, Salmonella typhimurium LT2
gcuguagcgucucauca

SEQ ID NO: 3794462 - RNA, 12 nt, Salmonella typhimurium LT2
gcuguagcguuu

SEQ ID NO: 3794463 - RNA, 13 nt, Salmonella typhimurium LT2
gcuguagcugccc

SEQ ID NO: 3794464 - RNA, 22 nt, Salmonella typhimurium LT2
gcuguaggcacuuuccagacca

SEQ ID NO: 3794465 - RNA, 15 nt, Salmonella typhimurium LT2
gcugucaccagcagc

SEQ ID NO: 3794466 - RNA, 21 nt, Salmonella typhimurium LT2
gcuguccagauagggccaggc

SEQ ID NO: 3794467 - RNA, 22 nt, Salmonella typhimurium LT2
gcuguccagauagggccaggcg

SEQ ID NO: 3794468 - RNA, 14 nt, Salmonella typhimurium LT2
gcuguccagucaaa

SEQ ID NO: 3794469 - RNA, 21 nt, Salmonella typhimurium LT2
gcuguccauaccggacuccag

SEQ ID NO: 3794470 - RNA, 14 nt, Salmonella typhimurium LT2
gcuguccgcccaac

SEQ ID NO: 3794471 - RNA, 17 nt, Salmonella typhimurium LT2
gcuguccgggcguuuca

SEQ ID NO: 3794472 - RNA, 18 nt, Salmonella typhimurium LT2
gcugucgauaauauccag

SEQ ID NO: 3794473 - RNA, 18 nt, Salmonella typhimurium LT2
gcugucgcuuauucggcc

SEQ ID NO: 3794474 - RNA, 15 nt, Salmonella typhimurium LT2
gcugucgguuaacac

SEQ ID NO: 3794475 - RNA, 14 nt, Salmonella typhimurium LT2
gcugucuggauaac

SEQ ID NO: 3794476 - RNA, 20 nt, Salmonella typhimurium LT2
gcugugcgaaugccguuaac

SEQ ID NO: 3794477 - RNA, 21 nt, Salmonella typhimurium LT2
gcuguggaaaaucagcgacug

SEQ ID NO: 3794478 - RNA, 19 nt, Salmonella typhimurium LT2
gcuguuaauuucauaaaug

SEQ ID NO: 3794479 - RNA, 21 nt, Salmonella typhimurium LT2
gcuguuaauuugcaucaggcc

SEQ ID NO: 3794480 - RNA, 22 nt, Salmonella typhimurium LT2
gcuguuaauuugcaucaggcca

SEQ ID NO: 3794481 - RNA, 16 nt, Salmonella typhimurium LT2
gcuguuaccguaagcg

SEQ ID NO: 3794482 - RNA, 19 nt, Salmonella typhimurium LT2
gcuguuacgcggucuuuua

SEQ ID NO: 3794483 - RNA, 18 nt, Salmonella typhimurium LT2
gcuguuaguaaacagcau

SEQ ID NO: 3794484 - RNA, 20 nt, Salmonella typhimurium LT2
gcuguuaguaaacagcauca

SEQ ID NO: 3794485 - RNA, 16 nt, Salmonella typhimurium LT2
gcuguuccagccgcca

SEQ ID NO: 3794486 - RNA, 13 nt, Salmonella typhimurium LT2
gcuguuccucggg

SEQ ID NO: 3794487 - RNA, 13 nt, Salmonella typhimurium LT2
gcuguuccuggug

SEQ ID NO: 3794488 - RNA, 18 nt, Salmonella typhimurium LT2
gcuguugaggaaauucug

SEQ ID NO: 3794489 - RNA, 21 nt, Salmonella typhimurium LT2
gcuguuuugcuucuucagccu

SEQ ID NO: 3794490 - RNA, 16 nt, Salmonella typhimurium LT2
gcuguuuuucaucauc

SEQ ID NO: 3794491 - RNA, 21 nt, Salmonella typhimurium LT2
gcuguuuuucaucaucaucca

SEQ ID NO: 3794492 - RNA, 13 nt, Salmonella typhimurium LT2
gcuuaaaaaaucc

SEQ ID NO: 3794493 - RNA, 15 nt, Salmonella typhimurium LT2
gcuuaaaaaauccug

SEQ ID NO: 3794494 - RNA, 16 nt, Salmonella typhimurium LT2
gcuuaaaaaauccugc

SEQ ID NO: 3794495 - RNA, 12 nt, Salmonella typhimurium LT2
gcuuaaacagaa

SEQ ID NO: 3794496 - RNA, 13 nt, Salmonella typhimurium LT2
gcuuaaacagaau

SEQ ID NO: 3794497 - RNA, 18 nt, Salmonella typhimurium LT2
gcuuaacagaauugcgcc

SEQ ID NO: 3794498 - RNA, 19 nt, Salmonella typhimurium LT2
gcuuaacgccaguuccgcc

SEQ ID NO: 3794499 - RNA, 17 nt, Salmonella typhimurium LT2
gcuuaaucuugagucgg

SEQ ID NO: 3794500 - RNA, 16 nt, Salmonella typhimurium LT2
gcuuaaugcucugcug

SEQ ID NO: 3794501 - RNA, 18 nt, Salmonella typhimurium LT2
gcuuaauggcgucaauca

SEQ ID NO: 3794502 - RNA, 18 nt, Salmonella typhimurium LT2
gcuuacacagacugcuug

SEQ ID NO: 3794503 - RNA, 21 nt, Salmonella typhimurium LT2
gcuuacagagcaguuacguuu

SEQ ID NO: 3794504 - RNA, 17 nt, Salmonella typhimurium LT2
gcuuacaggcacgccug

SEQ ID NO: 3794505 - RNA, 15 nt, Salmonella typhimurium LT2
gcuuacaguuuaucu

SEQ ID NO: 3794506 - RNA, 17 nt, Salmonella typhimurium LT2
gcuuacaguuuaucugc

SEQ ID NO: 3794507 - RNA, 14 nt, Salmonella typhimurium LT2
gcuuacauuucagg

SEQ ID NO: 3794508 - RNA, 15 nt, Salmonella typhimurium LT2
gcuuaccacuuugcg

SEQ ID NO: 3794509 - RNA, 14 nt, Salmonella typhimurium LT2
gcuuaccagaccgg

SEQ ID NO: 3794510 - RNA, 19 nt, Salmonella typhimurium LT2
gcuuaccgcggucaccuuc

SEQ ID NO: 3794511 - RNA, 19 nt, Salmonella typhimurium LT2
gcuuaccguaucccaccau

SEQ ID NO: 3794512 - RNA, 18 nt, Salmonella typhimurium LT2
gcuuaccuuguucuucca

SEQ ID NO: 3794513 - RNA, 17 nt, Salmonella typhimurium LT2
gcuuacggcaaacugaa

SEQ ID NO: 3794514 - RNA, 16 nt, Salmonella typhimurium LT2
gcuuacggcuauucuu

SEQ ID NO: 3794515 - RNA, 23 nt, Salmonella typhimurium LT2
gcuuacuuuccaaaauccaggga

SEQ ID NO: 3794516 - RNA, 17 nt, Salmonella typhimurium LT2
gcuuagcucaucagccu

SEQ ID NO: 3794517 - RNA, 12 nt, Salmonella typhimurium LT2
gcuuagcuuccc

SEQ ID NO: 3794518 - RNA, 20 nt, Salmonella typhimurium LT2
gcuuaucaggccuacgguuu

SEQ ID NO: 3794519 - RNA, 15 nt, Salmonella typhimurium LT2
gcuuauccagccacu

SEQ ID NO: 3794520 - RNA, 20 nt, Salmonella typhimurium LT2
gcuuauccagccacuguucg

SEQ ID NO: 3794521 - RNA, 17 nt, Salmonella typhimurium LT2
gcuuauccggccuacag

SEQ ID NO: 3794522 - RNA, 23 nt, Salmonella typhimurium LT2
gcuuaucgauaucugccugcaga

SEQ ID NO: 3794523 - RNA, 16 nt, Salmonella typhimurium LT2
gcuuaucgccaaagau

SEQ ID NO: 3794524 - RNA, 16 nt, Salmonella typhimurium LT2
gcuuaucgggccuaca

SEQ ID NO: 3794525 - RNA, 20 nt, Salmonella typhimurium LT2
gcuuaucuggccuacagcau

SEQ ID NO: 3794526 - RNA, 14 nt, Salmonella typhimurium LT2
gcuuauugcccagg

SEQ ID NO: 3794527 - RNA, 22 nt, Salmonella typhimurium LT2
gcuucaaaaagcgcgcggcugc

SEQ ID NO: 3794528 - RNA, 14 nt, Salmonella typhimurium LT2
gcuucaacagcggc

SEQ ID NO: 3794529 - RNA, 13 nt, Salmonella typhimurium LT2
gcuucaccucagc

SEQ ID NO: 3794530 - RNA, 20 nt, Salmonella typhimurium LT2
gcuucaccuuucgccgccag

SEQ ID NO: 3794531 - RNA, 20 nt, Salmonella typhimurium LT2
gcuucacgaagucuggcugc

SEQ ID NO: 3794532 - RNA, 14 nt, Salmonella typhimurium LT2
gcuucacgccacag

SEQ ID NO: 3794533 - RNA, 22 nt, Salmonella typhimurium LT2
gcuucagcaaacggcuggauaa

SEQ ID NO: 3794534 - RNA, 16 nt, Salmonella typhimurium LT2
gcuucagccacuggcu

SEQ ID NO: 3794535 - RNA, 22 nt, Salmonella typhimurium LT2
gcuucaggcgggguuaacugcu

SEQ ID NO: 3794536 - RNA, 21 nt, Salmonella typhimurium LT2
gcuucaguaaaucccgcauca

SEQ ID NO: 3794537 - RNA, 21 nt, Salmonella typhimurium LT2
gcuucagucauaauccuuccu

SEQ ID NO: 3794538 - RNA, 20 nt, Salmonella typhimurium LT2
gcuucauaucgcccagcagc

SEQ ID NO: 3794539 - RNA, 20 nt, Salmonella typhimurium LT2
gcuuccacccgggaagcccu

SEQ ID NO: 3794540 - RNA, 19 nt, Salmonella typhimurium LT2
gcuuccacgcacgccggcc

SEQ ID NO: 3794541 - RNA, 12 nt, Salmonella typhimurium LT2
gcuuccagcaug

SEQ ID NO: 3794542 - RNA, 21 nt, Salmonella typhimurium LT2
gcuuccagcgcgucggccggc

SEQ ID NO: 3794543 - RNA, 13 nt, Salmonella typhimurium LT2
gcuuccagcucca

SEQ ID NO: 3794544 - RNA, 22 nt, Salmonella typhimurium LT2
gcuuccaguugaaaaccacaau

SEQ ID NO: 3794545 - RNA, 14 nt, Salmonella typhimurium LT2
gcuucccaaaagga

SEQ ID NO: 3794546 - RNA, 16 nt, Salmonella typhimurium LT2
gcuucccaaaaggaag

SEQ ID NO: 3794547 - RNA, 19 nt, Salmonella typhimurium LT2
gcuucccacagucggcgaa

SEQ ID NO: 3794548 - RNA, 15 nt, Salmonella typhimurium LT2
gcuuccgcauucugg

SEQ ID NO: 3794549 - RNA, 11 nt, Salmonella typhimurium LT2
gcuuccggcag

SEQ ID NO: 3794550 - RNA, 23 nt, Salmonella typhimurium LT2
gcuuccguuuuguugccgcccgu

SEQ ID NO: 3794551 - RNA, 15 nt, Salmonella typhimurium LT2
gcuuccucgccaccg

SEQ ID NO: 3794552 - RNA, 13 nt, Salmonella typhimurium LT2
gcuuccuggaugu

SEQ ID NO: 3794553 - RNA, 15 nt, Salmonella typhimurium LT2
gcuuccuguuuauga

SEQ ID NO: 3794554 - RNA, 20 nt, Salmonella typhimurium LT2
gcuuccuguuuaugacccug

SEQ ID NO: 3794555 - RNA, 18 nt, Salmonella typhimurium LT2
gcuucgacaaacagcugu

SEQ ID NO: 3794556 - RNA, 18 nt, Salmonella typhimurium LT2
gcuucgccaucuccauca

SEQ ID NO: 3794557 - RNA, 17 nt, Salmonella typhimurium LT2
ggaaaagcgaccauucu

SEQ ID NO: 3794558 - RNA, 15 nt, Salmonella typhimurium LT2
ggaaaagcuguagca

SEQ ID NO: 3794559 - RNA, 13 nt, Salmonella typhimurium LT2
ggaaaauagcgca

SEQ ID NO: 3794560 - RNA, 12 nt, Salmonella typhimurium LT2
ggaaaaucuggu

SEQ ID NO: 3794561 - RNA, 17 nt, Salmonella typhimurium LT2
ggaaacuaugcaaaacg

SEQ ID NO: 3794562 - RNA, 16 nt, Salmonella typhimurium LT2
ggaaacuccagcggca

SEQ ID NO: 3794563 - RNA, 22 nt, Salmonella typhimurium LT2
ggaaacucgccgccaugacgca

SEQ ID NO: 3794564 - RNA, 21 nt, Salmonella typhimurium LT2
ggaaagacggcagcgccaucc

SEQ ID NO: 3794565 - RNA, 22 nt, Salmonella typhimurium LT2
ggaaagccccuaccgaggcagg

SEQ ID NO: 3794566 - RNA, 23 nt, Salmonella typhimurium LT2
ggaaagccuucaucaucauagug

SEQ ID NO: 3794567 - RNA, 13 nt, Salmonella typhimurium LT2
ggaaagcggcagg

SEQ ID NO: 3794568 - RNA, 23 nt, Salmonella typhimurium LT2
ggaaagcucuucaugcagcgcgg

SEQ ID NO: 3794569 - RNA, 21 nt, Salmonella typhimurium LT2
ggaaagguguggaucagauca

SEQ ID NO: 3794570 - RNA, 14 nt, Salmonella typhimurium LT2
ggaaauaaagguuc

SEQ ID NO: 3794571 - RNA, 16 nt, Salmonella typhimurium LT2
ggaaauacccuuauga

SEQ ID NO: 3794572 - RNA, 22 nt, Salmonella typhimurium LT2
ggaaauucuggcgcagcuucug

SEQ ID NO: 3794573 - RNA, 13 nt, Salmonella typhimurium LT2
ggaacaaaacgga

SEQ ID NO: 3794574 - RNA, 15 nt, Salmonella typhimurium LT2
ggaacaagcaaaccu

SEQ ID NO: 3794575 - RNA, 17 nt, Salmonella typhimurium LT2
ggaacaagcaaaccuau

SEQ ID NO: 3794576 - RNA, 18 nt, Salmonella typhimurium LT2
ggaacacggcaugaagca

SEQ ID NO: 3794577 - RNA, 20 nt, Salmonella typhimurium LT2
ggaacacggcaugaagcagc

SEQ ID NO: 3794578 - RNA, 13 nt, Salmonella typhimurium LT2
ggaacagacgccu

SEQ ID NO: 3794579 - RNA, 12 nt, Salmonella typhimurium LT2
ggaacagauaaa

SEQ ID NO: 3794580 - RNA, 12 nt, Salmonella typhimurium LT2
ggaacaucagca

SEQ ID NO: 3794581 - RNA, 14 nt, Salmonella typhimurium LT2
ggaacaucagcauu

SEQ ID NO: 3794582 - RNA, 14 nt, Salmonella typhimurium LT2
ggaacaucagccag

SEQ ID NO: 3794583 - RNA, 16 nt, Salmonella typhimurium LT2
ggaacaucagccagca

SEQ ID NO: 3794584 - RNA, 20 nt, Salmonella typhimurium LT2
ggaacaucagccagcagcuc

SEQ ID NO: 3794585 - RNA, 18 nt, Salmonella typhimurium LT2
ggaaccaaaugcccagcu

SEQ ID NO: 3794586 - RNA, 19 nt, Salmonella typhimurium LT2
ggaaccaugauaucgccaa

SEQ ID NO: 3794587 - RNA, 18 nt, Salmonella typhimurium LT2
ggaaccgguagccaggcg

SEQ ID NO: 3794588 - RNA, 22 nt, Salmonella typhimurium LT2
ggaacgccccucgguuuauccc

SEQ ID NO: 3794589 - RNA, 17 nt, Salmonella typhimurium LT2
ggaacgcccuguucguc

SEQ ID NO: 3794590 - RNA, 16 nt, Salmonella typhimurium LT2
ggaacgcgcaguccgu

SEQ ID NO: 3794591 - RNA, 14 nt, Salmonella typhimurium LT2
ggaacgucaucauu

SEQ ID NO: 3794592 - RNA, 15 nt, Salmonella typhimurium LT2
ggaacguugcgccau

SEQ ID NO: 3794593 - RNA, 14 nt, Salmonella typhimurium LT2
ggaacucaucauca

SEQ ID NO: 3794594 - RNA, 20 nt, Salmonella typhimurium LT2
ggaacucaucggaaaaauag

SEQ ID NO: 3794595 - RNA, 12 nt, Salmonella typhimurium LT2
ggaacuccagca

SEQ ID NO: 3794596 - RNA, 15 nt, Salmonella typhimurium LT2
ggaacuccagcaggg

SEQ ID NO: 3794597 - RNA, 23 nt, Salmonella typhimurium LT2
ggaacugccuggcucauucuccg

SEQ ID NO: 3794598 - RNA, 15 nt, Salmonella typhimurium LT2
ggaacuguucagcca

SEQ ID NO: 3794599 - RNA, 15 nt, Salmonella typhimurium LT2
ggaagaccguuuaaa

SEQ ID NO: 3794600 - RNA, 19 nt, Salmonella typhimurium LT2
ggaagacuggcgcagcaaa

SEQ ID NO: 3794601 - RNA, 21 nt, Salmonella typhimurium LT2
ggaagaguuguugaccaacaa

SEQ ID NO: 3794602 - RNA, 20 nt, Salmonella typhimurium LT2
ggaagcggaacugaugauca

SEQ ID NO: 3794603 - RNA, 15 nt, Salmonella typhimurium LT2
ggaaggaaauaacgu

SEQ ID NO: 3794604 - RNA, 21 nt, Salmonella typhimurium LT2
ggaaguagcaaaucaucgcca

SEQ ID NO: 3794605 - RNA, 15 nt, Salmonella typhimurium LT2
ggaagucagcuuccu

SEQ ID NO: 3794606 - RNA, 20 nt, Salmonella typhimurium LT2
ggaagucagcuuccuguacg

SEQ ID NO: 3794607 - RNA, 15 nt, Salmonella typhimurium LT2
ggaaguccuucuccu

SEQ ID NO: 3794608 - RNA, 15 nt, Salmonella typhimurium LT2
ggaagugauaauggu

SEQ ID NO: 3794609 - RNA, 20 nt, Salmonella typhimurium LT2
ggaaguuaccgcgccaggcg

SEQ ID NO: 3794610 - RNA, 21 nt, Salmonella typhimurium LT2
ggaaguuaccgcgccaggcgg

SEQ ID NO: 3794611 - RNA, 14 nt, Salmonella typhimurium LT2
ggaauaaacgguaa

SEQ ID NO: 3794612 - RNA, 20 nt, Salmonella typhimurium LT2
ggaauaacaucguaaaucaa

SEQ ID NO: 3794613 - RNA, 17 nt, Salmonella typhimurium LT2
ggaauaaccggugccaa

SEQ ID NO: 3794614 - RNA, 14 nt, Salmonella typhimurium LT2
ggaauaauuaaauc

SEQ ID NO: 3794615 - RNA, 15 nt, Salmonella typhimurium LT2
ggaauacguaauacc

SEQ ID NO: 3794616 - RNA, 15 nt, Salmonella typhimurium LT2
ggaauagcgccuuca

SEQ ID NO: 3794617 - RNA, 14 nt, Salmonella typhimurium LT2
ggaauaucaauuca

SEQ ID NO: 3794618 - RNA, 14 nt, Salmonella typhimurium LT2
ggaauaucccgcaa

SEQ ID NO: 3794619 - RNA, 22 nt, Salmonella typhimurium LT2
ggaaucacgcauaucccacugc

SEQ ID NO: 3794620 - RNA, 16 nt, Salmonella typhimurium LT2
ggaauccagcgcgccc

SEQ ID NO: 3794621 - RNA, 13 nt, Salmonella typhimurium LT2
ggaauccccgccg

SEQ ID NO: 3794622 - RNA, 15 nt, Salmonella typhimurium LT2
ggaaucgucacagac

SEQ ID NO: 3794623 - RNA, 18 nt, Salmonella typhimurium LT2
ggaaugauagggaaggcu

SEQ ID NO: 3794624 - RNA, 18 nt, Salmonella typhimurium LT2
ggaaugguauaugggcaa

SEQ ID NO: 3794625 - RNA, 23 nt, Salmonella typhimurium LT2
ggaauguuccccguugagaaugg

SEQ ID NO: 3794626 - RNA, 13 nt, Salmonella typhimurium LT2
ggaauguucuccu

SEQ ID NO: 3794627 - RNA, 18 nt, Salmonella typhimurium LT2
ggaauuuaucaacaaauu

SEQ ID NO: 3794628 - RNA, 16 nt, Salmonella typhimurium LT2
ggacaacgcuccagca

SEQ ID NO: 3794629 - RNA, 22 nt, Salmonella typhimurium LT2
ggacaaggcgguacuccgccau

SEQ ID NO: 3794630 - RNA, 13 nt, Salmonella typhimurium LT2
ggacaauuacccu

SEQ ID NO: 3794631 - RNA, 14 nt, Salmonella typhimurium LT2
ggacacccgcagcc

SEQ ID NO: 3794632 - RNA, 20 nt, Salmonella typhimurium LT2
ggacagacuucauuuuccac

SEQ ID NO: 3794633 - RNA, 14 nt, Salmonella typhimurium LT2
ggacaucaaaggca

SEQ ID NO: 3794634 - RNA, 12 nt, Salmonella typhimurium LT2
ggacaucgccau

SEQ ID NO: 3794635 - RNA, 16 nt, Salmonella typhimurium LT2
ggacauucagcacgcu

SEQ ID NO: 3794636 - RNA, 22 nt, Salmonella typhimurium LT2
ggaccaagaucggagauauaaa

SEQ ID NO: 3794637 - RNA, 18 nt, Salmonella typhimurium LT2
ggaccacaagcugugcca

SEQ ID NO: 3794638 - RNA, 12 nt, Salmonella typhimurium LT2
ggaccagcacaa

SEQ ID NO: 3794639 - RNA, 20 nt, Salmonella typhimurium LT2
ggaccggcaaucgccugcaa

SEQ ID NO: 3794640 - RNA, 23 nt, Salmonella typhimurium LT2
ggaccuguguauucugcgccagc

SEQ ID NO: 3794641 - RNA, 23 nt, Salmonella typhimurium LT2
ggacgaaaaaugaauaccaaguc

SEQ ID NO: 3794642 - RNA, 20 nt, Salmonella typhimurium LT2
ggacgagcgcgucagcgccu

SEQ ID NO: 3794643 - RNA, 18 nt, Salmonella typhimurium LT2
ggacgcugacgccaggcc

SEQ ID NO: 3794644 - RNA, 16 nt, Salmonella typhimurium LT2
ggacgcuuuuauccgg

SEQ ID NO: 3794645 - RNA, 23 nt, Salmonella typhimurium LT2
ggacggcauaagccagcccugcc

SEQ ID NO: 3794646 - RNA, 20 nt, Salmonella typhimurium LT2
ggacgggaucucgcacauca

SEQ ID NO: 3794647 - RNA, 22 nt, Salmonella typhimurium LT2
ggacgucgacgccuuucuucac

SEQ ID NO: 3794648 - RNA, 18 nt, Salmonella typhimurium LT2
ggacguuuccugcgccag

SEQ ID NO: 3794649 - RNA, 17 nt, Salmonella typhimurium LT2
ggacuaugcuccaguug

SEQ ID NO: 3794650 - RNA, 14 nt, Salmonella typhimurium LT2
ggacuccaggcaac

SEQ ID NO: 3794651 - RNA, 18 nt, Salmonella typhimurium LT2
ggacuccugacgcugaga

SEQ ID NO: 3794652 - RNA, 23 nt, Salmonella typhimurium LT2
ggacugauacagccaaaucagca

SEQ ID NO: 3794653 - RNA, 21 nt, Salmonella typhimurium LT2
ggacugccuaacuggaaaaag

SEQ ID NO: 3794654 - RNA, 15 nt, Salmonella typhimurium LT2
ggacuuuaaacguca

SEQ ID NO: 3794655 - RNA, 14 nt, Salmonella typhimurium LT2
ggagaaaacgcggc

SEQ ID NO: 3794656 - RNA, 17 nt, Salmonella typhimurium LT2
ggagaaaacgcggccug

SEQ ID NO: 3794657 - RNA, 15 nt, Salmonella typhimurium LT2
ggagaacgccgggcc

SEQ ID NO: 3794658 - RNA, 16 nt, Salmonella typhimurium LT2
ggagaagacgccgccg

SEQ ID NO: 3794659 - RNA, 19 nt, Salmonella typhimurium LT2
ggagaagacgccgccgcau

SEQ ID NO: 3794660 - RNA, 14 nt, Salmonella typhimurium LT2
ggagacgggcggag

SEQ ID NO: 3794661 - RNA, 16 nt, Salmonella typhimurium LT2
ggauucuuccucucgc

SEQ ID NO: 3794662 - RNA, 22 nt, Salmonella typhimurium LT2
ggauugaaccuaaaaaccagaa

SEQ ID NO: 3794663 - RNA, 21 nt, Salmonella typhimurium LT2
ggauugagcgaauccagcgcc

SEQ ID NO: 3794664 - RNA, 21 nt, Salmonella typhimurium LT2
ggauuggauaaaucggucauu

SEQ ID NO: 3794665 - RNA, 22 nt, Salmonella typhimurium LT2
ggauuggucgcgccgcgcgcaa

SEQ ID NO: 3794666 - RNA, 14 nt, Salmonella typhimurium LT2
ggauuggucugauu

SEQ ID NO: 3794667 - RNA, 15 nt, Salmonella typhimurium LT2
ggauuguggccccau

SEQ ID NO: 3794668 - RNA, 15 nt, Salmonella typhimurium LT2
ggauuguuuuuuagc

SEQ ID NO: 3794669 - RNA, 20 nt, Salmonella typhimurium LT2
ggauuuaaaccgccccgacu

SEQ ID NO: 3794670 - RNA, 12 nt, Salmonella typhimurium LT2
ggauuugcugcg

SEQ ID NO: 3794671 - RNA, 19 nt, Salmonella typhimurium LT2
ggcaaaaaauauagccauu

SEQ ID NO: 3794672 - RNA, 17 nt, Salmonella typhimurium LT2
ggcaaaaacgccgguca

SEQ ID NO: 3794673 - RNA, 20 nt, Salmonella typhimurium LT2
ggcaaaaauccuucuuccau

SEQ ID NO: 3794674 - RNA, 21 nt, Salmonella typhimurium LT2
ggcaaaacgccgcagaaaaug

SEQ ID NO: 3794675 - RNA, 15 nt, Salmonella typhimurium LT2
ggcaaaaugccagcc

SEQ ID NO: 3794676 - RNA, 20 nt, Salmonella typhimurium LT2
ggcaaacacaaaaugcccuu

SEQ ID NO: 3794677 - RNA, 18 nt, Salmonella typhimurium LT2
ggcaaaccauguacccuc

SEQ ID NO: 3794678 - RNA, 15 nt, Salmonella typhimurium LT2
ggcaaaccccugcuc

SEQ ID NO: 3794679 - RNA, 20 nt, Salmonella typhimurium LT2
ggcaaacggcgccagcucau

SEQ ID NO: 3794680 - RNA, 17 nt, Salmonella typhimurium LT2
ggcaaagaagcuuacaa

SEQ ID NO: 3794681 - RNA, 16 nt, Salmonella typhimurium LT2
ggcaaagcccugacga

SEQ ID NO: 3794682 - RNA, 18 nt, Salmonella typhimurium LT2
ggcaaaguaucccuuccu

SEQ ID NO: 3794683 - RNA, 16 nt, Salmonella typhimurium LT2
ggcaacagcucuucgc

SEQ ID NO: 3794684 - RNA, 15 nt, Salmonella typhimurium LT2
ggcaacaugaccagc

SEQ ID NO: 3794685 - RNA, 16 nt, Salmonella typhimurium LT2
ggcaaccaccagcagu

SEQ ID NO: 3794686 - RNA, 16 nt, Salmonella typhimurium LT2
ggcaaccagcccauga

SEQ ID NO: 3794687 - RNA, 17 nt, Salmonella typhimurium LT2
ggcaacccgcuccagaa

SEQ ID NO: 3794688 - RNA, 13 nt, Salmonella typhimurium LT2
ggcaaccuuaccg

SEQ ID NO: 3794689 - RNA, 17 nt, Salmonella typhimurium LT2
ggcaaccuucgacgagg

SEQ ID NO: 3794690 - RNA, 16 nt, Salmonella typhimurium LT2
ggcaacgccgccagcu

SEQ ID NO: 3794691 - RNA, 23 nt, Salmonella typhimurium LT2
ggcaacgccguacuccagcccau

SEQ ID NO: 3794692 - RNA, 16 nt, Salmonella typhimurium LT2
ggcaacggccagcgca

SEQ ID NO: 3794693 - RNA, 19 nt, Salmonella typhimurium LT2
ggcaacggccagcgcaggc

SEQ ID NO: 3794694 - RNA, 20 nt, Salmonella typhimurium LT2
ggcaacggccagcgcaggcu

SEQ ID NO: 3794695 - RNA, 19 nt, Salmonella typhimurium LT2
ggcaacgucgacccgcccc

SEQ ID NO: 3794696 - RNA, 12 nt, Salmonella typhimurium LT2
ggcaagacccga

SEQ ID NO: 3794697 - RNA, 20 nt, Salmonella typhimurium LT2
ggcaagacccgaaccugcga

SEQ ID NO: 3794698 - RNA, 23 nt, Salmonella typhimurium LT2
ggcaagauaagccgucauaaaau

SEQ ID NO: 3794699 - RNA, 19 nt, Salmonella typhimurium LT2
ggcaagauuaaccagcagu

SEQ ID NO: 3794700 - RNA, 22 nt, Salmonella typhimurium LT2
ggcaagccuguuuaauccggua

SEQ ID NO: 3794701 - RNA, 13 nt, Salmonella typhimurium LT2
ggcaagggaguga

SEQ ID NO: 3794702 - RNA, 16 nt, Salmonella typhimurium LT2
ggcaauaaacaucagc

SEQ ID NO: 3794703 - RNA, 21 nt, Salmonella typhimurium LT2
ggcaauaaacaucagccauuc

SEQ ID NO: 3794704 - RNA, 19 nt, Salmonella typhimurium LT2
ggcaauaauguuuacgcca

SEQ ID NO: 3794705 - RNA, 21 nt, Salmonella typhimurium LT2
ggcaauacuucguuauacccc

SEQ ID NO: 3794706 - RNA, 17 nt, Salmonella typhimurium LT2
ggcaauagucuccauga

SEQ ID NO: 3794707 - RNA, 17 nt, Salmonella typhimurium LT2
ggcaauauaauccggcg

SEQ ID NO: 3794708 - RNA, 22 nt, Salmonella typhimurium LT2
ggcaauauaccgucagcaccag

SEQ ID NO: 3794709 - RNA, 17 nt, Salmonella typhimurium LT2
ggcaauauuaaaugacg

SEQ ID NO: 3794710 - RNA, 13 nt, Salmonella typhimurium LT2
ggcaaucaaaucc

SEQ ID NO: 3794711 - RNA, 22 nt, Salmonella typhimurium LT2
ggcaaucauaccgucagauucu

SEQ ID NO: 3794712 - RNA, 20 nt, Salmonella typhimurium LT2
ggcaauccauuaaugccgca

SEQ ID NO: 3794713 - RNA, 23 nt, Salmonella typhimurium LT2
ggcaaucccuuucgacgucacca

SEQ ID NO: 3794714 - RNA, 14 nt, Salmonella typhimurium LT2
ggcaaucggccagg

SEQ ID NO: 3794715 - RNA, 17 nt, Salmonella typhimurium LT2
ggcaaugacgguaagca

SEQ ID NO: 3794716 - RNA, 12 nt, Salmonella typhimurium LT2
ggcaaugccccc

SEQ ID NO: 3794717 - RNA, 12 nt, Salmonella typhimurium LT2
ggcaauggcuua

SEQ ID NO: 3794718 - RNA, 15 nt, Salmonella typhimurium LT2
ggcaauuaaccgaac

SEQ ID NO: 3794719 - RNA, 16 nt, Salmonella typhimurium LT2
ggcaauuccgcaucag

SEQ ID NO: 3794720 - RNA, 21 nt, Salmonella typhimurium LT2
ggcaauucgcguucagaaaug

SEQ ID NO: 3794721 - RNA, 19 nt, Salmonella typhimurium LT2
ggcaauuucacugucgcca

SEQ ID NO: 3794722 - RNA, 15 nt, Salmonella typhimurium LT2
ggcaauuuccggcga

SEQ ID NO: 3794723 - RNA, 16 nt, Salmonella typhimurium LT2
ggcaauuucucgcucg

SEQ ID NO: 3794724 - RNA, 21 nt, Salmonella typhimurium LT2
ggcacaaccuggcuugccggg

SEQ ID NO: 3794725 - RNA, 14 nt, Salmonella typhimurium LT2
ggcacaauagcgcu

SEQ ID NO: 3794726 - RNA, 19 nt, Salmonella typhimurium LT2
ggcacaauagcgcuaaaca

SEQ ID NO: 3794727 - RNA, 13 nt, Salmonella typhimurium LT2
ggcacacagcacu

SEQ ID NO: 3794728 - RNA, 21 nt, Salmonella typhimurium LT2
ggcacacagccaaaauaugcu

SEQ ID NO: 3794729 - RNA, 23 nt, Salmonella typhimurium LT2
ggcacacaggccgccgggucagc

SEQ ID NO: 3794730 - RNA, 16 nt, Salmonella typhimurium LT2
ggcacacuacgcagcg

SEQ ID NO: 3794731 - RNA, 16 nt, Salmonella typhimurium LT2
ggcacaguagacaacc

SEQ ID NO: 3794732 - RNA, 12 nt, Salmonella typhimurium LT2
ggcacaguauua

SEQ ID NO: 3794733 - RNA, 21 nt, Salmonella typhimurium LT2
ggcacauauuccggcgcuggc

SEQ ID NO: 3794734 - RNA, 13 nt, Salmonella typhimurium LT2
ggcacaucaggca

SEQ ID NO: 3794735 - RNA, 22 nt, Salmonella typhimurium LT2
ggcaccagccaggaaccgccga

SEQ ID NO: 3794736 - RNA, 12 nt, Salmonella typhimurium LT2
ggcaccagcgua

SEQ ID NO: 3794737 - RNA, 15 nt, Salmonella typhimurium LT2
ggcaccgaucauccc

SEQ ID NO: 3794738 - RNA, 15 nt, Salmonella typhimurium LT2
ggcacgcccgcauuc

SEQ ID NO: 3794739 - RNA, 16 nt, Salmonella typhimurium LT2
ggcacgccggcaaucc

SEQ ID NO: 3794740 - RNA, 23 nt, Salmonella typhimurium LT2
ggcacgcuccugcuccugcggcg

SEQ ID NO: 3794741 - RNA, 21 nt, Salmonella typhimurium LT2
ggcacuguauaugcuacacgc

SEQ ID NO: 3794742 - RNA, 23 nt, Salmonella typhimurium LT2
ggcacuuuccgguuuccauggca

SEQ ID NO: 3794743 - RNA, 18 nt, Salmonella typhimurium LT2
ggcagaaaaaucagcauu

SEQ ID NO: 3794744 - RNA, 10 nt, Salmonella typhimurium LT2
ggcagaaccu

SEQ ID NO: 3794745 - RNA, 20 nt, Salmonella typhimurium LT2
ggcagacagccgcggcgcuu

SEQ ID NO: 3794746 - RNA, 19 nt, Salmonella typhimurium LT2
ggcagacguuuaucggcca

SEQ ID NO: 3794747 - RNA, 22 nt, Salmonella typhimurium LT2
ggcagacguuuaucggccagca

SEQ ID NO: 3794748 - RNA, 12 nt, Salmonella typhimurium LT2
ggcagagcgcgc

SEQ ID NO: 3794749 - RNA, 13 nt, Salmonella typhimurium LT2
ggcagauucuucu

SEQ ID NO: 3794750 - RNA, 17 nt, Salmonella typhimurium LT2
ggcagauugacgucggu

SEQ ID NO: 3794751 - RNA, 19 nt, Salmonella typhimurium LT2
ggcagcaauacgcccgccc

SEQ ID NO: 3794752 - RNA, 20 nt, Salmonella typhimurium LT2
ggcagcaauacgcccgcccg

SEQ ID NO: 3794753 - RNA, 19 nt, Salmonella typhimurium LT2
ggcagcacaaucagcgcgg

SEQ ID NO: 3794754 - RNA, 12 nt, Salmonella typhimurium LT2
ggcagcagaccg

SEQ ID NO: 3794755 - RNA, 19 nt, Salmonella typhimurium LT2
ggcagcagcagcagcagac

SEQ ID NO: 3794756 - RNA, 12 nt, Salmonella typhimurium LT2
ggcagcagcgcg

SEQ ID NO: 3794757 - RNA, 13 nt, Salmonella typhimurium LT2
ggcagccaggaac

SEQ ID NO: 3794758 - RNA, 23 nt, Salmonella typhimurium LT2
ggcagccaugcuauucagcaguu

SEQ ID NO: 3794759 - RNA, 22 nt, Salmonella typhimurium LT2
ggcagccggauuuuaaauuggu

SEQ ID NO: 3794760 - RNA, 16 nt, Salmonella typhimurium LT2
ggcagccguuuuccgg

SEQ ID NO: 3794761 - RNA, 19 nt, Salmonella typhimurium LT2
ggcagcgccugacggcgcu

SEQ ID NO: 3794762 - RNA, 24 nt, Salmonella typhimurium LT2
ggcagcggcuucaauaccgcccca

SEQ ID NO: 3794763 - RNA, 16 nt, Salmonella typhimurium LT2
ggcagcgggugagcgc

SEQ ID NO: 3794764 - RNA, 15 nt, Salmonella typhimurium LT2
ggcagcgucguccag

SEQ ID NO: 3794765 - RNA, 21 nt, Salmonella typhimurium LT2
ggccaucaacuucucgcaggc

SEQ ID NO: 3794766 - RNA, 14 nt, Salmonella typhimurium LT2
ggccaucaugcagg

SEQ ID NO: 3794767 - RNA, 21 nt, Salmonella typhimurium LT2
ggccaucgacgaaauggugug

SEQ ID NO: 3794768 - RNA, 17 nt, Salmonella typhimurium LT2
ggccaucgccgccauca

SEQ ID NO: 3794769 - RNA, 18 nt, Salmonella typhimurium LT2
ggccaucugaucgcugag

SEQ ID NO: 3794770 - RNA, 15 nt, Salmonella typhimurium LT2
ggccaucuggcguug

SEQ ID NO: 3794771 - RNA, 16 nt, Salmonella typhimurium LT2
ggccaucuggcguugc

SEQ ID NO: 3794772 - RNA, 17 nt, Salmonella typhimurium LT2
ggccaucuuccagcauc

SEQ ID NO: 3794773 - RNA, 20 nt, Salmonella typhimurium LT2
ggcccaaucaacgcauuaua

SEQ ID NO: 3794774 - RNA, 13 nt, Salmonella typhimurium LT2
ggcccacccauuc

SEQ ID NO: 3794775 - RNA, 17 nt, Salmonella typhimurium LT2
ggcccagcgcgguggcg

SEQ ID NO: 3794776 - RNA, 20 nt, Salmonella typhimurium LT2
ggcccagcuaaaccacggaa

SEQ ID NO: 3794777 - RNA, 19 nt, Salmonella typhimurium LT2
ggcccauaccccacgccau

SEQ ID NO: 3794778 - RNA, 16 nt, Salmonella typhimurium LT2
ggcccccaucgccagc

SEQ ID NO: 3794779 - RNA, 23 nt, Salmonella typhimurium LT2
ggcccccuguuccagggcuucca

SEQ ID NO: 3794780 - RNA, 20 nt, Salmonella typhimurium LT2
ggcccgauaagcaaagcgcc

SEQ ID NO: 3794781 - RNA, 15 nt, Salmonella typhimurium LT2
ggcccgauaagcgcc

SEQ ID NO: 3794782 - RNA, 20 nt, Salmonella typhimurium LT2
ggcccgauaagcgccgcgcc

SEQ ID NO: 3794783 - RNA, 23 nt, Salmonella typhimurium LT2
ggcccgauaagcgccgcgccauc

SEQ ID NO: 3794784 - RNA, 17 nt, Salmonella typhimurium LT2
ggcccgccagcacagca

SEQ ID NO: 3794785 - RNA, 22 nt, Salmonella typhimurium LT2
ggcccggcaggcaucgcgccgc

SEQ ID NO: 3794786 - RNA, 22 nt, Salmonella typhimurium LT2
ggcccgguaagcacaacgcauu

SEQ ID NO: 3794787 - RNA, 18 nt, Salmonella typhimurium LT2
ggcccgguaagcgcagcg

SEQ ID NO: 3794788 - RNA, 20 nt, Salmonella typhimurium LT2
ggcccgguaagcgcagcgcc

SEQ ID NO: 3794789 - RNA, 21 nt, Salmonella typhimurium LT2
ggcccgguggcgccgcgccac

SEQ ID NO: 3794790 - RNA, 18 nt, Salmonella typhimurium LT2
ggcccggugugccgcuug

SEQ ID NO: 3794791 - RNA, 21 nt, Salmonella typhimurium LT2
ggcccggugugccgcuugcca

SEQ ID NO: 3794792 - RNA, 15 nt, Salmonella typhimurium LT2
ggcccgucagagcga

SEQ ID NO: 3794793 - RNA, 12 nt, Salmonella typhimurium LT2
ggcccguugccu

SEQ ID NO: 3794794 - RNA, 17 nt, Salmonella typhimurium LT2
ggcccugacgggcucgu

SEQ ID NO: 3794795 - RNA, 19 nt, Salmonella typhimurium LT2
ggccgaaaccgcucacggu

SEQ ID NO: 3794796 - RNA, 20 nt, Salmonella typhimurium LT2
ggccgaaggaagauagcggg

SEQ ID NO: 3794797 - RNA, 21 nt, Salmonella typhimurium LT2
ggccgaauaagcgacagcgcc

SEQ ID NO: 3794798 - RNA, 14 nt, Salmonella typhimurium LT2
ggccgacaaaaauu

SEQ ID NO: 3794799 - RNA, 13 nt, Salmonella typhimurium LT2
ggccgaugcgccc

SEQ ID NO: 3794800 - RNA, 21 nt, Salmonella typhimurium LT2
ggccgauuuuuuaucucgccg

SEQ ID NO: 3794801 - RNA, 17 nt, Salmonella typhimurium LT2
ggccgcaaaugcggccc

SEQ ID NO: 3794802 - RNA, 13 nt, Salmonella typhimurium LT2
ggccgcagcgcca

SEQ ID NO: 3794803 - RNA, 21 nt, Salmonella typhimurium LT2
ggccgcaguuuuccagcgccu

SEQ ID NO: 3794804 - RNA, 22 nt, Salmonella typhimurium LT2
ggccgcaguuuuccagcgccuc

SEQ ID NO: 3794805 - RNA, 12 nt, Salmonella typhimurium LT2
ggccgcaucggg

SEQ ID NO: 3794806 - RNA, 16 nt, Salmonella typhimurium LT2
ggccgccaccgccucg

SEQ ID NO: 3794807 - RNA, 12 nt, Salmonella typhimurium LT2
ggccgccagcgc

SEQ ID NO: 3794808 - RNA, 12 nt, Salmonella typhimurium LT2
ggccgccagggg

SEQ ID NO: 3794809 - RNA, 16 nt, Salmonella typhimurium LT2
ggccgccgcacaggcg

SEQ ID NO: 3794810 - RNA, 20 nt, Salmonella typhimurium LT2
ggccgcgaugguuacuccuc

SEQ ID NO: 3794811 - RNA, 19 nt, Salmonella typhimurium LT2
ggccgcgccgcgcacgccg

SEQ ID NO: 3794812 - RNA, 21 nt, Salmonella typhimurium LT2
ggccgcgcugaugugcggccu

SEQ ID NO: 3794813 - RNA, 15 nt, Salmonella typhimurium LT2
ggccgcgcugcgccu

SEQ ID NO: 3794814 - RNA, 20 nt, Salmonella typhimurium LT2
ggccgcgugcucgcggcgga

SEQ ID NO: 3794815 - RNA, 14 nt, Salmonella typhimurium LT2
ggccgcguuaucgg

SEQ ID NO: 3794816 - RNA, 12 nt, Salmonella typhimurium LT2
ggccgcucgccu

SEQ ID NO: 3794817 - RNA, 16 nt, Salmonella typhimurium LT2
ggccgcucuauuugca

SEQ ID NO: 3794818 - RNA, 14 nt, Salmonella typhimurium LT2
ggccgcuuugcgaa

SEQ ID NO: 3794819 - RNA, 19 nt, Salmonella typhimurium LT2
ggccgcuuugcgaacagcg

SEQ ID NO: 3794820 - RNA, 21 nt, Salmonella typhimurium LT2
ggccgcuuugcgaacagcgca

SEQ ID NO: 3794821 - RNA, 19 nt, Salmonella typhimurium LT2
ggccgcuuuucggcguuua

SEQ ID NO: 3794822 - RNA, 23 nt, Salmonella typhimurium LT2
ggccggauaagacgcuacgcguc

SEQ ID NO: 3794823 - RNA, 22 nt, Salmonella typhimurium LT2
ggccggauaagcaaagcgccau

SEQ ID NO: 3794824 - RNA, 18 nt, Salmonella typhimurium LT2
ggccggauaagcgcagcg

SEQ ID NO: 3794825 - RNA, 20 nt, Salmonella typhimurium LT2
ggccggauaagcgcagcgcc

SEQ ID NO: 3794826 - RNA, 23 nt, Salmonella typhimurium LT2
ggccggauaagcgucagcgccau

SEQ ID NO: 3794827 - RNA, 22 nt, Salmonella typhimurium LT2
ggccggauaaggcguucacgcc

SEQ ID NO: 3794828 - RNA, 16 nt, Salmonella typhimurium LT2
ggccggaugaggcgca

SEQ ID NO: 3794829 - RNA, 19 nt, Salmonella typhimurium LT2
ggccggcaccagccaggaa

SEQ ID NO: 3794830 - RNA, 22 nt, Salmonella typhimurium LT2
ggccggguacugaaugccaucc

SEQ ID NO: 3794831 - RNA, 16 nt, Salmonella typhimurium LT2
ggccggguccgcccgg

SEQ ID NO: 3794832 - RNA, 21 nt, Salmonella typhimurium LT2
ggccgguuuuaaaaauaacgc

SEQ ID NO: 3794833 - RNA, 17 nt, Salmonella typhimurium LT2
ggccgucaaaccggcgg

SEQ ID NO: 3794834 - RNA, 15 nt, Salmonella typhimurium LT2
ggccgucccacgcgc

SEQ ID NO: 3794835 - RNA, 17 nt, Salmonella typhimurium LT2
ggccgucggcgccagcc

SEQ ID NO: 3794836 - RNA, 23 nt, Salmonella typhimurium LT2
ggccgugauccugguccggcagg

SEQ ID NO: 3794837 - RNA, 20 nt, Salmonella typhimurium LT2
ggccguggaucucgucgccg

SEQ ID NO: 3794838 - RNA, 23 nt, Salmonella typhimurium LT2
ggccguuggcuuuaugcacgccg

SEQ ID NO: 3794839 - RNA, 15 nt, Salmonella typhimurium LT2
ggccguuuucaugca

SEQ ID NO: 3794840 - RNA, 13 nt, Salmonella typhimurium LT2
ggccuaaaaauag

SEQ ID NO: 3794841 - RNA, 16 nt, Salmonella typhimurium LT2
ggccuaagaccagcac

SEQ ID NO: 3794842 - RNA, 24 nt, Salmonella typhimurium LT2
ggccuacaaaaucgcccaggucug

SEQ ID NO: 3794843 - RNA, 23 nt, Salmonella typhimurium LT2
ggccuacaagaucgcaacgugca

SEQ ID NO: 3794844 - RNA, 13 nt, Salmonella typhimurium LT2
ggccuacaagccg

SEQ ID NO: 3794845 - RNA, 14 nt, Salmonella typhimurium LT2
ggccuacaagccgc

SEQ ID NO: 3794846 - RNA, 17 nt, Salmonella typhimurium LT2
ggccuacaagccgccuc

SEQ ID NO: 3794847 - RNA, 18 nt, Salmonella typhimurium LT2
ggccuacaagccgccucg

SEQ ID NO: 3794848 - RNA, 17 nt, Salmonella typhimurium LT2
ggccuacagacuguacc

SEQ ID NO: 3794849 - RNA, 16 nt, Salmonella typhimurium LT2
ggccuacauucauuaa

SEQ ID NO: 3794850 - RNA, 15 nt, Salmonella typhimurium LT2
ggccuacccgcgugc

SEQ ID NO: 3794851 - RNA, 19 nt, Salmonella typhimurium LT2
ggccuacucuugagccaga

SEQ ID NO: 3794852 - RNA, 12 nt, Salmonella typhimurium LT2
ggccuccagcac

SEQ ID NO: 3794853 - RNA, 18 nt, Salmonella typhimurium LT2
ggccuccgcguaucucag

SEQ ID NO: 3794854 - RNA, 12 nt, Salmonella typhimurium LT2
ggccuccugacg

SEQ ID NO: 3794855 - RNA, 13 nt, Salmonella typhimurium LT2
ggccuccuggcuu

SEQ ID NO: 3794856 - RNA, 21 nt, Salmonella typhimurium LT2
ggccucgcgcucaagcgaaaa

SEQ ID NO: 3794857 - RNA, 13 nt, Salmonella typhimurium LT2
ggccucuccucga

SEQ ID NO: 3794858 - RNA, 18 nt, Salmonella typhimurium LT2
ggccucuuuuuagcagca

SEQ ID NO: 3794859 - RNA, 21 nt, Salmonella typhimurium LT2
ggccucuuuuuagcagcaaua

SEQ ID NO: 3794860 - RNA, 20 nt, Salmonella typhimurium LT2
ggccugaauaaugaccucca

SEQ ID NO: 3794861 - RNA, 22 nt, Salmonella typhimurium LT2
ggccugaaugcagaccucugcu

SEQ ID NO: 3794862 - RNA, 14 nt, Salmonella typhimurium LT2
ggccugagcgcgca

SEQ ID NO: 3794863 - RNA, 20 nt, Salmonella typhimurium LT2
ggccugauaagcgaagcgcc

SEQ ID NO: 3794864 - RNA, 20 nt, Salmonella typhimurium LT2
ggccugauaagcgcagcgca

SEQ ID NO: 3794865 - RNA, 20 nt, Salmonella typhimurium LT2
ggccugauaagcgcagcgcc

SEQ ID NO: 3794866 - RNA, 13 nt, Salmonella typhimurium LT2
ggccugauaggcc

SEQ ID NO: 3794867 - RNA, 18 nt, Salmonella typhimurium LT2
ggccugcgaaugcaggcc

SEQ ID NO: 3794868 - RNA, 15 nt, Salmonella typhimurium LT2
ggcgccaucaccauc

SEQ ID NO: 3794869 - RNA, 19 nt, Salmonella typhimurium LT2
ggcgccauuccugccgccg

SEQ ID NO: 3794870 - RNA, 15 nt, Salmonella typhimurium LT2
ggcgcccauccgccc

SEQ ID NO: 3794871 - RNA, 17 nt, Salmonella typhimurium LT2
ggcgccgaagcaggcgg

SEQ ID NO: 3794872 - RNA, 21 nt, Salmonella typhimurium LT2
ggcgccgcaaugccgccugcg

SEQ ID NO: 3794873 - RNA, 21 nt, Salmonella typhimurium LT2
ggcgccgugaguuucagcauc

SEQ ID NO: 3794874 - RNA, 15 nt, Salmonella typhimurium LT2
ggcgccuccagccau

SEQ ID NO: 3794875 - RNA, 15 nt, Salmonella typhimurium LT2
ggcgccugcggcagg

SEQ ID NO: 3794876 - RNA, 17 nt, Salmonella typhimurium LT2
ggcgccugcggcaggca

SEQ ID NO: 3794877 - RNA, 16 nt, Salmonella typhimurium LT2
ggcgccuuauccggcc

SEQ ID NO: 3794878 - RNA, 18 nt, Salmonella typhimurium LT2
ggcgccuuucgcgcugca

SEQ ID NO: 3794879 - RNA, 18 nt, Salmonella typhimurium LT2
ggcgcgaaaacagcuggc

SEQ ID NO: 3794880 - RNA, 13 nt, Salmonella typhimurium LT2
ggcgcgaaagcgc

SEQ ID NO: 3794881 - RNA, 15 nt, Salmonella typhimurium LT2
ggcgcgaaagcgccu

SEQ ID NO: 3794882 - RNA, 17 nt, Salmonella typhimurium LT2
ggcgcgaaagcgccuug

SEQ ID NO: 3794883 - RNA, 20 nt, Salmonella typhimurium LT2
ggcgcgacgcuuaucagccc

SEQ ID NO: 3794884 - RNA, 16 nt, Salmonella typhimurium LT2
ggcgcgauauccacca

SEQ ID NO: 3794885 - RNA, 17 nt, Salmonella typhimurium LT2
ggcgcgaucgguaggcc

SEQ ID NO: 3794886 - RNA, 18 nt, Salmonella typhimurium LT2
ggcgcgcuaucaagauaa

SEQ ID NO: 3794887 - RNA, 11 nt, Salmonella typhimurium LT2
ggcgcgcuggc

SEQ ID NO: 3794888 - RNA, 21 nt, Salmonella typhimurium LT2
ggcgcggaaagccuucaucau

SEQ ID NO: 3794889 - RNA, 13 nt, Salmonella typhimurium LT2
ggcgcggaaggga

SEQ ID NO: 3794890 - RNA, 17 nt, Salmonella typhimurium LT2
ggcgcggcgacgccucg

SEQ ID NO: 3794891 - RNA, 22 nt, Salmonella typhimurium LT2
ggcgcguaaguuugcguacuca

SEQ ID NO: 3794892 - RNA, 16 nt, Salmonella typhimurium LT2
ggcgcguccagccagc

SEQ ID NO: 3794893 - RNA, 14 nt, Salmonella typhimurium LT2
ggcgcguugccgcc

SEQ ID NO: 3794894 - RNA, 23 nt, Salmonella typhimurium LT2
ggcgcuaaaccggcggaauagcu

SEQ ID NO: 3794895 - RNA, 20 nt, Salmonella typhimurium LT2
ggcgcuaaggcaucucuggc

SEQ ID NO: 3794896 - RNA, 15 nt, Salmonella typhimurium LT2
ggcgcuacgcuuauc

SEQ ID NO: 3794897 - RNA, 18 nt, Salmonella typhimurium LT2
ggcgcuacgcuuaucagg

SEQ ID NO: 3794898 - RNA, 14 nt, Salmonella typhimurium LT2
ggcgcuacggcgca

SEQ ID NO: 3794899 - RNA, 15 nt, Salmonella typhimurium LT2
ggcgcuaucgccucc

SEQ ID NO: 3794900 - RNA, 17 nt, Salmonella typhimurium LT2
ggcgcuaucgccuccag

SEQ ID NO: 3794901 - RNA, 19 nt, Salmonella typhimurium LT2
ggcgcuaucgccuccagac

SEQ ID NO: 3794902 - RNA, 22 nt, Salmonella typhimurium LT2
ggcgcuaucgccuccagacugg

SEQ ID NO: 3794903 - RNA, 14 nt, Salmonella typhimurium LT2
ggcgcuccagccgu

SEQ ID NO: 3794904 - RNA, 21 nt, Salmonella typhimurium LT2
ggcgcugaacgcauacaggcu

SEQ ID NO: 3794905 - RNA, 23 nt, Salmonella typhimurium LT2
ggcgcugaguuucucccgccaga

SEQ ID NO: 3794906 - RNA, 23 nt, Salmonella typhimurium LT2
ggcgcugccgucaaugccgggca

SEQ ID NO: 3794907 - RNA, 19 nt, Salmonella typhimurium LT2
ggcgcugcgccaucaggca

SEQ ID NO: 3794908 - RNA, 20 nt, Salmonella typhimurium LT2
ggcgcugcgcuuaccaggcc

SEQ ID NO: 3794909 - RNA, 20 nt, Salmonella typhimurium LT2
ggcgcugcgcuuaucagacc

SEQ ID NO: 3794910 - RNA, 18 nt, Salmonella typhimurium LT2
ggcgcugcgcuuaucagg

SEQ ID NO: 3794911 - RNA, 20 nt, Salmonella typhimurium LT2
ggcgcugcgcuuaucaggcc

SEQ ID NO: 3794912 - RNA, 18 nt, Salmonella typhimurium LT2
ggcgcugcgcuuauccgg

SEQ ID NO: 3794913 - RNA, 17 nt, Salmonella typhimurium LT2
ggcgcugucgccacgca

SEQ ID NO: 3794914 - RNA, 18 nt, Salmonella typhimurium LT2
ggcgcugucgcuuaccgg

SEQ ID NO: 3794915 - RNA, 22 nt, Salmonella typhimurium LT2
ggcgcuuacacauuuuauccgg

SEQ ID NO: 3794916 - RNA, 19 nt, Salmonella typhimurium LT2
ggcgcuucgcuuaucaggc

SEQ ID NO: 3794917 - RNA, 17 nt, Salmonella typhimurium LT2
ggcgcuucgcuuaucgg

SEQ ID NO: 3794918 - RNA, 17 nt, Salmonella typhimurium LT2
ggcgcuugcgccgccau

SEQ ID NO: 3794919 - RNA, 23 nt, Salmonella typhimurium LT2
ggcgcuuuacaugccgcucuccg

SEQ ID NO: 3794920 - RNA, 15 nt, Salmonella typhimurium LT2
ggcgcuuugcuuauc

SEQ ID NO: 3794921 - RNA, 20 nt, Salmonella typhimurium LT2
ggcgcuuugcuuauccggcc

SEQ ID NO: 3794922 - RNA, 14 nt, Salmonella typhimurium LT2
ggcggaaaagcgcc

SEQ ID NO: 3794923 - RNA, 14 nt, Salmonella typhimurium LT2
ggcggaaaauagcg

SEQ ID NO: 3794924 - RNA, 22 nt, Salmonella typhimurium LT2
ggcggaaaggacuuaucaggcc

SEQ ID NO: 3794925 - RNA, 17 nt, Salmonella typhimurium LT2
ggcggaaauucgcgcca

SEQ ID NO: 3794926 - RNA, 22 nt, Salmonella typhimurium LT2
ggcggaaccauuuuccccagaa

SEQ ID NO: 3794927 - RNA, 14 nt, Salmonella typhimurium LT2
ggcggaauggcggg

SEQ ID NO: 3794928 - RNA, 21 nt, Salmonella typhimurium LT2
ggcggaauugguagacgcgcu

SEQ ID NO: 3794929 - RNA, 15 nt, Salmonella typhimurium LT2
ggcggauaaaucauc

SEQ ID NO: 3794930 - RNA, 21 nt, Salmonella typhimurium LT2
ggcggauacagcggcgcgcca

SEQ ID NO: 3794931 - RNA, 22 nt, Salmonella typhimurium LT2
ggcggaugaaacaguccggcga

SEQ ID NO: 3794932 - RNA, 22 nt, Salmonella typhimurium LT2
ggcggauuccaguagcgcgccc

SEQ ID NO: 3794933 - RNA, 12 nt, Salmonella typhimurium LT2
ggcggcaaaaaa

SEQ ID NO: 3794934 - RNA, 14 nt, Salmonella typhimurium LT2
ggcggcaaaaacgc

SEQ ID NO: 3794935 - RNA, 16 nt, Salmonella typhimurium LT2
ggcggcaaaaacgccg

SEQ ID NO: 3794936 - RNA, 14 nt, Salmonella typhimurium LT2
ggcggcaaagucuu

SEQ ID NO: 3794937 - RNA, 13 nt, Salmonella typhimurium LT2
ggcggcaaauaaa

SEQ ID NO: 3794938 - RNA, 15 nt, Salmonella typhimurium LT2
ggcggcaacaaaugu

SEQ ID NO: 3794939 - RNA, 19 nt, Salmonella typhimurium LT2
ggcggcaagaucauccggg

SEQ ID NO: 3794940 - RNA, 19 nt, Salmonella typhimurium LT2
ggcggcaagggagugaguc

SEQ ID NO: 3794941 - RNA, 21 nt, Salmonella typhimurium LT2
ggcggcaauuuguagcugcgc

SEQ ID NO: 3794942 - RNA, 14 nt, Salmonella typhimurium LT2
ggcggcacgcaggc

SEQ ID NO: 3794943 - RNA, 23 nt, Salmonella typhimurium LT2
ggcggcaguggacuaugcuccag

SEQ ID NO: 3794944 - RNA, 23 nt, Salmonella typhimurium LT2
ggcggcauaaacgccuuauccgg

SEQ ID NO: 3794945 - RNA, 18 nt, Salmonella typhimurium LT2
ggcggcccauucgcccaa

SEQ ID NO: 3794946 - RNA, 14 nt, Salmonella typhimurium LT2
ggcggccugcgcca

SEQ ID NO: 3794947 - RNA, 19 nt, Salmonella typhimurium LT2
ggcggcgaaacgccuuauc

SEQ ID NO: 3794948 - RNA, 21 nt, Salmonella typhimurium LT2
ggcggcgaaacgccuuauccg

SEQ ID NO: 3794949 - RNA, 21 nt, Salmonella typhimurium LT2
ggcggcgauacuccgacggcg

SEQ ID NO: 3794950 - RNA, 23 nt, Salmonella typhimurium LT2
ggcggcgcgaacgccuuauccgg

SEQ ID NO: 3794951 - RNA, 23 nt, Salmonella typhimurium LT2
ggcggcgcgaccauaaugaccca

SEQ ID NO: 3794952 - RNA, 14 nt, Salmonella typhimurium LT2
ggcggcgcgcugcc

SEQ ID NO: 3794953 - RNA, 22 nt, Salmonella typhimurium LT2
ggcggcgcuaacgcgucuuauc

SEQ ID NO: 3794954 - RNA, 20 nt, Salmonella typhimurium LT2
ggcggcggaaaggacuuauc

SEQ ID NO: 3794955 - RNA, 14 nt, Salmonella typhimurium LT2
ggcggcguaaacac

SEQ ID NO: 3794956 - RNA, 23 nt, Salmonella typhimurium LT2
ggcggcguaaacaccuuauccgg

SEQ ID NO: 3794957 - RNA, 23 nt, Salmonella typhimurium LT2
ggcggcgugaccgccuuauccgg

SEQ ID NO: 3794958 - RNA, 15 nt, Salmonella typhimurium LT2
ggcggcguuuuccgg

SEQ ID NO: 3794959 - RNA, 19 nt, Salmonella typhimurium LT2
ggcggcuaccucuuauccg

SEQ ID NO: 3794960 - RNA, 20 nt, Salmonella typhimurium LT2
ggcggcugcgccuuacccgg

SEQ ID NO: 3794961 - RNA, 17 nt, Salmonella typhimurium LT2
ggcggcugcgccuuauc

SEQ ID NO: 3794962 - RNA, 19 nt, Salmonella typhimurium LT2
ggcggcuucgccauccggu

SEQ ID NO: 3794963 - RNA, 20 nt, Salmonella typhimurium LT2
ggcggcuucgccuuacccgg

SEQ ID NO: 3794964 - RNA, 15 nt, Salmonella typhimurium LT2
ggcgggaucggggcg

SEQ ID NO: 3794965 - RNA, 16 nt, Salmonella typhimurium LT2
ggcggggcggaaccug

SEQ ID NO: 3794966 - RNA, 20 nt, Salmonella typhimurium LT2
ggcgggguucgggcagcgcu

SEQ ID NO: 3794967 - RNA, 18 nt, Salmonella typhimurium LT2
ggcggguaauuugcgcca

SEQ ID NO: 3794968 - RNA, 16 nt, Salmonella typhimurium LT2
ggcggguauggcgcca

SEQ ID NO: 3794969 - RNA, 21 nt, Salmonella typhimurium LT2
ggcggguuugaguguuuccgg

SEQ ID NO: 3794970 - RNA, 23 nt, Salmonella typhimurium LT2
ggcgguaaaaccuaacgccugca

SEQ ID NO: 3794971 - RNA, 22 nt, Salmonella typhimurium LT2
ggcugacugaauuuucagccau

SEQ ID NO: 3794972 - RNA, 14 nt, Salmonella typhimurium LT2
ggcugagaaaaaua

SEQ ID NO: 3794973 - RNA, 18 nt, Salmonella typhimurium LT2
ggcugaggccgcucgcca

SEQ ID NO: 3794974 - RNA, 23 nt, Salmonella typhimurium LT2
ggcugauacgccuggauagacga

SEQ ID NO: 3794975 - RNA, 16 nt, Salmonella typhimurium LT2
ggcugauuauauaaca

SEQ ID NO: 3794976 - RNA, 17 nt, Salmonella typhimurium LT2
ggcugauuuaaucgcuu

SEQ ID NO: 3794977 - RNA, 17 nt, Salmonella typhimurium LT2
ggcugcaaagcaucugc

SEQ ID NO: 3794978 - RNA, 18 nt, Salmonella typhimurium LT2
ggcugcaaagcaucugcc

SEQ ID NO: 3794979 - RNA, 21 nt, Salmonella typhimurium LT2
ggcugcaaagcaucugccggc

SEQ ID NO: 3794980 - RNA, 22 nt, Salmonella typhimurium LT2
ggcugcaaagcaucugccggca

SEQ ID NO: 3794981 - RNA, 21 nt, Salmonella typhimurium LT2
ggcugcacccggagagaaaca

SEQ ID NO: 3794982 - RNA, 15 nt, Salmonella typhimurium LT2
ggcugccagccagcg

SEQ ID NO: 3794983 - RNA, 17 nt, Salmonella typhimurium LT2
ggcugccagccagcggg

SEQ ID NO: 3794984 - RNA, 16 nt, Salmonella typhimurium LT2
ggcugccaucggcauu

SEQ ID NO: 3794985 - RNA, 19 nt, Salmonella typhimurium LT2
ggcugccgacuacgccucc

SEQ ID NO: 3794986 - RNA, 22 nt, Salmonella typhimurium LT2
ggcugccgaugaucccggcgcc

SEQ ID NO: 3794987 - RNA, 21 nt, Salmonella typhimurium LT2
ggcugccugccggauuuuuca

SEQ ID NO: 3794988 - RNA, 17 nt, Salmonella typhimurium LT2
ggcugccuuaauucucc

SEQ ID NO: 3794989 - RNA, 22 nt, Salmonella typhimurium LT2
ggcugcgacaaugaagcauaaa

SEQ ID NO: 3794990 - RNA, 20 nt, Salmonella typhimurium LT2
ggcugcgccuuaucaagccu

SEQ ID NO: 3794991 - RNA, 20 nt, Salmonella typhimurium LT2
ggcugcgccuuauccggccu

SEQ ID NO: 3794992 - RNA, 23 nt, Salmonella typhimurium LT2
ggcugcggccuccgcagcuucau

SEQ ID NO: 3794993 - RNA, 14 nt, Salmonella typhimurium LT2
ggcugcuugagcca

SEQ ID NO: 3794994 - RNA, 17 nt, Salmonella typhimurium LT2
ggcuggaaagcucuuca

SEQ ID NO: 3794995 - RNA, 19 nt, Salmonella typhimurium LT2
ggcuggauaaccguacggc

SEQ ID NO: 3794996 - RNA, 20 nt, Salmonella typhimurium LT2
ggcuggcaaugcgcuguauu

SEQ ID NO: 3794997 - RNA, 12 nt, Salmonella typhimurium LT2
ggcuggccacug

SEQ ID NO: 3794998 - RNA, 11 nt, Salmonella typhimurium LT2
ggcuggcuggc

SEQ ID NO: 3794999 - RNA, 19 nt, Salmonella typhimurium LT2
ggcuggguucauccagcaa

SEQ ID NO: 3795000 - RNA, 21 nt, Salmonella typhimurium LT2
ggcugguaacaguccguggca

SEQ ID NO: 3795001 - RNA, 14 nt, Salmonella typhimurium LT2
ggcugguuucuccg

SEQ ID NO: 3795002 - RNA, 23 nt, Salmonella typhimurium LT2
ggcuguauguaggguacagcgcg

SEQ ID NO: 3795003 - RNA, 21 nt, Salmonella typhimurium LT2
ggcugucgauuuccggcggca

SEQ ID NO: 3795004 - RNA, 23 nt, Salmonella typhimurium LT2
ggcuguggcguuuuaccgcccga

SEQ ID NO: 3795005 - RNA, 18 nt, Salmonella typhimurium LT2
ggcuuaacacccggauau

SEQ ID NO: 3795006 - RNA, 13 nt, Salmonella typhimurium LT2
ggcuuaccugcuc

SEQ ID NO: 3795007 - RNA, 23 nt, Salmonella typhimurium LT2
ggcuuacgaguggcgaucaggca

SEQ ID NO: 3795008 - RNA, 19 nt, Salmonella typhimurium LT2
ggcuuacgguuguuucagc

SEQ ID NO: 3795009 - RNA, 21 nt, Salmonella typhimurium LT2
ggcuuacuuuccaaaauccag

SEQ ID NO: 3795010 - RNA, 15 nt, Salmonella typhimurium LT2
ggcuucauaccgaga

SEQ ID NO: 3795011 - RNA, 13 nt, Salmonella typhimurium LT2
ggcuucccaucgc

SEQ ID NO: 3795012 - RNA, 16 nt, Salmonella typhimurium LT2
ggcuucgauuacagga

SEQ ID NO: 3795013 - RNA, 15 nt, Salmonella typhimurium LT2
ggcuucgcgcagcca

SEQ ID NO: 3795014 - RNA, 23 nt, Salmonella typhimurium LT2
ggcuucggcaauuuccggcgacg

SEQ ID NO: 3795015 - RNA, 22 nt, Salmonella typhimurium LT2
ggcuucugauaagcgcagcguc

SEQ ID NO: 3795016 - RNA, 23 nt, Salmonella typhimurium LT2
ggcuucugauaagcgcagcgucg

SEQ ID NO: 3795017 - RNA, 17 nt, Salmonella typhimurium LT2
ggcuugagcaccacgcg

SEQ ID NO: 3795018 - RNA, 17 nt, Salmonella typhimurium LT2
ggcuugccagauagaca

SEQ ID NO: 3795019 - RNA, 18 nt, Salmonella typhimurium LT2
ggcuuguaggccggauaa

SEQ ID NO: 3795020 - RNA, 18 nt, Salmonella typhimurium LT2
ggcuuuaguucagcauau

SEQ ID NO: 3795021 - RNA, 23 nt, Salmonella typhimurium LT2
ggcuuuauccugaccgcuccagu

SEQ ID NO: 3795022 - RNA, 15 nt, Salmonella typhimurium LT2
ggcuuucauccaaua

SEQ ID NO: 3795023 - RNA, 16 nt, Salmonella typhimurium LT2
ggcuuugcaacagggc

SEQ ID NO: 3795024 - RNA, 14 nt, Salmonella typhimurium LT2
ggcuuuuaucgaca

SEQ ID NO: 3795025 - RNA, 17 nt, Salmonella typhimurium LT2
gggaaaagcauucugaa

SEQ ID NO: 3795026 - RNA, 18 nt, Salmonella typhimurium LT2
gggaaaagguuccggcga

SEQ ID NO: 3795027 - RNA, 15 nt, Salmonella typhimurium LT2
gggaaagccccuacc

SEQ ID NO: 3795028 - RNA, 12 nt, Salmonella typhimurium LT2
gggaaagggggg

SEQ ID NO: 3795029 - RNA, 19 nt, Salmonella typhimurium LT2
gggaacacaaucacugcgg

SEQ ID NO: 3795030 - RNA, 23 nt, Salmonella typhimurium LT2
gggaagagauuaacgaccaggua

SEQ ID NO: 3795031 - RNA, 16 nt, Salmonella typhimurium LT2
gggaagaugugccacu

SEQ ID NO: 3795032 - RNA, 18 nt, Salmonella typhimurium LT2
gggaagaugugccacucc

SEQ ID NO: 3795033 - RNA, 24 nt, Salmonella typhimurium LT2
gggaagcacauccauguacuccug

SEQ ID NO: 3795034 - RNA, 11 nt, Salmonella typhimurium LT2
gggaagcccuu

SEQ ID NO: 3795035 - RNA, 23 nt, Salmonella typhimurium LT2
gggaaggggauuuuccggcgcgg

SEQ ID NO: 3795036 - RNA, 23 nt, Salmonella typhimurium LT2
gggaaggugauguccagaccaau

SEQ ID NO: 3795037 - RNA, 21 nt, Salmonella typhimurium LT2
gggaaguaaggcauaaugcca

SEQ ID NO: 3795038 - RNA, 20 nt, Salmonella typhimurium LT2
gggaauaucuuccgggcggg

SEQ ID NO: 3795039 - RNA, 20 nt, Salmonella typhimurium LT2
gggaaucagggugccaggca

SEQ ID NO: 3795040 - RNA, 17 nt, Salmonella typhimurium LT2
gggaaucuccgggaaaa

SEQ ID NO: 3795041 - RNA, 15 nt, Salmonella typhimurium LT2
gggaaucucuucacg

SEQ ID NO: 3795042 - RNA, 15 nt, Salmonella typhimurium LT2
gggacacugccggcu

SEQ ID NO: 3795043 - RNA, 19 nt, Salmonella typhimurium LT2
gggaccaugauuucauccc

SEQ ID NO: 3795044 - RNA, 17 nt, Salmonella typhimurium LT2
gggacgcugcgcggcga

SEQ ID NO: 3795045 - RNA, 17 nt, Salmonella typhimurium LT2
gggagaaaacgcggccu

SEQ ID NO: 3795046 - RNA, 19 nt, Salmonella typhimurium LT2
gggagacgucaaagaguuc

SEQ ID NO: 3795047 - RNA, 20 nt, Salmonella typhimurium LT2
gggagacgucaaagaguucc

SEQ ID NO: 3795048 - RNA, 16 nt, Salmonella typhimurium LT2
gggagcagacuguaaa

SEQ ID NO: 3795049 - RNA, 20 nt, Salmonella typhimurium LT2
gggagguauaaucagcauca

SEQ ID NO: 3795050 - RNA, 14 nt, Salmonella typhimurium LT2
gggauaacaguauu

SEQ ID NO: 3795051 - RNA, 21 nt, Salmonella typhimurium LT2
gggaucguucugcugauaaua

SEQ ID NO: 3795052 - RNA, 17 nt, Salmonella typhimurium LT2
gggaugaugccacaggc

SEQ ID NO: 3795053 - RNA, 16 nt, Salmonella typhimurium LT2
gggaugguuaaauuca

SEQ ID NO: 3795054 - RNA, 19 nt, Salmonella typhimurium LT2
gggauguggugcggcuuau

SEQ ID NO: 3795055 - RNA, 15 nt, Salmonella typhimurium LT2
gggauuaugcagacg

SEQ ID NO: 3795056 - RNA, 23 nt, Salmonella typhimurium LT2
gggcaacaaacauaagcaaaucc

SEQ ID NO: 3795057 - RNA, 13 nt, Salmonella typhimurium LT2
gggcaacggccag

SEQ ID NO: 3795058 - RNA, 16 nt, Salmonella typhimurium LT2
gggcaagggcaagggc

SEQ ID NO: 3795059 - RNA, 21 nt, Salmonella typhimurium LT2
gggcaauauaauccggcgagg

SEQ ID NO: 3795060 - RNA, 20 nt, Salmonella typhimurium LT2
gggcaaucugaguauuuaca

SEQ ID NO: 3795061 - RNA, 19 nt, Salmonella typhimurium LT2
gggcacuccggcucgcaca

SEQ ID NO: 3795062 - RNA, 12 nt, Salmonella typhimurium LT2
gggcagaaaaau

SEQ ID NO: 3795063 - RNA, 11 nt, Salmonella typhimurium LT2
gggcagcaucu

SEQ ID NO: 3795064 - RNA, 23 nt, Salmonella typhimurium LT2
gggcagcaucucgauuacagcau

SEQ ID NO: 3795065 - RNA, 18 nt, Salmonella typhimurium LT2
gggcaggcgucaaaacag

SEQ ID NO: 3795066 - RNA, 22 nt, Salmonella typhimurium LT2
gggcagucuccucgcaggcucg

SEQ ID NO: 3795067 - RNA, 16 nt, Salmonella typhimurium LT2
gggcauucccagaaag

SEQ ID NO: 3795068 - RNA, 17 nt, Salmonella typhimurium LT2
gggccaccugccaggcu

SEQ ID NO: 3795069 - RNA, 15 nt, Salmonella typhimurium LT2
gggccacucuccagc

SEQ ID NO: 3795070 - RNA, 23 nt, Salmonella typhimurium LT2
gggccagaaguagcagagaaaag

SEQ ID NO: 3795071 - RNA, 17 nt, Salmonella typhimurium LT2
gggccagcauaguaaau

SEQ ID NO: 3795072 - RNA, 17 nt, Salmonella typhimurium LT2
gggccagcucuuuucug

SEQ ID NO: 3795073 - RNA, 12 nt, Salmonella typhimurium LT2
gggccgacagac

SEQ ID NO: 3795074 - RNA, 16 nt, Salmonella typhimurium LT2
gguacgcaucaccagg

SEQ ID NO: 3795075 - RNA, 15 nt, Salmonella typhimurium LT2
gguacggccagcgcg

SEQ ID NO: 3795076 - RNA, 15 nt, Salmonella typhimurium LT2
gguacuggagaccgg

SEQ ID NO: 3795077 - RNA, 17 nt, Salmonella typhimurium LT2
gguacuucuccugccag

SEQ ID NO: 3795078 - RNA, 13 nt, Salmonella typhimurium LT2
gguacuuucucca

SEQ ID NO: 3795079 - RNA, 22 nt, Salmonella typhimurium LT2
gguacuuuucauccacagcgcc

SEQ ID NO: 3795080 - RNA, 17 nt, Salmonella typhimurium LT2
gguagacaaacagcgcg

SEQ ID NO: 3795081 - RNA, 15 nt, Salmonella typhimurium LT2
gguagacgcaccaga

SEQ ID NO: 3795082 - RNA, 14 nt, Salmonella typhimurium LT2
gguagacgcgcuag

SEQ ID NO: 3795083 - RNA, 22 nt, Salmonella typhimurium LT2
gguagacgcgcuagcuucaggu

SEQ ID NO: 3795084 - RNA, 21 nt, Salmonella typhimurium LT2
gguagagcaucgcagcaucau

SEQ ID NO: 3795085 - RNA, 12 nt, Salmonella typhimurium LT2
gguagccaggcg

SEQ ID NO: 3795086 - RNA, 21 nt, Salmonella typhimurium LT2
gguagcgcuuguuaucuggca

SEQ ID NO: 3795087 - RNA, 18 nt, Salmonella typhimurium LT2
gguaggcggauaaggcgc

SEQ ID NO: 3795088 - RNA, 21 nt, Salmonella typhimurium LT2
gguaggugauaagcaggaagg

SEQ ID NO: 3795089 - RNA, 16 nt, Salmonella typhimurium LT2
gguaguaauauuaaaa

SEQ ID NO: 3795090 - RNA, 14 nt, Salmonella typhimurium LT2
gguagucacggaga

SEQ ID NO: 3795091 - RNA, 19 nt, Salmonella typhimurium LT2
gguagucacggagagucgc

SEQ ID NO: 3795092 - RNA, 16 nt, Salmonella typhimurium LT2
gguaguguuaucgccg

SEQ ID NO: 3795093 - RNA, 16 nt, Salmonella typhimurium LT2
gguauaaaaacugcca

SEQ ID NO: 3795094 - RNA, 15 nt, Salmonella typhimurium LT2
gguauacaaaaaaga

SEQ ID NO: 3795095 - RNA, 15 nt, Salmonella typhimurium LT2
gguauaggccaggcu

SEQ ID NO: 3795096 - RNA, 22 nt, Salmonella typhimurium LT2
gguaucaucgcuuaacggccca

SEQ ID NO: 3795097 - RNA, 14 nt, Salmonella typhimurium LT2
gguauccagccagg

SEQ ID NO: 3795098 - RNA, 19 nt, Salmonella typhimurium LT2
gguauccauugccagauaa

SEQ ID NO: 3795099 - RNA, 21 nt, Salmonella typhimurium LT2
gguaucccgccagcggcgcca

SEQ ID NO: 3795100 - RNA, 15 nt, Salmonella typhimurium LT2
gguauccuccugcca

SEQ ID NO: 3795101 - RNA, 23 nt, Salmonella typhimurium LT2
gguauccucgaugaaaucaccca

SEQ ID NO: 3795102 - RNA, 14 nt, Salmonella typhimurium LT2
gguauccugaacca

SEQ ID NO: 3795103 - RNA, 13 nt, Salmonella typhimurium LT2
gguaucgccuucg

SEQ ID NO: 3795104 - RNA, 17 nt, Salmonella typhimurium LT2
gguaucguugcggcgca

SEQ ID NO: 3795105 - RNA, 13 nt, Salmonella typhimurium LT2
gguaucucgucgc

SEQ ID NO: 3795106 - RNA, 17 nt, Salmonella typhimurium LT2
gguaugaaagccaucgc

SEQ ID NO: 3795107 - RNA, 19 nt, Salmonella typhimurium LT2
gguaugccuuccagaaaua

SEQ ID NO: 3795108 - RNA, 17 nt, Salmonella typhimurium LT2
gguauguauuuuaucca

SEQ ID NO: 3795109 - RNA, 23 nt, Salmonella typhimurium LT2
gguauuauccgccgcaaacucca

SEQ ID NO: 3795110 - RNA, 15 nt, Salmonella typhimurium LT2
gguauucaucggcac

SEQ ID NO: 3795111 - RNA, 21 nt, Salmonella typhimurium LT2
gguauugcccggcuguaaugg

SEQ ID NO: 3795112 - RNA, 15 nt, Salmonella typhimurium LT2
gguauugcuuucaau

SEQ ID NO: 3795113 - RNA, 17 nt, Salmonella typhimurium LT2
gguauuuauccagcagg

SEQ ID NO: 3795114 - RNA, 17 nt, Salmonella typhimurium LT2
gguauuuucuaucgcau

SEQ ID NO: 3795115 - RNA, 19 nt, Salmonella typhimurium LT2
ggucaaaaaagcgacgcug

SEQ ID NO: 3795116 - RNA, 15 nt, Salmonella typhimurium LT2
ggucaaacaaaucau

SEQ ID NO: 3795117 - RNA, 17 nt, Salmonella typhimurium LT2
ggucaacgcgccgccaa

SEQ ID NO: 3795118 - RNA, 21 nt, Salmonella typhimurium LT2
ggucaacuaacaaugucgaaa

SEQ ID NO: 3795119 - RNA, 15 nt, Salmonella typhimurium LT2
ggucaaugugcucaa

SEQ ID NO: 3795120 - RNA, 23 nt, Salmonella typhimurium LT2
ggucacacuuaccgggcaucuga

SEQ ID NO: 3795121 - RNA, 15 nt, Salmonella typhimurium LT2
ggucacgacguauua

SEQ ID NO: 3795122 - RNA, 16 nt, Salmonella typhimurium LT2
ggucagcagaaacugg

SEQ ID NO: 3795123 - RNA, 23 nt, Salmonella typhimurium LT2
ggucagcaggcgaacuucaucca

SEQ ID NO: 3795124 - RNA, 21 nt, Salmonella typhimurium LT2
ggucagcauuucauccauuaa

SEQ ID NO: 3795125 - RNA, 18 nt, Salmonella typhimurium LT2
ggucagcguaccagcggu

SEQ ID NO: 3795126 - RNA, 13 nt, Salmonella typhimurium LT2
ggucaggcuaaau

SEQ ID NO: 3795127 - RNA, 22 nt, Salmonella typhimurium LT2
ggucagggugaauaccagcggc

SEQ ID NO: 3795128 - RNA, 23 nt, Salmonella typhimurium LT2
ggucaguacgcgcguauccgccg

SEQ ID NO: 3795129 - RNA, 24 nt, Salmonella typhimurium LT2
ggucaguagcguucucuccaguuc

SEQ ID NO: 3795130 - RNA, 18 nt, Salmonella typhimurium LT2
ggucaucaacuggcggcu

SEQ ID NO: 3795131 - RNA, 16 nt, Salmonella typhimurium LT2
ggucaucaccuccagc

SEQ ID NO: 3795132 - RNA, 16 nt, Salmonella typhimurium LT2
ggucaucgcaaauucu

SEQ ID NO: 3795133 - RNA, 16 nt, Salmonella typhimurium LT2
ggucaucgcccaugac

SEQ ID NO: 3795134 - RNA, 17 nt, Salmonella typhimurium LT2
ggucaucgcccaugaca

SEQ ID NO: 3795135 - RNA, 21 nt, Salmonella typhimurium LT2
ggucaugcggauguaaacgga

SEQ ID NO: 3795136 - RNA, 17 nt, Salmonella typhimurium LT2
ggucauuauucaggccu

SEQ ID NO: 3795137 - RNA, 17 nt, Salmonella typhimurium LT2
ggucauuggggacgcgc

SEQ ID NO: 3795138 - RNA, 19 nt, Salmonella typhimurium LT2
gguccggcgcuaaccagcg

SEQ ID NO: 3795139 - RNA, 19 nt, Salmonella typhimurium LT2
gguccguuuucgcccccag

SEQ ID NO: 3795140 - RNA, 15 nt, Salmonella typhimurium LT2
gguccugcggugcuu

SEQ ID NO: 3795141 - RNA, 18 nt, Salmonella typhimurium LT2
ggucgacagccacacgcc

SEQ ID NO: 3795142 - RNA, 15 nt, Salmonella typhimurium LT2
ggucgauaaauagcu

SEQ ID NO: 3795143 - RNA, 12 nt, Salmonella typhimurium LT2
ggucgccagcau

SEQ ID NO: 3795144 - RNA, 13 nt, Salmonella typhimurium LT2
ggucgccagcgcc

SEQ ID NO: 3795145 - RNA, 22 nt, Salmonella typhimurium LT2
ggucgcgccaaaagaggcagca

SEQ ID NO: 3795146 - RNA, 24 nt, Salmonella typhimurium LT2
ggucgcgccaaaagaggcagcaaa

SEQ ID NO: 3795147 - RNA, 16 nt, Salmonella typhimurium LT2
ggucgcguccggggcc

SEQ ID NO: 3795148 - RNA, 23 nt, Salmonella typhimurium LT2
ggucgcguccggggccagcgcca

SEQ ID NO: 3795149 - RNA, 15 nt, Salmonella typhimurium LT2
ggucgcuucccagug

SEQ ID NO: 3795150 - RNA, 16 nt, Salmonella typhimurium LT2
ggucgcuucggcgacc

SEQ ID NO: 3795151 - RNA, 15 nt, Salmonella typhimurium LT2
ggucggcccgacagg

SEQ ID NO: 3795152 - RNA, 14 nt, Salmonella typhimurium LT2
ggucggcgcauggc

SEQ ID NO: 3795153 - RNA, 15 nt, Salmonella typhimurium LT2
ggucggguguucuca

SEQ ID NO: 3795154 - RNA, 19 nt, Salmonella typhimurium LT2
ggucguacuaaagagcgcc

SEQ ID NO: 3795155 - RNA, 21 nt, Salmonella typhimurium LT2
ggucguacuaaagagcgccug

SEQ ID NO: 3795156 - RNA, 13 nt, Salmonella typhimurium LT2
ggucgucagccgu

SEQ ID NO: 3795157 - RNA, 17 nt, Salmonella typhimurium LT2
ggucguccugauagccg

SEQ ID NO: 3795158 - RNA, 19 nt, Salmonella typhimurium LT2
ggucgucugaaagcgacuc

SEQ ID NO: 3795159 - RNA, 11 nt, Salmonella typhimurium LT2
ggucucaggcu

SEQ ID NO: 3795160 - RNA, 19 nt, Salmonella typhimurium LT2
ggucucauagcgccccagu

SEQ ID NO: 3795161 - RNA, 21 nt, Salmonella typhimurium LT2
ggucuccgccuggaacccagg

SEQ ID NO: 3795162 - RNA, 21 nt, Salmonella typhimurium LT2
ggucucucgugcaggccggau

SEQ ID NO: 3795163 - RNA, 23 nt, Salmonella typhimurium LT2
ggucucucgugcaggccggauaa

SEQ ID NO: 3795164 - RNA, 21 nt, Salmonella typhimurium LT2
ggucucuucaugcauaaccgc

SEQ ID NO: 3795165 - RNA, 20 nt, Salmonella typhimurium LT2
ggucugauaagcgcagcgcc

SEQ ID NO: 3795166 - RNA, 17 nt, Salmonella typhimurium LT2
ggucugaugagcgcagc

SEQ ID NO: 3795167 - RNA, 21 nt, Salmonella typhimurium LT2
ggucugaugagcgcagcgacu

SEQ ID NO: 3795168 - RNA, 20 nt, Salmonella typhimurium LT2
ggucugcuucagccacuggc

SEQ ID NO: 3795169 - RNA, 22 nt, Salmonella typhimurium LT2
ggucuggauuacaaaaauagac

SEQ ID NO: 3795170 - RNA, 21 nt, Salmonella typhimurium LT2
ggucugguacauacuguugac

SEQ ID NO: 3795171 - RNA, 20 nt, Salmonella typhimurium LT2
ggucuguaugacaacauaaa

SEQ ID NO: 3795172 - RNA, 20 nt, Salmonella typhimurium LT2
ggucuucuuucagguuccac

SEQ ID NO: 3795173 - RNA, 21 nt, Salmonella typhimurium LT2
ggugaaaaacaucggcaaagc

SEQ ID NO: 3795174 - RNA, 19 nt, Salmonella typhimurium LT2
ggugaaacguguuuauccc

SEQ ID NO: 3795175 - RNA, 22 nt, Salmonella typhimurium LT2
ggugaaccaaagcaaaaaauga

SEQ ID NO: 3795176 - RNA, 22 nt, Salmonella typhimurium LT2
ggugaagcauccgggauauaaa

SEQ ID NO: 3795177 - RNA, 22 nt, Salmonella typhimurium LT2
gguuuuucgccgaccauccaga

SEQ ID NO: 3795178 - RNA, 12 nt, Salmonella typhimurium LT2
gguuuuuuaaug

SEQ ID NO: 3795179 - RNA, 14 nt, Salmonella typhimurium LT2
guaaaaaaaaccgu

SEQ ID NO: 3795180 - RNA, 13 nt, Salmonella typhimurium LT2
guaaaaaaauaaa

SEQ ID NO: 3795181 - RNA, 14 nt, Salmonella typhimurium LT2
guaaaaagaaagcu

SEQ ID NO: 3795182 - RNA, 18 nt, Salmonella typhimurium LT2
guaaaaauuguuccugua

SEQ ID NO: 3795183 - RNA, 16 nt, Salmonella typhimurium LT2
guaaaaccgacuauca

SEQ ID NO: 3795184 - RNA, 23 nt, Salmonella typhimurium LT2
guaaaacgauauugccuuauuca

SEQ ID NO: 3795185 - RNA, 22 nt, Salmonella typhimurium LT2
guaaaacgccaagaaugaaaca

SEQ ID NO: 3795186 - RNA, 12 nt, Salmonella typhimurium LT2
guaaaacgcugg

SEQ ID NO: 3795187 - RNA, 16 nt, Salmonella typhimurium LT2
guaaaaucagcagcga

SEQ ID NO: 3795188 - RNA, 22 nt, Salmonella typhimurium LT2
guaaaauucacuacuaaauccu

SEQ ID NO: 3795189 - RNA, 15 nt, Salmonella typhimurium LT2
guaaacagacaauua

SEQ ID NO: 3795190 - RNA, 13 nt, Salmonella typhimurium LT2
guaaacagaugcu

SEQ ID NO: 3795191 - RNA, 14 nt, Salmonella typhimurium LT2
guaaaccaggccag

SEQ ID NO: 3795192 - RNA, 16 nt, Salmonella typhimurium LT2
guaaaccggucaggca

SEQ ID NO: 3795193 - RNA, 23 nt, Salmonella typhimurium LT2
guaaaccucaaggcucagcagag

SEQ ID NO: 3795194 - RNA, 21 nt, Salmonella typhimurium LT2
guaaacgcauuaguauuucac

SEQ ID NO: 3795195 - RNA, 16 nt, Salmonella typhimurium LT2
guaaacgccugcacca

SEQ ID NO: 3795196 - RNA, 18 nt, Salmonella typhimurium LT2
guaaacgcgaccagcgca

SEQ ID NO: 3795197 - RNA, 15 nt, Salmonella typhimurium LT2
guaaacgcgccaucg

SEQ ID NO: 3795198 - RNA, 19 nt, Salmonella typhimurium LT2
guaaacgcuccggcaggca

SEQ ID NO: 3795199 - RNA, 15 nt, Salmonella typhimurium LT2
guaaacgcuuuuuca

SEQ ID NO: 3795200 - RNA, 15 nt, Salmonella typhimurium LT2
guaaacggaaccaaa

SEQ ID NO: 3795201 - RNA, 19 nt, Salmonella typhimurium LT2
guaaacggcgcugaaaggc

SEQ ID NO: 3795202 - RNA, 23 nt, Salmonella typhimurium LT2
guaaacggugcgauuaucccagu

SEQ ID NO: 3795203 - RNA, 12 nt, Salmonella typhimurium LT2
guaaacgucggc

SEQ ID NO: 3795204 - RNA, 16 nt, Salmonella typhimurium LT2
guaaacgugccacagu

SEQ ID NO: 3795205 - RNA, 14 nt, Salmonella typhimurium LT2
guaaacuccauuaa

SEQ ID NO: 3795206 - RNA, 18 nt, Salmonella typhimurium LT2
guaaacuggauaagcgca

SEQ ID NO: 3795207 - RNA, 16 nt, Salmonella typhimurium LT2
guaaagaagccgccgc

SEQ ID NO: 3795208 - RNA, 23 nt, Salmonella typhimurium LT2
guaaagauuaauaauugagcgca

SEQ ID NO: 3795209 - RNA, 16 nt, Salmonella typhimurium LT2
guaaagauuuuuauua

SEQ ID NO: 3795210 - RNA, 19 nt, Salmonella typhimurium LT2
guaaagauuuuuauuaaaa

SEQ ID NO: 3795211 - RNA, 18 nt, Salmonella typhimurium LT2
guaaagcagugcaguauu

SEQ ID NO: 3795212 - RNA, 14 nt, Salmonella typhimurium LT2
guaaagcauggcug

SEQ ID NO: 3795213 - RNA, 21 nt, Salmonella typhimurium LT2
guaaagcgcaaaauagcagcg

SEQ ID NO: 3795214 - RNA, 20 nt, Salmonella typhimurium LT2
guaaagcgccauauccgcag

SEQ ID NO: 3795215 - RNA, 15 nt, Salmonella typhimurium LT2
guaaaggcgaccggg

SEQ ID NO: 3795216 - RNA, 19 nt, Salmonella typhimurium LT2
guaaaggcggaaaucagca

SEQ ID NO: 3795217 - RNA, 14 nt, Salmonella typhimurium LT2
guaaauaaaaacca

SEQ ID NO: 3795218 - RNA, 19 nt, Salmonella typhimurium LT2
guaaauaaaaaccauuuau

SEQ ID NO: 3795219 - RNA, 14 nt, Salmonella typhimurium LT2
guaaauaagaaaau

SEQ ID NO: 3795220 - RNA, 17 nt, Salmonella typhimurium LT2
guaaauacgcugcggcc

SEQ ID NO: 3795221 - RNA, 13 nt, Salmonella typhimurium LT2
guaaauagcccgg

SEQ ID NO: 3795222 - RNA, 22 nt, Salmonella typhimurium LT2
guaaauauugaguucaauaagc

SEQ ID NO: 3795223 - RNA, 17 nt, Salmonella typhimurium LT2
guaaaucaaccugcuga

SEQ ID NO: 3795224 - RNA, 22 nt, Salmonella typhimurium LT2
guaaaucaacuuuuuuaccauu

SEQ ID NO: 3795225 - RNA, 21 nt, Salmonella typhimurium LT2
guaaaucgcgagccuucaaca

SEQ ID NO: 3795226 - RNA, 12 nt, Salmonella typhimurium LT2
guaaaucugaaa

SEQ ID NO: 3795227 - RNA, 18 nt, Salmonella typhimurium LT2
guaaaugcgcgcggcugc

SEQ ID NO: 3795228 - RNA, 16 nt, Salmonella typhimurium LT2
guaaauuagcgcgaaa

SEQ ID NO: 3795229 - RNA, 14 nt, Salmonella typhimurium LT2
guaaauugacugga

SEQ ID NO: 3795230 - RNA, 14 nt, Salmonella typhimurium LT2
guaacacaaaaucc

SEQ ID NO: 3795231 - RNA, 15 nt, Salmonella typhimurium LT2
guaacaccuuacgca

SEQ ID NO: 3795232 - RNA, 22 nt, Salmonella typhimurium LT2
guaacagacgcaucuuuuuccc

SEQ ID NO: 3795233 - RNA, 13 nt, Salmonella typhimurium LT2
guaacagcaggac

SEQ ID NO: 3795234 - RNA, 20 nt, Salmonella typhimurium LT2
guaacaggaacgagccgaua

SEQ ID NO: 3795235 - RNA, 11 nt, Salmonella typhimurium LT2
guaacaguccg

SEQ ID NO: 3795236 - RNA, 17 nt, Salmonella typhimurium LT2
guaacauacaaaaagua

SEQ ID NO: 3795237 - RNA, 23 nt, Salmonella typhimurium LT2
guaacaucgaacuguuuacccac

SEQ ID NO: 3795238 - RNA, 22 nt, Salmonella typhimurium LT2
guaaccaaagcaccauucuuca

SEQ ID NO: 3795239 - RNA, 17 nt, Salmonella typhimurium LT2
guaaccccugcccgcga

SEQ ID NO: 3795240 - RNA, 17 nt, Salmonella typhimurium LT2
guaacccgauacccuga

SEQ ID NO: 3795241 - RNA, 15 nt, Salmonella typhimurium LT2
guaaccuauuuuaaa

SEQ ID NO: 3795242 - RNA, 16 nt, Salmonella typhimurium LT2
guaaccuauuuuaaaa

SEQ ID NO: 3795243 - RNA, 15 nt, Salmonella typhimurium LT2
guaacgcauaagcgc

SEQ ID NO: 3795244 - RNA, 14 nt, Salmonella typhimurium LT2
guaacgccuccacc

SEQ ID NO: 3795245 - RNA, 16 nt, Salmonella typhimurium LT2
guaacggaugaaagcc

SEQ ID NO: 3795246 - RNA, 20 nt, Salmonella typhimurium LT2
guaacggcugacgcccauca

SEQ ID NO: 3795247 - RNA, 16 nt, Salmonella typhimurium LT2
guaacggucauucggc

SEQ ID NO: 3795248 - RNA, 21 nt, Salmonella typhimurium LT2
guaacgguguuucaucuucau

SEQ ID NO: 3795249 - RNA, 19 nt, Salmonella typhimurium LT2
guaacgucauugcgaucuc

SEQ ID NO: 3795250 - RNA, 23 nt, Salmonella typhimurium LT2
guaacgugcgguauaucacgcca

SEQ ID NO: 3795251 - RNA, 14 nt, Salmonella typhimurium LT2
guaacuaaaauacu

SEQ ID NO: 3795252 - RNA, 12 nt, Salmonella typhimurium LT2
guaacucaucgc

SEQ ID NO: 3795253 - RNA, 15 nt, Salmonella typhimurium LT2
guaacucaucgccag

SEQ ID NO: 3795254 - RNA, 21 nt, Salmonella typhimurium LT2
guaacugcaccuuuuuuucca

SEQ ID NO: 3795255 - RNA, 18 nt, Salmonella typhimurium LT2
guaacugcgguaaauaau

SEQ ID NO: 3795256 - RNA, 17 nt, Salmonella typhimurium LT2
guaacuggauuccuggc

SEQ ID NO: 3795257 - RNA, 17 nt, Salmonella typhimurium LT2
guaacuggcuccacggg

SEQ ID NO: 3795258 - RNA, 13 nt, Salmonella typhimurium LT2
guaacuuauccac

SEQ ID NO: 3795259 - RNA, 17 nt, Salmonella typhimurium LT2
guaacuucacgccaucg

SEQ ID NO: 3795260 - RNA, 15 nt, Salmonella typhimurium LT2
guaacuucagcauca

SEQ ID NO: 3795261 - RNA, 17 nt, Salmonella typhimurium LT2
guaacuucagcaucauc

SEQ ID NO: 3795262 - RNA, 20 nt, Salmonella typhimurium LT2
guaacuucuugguaccaaac

SEQ ID NO: 3795263 - RNA, 17 nt, Salmonella typhimurium LT2
guaagaauaacaaucug

SEQ ID NO: 3795264 - RNA, 19 nt, Salmonella typhimurium LT2
guaagaauuauuaccaaug

SEQ ID NO: 3795265 - RNA, 13 nt, Salmonella typhimurium LT2
guaagacaaaaau

SEQ ID NO: 3795266 - RNA, 23 nt, Salmonella typhimurium LT2
guaagacguuuacgccgccaucc

SEQ ID NO: 3795267 - RNA, 16 nt, Salmonella typhimurium LT2
guaagagcuggucgga

SEQ ID NO: 3795268 - RNA, 19 nt, Salmonella typhimurium LT2
guaagaucccagggcggcg

SEQ ID NO: 3795269 - RNA, 19 nt, Salmonella typhimurium LT2
guaagauuugcgccgccgu

SEQ ID NO: 3795270 - RNA, 15 nt, Salmonella typhimurium LT2
guaagcaaucaaggu

SEQ ID NO: 3795271 - RNA, 14 nt, Salmonella typhimurium LT2
guaagcacaacgca

SEQ ID NO: 3795272 - RNA, 13 nt, Salmonella typhimurium LT2
guaagccagcggg

SEQ ID NO: 3795273 - RNA, 23 nt, Salmonella typhimurium LT2
guaagccauuccccacgccaucg

SEQ ID NO: 3795274 - RNA, 23 nt, Salmonella typhimurium LT2
guaagcccauggcaggcagcaca

SEQ ID NO: 3795275 - RNA, 16 nt, Salmonella typhimurium LT2
guaagcccuuacaaaa

SEQ ID NO: 3795276 - RNA, 22 nt, Salmonella typhimurium LT2
guaagccuggcauaacauuggu

SEQ ID NO: 3795277 - RNA, 15 nt, Salmonella typhimurium LT2
guaagcgcagcgcca

SEQ ID NO: 3795278 - RNA, 18 nt, Salmonella typhimurium LT2
guaagcgcagcgccaccg

SEQ ID NO: 3795279 - RNA, 15 nt, Salmonella typhimurium LT2
guaagcgccagccgu

SEQ ID NO: 3795280 - RNA, 14 nt, Salmonella typhimurium LT2
guaagcgccagcgg

SEQ ID NO: 3795281 - RNA, 18 nt, Salmonella typhimurium LT2
guacuccgccauccggca

SEQ ID NO: 3795282 - RNA, 22 nt, Salmonella typhimurium LT2
guacucggcuacgaaccgagcg

SEQ ID NO: 3795283 - RNA, 14 nt, Salmonella typhimurium LT2
guacugaaauaacu

SEQ ID NO: 3795284 - RNA, 22 nt, Salmonella typhimurium LT2
guacugaacccggguaggcugc

SEQ ID NO: 3795285 - RNA, 17 nt, Salmonella typhimurium LT2
guacugaaugccauccc

SEQ ID NO: 3795286 - RNA, 23 nt, Salmonella typhimurium LT2
guacugacuaacgcuuaccguau

SEQ ID NO: 3795287 - RNA, 16 nt, Salmonella typhimurium LT2
guacugcaacgcgcau

SEQ ID NO: 3795288 - RNA, 16 nt, Salmonella typhimurium LT2
guacuugcgccgccau

SEQ ID NO: 3795289 - RNA, 12 nt, Salmonella typhimurium LT2
guacuuuaaccg

SEQ ID NO: 3795290 - RNA, 11 nt, Salmonella typhimurium LT2
guacuuucaaa

SEQ ID NO: 3795291 - RNA, 12 nt, Salmonella typhimurium LT2
guacuuucuaca

SEQ ID NO: 3795292 - RNA, 19 nt, Salmonella typhimurium LT2
guacuuucuccaugccaga

SEQ ID NO: 3795293 - RNA, 18 nt, Salmonella typhimurium LT2
guacuuucuccugggaua

SEQ ID NO: 3795294 - RNA, 21 nt, Salmonella typhimurium LT2
guacuuuucauccacagcgcc

SEQ ID NO: 3795295 - RNA, 14 nt, Salmonella typhimurium LT2
guacuuuugccagg

SEQ ID NO: 3795296 - RNA, 16 nt, Salmonella typhimurium LT2
guacuuuugccaggcg

SEQ ID NO: 3795297 - RNA, 17 nt, Salmonella typhimurium LT2
guagaaauucugcaggc

SEQ ID NO: 3795298 - RNA, 20 nt, Salmonella typhimurium LT2
guagaaauucugcaggccaa

SEQ ID NO: 3795299 - RNA, 23 nt, Salmonella typhimurium LT2
guagacccggcauugaaacgcau

SEQ ID NO: 3795300 - RNA, 15 nt, Salmonella typhimurium LT2
guagacgaccaggga

SEQ ID NO: 3795301 - RNA, 17 nt, Salmonella typhimurium LT2
guagagaucgacaaacc

SEQ ID NO: 3795302 - RNA, 18 nt, Salmonella typhimurium LT2
guagagcggauaagcgca

SEQ ID NO: 3795303 - RNA, 20 nt, Salmonella typhimurium LT2
guagagcuccacgccauagc

SEQ ID NO: 3795304 - RNA, 15 nt, Salmonella typhimurium LT2
guagauauaccauac

SEQ ID NO: 3795305 - RNA, 12 nt, Salmonella typhimurium LT2
guagaucaccag

SEQ ID NO: 3795306 - RNA, 20 nt, Salmonella typhimurium LT2
guagauggcgcuaaaaccgu

SEQ ID NO: 3795307 - RNA, 14 nt, Salmonella typhimurium LT2
guagcaaaucaucg

SEQ ID NO: 3795308 - RNA, 18 nt, Salmonella typhimurium LT2
guagcagcgaugacagca

SEQ ID NO: 3795309 - RNA, 20 nt, Salmonella typhimurium LT2
guagcagcgaugacagcagg

SEQ ID NO: 3795310 - RNA, 17 nt, Salmonella typhimurium LT2
guagcaguggagaggcc

SEQ ID NO: 3795311 - RNA, 18 nt, Salmonella typhimurium LT2
guagcaguguaucgaaga

SEQ ID NO: 3795312 - RNA, 18 nt, Salmonella typhimurium LT2
guagcauuuccgcaucgu

SEQ ID NO: 3795313 - RNA, 19 nt, Salmonella typhimurium LT2
guagccaaaagcgccacgc

SEQ ID NO: 3795314 - RNA, 20 nt, Salmonella typhimurium LT2
guagccaaaauuuacgggga

SEQ ID NO: 3795315 - RNA, 17 nt, Salmonella typhimurium LT2
guagccacgcccgccgc

SEQ ID NO: 3795316 - RNA, 19 nt, Salmonella typhimurium LT2
guagccacgcccgccgccu

SEQ ID NO: 3795317 - RNA, 20 nt, Salmonella typhimurium LT2
guagccagagcgcgcuggca

SEQ ID NO: 3795318 - RNA, 15 nt, Salmonella typhimurium LT2
guagccagcgcagcg

SEQ ID NO: 3795319 - RNA, 16 nt, Salmonella typhimurium LT2
guagcccgcuuuaccg

SEQ ID NO: 3795320 - RNA, 13 nt, Salmonella typhimurium LT2
guagccgcgccag

SEQ ID NO: 3795321 - RNA, 17 nt, Salmonella typhimurium LT2
guagccgcgcgccgccu

SEQ ID NO: 3795322 - RNA, 21 nt, Salmonella typhimurium LT2
guagccugcgaagaugagcca

SEQ ID NO: 3795323 - RNA, 16 nt, Salmonella typhimurium LT2
guagcgacgccauccg

SEQ ID NO: 3795324 - RNA, 13 nt, Salmonella typhimurium LT2
guagcgccaucag

SEQ ID NO: 3795325 - RNA, 17 nt, Salmonella typhimurium LT2
guagcgccaucaggcau

SEQ ID NO: 3795326 - RNA, 14 nt, Salmonella typhimurium LT2
guagcgccauccgg

SEQ ID NO: 3795327 - RNA, 13 nt, Salmonella typhimurium LT2
guagcgcgcgcua

SEQ ID NO: 3795328 - RNA, 14 nt, Salmonella typhimurium LT2
guagcgcggcagcg

SEQ ID NO: 3795329 - RNA, 15 nt, Salmonella typhimurium LT2
guagcgcugaagccc

SEQ ID NO: 3795330 - RNA, 21 nt, Salmonella typhimurium LT2
guagcgcuuuuuccagcgcau

SEQ ID NO: 3795331 - RNA, 21 nt, Salmonella typhimurium LT2
guagcggaaucaauuucuaca

SEQ ID NO: 3795332 - RNA, 18 nt, Salmonella typhimurium LT2
guagcggcaacagcacca

SEQ ID NO: 3795333 - RNA, 18 nt, Salmonella typhimurium LT2
guagcgucaccggcggcg

SEQ ID NO: 3795334 - RNA, 20 nt, Salmonella typhimurium LT2
guagcuauaaucacaggggu

SEQ ID NO: 3795335 - RNA, 14 nt, Salmonella typhimurium LT2
guagcucagcugga

SEQ ID NO: 3795336 - RNA, 14 nt, Salmonella typhimurium LT2
guagcuccagaccu

SEQ ID NO: 3795337 - RNA, 24 nt, Salmonella typhimurium LT2
guagcugcgccugaaaggcacgcu

SEQ ID NO: 3795338 - RNA, 21 nt, Salmonella typhimurium LT2
guagcuggcaagaccgauaga

SEQ ID NO: 3795339 - RNA, 18 nt, Salmonella typhimurium LT2
guagcuggucgccagcgc

SEQ ID NO: 3795340 - RNA, 14 nt, Salmonella typhimurium LT2
guagcuucugucug

SEQ ID NO: 3795341 - RNA, 16 nt, Salmonella typhimurium LT2
guagcuuuuccgcugg

SEQ ID NO: 3795342 - RNA, 22 nt, Salmonella typhimurium LT2
guaggagauauccugaaacgcg

SEQ ID NO: 3795343 - RNA, 19 nt, Salmonella typhimurium LT2
guaggcaggauaaggcguu

SEQ ID NO: 3795344 - RNA, 13 nt, Salmonella typhimurium LT2
guaggccaggcau

SEQ ID NO: 3795345 - RNA, 19 nt, Salmonella typhimurium LT2
guaggccggauaagcgcag

SEQ ID NO: 3795346 - RNA, 19 nt, Salmonella typhimurium LT2
guaggccggauaaggcgcu

SEQ ID NO: 3795347 - RNA, 19 nt, Salmonella typhimurium LT2
guaggccggauaaggcguu

SEQ ID NO: 3795348 - RNA, 14 nt, Salmonella typhimurium LT2
guaggccuaaaaau

SEQ ID NO: 3795349 - RNA, 18 nt, Salmonella typhimurium LT2
guaggccugauaagcgca

SEQ ID NO: 3795350 - RNA, 21 nt, Salmonella typhimurium LT2
guaggccugauaagcgcagcg

SEQ ID NO: 3795351 - RNA, 19 nt, Salmonella typhimurium LT2
guaggccugguaagcgcag

SEQ ID NO: 3795352 - RNA, 19 nt, Salmonella typhimurium LT2
guaggccugguaagcguag

SEQ ID NO: 3795353 - RNA, 18 nt, Salmonella typhimurium LT2
guaggcuggaucaggcgc

SEQ ID NO: 3795354 - RNA, 15 nt, Salmonella typhimurium LT2
guaggguacagcgcg

SEQ ID NO: 3795355 - RNA, 16 nt, Salmonella typhimurium LT2
guagguauccagcaga

SEQ ID NO: 3795356 - RNA, 20 nt, Salmonella typhimurium LT2
guaggucagguaagcgcuag

SEQ ID NO: 3795357 - RNA, 20 nt, Salmonella typhimurium LT2
guaggucgcgaacagcuuuu

SEQ ID NO: 3795358 - RNA, 13 nt, Salmonella typhimurium LT2
guaguaaauagga

SEQ ID NO: 3795359 - RNA, 13 nt, Salmonella typhimurium LT2
guaguaaucgaua

SEQ ID NO: 3795360 - RNA, 14 nt, Salmonella typhimurium LT2
guaguaucauccau

SEQ ID NO: 3795361 - RNA, 18 nt, Salmonella typhimurium LT2
guagucaaauuccagcaa

SEQ ID NO: 3795362 - RNA, 14 nt, Salmonella typhimurium LT2
guaguguauccaga

SEQ ID NO: 3795363 - RNA, 20 nt, Salmonella typhimurium LT2
guaguguuuaagcgucaggc

SEQ ID NO: 3795364 - RNA, 15 nt, Salmonella typhimurium LT2
guaguuaaaaaaggu

SEQ ID NO: 3795365 - RNA, 19 nt, Salmonella typhimurium LT2
guauaaaauggcaaagucg

SEQ ID NO: 3795366 - RNA, 23 nt, Salmonella typhimurium LT2
guauaaaucacgcugaaaaccgc

SEQ ID NO: 3795367 - RNA, 19 nt, Salmonella typhimurium LT2
guauaaaucccggugggga

SEQ ID NO: 3795368 - RNA, 13 nt, Salmonella typhimurium LT2
guauaacucagcg

SEQ ID NO: 3795369 - RNA, 19 nt, Salmonella typhimurium LT2
guauaacuggucauccccg

SEQ ID NO: 3795370 - RNA, 15 nt, Salmonella typhimurium LT2
guauaauaauauccu

SEQ ID NO: 3795371 - RNA, 18 nt, Salmonella typhimurium LT2
guauaaucccgcggcgga

SEQ ID NO: 3795372 - RNA, 19 nt, Salmonella typhimurium LT2
guauaauuucaggcugcuc

SEQ ID NO: 3795373 - RNA, 17 nt, Salmonella typhimurium LT2
guauacagacagcagau

SEQ ID NO: 3795374 - RNA, 14 nt, Salmonella typhimurium LT2
guauagccaggcag

SEQ ID NO: 3795375 - RNA, 12 nt, Salmonella typhimurium LT2
guauagcgcuug

SEQ ID NO: 3795376 - RNA, 22 nt, Salmonella typhimurium LT2
guauagcgcuugucgcgcuaua

SEQ ID NO: 3795377 - RNA, 21 nt, Salmonella typhimurium LT2
guauagcggcguuuauauaaa

SEQ ID NO: 3795378 - RNA, 21 nt, Salmonella typhimurium LT2
guauaugggcaauuauauucg

SEQ ID NO: 3795379 - RNA, 21 nt, Salmonella typhimurium LT2
guaucaacacgguuuaccugu

SEQ ID NO: 3795380 - RNA, 14 nt, Salmonella typhimurium LT2
guaucaacccgguu

SEQ ID NO: 3795381 - RNA, 21 nt, Salmonella typhimurium LT2
guaucaacccgguuuaccagu

SEQ ID NO: 3795382 - RNA, 11 nt, Salmonella typhimurium LT2
guaucaacggg

SEQ ID NO: 3795383 - RNA, 15 nt, Salmonella typhimurium LT2
guaucacaaucagcc

SEQ ID NO: 3795384 - RNA, 21 nt, Salmonella typhimurium LT2
guaucacguuuuuuacgucag

SEQ ID NO: 3795385 - RNA, 18 nt, Salmonella typhimurium LT2
gucagcacuucccacugu

SEQ ID NO: 3795386 - RNA, 15 nt, Salmonella typhimurium LT2
gucagcagaaacugg

SEQ ID NO: 3795387 - RNA, 11 nt, Salmonella typhimurium LT2
gucagcaggcg

SEQ ID NO: 3795388 - RNA, 13 nt, Salmonella typhimurium LT2
gucagcaguuuua

SEQ ID NO: 3795389 - RNA, 15 nt, Salmonella typhimurium LT2
gucagcaguuuuauc

SEQ ID NO: 3795390 - RNA, 16 nt, Salmonella typhimurium LT2
gucagcauaauauccu

SEQ ID NO: 3795391 - RNA, 19 nt, Salmonella typhimurium LT2
gucagcauaauauccugca

SEQ ID NO: 3795392 - RNA, 12 nt, Salmonella typhimurium LT2
gucagccuugac

SEQ ID NO: 3795393 - RNA, 14 nt, Salmonella typhimurium LT2
gucagcgcgagcgu

SEQ ID NO: 3795394 - RNA, 15 nt, Salmonella typhimurium LT2
gucagcgcggcuucc

SEQ ID NO: 3795395 - RNA, 16 nt, Salmonella typhimurium LT2
gucagcgcggcuucca

SEQ ID NO: 3795396 - RNA, 14 nt, Salmonella typhimurium LT2
gucagcggcgcgcc

SEQ ID NO: 3795397 - RNA, 22 nt, Salmonella typhimurium LT2
gucagcggcugacacucaucca

SEQ ID NO: 3795398 - RNA, 19 nt, Salmonella typhimurium LT2
gucagcguaccagcgguca

SEQ ID NO: 3795399 - RNA, 19 nt, Salmonella typhimurium LT2
gucagcguuacuggcguaa

SEQ ID NO: 3795400 - RNA, 22 nt, Salmonella typhimurium LT2
gucagcguuacuguagcugagc

SEQ ID NO: 3795401 - RNA, 15 nt, Salmonella typhimurium LT2
gucagcuccgguauc

SEQ ID NO: 3795402 - RNA, 13 nt, Salmonella typhimurium LT2
gucaggaaacugg

SEQ ID NO: 3795403 - RNA, 14 nt, Salmonella typhimurium LT2
gucaggaaacuggc

SEQ ID NO: 3795404 - RNA, 16 nt, Salmonella typhimurium LT2
gucaggaugggcuucu

SEQ ID NO: 3795405 - RNA, 13 nt, Salmonella typhimurium LT2
gucaggcaaaaau

SEQ ID NO: 3795406 - RNA, 11 nt, Salmonella typhimurium LT2
gucaggcagca

SEQ ID NO: 3795407 - RNA, 20 nt, Salmonella typhimurium LT2
gucaggccauuaauauuuua

SEQ ID NO: 3795408 - RNA, 19 nt, Salmonella typhimurium LT2
gucaggccgccgcacaggc

SEQ ID NO: 3795409 - RNA, 20 nt, Salmonella typhimurium LT2
gucaggccgccgcacaggcg

SEQ ID NO: 3795410 - RNA, 19 nt, Salmonella typhimurium LT2
gucaggcgaccaauauccg

SEQ ID NO: 3795411 - RNA, 12 nt, Salmonella typhimurium LT2
gucaggcuaaau

SEQ ID NO: 3795412 - RNA, 23 nt, Salmonella typhimurium LT2
gucagggucuuauuucuccugcg

SEQ ID NO: 3795413 - RNA, 19 nt, Salmonella typhimurium LT2
gucagggugaauaccagcg

SEQ ID NO: 3795414 - RNA, 21 nt, Salmonella typhimurium LT2
gucaggguuuucaggaaggag

SEQ ID NO: 3795415 - RNA, 15 nt, Salmonella typhimurium LT2
gucagguaagcccuu

SEQ ID NO: 3795416 - RNA, 20 nt, Salmonella typhimurium LT2
gucaggugggaccaccgcgc

SEQ ID NO: 3795417 - RNA, 13 nt, Salmonella typhimurium LT2
gucagguuuuuug

SEQ ID NO: 3795418 - RNA, 22 nt, Salmonella typhimurium LT2
gucaguacgcccgugacgccag

SEQ ID NO: 3795419 - RNA, 14 nt, Salmonella typhimurium LT2
gucaguccaccugu

SEQ ID NO: 3795420 - RNA, 19 nt, Salmonella typhimurium LT2
gucagugagcccuccucca

SEQ ID NO: 3795421 - RNA, 17 nt, Salmonella typhimurium LT2
gucagugcuacaggcgg

SEQ ID NO: 3795422 - RNA, 14 nt, Salmonella typhimurium LT2
gucaguggaaaaca

SEQ ID NO: 3795423 - RNA, 12 nt, Salmonella typhimurium LT2
gucauaaaacug

SEQ ID NO: 3795424 - RNA, 14 nt, Salmonella typhimurium LT2
gucauaacgcgcau

SEQ ID NO: 3795425 - RNA, 13 nt, Salmonella typhimurium LT2
gucauaauauuca

SEQ ID NO: 3795426 - RNA, 15 nt, Salmonella typhimurium LT2
gucauaauauucaua

SEQ ID NO: 3795427 - RNA, 17 nt, Salmonella typhimurium LT2
gucauaccaugauucau

SEQ ID NO: 3795428 - RNA, 15 nt, Salmonella typhimurium LT2
gucauaucauccagc

SEQ ID NO: 3795429 - RNA, 19 nt, Salmonella typhimurium LT2
gucauaucgaugguaauaa

SEQ ID NO: 3795430 - RNA, 13 nt, Salmonella typhimurium LT2
gucauauuuucag

SEQ ID NO: 3795431 - RNA, 20 nt, Salmonella typhimurium LT2
gucaucaaauuaucuguuga

SEQ ID NO: 3795432 - RNA, 22 nt, Salmonella typhimurium LT2
gucaucaaauuaucuguugaua

SEQ ID NO: 3795433 - RNA, 20 nt, Salmonella typhimurium LT2
gucaucaacgcgaucuucau

SEQ ID NO: 3795434 - RNA, 13 nt, Salmonella typhimurium LT2
gucaucaagauuu

SEQ ID NO: 3795435 - RNA, 16 nt, Salmonella typhimurium LT2
gucaucaccuccagca

SEQ ID NO: 3795436 - RNA, 15 nt, Salmonella typhimurium LT2
gucaucaucaggaac

SEQ ID NO: 3795437 - RNA, 16 nt, Salmonella typhimurium LT2
gucaucaucaggaaca

SEQ ID NO: 3795438 - RNA, 18 nt, Salmonella typhimurium LT2
gucaucauuacaggcgaa

SEQ ID NO: 3795439 - RNA, 16 nt, Salmonella typhimurium LT2
gucaucauugcgccaa

SEQ ID NO: 3795440 - RNA, 21 nt, Salmonella typhimurium LT2
gucaucauugucacuauucuu

SEQ ID NO: 3795441 - RNA, 13 nt, Salmonella typhimurium LT2
gucauccagacua

SEQ ID NO: 3795442 - RNA, 13 nt, Salmonella typhimurium LT2
gucauccagcgag

SEQ ID NO: 3795443 - RNA, 17 nt, Salmonella typhimurium LT2
gucauccauccacggca

SEQ ID NO: 3795444 - RNA, 12 nt, Salmonella typhimurium LT2
gucaucccgaac

SEQ ID NO: 3795445 - RNA, 22 nt, Salmonella typhimurium LT2
gucaucccgguuucccgcguga

SEQ ID NO: 3795446 - RNA, 11 nt, Salmonella typhimurium LT2
gucauccgcgu

SEQ ID NO: 3795447 - RNA, 19 nt, Salmonella typhimurium LT2
gucauccgguucauaaucc

SEQ ID NO: 3795448 - RNA, 21 nt, Salmonella typhimurium LT2
gucaucgaaggcaucuucaga

SEQ ID NO: 3795449 - RNA, 16 nt, Salmonella typhimurium LT2
gucaucgcaaauucug

SEQ ID NO: 3795450 - RNA, 22 nt, Salmonella typhimurium LT2
gucaucgcccaugacauuccca

SEQ ID NO: 3795451 - RNA, 14 nt, Salmonella typhimurium LT2
gucaucgcucauca

SEQ ID NO: 3795452 - RNA, 15 nt, Salmonella typhimurium LT2
gucaucgcucaucuc

SEQ ID NO: 3795453 - RNA, 23 nt, Salmonella typhimurium LT2
gucaucgcucaucucaagcccca

SEQ ID NO: 3795454 - RNA, 20 nt, Salmonella typhimurium LT2
gucaucggcacguaguaaug

SEQ ID NO: 3795455 - RNA, 21 nt, Salmonella typhimurium LT2
gucaucucuauuucacuggcg

SEQ ID NO: 3795456 - RNA, 22 nt, Salmonella typhimurium LT2
gucaugaaaagcuauauuuaua

SEQ ID NO: 3795457 - RNA, 17 nt, Salmonella typhimurium LT2
gucaugacgcuggaagu

SEQ ID NO: 3795458 - RNA, 18 nt, Salmonella typhimurium LT2
gucaugagcuauuucagu

SEQ ID NO: 3795459 - RNA, 12 nt, Salmonella typhimurium LT2
gucaugcgccac

SEQ ID NO: 3795460 - RNA, 17 nt, Salmonella typhimurium LT2
gucaugcgggagcuugg

SEQ ID NO: 3795461 - RNA, 14 nt, Salmonella typhimurium LT2
gucaugcucgcuuu

SEQ ID NO: 3795462 - RNA, 17 nt, Salmonella typhimurium LT2
gucaugcucgcuuucca

SEQ ID NO: 3795463 - RNA, 16 nt, Salmonella typhimurium LT2
gucaugcuggcuaaau

SEQ ID NO: 3795464 - RNA, 22 nt, Salmonella typhimurium LT2
gucaugcuucaccucagcaaaa

SEQ ID NO: 3795465 - RNA, 22 nt, Salmonella typhimurium LT2
gucauggcgccaccagcgauuu

SEQ ID NO: 3795466 - RNA, 14 nt, Salmonella typhimurium LT2
gucauuaaagcgcu

SEQ ID NO: 3795467 - RNA, 19 nt, Salmonella typhimurium LT2
gucauuacgguauuuauca

SEQ ID NO: 3795468 - RNA, 21 nt, Salmonella typhimurium LT2
gucauuggggacgcgcaaacg

SEQ ID NO: 3795469 - RNA, 20 nt, Salmonella typhimurium LT2
guccaacuggcuuucaucca

SEQ ID NO: 3795470 - RNA, 14 nt, Salmonella typhimurium LT2
guccacaccuucca

SEQ ID NO: 3795471 - RNA, 17 nt, Salmonella typhimurium LT2
guccacaccuuccacuu

SEQ ID NO: 3795472 - RNA, 17 nt, Salmonella typhimurium LT2
guccacaucuaccaggu

SEQ ID NO: 3795473 - RNA, 14 nt, Salmonella typhimurium LT2
guccaccagcgcca

SEQ ID NO: 3795474 - RNA, 19 nt, Salmonella typhimurium LT2
guccacgacaauauccucg

SEQ ID NO: 3795475 - RNA, 16 nt, Salmonella typhimurium LT2
guccacgcgagcugcc

SEQ ID NO: 3795476 - RNA, 22 nt, Salmonella typhimurium LT2
guccacggauauuuaccgccgc

SEQ ID NO: 3795477 - RNA, 23 nt, Salmonella typhimurium LT2
guccacuccggcgugaacgccuc

SEQ ID NO: 3795478 - RNA, 14 nt, Salmonella typhimurium LT2
guccacugaccgga

SEQ ID NO: 3795479 - RNA, 17 nt, Salmonella typhimurium LT2
guccagaccaaucaugu

SEQ ID NO: 3795480 - RNA, 19 nt, Salmonella typhimurium LT2
guccagauagggccaggcg

SEQ ID NO: 3795481 - RNA, 14 nt, Salmonella typhimurium LT2
guccagauccacug

SEQ ID NO: 3795482 - RNA, 20 nt, Salmonella typhimurium LT2
guccagauggcgguucgcca

SEQ ID NO: 3795483 - RNA, 16 nt, Salmonella typhimurium LT2
guccagccggugguuc

SEQ ID NO: 3795484 - RNA, 13 nt, Salmonella typhimurium LT2
guccagcgcguga

SEQ ID NO: 3795485 - RNA, 14 nt, Salmonella typhimurium LT2
guccagcggcagcu

SEQ ID NO: 3795486 - RNA, 17 nt, Salmonella typhimurium LT2
guccaggccguagcgca

SEQ ID NO: 3795487 - RNA, 19 nt, Salmonella typhimurium LT2
guccagggugaacaugggu

SEQ ID NO: 3795488 - RNA, 16 nt, Salmonella typhimurium LT2
guccaggguguucacc

SEQ ID NO: 3795489 - RNA, 18 nt, Salmonella typhimurium LT2
guccaggguguucaccau

SEQ ID NO: 3795490 - RNA, 19 nt, Salmonella typhimurium LT2
gucgccgcgcccagcagca

SEQ ID NO: 3795491 - RNA, 20 nt, Salmonella typhimurium LT2
gucgccgucuggggaaaccu

SEQ ID NO: 3795492 - RNA, 14 nt, Salmonella typhimurium LT2
gucgccuuccagcg

SEQ ID NO: 3795493 - RNA, 18 nt, Salmonella typhimurium LT2
gucgcgacguccgccaac

SEQ ID NO: 3795494 - RNA, 20 nt, Salmonella typhimurium LT2
gucgcgcauggcagggcgau

SEQ ID NO: 3795495 - RNA, 23 nt, Salmonella typhimurium LT2
gucgcgcccaacucccccaugga

SEQ ID NO: 3795496 - RNA, 16 nt, Salmonella typhimurium LT2
gucgcgcccuccucca

SEQ ID NO: 3795497 - RNA, 16 nt, Salmonella typhimurium LT2
gucgcgccgugcccag

SEQ ID NO: 3795498 - RNA, 13 nt, Salmonella typhimurium LT2
gucgcgcucgcca

SEQ ID NO: 3795499 - RNA, 22 nt, Salmonella typhimurium LT2
gucgcgcucguaggccagcgcu

SEQ ID NO: 3795500 - RNA, 20 nt, Salmonella typhimurium LT2
gucgcgcuuucaaucgucag

SEQ ID NO: 3795501 - RNA, 14 nt, Salmonella typhimurium LT2
gucgcggcuuucag

SEQ ID NO: 3795502 - RNA, 17 nt, Salmonella typhimurium LT2
gucgcguacuuucgcca

SEQ ID NO: 3795503 - RNA, 18 nt, Salmonella typhimurium LT2
gucgcguacuuucgccag

SEQ ID NO: 3795504 - RNA, 16 nt, Salmonella typhimurium LT2
gucgcguaguuuuuca

SEQ ID NO: 3795505 - RNA, 20 nt, Salmonella typhimurium LT2
gucgcguuuaccgccgccgu

SEQ ID NO: 3795506 - RNA, 22 nt, Salmonella typhimurium LT2
gucgcuacuggcguauuaucgg

SEQ ID NO: 3795507 - RNA, 15 nt, Salmonella typhimurium LT2
gucgcuauccagcag

SEQ ID NO: 3795508 - RNA, 22 nt, Salmonella typhimurium LT2
gucgcucaauagcgauucauca

SEQ ID NO: 3795509 - RNA, 18 nt, Salmonella typhimurium LT2
gucgcuccccauaaaaau

SEQ ID NO: 3795510 - RNA, 12 nt, Salmonella typhimurium LT2
gucgcuuccugu

SEQ ID NO: 3795511 - RNA, 17 nt, Salmonella typhimurium LT2
gucgcuuuuugcgccag

SEQ ID NO: 3795512 - RNA, 14 nt, Salmonella typhimurium LT2
gucggaauuuccgg

SEQ ID NO: 3795513 - RNA, 14 nt, Salmonella typhimurium LT2
gucggacagcgaca

SEQ ID NO: 3795514 - RNA, 21 nt, Salmonella typhimurium LT2
gucggcaaugccuaccggcgg

SEQ ID NO: 3795515 - RNA, 16 nt, Salmonella typhimurium LT2
gucggcagaaccuggc

SEQ ID NO: 3795516 - RNA, 20 nt, Salmonella typhimurium LT2
gucggcaucgugaaacucac

SEQ ID NO: 3795517 - RNA, 15 nt, Salmonella typhimurium LT2
gucggccugauaagc

SEQ ID NO: 3795518 - RNA, 16 nt, Salmonella typhimurium LT2
gucggcgaugugccug

SEQ ID NO: 3795519 - RNA, 19 nt, Salmonella typhimurium LT2
gucggcgccaucaugcagc

SEQ ID NO: 3795520 - RNA, 19 nt, Salmonella typhimurium LT2
gucggcuuuuuuaugcccc

SEQ ID NO: 3795521 - RNA, 17 nt, Salmonella typhimurium LT2
gucgggccugcugcggu

SEQ ID NO: 3795522 - RNA, 15 nt, Salmonella typhimurium LT2
gucggguucgcgcgc

SEQ ID NO: 3795523 - RNA, 21 nt, Salmonella typhimurium LT2
gucgguaaaaaugcaaugucu

SEQ ID NO: 3795524 - RNA, 20 nt, Salmonella typhimurium LT2
gucgguaucguugcggcgca

SEQ ID NO: 3795525 - RNA, 22 nt, Salmonella typhimurium LT2
gucgguaucguugcggcgcagg

SEQ ID NO: 3795526 - RNA, 13 nt, Salmonella typhimurium LT2
gucggucaggaaa

SEQ ID NO: 3795527 - RNA, 20 nt, Salmonella typhimurium LT2
gucggucugauaagcgcagc

SEQ ID NO: 3795528 - RNA, 17 nt, Salmonella typhimurium LT2
gucguagguuuuaucaa

SEQ ID NO: 3795529 - RNA, 14 nt, Salmonella typhimurium LT2
gucgucacgcccgu

SEQ ID NO: 3795530 - RNA, 15 nt, Salmonella typhimurium LT2
gucgucauaaagccc

SEQ ID NO: 3795531 - RNA, 16 nt, Salmonella typhimurium LT2
gucgucauaucgaugg

SEQ ID NO: 3795532 - RNA, 13 nt, Salmonella typhimurium LT2
gucguccccugga

SEQ ID NO: 3795533 - RNA, 14 nt, Salmonella typhimurium LT2
gucgucgaaaccgu

SEQ ID NO: 3795534 - RNA, 21 nt, Salmonella typhimurium LT2
gucgucgauuuucugcucaau

SEQ ID NO: 3795535 - RNA, 14 nt, Salmonella typhimurium LT2
gucgucuucauccc

SEQ ID NO: 3795536 - RNA, 19 nt, Salmonella typhimurium LT2
gucgugagcaaccaacgcg

SEQ ID NO: 3795537 - RNA, 17 nt, Salmonella typhimurium LT2
gucgugcaaccgccugc

SEQ ID NO: 3795538 - RNA, 18 nt, Salmonella typhimurium LT2
gucgugcaaccgccugca

SEQ ID NO: 3795539 - RNA, 14 nt, Salmonella typhimurium LT2
gucgugccuuccgc

SEQ ID NO: 3795540 - RNA, 15 nt, Salmonella typhimurium LT2
gucgugugcggaugc

SEQ ID NO: 3795541 - RNA, 23 nt, Salmonella typhimurium LT2
gucguuaaaacgguaugaaggac

SEQ ID NO: 3795542 - RNA, 15 nt, Salmonella typhimurium LT2
gucguugcgccguaa

SEQ ID NO: 3795543 - RNA, 19 nt, Salmonella typhimurium LT2
gucguuguaguuaucgccg

SEQ ID NO: 3795544 - RNA, 20 nt, Salmonella typhimurium LT2
gucguugucuuugcguaccg

SEQ ID NO: 3795545 - RNA, 22 nt, Salmonella typhimurium LT2
gucuacacuuugcgccgccagu

SEQ ID NO: 3795546 - RNA, 15 nt, Salmonella typhimurium LT2
gucuaccagcucucc

SEQ ID NO: 3795547 - RNA, 18 nt, Salmonella typhimurium LT2
gucuacccaggucgccga

SEQ ID NO: 3795548 - RNA, 20 nt, Salmonella typhimurium LT2
gucuacccgguguaaaaaau

SEQ ID NO: 3795549 - RNA, 21 nt, Salmonella typhimurium LT2
gucucauuguguacauccagg

SEQ ID NO: 3795550 - RNA, 22 nt, Salmonella typhimurium LT2
gucuccagacaauccgcggcaa

SEQ ID NO: 3795551 - RNA, 19 nt, Salmonella typhimurium LT2
gucucccgauuguauaaau

SEQ ID NO: 3795552 - RNA, 15 nt, Salmonella typhimurium LT2
gucuccgcagcaggc

SEQ ID NO: 3795553 - RNA, 19 nt, Salmonella typhimurium LT2
gucuccugccgaugaaaua

SEQ ID NO: 3795554 - RNA, 17 nt, Salmonella typhimurium LT2
gucuccuguaacagggg

SEQ ID NO: 3795555 - RNA, 19 nt, Salmonella typhimurium LT2
gucucgcacucgccgccaa

SEQ ID NO: 3795556 - RNA, 12 nt, Salmonella typhimurium LT2
gucucucccuca

SEQ ID NO: 3795557 - RNA, 13 nt, Salmonella typhimurium LT2
gucucucccucaa

SEQ ID NO: 3795558 - RNA, 18 nt, Salmonella typhimurium LT2
gucucucgugcaggccgg

SEQ ID NO: 3795559 - RNA, 19 nt, Salmonella typhimurium LT2
gucucucgugcaggccgga

SEQ ID NO: 3795560 - RNA, 15 nt, Salmonella typhimurium LT2
gucucuucaugccuc

SEQ ID NO: 3795561 - RNA, 14 nt, Salmonella typhimurium LT2
gucucuucuuccgc

SEQ ID NO: 3795562 - RNA, 18 nt, Salmonella typhimurium LT2
gucugaagaaguucuucu

SEQ ID NO: 3795563 - RNA, 19 nt, Salmonella typhimurium LT2
gucugaagaaguucuucug

SEQ ID NO: 3795564 - RNA, 20 nt, Salmonella typhimurium LT2
gucugacaacuauugcugcc

SEQ ID NO: 3795565 - RNA, 13 nt, Salmonella typhimurium LT2
gucugaccgccgc

SEQ ID NO: 3795566 - RNA, 20 nt, Salmonella typhimurium LT2
gucugauaagcgcagcgcca

SEQ ID NO: 3795567 - RNA, 15 nt, Salmonella typhimurium LT2
gucugauggcgcugc

SEQ ID NO: 3795568 - RNA, 23 nt, Salmonella typhimurium LT2
gucugauugcgcccuccggcaag

SEQ ID NO: 3795569 - RNA, 16 nt, Salmonella typhimurium LT2
gucugcaugccgcagg

SEQ ID NO: 3795570 - RNA, 18 nt, Salmonella typhimurium LT2
gucugcccgcgccaucca

SEQ ID NO: 3795571 - RNA, 16 nt, Salmonella typhimurium LT2
gucugcgcgccggaac

SEQ ID NO: 3795572 - RNA, 18 nt, Salmonella typhimurium LT2
gucugcgcucuuuuuuaa

SEQ ID NO: 3795573 - RNA, 15 nt, Salmonella typhimurium LT2
gucugcgcugggccg

SEQ ID NO: 3795574 - RNA, 22 nt, Salmonella typhimurium LT2
gucugcgcugggccgggccuga

SEQ ID NO: 3795575 - RNA, 15 nt, Salmonella typhimurium LT2
gucugcuucgucugg

SEQ ID NO: 3795576 - RNA, 16 nt, Salmonella typhimurium LT2
gucuggagccucugcg

SEQ ID NO: 3795577 - RNA, 20 nt, Salmonella typhimurium LT2
gucuggcagcggcaguaaau

SEQ ID NO: 3795578 - RNA, 15 nt, Salmonella typhimurium LT2
gucuggcgaggcgcc

SEQ ID NO: 3795579 - RNA, 14 nt, Salmonella typhimurium LT2
gucugguaaacgca

SEQ ID NO: 3795580 - RNA, 19 nt, Salmonella typhimurium LT2
gucugguacggccaccagg

SEQ ID NO: 3795581 - RNA, 19 nt, Salmonella typhimurium LT2
gucuggucagguaagcccu

SEQ ID NO: 3795582 - RNA, 15 nt, Salmonella typhimurium LT2
gucuggugauccagc

SEQ ID NO: 3795583 - RNA, 20 nt, Salmonella typhimurium LT2
gucugucaaaacccagccca

SEQ ID NO: 3795584 - RNA, 21 nt, Salmonella typhimurium LT2
gucugucagaacccugucaau

SEQ ID NO: 3795585 - RNA, 21 nt, Salmonella typhimurium LT2
gucuguucguagcccauagca

SEQ ID NO: 3795586 - RNA, 14 nt, Salmonella typhimurium LT2
gucuguuucaacac

SEQ ID NO: 3795587 - RNA, 21 nt, Salmonella typhimurium LT2
gucuguuucaacacauccagc

SEQ ID NO: 3795588 - RNA, 17 nt, Salmonella typhimurium LT2
gucuuaaaugccgccgg

SEQ ID NO: 3795589 - RNA, 13 nt, Salmonella typhimurium LT2
gucuuagugaaau

SEQ ID NO: 3795590 - RNA, 17 nt, Salmonella typhimurium LT2
gucuuauccggccugca

SEQ ID NO: 3795591 - RNA, 20 nt, Salmonella typhimurium LT2
gucuuauuucuccugcgcca

SEQ ID NO: 3795592 - RNA, 17 nt, Salmonella typhimurium LT2
gucuucacgacccggcg

SEQ ID NO: 3795593 - RNA, 21 nt, Salmonella typhimurium LT2
gucuuccagcauucuauuguu

SEQ ID NO: 3795594 - RNA, 20 nt, Salmonella typhimurium LT2
gugcauuauuuuagugaaaa

SEQ ID NO: 3795595 - RNA, 17 nt, Salmonella typhimurium LT2
gugccaaucuccagcau

SEQ ID NO: 3795596 - RNA, 21 nt, Salmonella typhimurium LT2
gugccaauggcgauaaaaaua

SEQ ID NO: 3795597 - RNA, 16 nt, Salmonella typhimurium LT2
gugccacaacgccuga

SEQ ID NO: 3795598 - RNA, 12 nt, Salmonella typhimurium LT2
gugccagaaaca

SEQ ID NO: 3795599 - RNA, 20 nt, Salmonella typhimurium LT2
gugccaguaacucaucgcca

SEQ ID NO: 3795600 - RNA, 12 nt, Salmonella typhimurium LT2
gugccaguaauc

SEQ ID NO: 3795601 - RNA, 22 nt, Salmonella typhimurium LT2
gugccauauucucuggcgcgaa

SEQ ID NO: 3795602 - RNA, 12 nt, Salmonella typhimurium LT2
gugcccagcgcg

SEQ ID NO: 3795603 - RNA, 19 nt, Salmonella typhimurium LT2
gugcccauaaaaaucccaa

SEQ ID NO: 3795604 - RNA, 12 nt, Salmonella typhimurium LT2
gugcccaucggc

SEQ ID NO: 3795605 - RNA, 18 nt, Salmonella typhimurium LT2
gugccccgcgcgccugca

SEQ ID NO: 3795606 - RNA, 23 nt, Salmonella typhimurium LT2
gugcccggcaugucgccagccag

SEQ ID NO: 3795607 - RNA, 22 nt, Salmonella typhimurium LT2
gugcccggggugagcaaaggca

SEQ ID NO: 3795608 - RNA, 21 nt, Salmonella typhimurium LT2
gugccgaugacgcuccugaau

SEQ ID NO: 3795609 - RNA, 16 nt, Salmonella typhimurium LT2
gugccgauucccgccu

SEQ ID NO: 3795610 - RNA, 18 nt, Salmonella typhimurium LT2
gugccgccauucgcuucc

SEQ ID NO: 3795611 - RNA, 19 nt, Salmonella typhimurium LT2
gugccgccauucgcuuccg

SEQ ID NO: 3795612 - RNA, 12 nt, Salmonella typhimurium LT2
gugccgcuggug

SEQ ID NO: 3795613 - RNA, 14 nt, Salmonella typhimurium LT2
gugccgcuugccag

SEQ ID NO: 3795614 - RNA, 19 nt, Salmonella typhimurium LT2
gugccggaaagacggcagc

SEQ ID NO: 3795615 - RNA, 19 nt, Salmonella typhimurium LT2
gugccgguaaagggcggga

SEQ ID NO: 3795616 - RNA, 12 nt, Salmonella typhimurium LT2
gugccgguggga

SEQ ID NO: 3795617 - RNA, 15 nt, Salmonella typhimurium LT2
gugccugacagcaau

SEQ ID NO: 3795618 - RNA, 18 nt, Salmonella typhimurium LT2
gugccugacagcaaugag

SEQ ID NO: 3795619 - RNA, 19 nt, Salmonella typhimurium LT2
gugccugacagcaaugagc

SEQ ID NO: 3795620 - RNA, 15 nt, Salmonella typhimurium LT2
gugccugcgcuuacg

SEQ ID NO: 3795621 - RNA, 21 nt, Salmonella typhimurium LT2
gugcgacaucgacaaaauagu

SEQ ID NO: 3795622 - RNA, 22 nt, Salmonella typhimurium LT2
gugcgagauaaccaucgcgcag

SEQ ID NO: 3795623 - RNA, 21 nt, Salmonella typhimurium LT2
gugcgaguucaagucucgccu

SEQ ID NO: 3795624 - RNA, 14 nt, Salmonella typhimurium LT2
gugcgcagccccag

SEQ ID NO: 3795625 - RNA, 19 nt, Salmonella typhimurium LT2
gugcgcagccccagcgcca

SEQ ID NO: 3795626 - RNA, 12 nt, Salmonella typhimurium LT2
gugcgccagcgc

SEQ ID NO: 3795627 - RNA, 14 nt, Salmonella typhimurium LT2
gugcgccagcgcau

SEQ ID NO: 3795628 - RNA, 12 nt, Salmonella typhimurium LT2
gugcgccccagc

SEQ ID NO: 3795629 - RNA, 18 nt, Salmonella typhimurium LT2
gugcgccccuugcagcaa

SEQ ID NO: 3795630 - RNA, 15 nt, Salmonella typhimurium LT2
gugcgccguaaacaa

SEQ ID NO: 3795631 - RNA, 17 nt, Salmonella typhimurium LT2
gugcgccguccugcaag

SEQ ID NO: 3795632 - RNA, 13 nt, Salmonella typhimurium LT2
gugcgcgccaccg

SEQ ID NO: 3795633 - RNA, 13 nt, Salmonella typhimurium LT2
gugcgcgcgggcg

SEQ ID NO: 3795634 - RNA, 21 nt, Salmonella typhimurium LT2
gugcgcggaucgugauaacgc

SEQ ID NO: 3795635 - RNA, 22 nt, Salmonella typhimurium LT2
gugcgcggucauaucuggacgg

SEQ ID NO: 3795636 - RNA, 18 nt, Salmonella typhimurium LT2
gugcgcuaaaaccaaugc

SEQ ID NO: 3795637 - RNA, 16 nt, Salmonella typhimurium LT2
gugcggcaaccaccag

SEQ ID NO: 3795638 - RNA, 22 nt, Salmonella typhimurium LT2
gugcgguauugauacaggcgcu

SEQ ID NO: 3795639 - RNA, 17 nt, Salmonella typhimurium LT2
gugcgucauccggcgcu

SEQ ID NO: 3795640 - RNA, 24 nt, Salmonella typhimurium LT2
gugcgugacccauaguuucauauc

SEQ ID NO: 3795641 - RNA, 23 nt, Salmonella typhimurium LT2
gugcguggcgccugcggcaggca

SEQ ID NO: 3795642 - RNA, 14 nt, Salmonella typhimurium LT2
gugcguucuuccac

SEQ ID NO: 3795643 - RNA, 16 nt, Salmonella typhimurium LT2
gugcuacgccugccug

SEQ ID NO: 3795644 - RNA, 14 nt, Salmonella typhimurium LT2
gugcuacgggcgcu

SEQ ID NO: 3795645 - RNA, 20 nt, Salmonella typhimurium LT2
gugcuacgggcgcugucgcc

SEQ ID NO: 3795646 - RNA, 21 nt, Salmonella typhimurium LT2
gugcuacgggcgcugucgcca

SEQ ID NO: 3795647 - RNA, 22 nt, Salmonella typhimurium LT2
gugcuauacaguaaaacgccaa

SEQ ID NO: 3795648 - RNA, 16 nt, Salmonella typhimurium LT2
gugcucaaucgccugc

SEQ ID NO: 3795649 - RNA, 21 nt, Salmonella typhimurium LT2
gugcucacggcacgcccuucg

SEQ ID NO: 3795650 - RNA, 18 nt, Salmonella typhimurium LT2
gugcucauuugcggcguc

SEQ ID NO: 3795651 - RNA, 23 nt, Salmonella typhimurium LT2
gugcuccagcgccugcugcaacg

SEQ ID NO: 3795652 - RNA, 12 nt, Salmonella typhimurium LT2
gugcuccgccgg

SEQ ID NO: 3795653 - RNA, 14 nt, Salmonella typhimurium LT2
gugcucgcggcgga

SEQ ID NO: 3795654 - RNA, 21 nt, Salmonella typhimurium LT2
gugcucucccagcugagcuaa

SEQ ID NO: 3795655 - RNA, 16 nt, Salmonella typhimurium LT2
gugcugagacgccugc

SEQ ID NO: 3795656 - RNA, 19 nt, Salmonella typhimurium LT2
gugcugauugucagcaguu

SEQ ID NO: 3795657 - RNA, 13 nt, Salmonella typhimurium LT2
gugcuggcggccg

SEQ ID NO: 3795658 - RNA, 13 nt, Salmonella typhimurium LT2
gugcuuccagcuc

SEQ ID NO: 3795659 - RNA, 14 nt, Salmonella typhimurium LT2
gugcuuccagcucc

SEQ ID NO: 3795660 - RNA, 15 nt, Salmonella typhimurium LT2
gugcuuccagcucca

SEQ ID NO: 3795661 - RNA, 16 nt, Salmonella typhimurium LT2
gugcuuccagcuccau

SEQ ID NO: 3795662 - RNA, 16 nt, Salmonella typhimurium LT2
gugcuuuagcuuuacu

SEQ ID NO: 3795663 - RNA, 14 nt, Salmonella typhimurium LT2
guggaaaacagcau

SEQ ID NO: 3795664 - RNA, 14 nt, Salmonella typhimurium LT2
guggaacaaacgca

SEQ ID NO: 3795665 - RNA, 15 nt, Salmonella typhimurium LT2
guggaacaaacgcaa

SEQ ID NO: 3795666 - RNA, 17 nt, Salmonella typhimurium LT2
guggaaucagucgggua

SEQ ID NO: 3795667 - RNA, 22 nt, Salmonella typhimurium LT2
guggaaugccccagguuauaga

SEQ ID NO: 3795668 - RNA, 23 nt, Salmonella typhimurium LT2
guggacaaucaggcugcggauga

SEQ ID NO: 3795669 - RNA, 14 nt, Salmonella typhimurium LT2
guggacaucgccau

SEQ ID NO: 3795670 - RNA, 22 nt, Salmonella typhimurium LT2
guggacaucgccauuccaagaa

SEQ ID NO: 3795671 - RNA, 16 nt, Salmonella typhimurium LT2
guggacuaugcuccag

SEQ ID NO: 3795672 - RNA, 15 nt, Salmonella typhimurium LT2
guggagacagaacag

SEQ ID NO: 3795673 - RNA, 22 nt, Salmonella typhimurium LT2
guggagaggccaccagcgccag

SEQ ID NO: 3795674 - RNA, 22 nt, Salmonella typhimurium LT2
guggagaucgacaacaacaucu

SEQ ID NO: 3795675 - RNA, 17 nt, Salmonella typhimurium LT2
guggauagaguuaaaag

SEQ ID NO: 3795676 - RNA, 15 nt, Salmonella typhimurium LT2
guggcaaaauccaac

SEQ ID NO: 3795677 - RNA, 11 nt, Salmonella typhimurium LT2
guggcaaauac

SEQ ID NO: 3795678 - RNA, 16 nt, Salmonella typhimurium LT2
guggcagaguccagcg

SEQ ID NO: 3795679 - RNA, 12 nt, Salmonella typhimurium LT2
guggcagggcag

SEQ ID NO: 3795680 - RNA, 22 nt, Salmonella typhimurium LT2
guggccacacuucgggcagagc

SEQ ID NO: 3795681 - RNA, 18 nt, Salmonella typhimurium LT2
guggccagcaugcccgcc

SEQ ID NO: 3795682 - RNA, 16 nt, Salmonella typhimurium LT2
guggccaucuuccagc

SEQ ID NO: 3795683 - RNA, 18 nt, Salmonella typhimurium LT2
guggccaucuuccagcau

SEQ ID NO: 3795684 - RNA, 19 nt, Salmonella typhimurium LT2
guggccgauauugccuuca

SEQ ID NO: 3795685 - RNA, 12 nt, Salmonella typhimurium LT2
guggccguggug

SEQ ID NO: 3795686 - RNA, 13 nt, Salmonella typhimurium LT2
guggccuuaucca

SEQ ID NO: 3795687 - RNA, 18 nt, Salmonella typhimurium LT2
guggcgaacaggcucagc

SEQ ID NO: 3795688 - RNA, 21 nt, Salmonella typhimurium LT2
guggcgaagcucagccaggcg

SEQ ID NO: 3795689 - RNA, 20 nt, Salmonella typhimurium LT2
guggcgacgcguggcaucuu

SEQ ID NO: 3795690 - RNA, 22 nt, Salmonella typhimurium LT2
guggcgaucagcggcgccgcaa

SEQ ID NO: 3795691 - RNA, 18 nt, Salmonella typhimurium LT2
guggcgcaaccgauagcu

SEQ ID NO: 3795692 - RNA, 18 nt, Salmonella typhimurium LT2
guggcgccaugcuuuccg

SEQ ID NO: 3795693 - RNA, 16 nt, Salmonella typhimurium LT2
guggcgccugcggcag

SEQ ID NO: 3795694 - RNA, 18 nt, Salmonella typhimurium LT2
guggcgcugcgcuuacca

SEQ ID NO: 3795695 - RNA, 18 nt, Salmonella typhimurium LT2
guggcgcugcgcuuaccg

SEQ ID NO: 3795696 - RNA, 19 nt, Salmonella typhimurium LT2
guggcgcuggcgcuuaccg

SEQ ID NO: 3795697 - RNA, 11 nt, Salmonella typhimurium LT2
guggcgcuggg

SEQ ID NO: 3795698 - RNA, 22 nt, Salmonella typhimurium LT2
guuccugcuuggccugaagcug

SEQ ID NO: 3795699 - RNA, 20 nt, Salmonella typhimurium LT2
guuccuggcaaagcgucaug

SEQ ID NO: 3795700 - RNA, 19 nt, Salmonella typhimurium LT2
guuccuguagcgugacggc

SEQ ID NO: 3795701 - RNA, 15 nt, Salmonella typhimurium LT2
guuccuucagcuuca

SEQ ID NO: 3795702 - RNA, 16 nt, Salmonella typhimurium LT2
guuccuucagcuucac

SEQ ID NO: 3795703 - RNA, 24 nt, Salmonella typhimurium LT2
guucgaaucccgucguagccacca

SEQ ID NO: 3795704 - RNA, 20 nt, Salmonella typhimurium LT2
guucgacaauguccgccaga

SEQ ID NO: 3795705 - RNA, 16 nt, Salmonella typhimurium LT2
guucgauacuauaacg

SEQ ID NO: 3795706 - RNA, 18 nt, Salmonella typhimurium LT2
guucgcaacaugaauuaa

SEQ ID NO: 3795707 - RNA, 20 nt, Salmonella typhimurium LT2
guucgcaaccuaaccaaaca

SEQ ID NO: 3795708 - RNA, 23 nt, Salmonella typhimurium LT2
guucgcauugguaucggcaggca

SEQ ID NO: 3795709 - RNA, 15 nt, Salmonella typhimurium LT2
guucgccagugacaa

SEQ ID NO: 3795710 - RNA, 15 nt, Salmonella typhimurium LT2
guucgccgcgcgcau

SEQ ID NO: 3795711 - RNA, 21 nt, Salmonella typhimurium LT2
guucgccuaagcguucaucag

SEQ ID NO: 3795712 - RNA, 19 nt, Salmonella typhimurium LT2
guucgccuucguuauaagg

SEQ ID NO: 3795713 - RNA, 13 nt, Salmonella typhimurium LT2
guucgcgacugau

SEQ ID NO: 3795714 - RNA, 15 nt, Salmonella typhimurium LT2
guucgcgcaguucau

SEQ ID NO: 3795715 - RNA, 23 nt, Salmonella typhimurium LT2
guucgcgcgugguaucgcggcag

SEQ ID NO: 3795716 - RNA, 15 nt, Salmonella typhimurium LT2
guucgcggcaaacac

SEQ ID NO: 3795717 - RNA, 13 nt, Salmonella typhimurium LT2
guucgcggcuggu

SEQ ID NO: 3795718 - RNA, 21 nt, Salmonella typhimurium LT2
guucgcugcauuguuccugcu

SEQ ID NO: 3795719 - RNA, 13 nt, Salmonella typhimurium LT2
guucgcuucuucu

SEQ ID NO: 3795720 - RNA, 23 nt, Salmonella typhimurium LT2
guucggaccagaaccucacggag

SEQ ID NO: 3795721 - RNA, 15 nt, Salmonella typhimurium LT2
guucggguaaacgcu

SEQ ID NO: 3795722 - RNA, 17 nt, Salmonella typhimurium LT2
guucggguaaacgcugc

SEQ ID NO: 3795723 - RNA, 16 nt, Salmonella typhimurium LT2
guucggguuuuccugc

SEQ ID NO: 3795724 - RNA, 18 nt, Salmonella typhimurium LT2
guucgguaucgcgccagg

SEQ ID NO: 3795725 - RNA, 20 nt, Salmonella typhimurium LT2
guucguaaagcauagcguca

SEQ ID NO: 3795726 - RNA, 14 nt, Salmonella typhimurium LT2
guucguacuccugc

SEQ ID NO: 3795727 - RNA, 23 nt, Salmonella typhimurium LT2
guucgucgguucgucgagcagca

SEQ ID NO: 3795728 - RNA, 17 nt, Salmonella typhimurium LT2
guucguuaacccggcau

SEQ ID NO: 3795729 - RNA, 20 nt, Salmonella typhimurium LT2
guucugaacuguaaccggcg

SEQ ID NO: 3795730 - RNA, 20 nt, Salmonella typhimurium LT2
guucugcgccauuuccagcc

SEQ ID NO: 3795731 - RNA, 16 nt, Salmonella typhimurium LT2
guucugcgucgcgcau

SEQ ID NO: 3795732 - RNA, 22 nt, Salmonella typhimurium LT2
guucugcugauaauacugccgc

SEQ ID NO: 3795733 - RNA, 15 nt, Salmonella typhimurium LT2
guucuggcugcgcuu

SEQ ID NO: 3795734 - RNA, 17 nt, Salmonella typhimurium LT2
guucuguaggcugugca

SEQ ID NO: 3795735 - RNA, 23 nt, Salmonella typhimurium LT2
guucuuccacuucagcagcagca

SEQ ID NO: 3795736 - RNA, 17 nt, Salmonella typhimurium LT2
guucuucggcauaacgc

SEQ ID NO: 3795737 - RNA, 13 nt, Salmonella typhimurium LT2
guucuuucauuuu

SEQ ID NO: 3795738 - RNA, 14 nt, Salmonella typhimurium LT2
guucuuucugccau

SEQ ID NO: 3795739 - RNA, 20 nt, Salmonella typhimurium LT2
guugaaaaaacgggcccgcg

SEQ ID NO: 3795740 - RNA, 16 nt, Salmonella typhimurium LT2
guugaauagcugccgc

SEQ ID NO: 3795741 - RNA, 23 nt, Salmonella typhimurium LT2
guugaccaaacagcaauuccgcc

SEQ ID NO: 3795742 - RNA, 22 nt, Salmonella typhimurium LT2
guugaccaacaaucgccccagg

SEQ ID NO: 3795743 - RNA, 14 nt, Salmonella typhimurium LT2
guugacgcuucaag

SEQ ID NO: 3795744 - RNA, 19 nt, Salmonella typhimurium LT2
guugacuuaaaaagcggau

SEQ ID NO: 3795745 - RNA, 13 nt, Salmonella typhimurium LT2
guugagcagcgcg

SEQ ID NO: 3795746 - RNA, 17 nt, Salmonella typhimurium LT2
guugagcagcgcgauau

SEQ ID NO: 3795747 - RNA, 21 nt, Salmonella typhimurium LT2
guugagcguguccucugcugc

SEQ ID NO: 3795748 - RNA, 20 nt, Salmonella typhimurium LT2
guugauacagaaaaccggca

SEQ ID NO: 3795749 - RNA, 22 nt, Salmonella typhimurium LT2
guugauacagaaaaccggcaaa

SEQ ID NO: 3795750 - RNA, 19 nt, Salmonella typhimurium LT2
guugauacaggaauaacca

SEQ ID NO: 3795751 - RNA, 14 nt, Salmonella typhimurium LT2
guugauaccggagg

SEQ ID NO: 3795752 - RNA, 13 nt, Salmonella typhimurium LT2
guugaucgccauc

SEQ ID NO: 3795753 - RNA, 18 nt, Salmonella typhimurium LT2
guugaucguaaagcgcau

SEQ ID NO: 3795754 - RNA, 23 nt, Salmonella typhimurium LT2
guugaucucauuguauuucucaa

SEQ ID NO: 3795755 - RNA, 23 nt, Salmonella typhimurium LT2
guugaugccgaccgucggcgcaa

SEQ ID NO: 3795756 - RNA, 14 nt, Salmonella typhimurium LT2
guugauucagcguc

SEQ ID NO: 3795757 - RNA, 21 nt, Salmonella typhimurium LT2
guugcaauaaaauauccucca

SEQ ID NO: 3795758 - RNA, 23 nt, Salmonella typhimurium LT2
guugcaauaaaauauccuccacc

SEQ ID NO: 3795759 - RNA, 15 nt, Salmonella typhimurium LT2
guugcaaucgccuga

SEQ ID NO: 3795760 - RNA, 20 nt, Salmonella typhimurium LT2
guugcacccgaacaacaaua

SEQ ID NO: 3795761 - RNA, 19 nt, Salmonella typhimurium LT2
guugcauucccuacgccca

SEQ ID NO: 3795762 - RNA, 19 nt, Salmonella typhimurium LT2
guugccaaaaaaucagcaa

SEQ ID NO: 3795763 - RNA, 21 nt, Salmonella typhimurium LT2
guugccaauagcaaugaagca

SEQ ID NO: 3795764 - RNA, 15 nt, Salmonella typhimurium LT2
guugccacugccacg

SEQ ID NO: 3795765 - RNA, 17 nt, Salmonella typhimurium LT2
guugccacugccacgag

SEQ ID NO: 3795766 - RNA, 18 nt, Salmonella typhimurium LT2
guugccacugccacgagc

SEQ ID NO: 3795767 - RNA, 19 nt, Salmonella typhimurium LT2
guugccagaaacgcguagc

SEQ ID NO: 3795768 - RNA, 19 nt, Salmonella typhimurium LT2
guugccaggguucaaccug

SEQ ID NO: 3795769 - RNA, 21 nt, Salmonella typhimurium LT2
guugccaggguucaaccugau

SEQ ID NO: 3795770 - RNA, 14 nt, Salmonella typhimurium LT2
guugccagucgaga

SEQ ID NO: 3795771 - RNA, 18 nt, Salmonella typhimurium LT2
guugccaugauccaucuc

SEQ ID NO: 3795772 - RNA, 13 nt, Salmonella typhimurium LT2
guugcccaguacg

SEQ ID NO: 3795773 - RNA, 19 nt, Salmonella typhimurium LT2
guugcccaguacggcgcga

SEQ ID NO: 3795774 - RNA, 20 nt, Salmonella typhimurium LT2
guugcccaucgcaacgccgg

SEQ ID NO: 3795775 - RNA, 14 nt, Salmonella typhimurium LT2
guugccccggcuua

SEQ ID NO: 3795776 - RNA, 12 nt, Salmonella typhimurium LT2
guugcccggcgc

SEQ ID NO: 3795777 - RNA, 18 nt, Salmonella typhimurium LT2
guugcccggcgccauccg

SEQ ID NO: 3795778 - RNA, 17 nt, Salmonella typhimurium LT2
guugcccucuuuaucaa

SEQ ID NO: 3795779 - RNA, 21 nt, Salmonella typhimurium LT2
guugccggagaccuuuuucau

SEQ ID NO: 3795780 - RNA, 17 nt, Salmonella typhimurium LT2
guugccugauggcgcug

SEQ ID NO: 3795781 - RNA, 13 nt, Salmonella typhimurium LT2
guugccuucgaug

SEQ ID NO: 3795782 - RNA, 15 nt, Salmonella typhimurium LT2
guugcgacaaccugu

SEQ ID NO: 3795783 - RNA, 21 nt, Salmonella typhimurium LT2
guugcgacuguucaucaaaga

SEQ ID NO: 3795784 - RNA, 21 nt, Salmonella typhimurium LT2
guugcgcaagcacugaaugcu

SEQ ID NO: 3795785 - RNA, 14 nt, Salmonella typhimurium LT2
guugcgcaauauaa

SEQ ID NO: 3795786 - RNA, 21 nt, Salmonella typhimurium LT2
guugcgcagcguuuccagacu

SEQ ID NO: 3795787 - RNA, 14 nt, Salmonella typhimurium LT2
guugcgcugguugg

SEQ ID NO: 3795788 - RNA, 20 nt, Salmonella typhimurium LT2
guugcggcaucagauggcga

SEQ ID NO: 3795789 - RNA, 14 nt, Salmonella typhimurium LT2
guugcguauuuuua

SEQ ID NO: 3795790 - RNA, 22 nt, Salmonella typhimurium LT2
guugcgucauauaauccugcgg

SEQ ID NO: 3795791 - RNA, 18 nt, Salmonella typhimurium LT2
guugcguguuguacagca

SEQ ID NO: 3795792 - RNA, 12 nt, Salmonella typhimurium LT2
guugcucaggua

SEQ ID NO: 3795793 - RNA, 17 nt, Salmonella typhimurium LT2
guugcuccuguaaguca

SEQ ID NO: 3795794 - RNA, 12 nt, Salmonella typhimurium LT2
guugcucuuucu

SEQ ID NO: 3795795 - RNA, 18 nt, Salmonella typhimurium LT2
guugcuguuccagccgcc

SEQ ID NO: 3795796 - RNA, 21 nt, Salmonella typhimurium LT2
guugcuuaccuuguucuucca

SEQ ID NO: 3795797 - RNA, 14 nt, Salmonella typhimurium LT2
guuggaucucacca

SEQ ID NO: 3795798 - RNA, 16 nt, Salmonella typhimurium LT2
guuggaucucaccacu

SEQ ID NO: 3795799 - RNA, 14 nt, Salmonella typhimurium LT2
guuggcauaaugaa

SEQ ID NO: 3795800 - RNA, 14 nt, Salmonella typhimurium LT2
guuggcauccugug

SEQ ID NO: 3795801 - RNA, 15 nt, Salmonella typhimurium LT2
guuuguuuaauuuug

SEQ ID NO: 3795802 - RNA, 13 nt, Salmonella typhimurium LT2
guuuuaaaaauaa

SEQ ID NO: 3795803 - RNA, 17 nt, Salmonella typhimurium LT2
guuuuaacgucaucacc

SEQ ID NO: 3795804 - RNA, 16 nt, Salmonella typhimurium LT2
guuuuaagcuucuuau

SEQ ID NO: 3795805 - RNA, 18 nt, Salmonella typhimurium LT2
guuuuaccgcccgacgga

SEQ ID NO: 3795806 - RNA, 19 nt, Salmonella typhimurium LT2
guuuuacgaugguugugug

SEQ ID NO: 3795807 - RNA, 14 nt, Salmonella typhimurium LT2
guuuuagcaugaca

SEQ ID NO: 3795808 - RNA, 22 nt, Salmonella typhimurium LT2
guuuucaggccgcguaauuuuu

SEQ ID NO: 3795809 - RNA, 13 nt, Salmonella typhimurium LT2
guuuucauuagcc

SEQ ID NO: 3795810 - RNA, 17 nt, Salmonella typhimurium LT2
guuuucauuagccgcca

SEQ ID NO: 3795811 - RNA, 16 nt, Salmonella typhimurium LT2
guuuuccgcaacguca

SEQ ID NO: 3795812 - RNA, 17 nt, Salmonella typhimurium LT2
guuuucucuuuccagcg

SEQ ID NO: 3795813 - RNA, 15 nt, Salmonella typhimurium LT2
guuuugauguccaga

SEQ ID NO: 3795814 - RNA, 22 nt, Salmonella typhimurium LT2
guuuugcaggaaaaacuguccc

SEQ ID NO: 3795815 - RNA, 18 nt, Salmonella typhimurium LT2
guuuugccaguuucucaa

SEQ ID NO: 3795816 - RNA, 13 nt, Salmonella typhimurium LT2
guuuugccgauac

SEQ ID NO: 3795817 - RNA, 14 nt, Salmonella typhimurium LT2
guuuugcggggcau

SEQ ID NO: 3795818 - RNA, 18 nt, Salmonella typhimurium LT2
guuuugcugauaugaaac

SEQ ID NO: 3795819 - RNA, 15 nt, Salmonella typhimurium LT2
guuuugcuggaauuu

SEQ ID NO: 3795820 - RNA, 14 nt, Salmonella typhimurium LT2
guuuuggcagcgcc

SEQ ID NO: 3795821 - RNA, 19 nt, Salmonella typhimurium LT2
guuuuguacagccgggcau

SEQ ID NO: 3795822 - RNA, 19 nt, Salmonella typhimurium LT2
guuuuuaccauauuuaucu

SEQ ID NO: 3795823 - RNA, 14 nt, Salmonella typhimurium LT2
guuuuuacuuucca

SEQ ID NO: 3795824 - RNA, 12 nt, Salmonella typhimurium LT2
guuuuucaucaa

SEQ ID NO: 3795825 - RNA, 13 nt, Salmonella typhimurium LT2
guuuuucaucaag

SEQ ID NO: 3795826 - RNA, 17 nt, Salmonella typhimurium LT2
guuuuugucucuucaug

SEQ ID NO: 3795827 - RNA, 21 nt, Salmonella typhimurium LT2
guuuuuuaaugagaaauuuua

SEQ ID NO: 3795828 - RNA, 13 nt, Salmonella typhimurium LT2
guuuuuucugucg

SEQ ID NO: 3795829 - RNA, 14 nt, Salmonella typhimurium LT2
guuuuuuucaucuu

SEQ ID NO: 3795830 - RNA, 20 nt, Salmonella typhimurium LT2
uaaaaaaacaucauaauaau

SEQ ID NO: 3795831 - RNA, 12 nt, Salmonella typhimurium LT2
uaaaaaaauaaa

SEQ ID NO: 3795832 - RNA, 16 nt, Salmonella typhimurium LT2
uaaaaaaauaaaaaag

SEQ ID NO: 3795833 - RNA, 15 nt, Salmonella typhimurium LT2
uaaaaaagaggaaug

SEQ ID NO: 3795834 - RNA, 16 nt, Salmonella typhimurium LT2
uaaaaaagccgaccug

SEQ ID NO: 3795835 - RNA, 18 nt, Salmonella typhimurium LT2
uaaaaaagugauucacuu

SEQ ID NO: 3795836 - RNA, 14 nt, Salmonella typhimurium LT2
uaaaaacagccaua

SEQ ID NO: 3795837 - RNA, 13 nt, Salmonella typhimurium LT2
uaaaaacaucauu

SEQ ID NO: 3795838 - RNA, 10 nt, Salmonella typhimurium LT2
uaaaaaccag

SEQ ID NO: 3795839 - RNA, 20 nt, Salmonella typhimurium LT2
uaaaaaccagaacuuccaga

SEQ ID NO: 3795840 - RNA, 21 nt, Salmonella typhimurium LT2
uaaaaaccaggcgaaaauagg

SEQ ID NO: 3795841 - RNA, 14 nt, Salmonella typhimurium LT2
uaaaaaccauuuau

SEQ ID NO: 3795842 - RNA, 16 nt, Salmonella typhimurium LT2
uaaaaacccugccgaa

SEQ ID NO: 3795843 - RNA, 23 nt, Salmonella typhimurium LT2
uaaaaacgcgcucgccagcgcag

SEQ ID NO: 3795844 - RNA, 13 nt, Salmonella typhimurium LT2
uaaaaagaacaag

SEQ ID NO: 3795845 - RNA, 16 nt, Salmonella typhimurium LT2
uaaaaagagaaaaaau

SEQ ID NO: 3795846 - RNA, 18 nt, Salmonella typhimurium LT2
uaaaaagccagcguaaau

SEQ ID NO: 3795847 - RNA, 22 nt, Salmonella typhimurium LT2
uaaaaagcugcauaaugcgcga

SEQ ID NO: 3795848 - RNA, 22 nt, Salmonella typhimurium LT2
uaaaaauaacgcgauaaucccc

SEQ ID NO: 3795849 - RNA, 13 nt, Salmonella typhimurium LT2
uaaaaauaauuga

SEQ ID NO: 3795850 - RNA, 18 nt, Salmonella typhimurium LT2
uaaaaauaccguuagcau

SEQ ID NO: 3795851 - RNA, 19 nt, Salmonella typhimurium LT2
uaaaaauaccguuagcaua

SEQ ID NO: 3795852 - RNA, 14 nt, Salmonella typhimurium LT2
uaaaaauauccgcc

SEQ ID NO: 3795853 - RNA, 23 nt, Salmonella typhimurium LT2
uaaaaauaucugaauaaccauuc

SEQ ID NO: 3795854 - RNA, 21 nt, Salmonella typhimurium LT2
uaaaaauauggcgggccugug

SEQ ID NO: 3795855 - RNA, 17 nt, Salmonella typhimurium LT2
uaaaaauccuguuccau

SEQ ID NO: 3795856 - RNA, 12 nt, Salmonella typhimurium LT2
uaaaaaugcgcu

SEQ ID NO: 3795857 - RNA, 17 nt, Salmonella typhimurium LT2
uaaaaaugcgcuaacgu

SEQ ID NO: 3795858 - RNA, 17 nt, Salmonella typhimurium LT2
uaaaaauuguuccugua

SEQ ID NO: 3795859 - RNA, 17 nt, Salmonella typhimurium LT2
uaaaacagccugucgcc

SEQ ID NO: 3795860 - RNA, 14 nt, Salmonella typhimurium LT2
uaaaacauaaagau

SEQ ID NO: 3795861 - RNA, 18 nt, Salmonella typhimurium LT2
uaaaacauaaagauaaau

SEQ ID NO: 3795862 - RNA, 23 nt, Salmonella typhimurium LT2
uaaaacauauccguacaagcguu

SEQ ID NO: 3795863 - RNA, 11 nt, Salmonella typhimurium LT2
uaaaaccauug

SEQ ID NO: 3795864 - RNA, 20 nt, Salmonella typhimurium LT2
uaaaaccauugcuaaaaaua

SEQ ID NO: 3795865 - RNA, 22 nt, Salmonella typhimurium LT2
uaaaaccgccgcccaucaauac

SEQ ID NO: 3795866 - RNA, 22 nt, Salmonella typhimurium LT2
uaaaacgauauugccuuauuca

SEQ ID NO: 3795867 - RNA, 16 nt, Salmonella typhimurium LT2
uaaaacgccugugcua

SEQ ID NO: 3795868 - RNA, 23 nt, Salmonella typhimurium LT2
uaaaacggaucagccugagcgcc

SEQ ID NO: 3795869 - RNA, 20 nt, Salmonella typhimurium LT2
uaaaacggcuuuucuucauc

SEQ ID NO: 3795870 - RNA, 18 nt, Salmonella typhimurium LT2
uaaaacucccggcggaaa

SEQ ID NO: 3795871 - RNA, 15 nt, Salmonella typhimurium LT2
uaaaacugccaucaa

SEQ ID NO: 3795872 - RNA, 17 nt, Salmonella typhimurium LT2
uaaaacuggcuaucgcc

SEQ ID NO: 3795873 - RNA, 20 nt, Salmonella typhimurium LT2
uaaaacuucgauaauaaaau

SEQ ID NO: 3795874 - RNA, 21 nt, Salmonella typhimurium LT2
uaaaacuucgauaauaaaaua

SEQ ID NO: 3795875 - RNA, 23 nt, Salmonella typhimurium LT2
uaaaagaagaaaccgcagaaaaa

SEQ ID NO: 3795876 - RNA, 16 nt, Salmonella typhimurium LT2
uaaaagagaaaaagaa

SEQ ID NO: 3795877 - RNA, 22 nt, Salmonella typhimurium LT2
uaaaagagaaaaagaagaaaaa

SEQ ID NO: 3795878 - RNA, 16 nt, Salmonella typhimurium LT2
uaaaagcaauguaaga

SEQ ID NO: 3795879 - RNA, 19 nt, Salmonella typhimurium LT2
uaaaagcaauguaagaaua

SEQ ID NO: 3795880 - RNA, 21 nt, Salmonella typhimurium LT2
uaaaagcgauaaagacagguu

SEQ ID NO: 3795881 - RNA, 17 nt, Salmonella typhimurium LT2
uaaaagggaguauuaau

SEQ ID NO: 3795882 - RNA, 14 nt, Salmonella typhimurium LT2
uaaaaguacaaugc

SEQ ID NO: 3795883 - RNA, 23 nt, Salmonella typhimurium LT2
uaaaaguacaaugcaaagaaaaa

SEQ ID NO: 3795884 - RNA, 17 nt, Salmonella typhimurium LT2
uaaaaguuagccccuua

SEQ ID NO: 3795885 - RNA, 14 nt, Salmonella typhimurium LT2
uaaaauaaauuaau

SEQ ID NO: 3795886 - RNA, 22 nt, Salmonella typhimurium LT2
uaaaauauacccguguggcugu

SEQ ID NO: 3795887 - RNA, 14 nt, Salmonella typhimurium LT2
uaaaaucaacgcuc

SEQ ID NO: 3795888 - RNA, 16 nt, Salmonella typhimurium LT2
uaaaauccggcugccu

SEQ ID NO: 3795889 - RNA, 19 nt, Salmonella typhimurium LT2
uaaaauccggcugccugcc

SEQ ID NO: 3795890 - RNA, 22 nt, Salmonella typhimurium LT2
uaaaauccggggcgguuuauac

SEQ ID NO: 3795891 - RNA, 19 nt, Salmonella typhimurium LT2
uaaaaucggguggccuaac

SEQ ID NO: 3795892 - RNA, 19 nt, Salmonella typhimurium LT2
uaaaaucgucccuuuuccc

SEQ ID NO: 3795893 - RNA, 20 nt, Salmonella typhimurium LT2
uaaaaucgucccuuuucccc

SEQ ID NO: 3795894 - RNA, 16 nt, Salmonella typhimurium LT2
uaaaauuauauucuaa

SEQ ID NO: 3795895 - RNA, 15 nt, Salmonella typhimurium LT2
uaaaauuauccacaa

SEQ ID NO: 3795896 - RNA, 23 nt, Salmonella typhimurium LT2
uaaaauuauuggcuuuguaaaua

SEQ ID NO: 3795897 - RNA, 17 nt, Salmonella typhimurium LT2
uaaaauucauuauaaaa

SEQ ID NO: 3795898 - RNA, 20 nt, Salmonella typhimurium LT2
uaaaauucauuauaaaacau

SEQ ID NO: 3795899 - RNA, 19 nt, Salmonella typhimurium LT2
uaaacaauggaaccaucaa

SEQ ID NO: 3795900 - RNA, 15 nt, Salmonella typhimurium LT2
uaaacacguuaucug

SEQ ID NO: 3795901 - RNA, 18 nt, Salmonella typhimurium LT2
uaaacagaaucaacgcca

SEQ ID NO: 3795902 - RNA, 16 nt, Salmonella typhimurium LT2
uaaacagacaauuagc

SEQ ID NO: 3795903 - RNA, 22 nt, Salmonella typhimurium LT2
uaaacagauaagcgucugcaau

SEQ ID NO: 3795904 - RNA, 16 nt, Salmonella typhimurium LT2
uaaacagaugcucacu

SEQ ID NO: 3795905 - RNA, 12 nt, Salmonella typhimurium LT2
uaaauugcggca

SEQ ID NO: 3795906 - RNA, 17 nt, Salmonella typhimurium LT2
uaaauugggaugaugcc

SEQ ID NO: 3795907 - RNA, 12 nt, Salmonella typhimurium LT2
uaaauugguuau

SEQ ID NO: 3795908 - RNA, 13 nt, Salmonella typhimurium LT2
uaaauuuacucag

SEQ ID NO: 3795909 - RNA, 14 nt, Salmonella typhimurium LT2
uaaauuuacucagu

SEQ ID NO: 3795910 - RNA, 23 nt, Salmonella typhimurium LT2
uaaauuuccucuugucaggcaaa

SEQ ID NO: 3795911 - RNA, 21 nt, Salmonella typhimurium LT2
uaaauuuggcgaugcuaucgg

SEQ ID NO: 3795912 - RNA, 21 nt, Salmonella typhimurium LT2
uaaauuuucauuauaaaacuu

SEQ ID NO: 3795913 - RNA, 22 nt, Salmonella typhimurium LT2
uaacaaaagcgguuaagauaca

SEQ ID NO: 3795914 - RNA, 23 nt, Salmonella typhimurium LT2
uaacaaaagcgguuaagauacau

SEQ ID NO: 3795915 - RNA, 20 nt, Salmonella typhimurium LT2
uaacaaaaugagauugauaa

SEQ ID NO: 3795916 - RNA, 20 nt, Salmonella typhimurium LT2
uaacaaaccgguaaucccuu

SEQ ID NO: 3795917 - RNA, 23 nt, Salmonella typhimurium LT2
uaacaaaccgguaaucccuucac

SEQ ID NO: 3795918 - RNA, 15 nt, Salmonella typhimurium LT2
uaacaaaugaagcaa

SEQ ID NO: 3795919 - RNA, 22 nt, Salmonella typhimurium LT2
uaacaacuccagcaaaucaauu

SEQ ID NO: 3795920 - RNA, 15 nt, Salmonella typhimurium LT2
uaacaacuguuuuuc

SEQ ID NO: 3795921 - RNA, 14 nt, Salmonella typhimurium LT2
uaacaauuuaucag

SEQ ID NO: 3795922 - RNA, 15 nt, Salmonella typhimurium LT2
uaacaauuuaucaga

SEQ ID NO: 3795923 - RNA, 18 nt, Salmonella typhimurium LT2
uaacaauuuaucagacaa

SEQ ID NO: 3795924 - RNA, 17 nt, Salmonella typhimurium LT2
uaacacacuuucugcuu

SEQ ID NO: 3795925 - RNA, 12 nt, Salmonella typhimurium LT2
uaacacaugcaa

SEQ ID NO: 3795926 - RNA, 23 nt, Salmonella typhimurium LT2
uaacaccacgaaggaaacgccag

SEQ ID NO: 3795927 - RNA, 17 nt, Salmonella typhimurium LT2
uaacaccggcaaauagc

SEQ ID NO: 3795928 - RNA, 14 nt, Salmonella typhimurium LT2
uaacacggcuggca

SEQ ID NO: 3795929 - RNA, 21 nt, Salmonella typhimurium LT2
uaacacuuugaacgagucuua

SEQ ID NO: 3795930 - RNA, 17 nt, Salmonella typhimurium LT2
uaacagacgcaggccgu

SEQ ID NO: 3795931 - RNA, 21 nt, Salmonella typhimurium LT2
uaacagacgcaucuuuuuccc

SEQ ID NO: 3795932 - RNA, 14 nt, Salmonella typhimurium LT2
uaacagaugacagu

SEQ ID NO: 3795933 - RNA, 16 nt, Salmonella typhimurium LT2
uaacagcauugaggcu

SEQ ID NO: 3795934 - RNA, 19 nt, Salmonella typhimurium LT2
uaacagcgcgaccagcgug

SEQ ID NO: 3795935 - RNA, 15 nt, Salmonella typhimurium LT2
uaacaggcaauuucc

SEQ ID NO: 3795936 - RNA, 17 nt, Salmonella typhimurium LT2
uaacaucaccuuucauu

SEQ ID NO: 3795937 - RNA, 11 nt, Salmonella typhimurium LT2
uaacaucagcc

SEQ ID NO: 3795938 - RNA, 16 nt, Salmonella typhimurium LT2
uaacaucguaaaucaa

SEQ ID NO: 3795939 - RNA, 18 nt, Salmonella typhimurium LT2
uaacaucuuccaugccuu

SEQ ID NO: 3795940 - RNA, 16 nt, Salmonella typhimurium LT2
uaacauguuuuguauu

SEQ ID NO: 3795941 - RNA, 20 nt, Salmonella typhimurium LT2
uaacauguuuuguauuaauu

SEQ ID NO: 3795942 - RNA, 19 nt, Salmonella typhimurium LT2
uaacauugguuaucaaaaa

SEQ ID NO: 3795943 - RNA, 18 nt, Salmonella typhimurium LT2
uaaccaaacagacacuuu

SEQ ID NO: 3795944 - RNA, 19 nt, Salmonella typhimurium LT2
uaaccaauaaugcaggcua

SEQ ID NO: 3795945 - RNA, 18 nt, Salmonella typhimurium LT2
uaaccaauuaaauuauuu

SEQ ID NO: 3795946 - RNA, 15 nt, Salmonella typhimurium LT2
uaaccaccuguucgc

SEQ ID NO: 3795947 - RNA, 17 nt, Salmonella typhimurium LT2
uaaccacugauggcugg

SEQ ID NO: 3795948 - RNA, 21 nt, Salmonella typhimurium LT2
uaaccagaaaaccgacagcaa

SEQ ID NO: 3795949 - RNA, 19 nt, Salmonella typhimurium LT2
uaaccagacgguuuauccc

SEQ ID NO: 3795950 - RNA, 12 nt, Salmonella typhimurium LT2
uaaccagcaguc

SEQ ID NO: 3795951 - RNA, 19 nt, Salmonella typhimurium LT2
uaaccagguauuaaauaca

SEQ ID NO: 3795952 - RNA, 19 nt, Salmonella typhimurium LT2
uaacccaaagaugauuucu

SEQ ID NO: 3795953 - RNA, 18 nt, Salmonella typhimurium LT2
uaacccaugggcggccug

SEQ ID NO: 3795954 - RNA, 14 nt, Salmonella typhimurium LT2
uaacccgcagccgg

SEQ ID NO: 3795955 - RNA, 15 nt, Salmonella typhimurium LT2
uaacccugaagcugc

SEQ ID NO: 3795956 - RNA, 15 nt, Salmonella typhimurium LT2
uaacccuucagcuua

SEQ ID NO: 3795957 - RNA, 18 nt, Salmonella typhimurium LT2
uaaccgauaacgcggccc

SEQ ID NO: 3795958 - RNA, 18 nt, Salmonella typhimurium LT2
uaaccgaugcccggcaau

SEQ ID NO: 3795959 - RNA, 22 nt, Salmonella typhimurium LT2
uaaccgaugugcguauucagcg

SEQ ID NO: 3795960 - RNA, 15 nt, Salmonella typhimurium LT2
uaaccgcccgcggcg

SEQ ID NO: 3795961 - RNA, 23 nt, Salmonella typhimurium LT2
uaaccgcuaaacagcaaaucggg

SEQ ID NO: 3795962 - RNA, 18 nt, Salmonella typhimurium LT2
uaaccguaacgcuccugg

SEQ ID NO: 3795963 - RNA, 17 nt, Salmonella typhimurium LT2
uaaccguagauuuucau

SEQ ID NO: 3795964 - RNA, 21 nt, Salmonella typhimurium LT2
uaaccguagauuuucaucaua

SEQ ID NO: 3795965 - RNA, 18 nt, Salmonella typhimurium LT2
uaaccgucuucauccaug

SEQ ID NO: 3795966 - RNA, 15 nt, Salmonella typhimurium LT2
uaaccuauuuuaaaa

SEQ ID NO: 3795967 - RNA, 17 nt, Salmonella typhimurium LT2
uaaccuauuuuaaaaaa

SEQ ID NO: 3795968 - RNA, 14 nt, Salmonella typhimurium LT2
uaaccuauuuugca

SEQ ID NO: 3795969 - RNA, 16 nt, Salmonella typhimurium LT2
uaaccucuauaguaaa

SEQ ID NO: 3795970 - RNA, 13 nt, Salmonella typhimurium LT2
uaaccucuuuuuc

SEQ ID NO: 3795971 - RNA, 15 nt, Salmonella typhimurium LT2
uaaccuuaaaaggcg

SEQ ID NO: 3795972 - RNA, 16 nt, Salmonella typhimurium LT2
uaaccuuauauauguu

SEQ ID NO: 3795973 - RNA, 21 nt, Salmonella typhimurium LT2
uaaccuucuucguuaugaaug

SEQ ID NO: 3795974 - RNA, 13 nt, Salmonella typhimurium LT2
uaaccuugcccau

SEQ ID NO: 3795975 - RNA, 15 nt, Salmonella typhimurium LT2
uaaccuuucaccuua

SEQ ID NO: 3795976 - RNA, 17 nt, Salmonella typhimurium LT2
uaacgacaaaaauacca

SEQ ID NO: 3795977 - RNA, 19 nt, Salmonella typhimurium LT2
uaacgacaaaaauaccacu

SEQ ID NO: 3795978 - RNA, 13 nt, Salmonella typhimurium LT2
uaacgacauuuuu

SEQ ID NO: 3795979 - RNA, 19 nt, Salmonella typhimurium LT2
uaacgaggccaccaucacu

SEQ ID NO: 3795980 - RNA, 16 nt, Salmonella typhimurium LT2
uaacgauuuuauagau

SEQ ID NO: 3795981 - RNA, 15 nt, Salmonella typhimurium LT2
uaacgcaacaacagu

SEQ ID NO: 3795982 - RNA, 22 nt, Salmonella typhimurium LT2
uaacgcaacggaaggaaauaac

SEQ ID NO: 3795983 - RNA, 22 nt, Salmonella typhimurium LT2
uaacgcacuaccagaaacaaca

SEQ ID NO: 3795984 - RNA, 13 nt, Salmonella typhimurium LT2
uaacgcaucgcgg

SEQ ID NO: 3795985 - RNA, 17 nt, Salmonella typhimurium LT2
uaacgcauguuccgcua

SEQ ID NO: 3795986 - RNA, 14 nt, Salmonella typhimurium LT2
uaacgccgccgccu

SEQ ID NO: 3795987 - RNA, 21 nt, Salmonella typhimurium LT2
uaacgccuucgcaaagugcca

SEQ ID NO: 3795988 - RNA, 17 nt, Salmonella typhimurium LT2
uaacgcgaaaaaaagau

SEQ ID NO: 3795989 - RNA, 19 nt, Salmonella typhimurium LT2
uaacgcgaauccgccauag

SEQ ID NO: 3795990 - RNA, 20 nt, Salmonella typhimurium LT2
uaacgcgaauccgccauagc

SEQ ID NO: 3795991 - RNA, 13 nt, Salmonella typhimurium LT2
uaacgcgccaucu

SEQ ID NO: 3795992 - RNA, 16 nt, Salmonella typhimurium LT2
uaacgcgccaucuuuc

SEQ ID NO: 3795993 - RNA, 23 nt, Salmonella typhimurium LT2
uaacgcgccaucuuucacccauu

SEQ ID NO: 3795994 - RNA, 17 nt, Salmonella typhimurium LT2
uaacgcgccaugcgcgg

SEQ ID NO: 3795995 - RNA, 13 nt, Salmonella typhimurium LT2
uaacgcgccccag

SEQ ID NO: 3795996 - RNA, 15 nt, Salmonella typhimurium LT2
uaacggaugaaagcc

SEQ ID NO: 3795997 - RNA, 23 nt, Salmonella typhimurium LT2
uaacggcgacaggcacaacaaua

SEQ ID NO: 3795998 - RNA, 20 nt, Salmonella typhimurium LT2
uaacggcgcgaaagcgccuu

SEQ ID NO: 3795999 - RNA, 22 nt, Salmonella typhimurium LT2
uaacggcugacgcccaucagca

SEQ ID NO: 3796000 - RNA, 23 nt, Salmonella typhimurium LT2
uaacggcugacgcccaucagcau

SEQ ID NO: 3796001 - RNA, 20 nt, Salmonella typhimurium LT2
uaacgggugaucuuuauaaa

SEQ ID NO: 3796002 - RNA, 15 nt, Salmonella typhimurium LT2
uaacguacagguugu

SEQ ID NO: 3796003 - RNA, 13 nt, Salmonella typhimurium LT2
uaacgucaucauc

SEQ ID NO: 3796004 - RNA, 22 nt, Salmonella typhimurium LT2
uaacgucgcgguuacagucuuu

SEQ ID NO: 3796005 - RNA, 15 nt, Salmonella typhimurium LT2
uaacgucgucauuca

SEQ ID NO: 3796006 - RNA, 19 nt, Salmonella typhimurium LT2
uaacgugcgcuggaacgcg

SEQ ID NO: 3796007 - RNA, 21 nt, Salmonella typhimurium LT2
uaacgugcgguauaucacgcc

SEQ ID NO: 3796008 - RNA, 17 nt, Salmonella typhimurium LT2
uaacgugcuccagcgcc

SEQ ID NO: 3796009 - RNA, 16 nt, Salmonella typhimurium LT2
uaauacgcuugcgcca

SEQ ID NO: 3796010 - RNA, 19 nt, Salmonella typhimurium LT2
uaauacggagcaaaaaacg

SEQ ID NO: 3796011 - RNA, 19 nt, Salmonella typhimurium LT2
uaauacguacugaaauaac

SEQ ID NO: 3796012 - RNA, 23 nt, Salmonella typhimurium LT2
uaauacgucgugacccacacaua

SEQ ID NO: 3796013 - RNA, 19 nt, Salmonella typhimurium LT2
uaauacguuuauucuuuuc

SEQ ID NO: 3796014 - RNA, 15 nt, Salmonella typhimurium LT2
uaauacuggcgccuu

SEQ ID NO: 3796015 - RNA, 21 nt, Salmonella typhimurium LT2
uaauagagauccuggcgaaag

SEQ ID NO: 3796016 - RNA, 20 nt, Salmonella typhimurium LT2
uaauauaaccaauuuaaaau

SEQ ID NO: 3796017 - RNA, 21 nt, Salmonella typhimurium LT2
uaauauaugaaccaagauaag

SEQ ID NO: 3796018 - RNA, 14 nt, Salmonella typhimurium LT2
uaauaucaauucca

SEQ ID NO: 3796019 - RNA, 13 nt, Salmonella typhimurium LT2
uaauauccagcac

SEQ ID NO: 3796020 - RNA, 13 nt, Salmonella typhimurium LT2
uaauauccaguga

SEQ ID NO: 3796021 - RNA, 22 nt, Salmonella typhimurium LT2
uaauaugccaggcuuccugcgc

SEQ ID NO: 3796022 - RNA, 24 nt, Salmonella typhimurium LT2
uaauaugccaggcuuccugcgcug

SEQ ID NO: 3796023 - RNA, 17 nt, Salmonella typhimurium LT2
uaauaugcgcaaucacc

SEQ ID NO: 3796024 - RNA, 19 nt, Salmonella typhimurium LT2
uaauaugcucaacuuccag

SEQ ID NO: 3796025 - RNA, 15 nt, Salmonella typhimurium LT2
uaauauuaaaaccau

SEQ ID NO: 3796026 - RNA, 17 nt, Salmonella typhimurium LT2
uaauauuaaaaccauug

SEQ ID NO: 3796027 - RNA, 14 nt, Salmonella typhimurium LT2
uaauauuaagcagc

SEQ ID NO: 3796028 - RNA, 20 nt, Salmonella typhimurium LT2
uaauauuaagcagcuuaucg

SEQ ID NO: 3796029 - RNA, 16 nt, Salmonella typhimurium LT2
uaauauuaucagcaau

SEQ ID NO: 3796030 - RNA, 17 nt, Salmonella typhimurium LT2
uaauauuaucagcaaua

SEQ ID NO: 3796031 - RNA, 13 nt, Salmonella typhimurium LT2
uaauauuauugac

SEQ ID NO: 3796032 - RNA, 15 nt, Salmonella typhimurium LT2
uaauauugccauucg

SEQ ID NO: 3796033 - RNA, 15 nt, Salmonella typhimurium LT2
uaaucaacucuccuu

SEQ ID NO: 3796034 - RNA, 21 nt, Salmonella typhimurium LT2
uaaucaacugcgccacaucau

SEQ ID NO: 3796035 - RNA, 14 nt, Salmonella typhimurium LT2
uaaucaccaccuca

SEQ ID NO: 3796036 - RNA, 14 nt, Salmonella typhimurium LT2
uaaucaccagcccg

SEQ ID NO: 3796037 - RNA, 17 nt, Salmonella typhimurium LT2
uaaucacccgcgccagc

SEQ ID NO: 3796038 - RNA, 16 nt, Salmonella typhimurium LT2
uaaucacgucauuaaa

SEQ ID NO: 3796039 - RNA, 12 nt, Salmonella typhimurium LT2
uaaucagcagcg

SEQ ID NO: 3796040 - RNA, 15 nt, Salmonella typhimurium LT2
uaaucagcaucaccu

SEQ ID NO: 3796041 - RNA, 18 nt, Salmonella typhimurium LT2
uaaucaggagggcugccc

SEQ ID NO: 3796042 - RNA, 15 nt, Salmonella typhimurium LT2
uaaucaugaacgcua

SEQ ID NO: 3796043 - RNA, 19 nt, Salmonella typhimurium LT2
uaauccacauccaaccgcu

SEQ ID NO: 3796044 - RNA, 21 nt, Salmonella typhimurium LT2
uaauccacgccaauaaucaga

SEQ ID NO: 3796045 - RNA, 21 nt, Salmonella typhimurium LT2
uaauccagaggguaauuucuu

SEQ ID NO: 3796046 - RNA, 18 nt, Salmonella typhimurium LT2
uaauccaggaauuuuccc

SEQ ID NO: 3796047 - RNA, 19 nt, Salmonella typhimurium LT2
uaauccaggaauuuuccca

SEQ ID NO: 3796048 - RNA, 15 nt, Salmonella typhimurium LT2
uaauccauuacgcag

SEQ ID NO: 3796049 - RNA, 17 nt, Salmonella typhimurium LT2
uaaucccaaaauuuacc

SEQ ID NO: 3796050 - RNA, 18 nt, Salmonella typhimurium LT2
uaaucccuucuuuuacug

SEQ ID NO: 3796051 - RNA, 22 nt, Salmonella typhimurium LT2
uaaucccuugcuggcgacggcg

SEQ ID NO: 3796052 - RNA, 12 nt, Salmonella typhimurium LT2
uaauccggcaau

SEQ ID NO: 3796053 - RNA, 18 nt, Salmonella typhimurium LT2
uaauccgugaauguccug

SEQ ID NO: 3796054 - RNA, 22 nt, Salmonella typhimurium LT2
uaauccuuguccauguaaacuc

SEQ ID NO: 3796055 - RNA, 14 nt, Salmonella typhimurium LT2
uaaucgaaucgccu

SEQ ID NO: 3796056 - RNA, 15 nt, Salmonella typhimurium LT2
uaaucgaaucgccuc

SEQ ID NO: 3796057 - RNA, 16 nt, Salmonella typhimurium LT2
uaaucgaaucgccuca

SEQ ID NO: 3796058 - RNA, 20 nt, Salmonella typhimurium LT2
uaaucgaaucgccucaacca

SEQ ID NO: 3796059 - RNA, 21 nt, Salmonella typhimurium LT2
uaaucgagacuguuugacacu

SEQ ID NO: 3796060 - RNA, 16 nt, Salmonella typhimurium LT2
uaaucgauaagccagc

SEQ ID NO: 3796061 - RNA, 13 nt, Salmonella typhimurium LT2
uaaucgaucccgc

SEQ ID NO: 3796062 - RNA, 15 nt, Salmonella typhimurium LT2
uaaucgccagcagcg

SEQ ID NO: 3796063 - RNA, 21 nt, Salmonella typhimurium LT2
uaaucgcccugcgguagcgcc

SEQ ID NO: 3796064 - RNA, 17 nt, Salmonella typhimurium LT2
uaaucggcgucauuuua

SEQ ID NO: 3796065 - RNA, 22 nt, Salmonella typhimurium LT2
uaaucguauucauugccguaaa

SEQ ID NO: 3796066 - RNA, 17 nt, Salmonella typhimurium LT2
uaaucgucccacaugaa

SEQ ID NO: 3796067 - RNA, 21 nt, Salmonella typhimurium LT2
uaaucgucccacaugaacucg

SEQ ID NO: 3796068 - RNA, 15 nt, Salmonella typhimurium LT2
uaaucguguaaucuu

SEQ ID NO: 3796069 - RNA, 23 nt, Salmonella typhimurium LT2
uaaucguuagcgagguucccgcc

SEQ ID NO: 3796070 - RNA, 16 nt, Salmonella typhimurium LT2
uaaucucacaaauauc

SEQ ID NO: 3796071 - RNA, 23 nt, Salmonella typhimurium LT2
uaaucucgguacgccaaaucugu

SEQ ID NO: 3796072 - RNA, 22 nt, Salmonella typhimurium LT2
uaaucugaaagacaugcaaugc

SEQ ID NO: 3796073 - RNA, 19 nt, Salmonella typhimurium LT2
uaaucugucgcuaaagcac

SEQ ID NO: 3796074 - RNA, 14 nt, Salmonella typhimurium LT2
uaaucuuuucauau

SEQ ID NO: 3796075 - RNA, 13 nt, Salmonella typhimurium LT2
uaaugacauccag

SEQ ID NO: 3796076 - RNA, 23 nt, Salmonella typhimurium LT2
uaaugagccagauggauaaccug

SEQ ID NO: 3796077 - RNA, 21 nt, Salmonella typhimurium LT2
uaaugaucagcaaaauagugu

SEQ ID NO: 3796078 - RNA, 13 nt, Salmonella typhimurium LT2
uaaugaucagcgc

SEQ ID NO: 3796079 - RNA, 14 nt, Salmonella typhimurium LT2
uaaugaucagcgcu

SEQ ID NO: 3796080 - RNA, 22 nt, Salmonella typhimurium LT2
uaaugaucaugcugcaccgcau

SEQ ID NO: 3796081 - RNA, 16 nt, Salmonella typhimurium LT2
uaaugauuguccagcc

SEQ ID NO: 3796082 - RNA, 19 nt, Salmonella typhimurium LT2
uaaugcaggcagcacugcu

SEQ ID NO: 3796083 - RNA, 22 nt, Salmonella typhimurium LT2
uaaugcccggcccgucaucuuc

SEQ ID NO: 3796084 - RNA, 16 nt, Salmonella typhimurium LT2
uaaugcccggcguaug

SEQ ID NO: 3796085 - RNA, 21 nt, Salmonella typhimurium LT2
uaaugccucauuaaaaaaaca

SEQ ID NO: 3796086 - RNA, 20 nt, Salmonella typhimurium LT2
uaaugcgaaaauaaaggugc

SEQ ID NO: 3796087 - RNA, 15 nt, Salmonella typhimurium LT2
uaaugcgugagcagg

SEQ ID NO: 3796088 - RNA, 16 nt, Salmonella typhimurium LT2
uaaugcuaucccaggc

SEQ ID NO: 3796089 - RNA, 14 nt, Salmonella typhimurium LT2
uaaugcucaacucu

SEQ ID NO: 3796090 - RNA, 16 nt, Salmonella typhimurium LT2
uaaugcuuaauucaua

SEQ ID NO: 3796091 - RNA, 16 nt, Salmonella typhimurium LT2
uaaugcuuuccagcca

SEQ ID NO: 3796092 - RNA, 11 nt, Salmonella typhimurium LT2
uaaugcuuuug

SEQ ID NO: 3796093 - RNA, 18 nt, Salmonella typhimurium LT2
uaauggcagaauaaaaca

SEQ ID NO: 3796094 - RNA, 18 nt, Salmonella typhimurium LT2
uaauggccaccagcacaa

SEQ ID NO: 3796095 - RNA, 12 nt, Salmonella typhimurium LT2
uaauggcccagc

SEQ ID NO: 3796096 - RNA, 17 nt, Salmonella typhimurium LT2
uaauggcgccgauaaca

SEQ ID NO: 3796097 - RNA, 12 nt, Salmonella typhimurium LT2
uaauggcgucaa

SEQ ID NO: 3796098 - RNA, 13 nt, Salmonella typhimurium LT2
uaauggcgucaau

SEQ ID NO: 3796099 - RNA, 21 nt, Salmonella typhimurium LT2
uaauggucagaucugcgccca

SEQ ID NO: 3796100 - RNA, 19 nt, Salmonella typhimurium LT2
uaaugguggaaugccccag

SEQ ID NO: 3796101 - RNA, 20 nt, Salmonella typhimurium LT2
uaaugguugugccaguaauc

SEQ ID NO: 3796102 - RNA, 17 nt, Salmonella typhimurium LT2
uaauguaaaaaaauaaa

SEQ ID NO: 3796103 - RNA, 18 nt, Salmonella typhimurium LT2
uaauguaaaaaaauaaaa

SEQ ID NO: 3796104 - RNA, 17 nt, Salmonella typhimurium LT2
uaaugucgacauaauuu

SEQ ID NO: 3796105 - RNA, 16 nt, Salmonella typhimurium LT2
uaaugucuggugcagc

SEQ ID NO: 3796106 - RNA, 19 nt, Salmonella typhimurium LT2
uaaugucuggugcagcaag

SEQ ID NO: 3796107 - RNA, 21 nt, Salmonella typhimurium LT2
uaaugugaugcagacgggcgu

SEQ ID NO: 3796108 - RNA, 18 nt, Salmonella typhimurium LT2
uaauguucaguuuuucca

SEQ ID NO: 3796109 - RNA, 20 nt, Salmonella typhimurium LT2
uaauguugauaucacucaga

SEQ ID NO: 3796110 - RNA, 17 nt, Salmonella typhimurium LT2
uaauguuuucugccagc

SEQ ID NO: 3796111 - RNA, 15 nt, Salmonella typhimurium LT2
uaauuaaaaagagaa

SEQ ID NO: 3796112 - RNA, 19 nt, Salmonella typhimurium LT2
uaauuaaaaagagaaaaaa

SEQ ID NO: 3796113 - RNA, 14 nt, Salmonella typhimurium LT2
uacaggugcagggc

SEQ ID NO: 3796114 - RNA, 22 nt, Salmonella typhimurium LT2
uacagguugugcaucuccugac

SEQ ID NO: 3796115 - RNA, 19 nt, Salmonella typhimurium LT2
uacaguguaaaaauuuuug

SEQ ID NO: 3796116 - RNA, 17 nt, Salmonella typhimurium LT2
uacaguuugucaucagu

SEQ ID NO: 3796117 - RNA, 16 nt, Salmonella typhimurium LT2
uacauaccacgcagcg

SEQ ID NO: 3796118 - RNA, 13 nt, Salmonella typhimurium LT2
uacauagcaggcc

SEQ ID NO: 3796119 - RNA, 22 nt, Salmonella typhimurium LT2
uacauaguucuggcuuugcgcc

SEQ ID NO: 3796120 - RNA, 17 nt, Salmonella typhimurium LT2
uacauaucauuauguca

SEQ ID NO: 3796121 - RNA, 22 nt, Salmonella typhimurium LT2
uacauaucauuaugucauagca

SEQ ID NO: 3796122 - RNA, 21 nt, Salmonella typhimurium LT2
uacauaucuguuuggcaaggg

SEQ ID NO: 3796123 - RNA, 16 nt, Salmonella typhimurium LT2
uacaucagaaaacagc

SEQ ID NO: 3796124 - RNA, 18 nt, Salmonella typhimurium LT2
uacaucguaaagcaccau

SEQ ID NO: 3796125 - RNA, 19 nt, Salmonella typhimurium LT2
uacaucucgaguaaucacu

SEQ ID NO: 3796126 - RNA, 12 nt, Salmonella typhimurium LT2
uacaucuuccau

SEQ ID NO: 3796127 - RNA, 18 nt, Salmonella typhimurium LT2
uacaucuuccauuuuggu

SEQ ID NO: 3796128 - RNA, 19 nt, Salmonella typhimurium LT2
uacaugaaaaauagacaca

SEQ ID NO: 3796129 - RNA, 13 nt, Salmonella typhimurium LT2
uacauuaauguca

SEQ ID NO: 3796130 - RNA, 16 nt, Salmonella typhimurium LT2
uacauucaaacggcug

SEQ ID NO: 3796131 - RNA, 19 nt, Salmonella typhimurium LT2
uacauucgauggccgacua

SEQ ID NO: 3796132 - RNA, 10 nt, Salmonella typhimurium LT2
uacauucugu

SEQ ID NO: 3796133 - RNA, 14 nt, Salmonella typhimurium LT2
uacauuuuuuucuu

SEQ ID NO: 3796134 - RNA, 21 nt, Salmonella typhimurium LT2
uaccaaagucaucaauugcca

SEQ ID NO: 3796135 - RNA, 15 nt, Salmonella typhimurium LT2
uaccaaauauuucuu

SEQ ID NO: 3796136 - RNA, 15 nt, Salmonella typhimurium LT2
uaccaacguaaauua

SEQ ID NO: 3796137 - RNA, 16 nt, Salmonella typhimurium LT2
uaccaacugcugcgua

SEQ ID NO: 3796138 - RNA, 21 nt, Salmonella typhimurium LT2
uaccaauaagaacuuuaucac

SEQ ID NO: 3796139 - RNA, 14 nt, Salmonella typhimurium LT2
uaccaauacccagc

SEQ ID NO: 3796140 - RNA, 15 nt, Salmonella typhimurium LT2
uaccaauacccagcg

SEQ ID NO: 3796141 - RNA, 17 nt, Salmonella typhimurium LT2
uaccaauacccagcgcc

SEQ ID NO: 3796142 - RNA, 15 nt, Salmonella typhimurium LT2
uaccaauaucgccgu

SEQ ID NO: 3796143 - RNA, 18 nt, Salmonella typhimurium LT2
uaccaauauuaauguauu

SEQ ID NO: 3796144 - RNA, 19 nt, Salmonella typhimurium LT2
uaccacaaaaccguugucg

SEQ ID NO: 3796145 - RNA, 22 nt, Salmonella typhimurium LT2
uaccacaaauuuugauaaaaac

SEQ ID NO: 3796146 - RNA, 14 nt, Salmonella typhimurium LT2
uaccacaacaagaa

SEQ ID NO: 3796147 - RNA, 11 nt, Salmonella typhimurium LT2
uaccacaucag

SEQ ID NO: 3796148 - RNA, 16 nt, Salmonella typhimurium LT2
uaccaccugccaaagc

SEQ ID NO: 3796149 - RNA, 12 nt, Salmonella typhimurium LT2
uaccacgccgcu

SEQ ID NO: 3796150 - RNA, 14 nt, Salmonella typhimurium LT2
uaccacuaauuuaa

SEQ ID NO: 3796151 - RNA, 13 nt, Salmonella typhimurium LT2
uaccagacacagu

SEQ ID NO: 3796152 - RNA, 17 nt, Salmonella typhimurium LT2
uaccagaccggcaucuc

SEQ ID NO: 3796153 - RNA, 17 nt, Salmonella typhimurium LT2
uaccagauuaauaauag

SEQ ID NO: 3796154 - RNA, 13 nt, Salmonella typhimurium LT2
uaccagcaauaac

SEQ ID NO: 3796155 - RNA, 11 nt, Salmonella typhimurium LT2
uaccagcaccu

SEQ ID NO: 3796156 - RNA, 19 nt, Salmonella typhimurium LT2
uaccagccuggcugaacca

SEQ ID NO: 3796157 - RNA, 16 nt, Salmonella typhimurium LT2
uaccagcgaaaugcga

SEQ ID NO: 3796158 - RNA, 17 nt, Salmonella typhimurium LT2
uaccagcgauaguuguu

SEQ ID NO: 3796159 - RNA, 19 nt, Salmonella typhimurium LT2
uaccagcgcgaacauuaca

SEQ ID NO: 3796160 - RNA, 23 nt, Salmonella typhimurium LT2
uaccagcgcgaacauuacauccu

SEQ ID NO: 3796161 - RNA, 15 nt, Salmonella typhimurium LT2
uaccagcgcggcgcc

SEQ ID NO: 3796162 - RNA, 18 nt, Salmonella typhimurium LT2
uaccagcgcuauccaggc

SEQ ID NO: 3796163 - RNA, 21 nt, Salmonella typhimurium LT2
uaccagcggucauugagccac

SEQ ID NO: 3796164 - RNA, 10 nt, Salmonella typhimurium LT2
uaccaggcac

SEQ ID NO: 3796165 - RNA, 19 nt, Salmonella typhimurium LT2
uaccaggcggcuuuuucau

SEQ ID NO: 3796166 - RNA, 14 nt, Salmonella typhimurium LT2
uaccaggcggucug

SEQ ID NO: 3796167 - RNA, 18 nt, Salmonella typhimurium LT2
uaccaguacaacaauugu

SEQ ID NO: 3796168 - RNA, 18 nt, Salmonella typhimurium LT2
uaccaguacaauuucugg

SEQ ID NO: 3796169 - RNA, 22 nt, Salmonella typhimurium LT2
uaccaguuggucgcguuuaccu

SEQ ID NO: 3796170 - RNA, 14 nt, Salmonella typhimurium LT2
uaccauaccaggcg

SEQ ID NO: 3796171 - RNA, 22 nt, Salmonella typhimurium LT2
uaccauaccggugcgccccagc

SEQ ID NO: 3796172 - RNA, 19 nt, Salmonella typhimurium LT2
uaccaucuacuaucaucug

SEQ ID NO: 3796173 - RNA, 14 nt, Salmonella typhimurium LT2
uaccaugauucaua

SEQ ID NO: 3796174 - RNA, 20 nt, Salmonella typhimurium LT2
uaccauugcccauucguaau

SEQ ID NO: 3796175 - RNA, 14 nt, Salmonella typhimurium LT2
uacccaaaauaauu

SEQ ID NO: 3796176 - RNA, 16 nt, Salmonella typhimurium LT2
uacccaacgcaaugcg

SEQ ID NO: 3796177 - RNA, 20 nt, Salmonella typhimurium LT2
uacccaccggaccgccgagc

SEQ ID NO: 3796178 - RNA, 18 nt, Salmonella typhimurium LT2
uacccagcgaaugcugca

SEQ ID NO: 3796179 - RNA, 21 nt, Salmonella typhimurium LT2
uacccagcgggugaugcgcca

SEQ ID NO: 3796180 - RNA, 13 nt, Salmonella typhimurium LT2
uacccaguaccau

SEQ ID NO: 3796181 - RNA, 18 nt, Salmonella typhimurium LT2
uacccaguaccauaccgg

SEQ ID NO: 3796182 - RNA, 18 nt, Salmonella typhimurium LT2
uacccaguuuaccaaaca

SEQ ID NO: 3796183 - RNA, 17 nt, Salmonella typhimurium LT2
uaccccacgccauaaug

SEQ ID NO: 3796184 - RNA, 16 nt, Salmonella typhimurium LT2
uaccccgccaccgccg

SEQ ID NO: 3796185 - RNA, 15 nt, Salmonella typhimurium LT2
uaccccgccagcagg

SEQ ID NO: 3796186 - RNA, 23 nt, Salmonella typhimurium LT2
uaccccgccugacgaaaaucauc

SEQ ID NO: 3796187 - RNA, 14 nt, Salmonella typhimurium LT2
uaccccucuuucac

SEQ ID NO: 3796188 - RNA, 21 nt, Salmonella typhimurium LT2
uaccccuuuuucaauuuccag

SEQ ID NO: 3796189 - RNA, 19 nt, Salmonella typhimurium LT2
uacccgauaccgccagccc

SEQ ID NO: 3796190 - RNA, 18 nt, Salmonella typhimurium LT2
uacccgcaguagcuaaug

SEQ ID NO: 3796191 - RNA, 19 nt, Salmonella typhimurium LT2
uacccgccgauaaacgcgu

SEQ ID NO: 3796192 - RNA, 15 nt, Salmonella typhimurium LT2
uacccgcguuuucuc

SEQ ID NO: 3796193 - RNA, 17 nt, Salmonella typhimurium LT2
uacccggccuacacauc

SEQ ID NO: 3796194 - RNA, 21 nt, Salmonella typhimurium LT2
uacccggcgcaaacaguacgc

SEQ ID NO: 3796195 - RNA, 21 nt, Salmonella typhimurium LT2
uacccgguacuuucuccaugc

SEQ ID NO: 3796196 - RNA, 21 nt, Salmonella typhimurium LT2
uacccucccuuucuucucaac

SEQ ID NO: 3796197 - RNA, 14 nt, Salmonella typhimurium LT2
uacccuucaugcag

SEQ ID NO: 3796198 - RNA, 19 nt, Salmonella typhimurium LT2
uacccuuuucuuuaaacaa

SEQ ID NO: 3796199 - RNA, 18 nt, Salmonella typhimurium LT2
uaccgaaaauagccugaa

SEQ ID NO: 3796200 - RNA, 15 nt, Salmonella typhimurium LT2
uaccgaaaucaucaa

SEQ ID NO: 3796201 - RNA, 17 nt, Salmonella typhimurium LT2
uaccgaaaucgguacgc

SEQ ID NO: 3796202 - RNA, 20 nt, Salmonella typhimurium LT2
uaccgaaaucgguacgcguc

SEQ ID NO: 3796203 - RNA, 21 nt, Salmonella typhimurium LT2
uaccgaacaaugugcgggggu

SEQ ID NO: 3796204 - RNA, 18 nt, Salmonella typhimurium LT2
uaccgauaaaucaaacgc

SEQ ID NO: 3796205 - RNA, 19 nt, Salmonella typhimurium LT2
uaccgauaauuaagccggu

SEQ ID NO: 3796206 - RNA, 17 nt, Salmonella typhimurium LT2
uaccgauagcgcggaau

SEQ ID NO: 3796207 - RNA, 23 nt, Salmonella typhimurium LT2
uaccgauuguuuggugcugaaau

SEQ ID NO: 3796208 - RNA, 13 nt, Salmonella typhimurium LT2
uaccgcacaucac

SEQ ID NO: 3796209 - RNA, 13 nt, Salmonella typhimurium LT2
uaccgccaaucaa

SEQ ID NO: 3796210 - RNA, 18 nt, Salmonella typhimurium LT2
uaccgccaaucaacgccg

SEQ ID NO: 3796211 - RNA, 20 nt, Salmonella typhimurium LT2
uaccgccuuguccggccuaa

SEQ ID NO: 3796212 - RNA, 19 nt, Salmonella typhimurium LT2
uaccgcgaugugcugggga

SEQ ID NO: 3796213 - RNA, 20 nt, Salmonella typhimurium LT2
uaccgcgcaguucaauauuc

SEQ ID NO: 3796214 - RNA, 22 nt, Salmonella typhimurium LT2
uaccgcgcaguucaauauucac

SEQ ID NO: 3796215 - RNA, 22 nt, Salmonella typhimurium LT2
uaccgcgguauuuaccgaacgg

SEQ ID NO: 3796216 - RNA, 15 nt, Salmonella typhimurium LT2
uaccgcuaaaauacc

SEQ ID NO: 3796217 - RNA, 17 nt, Salmonella typhimurium LT2
uacgcgcugaccuucag

SEQ ID NO: 3796218 - RNA, 22 nt, Salmonella typhimurium LT2
uacgcggcgcgcucuuuuucuu

SEQ ID NO: 3796219 - RNA, 16 nt, Salmonella typhimurium LT2
uacgcgggguaaaaug

SEQ ID NO: 3796220 - RNA, 17 nt, Salmonella typhimurium LT2
uacgcggucuuuuaaaa

SEQ ID NO: 3796221 - RNA, 14 nt, Salmonella typhimurium LT2
uacgcgucaauuac

SEQ ID NO: 3796222 - RNA, 10 nt, Salmonella typhimurium LT2
uacgcgucac

SEQ ID NO: 3796223 - RNA, 16 nt, Salmonella typhimurium LT2
uacgcgucacaaucgc

SEQ ID NO: 3796224 - RNA, 13 nt, Salmonella typhimurium LT2
uacgcucgaaagc

SEQ ID NO: 3796225 - RNA, 20 nt, Salmonella typhimurium LT2
uacgcugaagauuuuuauuc

SEQ ID NO: 3796226 - RNA, 14 nt, Salmonella typhimurium LT2
uacgcugacgcgau

SEQ ID NO: 3796227 - RNA, 14 nt, Salmonella typhimurium LT2
uacgcugcaaaaag

SEQ ID NO: 3796228 - RNA, 21 nt, Salmonella typhimurium LT2
uacgcugcaacccgccgccau

SEQ ID NO: 3796229 - RNA, 16 nt, Salmonella typhimurium LT2
uacgcuuaucaggccu

SEQ ID NO: 3796230 - RNA, 19 nt, Salmonella typhimurium LT2
uacgcuuaucaggccuaca

SEQ ID NO: 3796231 - RNA, 14 nt, Salmonella typhimurium LT2
uacgcuucauaucc

SEQ ID NO: 3796232 - RNA, 16 nt, Salmonella typhimurium LT2
uacgcuucucacggau

SEQ ID NO: 3796233 - RNA, 17 nt, Salmonella typhimurium LT2
uacgcuugcgccagcau

SEQ ID NO: 3796234 - RNA, 14 nt, Salmonella typhimurium LT2
uacggaaaaaauac

SEQ ID NO: 3796235 - RNA, 19 nt, Salmonella typhimurium LT2
uacggacgauacaccuuca

SEQ ID NO: 3796236 - RNA, 20 nt, Salmonella typhimurium LT2
uacggacgccagauaaucac

SEQ ID NO: 3796237 - RNA, 18 nt, Salmonella typhimurium LT2
uacggacguggggguuca

SEQ ID NO: 3796238 - RNA, 12 nt, Salmonella typhimurium LT2
uacggagaaauu

SEQ ID NO: 3796239 - RNA, 21 nt, Salmonella typhimurium LT2
uacggauaccguccaccagca

SEQ ID NO: 3796240 - RNA, 16 nt, Salmonella typhimurium LT2
uacggauguacucauc

SEQ ID NO: 3796241 - RNA, 14 nt, Salmonella typhimurium LT2
uacggcccagaccc

SEQ ID NO: 3796242 - RNA, 20 nt, Salmonella typhimurium LT2
uacggcccguacugaacccg

SEQ ID NO: 3796243 - RNA, 20 nt, Salmonella typhimurium LT2
uacggcguuucacuucugag

SEQ ID NO: 3796244 - RNA, 22 nt, Salmonella typhimurium LT2
uacggcugaaucucgccuggcu

SEQ ID NO: 3796245 - RNA, 13 nt, Salmonella typhimurium LT2
uacggcuuccacu

SEQ ID NO: 3796246 - RNA, 20 nt, Salmonella typhimurium LT2
uacggcuuucacaccguuau

SEQ ID NO: 3796247 - RNA, 21 nt, Salmonella typhimurium LT2
uacgggagagcguauccagca

SEQ ID NO: 3796248 - RNA, 20 nt, Salmonella typhimurium LT2
uacgggcuuuugcgccgaaa

SEQ ID NO: 3796249 - RNA, 14 nt, Salmonella typhimurium LT2
uacgguacugccca

SEQ ID NO: 3796250 - RNA, 21 nt, Salmonella typhimurium LT2
uacggucaaggaaccaacggu

SEQ ID NO: 3796251 - RNA, 22 nt, Salmonella typhimurium LT2
uacggugaauauuugcgcuagu

SEQ ID NO: 3796252 - RNA, 15 nt, Salmonella typhimurium LT2
uacguaacaugaccu

SEQ ID NO: 3796253 - RNA, 14 nt, Salmonella typhimurium LT2
uacguaauaaaauu

SEQ ID NO: 3796254 - RNA, 21 nt, Salmonella typhimurium LT2
uacguacccgcucggcauaca

SEQ ID NO: 3796255 - RNA, 19 nt, Salmonella typhimurium LT2
uacguagccgcaaaugcca

SEQ ID NO: 3796256 - RNA, 18 nt, Salmonella typhimurium LT2
uacguaguccggcaauga

SEQ ID NO: 3796257 - RNA, 22 nt, Salmonella typhimurium LT2
uacgucaaaaacagaucgcagg

SEQ ID NO: 3796258 - RNA, 16 nt, Salmonella typhimurium LT2
uacgucauaucaucca

SEQ ID NO: 3796259 - RNA, 17 nt, Salmonella typhimurium LT2
uacgucauaucauccag

SEQ ID NO: 3796260 - RNA, 23 nt, Salmonella typhimurium LT2
uacgucgcacggaucaucuaccc

SEQ ID NO: 3796261 - RNA, 23 nt, Salmonella typhimurium LT2
uacgugccgccguuuugucuaua

SEQ ID NO: 3796262 - RNA, 13 nt, Salmonella typhimurium LT2
uacguucaaauug

SEQ ID NO: 3796263 - RNA, 15 nt, Salmonella typhimurium LT2
uacguucaucaggcc

SEQ ID NO: 3796264 - RNA, 19 nt, Salmonella typhimurium LT2
uacguucaucaggccugca

SEQ ID NO: 3796265 - RNA, 13 nt, Salmonella typhimurium LT2
uacguuccagcag

SEQ ID NO: 3796266 - RNA, 23 nt, Salmonella typhimurium LT2
uacguucccggggauuugcugcg

SEQ ID NO: 3796267 - RNA, 21 nt, Salmonella typhimurium LT2
uacguuuauccccgucauacu

SEQ ID NO: 3796268 - RNA, 12 nt, Salmonella typhimurium LT2
uacguuuauucu

SEQ ID NO: 3796269 - RNA, 16 nt, Salmonella typhimurium LT2
uacguuuauucuuuuc

SEQ ID NO: 3796270 - RNA, 16 nt, Salmonella typhimurium LT2
uacguuuuaauaauuu

SEQ ID NO: 3796271 - RNA, 13 nt, Salmonella typhimurium LT2
uacuaaaaguaaa

SEQ ID NO: 3796272 - RNA, 16 nt, Salmonella typhimurium LT2
uacuaaaaguaaauaa

SEQ ID NO: 3796273 - RNA, 16 nt, Salmonella typhimurium LT2
uacuaaauaggcggca

SEQ ID NO: 3796274 - RNA, 21 nt, Salmonella typhimurium LT2
uacuaaucucacccauagaua

SEQ ID NO: 3796275 - RNA, 20 nt, Salmonella typhimurium LT2
uacuauacccgcguuuucuc

SEQ ID NO: 3796276 - RNA, 14 nt, Salmonella typhimurium LT2
uacuauaggaucug

SEQ ID NO: 3796277 - RNA, 15 nt, Salmonella typhimurium LT2
uacuaucccauuuuu

SEQ ID NO: 3796278 - RNA, 16 nt, Salmonella typhimurium LT2
uacuaucuucaaaacc

SEQ ID NO: 3796279 - RNA, 11 nt, Salmonella typhimurium LT2
uacuauuuccu

SEQ ID NO: 3796280 - RNA, 13 nt, Salmonella typhimurium LT2
uacuauuuuucac

SEQ ID NO: 3796281 - RNA, 19 nt, Salmonella typhimurium LT2
uacucacgacuuucaccag

SEQ ID NO: 3796282 - RNA, 20 nt, Salmonella typhimurium LT2
uacucacgacuuucaccaga

SEQ ID NO: 3796283 - RNA, 18 nt, Salmonella typhimurium LT2
uacucagaucggcagaca

SEQ ID NO: 3796284 - RNA, 20 nt, Salmonella typhimurium LT2
uacucagcacauucagagcg

SEQ ID NO: 3796285 - RNA, 16 nt, Salmonella typhimurium LT2
uacucagcgucaucac

SEQ ID NO: 3796286 - RNA, 22 nt, Salmonella typhimurium LT2
uacucagggcgaaaaugaucac

SEQ ID NO: 3796287 - RNA, 14 nt, Salmonella typhimurium LT2
uacuccacaguuca

SEQ ID NO: 3796288 - RNA, 12 nt, Salmonella typhimurium LT2
uacuccagccca

SEQ ID NO: 3796289 - RNA, 17 nt, Salmonella typhimurium LT2
uacuccgcuauaaaaau

SEQ ID NO: 3796290 - RNA, 14 nt, Salmonella typhimurium LT2
uacucgccaauauc

SEQ ID NO: 3796291 - RNA, 16 nt, Salmonella typhimurium LT2
uacucugcggagcaag

SEQ ID NO: 3796292 - RNA, 15 nt, Salmonella typhimurium LT2
uacucugcucgccag

SEQ ID NO: 3796293 - RNA, 13 nt, Salmonella typhimurium LT2
uacucuuccacca

SEQ ID NO: 3796294 - RNA, 21 nt, Salmonella typhimurium LT2
uacucuuggagagcaucaucu

SEQ ID NO: 3796295 - RNA, 13 nt, Salmonella typhimurium LT2
uacucuuguugug

SEQ ID NO: 3796296 - RNA, 19 nt, Salmonella typhimurium LT2
uacucuuugaacagccaga

SEQ ID NO: 3796297 - RNA, 22 nt, Salmonella typhimurium LT2
uacugaaaaguagcaagguaug

SEQ ID NO: 3796298 - RNA, 21 nt, Salmonella typhimurium LT2
uacugaacuauaggaaaauaa

SEQ ID NO: 3796299 - RNA, 22 nt, Salmonella typhimurium LT2
uacugaacuauaggaaaauaau

SEQ ID NO: 3796300 - RNA, 13 nt, Salmonella typhimurium LT2
uacugauuccugc

SEQ ID NO: 3796301 - RNA, 16 nt, Salmonella typhimurium LT2
uacugauuccugccag

SEQ ID NO: 3796302 - RNA, 17 nt, Salmonella typhimurium LT2
uacugauuuaacauguu

SEQ ID NO: 3796303 - RNA, 20 nt, Salmonella typhimurium LT2
uacugcaacgccagaugcgu

SEQ ID NO: 3796304 - RNA, 14 nt, Salmonella typhimurium LT2
uacugcaacgcgca

SEQ ID NO: 3796305 - RNA, 15 nt, Salmonella typhimurium LT2
uacugcaacgcgcau

SEQ ID NO: 3796306 - RNA, 15 nt, Salmonella typhimurium LT2
uacugcauuuucaau

SEQ ID NO: 3796307 - RNA, 18 nt, Salmonella typhimurium LT2
uacugcgcguggcaaaua

SEQ ID NO: 3796308 - RNA, 21 nt, Salmonella typhimurium LT2
uacugcgcucuaucaccgccc

SEQ ID NO: 3796309 - RNA, 21 nt, Salmonella typhimurium LT2
uacugcggguguccguuccug

SEQ ID NO: 3796310 - RNA, 18 nt, Salmonella typhimurium LT2
uacugcuuagcucaucag

SEQ ID NO: 3796311 - RNA, 18 nt, Salmonella typhimurium LT2
uacugcuuagcuguuacg

SEQ ID NO: 3796312 - RNA, 19 nt, Salmonella typhimurium LT2
uacuggauaaccgcuucga

SEQ ID NO: 3796313 - RNA, 21 nt, Salmonella typhimurium LT2
uacuggugcccgcaaaaccuu

SEQ ID NO: 3796314 - RNA, 16 nt, Salmonella typhimurium LT2
uacuguucuaccggcg

SEQ ID NO: 3796315 - RNA, 18 nt, Salmonella typhimurium LT2
uacuuaauucugcugccu

SEQ ID NO: 3796316 - RNA, 19 nt, Salmonella typhimurium LT2
uacuucguagacucaggcg

SEQ ID NO: 3796317 - RNA, 23 nt, Salmonella typhimurium LT2
uacuucuucaguuccgccagacu

SEQ ID NO: 3796318 - RNA, 23 nt, Salmonella typhimurium LT2
uacuugcgccgccauccggcgau

SEQ ID NO: 3796319 - RNA, 18 nt, Salmonella typhimurium LT2
uacuugcugcuaugaaaa

SEQ ID NO: 3796320 - RNA, 16 nt, Salmonella typhimurium LT2
uacuuguugagugaau

SEQ ID NO: 3796321 - RNA, 21 nt, Salmonella typhimurium LT2
uagcgccuuauccggccuacg

SEQ ID NO: 3796322 - RNA, 21 nt, Salmonella typhimurium LT2
uagcgccuucaggcaucagau

SEQ ID NO: 3796323 - RNA, 23 nt, Salmonella typhimurium LT2
uagcgcgguaucauugcugcugu

SEQ ID NO: 3796324 - RNA, 15 nt, Salmonella typhimurium LT2
uagcgcugaugcguu

SEQ ID NO: 3796325 - RNA, 17 nt, Salmonella typhimurium LT2
uagcgcuuaucccaguc

SEQ ID NO: 3796326 - RNA, 16 nt, Salmonella typhimurium LT2
uagcgggcaaugccac

SEQ ID NO: 3796327 - RNA, 23 nt, Salmonella typhimurium LT2
uagcgggcaaugccaccagcgcc

SEQ ID NO: 3796328 - RNA, 16 nt, Salmonella typhimurium LT2
uagcggguaaacagau

SEQ ID NO: 3796329 - RNA, 16 nt, Salmonella typhimurium LT2
uagcggguucuuucuu

SEQ ID NO: 3796330 - RNA, 14 nt, Salmonella typhimurium LT2
uagcgguuugacga

SEQ ID NO: 3796331 - RNA, 14 nt, Salmonella typhimurium LT2
uagcgucuaaauuu

SEQ ID NO: 3796332 - RNA, 18 nt, Salmonella typhimurium LT2
uagcgucucaucaaaaag

SEQ ID NO: 3796333 - RNA, 17 nt, Salmonella typhimurium LT2
uagcgucuuauccggcc

SEQ ID NO: 3796334 - RNA, 14 nt, Salmonella typhimurium LT2
uagcguucaucaau

SEQ ID NO: 3796335 - RNA, 22 nt, Salmonella typhimurium LT2
uagcguucaucaauauacuccc

SEQ ID NO: 3796336 - RNA, 14 nt, Salmonella typhimurium LT2
uagcguuggcguca

SEQ ID NO: 3796337 - RNA, 19 nt, Salmonella typhimurium LT2
uagcguuuaaaaagcugca

SEQ ID NO: 3796338 - RNA, 16 nt, Salmonella typhimurium LT2
uagcguuucgaacucu

SEQ ID NO: 3796339 - RNA, 14 nt, Salmonella typhimurium LT2
uagcguuuuccagc

SEQ ID NO: 3796340 - RNA, 13 nt, Salmonella typhimurium LT2
uagcuaaccagcg

SEQ ID NO: 3796341 - RNA, 16 nt, Salmonella typhimurium LT2
uagcuaaugcgguagc

SEQ ID NO: 3796342 - RNA, 13 nt, Salmonella typhimurium LT2
uagcuaauggcuu

SEQ ID NO: 3796343 - RNA, 16 nt, Salmonella typhimurium LT2
uagcuauauuuagccg

SEQ ID NO: 3796344 - RNA, 18 nt, Salmonella typhimurium LT2
uagcuaucgaucccaaua

SEQ ID NO: 3796345 - RNA, 19 nt, Salmonella typhimurium LT2
uagcuauguaguaaauagg

SEQ ID NO: 3796346 - RNA, 13 nt, Salmonella typhimurium LT2
uagcucagcgcgg

SEQ ID NO: 3796347 - RNA, 14 nt, Salmonella typhimurium LT2
uagcucgccgcuga

SEQ ID NO: 3796348 - RNA, 21 nt, Salmonella typhimurium LT2
uagcucggcaaagcccaucac

SEQ ID NO: 3796349 - RNA, 12 nt, Salmonella typhimurium LT2
uagcugaacgcu

SEQ ID NO: 3796350 - RNA, 14 nt, Salmonella typhimurium LT2
uagcugagacucag

SEQ ID NO: 3796351 - RNA, 16 nt, Salmonella typhimurium LT2
uagcugccgcccggcg

SEQ ID NO: 3796352 - RNA, 12 nt, Salmonella typhimurium LT2
uagcugcgcgcc

SEQ ID NO: 3796353 - RNA, 16 nt, Salmonella typhimurium LT2
uagcugcggcucgcca

SEQ ID NO: 3796354 - RNA, 20 nt, Salmonella typhimurium LT2
uagcugugagaauucugcgc

SEQ ID NO: 3796355 - RNA, 19 nt, Salmonella typhimurium LT2
uagcuuaaaaaauccugca

SEQ ID NO: 3796356 - RNA, 16 nt, Salmonella typhimurium LT2
uagcuuacuuucagau

SEQ ID NO: 3796357 - RNA, 20 nt, Salmonella typhimurium LT2
uagcuuaucgccaaagauau

SEQ ID NO: 3796358 - RNA, 14 nt, Salmonella typhimurium LT2
uagcuucagcggcg

SEQ ID NO: 3796359 - RNA, 11 nt, Salmonella typhimurium LT2
uagcuuccagc

SEQ ID NO: 3796360 - RNA, 22 nt, Salmonella typhimurium LT2
uagcuuguguaggccggauaag

SEQ ID NO: 3796361 - RNA, 10 nt, Salmonella typhimurium LT2
uagcuuugca

SEQ ID NO: 3796362 - RNA, 16 nt, Salmonella typhimurium LT2
uagcuuugcgccagau

SEQ ID NO: 3796363 - RNA, 17 nt, Salmonella typhimurium LT2
uagcuuuuccgcuggaa

SEQ ID NO: 3796364 - RNA, 16 nt, Salmonella typhimurium LT2
uaggaaaggcagagaa

SEQ ID NO: 3796365 - RNA, 22 nt, Salmonella typhimurium LT2
uaggaauacccagcucagcuuu

SEQ ID NO: 3796366 - RNA, 17 nt, Salmonella typhimurium LT2
uaggagagcagaagcac

SEQ ID NO: 3796367 - RNA, 22 nt, Salmonella typhimurium LT2
uaggagauauccugaaacgcgg

SEQ ID NO: 3796368 - RNA, 12 nt, Salmonella typhimurium LT2
uaggauaaaauc

SEQ ID NO: 3796369 - RNA, 17 nt, Salmonella typhimurium LT2
uaggaucugaaaggcgu

SEQ ID NO: 3796370 - RNA, 22 nt, Salmonella typhimurium LT2
uaggcagagaaaugcgccugca

SEQ ID NO: 3796371 - RNA, 20 nt, Salmonella typhimurium LT2
uaggcaggauaaggcguuca

SEQ ID NO: 3796372 - RNA, 20 nt, Salmonella typhimurium LT2
uaggccagccgacgcucuuc

SEQ ID NO: 3796373 - RNA, 22 nt, Salmonella typhimurium LT2
uaggccagcguuaccucuuucg

SEQ ID NO: 3796374 - RNA, 18 nt, Salmonella typhimurium LT2
uaggccaucacuggcauu

SEQ ID NO: 3796375 - RNA, 22 nt, Salmonella typhimurium LT2
uaggccgcuauaagcggcguca

SEQ ID NO: 3796376 - RNA, 20 nt, Salmonella typhimurium LT2
uaggccggauaagcguuagc

SEQ ID NO: 3796377 - RNA, 20 nt, Salmonella typhimurium LT2
uaggccggauaaggcauuca

SEQ ID NO: 3796378 - RNA, 20 nt, Salmonella typhimurium LT2
uaggccggauaaggcgcagc

SEQ ID NO: 3796379 - RNA, 21 nt, Salmonella typhimurium LT2
uaggccggauaaggcgcuagc

SEQ ID NO: 3796380 - RNA, 19 nt, Salmonella typhimurium LT2
uaggccggauaaggcguua

SEQ ID NO: 3796381 - RNA, 20 nt, Salmonella typhimurium LT2
uaggccggauaaggcguuca

SEQ ID NO: 3796382 - RNA, 21 nt, Salmonella typhimurium LT2
uaggccggauaaggcguuugc

SEQ ID NO: 3796383 - RNA, 20 nt, Salmonella typhimurium LT2
uaggccggaugaggcgcagc

SEQ ID NO: 3796384 - RNA, 20 nt, Salmonella typhimurium LT2
uaggccggguaaggcgaagc

SEQ ID NO: 3796385 - RNA, 18 nt, Salmonella typhimurium LT2
uaggccgguaugacgcuu

SEQ ID NO: 3796386 - RNA, 19 nt, Salmonella typhimurium LT2
uaggccugauaagcguagc

SEQ ID NO: 3796387 - RNA, 20 nt, Salmonella typhimurium LT2
uaggccugauaagcguagcg

SEQ ID NO: 3796388 - RNA, 15 nt, Salmonella typhimurium LT2
uaggcgaggaagaca

SEQ ID NO: 3796389 - RNA, 18 nt, Salmonella typhimurium LT2
uaggcuauaaaaaucauc

SEQ ID NO: 3796390 - RNA, 19 nt, Salmonella typhimurium LT2
uaggcucaauaugccaggc

SEQ ID NO: 3796391 - RNA, 14 nt, Salmonella typhimurium LT2
uaggcugaaagcgc

SEQ ID NO: 3796392 - RNA, 12 nt, Salmonella typhimurium LT2
uaggcugaauac

SEQ ID NO: 3796393 - RNA, 14 nt, Salmonella typhimurium LT2
uagggcagggugcc

SEQ ID NO: 3796394 - RNA, 13 nt, Salmonella typhimurium LT2
uaggggaaaacau

SEQ ID NO: 3796395 - RNA, 14 nt, Salmonella typhimurium LT2
uaggggcaucggag

SEQ ID NO: 3796396 - RNA, 14 nt, Salmonella typhimurium LT2
uagggugaucgauc

SEQ ID NO: 3796397 - RNA, 14 nt, Salmonella typhimurium LT2
uagguauccagcag

SEQ ID NO: 3796398 - RNA, 12 nt, Salmonella typhimurium LT2
uaggucagcgau

SEQ ID NO: 3796399 - RNA, 21 nt, Salmonella typhimurium LT2
uaggucagguuuaauguugcc

SEQ ID NO: 3796400 - RNA, 16 nt, Salmonella typhimurium LT2
uaguaaacggcgcuga

SEQ ID NO: 3796401 - RNA, 21 nt, Salmonella typhimurium LT2
uaguaacgacgaauauccaga

SEQ ID NO: 3796402 - RNA, 16 nt, Salmonella typhimurium LT2
uaguaauaaagcguag

SEQ ID NO: 3796403 - RNA, 12 nt, Salmonella typhimurium LT2
uaguaccaggca

SEQ ID NO: 3796404 - RNA, 13 nt, Salmonella typhimurium LT2
uaguaccaggcag

SEQ ID NO: 3796405 - RNA, 19 nt, Salmonella typhimurium LT2
uaguaccgaacagccaggc

SEQ ID NO: 3796406 - RNA, 21 nt, Salmonella typhimurium LT2
uaguagcggaauaucuucccg

SEQ ID NO: 3796407 - RNA, 12 nt, Salmonella typhimurium LT2
uaguaucauauu

SEQ ID NO: 3796408 - RNA, 21 nt, Salmonella typhimurium LT2
uaguaucauauuuucuugcua

SEQ ID NO: 3796409 - RNA, 22 nt, Salmonella typhimurium LT2
uaguauccccggcaaccuuaaa

SEQ ID NO: 3796410 - RNA, 20 nt, Salmonella typhimurium LT2
uaguauggagcaggaaaaga

SEQ ID NO: 3796411 - RNA, 13 nt, Salmonella typhimurium LT2
uaguauuucccuu

SEQ ID NO: 3796412 - RNA, 16 nt, Salmonella typhimurium LT2
uagucaaacccuuccg

SEQ ID NO: 3796413 - RNA, 13 nt, Salmonella typhimurium LT2
uagucaaauugaa

SEQ ID NO: 3796414 - RNA, 12 nt, Salmonella typhimurium LT2
uagucacuccag

SEQ ID NO: 3796415 - RNA, 17 nt, Salmonella typhimurium LT2
uagucagcuuaauuguu

SEQ ID NO: 3796416 - RNA, 22 nt, Salmonella typhimurium LT2
uagucaggaggauauucgucca

SEQ ID NO: 3796417 - RNA, 22 nt, Salmonella typhimurium LT2
uagucaggaucgcuggcgcguu

SEQ ID NO: 3796418 - RNA, 17 nt, Salmonella typhimurium LT2
uagucaggcacaaaaaa

SEQ ID NO: 3796419 - RNA, 15 nt, Salmonella typhimurium LT2
uagucauauuaucgc

SEQ ID NO: 3796420 - RNA, 20 nt, Salmonella typhimurium LT2
uagucaucgccuucauccgc

SEQ ID NO: 3796421 - RNA, 11 nt, Salmonella typhimurium LT2
uaguccagcag

SEQ ID NO: 3796422 - RNA, 18 nt, Salmonella typhimurium LT2
uaguccggcaaugauauc

SEQ ID NO: 3796423 - RNA, 19 nt, Salmonella typhimurium LT2
uaguccguuuaaagacauc

SEQ ID NO: 3796424 - RNA, 20 nt, Salmonella typhimurium LT2
uaguccugccgacaggcagg

SEQ ID NO: 3796425 - RNA, 23 nt, Salmonella typhimurium LT2
uaucaagauaaaaagacagauaa

SEQ ID NO: 3796426 - RNA, 15 nt, Salmonella typhimurium LT2
uaucaagccuacacc

SEQ ID NO: 3796427 - RNA, 17 nt, Salmonella typhimurium LT2
uaucaauagaucuuaau

SEQ ID NO: 3796428 - RNA, 17 nt, Salmonella typhimurium LT2
uaucaaucaccucuucc

SEQ ID NO: 3796429 - RNA, 24 nt, Salmonella typhimurium LT2
uaucaaugcgacagcggcaaggca

SEQ ID NO: 3796430 - RNA, 19 nt, Salmonella typhimurium LT2
uaucacacugacaauaaag

SEQ ID NO: 3796431 - RNA, 19 nt, Salmonella typhimurium LT2
uaucaccaaguagacagag

SEQ ID NO: 3796432 - RNA, 12 nt, Salmonella typhimurium LT2
uaucaccaucuu

SEQ ID NO: 3796433 - RNA, 20 nt, Salmonella typhimurium LT2
uaucaccaucuuuuugcuca

SEQ ID NO: 3796434 - RNA, 14 nt, Salmonella typhimurium LT2
uaucagaccgacaa

SEQ ID NO: 3796435 - RNA, 14 nt, Salmonella typhimurium LT2
uaucagcaauaauu

SEQ ID NO: 3796436 - RNA, 17 nt, Salmonella typhimurium LT2
uaucagcgcguuuucca

SEQ ID NO: 3796437 - RNA, 14 nt, Salmonella typhimurium LT2
uaucagcuugccgu

SEQ ID NO: 3796438 - RNA, 21 nt, Salmonella typhimurium LT2
uaucaggcaugauuuucuuca

SEQ ID NO: 3796439 - RNA, 14 nt, Salmonella typhimurium LT2
uaucaggccgacaa

SEQ ID NO: 3796440 - RNA, 18 nt, Salmonella typhimurium LT2
uaucaggccgacaaauga

SEQ ID NO: 3796441 - RNA, 18 nt, Salmonella typhimurium LT2
uaucaggccuaccagucg

SEQ ID NO: 3796442 - RNA, 23 nt, Salmonella typhimurium LT2
uaucaggguuauuuccgcuggcc

SEQ ID NO: 3796443 - RNA, 15 nt, Salmonella typhimurium LT2
uaucagguaucccgc

SEQ ID NO: 3796444 - RNA, 16 nt, Salmonella typhimurium LT2
uaucaggugcgagagc

SEQ ID NO: 3796445 - RNA, 14 nt, Salmonella typhimurium LT2
uaucauaaaaggcu

SEQ ID NO: 3796446 - RNA, 16 nt, Salmonella typhimurium LT2
uaucauagugccggug

SEQ ID NO: 3796447 - RNA, 13 nt, Salmonella typhimurium LT2
uaucauauuuucu

SEQ ID NO: 3796448 - RNA, 19 nt, Salmonella typhimurium LT2
uaucaucagcacgaauugu

SEQ ID NO: 3796449 - RNA, 20 nt, Salmonella typhimurium LT2
uaucaugaaugccccagcgc

SEQ ID NO: 3796450 - RNA, 15 nt, Salmonella typhimurium LT2
uaucaugcugauaac

SEQ ID NO: 3796451 - RNA, 19 nt, Salmonella typhimurium LT2
uaucauuuuuguuaauucu

SEQ ID NO: 3796452 - RNA, 14 nt, Salmonella typhimurium LT2
uaucauuuuuucua

SEQ ID NO: 3796453 - RNA, 15 nt, Salmonella typhimurium LT2
uaucauuuuuucuaa

SEQ ID NO: 3796454 - RNA, 22 nt, Salmonella typhimurium LT2
uaucauuuuuucuaagaugacu

SEQ ID NO: 3796455 - RNA, 15 nt, Salmonella typhimurium LT2
uauccaccgccagac

SEQ ID NO: 3796456 - RNA, 22 nt, Salmonella typhimurium LT2
uauccacugucgggcaaaaugc

SEQ ID NO: 3796457 - RNA, 21 nt, Salmonella typhimurium LT2
uauccagaucuucagaggccu

SEQ ID NO: 3796458 - RNA, 12 nt, Salmonella typhimurium LT2
uauccagcagcc

SEQ ID NO: 3796459 - RNA, 15 nt, Salmonella typhimurium LT2
uauccagcagccagg

SEQ ID NO: 3796460 - RNA, 23 nt, Salmonella typhimurium LT2
uauccagcagguagcguuucagu

SEQ ID NO: 3796461 - RNA, 16 nt, Salmonella typhimurium LT2
uauccagcaguaaaua

SEQ ID NO: 3796462 - RNA, 16 nt, Salmonella typhimurium LT2
uauccagccaggucag

SEQ ID NO: 3796463 - RNA, 15 nt, Salmonella typhimurium LT2
uauccagcgcaggca

SEQ ID NO: 3796464 - RNA, 19 nt, Salmonella typhimurium LT2
uauccagcuucugacguaa

SEQ ID NO: 3796465 - RNA, 14 nt, Salmonella typhimurium LT2
uauccaggcgggca

SEQ ID NO: 3796466 - RNA, 19 nt, Salmonella typhimurium LT2
uauccagucagcguuacug

SEQ ID NO: 3796467 - RNA, 14 nt, Salmonella typhimurium LT2
uauccaguugauga

SEQ ID NO: 3796468 - RNA, 16 nt, Salmonella typhimurium LT2
uauccauaaacuggcg

SEQ ID NO: 3796469 - RNA, 23 nt, Salmonella typhimurium LT2
uauccaucagccaggguuuaauc

SEQ ID NO: 3796470 - RNA, 15 nt, Salmonella typhimurium LT2
uauccauuucaucag

SEQ ID NO: 3796471 - RNA, 19 nt, Salmonella typhimurium LT2
uauccauuucaucaggcag

SEQ ID NO: 3796472 - RNA, 18 nt, Salmonella typhimurium LT2
uaucccaaacgucguaaa

SEQ ID NO: 3796473 - RNA, 23 nt, Salmonella typhimurium LT2
uaucccaaacgucguaaaaccug

SEQ ID NO: 3796474 - RNA, 20 nt, Salmonella typhimurium LT2
uaucccaucgacuuaaaaga

SEQ ID NO: 3796475 - RNA, 14 nt, Salmonella typhimurium LT2
uauccccgcuggcg

SEQ ID NO: 3796476 - RNA, 14 nt, Salmonella typhimurium LT2
uaucccugcugagu

SEQ ID NO: 3796477 - RNA, 18 nt, Salmonella typhimurium LT2
uaucccuuccucauuauu

SEQ ID NO: 3796478 - RNA, 16 nt, Salmonella typhimurium LT2
uauccgacgcaacuca

SEQ ID NO: 3796479 - RNA, 15 nt, Salmonella typhimurium LT2
uauccgccagccagu

SEQ ID NO: 3796480 - RNA, 21 nt, Salmonella typhimurium LT2
uauccgccaucgacagcgcca

SEQ ID NO: 3796481 - RNA, 18 nt, Salmonella typhimurium LT2
uauccgcuauuaccagua

SEQ ID NO: 3796482 - RNA, 21 nt, Salmonella typhimurium LT2
uauccggcacgguaaaccucu

SEQ ID NO: 3796483 - RNA, 17 nt, Salmonella typhimurium LT2
uauccggccugcaggca

SEQ ID NO: 3796484 - RNA, 16 nt, Salmonella typhimurium LT2
uauccggcgcaucggu

SEQ ID NO: 3796485 - RNA, 17 nt, Salmonella typhimurium LT2
uauccggcgcaucgguc

SEQ ID NO: 3796486 - RNA, 19 nt, Salmonella typhimurium LT2
uauccggcggcaaaggcau

SEQ ID NO: 3796487 - RNA, 22 nt, Salmonella typhimurium LT2
uauccggcuuacggcuauucuu

SEQ ID NO: 3796488 - RNA, 14 nt, Salmonella typhimurium LT2
uauccggcuuaucc

SEQ ID NO: 3796489 - RNA, 20 nt, Salmonella typhimurium LT2
uauccguacuuucuacaaau

SEQ ID NO: 3796490 - RNA, 16 nt, Salmonella typhimurium LT2
uauccguccucuuucc

SEQ ID NO: 3796491 - RNA, 18 nt, Salmonella typhimurium LT2
uauccguucaucgguaau

SEQ ID NO: 3796492 - RNA, 14 nt, Salmonella typhimurium LT2
uauccuaaugccac

SEQ ID NO: 3796493 - RNA, 19 nt, Salmonella typhimurium LT2
uauccuaaugccacggcug

SEQ ID NO: 3796494 - RNA, 13 nt, Salmonella typhimurium LT2
uauccucuccuga

SEQ ID NO: 3796495 - RNA, 21 nt, Salmonella typhimurium LT2
uauccugaaggacaagcugcg

SEQ ID NO: 3796496 - RNA, 15 nt, Salmonella typhimurium LT2
uauccugaugcgccu

SEQ ID NO: 3796497 - RNA, 20 nt, Salmonella typhimurium LT2
uauccugcggacgcagcuca

SEQ ID NO: 3796498 - RNA, 15 nt, Salmonella typhimurium LT2
uauccugguagcgcc

SEQ ID NO: 3796499 - RNA, 22 nt, Salmonella typhimurium LT2
uaucgaaauagcggugaacuug

SEQ ID NO: 3796500 - RNA, 16 nt, Salmonella typhimurium LT2
uaucgaaguaauaaaa

SEQ ID NO: 3796501 - RNA, 18 nt, Salmonella typhimurium LT2
uaucgaaguaauaaaaaa

SEQ ID NO: 3796502 - RNA, 22 nt, Salmonella typhimurium LT2
uaucgaaguaauaaaaaacaac

SEQ ID NO: 3796503 - RNA, 23 nt, Salmonella typhimurium LT2
uaucgaagugcgaaauuuaauau

SEQ ID NO: 3796504 - RNA, 15 nt, Salmonella typhimurium LT2
uaucgagggaacucu

SEQ ID NO: 3796505 - RNA, 21 nt, Salmonella typhimurium LT2
uaucgauaaucaacaaugucg

SEQ ID NO: 3796506 - RNA, 16 nt, Salmonella typhimurium LT2
uaucgauaucugccug

SEQ ID NO: 3796507 - RNA, 23 nt, Salmonella typhimurium LT2
uaucgaugcgccaguucagcguc

SEQ ID NO: 3796508 - RNA, 18 nt, Salmonella typhimurium LT2
uaucgaugcuuauuauuu

SEQ ID NO: 3796509 - RNA, 17 nt, Salmonella typhimurium LT2
uaucgccaagcgguaag

SEQ ID NO: 3796510 - RNA, 20 nt, Salmonella typhimurium LT2
uaucgccgaaagcgaucaca

SEQ ID NO: 3796511 - RNA, 22 nt, Salmonella typhimurium LT2
uaucgccgaaagcgaucacauu

SEQ ID NO: 3796512 - RNA, 14 nt, Salmonella typhimurium LT2
uaucgccgaucaca

SEQ ID NO: 3796513 - RNA, 24 nt, Salmonella typhimurium LT2
uaucgccggcagacgauagcgggu

SEQ ID NO: 3796514 - RNA, 19 nt, Salmonella typhimurium LT2
uaucgccguaaccgccugc

SEQ ID NO: 3796515 - RNA, 18 nt, Salmonella typhimurium LT2
uaucgccguaacgaacgc

SEQ ID NO: 3796516 - RNA, 21 nt, Salmonella typhimurium LT2
uaucgccguuaaauagcccca

SEQ ID NO: 3796517 - RNA, 18 nt, Salmonella typhimurium LT2
uaucgccguucgcauugg

SEQ ID NO: 3796518 - RNA, 23 nt, Salmonella typhimurium LT2
uaucgcgacggaccggcagcguc

SEQ ID NO: 3796519 - RNA, 17 nt, Salmonella typhimurium LT2
uaucgcgccagguauac

SEQ ID NO: 3796520 - RNA, 19 nt, Salmonella typhimurium LT2
uaucgcgccgccaauaucc

SEQ ID NO: 3796521 - RNA, 20 nt, Salmonella typhimurium LT2
uaucgcggaugacuucuucu

SEQ ID NO: 3796522 - RNA, 20 nt, Salmonella typhimurium LT2
uaucgcuaucaagcugauug

SEQ ID NO: 3796523 - RNA, 14 nt, Salmonella typhimurium LT2
uaucgcugcccaga

SEQ ID NO: 3796524 - RNA, 17 nt, Salmonella typhimurium LT2
uaucgcugcuaaacgaa

SEQ ID NO: 3796525 - RNA, 18 nt, Salmonella typhimurium LT2
uaucggaagaaaacgcaa

SEQ ID NO: 3796526 - RNA, 17 nt, Salmonella typhimurium LT2
uaucggagguauacauc

SEQ ID NO: 3796527 - RNA, 15 nt, Salmonella typhimurium LT2
uaucggauagucggc

SEQ ID NO: 3796528 - RNA, 22 nt, Salmonella typhimurium LT2
uauuauuuugauaaucaucaua

SEQ ID NO: 3796529 - RNA, 15 nt, Salmonella typhimurium LT2
uauuauuuuucuauu

SEQ ID NO: 3796530 - RNA, 14 nt, Salmonella typhimurium LT2
uauuauuuuuucuu

SEQ ID NO: 3796531 - RNA, 21 nt, Salmonella typhimurium LT2
uauucaagaacgguuuauccc

SEQ ID NO: 3796532 - RNA, 13 nt, Salmonella typhimurium LT2
uauucaauaauau

SEQ ID NO: 3796533 - RNA, 18 nt, Salmonella typhimurium LT2
uauucagaauaugccagg

SEQ ID NO: 3796534 - RNA, 18 nt, Salmonella typhimurium LT2
uauucagcaguucauucg

SEQ ID NO: 3796535 - RNA, 13 nt, Salmonella typhimurium LT2
uauucaggccucc

SEQ ID NO: 3796536 - RNA, 13 nt, Salmonella typhimurium LT2
uauucauaacgcc

SEQ ID NO: 3796537 - RNA, 22 nt, Salmonella typhimurium LT2
uauucauaucguaaauuacuca

SEQ ID NO: 3796538 - RNA, 13 nt, Salmonella typhimurium LT2
uauucauauuaua

SEQ ID NO: 3796539 - RNA, 20 nt, Salmonella typhimurium LT2
uauucauauuuauacaucau

SEQ ID NO: 3796540 - RNA, 17 nt, Salmonella typhimurium LT2
uauucaucaucuugucc

SEQ ID NO: 3796541 - RNA, 21 nt, Salmonella typhimurium LT2
uauucaugguuccgccguuaa

SEQ ID NO: 3796542 - RNA, 19 nt, Salmonella typhimurium LT2
uauuccagggcauuuuuuc

SEQ ID NO: 3796543 - RNA, 20 nt, Salmonella typhimurium LT2
uauuccagucgcuccaccac

SEQ ID NO: 3796544 - RNA, 13 nt, Salmonella typhimurium LT2
uauuccauacaga

SEQ ID NO: 3796545 - RNA, 16 nt, Salmonella typhimurium LT2
uauucccaggcaaaug

SEQ ID NO: 3796546 - RNA, 16 nt, Salmonella typhimurium LT2
uauucccguuccagcu

SEQ ID NO: 3796547 - RNA, 19 nt, Salmonella typhimurium LT2
uauucccguuuuucaucca

SEQ ID NO: 3796548 - RNA, 18 nt, Salmonella typhimurium LT2
uauuccgaauacggacau

SEQ ID NO: 3796549 - RNA, 23 nt, Salmonella typhimurium LT2
uauuccguuuuuaucggcgucgc

SEQ ID NO: 3796550 - RNA, 15 nt, Salmonella typhimurium LT2
uauucggcuccagau

SEQ ID NO: 3796551 - RNA, 18 nt, Salmonella typhimurium LT2
uauucggucagauaaaua

SEQ ID NO: 3796552 - RNA, 13 nt, Salmonella typhimurium LT2
uauucucgccgua

SEQ ID NO: 3796553 - RNA, 21 nt, Salmonella typhimurium LT2
uauucugggcuuacuuuccaa

SEQ ID NO: 3796554 - RNA, 20 nt, Salmonella typhimurium LT2
uauucugucgccaccacucg

SEQ ID NO: 3796555 - RNA, 17 nt, Salmonella typhimurium LT2
uauucuguuagcgcccu

SEQ ID NO: 3796556 - RNA, 13 nt, Salmonella typhimurium LT2
uauucuuaucauu

SEQ ID NO: 3796557 - RNA, 16 nt, Salmonella typhimurium LT2
uauugaacauuuuuuc

SEQ ID NO: 3796558 - RNA, 20 nt, Salmonella typhimurium LT2
uauugaacggcucaaaauaa

SEQ ID NO: 3796559 - RNA, 21 nt, Salmonella typhimurium LT2
uauugacaacaaauccaaucu

SEQ ID NO: 3796560 - RNA, 23 nt, Salmonella typhimurium LT2
uauugacaacaaauccaaucuga

SEQ ID NO: 3796561 - RNA, 15 nt, Salmonella typhimurium LT2
uauugaccaucucuu

SEQ ID NO: 3796562 - RNA, 17 nt, Salmonella typhimurium LT2
uauugacgaaaagauaa

SEQ ID NO: 3796563 - RNA, 13 nt, Salmonella typhimurium LT2
uauugagaauaaa

SEQ ID NO: 3796564 - RNA, 14 nt, Salmonella typhimurium LT2
uauugagaauaaac

SEQ ID NO: 3796565 - RNA, 12 nt, Salmonella typhimurium LT2
uauugagauaau

SEQ ID NO: 3796566 - RNA, 21 nt, Salmonella typhimurium LT2
uauugauaccuuuaaccucuu

SEQ ID NO: 3796567 - RNA, 15 nt, Salmonella typhimurium LT2
uauugaugacgcuua

SEQ ID NO: 3796568 - RNA, 19 nt, Salmonella typhimurium LT2
uauugcauaaugccugucg

SEQ ID NO: 3796569 - RNA, 16 nt, Salmonella typhimurium LT2
uauugccacaauauca

SEQ ID NO: 3796570 - RNA, 15 nt, Salmonella typhimurium LT2
uauugccgucucaac

SEQ ID NO: 3796571 - RNA, 16 nt, Salmonella typhimurium LT2
uauugccuaaaguggc

SEQ ID NO: 3796572 - RNA, 19 nt, Salmonella typhimurium LT2
uauugccuaaaguggcgcc

SEQ ID NO: 3796573 - RNA, 16 nt, Salmonella typhimurium LT2
uauugccuuauucaca

SEQ ID NO: 3796574 - RNA, 21 nt, Salmonella typhimurium LT2
uauugccuuauucacagcgua

SEQ ID NO: 3796575 - RNA, 17 nt, Salmonella typhimurium LT2
uauugcggaucagcaaa

SEQ ID NO: 3796576 - RNA, 17 nt, Salmonella typhimurium LT2
uauugcuuucaauuucc

SEQ ID NO: 3796577 - RNA, 22 nt, Salmonella typhimurium LT2
uauuggaaagauucuacauucc

SEQ ID NO: 3796578 - RNA, 23 nt, Salmonella typhimurium LT2
uauuggaguuaaggauauauacu

SEQ ID NO: 3796579 - RNA, 21 nt, Salmonella typhimurium LT2
uauuggccgucgguucgucug

SEQ ID NO: 3796580 - RNA, 22 nt, Salmonella typhimurium LT2
uauuggcgcagccuuuuucucg

SEQ ID NO: 3796581 - RNA, 18 nt, Salmonella typhimurium LT2
uauugugcgcaagaaaag

SEQ ID NO: 3796582 - RNA, 21 nt, Salmonella typhimurium LT2
uauuguuuaacguuucaugga

SEQ ID NO: 3796583 - RNA, 21 nt, Salmonella typhimurium LT2
uauuuaacgaaauguuuucuu

SEQ ID NO: 3796584 - RNA, 17 nt, Salmonella typhimurium LT2
uauuuaacuuaaauaaa

SEQ ID NO: 3796585 - RNA, 16 nt, Salmonella typhimurium LT2
uauuuaagcucuucuu

SEQ ID NO: 3796586 - RNA, 13 nt, Salmonella typhimurium LT2
uauuuacagguga

SEQ ID NO: 3796587 - RNA, 19 nt, Salmonella typhimurium LT2
uauuuagccguucaugcac

SEQ ID NO: 3796588 - RNA, 14 nt, Salmonella typhimurium LT2
uauuuauauauaga

SEQ ID NO: 3796589 - RNA, 21 nt, Salmonella typhimurium LT2
uauuuauuaguguuauauaau

SEQ ID NO: 3796590 - RNA, 16 nt, Salmonella typhimurium LT2
uauuuauugauuauuu

SEQ ID NO: 3796591 - RNA, 22 nt, Salmonella typhimurium LT2
uauuucacgccgaugguugcca

SEQ ID NO: 3796592 - RNA, 23 nt, Salmonella typhimurium LT2
uauuucaggccaugcuuuugcag

SEQ ID NO: 3796593 - RNA, 22 nt, Salmonella typhimurium LT2
uauuucaucuauuauuuuucua

SEQ ID NO: 3796594 - RNA, 19 nt, Salmonella typhimurium LT2
uauuuccaauguaaauuaa

SEQ ID NO: 3796595 - RNA, 17 nt, Salmonella typhimurium LT2
uauuucccuucccagcc

SEQ ID NO: 3796596 - RNA, 14 nt, Salmonella typhimurium LT2
uauuucugaaaaac

SEQ ID NO: 3796597 - RNA, 15 nt, Salmonella typhimurium LT2
uauuucugaaaaacc

SEQ ID NO: 3796598 - RNA, 19 nt, Salmonella typhimurium LT2
uauuucuguauaauuauuu

SEQ ID NO: 3796599 - RNA, 15 nt, Salmonella typhimurium LT2
uauuucugucagcgu

SEQ ID NO: 3796600 - RNA, 18 nt, Salmonella typhimurium LT2
uauuugaugccuggcagu

SEQ ID NO: 3796601 - RNA, 15 nt, Salmonella typhimurium LT2
uauuuguguauuuuu

SEQ ID NO: 3796602 - RNA, 17 nt, Salmonella typhimurium LT2
uauuuguguauuuuuuu

SEQ ID NO: 3796603 - RNA, 14 nt, Salmonella typhimurium LT2
uauuuguuccggca

SEQ ID NO: 3796604 - RNA, 15 nt, Salmonella typhimurium LT2
uauuuguuccggcaa

SEQ ID NO: 3796605 - RNA, 17 nt, Salmonella typhimurium LT2
uauuuuauaaaacuaca

SEQ ID NO: 3796606 - RNA, 12 nt, Salmonella typhimurium LT2
uauuuuauuuuu

SEQ ID NO: 3796607 - RNA, 23 nt, Salmonella typhimurium LT2
uauuuucagaaaucauauaaaac

SEQ ID NO: 3796608 - RNA, 12 nt, Salmonella typhimurium LT2
uauuuuccagaa

SEQ ID NO: 3796609 - RNA, 14 nt, Salmonella typhimurium LT2
uauuuuccaucacg

SEQ ID NO: 3796610 - RNA, 15 nt, Salmonella typhimurium LT2
uauuuucuaucuuuu

SEQ ID NO: 3796611 - RNA, 20 nt, Salmonella typhimurium LT2
uauuuuggugugacagcaac

SEQ ID NO: 3796612 - RNA, 14 nt, Salmonella typhimurium LT2
uauuuuuagcccuu

SEQ ID NO: 3796613 - RNA, 14 nt, Salmonella typhimurium LT2
uauuuuucaccuca

SEQ ID NO: 3796614 - RNA, 20 nt, Salmonella typhimurium LT2
uauuuuucuaaugucagcuc

SEQ ID NO: 3796615 - RNA, 12 nt, Salmonella typhimurium LT2
uauuuuuucgca

SEQ ID NO: 3796616 - RNA, 13 nt, Salmonella typhimurium LT2
uauuuuuucuuua

SEQ ID NO: 3796617 - RNA, 15 nt, Salmonella typhimurium LT2
uauuuuuuuaucgaa

SEQ ID NO: 3796618 - RNA, 14 nt, Salmonella typhimurium LT2
ucaaaaaaaaccag

SEQ ID NO: 3796619 - RNA, 15 nt, Salmonella typhimurium LT2
ucaaaaaaaaccaga

SEQ ID NO: 3796620 - RNA, 11 nt, Salmonella typhimurium LT2
ucaaaaaagag

SEQ ID NO: 3796621 - RNA, 14 nt, Salmonella typhimurium LT2
ucaaaaaagagaag

SEQ ID NO: 3796622 - RNA, 22 nt, Salmonella typhimurium LT2
ucaaaaaagcgacgcugucaau

SEQ ID NO: 3796623 - RNA, 19 nt, Salmonella typhimurium LT2
ucaaaaagaggaaagcgua

SEQ ID NO: 3796624 - RNA, 19 nt, Salmonella typhimurium LT2
ucaaaaagcgcgcggcugc

SEQ ID NO: 3796625 - RNA, 14 nt, Salmonella typhimurium LT2
ucaaaaauaaaaaa

SEQ ID NO: 3796626 - RNA, 23 nt, Salmonella typhimurium LT2
ucaaaacccagcccaauacgcca

SEQ ID NO: 3796627 - RNA, 13 nt, Salmonella typhimurium LT2
ucaaaacuggaaa

SEQ ID NO: 3796628 - RNA, 22 nt, Salmonella typhimurium LT2
ucaaaagcguguagcaggagau

SEQ ID NO: 3796629 - RNA, 14 nt, Salmonella typhimurium LT2
ucaaaauaaaauua

SEQ ID NO: 3796630 - RNA, 18 nt, Salmonella typhimurium LT2
ucaaaauaacgcuucacc

SEQ ID NO: 3796631 - RNA, 17 nt, Salmonella typhimurium LT2
ucaaaauauaacuucuu

SEQ ID NO: 3796632 - RNA, 17 nt, Salmonella typhimurium LT2
ucaagcaacuguagaau

SEQ ID NO: 3796633 - RNA, 14 nt, Salmonella typhimurium LT2
ucaagcaguuccag

SEQ ID NO: 3796634 - RNA, 22 nt, Salmonella typhimurium LT2
ucaagcccauguucaugaacca

SEQ ID NO: 3796635 - RNA, 19 nt, Salmonella typhimurium LT2
ucaagcccccgcaacauug

SEQ ID NO: 3796636 - RNA, 13 nt, Salmonella typhimurium LT2
ucaagccgcaacg

SEQ ID NO: 3796637 - RNA, 21 nt, Salmonella typhimurium LT2
ucaagccgggcggcugugucc

SEQ ID NO: 3796638 - RNA, 18 nt, Salmonella typhimurium LT2
ucaagccguuuuggcagc

SEQ ID NO: 3796639 - RNA, 20 nt, Salmonella typhimurium LT2
ucaagcugauugauuuugua

SEQ ID NO: 3796640 - RNA, 22 nt, Salmonella typhimurium LT2
ucaagcugauugauuuuguaau

SEQ ID NO: 3796641 - RNA, 21 nt, Salmonella typhimurium LT2
ucaagcuuugcguaaaaaaac

SEQ ID NO: 3796642 - RNA, 22 nt, Salmonella typhimurium LT2
ucaagcuuugcguaaaaaaaca

SEQ ID NO: 3796643 - RNA, 19 nt, Salmonella typhimurium LT2
ucaaggcaggaaucguccg

SEQ ID NO: 3796644 - RNA, 22 nt, Salmonella typhimurium LT2
ucaaggcaggaaucguccgaau

SEQ ID NO: 3796645 - RNA, 22 nt, Salmonella typhimurium LT2
ucaaguagaacuuccaacuaaa

SEQ ID NO: 3796646 - RNA, 14 nt, Salmonella typhimurium LT2
ucaagucccccccc

SEQ ID NO: 3796647 - RNA, 16 nt, Salmonella typhimurium LT2
ucaaguccccccccuc

SEQ ID NO: 3796648 - RNA, 23 nt, Salmonella typhimurium LT2
ucaaguuuuaggcuaaaggcuac

SEQ ID NO: 3796649 - RNA, 16 nt, Salmonella typhimurium LT2
ucaauaaccgccagca

SEQ ID NO: 3796650 - RNA, 14 nt, Salmonella typhimurium LT2
ucaauaauauccug

SEQ ID NO: 3796651 - RNA, 17 nt, Salmonella typhimurium LT2
ucaauaauggcgcgaaa

SEQ ID NO: 3796652 - RNA, 21 nt, Salmonella typhimurium LT2
ucaauaauggcgcgaaaacag

SEQ ID NO: 3796653 - RNA, 18 nt, Salmonella typhimurium LT2
ucaauacagagauauuaa

SEQ ID NO: 3796654 - RNA, 16 nt, Salmonella typhimurium LT2
ucaauaccagccccac

SEQ ID NO: 3796655 - RNA, 22 nt, Salmonella typhimurium LT2
ucaauaccguccagcgcauacg

SEQ ID NO: 3796656 - RNA, 17 nt, Salmonella typhimurium LT2
ucaauacgaaaaccaag

SEQ ID NO: 3796657 - RNA, 18 nt, Salmonella typhimurium LT2
ucaauagagcgcagcaaa

SEQ ID NO: 3796658 - RNA, 15 nt, Salmonella typhimurium LT2
ucaauagcacaucag

SEQ ID NO: 3796659 - RNA, 19 nt, Salmonella typhimurium LT2
ucaauagguguaucccuau

SEQ ID NO: 3796660 - RNA, 19 nt, Salmonella typhimurium LT2
ucaauauaguuuuuaccau

SEQ ID NO: 3796661 - RNA, 13 nt, Salmonella typhimurium LT2
ucaauauccagcc

SEQ ID NO: 3796662 - RNA, 17 nt, Salmonella typhimurium LT2
ucaauauuaaugcugcg

SEQ ID NO: 3796663 - RNA, 17 nt, Salmonella typhimurium LT2
ucaauauucaauggguu

SEQ ID NO: 3796664 - RNA, 18 nt, Salmonella typhimurium LT2
ucaauauugaacauuuuu

SEQ ID NO: 3796665 - RNA, 19 nt, Salmonella typhimurium LT2
ucaaucaacuccauaauuu

SEQ ID NO: 3796666 - RNA, 14 nt, Salmonella typhimurium LT2
ucaaucacuuauca

SEQ ID NO: 3796667 - RNA, 15 nt, Salmonella typhimurium LT2
ucaaucacuuaucaa

SEQ ID NO: 3796668 - RNA, 22 nt, Salmonella typhimurium LT2
ucaaucacuugaagccuuucug

SEQ ID NO: 3796669 - RNA, 10 nt, Salmonella typhimurium LT2
ucaaucagcg

SEQ ID NO: 3796670 - RNA, 12 nt, Salmonella typhimurium LT2
ucaaucaucaua

SEQ ID NO: 3796671 - RNA, 17 nt, Salmonella typhimurium LT2
ucaauccugccaaauaa

SEQ ID NO: 3796672 - RNA, 17 nt, Salmonella typhimurium LT2
ucaaucggcgauagagu

SEQ ID NO: 3796673 - RNA, 17 nt, Salmonella typhimurium LT2
ucaaucuggauagcgau

SEQ ID NO: 3796674 - RNA, 15 nt, Salmonella typhimurium LT2
ucaaugaucagcuug

SEQ ID NO: 3796675 - RNA, 23 nt, Salmonella typhimurium LT2
ucaaugccgucggcaauuaacau

SEQ ID NO: 3796676 - RNA, 15 nt, Salmonella typhimurium LT2
ucaaugcgacgccca

SEQ ID NO: 3796677 - RNA, 20 nt, Salmonella typhimurium LT2
ucaaugcgccccgucugcgu

SEQ ID NO: 3796678 - RNA, 20 nt, Salmonella typhimurium LT2
ucaauggcgucaaacagcuu

SEQ ID NO: 3796679 - RNA, 14 nt, Salmonella typhimurium LT2
ucaaugggaaaaau

SEQ ID NO: 3796680 - RNA, 20 nt, Salmonella typhimurium LT2
ucaaugggauagugccugcc

SEQ ID NO: 3796681 - RNA, 19 nt, Salmonella typhimurium LT2
ucaauguuagcauuauuuu

SEQ ID NO: 3796682 - RNA, 13 nt, Salmonella typhimurium LT2
ucaauuauguauu

SEQ ID NO: 3796683 - RNA, 13 nt, Salmonella typhimurium LT2
ucaauugccaccu

SEQ ID NO: 3796684 - RNA, 11 nt, Salmonella typhimurium LT2
ucaauuuccag

SEQ ID NO: 3796685 - RNA, 13 nt, Salmonella typhimurium LT2
ucaauuucguauu

SEQ ID NO: 3796686 - RNA, 17 nt, Salmonella typhimurium LT2
ucaauuugauggcuaau

SEQ ID NO: 3796687 - RNA, 17 nt, Salmonella typhimurium LT2
ucacaaaaacacccgca

SEQ ID NO: 3796688 - RNA, 14 nt, Salmonella typhimurium LT2
ucacaaacaccacc

SEQ ID NO: 3796689 - RNA, 23 nt, Salmonella typhimurium LT2
ucacaaacaccaccaguaaccgc

SEQ ID NO: 3796690 - RNA, 23 nt, Salmonella typhimurium LT2
ucacaaacggcacacgcggcgcu

SEQ ID NO: 3796691 - RNA, 19 nt, Salmonella typhimurium LT2
ucacaaauaucacaaaccc

SEQ ID NO: 3796692 - RNA, 14 nt, Salmonella typhimurium LT2
ucacaaauuaaaaa

SEQ ID NO: 3796693 - RNA, 16 nt, Salmonella typhimurium LT2
ucacaaauuaaaaauc

SEQ ID NO: 3796694 - RNA, 13 nt, Salmonella typhimurium LT2
ucacaaccuccac

SEQ ID NO: 3796695 - RNA, 21 nt, Salmonella typhimurium LT2
ucacaacguaaugaucaugcu

SEQ ID NO: 3796696 - RNA, 14 nt, Salmonella typhimurium LT2
ucacaagauucacu

SEQ ID NO: 3796697 - RNA, 15 nt, Salmonella typhimurium LT2
ucacaagcuguuucu

SEQ ID NO: 3796698 - RNA, 20 nt, Salmonella typhimurium LT2
ucacaagcuguuucuccguu

SEQ ID NO: 3796699 - RNA, 17 nt, Salmonella typhimurium LT2
ucacaauaucgagauga

SEQ ID NO: 3796700 - RNA, 17 nt, Salmonella typhimurium LT2
ucacaaucagccacggc

SEQ ID NO: 3796701 - RNA, 17 nt, Salmonella typhimurium LT2
ucacaaucgcgccugcc

SEQ ID NO: 3796702 - RNA, 12 nt, Salmonella typhimurium LT2
ucacaaugccgc

SEQ ID NO: 3796703 - RNA, 16 nt, Salmonella typhimurium LT2
ucacaaugccuucaac

SEQ ID NO: 3796704 - RNA, 11 nt, Salmonella typhimurium LT2
ucacaauuacg

SEQ ID NO: 3796705 - RNA, 20 nt, Salmonella typhimurium LT2
ucacacaagucaccguuuuu

SEQ ID NO: 3796706 - RNA, 21 nt, Salmonella typhimurium LT2
ucacacagugcgcgaccgcau

SEQ ID NO: 3796707 - RNA, 19 nt, Salmonella typhimurium LT2
ucacacauaagcacaccau

SEQ ID NO: 3796708 - RNA, 16 nt, Salmonella typhimurium LT2
ucacacgcucacccag

SEQ ID NO: 3796709 - RNA, 20 nt, Salmonella typhimurium LT2
ucacacugcgccgccagcga

SEQ ID NO: 3796710 - RNA, 22 nt, Salmonella typhimurium LT2
ucacagacaucggagauuucau

SEQ ID NO: 3796711 - RNA, 14 nt, Salmonella typhimurium LT2
ucacagacaucggu

SEQ ID NO: 3796712 - RNA, 16 nt, Salmonella typhimurium LT2
ucacagaugacagagu

SEQ ID NO: 3796713 - RNA, 14 nt, Salmonella typhimurium LT2
ucacagcaccaugu

SEQ ID NO: 3796714 - RNA, 14 nt, Salmonella typhimurium LT2
ucacaggcuuauac

SEQ ID NO: 3796715 - RNA, 15 nt, Salmonella typhimurium LT2
ucacaggcuucgaca

SEQ ID NO: 3796716 - RNA, 20 nt, Salmonella typhimurium LT2
ucacaggcuucgacaaacag

SEQ ID NO: 3796717 - RNA, 14 nt, Salmonella typhimurium LT2
ucacauacuucugu

SEQ ID NO: 3796718 - RNA, 15 nt, Salmonella typhimurium LT2
ucacauauucaauaa

SEQ ID NO: 3796719 - RNA, 17 nt, Salmonella typhimurium LT2
ucacauauucaauaaua

SEQ ID NO: 3796720 - RNA, 17 nt, Salmonella typhimurium LT2
ucacaucaaagccccau

SEQ ID NO: 3796721 - RNA, 23 nt, Salmonella typhimurium LT2
ucacaucaucgccaagcggcaau

SEQ ID NO: 3796722 - RNA, 15 nt, Salmonella typhimurium LT2
ucacaucgcgcagca

SEQ ID NO: 3796723 - RNA, 17 nt, Salmonella typhimurium LT2
ucacaucguaaaucagc

SEQ ID NO: 3796724 - RNA, 16 nt, Salmonella typhimurium LT2
ucacaugcggaugcug

SEQ ID NO: 3796725 - RNA, 21 nt, Salmonella typhimurium LT2
ucacauggcgaauaucacuau

SEQ ID NO: 3796726 - RNA, 18 nt, Salmonella typhimurium LT2
ucacauuacuuccggcga

SEQ ID NO: 3796727 - RNA, 19 nt, Salmonella typhimurium LT2
ucacauucauaaaagauca

SEQ ID NO: 3796728 - RNA, 12 nt, Salmonella typhimurium LT2
ucacauucugac

SEQ ID NO: 3796729 - RNA, 23 nt, Salmonella typhimurium LT2
ucacauuuugacugguaagcugc

SEQ ID NO: 3796730 - RNA, 15 nt, Salmonella typhimurium LT2
ucaccaccacccgau

SEQ ID NO: 3796731 - RNA, 16 nt, Salmonella typhimurium LT2
ucaccaccgcaggcag

SEQ ID NO: 3796732 - RNA, 18 nt, Salmonella typhimurium LT2
ucaccaccgcaggcagcg

SEQ ID NO: 3796733 - RNA, 22 nt, Salmonella typhimurium LT2
ucaccacgccauagcgcuaugc

SEQ ID NO: 3796734 - RNA, 20 nt, Salmonella typhimurium LT2
ucaccacgcgcacgcccauc

SEQ ID NO: 3796735 - RNA, 22 nt, Salmonella typhimurium LT2
ucaccacgcggauaccuaacag

SEQ ID NO: 3796736 - RNA, 15 nt, Salmonella typhimurium LT2
ucacugucguaaggc

SEQ ID NO: 3796737 - RNA, 17 nt, Salmonella typhimurium LT2
ucacuuaaguaaagauu

SEQ ID NO: 3796738 - RNA, 19 nt, Salmonella typhimurium LT2
ucacuuucagauuuuuaau

SEQ ID NO: 3796739 - RNA, 20 nt, Salmonella typhimurium LT2
ucacuuucagauuuuuaaug

SEQ ID NO: 3796740 - RNA, 22 nt, Salmonella typhimurium LT2
ucacuuucuugccacuggccuc

SEQ ID NO: 3796741 - RNA, 18 nt, Salmonella typhimurium LT2
ucacuuuucuuuccugca

SEQ ID NO: 3796742 - RNA, 13 nt, Salmonella typhimurium LT2
ucagaauaaugcu

SEQ ID NO: 3796743 - RNA, 15 nt, Salmonella typhimurium LT2
ucagaauaugccagg

SEQ ID NO: 3796744 - RNA, 17 nt, Salmonella typhimurium LT2
ucagaaucagauccgcg

SEQ ID NO: 3796745 - RNA, 14 nt, Salmonella typhimurium LT2
ucagaauuucccca

SEQ ID NO: 3796746 - RNA, 16 nt, Salmonella typhimurium LT2
ucagaauuuccccagu

SEQ ID NO: 3796747 - RNA, 16 nt, Salmonella typhimurium LT2
ucagacaacgccgccu

SEQ ID NO: 3796748 - RNA, 17 nt, Salmonella typhimurium LT2
ucagacaccagcccugg

SEQ ID NO: 3796749 - RNA, 19 nt, Salmonella typhimurium LT2
ucagacaccagcccuggcu

SEQ ID NO: 3796750 - RNA, 17 nt, Salmonella typhimurium LT2
ucagacauuguugcguu

SEQ ID NO: 3796751 - RNA, 19 nt, Salmonella typhimurium LT2
ucagaccauaguccaugcc

SEQ ID NO: 3796752 - RNA, 22 nt, Salmonella typhimurium LT2
ucagaccauaguccaugcccaa

SEQ ID NO: 3796753 - RNA, 18 nt, Salmonella typhimurium LT2
ucagaccgagacccagcg

SEQ ID NO: 3796754 - RNA, 18 nt, Salmonella typhimurium LT2
ucagaccgauaaauaccg

SEQ ID NO: 3796755 - RNA, 14 nt, Salmonella typhimurium LT2
ucagacgaggcgca

SEQ ID NO: 3796756 - RNA, 19 nt, Salmonella typhimurium LT2
ucagacgaugugaacgccc

SEQ ID NO: 3796757 - RNA, 16 nt, Salmonella typhimurium LT2
ucagacgcuauuugca

SEQ ID NO: 3796758 - RNA, 13 nt, Salmonella typhimurium LT2
ucagacgcugguu

SEQ ID NO: 3796759 - RNA, 16 nt, Salmonella typhimurium LT2
ucagacggacaucaga

SEQ ID NO: 3796760 - RNA, 17 nt, Salmonella typhimurium LT2
ucagacggacaucagag

SEQ ID NO: 3796761 - RNA, 15 nt, Salmonella typhimurium LT2
ucagacggcugaccu

SEQ ID NO: 3796762 - RNA, 15 nt, Salmonella typhimurium LT2
ucagagcauaaaaau

SEQ ID NO: 3796763 - RNA, 19 nt, Salmonella typhimurium LT2
ucagagcauaaaaaucauu

SEQ ID NO: 3796764 - RNA, 15 nt, Salmonella typhimurium LT2
ucagagcuauguacu

SEQ ID NO: 3796765 - RNA, 21 nt, Salmonella typhimurium LT2
ucagaggccuuuugcagcagc

SEQ ID NO: 3796766 - RNA, 22 nt, Salmonella typhimurium LT2
ucagaggccuuuugcagcagcg

SEQ ID NO: 3796767 - RNA, 21 nt, Salmonella typhimurium LT2
ucagauaaacagguaaaacaa

SEQ ID NO: 3796768 - RNA, 16 nt, Salmonella typhimurium LT2
ucagauacggcuccag

SEQ ID NO: 3796769 - RNA, 20 nt, Salmonella typhimurium LT2
ucagauagagaaggcuggaa

SEQ ID NO: 3796770 - RNA, 16 nt, Salmonella typhimurium LT2
ucagauaggcgcgaaa

SEQ ID NO: 3796771 - RNA, 23 nt, Salmonella typhimurium LT2
ucagauaggcgcgaaaugucccg

SEQ ID NO: 3796772 - RNA, 12 nt, Salmonella typhimurium LT2
ucagaucaauac

SEQ ID NO: 3796773 - RNA, 15 nt, Salmonella typhimurium LT2
ucagauccaacgcuu

SEQ ID NO: 3796774 - RNA, 15 nt, Salmonella typhimurium LT2
ucagaucggcaagca

SEQ ID NO: 3796775 - RNA, 15 nt, Salmonella typhimurium LT2
ucagaucugcgccca

SEQ ID NO: 3796776 - RNA, 20 nt, Salmonella typhimurium LT2
ucagaucuuauaugagcggg

SEQ ID NO: 3796777 - RNA, 18 nt, Salmonella typhimurium LT2
ucagaugacaguccgggc

SEQ ID NO: 3796778 - RNA, 17 nt, Salmonella typhimurium LT2
ucagauugccacaggac

SEQ ID NO: 3796779 - RNA, 11 nt, Salmonella typhimurium LT2
ucagcaaaaac

SEQ ID NO: 3796780 - RNA, 14 nt, Salmonella typhimurium LT2
ucagcaaaaacauu

SEQ ID NO: 3796781 - RNA, 15 nt, Salmonella typhimurium LT2
ucagcaaaaucacgc

SEQ ID NO: 3796782 - RNA, 13 nt, Salmonella typhimurium LT2
ucagcaaauaauc

SEQ ID NO: 3796783 - RNA, 14 nt, Salmonella typhimurium LT2
ucagcaacaccacc

SEQ ID NO: 3796784 - RNA, 18 nt, Salmonella typhimurium LT2
ucagcaacccuuuuucaa

SEQ ID NO: 3796785 - RNA, 16 nt, Salmonella typhimurium LT2
ucagcaacgccuccag

SEQ ID NO: 3796786 - RNA, 19 nt, Salmonella typhimurium LT2
ucagcaacggaagcugacc

SEQ ID NO: 3796787 - RNA, 13 nt, Salmonella typhimurium LT2
ucagcaacugcgu

SEQ ID NO: 3796788 - RNA, 17 nt, Salmonella typhimurium LT2
ucagcaauuaacaaaua

SEQ ID NO: 3796789 - RNA, 18 nt, Salmonella typhimurium LT2
ucagcaauuaacaaauaa

SEQ ID NO: 3796790 - RNA, 15 nt, Salmonella typhimurium LT2
ucagcaauugccuga

SEQ ID NO: 3796791 - RNA, 20 nt, Salmonella typhimurium LT2
ucagcaauuucucgcccgcc

SEQ ID NO: 3796792 - RNA, 20 nt, Salmonella typhimurium LT2
ucagcaauuuuguuaaaucc

SEQ ID NO: 3796793 - RNA, 16 nt, Salmonella typhimurium LT2
ucagcacaaaauccca

SEQ ID NO: 3796794 - RNA, 21 nt, Salmonella typhimurium LT2
ucagcacaaaaucccacaucc

SEQ ID NO: 3796795 - RNA, 16 nt, Salmonella typhimurium LT2
ucagcacacuacacag

SEQ ID NO: 3796796 - RNA, 18 nt, Salmonella typhimurium LT2
ucagcaccacgcccggau

SEQ ID NO: 3796797 - RNA, 12 nt, Salmonella typhimurium LT2
ucagcaccagcg

SEQ ID NO: 3796798 - RNA, 17 nt, Salmonella typhimurium LT2
ucagcaccgcgcgcugc

SEQ ID NO: 3796799 - RNA, 14 nt, Salmonella typhimurium LT2
ucagcacgcggaac

SEQ ID NO: 3796800 - RNA, 21 nt, Salmonella typhimurium LT2
ucagcacgcuuuggcaggccu

SEQ ID NO: 3796801 - RNA, 22 nt, Salmonella typhimurium LT2
ucagcacgcuuuggcaggccuc

SEQ ID NO: 3796802 - RNA, 15 nt, Salmonella typhimurium LT2
ucagcacuucccacu

SEQ ID NO: 3796803 - RNA, 14 nt, Salmonella typhimurium LT2
ucagcagcaccacu

SEQ ID NO: 3796804 - RNA, 15 nt, Salmonella typhimurium LT2
ucagcagccgggcca

SEQ ID NO: 3796805 - RNA, 19 nt, Salmonella typhimurium LT2
ucagcaggcuacgguacug

SEQ ID NO: 3796806 - RNA, 12 nt, Salmonella typhimurium LT2
ucagcaguucau

SEQ ID NO: 3796807 - RNA, 21 nt, Salmonella typhimurium LT2
ucagcauaauauccugcaccg

SEQ ID NO: 3796808 - RNA, 20 nt, Salmonella typhimurium LT2
ucagcauagcgccuucaggc

SEQ ID NO: 3796809 - RNA, 13 nt, Salmonella typhimurium LT2
ucagcaucaucac

SEQ ID NO: 3796810 - RNA, 19 nt, Salmonella typhimurium LT2
ucagcaucgggaaucaucg

SEQ ID NO: 3796811 - RNA, 15 nt, Salmonella typhimurium LT2
ucagcaucuuaugcg

SEQ ID NO: 3796812 - RNA, 19 nt, Salmonella typhimurium LT2
ucagcauguuucuccugcc

SEQ ID NO: 3796813 - RNA, 16 nt, Salmonella typhimurium LT2
ucagcauuucggcgug

SEQ ID NO: 3796814 - RNA, 18 nt, Salmonella typhimurium LT2
ucagcauuuucacaaccg

SEQ ID NO: 3796815 - RNA, 16 nt, Salmonella typhimurium LT2
ucagccaaaacccuuc

SEQ ID NO: 3796816 - RNA, 18 nt, Salmonella typhimurium LT2
ucagccacggaauaucuu

SEQ ID NO: 3796817 - RNA, 22 nt, Salmonella typhimurium LT2
ucagccacggaauaucuuuuuu

SEQ ID NO: 3796818 - RNA, 19 nt, Salmonella typhimurium LT2
ucagccacuucuuccagcg

SEQ ID NO: 3796819 - RNA, 18 nt, Salmonella typhimurium LT2
ucagccagcguaccagcg

SEQ ID NO: 3796820 - RNA, 13 nt, Salmonella typhimurium LT2
ucagccagcugcu

SEQ ID NO: 3796821 - RNA, 20 nt, Salmonella typhimurium LT2
ucagccagcugcuggcgaug

SEQ ID NO: 3796822 - RNA, 21 nt, Salmonella typhimurium LT2
ucagccauuaaccagauuacc

SEQ ID NO: 3796823 - RNA, 16 nt, Salmonella typhimurium LT2
ucagcccaaaacgcgc

SEQ ID NO: 3796824 - RNA, 21 nt, Salmonella typhimurium LT2
ucagcccuaucgcugcgcugc

SEQ ID NO: 3796825 - RNA, 18 nt, Salmonella typhimurium LT2
ucagccgcgcauagcugg

SEQ ID NO: 3796826 - RNA, 22 nt, Salmonella typhimurium LT2
ucagccgcgcuaucaaaaugca

SEQ ID NO: 3796827 - RNA, 16 nt, Salmonella typhimurium LT2
ucagccgggcgggaac

SEQ ID NO: 3796828 - RNA, 17 nt, Salmonella typhimurium LT2
ucagccugagcgccagc

SEQ ID NO: 3796829 - RNA, 16 nt, Salmonella typhimurium LT2
ucagccuuaaucaacu

SEQ ID NO: 3796830 - RNA, 14 nt, Salmonella typhimurium LT2
ucagccuuuucaua

SEQ ID NO: 3796831 - RNA, 16 nt, Salmonella typhimurium LT2
ucagccuuuucauaug

SEQ ID NO: 3796832 - RNA, 18 nt, Salmonella typhimurium LT2
ucagcgacucauucagca

SEQ ID NO: 3796833 - RNA, 16 nt, Salmonella typhimurium LT2
ucagcgauucaaacuc

SEQ ID NO: 3796834 - RNA, 21 nt, Salmonella typhimurium LT2
ucagcgcauggacgucgacgc

SEQ ID NO: 3796835 - RNA, 14 nt, Salmonella typhimurium LT2
ucagcgccaccaca

SEQ ID NO: 3796836 - RNA, 15 nt, Salmonella typhimurium LT2
ucagcgccaccacaa

SEQ ID NO: 3796837 - RNA, 17 nt, Salmonella typhimurium LT2
ucagcgccaccacaaac

SEQ ID NO: 3796838 - RNA, 14 nt, Salmonella typhimurium LT2
ucagcgccagcccu

SEQ ID NO: 3796839 - RNA, 17 nt, Salmonella typhimurium LT2
ucagcgccagcgcugac

SEQ ID NO: 3796840 - RNA, 23 nt, Salmonella typhimurium LT2
ucaguaccucgcauacuuccuca

SEQ ID NO: 3796841 - RNA, 12 nt, Salmonella typhimurium LT2
ucaguauggcca

SEQ ID NO: 3796842 - RNA, 13 nt, Salmonella typhimurium LT2
ucagucauaaucc

SEQ ID NO: 3796843 - RNA, 23 nt, Salmonella typhimurium LT2
ucaguccccagcguaccacgccg

SEQ ID NO: 3796844 - RNA, 19 nt, Salmonella typhimurium LT2
ucaguccgcaaagaaccaa

SEQ ID NO: 3796845 - RNA, 14 nt, Salmonella typhimurium LT2
ucagugaacacccu

SEQ ID NO: 3796846 - RNA, 17 nt, Salmonella typhimurium LT2
ucagugaacacccugcc

SEQ ID NO: 3796847 - RNA, 17 nt, Salmonella typhimurium LT2
ucagugaacguucacua

SEQ ID NO: 3796848 - RNA, 12 nt, Salmonella typhimurium LT2
ucagugauaaag

SEQ ID NO: 3796849 - RNA, 21 nt, Salmonella typhimurium LT2
ucagugauaaagcacagcccc

SEQ ID NO: 3796850 - RNA, 18 nt, Salmonella typhimurium LT2
ucagugccaaaucaugag

SEQ ID NO: 3796851 - RNA, 14 nt, Salmonella typhimurium LT2
ucaguggaaaacag

SEQ ID NO: 3796852 - RNA, 15 nt, Salmonella typhimurium LT2
ucaguggaaaacagc

SEQ ID NO: 3796853 - RNA, 18 nt, Salmonella typhimurium LT2
ucaguggcguagcguacu

SEQ ID NO: 3796854 - RNA, 20 nt, Salmonella typhimurium LT2
ucaguggcguagcguacugc

SEQ ID NO: 3796855 - RNA, 22 nt, Salmonella typhimurium LT2
ucaguggucauuuuacugcgua

SEQ ID NO: 3796856 - RNA, 18 nt, Salmonella typhimurium LT2
ucaguuaugacagacagg

SEQ ID NO: 3796857 - RNA, 14 nt, Salmonella typhimurium LT2
ucaguucagaaacg

SEQ ID NO: 3796858 - RNA, 16 nt, Salmonella typhimurium LT2
ucaguucagccgccag

SEQ ID NO: 3796859 - RNA, 12 nt, Salmonella typhimurium LT2
ucaguucaggaa

SEQ ID NO: 3796860 - RNA, 22 nt, Salmonella typhimurium LT2
ucaguucgccacggucggcaau

SEQ ID NO: 3796861 - RNA, 14 nt, Salmonella typhimurium LT2
ucaguuguccauuu

SEQ ID NO: 3796862 - RNA, 13 nt, Salmonella typhimurium LT2
ucaguuucggccc

SEQ ID NO: 3796863 - RNA, 17 nt, Salmonella typhimurium LT2
ucaguuugccuuuauuc

SEQ ID NO: 3796864 - RNA, 22 nt, Salmonella typhimurium LT2
ucauaaaacccguuaaauacca

SEQ ID NO: 3796865 - RNA, 21 nt, Salmonella typhimurium LT2
ucauaaaaucaaucugcaugu

SEQ ID NO: 3796866 - RNA, 22 nt, Salmonella typhimurium LT2
ucauaaaggcuuuaaagcaggc

SEQ ID NO: 3796867 - RNA, 18 nt, Salmonella typhimurium LT2
ucauaaauagccagcauc

SEQ ID NO: 3796868 - RNA, 21 nt, Salmonella typhimurium LT2
ucauaaccgcagucuccggua

SEQ ID NO: 3796869 - RNA, 17 nt, Salmonella typhimurium LT2
ucauaacgaccaaacaa

SEQ ID NO: 3796870 - RNA, 16 nt, Salmonella typhimurium LT2
ucauaauaaacugcau

SEQ ID NO: 3796871 - RNA, 13 nt, Salmonella typhimurium LT2
ucauaaucgccgu

SEQ ID NO: 3796872 - RNA, 16 nt, Salmonella typhimurium LT2
ucauaaugaauacgcu

SEQ ID NO: 3796873 - RNA, 20 nt, Salmonella typhimurium LT2
ucauaauuucguuuuaccca

SEQ ID NO: 3796874 - RNA, 16 nt, Salmonella typhimurium LT2
ucauacauagcaggcc

SEQ ID NO: 3796875 - RNA, 17 nt, Salmonella typhimurium LT2
ucauacauagcaggcca

SEQ ID NO: 3796876 - RNA, 21 nt, Salmonella typhimurium LT2
ucauaccagguuagcgugaau

SEQ ID NO: 3796877 - RNA, 17 nt, Salmonella typhimurium LT2
ucauaccaugauucaua

SEQ ID NO: 3796878 - RNA, 13 nt, Salmonella typhimurium LT2
ucauacccuucca

SEQ ID NO: 3796879 - RNA, 21 nt, Salmonella typhimurium LT2
ucauaccgagagcuacagugu

SEQ ID NO: 3796880 - RNA, 14 nt, Salmonella typhimurium LT2
ucauacgcuuucug

SEQ ID NO: 3796881 - RNA, 14 nt, Salmonella typhimurium LT2
ucauacuauuuccu

SEQ ID NO: 3796882 - RNA, 18 nt, Salmonella typhimurium LT2
ucauacugccaaccauca

SEQ ID NO: 3796883 - RNA, 15 nt, Salmonella typhimurium LT2
ucauaucauccagcc

SEQ ID NO: 3796884 - RNA, 16 nt, Salmonella typhimurium LT2
ucauaucauccagccc

SEQ ID NO: 3796885 - RNA, 15 nt, Salmonella typhimurium LT2
ucauaugugccgaug

SEQ ID NO: 3796886 - RNA, 19 nt, Salmonella typhimurium LT2
ucauauuaaauuccggcuc

SEQ ID NO: 3796887 - RNA, 20 nt, Salmonella typhimurium LT2
ucauauucaagaacgguuua

SEQ ID NO: 3796888 - RNA, 20 nt, Salmonella typhimurium LT2
ucauauuguagguuuuccuc

SEQ ID NO: 3796889 - RNA, 13 nt, Salmonella typhimurium LT2
ucauauuuauaca

SEQ ID NO: 3796890 - RNA, 11 nt, Salmonella typhimurium LT2
ucaucaacgcg

SEQ ID NO: 3796891 - RNA, 21 nt, Salmonella typhimurium LT2
ucaucaagauuuugugaccgc

SEQ ID NO: 3796892 - RNA, 20 nt, Salmonella typhimurium LT2
ucaucaauaccguccagcgc

SEQ ID NO: 3796893 - RNA, 19 nt, Salmonella typhimurium LT2
ucaucaauacguuaugcag

SEQ ID NO: 3796894 - RNA, 17 nt, Salmonella typhimurium LT2
ucaucaaucaucucauu

SEQ ID NO: 3796895 - RNA, 21 nt, Salmonella typhimurium LT2
ucaucaauggauuuauggcac

SEQ ID NO: 3796896 - RNA, 20 nt, Salmonella typhimurium LT2
ucaucacaaaaucauugcgu

SEQ ID NO: 3796897 - RNA, 20 nt, Salmonella typhimurium LT2
ucaucacaucgcgcagcagg

SEQ ID NO: 3796898 - RNA, 16 nt, Salmonella typhimurium LT2
ucaucaccagcagcag

SEQ ID NO: 3796899 - RNA, 20 nt, Salmonella typhimurium LT2
ucaucaccuacccucaacgc

SEQ ID NO: 3796900 - RNA, 17 nt, Salmonella typhimurium LT2
ucaucagaccgagaccc

SEQ ID NO: 3796901 - RNA, 15 nt, Salmonella typhimurium LT2
ucaucagcacaaaau

SEQ ID NO: 3796902 - RNA, 15 nt, Salmonella typhimurium LT2
ucaucagcagcagcg

SEQ ID NO: 3796903 - RNA, 19 nt, Salmonella typhimurium LT2
ucaucagcagcagcguaau

SEQ ID NO: 3796904 - RNA, 15 nt, Salmonella typhimurium LT2
ucaucagcaucuuug

SEQ ID NO: 3796905 - RNA, 16 nt, Salmonella typhimurium LT2
ucaucagccugaaaga

SEQ ID NO: 3796906 - RNA, 15 nt, Salmonella typhimurium LT2
ucaucaggcaauaaa

SEQ ID NO: 3796907 - RNA, 19 nt, Salmonella typhimurium LT2
ucaucaggcaauaaacauc

SEQ ID NO: 3796908 - RNA, 15 nt, Salmonella typhimurium LT2
ucaucaggccugcaa

SEQ ID NO: 3796909 - RNA, 21 nt, Salmonella typhimurium LT2
ucaucaggccugcaaaccucu

SEQ ID NO: 3796910 - RNA, 12 nt, Salmonella typhimurium LT2
ucaucauacuga

SEQ ID NO: 3796911 - RNA, 19 nt, Salmonella typhimurium LT2
ucaucauacugaagauaaa

SEQ ID NO: 3796912 - RNA, 16 nt, Salmonella typhimurium LT2
ucaucauauggcugga

SEQ ID NO: 3796913 - RNA, 16 nt, Salmonella typhimurium LT2
ucaucaucggcacagc

SEQ ID NO: 3796914 - RNA, 22 nt, Salmonella typhimurium LT2
ucaucaucuuguccucaucauu

SEQ ID NO: 3796915 - RNA, 18 nt, Salmonella typhimurium LT2
ucaucaugacacuuuauu

SEQ ID NO: 3796916 - RNA, 22 nt, Salmonella typhimurium LT2
ucaucaugcugcugauccuguu

SEQ ID NO: 3796917 - RNA, 21 nt, Salmonella typhimurium LT2
ucaucauggcugauggcgaaa

SEQ ID NO: 3796918 - RNA, 15 nt, Salmonella typhimurium LT2
ucaucauucgcgaau

SEQ ID NO: 3796919 - RNA, 19 nt, Salmonella typhimurium LT2
ucaucauugcgccaagacc

SEQ ID NO: 3796920 - RNA, 15 nt, Salmonella typhimurium LT2
ucaucauuuucccac

SEQ ID NO: 3796921 - RNA, 18 nt, Salmonella typhimurium LT2
ucauccacauacugcaau

SEQ ID NO: 3796922 - RNA, 18 nt, Salmonella typhimurium LT2
ucauccacggcaucaaua

SEQ ID NO: 3796923 - RNA, 19 nt, Salmonella typhimurium LT2
ucauccacgucauaacgcg

SEQ ID NO: 3796924 - RNA, 11 nt, Salmonella typhimurium LT2
ucauccagcaa

SEQ ID NO: 3796925 - RNA, 22 nt, Salmonella typhimurium LT2
ucauccagcaauaacacaggcg

SEQ ID NO: 3796926 - RNA, 11 nt, Salmonella typhimurium LT2
ucauccagcag

SEQ ID NO: 3796927 - RNA, 13 nt, Salmonella typhimurium LT2
ucauccagcagca

SEQ ID NO: 3796928 - RNA, 14 nt, Salmonella typhimurium LT2
ucauccagcagcau

SEQ ID NO: 3796929 - RNA, 20 nt, Salmonella typhimurium LT2
ucauccagucagcaauuaac

SEQ ID NO: 3796930 - RNA, 14 nt, Salmonella typhimurium LT2
ucauccaucagcgc

SEQ ID NO: 3796931 - RNA, 19 nt, Salmonella typhimurium LT2
ucauccauugcuuccuuga

SEQ ID NO: 3796932 - RNA, 19 nt, Salmonella typhimurium LT2
ucaucccacucaaucauug

SEQ ID NO: 3796933 - RNA, 19 nt, Salmonella typhimurium LT2
ucaucccacuccaucgccu

SEQ ID NO: 3796934 - RNA, 22 nt, Salmonella typhimurium LT2
ucaucccgguuugggcgcgaaa

SEQ ID NO: 3796935 - RNA, 23 nt, Salmonella typhimurium LT2
ucaucccgguuugggcgcgaaac

SEQ ID NO: 3796936 - RNA, 17 nt, Salmonella typhimurium LT2
ucauccgagaccaggcg

SEQ ID NO: 3796937 - RNA, 12 nt, Salmonella typhimurium LT2
ucauccgcuucg

SEQ ID NO: 3796938 - RNA, 12 nt, Salmonella typhimurium LT2
ucauccggcguu

SEQ ID NO: 3796939 - RNA, 21 nt, Salmonella typhimurium LT2
ucauccgguucauaauccgga

SEQ ID NO: 3796940 - RNA, 13 nt, Salmonella typhimurium LT2
ucaucgaacgccg

SEQ ID NO: 3796941 - RNA, 16 nt, Salmonella typhimurium LT2
ucaucgaacgccgccu

SEQ ID NO: 3796942 - RNA, 14 nt, Salmonella typhimurium LT2
ucaucgacaaauac

SEQ ID NO: 3796943 - RNA, 18 nt, Salmonella typhimurium LT2
ucaucgacaguaccagca

SEQ ID NO: 3796944 - RNA, 14 nt, Salmonella typhimurium LT2
uccaacucaguuuc

SEQ ID NO: 3796945 - RNA, 15 nt, Salmonella typhimurium LT2
uccaacugucgccau

SEQ ID NO: 3796946 - RNA, 17 nt, Salmonella typhimurium LT2
uccaaucucuuuugcgg

SEQ ID NO: 3796947 - RNA, 16 nt, Salmonella typhimurium LT2
uccacaaacgccggau

SEQ ID NO: 3796948 - RNA, 16 nt, Salmonella typhimurium LT2
uccacaaucccggcaa

SEQ ID NO: 3796949 - RNA, 15 nt, Salmonella typhimurium LT2
uccacaccuuccacu

SEQ ID NO: 3796950 - RNA, 16 nt, Salmonella typhimurium LT2
uccacacguccauccg

SEQ ID NO: 3796951 - RNA, 17 nt, Salmonella typhimurium LT2
uccacacugacgcgcca

SEQ ID NO: 3796952 - RNA, 22 nt, Salmonella typhimurium LT2
uccacagguaaaauugccgcca

SEQ ID NO: 3796953 - RNA, 15 nt, Salmonella typhimurium LT2
uccacauaaaguagc

SEQ ID NO: 3796954 - RNA, 14 nt, Salmonella typhimurium LT2
uccacauugcaaug

SEQ ID NO: 3796955 - RNA, 14 nt, Salmonella typhimurium LT2
uccacauuggcuuu

SEQ ID NO: 3796956 - RNA, 12 nt, Salmonella typhimurium LT2
uccaccaccauc

SEQ ID NO: 3796957 - RNA, 12 nt, Salmonella typhimurium LT2
uccaccaccucc

SEQ ID NO: 3796958 - RNA, 19 nt, Salmonella typhimurium LT2
uccaccaccuggugaaacu

SEQ ID NO: 3796959 - RNA, 12 nt, Salmonella typhimurium LT2
uccaccagaacc

SEQ ID NO: 3796960 - RNA, 13 nt, Salmonella typhimurium LT2
uccaccagcccau

SEQ ID NO: 3796961 - RNA, 21 nt, Salmonella typhimurium LT2
uccaccagcccaucuuucgcc

SEQ ID NO: 3796962 - RNA, 19 nt, Salmonella typhimurium LT2
uccaccagccccaaaauuc

SEQ ID NO: 3796963 - RNA, 13 nt, Salmonella typhimurium LT2
uccaccagcgcca

SEQ ID NO: 3796964 - RNA, 15 nt, Salmonella typhimurium LT2
uccaccagcggacgg

SEQ ID NO: 3796965 - RNA, 16 nt, Salmonella typhimurium LT2
uccaccagcuuaucug

SEQ ID NO: 3796966 - RNA, 18 nt, Salmonella typhimurium LT2
uccaccaggcaugcagcu

SEQ ID NO: 3796967 - RNA, 16 nt, Salmonella typhimurium LT2
uccaccauaggccagc

SEQ ID NO: 3796968 - RNA, 18 nt, Salmonella typhimurium LT2
uccaccauaggccagcgu

SEQ ID NO: 3796969 - RNA, 14 nt, Salmonella typhimurium LT2
uccaccccagcauu

SEQ ID NO: 3796970 - RNA, 18 nt, Salmonella typhimurium LT2
uccaccccagcauuacca

SEQ ID NO: 3796971 - RNA, 18 nt, Salmonella typhimurium LT2
uccacccucgucagugaa

SEQ ID NO: 3796972 - RNA, 12 nt, Salmonella typhimurium LT2
uccaccgccaga

SEQ ID NO: 3796973 - RNA, 19 nt, Salmonella typhimurium LT2
uccaccgccagcauaucca

SEQ ID NO: 3796974 - RNA, 18 nt, Salmonella typhimurium LT2
uccaccggguccagucgc

SEQ ID NO: 3796975 - RNA, 20 nt, Salmonella typhimurium LT2
uccaccuacgcucauaaaaa

SEQ ID NO: 3796976 - RNA, 19 nt, Salmonella typhimurium LT2
uccaccucgcgacugcuga

SEQ ID NO: 3796977 - RNA, 20 nt, Salmonella typhimurium LT2
uccaccuuaccuucauccug

SEQ ID NO: 3796978 - RNA, 15 nt, Salmonella typhimurium LT2
uccacgcacgccggc

SEQ ID NO: 3796979 - RNA, 19 nt, Salmonella typhimurium LT2
uccacgccgcuaucgacca

SEQ ID NO: 3796980 - RNA, 15 nt, Salmonella typhimurium LT2
uccacgccuggcagu

SEQ ID NO: 3796981 - RNA, 22 nt, Salmonella typhimurium LT2
uccacgcgaugagcugcgguaa

SEQ ID NO: 3796982 - RNA, 14 nt, Salmonella typhimurium LT2
uccacgcgcaccau

SEQ ID NO: 3796983 - RNA, 14 nt, Salmonella typhimurium LT2
uccacggcaucaau

SEQ ID NO: 3796984 - RNA, 17 nt, Salmonella typhimurium LT2
uccacguauaauaauau

SEQ ID NO: 3796985 - RNA, 22 nt, Salmonella typhimurium LT2
uccacguauaauaauauccuuu

SEQ ID NO: 3796986 - RNA, 16 nt, Salmonella typhimurium LT2
uccacguuuuacuucc

SEQ ID NO: 3796987 - RNA, 16 nt, Salmonella typhimurium LT2
uccacuaacuggcaau

SEQ ID NO: 3796988 - RNA, 16 nt, Salmonella typhimurium LT2
uccacugagcgcgcca

SEQ ID NO: 3796989 - RNA, 21 nt, Salmonella typhimurium LT2
uccacugaguuucaccgccag

SEQ ID NO: 3796990 - RNA, 22 nt, Salmonella typhimurium LT2
uccacugaguuucaccgccaga

SEQ ID NO: 3796991 - RNA, 18 nt, Salmonella typhimurium LT2
uccacugcaucucuucca

SEQ ID NO: 3796992 - RNA, 19 nt, Salmonella typhimurium LT2
uccacugcuuaucgauauc

SEQ ID NO: 3796993 - RNA, 19 nt, Salmonella typhimurium LT2
uccacugguaggcauccag

SEQ ID NO: 3796994 - RNA, 22 nt, Salmonella typhimurium LT2
uccacuguccagaucuucccag

SEQ ID NO: 3796995 - RNA, 23 nt, Salmonella typhimurium LT2
uccacuguccagaucuucccagu

SEQ ID NO: 3796996 - RNA, 22 nt, Salmonella typhimurium LT2
uccacuucagccagcugcuggc

SEQ ID NO: 3796997 - RNA, 13 nt, Salmonella typhimurium LT2
uccacuucaucag

SEQ ID NO: 3796998 - RNA, 17 nt, Salmonella typhimurium LT2
uccacuuucucggcuuu

SEQ ID NO: 3796999 - RNA, 23 nt, Salmonella typhimurium LT2
uccacuuucucggcuuuccagcu

SEQ ID NO: 3797000 - RNA, 20 nt, Salmonella typhimurium LT2
uccagaaauaaaauacgcuc

SEQ ID NO: 3797001 - RNA, 19 nt, Salmonella typhimurium LT2
uccagaacugcgaaaucac

SEQ ID NO: 3797002 - RNA, 13 nt, Salmonella typhimurium LT2
uccagaaggcgag

SEQ ID NO: 3797003 - RNA, 17 nt, Salmonella typhimurium LT2
uccagaauacgccgccg

SEQ ID NO: 3797004 - RNA, 18 nt, Salmonella typhimurium LT2
uccagacccagacaaccg

SEQ ID NO: 3797005 - RNA, 23 nt, Salmonella typhimurium LT2
uccagaccggcaugauggcgaac

SEQ ID NO: 3797006 - RNA, 19 nt, Salmonella typhimurium LT2
uccagagcgccguggaaaa

SEQ ID NO: 3797007 - RNA, 22 nt, Salmonella typhimurium LT2
uccagaggaucuggacgccaau

SEQ ID NO: 3797008 - RNA, 16 nt, Salmonella typhimurium LT2
uccagauagcgcugcg

SEQ ID NO: 3797009 - RNA, 18 nt, Salmonella typhimurium LT2
uccagauagggccaggcg

SEQ ID NO: 3797010 - RNA, 18 nt, Salmonella typhimurium LT2
uccagauccacugcaucc

SEQ ID NO: 3797011 - RNA, 20 nt, Salmonella typhimurium LT2
uccagaucuucacgcgucag

SEQ ID NO: 3797012 - RNA, 17 nt, Salmonella typhimurium LT2
uccagaucuucccaguu

SEQ ID NO: 3797013 - RNA, 18 nt, Salmonella typhimurium LT2
uccagaucuucccaguua

SEQ ID NO: 3797014 - RNA, 23 nt, Salmonella typhimurium LT2
uccagaucuucccaguuauauuu

SEQ ID NO: 3797015 - RNA, 16 nt, Salmonella typhimurium LT2
uccagaugaagcgcau

SEQ ID NO: 3797016 - RNA, 14 nt, Salmonella typhimurium LT2
uccagaugacacua

SEQ ID NO: 3797017 - RNA, 21 nt, Salmonella typhimurium LT2
uccagaugcgccagauucaug

SEQ ID NO: 3797018 - RNA, 18 nt, Salmonella typhimurium LT2
uccagaugucaguaacag

SEQ ID NO: 3797019 - RNA, 17 nt, Salmonella typhimurium LT2
uccagcaaaaaaugccg

SEQ ID NO: 3797020 - RNA, 14 nt, Salmonella typhimurium LT2
uccagcaacagaag

SEQ ID NO: 3797021 - RNA, 16 nt, Salmonella typhimurium LT2
uccagcacauccucaa

SEQ ID NO: 3797022 - RNA, 17 nt, Salmonella typhimurium LT2
uccagcacauccucaau

SEQ ID NO: 3797023 - RNA, 15 nt, Salmonella typhimurium LT2
uccagcaccucaucc

SEQ ID NO: 3797024 - RNA, 20 nt, Salmonella typhimurium LT2
uccagcacgagugccagccc

SEQ ID NO: 3797025 - RNA, 15 nt, Salmonella typhimurium LT2
uccagcacgcgcugc

SEQ ID NO: 3797026 - RNA, 12 nt, Salmonella typhimurium LT2
uccagcacggca

SEQ ID NO: 3797027 - RNA, 20 nt, Salmonella typhimurium LT2
uccagcacggcauaagccuc

SEQ ID NO: 3797028 - RNA, 12 nt, Salmonella typhimurium LT2
uccagcagcagg

SEQ ID NO: 3797029 - RNA, 23 nt, Salmonella typhimurium LT2
uccagcagcaggcaaggcaucag

SEQ ID NO: 3797030 - RNA, 11 nt, Salmonella typhimurium LT2
uccagcagcca

SEQ ID NO: 3797031 - RNA, 21 nt, Salmonella typhimurium LT2
uccagcagccacagaaugccg

SEQ ID NO: 3797032 - RNA, 20 nt, Salmonella typhimurium LT2
uccagcagccaugccagcgc

SEQ ID NO: 3797033 - RNA, 17 nt, Salmonella typhimurium LT2
uccagcagcucaucaau

SEQ ID NO: 3797034 - RNA, 20 nt, Salmonella typhimurium LT2
uccagcagggcguuuuccag

SEQ ID NO: 3797035 - RNA, 22 nt, Salmonella typhimurium LT2
uccagcaggguauuugcgcccg

SEQ ID NO: 3797036 - RNA, 20 nt, Salmonella typhimurium LT2
uccagcagguggaucugaau

SEQ ID NO: 3797037 - RNA, 12 nt, Salmonella typhimurium LT2
uccagcaguguc

SEQ ID NO: 3797038 - RNA, 15 nt, Salmonella typhimurium LT2
uccagcaucagcaau

SEQ ID NO: 3797039 - RNA, 19 nt, Salmonella typhimurium LT2
uccagcaucauuuuuuaau

SEQ ID NO: 3797040 - RNA, 16 nt, Salmonella typhimurium LT2
uccagcauccugcguu

SEQ ID NO: 3797041 - RNA, 23 nt, Salmonella typhimurium LT2
uccagccagcguuucuggaagua

SEQ ID NO: 3797042 - RNA, 13 nt, Salmonella typhimurium LT2
uccagccagggau

SEQ ID NO: 3797043 - RNA, 23 nt, Salmonella typhimurium LT2
uccagccccagcgccagcugcgu

SEQ ID NO: 3797044 - RNA, 13 nt, Salmonella typhimurium LT2
uccagccccuucg

SEQ ID NO: 3797045 - RNA, 13 nt, Salmonella typhimurium LT2
uccagcccgcguu

SEQ ID NO: 3797046 - RNA, 23 nt, Salmonella typhimurium LT2
uccagcccggcggauaaaucauc

SEQ ID NO: 3797047 - RNA, 16 nt, Salmonella typhimurium LT2
uccagccgccaggcaa

SEQ ID NO: 3797048 - RNA, 15 nt, Salmonella typhimurium LT2
uccauguucggcaug

SEQ ID NO: 3797049 - RNA, 20 nt, Salmonella typhimurium LT2
uccauguuuccccuucuggu

SEQ ID NO: 3797050 - RNA, 21 nt, Salmonella typhimurium LT2
uccauuaaaugcgccagcggc

SEQ ID NO: 3797051 - RNA, 20 nt, Salmonella typhimurium LT2
uccauuaaauuacuuguuga

SEQ ID NO: 3797052 - RNA, 20 nt, Salmonella typhimurium LT2
uccauuaaguugaugaauga

SEQ ID NO: 3797053 - RNA, 16 nt, Salmonella typhimurium LT2
uccauucccgccgcaa

SEQ ID NO: 3797054 - RNA, 22 nt, Salmonella typhimurium LT2
uccauugaaacggugccuacug

SEQ ID NO: 3797055 - RNA, 18 nt, Salmonella typhimurium LT2
uccauugcgagaaaaaac

SEQ ID NO: 3797056 - RNA, 17 nt, Salmonella typhimurium LT2
uccauuggcgggcgaau

SEQ ID NO: 3797057 - RNA, 12 nt, Salmonella typhimurium LT2
uccauuuuccua

SEQ ID NO: 3797058 - RNA, 18 nt, Salmonella typhimurium LT2
uccauuuuggggaaaaua

SEQ ID NO: 3797059 - RNA, 15 nt, Salmonella typhimurium LT2
uccauuuuugcggau

SEQ ID NO: 3797060 - RNA, 18 nt, Salmonella typhimurium LT2
ucccaacaaugccacgcc

SEQ ID NO: 3797061 - RNA, 15 nt, Salmonella typhimurium LT2
ucccaacagcgagcu

SEQ ID NO: 3797062 - RNA, 16 nt, Salmonella typhimurium LT2
ucccaauaccggcgua

SEQ ID NO: 3797063 - RNA, 18 nt, Salmonella typhimurium LT2
ucccaauacggcuaagca

SEQ ID NO: 3797064 - RNA, 14 nt, Salmonella typhimurium LT2
ucccacaccacacg

SEQ ID NO: 3797065 - RNA, 18 nt, Salmonella typhimurium LT2
ucccacaguuaacgccaa

SEQ ID NO: 3797066 - RNA, 15 nt, Salmonella typhimurium LT2
ucccaccacuucgcc

SEQ ID NO: 3797067 - RNA, 12 nt, Salmonella typhimurium LT2
ucccaccaggag

SEQ ID NO: 3797068 - RNA, 14 nt, Salmonella typhimurium LT2
ucccacccagcaau

SEQ ID NO: 3797069 - RNA, 21 nt, Salmonella typhimurium LT2
ucccacgucgccuuuaacgcc

SEQ ID NO: 3797070 - RNA, 13 nt, Salmonella typhimurium LT2
ucccacucuucca

SEQ ID NO: 3797071 - RNA, 14 nt, Salmonella typhimurium LT2
ucccacucuuccag

SEQ ID NO: 3797072 - RNA, 22 nt, Salmonella typhimurium LT2
ucccacuuggcgaucaccagca

SEQ ID NO: 3797073 - RNA, 13 nt, Salmonella typhimurium LT2
ucccagaccauuc

SEQ ID NO: 3797074 - RNA, 17 nt, Salmonella typhimurium LT2
ucccagauuaaaucauc

SEQ ID NO: 3797075 - RNA, 11 nt, Salmonella typhimurium LT2
ucccagcacaa

SEQ ID NO: 3797076 - RNA, 15 nt, Salmonella typhimurium LT2
ucccagccgcgauga

SEQ ID NO: 3797077 - RNA, 14 nt, Salmonella typhimurium LT2
ucccagccgggcag

SEQ ID NO: 3797078 - RNA, 20 nt, Salmonella typhimurium LT2
ucccagcgcgcgcgcaaagc

SEQ ID NO: 3797079 - RNA, 15 nt, Salmonella typhimurium LT2
ucccagcggacugau

SEQ ID NO: 3797080 - RNA, 18 nt, Salmonella typhimurium LT2
ucccagcuaaaaagcugu

SEQ ID NO: 3797081 - RNA, 14 nt, Salmonella typhimurium LT2
ucccagcugagcua

SEQ ID NO: 3797082 - RNA, 19 nt, Salmonella typhimurium LT2
ucccaggccgccaccgccu

SEQ ID NO: 3797083 - RNA, 16 nt, Salmonella typhimurium LT2
ucccaggcgcgcagcu

SEQ ID NO: 3797084 - RNA, 16 nt, Salmonella typhimurium LT2
ucccauacugcccagc

SEQ ID NO: 3797085 - RNA, 22 nt, Salmonella typhimurium LT2
ucccauacugcccagccgccag

SEQ ID NO: 3797086 - RNA, 12 nt, Salmonella typhimurium LT2
ucccauccgccg

SEQ ID NO: 3797087 - RNA, 14 nt, Salmonella typhimurium LT2
ucccauccgggcca

SEQ ID NO: 3797088 - RNA, 19 nt, Salmonella typhimurium LT2
ucccauccgugcgauaaga

SEQ ID NO: 3797089 - RNA, 19 nt, Salmonella typhimurium LT2
ucccaugacgacagguuua

SEQ ID NO: 3797090 - RNA, 18 nt, Salmonella typhimurium LT2
ucccauguugcgccgaau

SEQ ID NO: 3797091 - RNA, 17 nt, Salmonella typhimurium LT2
ucccauugggccagcag

SEQ ID NO: 3797092 - RNA, 16 nt, Salmonella typhimurium LT2
uccccaacagcgacca

SEQ ID NO: 3797093 - RNA, 14 nt, Salmonella typhimurium LT2
uccccaacaucaug

SEQ ID NO: 3797094 - RNA, 21 nt, Salmonella typhimurium LT2
uccccaacaucauuacugcuu

SEQ ID NO: 3797095 - RNA, 22 nt, Salmonella typhimurium LT2
uccccaacgagagcacuacgcu

SEQ ID NO: 3797096 - RNA, 17 nt, Salmonella typhimurium LT2
uccccacaaucccgcca

SEQ ID NO: 3797097 - RNA, 20 nt, Salmonella typhimurium LT2
uccccacaggaucaccgcca

SEQ ID NO: 3797098 - RNA, 14 nt, Salmonella typhimurium LT2
uccccaccacugau

SEQ ID NO: 3797099 - RNA, 21 nt, Salmonella typhimurium LT2
uccccacgccgaccaccagcu

SEQ ID NO: 3797100 - RNA, 23 nt, Salmonella typhimurium LT2
uccccagcguaccacgccgcaca

SEQ ID NO: 3797101 - RNA, 19 nt, Salmonella typhimurium LT2
uccccagcuaaaaacgcca

SEQ ID NO: 3797102 - RNA, 20 nt, Salmonella typhimurium LT2
uccccagcuaaaaacgccaa

SEQ ID NO: 3797103 - RNA, 19 nt, Salmonella typhimurium LT2
uccccaggcgcuauuccca

SEQ ID NO: 3797104 - RNA, 23 nt, Salmonella typhimurium LT2
uccccaggcuggcgcagccgcuu

SEQ ID NO: 3797105 - RNA, 21 nt, Salmonella typhimurium LT2
uccccauaaucgaccguaucc

SEQ ID NO: 3797106 - RNA, 23 nt, Salmonella typhimurium LT2
uccccauacugacggcgcucuuu

SEQ ID NO: 3797107 - RNA, 13 nt, Salmonella typhimurium LT2
uccccauaucccg

SEQ ID NO: 3797108 - RNA, 19 nt, Salmonella typhimurium LT2
uccccauaucccgaaaagc

SEQ ID NO: 3797109 - RNA, 19 nt, Salmonella typhimurium LT2
uccccaucccaaucagguu

SEQ ID NO: 3797110 - RNA, 15 nt, Salmonella typhimurium LT2
uccccaucccagacc

SEQ ID NO: 3797111 - RNA, 16 nt, Salmonella typhimurium LT2
ucccccagauucugau

SEQ ID NO: 3797112 - RNA, 24 nt, Salmonella typhimurium LT2
ucccccagccgcagccaccccggc

SEQ ID NO: 3797113 - RNA, 13 nt, Salmonella typhimurium LT2
ucccccccuuccc

SEQ ID NO: 3797114 - RNA, 17 nt, Salmonella typhimurium LT2
uccccccuuuuuugcug

SEQ ID NO: 3797115 - RNA, 22 nt, Salmonella typhimurium LT2
uccccccuuuuuugcuggcaag

SEQ ID NO: 3797116 - RNA, 14 nt, Salmonella typhimurium LT2
ucccccgcugaggc

SEQ ID NO: 3797117 - RNA, 21 nt, Salmonella typhimurium LT2
ucccccggcaccacgcacagu

SEQ ID NO: 3797118 - RNA, 20 nt, Salmonella typhimurium LT2
ucccccggcgccuuuuaaau

SEQ ID NO: 3797119 - RNA, 22 nt, Salmonella typhimurium LT2
ucccccugauagcgagcgauag

SEQ ID NO: 3797120 - RNA, 12 nt, Salmonella typhimurium LT2
ucccccuggccc

SEQ ID NO: 3797121 - RNA, 17 nt, Salmonella typhimurium LT2
uccccgccaucuucacg

SEQ ID NO: 3797122 - RNA, 12 nt, Salmonella typhimurium LT2
uccccgccgcca

SEQ ID NO: 3797123 - RNA, 20 nt, Salmonella typhimurium LT2
uccccgcuggcgcggggaac

SEQ ID NO: 3797124 - RNA, 11 nt, Salmonella typhimurium LT2
uccccggcaac

SEQ ID NO: 3797125 - RNA, 22 nt, Salmonella typhimurium LT2
uccccggcaaccuuaaacaucg

SEQ ID NO: 3797126 - RNA, 17 nt, Salmonella typhimurium LT2
uccccggcgaaagaaaa

SEQ ID NO: 3797127 - RNA, 14 nt, Salmonella typhimurium LT2
uccccggcuucaca

SEQ ID NO: 3797128 - RNA, 16 nt, Salmonella typhimurium LT2
uccccgucucuuuauc

SEQ ID NO: 3797129 - RNA, 19 nt, Salmonella typhimurium LT2
uccccguuuuacaccagcu

SEQ ID NO: 3797130 - RNA, 18 nt, Salmonella typhimurium LT2
uccccuacggugugccug

SEQ ID NO: 3797131 - RNA, 15 nt, Salmonella typhimurium LT2
uccccucuuccauca

SEQ ID NO: 3797132 - RNA, 12 nt, Salmonella typhimurium LT2
uccccugcagau

SEQ ID NO: 3797133 - RNA, 16 nt, Salmonella typhimurium LT2
uccccugcagaugcug

SEQ ID NO: 3797134 - RNA, 14 nt, Salmonella typhimurium LT2
uccccugcaggaau

SEQ ID NO: 3797135 - RNA, 15 nt, Salmonella typhimurium LT2
uccccugcuccugcc

SEQ ID NO: 3797136 - RNA, 19 nt, Salmonella typhimurium LT2
uccccugcuccugccagau

SEQ ID NO: 3797137 - RNA, 21 nt, Salmonella typhimurium LT2
uccccuuuucacccaacauuu

SEQ ID NO: 3797138 - RNA, 16 nt, Salmonella typhimurium LT2
uccccuuuuuucuguu

SEQ ID NO: 3797139 - RNA, 21 nt, Salmonella typhimurium LT2
ucccgaacugucugaaucaau

SEQ ID NO: 3797140 - RNA, 18 nt, Salmonella typhimurium LT2
ucccgacacuuguaaguu

SEQ ID NO: 3797141 - RNA, 21 nt, Salmonella typhimurium LT2
ucccgacgaauaacaaaauga

SEQ ID NO: 3797142 - RNA, 15 nt, Salmonella typhimurium LT2
ucccgacggcaggcg

SEQ ID NO: 3797143 - RNA, 20 nt, Salmonella typhimurium LT2
ucccgacuuuacaccccacu

SEQ ID NO: 3797144 - RNA, 13 nt, Salmonella typhimurium LT2
ucccgaucuucau

SEQ ID NO: 3797145 - RNA, 19 nt, Salmonella typhimurium LT2
ucccgaucuucaucguuac

SEQ ID NO: 3797146 - RNA, 17 nt, Salmonella typhimurium LT2
ucccgaugguggcgucg

SEQ ID NO: 3797147 - RNA, 21 nt, Salmonella typhimurium LT2
ucccgauuucgcuccacuggc

SEQ ID NO: 3797148 - RNA, 20 nt, Salmonella typhimurium LT2
ucccgcaaacuggccacagc

SEQ ID NO: 3797149 - RNA, 23 nt, Salmonella typhimurium LT2
ucccgcacccgggaaagcggauc

SEQ ID NO: 3797150 - RNA, 14 nt, Salmonella typhimurium LT2
ucccgcacgcuggc

SEQ ID NO: 3797151 - RNA, 22 nt, Salmonella typhimurium LT2
ucccgcacgcuggcaucaauau

SEQ ID NO: 3797152 - RNA, 20 nt, Salmonella typhimurium LT2
uccgcuaccugcgagcugua

SEQ ID NO: 3797153 - RNA, 14 nt, Salmonella typhimurium LT2
uccgcuacuaccgg

SEQ ID NO: 3797154 - RNA, 20 nt, Salmonella typhimurium LT2
uccgcuauuaccaguaauga

SEQ ID NO: 3797155 - RNA, 14 nt, Salmonella typhimurium LT2
uccgcuauuugcgc

SEQ ID NO: 3797156 - RNA, 10 nt, Salmonella typhimurium LT2
uccgcugcaa

SEQ ID NO: 3797157 - RNA, 16 nt, Salmonella typhimurium LT2
uccgcuuuugguuuuu

SEQ ID NO: 3797158 - RNA, 18 nt, Salmonella typhimurium LT2
uccggacguacccaggcg

SEQ ID NO: 3797159 - RNA, 18 nt, Salmonella typhimurium LT2
uccggaguaaugaaaccg

SEQ ID NO: 3797160 - RNA, 21 nt, Salmonella typhimurium LT2
uccggaucaucuuuuaccgcc

SEQ ID NO: 3797161 - RNA, 19 nt, Salmonella typhimurium LT2
uccggaucgccgaagcggc

SEQ ID NO: 3797162 - RNA, 15 nt, Salmonella typhimurium LT2
uccggaucgcggcug

SEQ ID NO: 3797163 - RNA, 20 nt, Salmonella typhimurium LT2
uccggaugcgacuccaggaa

SEQ ID NO: 3797164 - RNA, 20 nt, Salmonella typhimurium LT2
uccggaugcgccucaucugc

SEQ ID NO: 3797165 - RNA, 13 nt, Salmonella typhimurium LT2
uccggauuguuuu

SEQ ID NO: 3797166 - RNA, 19 nt, Salmonella typhimurium LT2
uccggcaacugccggggaa

SEQ ID NO: 3797167 - RNA, 17 nt, Salmonella typhimurium LT2
uccggcacuacagcguu

SEQ ID NO: 3797168 - RNA, 12 nt, Salmonella typhimurium LT2
uccggcaggcaa

SEQ ID NO: 3797169 - RNA, 23 nt, Salmonella typhimurium LT2
uccggcaguuauuuuacgggcgu

SEQ ID NO: 3797170 - RNA, 16 nt, Salmonella typhimurium LT2
uccggcauaaauaaua

SEQ ID NO: 3797171 - RNA, 24 nt, Salmonella typhimurium LT2
uccggcaucacaaaccagacgcgu

SEQ ID NO: 3797172 - RNA, 14 nt, Salmonella typhimurium LT2
uccggccaacagau

SEQ ID NO: 3797173 - RNA, 13 nt, Salmonella typhimurium LT2
uccggccacggau

SEQ ID NO: 3797174 - RNA, 17 nt, Salmonella typhimurium LT2
uccggccagacaggcuu

SEQ ID NO: 3797175 - RNA, 17 nt, Salmonella typhimurium LT2
uccggccaucaugcagg

SEQ ID NO: 3797176 - RNA, 17 nt, Salmonella typhimurium LT2
uccggcccgugccagcu

SEQ ID NO: 3797177 - RNA, 21 nt, Salmonella typhimurium LT2
uccggcccgugccagcuaucg

SEQ ID NO: 3797178 - RNA, 19 nt, Salmonella typhimurium LT2
uccggccuacaagccgccu

SEQ ID NO: 3797179 - RNA, 15 nt, Salmonella typhimurium LT2
uccggccuacagcug

SEQ ID NO: 3797180 - RNA, 15 nt, Salmonella typhimurium LT2
uccggccuacucuug

SEQ ID NO: 3797181 - RNA, 21 nt, Salmonella typhimurium LT2
uccggccuauagcuaauggcu

SEQ ID NO: 3797182 - RNA, 22 nt, Salmonella typhimurium LT2
uccggccucuuuuuagcagcaa

SEQ ID NO: 3797183 - RNA, 16 nt, Salmonella typhimurium LT2
uccggccugcaggcaa

SEQ ID NO: 3797184 - RNA, 15 nt, Salmonella typhimurium LT2
uccggccuggcgcag

SEQ ID NO: 3797185 - RNA, 15 nt, Salmonella typhimurium LT2
uccggccugucagga

SEQ ID NO: 3797186 - RNA, 18 nt, Salmonella typhimurium LT2
uccggcgaauuucaucag

SEQ ID NO: 3797187 - RNA, 14 nt, Salmonella typhimurium LT2
uccggcgacgcgua

SEQ ID NO: 3797188 - RNA, 14 nt, Salmonella typhimurium LT2
uccggcgcaucggu

SEQ ID NO: 3797189 - RNA, 22 nt, Salmonella typhimurium LT2
uccggcguguaaaccgccagau

SEQ ID NO: 3797190 - RNA, 24 nt, Salmonella typhimurium LT2
uccggcguuucguuuagcgccugc

SEQ ID NO: 3797191 - RNA, 15 nt, Salmonella typhimurium LT2
uccggcuacaggcgu

SEQ ID NO: 3797192 - RNA, 15 nt, Salmonella typhimurium LT2
uccggcugaagcccc

SEQ ID NO: 3797193 - RNA, 18 nt, Salmonella typhimurium LT2
uccggcugcaccagcguu

SEQ ID NO: 3797194 - RNA, 11 nt, Salmonella typhimurium LT2
uccggcugccu

SEQ ID NO: 3797195 - RNA, 20 nt, Salmonella typhimurium LT2
uccggcuuauccggccugca

SEQ ID NO: 3797196 - RNA, 16 nt, Salmonella typhimurium LT2
uccgggauauaaaauu

SEQ ID NO: 3797197 - RNA, 17 nt, Salmonella typhimurium LT2
uccgggcgguucggcug

SEQ ID NO: 3797198 - RNA, 14 nt, Salmonella typhimurium LT2
uccggggccagcgc

SEQ ID NO: 3797199 - RNA, 16 nt, Salmonella typhimurium LT2
uccggguucgcggcaa

SEQ ID NO: 3797200 - RNA, 21 nt, Salmonella typhimurium LT2
uccgguaaaucaacaaccggc

SEQ ID NO: 3797201 - RNA, 23 nt, Salmonella typhimurium LT2
uccgguagcaaaggcuaccggac

SEQ ID NO: 3797202 - RNA, 22 nt, Salmonella typhimurium LT2
uccgguagguuuaaaccacucc

SEQ ID NO: 3797203 - RNA, 14 nt, Salmonella typhimurium LT2
uccgguaucggcaa

SEQ ID NO: 3797204 - RNA, 16 nt, Salmonella typhimurium LT2
uccggucauccagcgg

SEQ ID NO: 3797205 - RNA, 14 nt, Salmonella typhimurium LT2
uccggucgcgcaau

SEQ ID NO: 3797206 - RNA, 15 nt, Salmonella typhimurium LT2
uccggugcguuucau

SEQ ID NO: 3797207 - RNA, 20 nt, Salmonella typhimurium LT2
uccguaagcggcggaccagc

SEQ ID NO: 3797208 - RNA, 18 nt, Salmonella typhimurium LT2
uccguaaucgcuuucauu

SEQ ID NO: 3797209 - RNA, 17 nt, Salmonella typhimurium LT2
uccguauugagcagcgg

SEQ ID NO: 3797210 - RNA, 16 nt, Salmonella typhimurium LT2
uccguauugcaaugcg

SEQ ID NO: 3797211 - RNA, 18 nt, Salmonella typhimurium LT2
uccgucaaaaaaucgacc

SEQ ID NO: 3797212 - RNA, 23 nt, Salmonella typhimurium LT2
uccgucagcgucacguuauacca

SEQ ID NO: 3797213 - RNA, 13 nt, Salmonella typhimurium LT2
uccguccucuuuc

SEQ ID NO: 3797214 - RNA, 22 nt, Salmonella typhimurium LT2
uccgucgcugcguuugccgccu

SEQ ID NO: 3797215 - RNA, 18 nt, Salmonella typhimurium LT2
uccgucgugccuuucagg

SEQ ID NO: 3797216 - RNA, 15 nt, Salmonella typhimurium LT2
uccgucguguagccu

SEQ ID NO: 3797217 - RNA, 20 nt, Salmonella typhimurium LT2
uccgucguuaaucagcgcgg

SEQ ID NO: 3797218 - RNA, 16 nt, Salmonella typhimurium LT2
uccgucuccggacguu

SEQ ID NO: 3797219 - RNA, 13 nt, Salmonella typhimurium LT2
uccgucuggcgau

SEQ ID NO: 3797220 - RNA, 18 nt, Salmonella typhimurium LT2
uccguggcgauaaugacg

SEQ ID NO: 3797221 - RNA, 19 nt, Salmonella typhimurium LT2
uccguuaccccuuuuucaa

SEQ ID NO: 3797222 - RNA, 18 nt, Salmonella typhimurium LT2
uccguucaucggcauaca

SEQ ID NO: 3797223 - RNA, 13 nt, Salmonella typhimurium LT2
uccguucccucug

SEQ ID NO: 3797224 - RNA, 15 nt, Salmonella typhimurium LT2
uccguugaucgucca

SEQ ID NO: 3797225 - RNA, 21 nt, Salmonella typhimurium LT2
uccguugccacccaaugaucc

SEQ ID NO: 3797226 - RNA, 18 nt, Salmonella typhimurium LT2
uccguugugaacagcguu

SEQ ID NO: 3797227 - RNA, 13 nt, Salmonella typhimurium LT2
uccguuuucaggu

SEQ ID NO: 3797228 - RNA, 23 nt, Salmonella typhimurium LT2
uccguuuucgacaugguuggcca

SEQ ID NO: 3797229 - RNA, 23 nt, Salmonella typhimurium LT2
uccuaccacgccgcuacugccgc

SEQ ID NO: 3797230 - RNA, 13 nt, Salmonella typhimurium LT2
uccuaggacgaaa

SEQ ID NO: 3797231 - RNA, 23 nt, Salmonella typhimurium LT2
uccuauucgccgcgcgacagagc

SEQ ID NO: 3797232 - RNA, 20 nt, Salmonella typhimurium LT2
uccuauuggcgcagccuuuu

SEQ ID NO: 3797233 - RNA, 21 nt, Salmonella typhimurium LT2
uccucaacagcgcggcaggcc

SEQ ID NO: 3797234 - RNA, 22 nt, Salmonella typhimurium LT2
uccucaaccugaggaagaagcg

SEQ ID NO: 3797235 - RNA, 20 nt, Salmonella typhimurium LT2
uccucaauauuaucuucguc

SEQ ID NO: 3797236 - RNA, 23 nt, Salmonella typhimurium LT2
uccucaauauuaucuucgucaau

SEQ ID NO: 3797237 - RNA, 18 nt, Salmonella typhimurium LT2
uccucaaugguuucacgc

SEQ ID NO: 3797238 - RNA, 15 nt, Salmonella typhimurium LT2
uccucaauguuaacu

SEQ ID NO: 3797239 - RNA, 16 nt, Salmonella typhimurium LT2
uccucacugccgacgc

SEQ ID NO: 3797240 - RNA, 17 nt, Salmonella typhimurium LT2
uccucagaauccgucag

SEQ ID NO: 3797241 - RNA, 14 nt, Salmonella typhimurium LT2
uccucauucagcgg

SEQ ID NO: 3797242 - RNA, 15 nt, Salmonella typhimurium LT2
uccucauucagcggc

SEQ ID NO: 3797243 - RNA, 16 nt, Salmonella typhimurium LT2
uccucauucagcggcu

SEQ ID NO: 3797244 - RNA, 21 nt, Salmonella typhimurium LT2
uccucauuuuguugcuccagc

SEQ ID NO: 3797245 - RNA, 23 nt, Salmonella typhimurium LT2
uccucauuuuguugcuccagcau

SEQ ID NO: 3797246 - RNA, 16 nt, Salmonella typhimurium LT2
uccuccagcgugcaga

SEQ ID NO: 3797247 - RNA, 20 nt, Salmonella typhimurium LT2
uccuccggcgagcgaugcug

SEQ ID NO: 3797248 - RNA, 21 nt, Salmonella typhimurium LT2
uccucgcgcguuugcaauauc

SEQ ID NO: 3797249 - RNA, 16 nt, Salmonella typhimurium LT2
uccucggacgaaaaau

SEQ ID NO: 3797250 - RNA, 15 nt, Salmonella typhimurium LT2
uccucugaaaaauau

SEQ ID NO: 3797251 - RNA, 20 nt, Salmonella typhimurium LT2
uccucuggcccguuucgggc

SEQ ID NO: 3797252 - RNA, 15 nt, Salmonella typhimurium LT2
uccucuucaguaaga

SEQ ID NO: 3797253 - RNA, 19 nt, Salmonella typhimurium LT2
uccucuuccgacaaaccuu

SEQ ID NO: 3797254 - RNA, 16 nt, Salmonella typhimurium LT2
uccucuugucaggcag

SEQ ID NO: 3797255 - RNA, 13 nt, Salmonella typhimurium LT2
uccucuuucccuu

SEQ ID NO: 3797256 - RNA, 17 nt, Salmonella typhimurium LT2
ucgaaucgccucaacca

SEQ ID NO: 3797257 - RNA, 17 nt, Salmonella typhimurium LT2
ucgacaaacaccgagcc

SEQ ID NO: 3797258 - RNA, 21 nt, Salmonella typhimurium LT2
ucgacaaacaccgagccagaa

SEQ ID NO: 3797259 - RNA, 19 nt, Salmonella typhimurium LT2
ucgacaacaacaucuguga

SEQ ID NO: 3797260 - RNA, 14 nt, Salmonella typhimurium LT2
ucgacaacaucauu

SEQ ID NO: 3797261 - RNA, 11 nt, Salmonella typhimurium LT2
ucgacaagcua

SEQ ID NO: 3797262 - RNA, 22 nt, Salmonella typhimurium LT2
ucgacaagcuaauccccagcgc

SEQ ID NO: 3797263 - RNA, 19 nt, Salmonella typhimurium LT2
ucgacaauaaauugcgacc

SEQ ID NO: 3797264 - RNA, 13 nt, Salmonella typhimurium LT2
ucgacacaggcgu

SEQ ID NO: 3797265 - RNA, 12 nt, Salmonella typhimurium LT2
ucgacaccagcg

SEQ ID NO: 3797266 - RNA, 14 nt, Salmonella typhimurium LT2
ucgacaccagcgau

SEQ ID NO: 3797267 - RNA, 23 nt, Salmonella typhimurium LT2
ucgacaccagcgauaaacgccag

SEQ ID NO: 3797268 - RNA, 14 nt, Salmonella typhimurium LT2
ucgacagcagcgcu

SEQ ID NO: 3797269 - RNA, 15 nt, Salmonella typhimurium LT2
ucgacaggaguauag

SEQ ID NO: 3797270 - RNA, 18 nt, Salmonella typhimurium LT2
ucgacaguaccagcagaa

SEQ ID NO: 3797271 - RNA, 19 nt, Salmonella typhimurium LT2
ucgacaucuuggcgcugcc

SEQ ID NO: 3797272 - RNA, 17 nt, Salmonella typhimurium LT2
ucgacaugcagaucgcg

SEQ ID NO: 3797273 - RNA, 23 nt, Salmonella typhimurium LT2
ucgacaugggcgggauccugcaa

SEQ ID NO: 3797274 - RNA, 18 nt, Salmonella typhimurium LT2
ucgacaugguuggccacc

SEQ ID NO: 3797275 - RNA, 19 nt, Salmonella typhimurium LT2
ucgaccagacgaauaaucu

SEQ ID NO: 3797276 - RNA, 13 nt, Salmonella typhimurium LT2
ucgaccagcaccu

SEQ ID NO: 3797277 - RNA, 17 nt, Salmonella typhimurium LT2
ucgaccagcagcgggcu

SEQ ID NO: 3797278 - RNA, 22 nt, Salmonella typhimurium LT2
ucgacccgcaaugugcagcagg

SEQ ID NO: 3797279 - RNA, 13 nt, Salmonella typhimurium LT2
ucgacgaaauggu

SEQ ID NO: 3797280 - RNA, 13 nt, Salmonella typhimurium LT2
ucgacgccagcgg

SEQ ID NO: 3797281 - RNA, 13 nt, Salmonella typhimurium LT2
ucgacggcaaccu

SEQ ID NO: 3797282 - RNA, 19 nt, Salmonella typhimurium LT2
ucgacgucaccaucagcgu

SEQ ID NO: 3797283 - RNA, 16 nt, Salmonella typhimurium LT2
ucgacguccagcgcgu

SEQ ID NO: 3797284 - RNA, 23 nt, Salmonella typhimurium LT2
ucgacguucagcauauccagcgc

SEQ ID NO: 3797285 - RNA, 18 nt, Salmonella typhimurium LT2
ucgacguugccaggcgac

SEQ ID NO: 3797286 - RNA, 17 nt, Salmonella typhimurium LT2
ucgacguuuuccaucac

SEQ ID NO: 3797287 - RNA, 23 nt, Salmonella typhimurium LT2
ucgacuccuauuaucggcaccau

SEQ ID NO: 3797288 - RNA, 17 nt, Salmonella typhimurium LT2
ucgacugcguuaucgcu

SEQ ID NO: 3797289 - RNA, 21 nt, Salmonella typhimurium LT2
ucgacuggucgcagcccagca

SEQ ID NO: 3797290 - RNA, 13 nt, Salmonella typhimurium LT2
ucgacuuaaaaga

SEQ ID NO: 3797291 - RNA, 21 nt, Salmonella typhimurium LT2
ucgacuucaaugggaaaaauu

SEQ ID NO: 3797292 - RNA, 19 nt, Salmonella typhimurium LT2
ucgacuucauucggcagau

SEQ ID NO: 3797293 - RNA, 21 nt, Salmonella typhimurium LT2
ucgacuuuguugaucucauug

SEQ ID NO: 3797294 - RNA, 18 nt, Salmonella typhimurium LT2
ucgagaacguaaaagacg

SEQ ID NO: 3797295 - RNA, 17 nt, Salmonella typhimurium LT2
ucgagaugcauaaaaaa

SEQ ID NO: 3797296 - RNA, 16 nt, Salmonella typhimurium LT2
ucgagauuuaccggga

SEQ ID NO: 3797297 - RNA, 13 nt, Salmonella typhimurium LT2
ucgagauuuuucu

SEQ ID NO: 3797298 - RNA, 20 nt, Salmonella typhimurium LT2
ucgagauuuuucugcgccac

SEQ ID NO: 3797299 - RNA, 12 nt, Salmonella typhimurium LT2
ucgagcagcagg

SEQ ID NO: 3797300 - RNA, 19 nt, Salmonella typhimurium LT2
ucgagcaucuccagcgcau

SEQ ID NO: 3797301 - RNA, 17 nt, Salmonella typhimurium LT2
ucgagcgaaagaacguu

SEQ ID NO: 3797302 - RNA, 18 nt, Salmonella typhimurium LT2
ucgagcguaauuccggcc

SEQ ID NO: 3797303 - RNA, 19 nt, Salmonella typhimurium LT2
ucgagcugcgcuuuuucau

SEQ ID NO: 3797304 - RNA, 20 nt, Salmonella typhimurium LT2
ucgaggagcgcggcggcgcg

SEQ ID NO: 3797305 - RNA, 16 nt, Salmonella typhimurium LT2
ucgagucaggcgccag

SEQ ID NO: 3797306 - RNA, 21 nt, Salmonella typhimurium LT2
ucgauaaaagcucgcggaucg

SEQ ID NO: 3797307 - RNA, 20 nt, Salmonella typhimurium LT2
ucgauaaccuguaaauaaua

SEQ ID NO: 3797308 - RNA, 14 nt, Salmonella typhimurium LT2
ucgauaauaaaaua

SEQ ID NO: 3797309 - RNA, 17 nt, Salmonella typhimurium LT2
ucgauaauauccagcac

SEQ ID NO: 3797310 - RNA, 22 nt, Salmonella typhimurium LT2
ucgauaaucauacagcgcagcc

SEQ ID NO: 3797311 - RNA, 16 nt, Salmonella typhimurium LT2
ucgauaaucgcgcgcu

SEQ ID NO: 3797312 - RNA, 12 nt, Salmonella typhimurium LT2
ucgauacagccu

SEQ ID NO: 3797313 - RNA, 16 nt, Salmonella typhimurium LT2
ucgauacuauaacgcu

SEQ ID NO: 3797314 - RNA, 14 nt, Salmonella typhimurium LT2
ucgauagcauuuuu

SEQ ID NO: 3797315 - RNA, 22 nt, Salmonella typhimurium LT2
ucgauauaccaugccgccauuu

SEQ ID NO: 3797316 - RNA, 19 nt, Salmonella typhimurium LT2
ucgauaucgauaaucaaca

SEQ ID NO: 3797317 - RNA, 19 nt, Salmonella typhimurium LT2
ucgaucacccacaucagcg

SEQ ID NO: 3797318 - RNA, 16 nt, Salmonella typhimurium LT2
ucgaucaugccuuuaa

SEQ ID NO: 3797319 - RNA, 22 nt, Salmonella typhimurium LT2
ucgauccccucuuccaucagcc

SEQ ID NO: 3797320 - RNA, 22 nt, Salmonella typhimurium LT2
ucgaucucgauauucacacgcu

SEQ ID NO: 3797321 - RNA, 23 nt, Salmonella typhimurium LT2
ucgaucuuauuagcgauuuaaug

SEQ ID NO: 3797322 - RNA, 15 nt, Salmonella typhimurium LT2
ucgaugaaaaagagg

SEQ ID NO: 3797323 - RNA, 21 nt, Salmonella typhimurium LT2
ucgaugauuuguucgccccag

SEQ ID NO: 3797324 - RNA, 13 nt, Salmonella typhimurium LT2
ucgauggccucau

SEQ ID NO: 3797325 - RNA, 21 nt, Salmonella typhimurium LT2
ucgauguuaaaggucagaagc

SEQ ID NO: 3797326 - RNA, 17 nt, Salmonella typhimurium LT2
ucgauuaaacgccuggg

SEQ ID NO: 3797327 - RNA, 15 nt, Salmonella typhimurium LT2
ucgauuacagcaugu

SEQ ID NO: 3797328 - RNA, 22 nt, Salmonella typhimurium LT2
ucgauucccagauguugagcaa

SEQ ID NO: 3797329 - RNA, 21 nt, Salmonella typhimurium LT2
ucgauuuccggcggcagaugc

SEQ ID NO: 3797330 - RNA, 21 nt, Salmonella typhimurium LT2
ucgauuuccgguuccagcggc

SEQ ID NO: 3797331 - RNA, 22 nt, Salmonella typhimurium LT2
ucgauuuucugcucaauauuau

SEQ ID NO: 3797332 - RNA, 22 nt, Salmonella typhimurium LT2
ucgauuuugaccugaauccaga

SEQ ID NO: 3797333 - RNA, 20 nt, Salmonella typhimurium LT2
ucgcaaacccacccgguaau

SEQ ID NO: 3797334 - RNA, 13 nt, Salmonella typhimurium LT2
ucgcaaacgccag

SEQ ID NO: 3797335 - RNA, 15 nt, Salmonella typhimurium LT2
ucgcaaacuggucga

SEQ ID NO: 3797336 - RNA, 21 nt, Salmonella typhimurium LT2
ucgcaaagaaaucaacgaauu

SEQ ID NO: 3797337 - RNA, 14 nt, Salmonella typhimurium LT2
ucgcaaauucugua

SEQ ID NO: 3797338 - RNA, 16 nt, Salmonella typhimurium LT2
ucgcaacagguuaacc

SEQ ID NO: 3797339 - RNA, 21 nt, Salmonella typhimurium LT2
ucgcacaaagcguucggccug

SEQ ID NO: 3797340 - RNA, 19 nt, Salmonella typhimurium LT2
ucgcacagaaucaccuuau

SEQ ID NO: 3797341 - RNA, 23 nt, Salmonella typhimurium LT2
ucgcacaucaugaugaucuucag

SEQ ID NO: 3797342 - RNA, 17 nt, Salmonella typhimurium LT2
ucgcaccauagcagcca

SEQ ID NO: 3797343 - RNA, 22 nt, Salmonella typhimurium LT2
ucgcacccgccaucaugcccac

SEQ ID NO: 3797344 - RNA, 15 nt, Salmonella typhimurium LT2
ucgcagacauggcaa

SEQ ID NO: 3797345 - RNA, 18 nt, Salmonella typhimurium LT2
ucgcagagucgcagcggc

SEQ ID NO: 3797346 - RNA, 16 nt, Salmonella typhimurium LT2
ucgcagcccaucgcgu

SEQ ID NO: 3797347 - RNA, 19 nt, Salmonella typhimurium LT2
ucgcagcgaucagggguca

SEQ ID NO: 3797348 - RNA, 21 nt, Salmonella typhimurium LT2
ucgcaggccaaacagcggcuc

SEQ ID NO: 3797349 - RNA, 16 nt, Salmonella typhimurium LT2
ucgcaggcggccaggc

SEQ ID NO: 3797350 - RNA, 22 nt, Salmonella typhimurium LT2
ucgcaggguaugaauuuuuucc

SEQ ID NO: 3797351 - RNA, 17 nt, Salmonella typhimurium LT2
ucgcauauuguaccugc

SEQ ID NO: 3797352 - RNA, 15 nt, Salmonella typhimurium LT2
ucgcauuuaaucgcc

SEQ ID NO: 3797353 - RNA, 22 nt, Salmonella typhimurium LT2
ucgcauuuuuaagcuggcgaac

SEQ ID NO: 3797354 - RNA, 16 nt, Salmonella typhimurium LT2
ucgcauuuuuaucggc

SEQ ID NO: 3797355 - RNA, 23 nt, Salmonella typhimurium LT2
ucgcauuuuuaucggcuauuagc

SEQ ID NO: 3797356 - RNA, 17 nt, Salmonella typhimurium LT2
ucgccaaacacccagcc

SEQ ID NO: 3797357 - RNA, 16 nt, Salmonella typhimurium LT2
ucgccaaaccagaccc

SEQ ID NO: 3797358 - RNA, 21 nt, Salmonella typhimurium LT2
ucgccaaagaaacgcugaucu

SEQ ID NO: 3797359 - RNA, 17 nt, Salmonella typhimurium LT2
ucgcgccugccaggauc

SEQ ID NO: 3797360 - RNA, 22 nt, Salmonella typhimurium LT2
ucgcgcgccgcuuccggcaggu

SEQ ID NO: 3797361 - RNA, 22 nt, Salmonella typhimurium LT2
ucgcgcggcgguucauccugcg

SEQ ID NO: 3797362 - RNA, 17 nt, Salmonella typhimurium LT2
ucgcgcucaagcgaaaa

SEQ ID NO: 3797363 - RNA, 17 nt, Salmonella typhimurium LT2
ucgcgcucuuccgccag

SEQ ID NO: 3797364 - RNA, 14 nt, Salmonella typhimurium LT2
ucgcgcugcaggug

SEQ ID NO: 3797365 - RNA, 16 nt, Salmonella typhimurium LT2
ucgcgcugcgcaggcg

SEQ ID NO: 3797366 - RNA, 18 nt, Salmonella typhimurium LT2
ucgcggaauuucaggaag

SEQ ID NO: 3797367 - RNA, 15 nt, Salmonella typhimurium LT2
ucgcggcaauggcuu

SEQ ID NO: 3797368 - RNA, 17 nt, Salmonella typhimurium LT2
ucgcggccgcuuuucgg

SEQ ID NO: 3797369 - RNA, 16 nt, Salmonella typhimurium LT2
ucgcggcgauuaauac

SEQ ID NO: 3797370 - RNA, 17 nt, Salmonella typhimurium LT2
ucgcggcugguacggcg

SEQ ID NO: 3797371 - RNA, 14 nt, Salmonella typhimurium LT2
ucgcgggcauacuc

SEQ ID NO: 3797372 - RNA, 17 nt, Salmonella typhimurium LT2
ucgcggggguuguucag

SEQ ID NO: 3797373 - RNA, 23 nt, Salmonella typhimurium LT2
ucgcgggucgguuucaguucgua

SEQ ID NO: 3797374 - RNA, 19 nt, Salmonella typhimurium LT2
ucgcgguuuuucgggucca

SEQ ID NO: 3797375 - RNA, 15 nt, Salmonella typhimurium LT2
ucgcguacuuucgcc

SEQ ID NO: 3797376 - RNA, 20 nt, Salmonella typhimurium LT2
ucgcgucaauauuaaugcug

SEQ ID NO: 3797377 - RNA, 12 nt, Salmonella typhimurium LT2
ucgcguuacggc

SEQ ID NO: 3797378 - RNA, 21 nt, Salmonella typhimurium LT2
ucgcguuuuucugcccauuuc

SEQ ID NO: 3797379 - RNA, 13 nt, Salmonella typhimurium LT2
ucgcuaaccggcg

SEQ ID NO: 3797380 - RNA, 13 nt, Salmonella typhimurium LT2
ucgcuaaugcccg

SEQ ID NO: 3797381 - RNA, 14 nt, Salmonella typhimurium LT2
ucgcuaauuuuuaa

SEQ ID NO: 3797382 - RNA, 23 nt, Salmonella typhimurium LT2
ucgcuacaggcaaucggccaggu

SEQ ID NO: 3797383 - RNA, 19 nt, Salmonella typhimurium LT2
ucgcuaccuuuuuucagua

SEQ ID NO: 3797384 - RNA, 16 nt, Salmonella typhimurium LT2
ucgcuauauacccccu

SEQ ID NO: 3797385 - RNA, 13 nt, Salmonella typhimurium LT2
ucgcuaucaauac

SEQ ID NO: 3797386 - RNA, 13 nt, Salmonella typhimurium LT2
ucgcuauccagca

SEQ ID NO: 3797387 - RNA, 14 nt, Salmonella typhimurium LT2
ucgcuauccagcag

SEQ ID NO: 3797388 - RNA, 14 nt, Salmonella typhimurium LT2
ucgcuauuccagag

SEQ ID NO: 3797389 - RNA, 16 nt, Salmonella typhimurium LT2
ucgcucaacaaacuua

SEQ ID NO: 3797390 - RNA, 17 nt, Salmonella typhimurium LT2
ucgcucaacaaacuuaa

SEQ ID NO: 3797391 - RNA, 16 nt, Salmonella typhimurium LT2
ucgcucaucucaagcc

SEQ ID NO: 3797392 - RNA, 13 nt, Salmonella typhimurium LT2
ucgcuccagggca

SEQ ID NO: 3797393 - RNA, 17 nt, Salmonella typhimurium LT2
ucgcucccucaucaaua

SEQ ID NO: 3797394 - RNA, 20 nt, Salmonella typhimurium LT2
ucgcuccucagcgcuuacca

SEQ ID NO: 3797395 - RNA, 21 nt, Salmonella typhimurium LT2
ucgcucgacauagguucugcg

SEQ ID NO: 3797396 - RNA, 22 nt, Salmonella typhimurium LT2
ucgcucuccgccgcgggcagca

SEQ ID NO: 3797397 - RNA, 21 nt, Salmonella typhimurium LT2
ucgcucucgugccaguaacgu

SEQ ID NO: 3797398 - RNA, 17 nt, Salmonella typhimurium LT2
ucgcucucuuucaccag

SEQ ID NO: 3797399 - RNA, 15 nt, Salmonella typhimurium LT2
ucgcugacgccagcc

SEQ ID NO: 3797400 - RNA, 18 nt, Salmonella typhimurium LT2
ucgcugcccagaugguua

SEQ ID NO: 3797401 - RNA, 15 nt, Salmonella typhimurium LT2
ucgcugcgccagcag

SEQ ID NO: 3797402 - RNA, 15 nt, Salmonella typhimurium LT2
ucgcugcgcucgccc

SEQ ID NO: 3797403 - RNA, 20 nt, Salmonella typhimurium LT2
ucgcugcgcucgcccuucgg

SEQ ID NO: 3797404 - RNA, 18 nt, Salmonella typhimurium LT2
ucgcugcguuucgggaac

SEQ ID NO: 3797405 - RNA, 16 nt, Salmonella typhimurium LT2
ucgcugcguuugccgc

SEQ ID NO: 3797406 - RNA, 19 nt, Salmonella typhimurium LT2
ucgcugcguuugccgccuu

SEQ ID NO: 3797407 - RNA, 15 nt, Salmonella typhimurium LT2
ucgcuguacgacugg

SEQ ID NO: 3797408 - RNA, 15 nt, Salmonella typhimurium LT2
ucgcuguaggccgga

SEQ ID NO: 3797409 - RNA, 12 nt, Salmonella typhimurium LT2
ucgcuguuaacc

SEQ ID NO: 3797410 - RNA, 16 nt, Salmonella typhimurium LT2
ucgcuuacgcggcgcg

SEQ ID NO: 3797411 - RNA, 15 nt, Salmonella typhimurium LT2
ucgcuuaucugcugc

SEQ ID NO: 3797412 - RNA, 14 nt, Salmonella typhimurium LT2
ucgcuuccagcgcc

SEQ ID NO: 3797413 - RNA, 17 nt, Salmonella typhimurium LT2
ucgcuugcccggccguu

SEQ ID NO: 3797414 - RNA, 23 nt, Salmonella typhimurium LT2
ucgcuugcccggccuacguucgc

SEQ ID NO: 3797415 - RNA, 21 nt, Salmonella typhimurium LT2
ucgcuuucaucguauaaauuu

SEQ ID NO: 3797416 - RNA, 18 nt, Salmonella typhimurium LT2
ucgcuuucgcuuucucuu

SEQ ID NO: 3797417 - RNA, 13 nt, Salmonella typhimurium LT2
ucgcuuucucuuc

SEQ ID NO: 3797418 - RNA, 20 nt, Salmonella typhimurium LT2
ucggaacucacuugucuucu

SEQ ID NO: 3797419 - RNA, 18 nt, Salmonella typhimurium LT2
ucggaagacuggcgcagc

SEQ ID NO: 3797420 - RNA, 16 nt, Salmonella typhimurium LT2
ucggaagcauccguuu

SEQ ID NO: 3797421 - RNA, 14 nt, Salmonella typhimurium LT2
ucggacuaauacuu

SEQ ID NO: 3797422 - RNA, 15 nt, Salmonella typhimurium LT2
ucggagaaauagacg

SEQ ID NO: 3797423 - RNA, 12 nt, Salmonella typhimurium LT2
ucggagauauac

SEQ ID NO: 3797424 - RNA, 22 nt, Salmonella typhimurium LT2
ucggagguauacauccacuggu

SEQ ID NO: 3797425 - RNA, 16 nt, Salmonella typhimurium LT2
ucggaugaucgucaac

SEQ ID NO: 3797426 - RNA, 22 nt, Salmonella typhimurium LT2
ucggauuauuggucagcaggcg

SEQ ID NO: 3797427 - RNA, 21 nt, Salmonella typhimurium LT2
ucggauucguuaagcaacugc

SEQ ID NO: 3797428 - RNA, 17 nt, Salmonella typhimurium LT2
ucggauuucguaccgaa

SEQ ID NO: 3797429 - RNA, 15 nt, Salmonella typhimurium LT2
ucggcaaacaucugc

SEQ ID NO: 3797430 - RNA, 22 nt, Salmonella typhimurium LT2
ucggcaaacaucugcuccagcg

SEQ ID NO: 3797431 - RNA, 19 nt, Salmonella typhimurium LT2
ucggcaagaauuucaauca

SEQ ID NO: 3797432 - RNA, 19 nt, Salmonella typhimurium LT2
ucggcacagccaguaagaa

SEQ ID NO: 3797433 - RNA, 15 nt, Salmonella typhimurium LT2
ucggcaccauuccca

SEQ ID NO: 3797434 - RNA, 12 nt, Salmonella typhimurium LT2
ucggcacgcgau

SEQ ID NO: 3797435 - RNA, 18 nt, Salmonella typhimurium LT2
ucggcagcaauacgcccg

SEQ ID NO: 3797436 - RNA, 14 nt, Salmonella typhimurium LT2
ucggcagcgcgaac

SEQ ID NO: 3797437 - RNA, 17 nt, Salmonella typhimurium LT2
ucggcaggaacagauac

SEQ ID NO: 3797438 - RNA, 23 nt, Salmonella typhimurium LT2
ucggcaggguuugaccucaucca

SEQ ID NO: 3797439 - RNA, 13 nt, Salmonella typhimurium LT2
ucggcauaucgcc

SEQ ID NO: 3797440 - RNA, 18 nt, Salmonella typhimurium LT2
ucggcaucuguagcggcg

SEQ ID NO: 3797441 - RNA, 20 nt, Salmonella typhimurium LT2
ucggcauggcgggagauuga

SEQ ID NO: 3797442 - RNA, 18 nt, Salmonella typhimurium LT2
ucggccagauaguggcug

SEQ ID NO: 3797443 - RNA, 14 nt, Salmonella typhimurium LT2
ucggccagcaggcg

SEQ ID NO: 3797444 - RNA, 16 nt, Salmonella typhimurium LT2
ucggccagcaguucca

SEQ ID NO: 3797445 - RNA, 15 nt, Salmonella typhimurium LT2
ucggccagcgccagc

SEQ ID NO: 3797446 - RNA, 16 nt, Salmonella typhimurium LT2
ucggccauauccagcc

SEQ ID NO: 3797447 - RNA, 18 nt, Salmonella typhimurium LT2
ucggccaucuggcguugc

SEQ ID NO: 3797448 - RNA, 23 nt, Salmonella typhimurium LT2
ucggccgcuaucugcuccgccag

SEQ ID NO: 3797449 - RNA, 15 nt, Salmonella typhimurium LT2
ucggccugcguuaac

SEQ ID NO: 3797450 - RNA, 22 nt, Salmonella typhimurium LT2
ucggcgacguccguuagcuggc

SEQ ID NO: 3797451 - RNA, 14 nt, Salmonella typhimurium LT2
ucggcgaggacccg

SEQ ID NO: 3797452 - RNA, 18 nt, Salmonella typhimurium LT2
ucggcgauugucaucauu

SEQ ID NO: 3797453 - RNA, 23 nt, Salmonella typhimurium LT2
ucggcgcccggacgaaccuggcg

SEQ ID NO: 3797454 - RNA, 16 nt, Salmonella typhimurium LT2
ucggcgcggggaacac

SEQ ID NO: 3797455 - RNA, 18 nt, Salmonella typhimurium LT2
ucggcgcggggaacacaa

SEQ ID NO: 3797456 - RNA, 19 nt, Salmonella typhimurium LT2
ucggcgcggggaacacaau

SEQ ID NO: 3797457 - RNA, 20 nt, Salmonella typhimurium LT2
ucggcggaaauucgcgccag

SEQ ID NO: 3797458 - RNA, 23 nt, Salmonella typhimurium LT2
ucggcggcaggugagggcgucgc

SEQ ID NO: 3797459 - RNA, 20 nt, Salmonella typhimurium LT2
ucggcgucgacguuuuucag

SEQ ID NO: 3797460 - RNA, 13 nt, Salmonella typhimurium LT2
ucggcgucgcggc

SEQ ID NO: 3797461 - RNA, 13 nt, Salmonella typhimurium LT2
ucggcgucuggag

SEQ ID NO: 3797462 - RNA, 17 nt, Salmonella typhimurium LT2
ucggcgugaauaaaaua

SEQ ID NO: 3797463 - RNA, 12 nt, Salmonella typhimurium LT2
ucguuaaagcgg

SEQ ID NO: 3797464 - RNA, 21 nt, Salmonella typhimurium LT2
ucguuaacccaaauccgcauu

SEQ ID NO: 3797465 - RNA, 14 nt, Salmonella typhimurium LT2
ucguuaaucagcgc

SEQ ID NO: 3797466 - RNA, 14 nt, Salmonella typhimurium LT2
ucguuaccagcauc

SEQ ID NO: 3797467 - RNA, 16 nt, Salmonella typhimurium LT2
ucguuaccagcaucgc

SEQ ID NO: 3797468 - RNA, 14 nt, Salmonella typhimurium LT2
ucguuacccgugcg

SEQ ID NO: 3797469 - RNA, 16 nt, Salmonella typhimurium LT2
ucguuacccuccugca

SEQ ID NO: 3797470 - RNA, 14 nt, Salmonella typhimurium LT2
ucguuaccgcuuca

SEQ ID NO: 3797471 - RNA, 20 nt, Salmonella typhimurium LT2
ucguuagcaaauugcugaug

SEQ ID NO: 3797472 - RNA, 23 nt, Salmonella typhimurium LT2
ucguuagugauacgcggcugaug

SEQ ID NO: 3797473 - RNA, 11 nt, Salmonella typhimurium LT2
ucguuaucauu

SEQ ID NO: 3797474 - RNA, 21 nt, Salmonella typhimurium LT2
ucguuaucgccccaggcgaua

SEQ ID NO: 3797475 - RNA, 13 nt, Salmonella typhimurium LT2
ucguuauuuccga

SEQ ID NO: 3797476 - RNA, 15 nt, Salmonella typhimurium LT2
ucguucaaaagugcc

SEQ ID NO: 3797477 - RNA, 14 nt, Salmonella typhimurium LT2
ucguucaagacagg

SEQ ID NO: 3797478 - RNA, 17 nt, Salmonella typhimurium LT2
ucguucacguaaucgcc

SEQ ID NO: 3797479 - RNA, 20 nt, Salmonella typhimurium LT2
ucguucacguaaucgccgug

SEQ ID NO: 3797480 - RNA, 17 nt, Salmonella typhimurium LT2
ucguugacuucaaucac

SEQ ID NO: 3797481 - RNA, 15 nt, Salmonella typhimurium LT2
ucguugccagcggcc

SEQ ID NO: 3797482 - RNA, 12 nt, Salmonella typhimurium LT2
ucguugcgccug

SEQ ID NO: 3797483 - RNA, 18 nt, Salmonella typhimurium LT2
ucguuucccucauauuug

SEQ ID NO: 3797484 - RNA, 17 nt, Salmonella typhimurium LT2
ucguuugcaguuccgca

SEQ ID NO: 3797485 - RNA, 13 nt, Salmonella typhimurium LT2
ucguuuuccgcaa

SEQ ID NO: 3797486 - RNA, 11 nt, Salmonella typhimurium LT2
ucuaaaaagga

SEQ ID NO: 3797487 - RNA, 23 nt, Salmonella typhimurium LT2
ucuaaaaauaauugauaauaacc

SEQ ID NO: 3797488 - RNA, 20 nt, Salmonella typhimurium LT2
ucuaaauuucgcguuuuucu

SEQ ID NO: 3797489 - RNA, 15 nt, Salmonella typhimurium LT2
ucuaacauaaugaau

SEQ ID NO: 3797490 - RNA, 22 nt, Salmonella typhimurium LT2
ucuaacgaaaccggcggcgacu

SEQ ID NO: 3797491 - RNA, 21 nt, Salmonella typhimurium LT2
ucuaacgcaacggaaggaaau

SEQ ID NO: 3797492 - RNA, 14 nt, Salmonella typhimurium LT2
ucuaagaauuuaau

SEQ ID NO: 3797493 - RNA, 21 nt, Salmonella typhimurium LT2
ucuaauuaaaaagagaaaaaa

SEQ ID NO: 3797494 - RNA, 23 nt, Salmonella typhimurium LT2
ucuaauucccaguaaccuauuuu

SEQ ID NO: 3797495 - RNA, 22 nt, Salmonella typhimurium LT2
ucuacaaauggguccauacgcg

SEQ ID NO: 3797496 - RNA, 17 nt, Salmonella typhimurium LT2
ucuacaaguucagcagg

SEQ ID NO: 3797497 - RNA, 19 nt, Salmonella typhimurium LT2
ucuacaaguucagcaggcu

SEQ ID NO: 3797498 - RNA, 12 nt, Salmonella typhimurium LT2
ucuacacuuugc

SEQ ID NO: 3797499 - RNA, 18 nt, Salmonella typhimurium LT2
ucuacacuuugcgccgcc

SEQ ID NO: 3797500 - RNA, 15 nt, Salmonella typhimurium LT2
ucuacaucgccgcga

SEQ ID NO: 3797501 - RNA, 19 nt, Salmonella typhimurium LT2
ucuacccaggucgccgaug

SEQ ID NO: 3797502 - RNA, 19 nt, Salmonella typhimurium LT2
ucuaccgcuucgcgcgcca

SEQ ID NO: 3797503 - RNA, 14 nt, Salmonella typhimurium LT2
ucuacgguaucugc

SEQ ID NO: 3797504 - RNA, 13 nt, Salmonella typhimurium LT2
ucuauauauucuu

SEQ ID NO: 3797505 - RNA, 11 nt, Salmonella typhimurium LT2
ucuauaucgcu

SEQ ID NO: 3797506 - RNA, 13 nt, Salmonella typhimurium LT2
ucuaucaccgccu

SEQ ID NO: 3797507 - RNA, 19 nt, Salmonella typhimurium LT2
ucuaucagguaucccgcca

SEQ ID NO: 3797508 - RNA, 14 nt, Salmonella typhimurium LT2
ucuaucgccagcgc

SEQ ID NO: 3797509 - RNA, 16 nt, Salmonella typhimurium LT2
ucuaucggcaaaccau

SEQ ID NO: 3797510 - RNA, 17 nt, Salmonella typhimurium LT2
ucuaucuguaacuucgg

SEQ ID NO: 3797511 - RNA, 14 nt, Salmonella typhimurium LT2
ucuaugcgcuaugu

SEQ ID NO: 3797512 - RNA, 15 nt, Salmonella typhimurium LT2
ucuauuaaaauaaau

SEQ ID NO: 3797513 - RNA, 17 nt, Salmonella typhimurium LT2
ucuauuauuuuucuauu

SEQ ID NO: 3797514 - RNA, 17 nt, Salmonella typhimurium LT2
ucuauucuugugcuuac

SEQ ID NO: 3797515 - RNA, 15 nt, Salmonella typhimurium LT2
ucuauuucauaauaa

SEQ ID NO: 3797516 - RNA, 21 nt, Salmonella typhimurium LT2
ucucaaacuauuuuuagcccu

SEQ ID NO: 3797517 - RNA, 14 nt, Salmonella typhimurium LT2
ucucaagagugaac

SEQ ID NO: 3797518 - RNA, 18 nt, Salmonella typhimurium LT2
ucucaagcgccgccgcau

SEQ ID NO: 3797519 - RNA, 22 nt, Salmonella typhimurium LT2
ucucaagcgccgccgcauuuug

SEQ ID NO: 3797520 - RNA, 13 nt, Salmonella typhimurium LT2
ucucaaugaacag

SEQ ID NO: 3797521 - RNA, 23 nt, Salmonella typhimurium LT2
ucucaaugaacaguuucgccagc

SEQ ID NO: 3797522 - RNA, 23 nt, Salmonella typhimurium LT2
ucucaaugccacgccguagcugc

SEQ ID NO: 3797523 - RNA, 17 nt, Salmonella typhimurium LT2
ucucacagaaucaucag

SEQ ID NO: 3797524 - RNA, 12 nt, Salmonella typhimurium LT2
ucucaccacugu

SEQ ID NO: 3797525 - RNA, 13 nt, Salmonella typhimurium LT2
ucucaccgcccag

SEQ ID NO: 3797526 - RNA, 16 nt, Salmonella typhimurium LT2
ucucaccgcccaggcc

SEQ ID NO: 3797527 - RNA, 18 nt, Salmonella typhimurium LT2
ucucaccgcccaggccag

SEQ ID NO: 3797528 - RNA, 13 nt, Salmonella typhimurium LT2
ucucaccguggca

SEQ ID NO: 3797529 - RNA, 19 nt, Salmonella typhimurium LT2
ucucacguacaaacgcuuc

SEQ ID NO: 3797530 - RNA, 23 nt, Salmonella typhimurium LT2
ucucaggcaucgcugauaaaaac

SEQ ID NO: 3797531 - RNA, 16 nt, Salmonella typhimurium LT2
ucucaggcgagcccug

SEQ ID NO: 3797532 - RNA, 23 nt, Salmonella typhimurium LT2
ucucaggguguuuuuauacaucc

SEQ ID NO: 3797533 - RNA, 12 nt, Salmonella typhimurium LT2
ucucaucaaaaa

SEQ ID NO: 3797534 - RNA, 19 nt, Salmonella typhimurium LT2
ucucauccagcuugccguc

SEQ ID NO: 3797535 - RNA, 16 nt, Salmonella typhimurium LT2
ucucaucugaugauua

SEQ ID NO: 3797536 - RNA, 22 nt, Salmonella typhimurium LT2
ucucaucugcaaaauauauaau

SEQ ID NO: 3797537 - RNA, 19 nt, Salmonella typhimurium LT2
ucucauggagcugcccguc

SEQ ID NO: 3797538 - RNA, 12 nt, Salmonella typhimurium LT2
ucucauuguauu

SEQ ID NO: 3797539 - RNA, 18 nt, Salmonella typhimurium LT2
ucucauuguauuucucaa

SEQ ID NO: 3797540 - RNA, 22 nt, Salmonella typhimurium LT2
ucucauuguguacauccaggag

SEQ ID NO: 3797541 - RNA, 11 nt, Salmonella typhimurium LT2
ucuccagcaaa

SEQ ID NO: 3797542 - RNA, 14 nt, Salmonella typhimurium LT2
ucuccagcaacagc

SEQ ID NO: 3797543 - RNA, 22 nt, Salmonella typhimurium LT2
ucuccagcaggguauuugcgcc

SEQ ID NO: 3797544 - RNA, 23 nt, Salmonella typhimurium LT2
ucuccagcgcauugcccuucgcg

SEQ ID NO: 3797545 - RNA, 22 nt, Salmonella typhimurium LT2
ucuccaggcugaugugcuccau

SEQ ID NO: 3797546 - RNA, 22 nt, Salmonella typhimurium LT2
ucuccagggcaacggccagcgc

SEQ ID NO: 3797547 - RNA, 15 nt, Salmonella typhimurium LT2
ucuccaguaucagcg

SEQ ID NO: 3797548 - RNA, 14 nt, Salmonella typhimurium LT2
ucuccaguuugcgu

SEQ ID NO: 3797549 - RNA, 22 nt, Salmonella typhimurium LT2
ucuccaugccagaagagaagcu

SEQ ID NO: 3797550 - RNA, 22 nt, Salmonella typhimurium LT2
ucuccaugccaucggccagcag

SEQ ID NO: 3797551 - RNA, 20 nt, Salmonella typhimurium LT2
ucucccagccgggcaggaaa

SEQ ID NO: 3797552 - RNA, 12 nt, Salmonella typhimurium LT2
ucucccagcuga

SEQ ID NO: 3797553 - RNA, 14 nt, Salmonella typhimurium LT2
ucucccaucaauaa

SEQ ID NO: 3797554 - RNA, 22 nt, Salmonella typhimurium LT2
ucuccccauuugaacucuucca

SEQ ID NO: 3797555 - RNA, 21 nt, Salmonella typhimurium LT2
ucucccgguugauaaucgcua

SEQ ID NO: 3797556 - RNA, 22 nt, Salmonella typhimurium LT2
ucucccuacugcuuagcucauc

SEQ ID NO: 3797557 - RNA, 15 nt, Salmonella typhimurium LT2
ucuccgcgcaaucgc

SEQ ID NO: 3797558 - RNA, 18 nt, Salmonella typhimurium LT2
ucuccgcuuuuuuaaucc

SEQ ID NO: 3797559 - RNA, 19 nt, Salmonella typhimurium LT2
ucuccggcagcgaauguau

SEQ ID NO: 3797560 - RNA, 16 nt, Salmonella typhimurium LT2
ucuccggccagacagg

SEQ ID NO: 3797561 - RNA, 17 nt, Salmonella typhimurium LT2
ucuccggccagacaggc

SEQ ID NO: 3797562 - RNA, 17 nt, Salmonella typhimurium LT2
ucuccggucaucaccag

SEQ ID NO: 3797563 - RNA, 15 nt, Salmonella typhimurium LT2
ucuccguuguugcac

SEQ ID NO: 3797564 - RNA, 18 nt, Salmonella typhimurium LT2
ucuccuacaccaccagcc

SEQ ID NO: 3797565 - RNA, 18 nt, Salmonella typhimurium LT2
ucuccuccucauucagcg

SEQ ID NO: 3797566 - RNA, 13 nt, Salmonella typhimurium LT2
ucuccugcgauag

SEQ ID NO: 3797567 - RNA, 23 nt, Salmonella typhimurium LT2
ucuggcguuggcaucugucaucg

SEQ ID NO: 3797568 - RNA, 14 nt, Salmonella typhimurium LT2
ucuggcucagacca

SEQ ID NO: 3797569 - RNA, 20 nt, Salmonella typhimurium LT2
ucuggcucagaccauauuca

SEQ ID NO: 3797570 - RNA, 13 nt, Salmonella typhimurium LT2
ucuggcucccgca

SEQ ID NO: 3797571 - RNA, 13 nt, Salmonella typhimurium LT2
ucuggcucgccgu

SEQ ID NO: 3797572 - RNA, 19 nt, Salmonella typhimurium LT2
ucuggcugccaucggcauu

SEQ ID NO: 3797573 - RNA, 14 nt, Salmonella typhimurium LT2
ucuggcugcugaug

SEQ ID NO: 3797574 - RNA, 23 nt, Salmonella typhimurium LT2
ucugggcugacaaaaauuuaagc

SEQ ID NO: 3797575 - RNA, 12 nt, Salmonella typhimurium LT2
ucugggucagga

SEQ ID NO: 3797576 - RNA, 20 nt, Salmonella typhimurium LT2
ucugguacggccaccaggcc

SEQ ID NO: 3797577 - RNA, 19 nt, Salmonella typhimurium LT2
ucuggugaugauuacucuu

SEQ ID NO: 3797578 - RNA, 12 nt, Salmonella typhimurium LT2
ucuggugcagca

SEQ ID NO: 3797579 - RNA, 15 nt, Salmonella typhimurium LT2
ucugguggaacggcg

SEQ ID NO: 3797580 - RNA, 21 nt, Salmonella typhimurium LT2
ucuguaauucucccaaauuuu

SEQ ID NO: 3797581 - RNA, 15 nt, Salmonella typhimurium LT2
ucuguagcuucuguc

SEQ ID NO: 3797582 - RNA, 17 nt, Salmonella typhimurium LT2
ucuguauaaauaaaauu

SEQ ID NO: 3797583 - RNA, 17 nt, Salmonella typhimurium LT2
ucugucaacgugccugc

SEQ ID NO: 3797584 - RNA, 12 nt, Salmonella typhimurium LT2
ucugugaggaaa

SEQ ID NO: 3797585 - RNA, 11 nt, Salmonella typhimurium LT2
ucuguuauuuc

SEQ ID NO: 3797586 - RNA, 16 nt, Salmonella typhimurium LT2
ucuguuccgaaauaaa

SEQ ID NO: 3797587 - RNA, 12 nt, Salmonella typhimurium LT2
ucuguuguucuu

SEQ ID NO: 3797588 - RNA, 19 nt, Salmonella typhimurium LT2
ucuguuucaacacauccag

SEQ ID NO: 3797589 - RNA, 14 nt, Salmonella typhimurium LT2
ucuuaaaucaugaa

SEQ ID NO: 3797590 - RNA, 14 nt, Salmonella typhimurium LT2
ucuuaauggccagu

SEQ ID NO: 3797591 - RNA, 19 nt, Salmonella typhimurium LT2
ucuuaauuccucagaaucc

SEQ ID NO: 3797592 - RNA, 14 nt, Salmonella typhimurium LT2
ucuuacauaagaga

SEQ ID NO: 3797593 - RNA, 21 nt, Salmonella typhimurium LT2
ucuuacccgcuuuuaaacggc

SEQ ID NO: 3797594 - RNA, 18 nt, Salmonella typhimurium LT2
ucuuaccgcuaaaauacc

SEQ ID NO: 3797595 - RNA, 16 nt, Salmonella typhimurium LT2
ucuuacugaccggccc

SEQ ID NO: 3797596 - RNA, 14 nt, Salmonella typhimurium LT2
ucuuagaauagcau

SEQ ID NO: 3797597 - RNA, 14 nt, Salmonella typhimurium LT2
ucuuagugaaauac

SEQ ID NO: 3797598 - RNA, 22 nt, Salmonella typhimurium LT2
ucuuaucaaauuugcccagcac

SEQ ID NO: 3797599 - RNA, 18 nt, Salmonella typhimurium LT2
ucuuauccggccugcaug

SEQ ID NO: 3797600 - RNA, 21 nt, Salmonella typhimurium LT2
ucuuaucuggccuacaaagaa

SEQ ID NO: 3797601 - RNA, 11 nt, Salmonella typhimurium LT2
ucuuauuuucc

SEQ ID NO: 3797602 - RNA, 17 nt, Salmonella typhimurium LT2
ucuucaacggcgccgug

SEQ ID NO: 3797603 - RNA, 14 nt, Salmonella typhimurium LT2
ucuucacccuucuu

SEQ ID NO: 3797604 - RNA, 19 nt, Salmonella typhimurium LT2
ucuucaccuuuccagucaa

SEQ ID NO: 3797605 - RNA, 22 nt, Salmonella typhimurium LT2
ucuucaccuuuccagucaacga

SEQ ID NO: 3797606 - RNA, 16 nt, Salmonella typhimurium LT2
ucuucacuaaaaacag

SEQ ID NO: 3797607 - RNA, 16 nt, Salmonella typhimurium LT2
ucuucacuaaacuaau

SEQ ID NO: 3797608 - RNA, 22 nt, Salmonella typhimurium LT2
ucuucagcccguucucgccgcg

SEQ ID NO: 3797609 - RNA, 14 nt, Salmonella typhimurium LT2
ucuucaguaaccag

SEQ ID NO: 3797610 - RNA, 18 nt, Salmonella typhimurium LT2
ucuucaguaaccagggcg

SEQ ID NO: 3797611 - RNA, 16 nt, Salmonella typhimurium LT2
ucuucaguaauuucga

SEQ ID NO: 3797612 - RNA, 22 nt, Salmonella typhimurium LT2
ucuucaguaauuucgaugauga

SEQ ID NO: 3797613 - RNA, 23 nt, Salmonella typhimurium LT2
ucuucauauuguagguuuuccuc

SEQ ID NO: 3797614 - RNA, 12 nt, Salmonella typhimurium LT2
ucuucauauuug

SEQ ID NO: 3797615 - RNA, 11 nt, Salmonella typhimurium LT2
ucuucaucaaa

SEQ ID NO: 3797616 - RNA, 20 nt, Salmonella typhimurium LT2
ucuuccaaccgugucugcug

SEQ ID NO: 3797617 - RNA, 23 nt, Salmonella typhimurium LT2
ucuuccaccacggcaaaaauaug

SEQ ID NO: 3797618 - RNA, 13 nt, Salmonella typhimurium LT2
ucuuccaccauuc

SEQ ID NO: 3797619 - RNA, 15 nt, Salmonella typhimurium LT2
ucuuccaccauucgc

SEQ ID NO: 3797620 - RNA, 22 nt, Salmonella typhimurium LT2
ucuuccacuucaaucaacacca

SEQ ID NO: 3797621 - RNA, 18 nt, Salmonella typhimurium LT2
ucuuccacuucaucagcg

SEQ ID NO: 3797622 - RNA, 23 nt, Salmonella typhimurium LT2
ucuuccagcacgauauccagcac

SEQ ID NO: 3797623 - RNA, 18 nt, Salmonella typhimurium LT2
ucuuccauugcuuuuuug

SEQ ID NO: 3797624 - RNA, 16 nt, Salmonella typhimurium LT2
ucuuccgacagggccc

SEQ ID NO: 3797625 - RNA, 21 nt, Salmonella typhimurium LT2
ucuuccgacagggcccuucgu

SEQ ID NO: 3797626 - RNA, 18 nt, Salmonella typhimurium LT2
ucuuccgccugauaaaac

SEQ ID NO: 3797627 - RNA, 23 nt, Salmonella typhimurium LT2
ucuuccggcaucacaucgccguu

SEQ ID NO: 3797628 - RNA, 16 nt, Salmonella typhimurium LT2
ucuuccggcugccagc

SEQ ID NO: 3797629 - RNA, 16 nt, Salmonella typhimurium LT2
ucuuccgguuucaacu

SEQ ID NO: 3797630 - RNA, 17 nt, Salmonella typhimurium LT2
ucuucgaccgucgcgcc

SEQ ID NO: 3797631 - RNA, 21 nt, Salmonella typhimurium LT2
ucuucgauaaacucaaucagg

SEQ ID NO: 3797632 - RNA, 14 nt, Salmonella typhimurium LT2
ucuucgauaaaggg

SEQ ID NO: 3797633 - RNA, 14 nt, Salmonella typhimurium LT2
ucuucgaucgccug

SEQ ID NO: 3797634 - RNA, 17 nt, Salmonella typhimurium LT2
ucuucgaucgccuggcg

SEQ ID NO: 3797635 - RNA, 16 nt, Salmonella typhimurium LT2
ucuucgaugagaugcg

SEQ ID NO: 3797636 - RNA, 21 nt, Salmonella typhimurium LT2
ucuucgauuguugacugccag

SEQ ID NO: 3797637 - RNA, 15 nt, Salmonella typhimurium LT2
ucuucgcaaucuccg

SEQ ID NO: 3797638 - RNA, 18 nt, Salmonella typhimurium LT2
ucuucgccgucauaaaac

SEQ ID NO: 3797639 - RNA, 22 nt, Salmonella typhimurium LT2
ucuucgcgguaacgcaacucau

SEQ ID NO: 3797640 - RNA, 17 nt, Salmonella typhimurium LT2
ucuucgcgguagauucu

SEQ ID NO: 3797641 - RNA, 22 nt, Salmonella typhimurium LT2
ucuucgcuggcggaaagaagca

SEQ ID NO: 3797642 - RNA, 23 nt, Salmonella typhimurium LT2
ucuucggcaaaauacucagcgaa

SEQ ID NO: 3797643 - RNA, 14 nt, Salmonella typhimurium LT2
ucuucgucgucauc

SEQ ID NO: 3797644 - RNA, 13 nt, Salmonella typhimurium LT2
ucuucgucgucuu

SEQ ID NO: 3797645 - RNA, 16 nt, Salmonella typhimurium LT2
ucuucuaccaccuuau

SEQ ID NO: 3797646 - RNA, 18 nt, Salmonella typhimurium LT2
ucuucucaacgccggaug

SEQ ID NO: 3797647 - RNA, 23 nt, Salmonella typhimurium LT2
ucuucucaggcgagcccugugcg

SEQ ID NO: 3797648 - RNA, 15 nt, Salmonella typhimurium LT2
ucuucucuucuucaa

SEQ ID NO: 3797649 - RNA, 13 nt, Salmonella typhimurium LT2
ucuucuuccggcu

SEQ ID NO: 3797650 - RNA, 21 nt, Salmonella typhimurium LT2
ucuucuugcugacgaucgauc

SEQ ID NO: 3797651 - RNA, 21 nt, Salmonella typhimurium LT2
ucuucuuuaaggcccuggcuc

SEQ ID NO: 3797652 - RNA, 19 nt, Salmonella typhimurium LT2
ucuucuuuagauaauuucg

SEQ ID NO: 3797653 - RNA, 15 nt, Salmonella typhimurium LT2
ucuucuuucagguuc

SEQ ID NO: 3797654 - RNA, 15 nt, Salmonella typhimurium LT2
ucuucuuucgguucg

SEQ ID NO: 3797655 - RNA, 18 nt, Salmonella typhimurium LT2
ucuugccacuggccuccc

SEQ ID NO: 3797656 - RNA, 14 nt, Salmonella typhimurium LT2
ucuugcccgcugag

SEQ ID NO: 3797657 - RNA, 13 nt, Salmonella typhimurium LT2
ucuugcccggugg

SEQ ID NO: 3797658 - RNA, 14 nt, Salmonella typhimurium LT2
ucuugcgccagcgc

SEQ ID NO: 3797659 - RNA, 11 nt, Salmonella typhimurium LT2
ucuugcuauca

SEQ ID NO: 3797660 - RNA, 15 nt, Salmonella typhimurium LT2
ucuugcucaauaaua

SEQ ID NO: 3797661 - RNA, 15 nt, Salmonella typhimurium LT2
ucuugcucucaggca

SEQ ID NO: 3797662 - RNA, 15 nt, Salmonella typhimurium LT2
ucuugcuuuauuuuu

SEQ ID NO: 3797663 - RNA, 18 nt, Salmonella typhimurium LT2
ucuugguaccaaacagca

SEQ ID NO: 3797664 - RNA, 17 nt, Salmonella typhimurium LT2
ucuuguagugugaucca

SEQ ID NO: 3797665 - RNA, 22 nt, Salmonella typhimurium LT2
ucuuguagugugauccaucccu

SEQ ID NO: 3797666 - RNA, 21 nt, Salmonella typhimurium LT2
ucuugucaggcaaaaauaacu

SEQ ID NO: 3797667 - RNA, 21 nt, Salmonella typhimurium LT2
ucuugucaggcagaaauaacu

SEQ ID NO: 3797668 - RNA, 16 nt, Salmonella typhimurium LT2
ucuuuaaauuucaggg

SEQ ID NO: 3797669 - RNA, 14 nt, Salmonella typhimurium LT2
ucuuuaacaccuuu

SEQ ID NO: 3797670 - RNA, 16 nt, Salmonella typhimurium LT2
ucuuuaauuaaauuuu

SEQ ID NO: 3797671 - RNA, 18 nt, Salmonella typhimurium LT2
ugaagaugguaauauuaa

SEQ ID NO: 3797672 - RNA, 19 nt, Salmonella typhimurium LT2
ugaagaugguaauauuaaa

SEQ ID NO: 3797673 - RNA, 19 nt, Salmonella typhimurium LT2
ugaagauuauucucgcacu

SEQ ID NO: 3797674 - RNA, 17 nt, Salmonella typhimurium LT2
ugaagauuuuuauuccc

SEQ ID NO: 3797675 - RNA, 20 nt, Salmonella typhimurium LT2
ugaagauuuuuauucccgcc

SEQ ID NO: 3797676 - RNA, 19 nt, Salmonella typhimurium LT2
ugaagcauaaaaagacuau

SEQ ID NO: 3797677 - RNA, 20 nt, Salmonella typhimurium LT2
ugaagcauccgggauauaaa

SEQ ID NO: 3797678 - RNA, 20 nt, Salmonella typhimurium LT2
ugaagcccuuuaguaaaguu

SEQ ID NO: 3797679 - RNA, 22 nt, Salmonella typhimurium LT2
ugaagcgauuuauccaccgcca

SEQ ID NO: 3797680 - RNA, 12 nt, Salmonella typhimurium LT2
ugaagcggcgca

SEQ ID NO: 3797681 - RNA, 13 nt, Salmonella typhimurium LT2
ugaagcuguuuug

SEQ ID NO: 3797682 - RNA, 22 nt, Salmonella typhimurium LT2
ugaaggcucaaauuuggcucaa

SEQ ID NO: 3797683 - RNA, 21 nt, Salmonella typhimurium LT2
ugaagggcggcuggauaaaag

SEQ ID NO: 3797684 - RNA, 18 nt, Salmonella typhimurium LT2
ugaagggggccagagcag

SEQ ID NO: 3797685 - RNA, 15 nt, Salmonella typhimurium LT2
ugaagguuuuucccg

SEQ ID NO: 3797686 - RNA, 15 nt, Salmonella typhimurium LT2
ugaaguaauguucag

SEQ ID NO: 3797687 - RNA, 18 nt, Salmonella typhimurium LT2
ugaaguaucgacgcagac

SEQ ID NO: 3797688 - RNA, 15 nt, Salmonella typhimurium LT2
ugaauaaaaccggca

SEQ ID NO: 3797689 - RNA, 16 nt, Salmonella typhimurium LT2
ugaauaaccauacuga

SEQ ID NO: 3797690 - RNA, 12 nt, Salmonella typhimurium LT2
ugaauaccagcg

SEQ ID NO: 3797691 - RNA, 19 nt, Salmonella typhimurium LT2
ugaauaccagcggcaaaca

SEQ ID NO: 3797692 - RNA, 18 nt, Salmonella typhimurium LT2
ugaauaccuucacaaaaa

SEQ ID NO: 3797693 - RNA, 12 nt, Salmonella typhimurium LT2
ugaauagccagc

SEQ ID NO: 3797694 - RNA, 15 nt, Salmonella typhimurium LT2
ugaauagccagcccc

SEQ ID NO: 3797695 - RNA, 18 nt, Salmonella typhimurium LT2
ugaauaguugauaauauu

SEQ ID NO: 3797696 - RNA, 14 nt, Salmonella typhimurium LT2
ugaauauaauucau

SEQ ID NO: 3797697 - RNA, 21 nt, Salmonella typhimurium LT2
ugaauauauuggcaggauccc

SEQ ID NO: 3797698 - RNA, 17 nt, Salmonella typhimurium LT2
ugaauauucggcuccag

SEQ ID NO: 3797699 - RNA, 14 nt, Salmonella typhimurium LT2
ugaauauugucggc

SEQ ID NO: 3797700 - RNA, 19 nt, Salmonella typhimurium LT2
ugaauauuuuagccgcccc

SEQ ID NO: 3797701 - RNA, 21 nt, Salmonella typhimurium LT2
ugaaucagauacggcuccagc

SEQ ID NO: 3797702 - RNA, 20 nt, Salmonella typhimurium LT2
ugaaucagaugcgcuucagc

SEQ ID NO: 3797703 - RNA, 17 nt, Salmonella typhimurium LT2
ugaauccagcguacuga

SEQ ID NO: 3797704 - RNA, 16 nt, Salmonella typhimurium LT2
ugaauccaggccagau

SEQ ID NO: 3797705 - RNA, 20 nt, Salmonella typhimurium LT2
ugaauccccagaauuucuuu

SEQ ID NO: 3797706 - RNA, 21 nt, Salmonella typhimurium LT2
ugaaucccccugccacaaccg

SEQ ID NO: 3797707 - RNA, 21 nt, Salmonella typhimurium LT2
ugaaucccgccaucguccagc

SEQ ID NO: 3797708 - RNA, 15 nt, Salmonella typhimurium LT2
ugaaucgccgucagu

SEQ ID NO: 3797709 - RNA, 16 nt, Salmonella typhimurium LT2
ugaaucgccucaacgc

SEQ ID NO: 3797710 - RNA, 17 nt, Salmonella typhimurium LT2
ugaaucucuucccagcg

SEQ ID NO: 3797711 - RNA, 18 nt, Salmonella typhimurium LT2
ugaaucucuucccagcga

SEQ ID NO: 3797712 - RNA, 19 nt, Salmonella typhimurium LT2
ugaaucucuucccagcgaa

SEQ ID NO: 3797713 - RNA, 22 nt, Salmonella typhimurium LT2
ugaaugacuguccacgacagaa

SEQ ID NO: 3797714 - RNA, 15 nt, Salmonella typhimurium LT2
ugaaugaguaaccag

SEQ ID NO: 3797715 - RNA, 17 nt, Salmonella typhimurium LT2
ugaaugaguaaccagac

SEQ ID NO: 3797716 - RNA, 20 nt, Salmonella typhimurium LT2
ugaaugaguaaccagaccgu

SEQ ID NO: 3797717 - RNA, 18 nt, Salmonella typhimurium LT2
ugaaugagucggaccauc

SEQ ID NO: 3797718 - RNA, 20 nt, Salmonella typhimurium LT2
ugaaugcucucauauuccag

SEQ ID NO: 3797719 - RNA, 20 nt, Salmonella typhimurium LT2
ugaauggcggagaucuccag

SEQ ID NO: 3797720 - RNA, 11 nt, Salmonella typhimurium LT2
ugaauguuuug

SEQ ID NO: 3797721 - RNA, 18 nt, Salmonella typhimurium LT2
ugaauuaauggucagauc

SEQ ID NO: 3797722 - RNA, 19 nt, Salmonella typhimurium LT2
ugaauuaauggucagaucu

SEQ ID NO: 3797723 - RNA, 14 nt, Salmonella typhimurium LT2
ugaauucguuaccu

SEQ ID NO: 3797724 - RNA, 15 nt, Salmonella typhimurium LT2
ugacaaaaaucugaa

SEQ ID NO: 3797725 - RNA, 16 nt, Salmonella typhimurium LT2
ugacaaaaauuaaaac

SEQ ID NO: 3797726 - RNA, 22 nt, Salmonella typhimurium LT2
ugacaaauaaaauaagcaauua

SEQ ID NO: 3797727 - RNA, 22 nt, Salmonella typhimurium LT2
ugacaaaucggcuccggcaaaa

SEQ ID NO: 3797728 - RNA, 20 nt, Salmonella typhimurium LT2
ugacaaauuguuuaaaaaca

SEQ ID NO: 3797729 - RNA, 14 nt, Salmonella typhimurium LT2
ugacaacaaaucca

SEQ ID NO: 3797730 - RNA, 11 nt, Salmonella typhimurium LT2
ugacaaggcga

SEQ ID NO: 3797731 - RNA, 17 nt, Salmonella typhimurium LT2
ugacaaggcgaucucaa

SEQ ID NO: 3797732 - RNA, 11 nt, Salmonella typhimurium LT2
ugacaauaagu

SEQ ID NO: 3797733 - RNA, 17 nt, Salmonella typhimurium LT2
ugacaaucagcacacua

SEQ ID NO: 3797734 - RNA, 16 nt, Salmonella typhimurium LT2
ugacacaauauaacaa

SEQ ID NO: 3797735 - RNA, 15 nt, Salmonella typhimurium LT2
ugacacagaggaaua

SEQ ID NO: 3797736 - RNA, 18 nt, Salmonella typhimurium LT2
ugacacagaggaauauua

SEQ ID NO: 3797737 - RNA, 21 nt, Salmonella typhimurium LT2
ugacacuauauugcgaauaaa

SEQ ID NO: 3797738 - RNA, 17 nt, Salmonella typhimurium LT2
ugacacuaucuccuucc

SEQ ID NO: 3797739 - RNA, 23 nt, Salmonella typhimurium LT2
ugacacuaucuccuuccggcuuu

SEQ ID NO: 3797740 - RNA, 14 nt, Salmonella typhimurium LT2
ugacacucauccag

SEQ ID NO: 3797741 - RNA, 16 nt, Salmonella typhimurium LT2
ugacacuuuauucucu

SEQ ID NO: 3797742 - RNA, 14 nt, Salmonella typhimurium LT2
ugacagacaggccu

SEQ ID NO: 3797743 - RNA, 22 nt, Salmonella typhimurium LT2
ugacagacaggccuucuucaua

SEQ ID NO: 3797744 - RNA, 21 nt, Salmonella typhimurium LT2
ugacagagcucgucaaaaauc

SEQ ID NO: 3797745 - RNA, 13 nt, Salmonella typhimurium LT2
ugacagcaacauc

SEQ ID NO: 3797746 - RNA, 19 nt, Salmonella typhimurium LT2
ugacagcacaauuccggcc

SEQ ID NO: 3797747 - RNA, 18 nt, Salmonella typhimurium LT2
ugacagcacauagccuaa

SEQ ID NO: 3797748 - RNA, 19 nt, Salmonella typhimurium LT2
ugacagccaaacugcugua

SEQ ID NO: 3797749 - RNA, 16 nt, Salmonella typhimurium LT2
ugacauaaucaugaac

SEQ ID NO: 3797750 - RNA, 11 nt, Salmonella typhimurium LT2
ugacaucaucc

SEQ ID NO: 3797751 - RNA, 17 nt, Salmonella typhimurium LT2
ugacaucgccggagccg
